United States Patent 10,006,042 (ISOLATED POLYNUCLEOTIDES AND POLYPEPTIDES, AND METHODS OF USING SAME FOR INCREASING PLANT YIELD AND/OR AGRICULTURAL CHARACTERISTICS) - sequence listing, part 2

SEQ ID NO: 1512 - DNA, 1538 bp, Eutrema parvulum
ttctagtcaaataaccgtaaccacaactttgatcaacgaagattcttcttcaaacctcgtccacccaaacacacaaatgtcttccaatccttctcttatctattctctccttctgattcctttttatactcccttgaaattttctcccaatttcatttcatttcatttcctcggcaatggcgactactttgaatgctgctttttctctcacgtcgtcaaaatcttcttctcttccagctacaagctgtgccattgctcctgaaaggatcaggtttggtaagggtgctttttactacaaaagcaacaatgtagtgacaggcaaaagagtggtttctgtaagagctgaaatcacaacagatgctcctgtgaagaaagtagagaaagtgtctaagaagaacgaggaaggtgtgatcactaacacgtacagaccaaaggaaccttacaccggaaaagttcttctcaacacaaaaatcacagcagatgatgctcctggagagacctggcacatggttttcagccatgaaggaaaaatcccgtacagagagggccaatctgttggtgtgattgcagatggagttgacaagaatggaaagcctaacaaggtcaggctttactcgattgcaagcagcgctcttggagatcttggcaattccgaaaccgtttctttgtgcgtgaaaaggcttgtctatactaatgacgcaggagaggttgttaaaggagtttgctcaaatttcttgtgtgacttgacaccaggaagtgatgtcaagctcactggtccagtaggaaaagagatgcttatgccaaaggaccccaacgccactgttattatgcttgccacagggacaggaatcgctcctttccggtctttcttgtggaaaatgttcttcgaaaaacacgacgactacaagtttaatggcttagcttggctgttcttgggtgtaccaaccactagctcattgctctacacagaggagtttgataagatgaaagcaaaggcccccgagaatttcagggttgattacgcgataagcagagaacaagcaaacgacaaaggagagaaaatgtacatccagaccagaatggcgcaatatgcacctgaattatgggagttgttgaagaaagacaacacatttgtctacatgtgtgggcttaagggcatggagaaaggaatcgatgacattatggtctcattagctgctaaagacggtattgactggtttgactataagaagcagttgaagaaggcagagcaatggaacgttgaagtctactgatttaacattctgtggcaagtatagtggaacaaaagtgtaattttcgcatccaaatttctgtaatctgaagataagttatgttttagatatatattatactaaaaagagggttcttttaatcttttatcattcattcattgccatgaatttgctctaatataaatggtacattgataaagagttgtcctcaattggcagcaatctgtatattgtggtagataaccaatcctctgacaatgagatgagactaatatccaatcttat

SEQ ID NO: 1513 - DNA, 1201 bp, Brassica napus
ctccaatggcgtctactctgaatgctgctgtctccctcacctcttcaaaatcttcttcccttccagctacaagctgtgccattgctcctgacaggatcaggtttgccaagggtgcttttaactacaaaagcaacaatgtggtgacaagcagaagaatggtttcagtaagagccgaagtcacaacaacagatactcctccagtgaagaaagtagagaaagagtcaaagaagaacgaggaaggtgtgattacaaacaagtacagaccaaaggagccttacactggcaaagtccttctcaacaccaaaatcacagcagatgatgctcctggagagacctggcacatggtgttcagccatcaaggagaaatcccctacagagaagggacaatctgttggtgtgattgcagatggtattgacaagaacgggaagcctaacaaggtcaggctttactccattgcaagcagcgctcttggagatctcggcaactctgaaaacgtttctttgtgtgtgaaaagacttgtttacactaatgatgcaggagaggttgttaaaggagtttgctcaaatttcttgtgtgacttgaaaccagggagtgatgtcaagctcactggtcctgtaggaaaagaaatgcttatgcctaaggatccaaacgctactgtttttatgcttgccacagggacaggaatagctcctttcaggtctttcttgtggaagatgttcttcgagaaacatgatgactacaagtttaatggcttagcgtggctgttcttgggtgtaccaaccactagttcattgctctacacagaggagtttgataagatgaaagcaaaggcacctgagaatttcagggttgattacgctataagcagagaagaaactaacgataaaggagagaaaatgtatatccagaccagaatggcgcagtacgcaccagagttatggggacgttgttgaagaaagacaacaccgttttgtcctacatgtgttgggctcaagggcatggacaaggattgatgacattatggtctcattagcagctaatgacggcattgactggtttgattataagaagcagttgaagaaggcagagcaatggacgttgaagtctactgatttaactattcagtggcaagtatagtggagaaacaaagtgtaattttcgtcatccaagtttctgtaatttgtacgataaagctatgtt

SEQ ID NO: 1514 - DNA, 1443 bp, Eutrema halophilum
ttctagtcaaataacgatgaccacaactttgatcaacgaagatactctcttcttcaaacctcatccacccaaacacaaaatgtcttccaatccttctcttatctctctccttctgattccttttaatactcccttgaaattttctcccaatttcatttcatttcatttcctcggcaatggcgactactttgaatgctgctgtttctctcacatcttcaaaatcttcttctcttccagctacaagttgcgccattgctcctgaatggatcaggtttggtaagggtgcttttcaatacaaaagcaacaatgcagtgacaggtaaaagattggtttccgtcagagctgaagccacaacagatactcctgtgaagaaagtagagaaagtgtctaagaagaacgaggaaggtgtggttactaacaagtacagaccaaaggagccttacaccggaaaagtccttctcaacaccaaaatcacagcagatgatgctcctggagagacctggcacatgcttttcagccatgaaggagaaatcccgtacagagaggggcaatctgttggtgtgattgctgatggaattgacaagaatggaaagcctcacaaagtcaggctttactcgattgcaagcagcgctcttggagatctcggcaattctgaaaccgtttctttgtgcgtgaaaaggctcgtctatactaatgacgcaggagagactgttaaaggagtttgctcaaatttcttgtgtgacttgaaaccaggaagtgaagttaaactcactggtcctgtaggaaaagaaatgcttatgccaaaggatccaaacgccactgttattatgcttgccacagggacaggaatcgctcctttccggtctttcttgtggaagatgttcttcgagaaacacgatgactacaagtttaatggcttagcttggctgttcttgggagtgccaaccactagctcattgctttaccaagaggagtttgctaagatgaaggcaaaggcccccgagaatttcagggttgattatgcgataagcagagaacaagcgaacgagaaaggagagaagatgtatatccagaccagaatggcgcaatacgcagctgagttatgggagttattgaagaaagacaacacttttgtctacatgtgtggtcttaagggcatggagaaaggaatcgatgacattatggtctcactggctgctaaagacggtattgactggtttgattataagaagcagttgaagaaggcagagcaatggaacgttgaagtctactgattaagagctgttaacatttaatggcaagtatagtggaacaaaagtgtaattttcccattcaaatttctgtaatttggagtaagtttatttagatatattatactaaaaaggggtttttctttcttatcatctagttgccattattttctctaagataggtgaatcattg

SEQ ID NO: 1515 - DNA, 1418 bp, Eutrema halophilum
ttctagtcaaataacgatgaccacaactttgatcaacgaagatactctcttcttcaaacctcatccacccaaacacaaaatgtcttccaatccttctcttatctctctccttctgattccttttaatactcccttgaaattttctcccaatttcatttcatttcatttcctcggcaatggcgactactttgaatgctgctgtttctctcacatcttcaaaatcttcttctcttccagctacaagttgcgccattgctcctgaatggatcaggtttggtaagggtgcttttcaatacaaaagcaacaatgcagtgacaggtaaaagattggtttccgtcagagctgaagccacaacagatactcctgtgaagaaagtagagaaagtgtctaagaagaacgaggaaggtgtggttactaacaagtacagaccaaaggagccttacaccggaaaagtccttctcaacaccaaaatcacagcagatgatgctcctggagagacctggcacatgcttttcagccatgaaggagaaatcccgtacagagaggggcaatctgttggtgtgattgctgatggaattgacaagaatggaaagcctcacaaagtcaggctttactcgattgcaagcagcgctcttggagatctcggcaattctgaaaccgtttctttgtgcgtgaaaaggctcgtctatactaatgacgcaggagagactgttaaaggagtttgctcaaatttcttgtgtgacttgaaaccaggaagtgaagttaaactcactggtcctgtaggaaaagaaatgcttatgccaaaggatccaaacgccactgttattatgcttgccacagggacaggaatcgctcctttccggtctttcttgtggaagatgttcttcgagaaacacgatgactacaagtttaatggcttagcttggctgttcttgggagtgccaaccactagctcattgctttaccaagaggagtttgctaagatgaaggcaaaggcccccgagaatttcagggttgattatgcgataagcagagaacaagcgaacgagaaaggagagaagatgtatatccagaccagaatggcgcaatacgcagctgagttatgggagttattgaagaaagacaacacttttgtctacatgtgtggtcttaagggcatggagaaaggaatcgatgacattatggtctcactggctgctaaagacggtattgactggtttgattataagaagcagttgaagaaggcagagcaatggaacgttgaagtctactgattaagagctgttaacatttaatggcaagtatagtggaacaaaagtgtaattttcccattcaaatttctgtaatttggagtaagtttatttagatatattatactaaaaaggggtttttctttcttatcatctagttgccattat

SEQ ID NO: 1516 - DNA, 1055 bp, Brassica juncea
ttcccttccagctacaagctatgccattgctcctgacaggatcaggtttgccaagggtgcttttaactacaaaagcaacaatgtggtgacaagcagaagaatggtttcagtaagagccgaagtcacaacaacagatactcctccagtgaagaaagtagagaaagagtcaaagaagaacgaggaaggtgtgattacaaacaagtacagaccaaaggagccttacaccggcaaagtccttctcaacaccaaaatcacagcagatgatgctcctggagagacctggcacatggttttcagccatcaaggagaaatcccatacagagaaggacaatctgttggtgtgattgcagatggtattgacaagaacgggaagcctaacaaggtcaggctttactccattgcaagcagcgctcttggagatctcggcaactctgaaactgtttctttgtgtgtgaagaggcttgtttatactaatgatgcaggggaggttgttaaaggagtctgctcaaacttcttgtgtgacttgaagccagggagtgatgtcaagctcactggtcctgtaggaaaagaaatgctcatgcctaaggatccaaacgccactgttattatgcttgccacagggacaggaatagctcctttcaggtctttcttgtggaagatgttctttgagaaacatgatgactacaagtttaatggcttagcttggctgttcttgggtgtaccaactactagttcattgctctacacagaggagtttgataagatgaaagcaaaggcaccagagaacttcagggttgattacgcgataagcagagaacaagcaaacgataaaggagagaaaatgtatatccagacaagaatggcgcagtacgcacctgagctatgggagttgctgaagaaagacaacacgtttgtgtacatgtgtgggcttaagggcatggagaaaggaattgacgacatcatggtctcattagctgctaatgacggtattgactggtttgattataagaagcagttgaagaaggcagagcaatggaacgttgaagtctactgat

SEQ ID NO: 1517 - DNA, 1384 bp, Arabidopsis thaliana
acaactttgatgaacgagatactctcttcttaaaacctcatccacccaaacacaaatgtcttgtaatccttctcttatctttctccttgtgattcctttttatattcctctgatattttctctcagtttgatctcatttgctctgcaatggcgactaccatgaatgctgctgtttctctcacatcttcaaactcttcttcttttcccgctacaagttgtgccattgctcctgaaaggatcaggtttactaagggtgctttttactacaaaagcaacaatgtagtgacaggtaaaagagtgttttccataaaagcacaaatcacaacagaaacagatactcctactcctgcaaagaaagtagagaaagtgtcaaagaagaacgaggaaggtgtgattgttaacaggtacagaccaaaagagccttacactggaaaatgccttctcaacaccaaaatcacagctgatgatgctcctggagagacctggcacatggttttcagccatcaaggagaaatcccgtacagagaaggacaatctgttggtgtgattgcagatggaattgacaagaatggaaagcctcacaaggtcagactttactccattgcaagcagcgctcttggagatctcggcaattctgaaaccgtttctttgtgtgttaaaagacttgtttatactaatgaccaaggagagactgttaaaggagtttgctcaaatttcttgtgtgatttggcacccggaagtgatgttaagctgactggtcctgtaggcaaagaaatgcttatgccaaaggatccaaacgccaccgttattatgcttgccacagggacaggaattgctcctttcaggtctttcttatggaagatgttctttgagaaacatgatgactacaagttcaatggcttagcttggttgttcttgggtgtaccaaccactagctctttgctctaccaagaggagtttgataagatgaaagcaaaggcccccgagaacttcagggtggattacgcgataagcagagaacaagcgaacgataaaggagagaaaatgtatatccagactcggatggcgcaatacgcagctgagttatgggagttgttgaagaaagacaacacttttgtttacatgtgtggactcaagggaatggagaaaggaattgatgacattatggtctcattggctgcaaatgacggtattgactggtttgattacaagaagcagttgaagaaggcagagcaatggaacgttgaagtctactgatcaaaaagcctttgacatttctgtagcaaagtatagctgaacaaaactgtaattttcgcttctgaatttctgtattttgaagataagttttttagatatgttatactaaaaaaagagttctttaatc

SEQ ID NO: 1518 - DNA, 1301 bp, Arabidopsis thaliana
atattcctctgatattttctctcagtttgatctcatttgctctgcaatggcgactaccatgaatgctgctgtttctctcacatcttcaaactcttcttcttttcccgctacaagttgtgccattgctcctgaaaggatcaggtttactaagggtgctttttactacaaaagcaacaatgtagtgacaggtaaaagagtgttttccataaaagcacaaatcacaacagaaacagatactcctactcctgcaaagaaagtagagaaagtgtcaaagaagaacgaggaaggtgtgattgttaacaggtacagaccaaaagagccttacactggaaaatgccttctcaacaccaaaatcacagctgatgatgctcctggagagacctggcacatggttttcagccatcaaggagaaatcccgtacagagaaggacaatctgttggtgtgattgcagatggaattgacaagaatggaaagcctcacaaggtcagactttactccattgcaagcagcgctcttggagatctcggcaattctgaaaccgtttctttgtgtgttaaaagacttgtttatactaatgaccaaggagagactgttaaaggagtttgctcaaatttcttgtgtgatttggcacccggaagtgatgttaagctgactggtcctgtaggcaaagaaatgcttatgccaaaggatccaaacgccaccgttattatgcttgccacagggacaggaattgctcctttcaggtctttcttatggaagatgttctttgagaaacatgatgactacaagttcaatggcttagcttggttgttcttgggtgtaccaaccactagctctttgctctaccaagaggagtttgataagatgaaagcaaaggcccccgagaacttcagggtggattacgcgataagcagagaacaagcgaacgataaaggagagaaaatgtatatccagactcggatggcgcaatacgcagctgagttatgggagttgttgaagaaagacaacacttttgtttacatgtgtggactcaagggaatggagaaaggaattgatgacattatggtctcattggctgcaaatgacggtattgactggtttgattacaagaagcagttgaagaaggcagagcaatggaacgttgaagtctactgatcaaaaagcctttgacatttctgtagcaaagtatagctgaacaaaactgtaattttcgcttctgaatttctgtattttgaagataagttttttagatatgttatactaaaaaaagagttctttaatcattatcatttacttcttc

SEQ ID NO: 1519 - DNA, 1372 bp, Arabidopsis lyrata
acgagatactctcttctacaaacctcatccacccaaacacaaatgtcttctaatccttctcttatctttctccttctgattcctttttatattcctctgattttttctctcaatttgatttcatttgctctgcaatgactactaccatgaatgctgctgtttccctcacatcttcaaactcttcttcgtttccagctacaagttgtgccattgctcctgaaaggatcaggtttagtaagggtgctttttactacaaaagcaacaatgtagtgacaagcaaaagagtgttttccataagagcacaaatcacaacagaaacagatactcctactcctgccaagaaagttgagaaagtgtcaaagaagaatgaggaaggtgtgattgttaataggtacagaccaaaggagccttacattggaaaatgccttctcaacaccaaaatcacagctgatgatgctcctggagagacctggcacatggttttgagccatgaaggagaaatcccgtacagagaaggacaatctgttggtgtgattgcagatggaattgacaagaatggaaagcctcacaaggtcagactttactcgatagcgagcagcgctcttggagatctcggcaattctgaaaccgtttctttgtgtgtgaaaagacttgtctatactaatgaccaaggagagactgttaaaggagtttgctcaaatttcttgtgtgatttggcacccggaagtgatgttaagctgactggtcctgtaggcaaagaaatgcttatgccaaaggatccaaacgccactgttattatgcttgccacagggacaggaattgctcctttccggtctttcttatggaagatgttctttgagaaacatgatgactacaagttcaatggcttagcctggttgttcttgggtgtaccaaccactagctcattgctctaccaagaggagtttgataagatgaaagcaaaggcccccgagaacttcagggtggattacgctataagcagagaacaagcgaacgataaaggagagaaaatgtatatccagactcggatggcgcagtacgcagctgaattatgggagttgttgaagaaagacaacacttttgtctacatgtgtgggctcaagggaatggagaaaggaattgatgacattatggtctcattggctgcaaatgacggtattgactggtttgactataagaagcagttgaagaaggcagagcaatggaacgttgaagtctactgatcagaagccctatgacattctgtagcaagtatagctgaaaaaaactgtaattctctgcttccgaatttctgtaatgtgaagataagtttttttagatatattatactaaaaaaagagttctttaatca

SEQ ID NO: 1520 - DNA, 1393 bp, Arabidopsis lyrata
acgagatactctcttctacaaacctcatccacccaaacacaaatgtcttctaatccttctcttatctttctccttctgattcctttttatattcctctgattttttctctcaatttgatttcatttgctctgcaatgactactaccatgaatgctgctgtttccctcacatcttcaaactcttcttcgtttccagctacaagttgtgccattgctcctgaaaggatcaggtttagtaagggtgctttttactacaaaagcaacaatgtagtgacaagcaaaagagtgttttccataagagcacaaatcacaacagaaacagatactcctactcctgccaagaaagttgagaaagtgtcaaagaagaatgaggaaggtgtgattgttaataggtacagaccaaaggagccttacattggaaaatgccttctcaacaccaaaatcacagctgatgatgctcctggagagacctggcacatggttttgagccatgaaggagaaatcccgtacagagaaggacaatctgttggtgtgattgcagatggaattgacaagaatggaaagcctcacaaggtcagactttactcgatagcgagcagcgctcttggagatctcggcaattctgaaaccgtttctttgtgtgtgaaaagacttgtctatactaatgaccaaggagagactgttaaaggagtttgctcaaatttcttgtgtgatttggcacccggaagtgatgttaagctgactggtcctgtaggcaaagaaatgcttatgccaaaggatccaaacgccactgttattatgcttgccacagggacaggaattgctcctttccggtctttcttatggaagatgttctttgagaaacatgatgactacaagttcaatggcttagcctggttgttcttgggtgtaccaaccactagctcattgctctaccaagaggagtttgataagatgaaagcaaaggcccccgagaacttcagggtggattacgctataagcagagaacaagcgaacgataaaggagagaaaatgtatatccagactcggatggcgcagtacgcagctgaattatgggagttgttgaagaaagacaacacttttgtctacatgtgtgggctcaagggaatggagaaaggaattgatgacattatggtctcattggctgcaaatgacggtattgactggtttgactataagaagcagttgaagaaggcagagcaatggaacgttgaagtctactgatcagaagccctatgacattctgtagcaagtatagctgaaaaaaactgtaattctctgcttccgaatttctgtaatgtgaagataagtttttttagatatattatactaaaaaaagagttctttaatcaattatcattcatttcttgcca

SEQ ID NO: 1521 - DNA, 1017 bp, Brassica napus
aaatcttcttctcttccagctacaagctgtgccattgctcctgaaaggatcaggtttggtaagggtggtttttcctacaaaagcaacaatgtagcgacaagcagaagagtggtttcggtaagagctgaagtcacaacagatactcctcctgctgtgaagaaagtagagaaagagtcaaagaagaacgaggaaggtgtgatcaccaacaagtacagaccaaaagagccttacacaggcaaagtccttctcaacaccaagatcacagctgatgatgcccctggagagacctggcacatggttttcagccatcaaggtgaaataccgtacagagagggacaatctgttggtgtgattgcagatgggattgacaagaatgggaagcctcacaaggtcaggctttactccattgcaagcagtgctcttggagacctcggcaactctgaaaccgtttctttgtgtgtgaaaagacttgtgtatactaatgacgcaggagaggttgttaaaggagtttgctcaaatttcttgtgtgacttgaaaccagggagtgatgttaagctcactggtcctgtagggaaagagatgcttatgcctaaggatccgaacgctactgtcattatgcttgccacagggacaggaatagctcctttcaggtctttcttgtggaagatgttctttgagaaacatgatgactacaagtttaatggcttagcgtggctgttcttgggcgtaccaaccactagttcattgctctacacagaggagtttgataagatgaaagcaaaggcacctgagaatttcagggttgattacgctataagcagagaagaaactaacgataaaggagagaaaatgtatatccagaccagaatggcgcagtacgcaccagagttatgggagttgttgaagaaagacaacacgtttgtctacatgtgtgggctcaagggcatggagaaaggaattgatgacattatggtctcattagctgctaatgacggcattgactggtttgattataag

SEQ ID NO: 1522 - DNA, 982 bp, Brassica juncea
ctgctgtctctctcacttcttcaaaatcttcttctcttccagctactagctgtgccattgctcctgataggatcaggtttggtaagggtgctttttactacaaaaacaacaatgttgtgacaagcagaagagtggtttccgtaagagctgaggtgacaacagatactcctccagtgaagaaagtagagaaagagtcaaagaagaacgaggaaggtgtgatcaccaacaagtacagaccaaaagagccttacactggcaaagtccttctcaacaccaagatcacagctgatgatgcccctggagagacctggcacatggttttcagccatcaaggtgaaataccgtacagagagggacaatctgttggtgtgattgcagatgggattgacaagaatggaaagcctcacaaggtcaggctttactccattgcaagcagcgctcttggagatcttggcaactccgaaaccgtttctttgtgcgtgaaaaggcttgtttatactaatgacgcaggagaggttgttaaaggagtttgctcaaacttcttgtgtgacttgaaaccagggagtaatgttaagctcactggtcctgtagggaaagaaatgcttatgcctaaggatccaaacgccactgttattatgcttgccacagggacaggaatagctcctttcaggtctttcttgtggaagatgttctttgagaaacatgatgactacaagttcaatggcttagcttggctgttcttgggtgtaccaaccactagttcattgctctacacagaggagtttgataagatgaaagcaaaggcacctgagaatttcagggttgattacgctataagcagagaagaaacgaacgataaaggagagaaaatgtatattcaaaccagaatggcgcagtacgcacctgagttatgggagttgttgaagaaagacaacacatttgtctacatgtgtgggctcaagggcatggagaaaggaattga

SEQ ID NO: 1523 - DNA, 975 bp, Brassica napus
gctgctgtctccctcacctcttcaaaatcttcttcccttccagctacaagctgtgccattgctcctgacaggatcaggtttgccaagggtgcttttaactacaaaagcaacaatgtggtgacaagcagaagaatggtttcagtaagagccgaagtcacaacaacagatactcctccagtgaagaaagtagagaaagagtcaaagaagaacgaggaaggtgtgattacaaacaagtacagaccaaaggagccttacactggcaaagtccttctcaacaccaaaatcacagcagatgatgctcctggagagacctggcacatggtgttcagccatcaaggagaaatcccctacagagaaggacaatctgttggtgtgattgcagatggtattgacaagacggagcctaacaggtcaggctttactccattgcaagcagcgctcttggagatctcggcaactctgaaacttgtttctttgtgtgtgaagaggcttgtttatactaatgatgcagggagtaggttgttaaaggagtctgctacaaactttcttgtgtgacttgaagccaggaagtgatgtcaagctcactggtcctgtaggaaaagaaatgcttatgcctaaagatccaaacgccactgttattatgcttgccacagggacaggaatagctcctttcaggtctttcttgtggaagatgttctttgaaaaacatgatgactacaagtttaatggattagcgtggctgttcttgggtgtaccaaccactagttcattgctctacacagaggagtttgataagatgaaagcaaaggcaccagagaacttcagggttgattacgcgataagcagagaacaagcaaacgacaaaggagagaaaatgtatatccagacaagaatggcgcagtacgcacctgagctatgggagttgctcaagaaagacaacacatatgtgtacatgtgtgggcttaagggcatgga

SEQ ID NO: 1524 - DNA, 1446 bp, Cleome spinosa
tccttcactcttcttcttatctctctcttccatccctcttataacctccgcagattcttcccctgcccctttgcattttcttctgatgtcatcaatggcggctactctctactcttctgtttctctcacatcttccaactcctcttctcttcccgccacaagcttctcgatcgcccctgagataatcagatttggcaagggtgcttgctacaacagaagcaatgcctctacaggcaaaagattagtttccattagggctcaagtggcagcagaagctcctgcgaaagcagagaaggtttccaagaagaacgaggaaggtgttgtggttaacaagtacaggccaaaggaaccttacactggcaaatgccttctcaacaccaaaatcactgcagatgatgcacctggagagacatggcacatggttttcaccacagaaggagaaataccatacagagaagggcaatccattggtgtcatcccggatggtatcgacaagaatggaaagcctcacaaggtcagactgtactccatagccagcagtgctataggagatctcggcgattccaaaagcgtctctttgtgtgtgaaaaggcttgtttacaccaacgagcaaggcgagatcgttaaaggagtttgctcgaacttcttgtgtgacttgaagcctggagctgacgttaagatcaccggacctcttgggaaagaaatgcttatgcctaaggatccaaatgccaccgttattatgctcgcgaccgggacggggattgctcctttccgttctttcttgtggaagatgttctttgagaaacacagtgattacgagttcaatggcttggcttggctgttcttgggtgtgcccaccactagctccttactctaccaagaggagtttgacaagatgaaggcaaaggcccccgagaattttagggtcgactacgcaataagcagagaacaaacaaacgagaaaggcgagaaaatgtacatccagacccggatggcggaatatgcagacgagctatgggaactgctgaagaaggacaacacttatatctacatgtgtggactcaagggcatggagaaaggcattgatgacattatggttagcttagctgccagagacgggattgattggattgagtacaagaagcaaatgaagaaagcagagcaatggaacgttgaagtctactgatgcgcgcacacacaccattggcaaaagttatatagtatggtaacggtaacttgtatatggtgaaaaaacgtacgtttaattttcgtattacaaccctttttgtaatttattttgattttatttttttctagatattaattttcgtgtttattgcaagtgtctaaggacttagaacacggaaaacattagaaattcatagttcttgatgatatcaaacttatattaacatatattattattgaagggtatgtactaaaaat

SEQ ID NO: 1525 - DNA, 1479 bp, Cleome gynandra
tgtctttcactcttcttcttatccctctcttcgattcctcttataacctccgcagattcttcccctttcgctggccattttcttctcatgtcatcaatggcggctactctcaacgcttctgtttctctcacatcttccaactcctctcttcccgccacaagattttccattgctcctgagagaatcagaattggaaagggtgctctgtactacagaagcaatgtatctgcaagtaaaggagtggttcccattagggctcaagtcgcatcagaagctcctgcaaaagcagaaaaagtgtccaagaaggatgaagaaggtattgtggttaacaagtacagaccaaaggaacctttcacggggaaatgccttcttaacaccaaaatcactggagacgatgcaccgggagagacctggcacatggtcttcaccacagaaggagaaataccatacagagaagggcaatccattggtgtaattgcagatggtgttgacaagaatggaaagcctcacaaagtcagattgtactcaatagcgagcagtgctataggagatctcggcgattccaaaaccgtctcactgtgtgttaaaaggcttgtttacaccaatgagcaaggcgagatcgttaaaggggtttgctcaaacttcttgtgtgacttaaagcctggagctgatgttaagatcactggaccgctaggaaaagaaatgctcatgcccaaggatccaaatgcaactgttattatgctcgcgacagggacaggcattgctcctttccgttcgttcctgtggaagatgttcttcgagaaacacgaaaactacaagttcaatggattggcttggctgttcttgggtgtaccaacaacaagctctttactttacaaagaggagtttgacaagatgaagacgagggcccccgagaatttgagggtggactatgcaataagcagagaacaaacgaacgagaaaggcgagaaaatgtacattcaaactcggatggcagaatacgcagacgagctatgggagttgctgaagaaggacaacacttatgtctacatgtgtggactcaagggcatggagaagggcattgatgatattatggtcaatttggctgcaagagacggcattgattggcttgagtacaagaaacaaatgaagaaagcagagcaatggaacgtcgaagtctactgatgaacaccattcccgaagttcaaatggtgatggttacttgtatatctagttatgtcaatttggtttttaatgggttaatccaggccatttaaaatatatgggtccttgcggaaataaaattaaatggattaattgagtgtaaaattcaattagattaatattagggctcgactggtggaaacgtagcgtttgcgcttgcgtttgacattgtttctgtcggcgattgacggtttttatttcattttgtctgaatggtggaacggttgcgtttgcaggcgactgcgaatagaagcg

SEQ ID NO: 1526 - DNA, 1379 bp, Catharanthus roseus
ttcttctttggcagaaatggctactgctgtcagtgctgcagtttctcttccttcttccaagtcttctgcttctctttcctcttcaagaacatcacttatctcatcagaaagagtcaattttaacaaggttcctttgtactacaagaatgtttctgttggtggaaaattggtttcagttagagcccaggtgacaactgaggctcctgctgttaaagttgagaaacattccaagaaacaagaagaaggtgttgtagttaacaaatataggccaaaggaaccatacattggtagatgtttacttaacactaagatcactggtgatgatgcacctggtgaaacttggcacatggtcttcagcactgagggagaaatcccatacagagaaggtcagtcaattggggttattgctgatggagttgacaagaacgggaagcctcacaaactgaggttatactccattgctagcagtgccctcggtgactttggagattccaaaactgtttctctatgtgttaaaagacttgtatataccaatgataagggagaacttgtaaaaggagtttgctctaacttcttgtgtgatttgaaacctggagctgaggtgaaaattactggacctgttggaaaagaaatgcttatgcctaaggatcccaatgccactgtagtcatgcttgccaccggaactggaattgctcctttccgtgcatttttgtggaaaatgttctttgagaagcatgatgactacaagttcaacggtttggcatggcttttcttgggtgttccaacaagcagttcccttctttacaaggaggaattcgagaaaatgaaggagaaaaatccagacaatttcagagtggattttgcagtcagcagagagcaaacgaacgagaaaggagagaagatgtacatccagaccaggatggcacaatatgcagaagaactatgggaactactcaagaaagacaacacttttgtgtacatgtgtggactcaaaggcatggagaagggaattgatgatattatggtttctttggctgaaagagatggtattgactggtttgattacaaaaaacaattgaagaaggcagagcaatggaatgtggaagtctactaattctgcttccttgtacaaatatatataagtcttataattactacttaattttctctgcatttgatgtagataggtattattattattactattccttctgctaatttttttccttttctttttggagtgttataattttttacctttctcacttttcatttcattttctgtttcttcaacaaactgcttgtactctttctctgcctctccaatttttttgaggaatggataatgaccatgtaataaagaaccttaacctttctat

SEQ ID NO: 1527 - DNA, 1318 bp, Juglans hindsii x Juglans regia
  misc_feature (255)..(255): n is a, c, g, or t
  misc_feature (1153)..(1153): n is a, c, g, or t
  misc_feature (1165)..(1165): n is a, c, g, or t
  misc_feature (1174)..(1174): n is a, c, g, or t
atggctactgcagtaacttctacggtctcatttccatcctccaagtctgcatctcttccctcaagaaccagtattatctcaccagaaagaatctccttcaagaaggttcctctgcactatagggatgtttctgttggaggaagagtggtttctgtcagagcccaggtcaccatagaggctcctgctaaaaaggttgagaaggagtccaagaaaatggaggaaggtgtggttgtgaacaagtataagcctaagganccttacgttgggagatgcctccttaacactaagattactgcggatgatgctcctggagaaacttggcacatggtcttcagcactgatggggaggttccctacagagaagggcaatcaattggggtaattgcagatggtattgacaagaatggaaagcctcacaagttgagactatactccattgccagcagtgcccttggcgactttggagactccaaaactgtttctctgtgtgtcaaacggcttgtatacacaaatgataaaggagaagttgttaaaggagtctgctcaaatttcttgtgtgacttaaaacctggatatgaagtaaagattacaggaccagttgggaaagaaatgcttatgccaaaagaccccactgcaaccatcattatgcttgcaactggaactggaattgctcctttccgctcatttttgtggaaaatgttctttgagaagcatgatgactacaagttcaacggtttggcatggctcttcttgggtgtccccacaagcagctcactgctttacaaggaggaatttgagaaaatgaaggagaaggccccagaaaactttaggctagactttgctgtgagcagagagcaaacaaatgagaaaggagagaagatgtacattcaaacacgaatggctcagtatgcagaagagctatgggaattactgaagaaggataacacctatgtctatatgtgtggactcaaggggatggaaaagggaattgacgagattatgctgtcattggccgctagagatggcattgattggttggactacaaaaagaagttgaagaaggcagaacaatggaatgttgaagtctactaatccctgactacaaagtgtctcccattgcaatgctttcctccacattctgtagataggtaangcctttttgtanttttttttncttcctttgttaatgaatttgtattggtatagcctctacaagttttatttatgaggtatcatatgtcataatcatacaatagagttgaaacgaacttcaactatatttttcaacttcattagtaattaattcctccatgttttg

SEQ ID NO: 1528 - DNA, 1536 bp, Malus domestica
ctctcatccgccactgcattggccgtcaaatctctaccaccaatctttaatccaaaacccaccaaaaaaatcccccatttcttcaacaaattttctcatcaagcatcgaacttttgcttctcttttatttcatctccctcttctgcttcctcagcattttaactccacaaccatggctgcagctgtaactgctgctgtctccttcccctcctccaagtcctccgccctccccaccaggacctccataatctcacctgacagaatcaccctaaaaaaggttcctttgtacaacagcaatgctggtgggagagtggtatccatcagagcccaggtgaccaccaccgagcctgctccacctgccaaggttgtgaaggaatccaagaagcaagaagaaggggttgttgtcaacaaattcaagcccaagaatccctacactggcagagtccttctcaacactaagatcactgctgatgatgcacctggtgagacctggcacatggtctttagcactgaaggagaggtgccctacagagaagggcagtccattggagttattccagacggtattgacaaaaatgggaagcctcacaagctgaggttgtactcaatcgccagcagtgcccttggtgactttggagactccaaaactgtttctctgtgtgtgaaacgtcttgtgtacaccaatgacgcaggcgaaattgttaaaggagtgtgttcaaactttttgtgtgacttgaagcccgcaagtgaagtgacgatcaccggaccagttggaaaagaaatgcttatgccaaaagaccctaatgcaaccgtcatcatgcttgcaactggaactggaattgctccttttagagcattcttatggaaaatgttcttcgagaagcatgaagactacaagttcaatggtttggcatggctcttcttgggtgttcctacaagtagctcactgctctacaaggaggaattcgagaagatgaaggagaaggcccccgaaaacttcaggcttgacttcgccgtcagcagagagcaaaccaacgagaagggtgagaagatgtacatccaaaccagaatggctcagtatgcagaagagctatgggagttgctcaagaaggacaacacctacgtctacatgtgtggtctcaagggaatggagaagggtatcgatgacatcatggtctcgttggctgccaaagacggcattgactggatggactacaagaagcagttgaagaaagcagagcaatggaatgtggaagtctactaatttctggtcatcttgtacaaatctctctctctctctctctctctctctctctctcttgcgataaaacaaggaaatcttgaaagattaccactgcagtatgtagataggtgaaagtctttgcatctctactttttttttcccttctattttaataaagcttttgtattatactattaaaaaatggccacaataattttatttataagggtgcaaatttagtggaaacattgtagactcgatgttcctcttctctcgtttcaagagagtgaaca

SEQ ID NO: 1529 - DNA, 1428 bp, Castanea mollissima
cgaaaaagatcataccctctcgttttcatgcttcttcaccaactcctcgcaaccccataaaaccatcacactttctttctcttgctctgctttatcaactagcattgcagtcatggctactgcagtaactgccacggtctcttttccatcatccaagtcatcttctctgtcctccagaacctctataatcttaccagagagaatccctttcaagaaggttcctttgcagtacagagatgtttctgttggtggaagagtggtttcgatcagagcccaggtcaccacagaggctcctgcaaaggttgcgaaggaatccaagaaaatggaggaaggagtggtagtgaacaagtacaaaccgaaaaatccatacactggaagatgcctacttaacactaagattactggtgatgatgctcctggagaaacttggcacatggtcttcagcactgagggggagatcccatacagagaagggcaatcagttggggtaattccagatggtattgacaaaaatggcaagcctcacaagctgaggttatactcaattgccagcagtgccattggtgactttggggattccaaaactgtttctctgtgtgtgaaacggttagtgtacaccaatgatgcgggagaaattgttaaaggagtatgctcaaatttcttgtgtgacttgaaacctggagctgaagtgaagatgacaggacctgttggaaaagaaatgctaatgccaaaagatcccaacgctaccatcatcatgcttgcaactggaactgggattgctcctttccgctcatttttgtggaaaatgttctttgagaagcatgatgactacaagttcaatggtttggcgtggctcttcttgggtgtccccacgagtagctcactgctttataaggaggaatttgagaaaatgaaggagaaggcccccgaaaattttagacttgactttgctgtgagtagagagcaaaaaaatgagaaaggtgagaagatgtacatccaaacccgaatggctcagtatgcagaagagctatggcaattgcttaagaaggataacacctttgtctatatgtgtgggctgaaggggatggaaaagggaattgatgacataatgatttcattggctgctagagatggcattgattggttggactacaaaaagcagttgaagagggcagagcaatggaatgtggaagtatactaatgcctaaagtactcgtacaaatttctcccacttcacttttaagcggcaactgataatgatttccactgcattctgtagataggtaatgcctttgtaatttttcattttatatttttgtccttttttgtttaatgcagcagttgtatggtatagcctccacaggagttttatttatgaggggtcatggatatatagtcataaatatagttgaagccaacttcaacttc

SEQ ID NO: 1530 - DNA, 1913 bp, Quercus alba
gggactgcaaacgaaagagatcataccctctcgttttcatacttcttcaccaactcctcgcaaccccataaaaccatcacactttcttgctcttgctctgctttatcaactagcattgcagtcatggctactgcagtaactgccacggtctcttttccatcatccaagtcatcttctctgtcctccagaacctctataatctcaccagaaagaatttccttcaagaaggttcctttgcagtacagagatgtttctgttggtggaagagtggtttcgatcagagcccaggtcaccacagaggctcctgcaaaggttgcgaaggaatccaagaaaatggaggaaggcgtggttgtgaacaagtacaaaccgaaaaatccatacactggaagatgcctacttaacactaagattactggtgatgatgctcctggagaaacttggcacatggtcttcagcactgagggggagatcccatacagagaagggcaatcagttggggtaattccagatggtattgacaaaaatggcaagcctcacaagctgaggttatactcaattgccagcagtgccattggtgactttggagactccaaaacagtttctctgtgtgtgaaacggctagtgtacaccaatgatgcgggagaaattgttaaaggagtatgctcaaatttcttgtgtgacttgaaagctggagctgaagtgaaaatgacaggacctgttggaaaagaaatgcttatgccaaaagatcccaatgctaccatcatcatgcttgcaaccggaactggaattgctcctttccgctcatttttgtggaaaatgttctttgagaagcatgatgactacaagttcaatggtttggcgtggctcttcttgggtgtccccacaagtagctcactgctttataaggaggaatttgagaaaatgaaggagaaggcccccgaaaattttagacttgactttgctgtgagtagagagcaaaaaaatgagaaaggtgagaagatgtacatccaaacccgaatggctcagtatgcagaagagctatggcaattgcttaagaaggataacacctttgtctacatgtgtgggctgaaggggatggaaaagggaattgatgacataatggtttcattggctgctagagatggcattgattgggcggactacaaaaagcagttgaagagagcagagcaatggaatgtggaagtatactaatgcctgattacttgtacaaatttctcccacttcacttttaagcggcaactgataatgatttccactgcattttctgtagataggtaatgcctttgtaattttccattttatattttgtcttttttttttaatgcagcagttgtattggtatagcctccacaggagttttatttatgaggggtcatggattatatagtcataaatatagttgaagctaacttcaacttctttttacggagaataatgctagagatacaaattattttataaaaaaatttacaaactgctgatgtggtgaatgattattagtaaataaaaaaaaatgatattaatagtaagactagatgaaaaccaataagaggttgactacattaacattttgtaaaatgttgtaaaaataatttgtgtctgtagaattactcttttatgaatattcagctccatttttcatcattaatcatgacaaaacagtcatacatccagtttaagaaaaattagaagacaaaatgtaatacttatttcatgtggccattataattctgtttgtagatactacagtcaaattgttctgattcaactccatatttcaattttctaaatcacattgtggacatcactaaggttactgtgttatgatccttcacattcttcattttgatacttccgaccacatgagagtgtaaacattgtctacaagctaa

SEQ ID NO: 1531 - DNA, 1551 bp, Quercus alba
atgggataaacttatcctcacatctgccactgcattggccttaaaattctcctccactcaaaatctcataatccactgcaaacgaaagagatcataccctctcgttttcatacttcttcaccaactcctcgcaaccccataaaaccatcacactttcttgctcttgctctgctttatcaactagcattgcagtcatggctactgcagtaactgccacggtctcttttccatcatccaagtcatcttctctgtcctccagaacctctataatctcaccagaaagaatttccttcaagaaggttcctttgcagtacagagatgtttctgttggtggaagagtggtttcgatcagagcccaggtcaccacagaggctcctgcaaaggttgcgaaggaatccaagaaaatggaggaaggcgtggttgtgaacaagtacaaaccgaaaaatccatacactggaagatgcctacttaacactaagattactggtgatgatgctcctggagaaacttggcacatggtcttcagcactgagggggagatcccatacagagaagggcaatcagttggggtaattccagatggtattgacaaaaatggcaagcctcacaagctgaggttatactcaattgccagcagtgccattggtgactttggagactccaaaacagtttctctgtgtgtgaaacggctagtgtacaccaatgatgcgggagaaattgttaaaggagtatgctcaaatttcttgtgtgacttgaaagctggagctgaagtgaaaatgacaggacctgttggaaaagaaatgcttatgccaaaagatcccaatgctaccatcatcatgcttgcaaccggaactggaattgctcctttccgctcatttttgtggaaaatgttctttgagaagcatgatgactacaagttcaatggtttggcgtggctcttcttgggtgtccccacaagtagctcactgctttataaggaggaatttgagaaaatgaaggagaaggcccccgaaaattttagacttgactttgctgtgagtagagagcaaaaaaatgagaaaggtgagaagatgtacatccaaacccgaatggctcagtatgcagaagagctatggcaattgcttaagaaggataacacctttgtctacatgtgtgggctgaaggggatggaaaagggaattgatgacataatggtttcattggctgctagagatggcattgattgggcggactacaaaaagcagttgaagagagcagagcaatggaatgtggaagtatactaatgcctgattacttgtacaaatttctcccacttcacttttaagcggcaactgataatgatttccactgcattttctgtagataggtaatgcctttgtaattttccattttatatttttgtctttttttttttaatgcagcagttgtattggtatagcctccacaggagttttatttatgaggggtcatggattatatagtcataaatatagttgaagctaacttcaacttctttttacggagaataatgctagagatacaaattatttt

SEQ ID NO: 1532 - DNA, 2724 bp, Quercus alba
gttttcatacttcttcaccaactcctcgcaaccccataaaaccatcacactttcttgctcttgctctgctttatcaactagcattgcagtcatggctactgcagtaactgccacggtctcttttccatcatccaagtcatcttctctgtcctccagaacctctataatctcaccagaaagaatttccttcaagaaggttcctttgcagtacagagatgtttctgttggtggaagagtggtttcgatcagagcccaggtcaccacagaggctcctgcaaaggttgcgaaggaatccaagaaaatggaggaaggcgtggttgtgaacaagtacaaaccgaaaaatccatacactggaagatgcctacttaacactaagattactggtgatgatgctcctggagaaacttggcacatggtcttcagcactgagggggagatcccatacagagaagggcaatcagttggggtaattccagatggtattgacaaaaatggcaagcctcacaagctgaggttatactcaattgccagcagtgccattggtgactttggagactccaaaacagtttctctgtgtgtgaaacggctagtgtacaccaatgatgcgggagaaattgttaaaggagtatgctcaaatttcttgtgtgacttgaaagctggagctgaagtgaaaatgacaggacctgttggaaaagaaatgcttatgccaaaagatcccaatgctaccatcatcatgcttgcaaccggaactggaattgctcctttccgctcatttttgtggaaaatgttctttgagaagcatgatgactacaagttcaatggtttggcgtggctcttcttgggtgtccccacaagtagctcactgctttataaggaggaatttgagaaaatgaaggagaaggcccccgaaaattttagacttgactttgctgtgagtagagagcaaaaaaatgagaaaggtgagaagatgtacatccaaacccgaatggctcagtatgcagaagagctatggcaattgcttaagaaggataacacctttgtctacatgtgtgggctgaaggggatggaaaagggaattgatgacataatggtttcattggctgctagagatggcattgattgggcggactacaaaaagcagttgaagagagcagagcaatggaatgtggaagtatactaatgcctgattacttgtacaaatttctcccacttcacttttaagcggcaactgataatgatttccactgcattttctgtagataggtaatgcctttgtaattttccattttatatttgttcttttttttttttttaatgcagcagttgtattggtatagcctccacaggagttttatttatgaggggtcatggattatatagtcataaatatagttgaagctaacttcaactttctttttacggagaataatgctagagatacaaattattttataaaaaaatttacaaactgctgatgtggtgaatgattattagtaaaataaaaaaaaatgatattaatggtaagactagatgaaaaccaataagagattgattacattaacattttgttaaaatgttgtaaaatagtttgtgtctgtagaattactcttttatgaatattcagctccatttttcatcattaatcatgacaaaacagtcatacatccagcttaaaaaaaaattgaagacaaaatgtaatacttatttcaggtggccattataattctgtttgtagatcctacagtcaaattgttctgattcaactccatatttcaattttctaaatcacattgtggacatcactaaggttactgtgttatgatccttcacattcttcattttgatacttccaaccacatgagagtgtaaacattgtctacaagctaaaattggtacaaattttagctattttctgattcttaccaagtcacaattacttttggtttatttgtttggtattaaactaaaataactttttgttactccctactgccttttgtatgctaatttactgaaaatgagatgttgtgagacttgacccttgatatgtcacagctcacaggtcttatattcctgctcttgtaacatcacaattcttgacgctctatttgtttcaacaatgatattttttagaaaattagttattttccaaaaaaataatttctataaaactatctcattttcctatgtttggtatcaaccttaaatgagttgaaaaataatctcttaacttctcttatttagcttactatgagatagaactgtttaccaaaaaaaaagaattagtggaaaataatctctaaaaataagtcataatttttatgttgactaaaaatagttttccgttgactaaaaatagttttcttttgactaattttttctaatgctactaaatactggaaaataggaaaaactatctttacataatgtcttcaaatcaaaacaaacaaagcgtgagtctctgttcatctgacataaaattgcttctgcattgaaccaatcatgtaaattataaaccccaatggaagagtatctacatacaagtagttagcacatataaatatagggaaaattataattttgatccctgaaatttgaagtaagttcaatttttgaccattgcaattttaaaaagttggatttagtccaataaaattttaaaaaatgaaactaattttgttactttgtctacagttcgattcagttttgttatctaaaattggg

SEQ ID NO: 1533 - DNA, 1224 bp, Vitis vinifera
acaaccccacagaaattctgctctctttcgttttcttcgccaaaaaatcatggctaccgctgtcaatgctgcagtctctcttccatcatcgaagtcatcttctctccccatcagaaaccatataatagtctccccagaaagaattaacttcaataagtgtttcttgtactcgagaaacgtctgtgttggccggaaagtagttaccattaaagctcaggtcactacagaggctcctgcaaaagtagagaaggtttctaagaaaaacgatgagggtgtggttgttaacaagttcagacccaagaatccttacatcggaaaatgtctcctcaacaccaagattactggagacgatgctccaggagagacctggcacatggtattcaccactgagggggaagtcccatatagagaggggcaatctattggtgtgattccggatggtatagacaagaatgggaaaccccacaagcttagactctactctattgccagtagtgctcttggagactttggggacacaaaaactgtttcattgtgtgtaaaaaggcttgtctacaccaatgaccaaggagagatagttaaaggagtttgctcaaatttcttgtgtgacttgaagcctggggctgatgtcaaaatcacaggacctgttgggaaagaaatgcttatgccaaaagatccaaatgccactgtcataatgcttgcaactggtactggcattgctccttttcgctcattcttgtggaaaatgttcttcgagaaatatgaagactacaagtttaaagggttgggttggctcttcttgggtgtcccaacaactagctccctgctgtacaaggacgagtttgagaagatgaaggagaaggccccagaaaactttagggttgactatgctgtcagcagagagcaaacaaatgagaagggcgagaaaatgtacattcaaacccggatggctcaatatgcagaggagctatgggagttacttaaaaaggataatacctatgtgtatatgtgtgggctgaagggaatggagaagggaattgatgacataatggtgtctttggctgctagagatggtattgattggaccgaatacaaaaggcaattgaagaagagcgagcagtggaatgttgaagtctattgatatcagttgcatagggggtttacaaacatctatttactgaagaatatccattgttgtatgattgatttcttcctgtagtgggg

SEQ ID NO: 1534 - DNA, 1596 bp, Vitis vinifera
aagctctccaaccttaaccaccaatgtgatagtccaacaatcttctccacccattctataatccactcaaaaatgtttttgtcatttttcactttttgtttctttcttcttaattttcttcttcttcttccgatcctcacaaccccacagaaattctgctctctttcgttttcttcgccaaaaaatcatggctaccgctgtcaatgctgcagtctctcttccatcatcgaagtcatcttctctccccatcagaaaccatataatagtctccccagaaagaattaacttcaataagtgtttcttgtactcgagaaacgtctgtgttggccggaaagtagttaccattaaagctcaggtcactacagaggctcctgcaaaagtagagaaggtttctaagaaaaacgatgagggtgtggttgttaacaagttcagacccaagaatccttacatcggaaaatgtctcctcaacaccaagattactggagacgatgctccaggagagacctggcacatggtattcaccactgagggggaagtcccatatagagaggggcaatctattggtgtgattccggatggtatagacaagaatgggaaaccccacaagcttagactctactctattgccagtagtgctcttggagactttggggacacaaaaactgtttcattgtgtgtaaaaaggcttgtctacaccaatgaccaaggagagatagttaaaggagtttgctcaaatttcttgtgtgacttgaagcctggggctgatgtcaaaatcacaggacctgttgggaaagaaatgcttatgccaaaagatccaaatgccactgtcataatgcttgcaactggtactggcattgctccttttcgctcattcttgtggaaaatgttcttcgagaaatatgaagactacaagtttaaagggttgggttggctcttcttgggtgtcccaacaactagctccctgctgtacaaggacgagtttgagaagatgaaggagaaggccccagaaaactttagggttgactatgctgtcagcagagagcaaacaaatgagaagggcgagaaaatgtacattcaaacccggatggctcaatatgcagaggagctatgggagttacttaaaaaggataatacctatgtgtatatgtgtgggctgaagggaatggagaagggaattgatgacataatggtgtctttggctgctagagatggtattgattggaccgaatacaaaaggcaattgaagaagagcgagcagtggaatgttgaagtctattgatatcagttgcatagggggtttacaaacatctatttactgaagaatatccattgttgtatgattgatttcttcctgtagtggggataggtgaacttctcttgatttgctttttttttttttctccatttggcgattgtattattttgttttacatgagaaggacgtggatgataaaataagttgcaaaatgaattcaagctcatgaaaatatgatcagattctggcattctgcatagagatgtttccaatgttatggcaacttctggttcctgaacaaggaagatcatataacccactgagccgaagaatgactggtc

SEQ ID NO: 1535 - DNA, 1416 bp, Primula obconica
agcgaaaagtattccaccctctcacatcatactactctcagctctctctctctctctctctctctctctggtattctagctatggctactgcagtaagtgctgcagtgtctctcccactcctcgaattctacatctctctcttcaagaaactcaatcatctctcccgatagaatcagctttaagatacctttcccaagtggaaatgtatctacggggtgtagggttctctctatcagagcccagatcacgagtgatgctcctgctaagaaagtcgaaaaacattcaaagaaaatggaagagggtgtaatagtgaacaagtacaggccaaaagacccctatattggaaaatgccttcttaactctaaaatcactgctgacgatgcgcctggtgaaacttggcacatggttttctccactgagggagaggtaccctatcgagaagggcaatctatcggtgtgattgcagatggtattgacaagaatggaaagccccacaaactcagattatactcgatcgctagcagtgctcttggtgatttgggagactcaaaaactgtgtccctgtgtgtaaagaggcttgtgtacacaaatgatcaaggagaaattgtcaaaggagtttgctcaaactttttgtgtgatctgaagcctggagctgatgtgaaaatcactgggcccgtaggaaaagaaatgctcatgccaaaagatccaaatgcaaccattataatgcttgcaactggaactggaattgctccattccgttcatttttgtggaagatgttctttgagaagcatgaagattatgagttcaaaggtttggcgtggctcttcttgggtgtccccaccagcagctccctattatacaaggatgaattcacaaaaatgaaggagaaggccccagaaaacttcaaggttgactatgctgttagcagagaagaatcaaatgaaaagggtgagaagatgtacatccaaaccagaatggctcaatatgcagaagagctatgggagctgctcaaaaaggataacacatatgtctatatgtgtgggctcaaaggcatggaaaagggtattgatgacattatgatttctttggcggccaaagacggcatcgattggatcgaatacaggaagcagttgaagaaggcagagcaatggaatgtggaagtctattaatatatttgccttttgaatgtacatctttagtaaagaggccatatctttgtgttattggagttatttcatggtcaatgaacaatgctcaatgaatgattacttcatgtttaggcttgtttccagggtaaaaactcttttaggacatttgttaacttatttttactgatacaaaacggttattatgttgatttttttttttttttttttttttgaacggttttacaccttgttgattgattctcgtg

SEQ ID NO: 1536 - DNA, 1424 bp, Vigna unguiculata
atccacccaatcttaaaatctcattctttctcctttcgttcttcactgcacacacatcatttcatcacttcattaaacataaacattactctctctttctctgtctcaagtttttacaacatggctactgcggtaactgctgcagtttcctttcctgcttctaagtccacctctcttccaaccagaacctccatcactgccccagatagaatcttcttcaagaaggtttcgttacaatacagagatgtttcagtgagtggaagggtggtttcggtgagagcccaagtgacaacagaggcacctgctaaggttgaaaaggaatcgaagaaacaagatgaaggtgtggtcgtgaacaagttcagacccaaggacccatatgttggtaggtgtcttctcaacacaaagatcaccggggatgatgcacctggagaaacttggcacatggtcttcagcactgagggagaagttccttacagagaaggacaatcaattggggtaattgctgatggggttgacaagaatggcaagcctcacaaactgagattgtattctattgccagcagtgcccttggtgattttggagattccaaaactgtttctttatgcgtgaaacgtcttgtgtacacagatgaaaagggagaaattgtcaagggagtttgctcaaatttcttgtgcgacttaaaaccaggagcagaggtaaagattactggacctgttggtaaagaaatgcttatgccaaaagatcccaatgccacagtcatcatgttggccactggaactggaattgccccatttcgctcatttttatggaaaatgttcttcgagaagcatgatgactacaagttcaatggtttggcatggctcttcttgggtgttcccacaagcagttcactactctataaggaggaatttgaaaagatgaaggagaaagcacccgagaacttcagactagactttgctgtgagcagagagcaaacaaacgagaagggagaaaagatgtacatccaaacaagaatggctgaatatgcagaagagttatgggaattactgaagaaagataacacttttgtgtacatgtgtggattgaaaggaatggaacagggaatcgatgagataatggtgtcattggcagcaaaagatggtatcgattggtttgattacaagaagcaattgaagaaggcagaacaatggaatgtggaagtatactgaacaatctgtgttcagtggcacttgcatggatatgatgtccctctttcagcagcagcagatttattttgctgttctctgttctgtagataatttgagaatcatggagttattaccatgtttatgaacaagcttcattgcatgaaataattttgaggatcatgcaatatagatgaaatcgacttcgttttacgaatctccttaaaaaaaaaaaaaaa

SEQ ID NO: 1537 - DNA, 1662 bp, Quercus alba
actgcaaacgaaagagatcataccctctcgttttcatacttcttcaccaactcctcgcaaccccataaaaccatcacactttcttgctcttgctctgctttatcaactagcattgcagtcatggctactgcagtaactgccacgggctcttttccatcatccaagtcatcttctctgtcctccagaacctctataatctcaccagaaagaatttccttcaagaaggttcctttgcagtacagagatgtttctgttggtggaagagtggtttcgatcagagcccaggtcaccacagaggctcctgcaaaggttgccaaggaatccaagaaaatggaggaaggcgtggttgtgaacaagtacaaaccgaaaaatccatacactggaagatgcctacttaacactaagattactggtgatgatgctcctggagaaacttggcacatggtcttcagcactgagggggagatcccatacagagaagggcaatcagttggggtaattccagatggtattgacaaaaatggcaagcctcacaagctgaggttatactcaattgccagcagtgccattggtgactttggagactccaaaacagtttctctgtgtgtgaaacggctagtgtacaccaatgatgcgggagaaattgttaaaggagtatgctcaaatttcttgtgtgacttgaaagctggagctgaagtgaaaatgacaggacctgttggaaaagaaatgcttatgccaaaagatcccaatgctaccatcatcatgcttgcaaccggaactggaattgctcctttccgctcatttttgtggaaaatgttctttgagaagcatgatgactacaagttcaatggtttggcgtggctcttcttgggtgtccccacaagtagctcactgctttataaggaggaatttgagaaaatgaaggagaaggcccccgaaaattttagacttgactttgctgtgagtagagagcaaaaaaatgagaaaggtgagaagatgtacatccaaacccgaatggctcagtatgcagaagagctatggcaattgcttaagaaggataacacctttgtctacatgtgtgggctgaaggggatggaaaagggaattgatgacataatggtttcattggctgctagagatggcattgattgggcggactacaaaaagcagttgaagagagcagagcaatggaatgtggaagtatactaatgcctgattacttgtacaaatttctcccacttcacttttaagcggcaactgataatgatttccactgcattttctgtagataggtaatgcctttgtaattttccattttatatttgtttttttttttttttaatgcagcagttgtattggtatagcctccacaggagttttatttatgaggggtcatggattatatagtcataaatatagttgaagctaacttcaacttctttttacggagaataatgctagagatataaattattttataaaaaatttacaaactgctgatgtggtgaatgattattagtaaataaaaaaatagatattaatagtaagactagatgaaaaccaataagaggttgactacattaacattttgttaaaatgttgtaaaatagtttgtgtctgtagaattactcttttatgaatattcagctccatttttcatca

SEQ ID NO: 1538 - DNA, 1556 bp, Mesembryanthemum crystallinum
ctcactctctctgctccaccaaaactccattcagtataataaaaacaatcaaacttttatctctttcctttttatttctggttcctcttcttcttcttcttcttcttctgcaaagatatcttcttcaatcagctcagcaatggctgccgcagtaactgccgcagtctctttcccttctactaaatccactcccctttctaccagaacatcttccgtcatcacccatgagaaaattaacttcaacaaggttcctctatactacaggaatgtatcagttggtgggaaagtgggaaccattagggcagtagcctcagatgttgaggcacctgttgcaaaggtggagaagcattcaaagaaaatggaggaaggagtgatagtcaacaagtacaagcccaagaacccttacactggcagatgcctcctcaacactaagattactggagatgatgctcctggagagacctggcacatggttttctcccatgaaggagagattccctacagagaggggcagtctgttggagtgattcccgaaggtattgacaagaatggaaagccccacaagttgagattgtactcaattgccagcagcgcccttggcgactttggtgactctaaaactgtttccttgtgtgtaaaacgacttatctacaccaatgacaacggagaaatagtcaagggtgtttgctcaaactttttgtgtgatttgaaacctggtagtgaagtagtgctaactggaccagttgggaaggaaatgctgatgccaaaagaccctaatgccacaattatcatgcttgcaactggaactggtattgctcctttccgttcgttcttgtggaaaatgttctttgagaagcacgatgactacaagttcaatggtttggcatggctcttcttgggtgtacccactagcagttctttgttatacaaggaggaatttgagaagatgaaggagaaagctccagaaaacttcaggttggatttcgctgtgagcagagaacaaactaatgagaaaggggagaaaatgtacatccaaacccgtatggcacaatatgatagagagctatgggaattgctcaagaaagacaacacttacgtctacatgtgtgggctgaaaggcatggagaaaggaatcgatgacattatggtttcattggccgcagaagatggtattgactggttcgactacaagaagcagttgaagaaggcagaacagtggaacgtggaagtctactgataaacttgtacaaaactctcttctttctttttgtgaagcagaatatatctatttgtcatctcccactgcaccttgtagataggtcagtttcttttcgatattgttatgaatatcagctaattgcattgtagaagctatagccaaaaaagctctgttttggagtactcatgtatcgcgtaattatactggaaaccagtgtcaacacttctacactgagaaattcatgaggatgaacacattatgctcaattcgagattatactactatgtttcccaaccggcgattcctgcagcccgggatcatagtttgacgccgccac

SEQ ID NO: 1539 - DNA, 1641 bp, Tabernaemontana elegans
cccctcacttctttaccgaacagaagctttactttctttcaaatctcatcaccccatcacttctttctttctctgtattacaataacaagaaatggctactgcagtcagtgctgcagtgtcccttccttcctccaagtcttctgcttctcttcccactaccagaacatctatcatctcaacagagagagtcaactttaacaaggttcctttgtactataggaatgtttctgcaggtgggaaagtggtttccatcagagcccaggtgaccacagaggctcctgtcaaggttgagaaagtttccaagaaaaatgaagaaggtgtgatagtgaacaagtttaagccaaagaacccatacattggcagatgtctccttaacactaagatcactggtgatgatgcaccaggagaaacttggcacatggtcttcagcactgagggagaaatcccatacagagaaggtcagtcagttggggttattgctgatggaattgacaagaatggaaagcctcacaagctgaggttgtactcgattgctagcagtgcaattggtgactttggagattccaaaacggtttctctatgtgttaaaaggcttgtctataccaatgaaaatggagaaatcgtcaaaggagtttgctcgaacttcttgtgtgatctgaagcctggagctgaggtaaaactgactggacccgttgggaaagaaatgctcatgcctaaggatcccaatgccaccataatcatgctggccaccggaactggaattgctcctttccgaggatttttgtggaaaatgttctttgagaagcatgatgactacaagtttaatggtttggcatggcttttcttgggtgttccaactagcagttccctgctttacaaggaggaatttgagaaaatgaaggagaaaaatccagacaatttcagactagactttgctgtcagcagagagcaaaccaacgagaaaggtgagaagatgtacattcaaaccaggatggctcaatacgcggaagagctatgggaactactcaagaaagacaacacttttgtgtacatgtgtgggctgaagggcatggagaagggaattgatgacattatgttgtcattggctgctaaagatggtattgactggctggaatataaaagacagttgaagaaggaagagcaatggaatgtggaagtctactaattcttgcttccttgtacaaatattagtcgatatttcgtgaatttctctgcattggtgctatgatgtagataggtattattccctctacaatttgttttgttcaaattttctatcttttttccttttcattttctgttttcttcaagaaatgcttgtagccttccctaaaatttttgagggcatggatgacatatactgaaaaaaccttgacccttttacaaatctatcttcaccttgtccatgctggagttttgaggttgtcaatgtagagtatgctaaaagcctggatctgaagcagataatgaggttgttgagaaaggtaactgctttactttatacataatctatgttctggttgaggatcagtagttgcgagaaacaaagcatacaggctatctttcttggttcccatagtttgtattcatacatgtgtagccctttgaaaattttgtac

SEQ ID NO: 1540 - DNA, 1556 bp, Citrus clementina
caaaaacaaagtgtgagaatcatagattttactcataaacttatcctttcataagccactgcattggctttccaatctcctccacccaattcaatatccataaacacaacccactaaatcaaatacacaaaaatctcaaccttttcttttttctcatctcacttcttcacttaaaaacgtcaacacccctttaaattttcttctctcttcatctaaattcttctttatcatcacttatcaatcatggctgcagtgagtgctgcagtttctcttccgacttccaagtccacttcgcttccaaccagaacctctatcatctctcctgacagaatcaccttcagaaaggttccattttactacaaagatgtttcaactggagggagagtggtttctgtcagagctcaggttaccactgaggctcctgctaaggttgagaaagagtccaagaaaatggaggaaggtgttattgttaacaagttcaaacctaagacaccttacattggcagatgccttttaaacactaagatcactggtgatgatgctcctggagagacctggcacatggtcttcagcactgaaggagaggttccctacaaagaagggcaatcaattggggtgattgcagatggtgttgacaagaatgcgaagcctcacaaactgagattatactccattgctagcagtgcccttggtgactttggagactccaaaactgtttctttatgtgtgaaaaggcttgtgtacaccaacgaaaatggagaaattgttaagggagtctgctcaaatttcttgtgtgacttgaagcctggggctgaagtgaaaattacaggacctgttgggaaagaaatgctcatgccaagggatcccaatgctacagtcatcatgcttgcaactggaactggaatcgctccattccgtggatttttgtggaaaatgttctttgagaagcacgaagactacaagttcaatggtttggcttggctcttcttgggtgtcccgactagcagttccctactctacaaggaggagtttgagaagatgaaggagaaggccccggaaaacttcaggcttgactttgcagtgagcagagaacaaaagaatgagaagggtgagaagatgtacattcaaacccgaatggctgaatatgcaaatgagctgtgggaattactcaagaaagataacacttatgtgtacatgtgtgggttgagaggcatggagaagggaatcgatgacattatggtgtcattggccgctaacgatggcattgattggctggactacaaaaagcaattgaagaaagctgagcaatggaatgttgaagtctactaatgctttacatgtacaaaacatccctcacattttcattttttttcctttttgtcccattgtatgatatttccctctgcactgtgtagataggtagactattttcaaattttctttctattttggtcttttttaacggagcaatttacggctattgtctctacagatttttattcttgagggatcatgtatcttgcaaatatatatttggaggcaattcaacttgctca

SEQ ID NO: 1541 - DNA, 1541 bp, Capsicum annuum
ctcttatcctcacatctgccactgcctttctcctaccaatctcctccacccaattcttaatccactctctcaaaaagatcacaattccccttcctccttattttttccttcttcaccattcccttactatcaacttcttcattttcttgttccataaacatggctactgcagtaagtgctgcagtctctcttccttcatccaagtccacttcttttcccactagaacatccatcatctcccctgaaaaaatcaacttcaacaaggtgcctttgtactacagaaatgtgtccggtggtagtagattggttactattagagcccaagtgaccacagaggctcctgctaaagttgagaagatttcaaagaaacaggatgaaggtgtggttgtgaacaagttcaggccaaaggaaccttacattggtagatgtctactcaacactaagatcactggtgatgatgcacctggtgaaacttggcacatggtctttagcactgaaggggagatcccatatagagaaggccaatccattggtgtgattgctgatggtgttgatgccaatgggaagcctcacaagcttcgattatactccattgccagcagtgcccttggtgacttcggcgactccaaaaccgtttccctgtgtgtcaaaaggcttgtgtacaccaacgacaaaggggaagaagttaaaggagtttgctcaaacttcttgtgtgacttgaagcctggagcagatgtcaagattactggacccgttggcaaagaaatgctcatgccaaaagatccaaacgccactgttataatgcttggtactggaactggaattgctcctttccgatcattcttgtggaaaatgttctttgagaaacacgacgattacaagttcaatggtttggcatggcttttcttgggtgttcccaccagcagctccctactttacaaggaggaattcgagaaaatgaaggagaaggccccagaaaacttcagattggactttgctgtgagcagagagcaaacaaacgaaaagggtgaaaagatgtacatccaaaccagaatggctcaatatgctgaagaactatggactttgctcaagaaagacaacacatttgtgtacatgtgtggactcaagggcatggagcaaggaattgatgacattatgtcttcacttgctgccaaagagggtattgactgggcagactacaagaagcaattgaagaaggcagagcaatggaatgtggaagtctactaaatatttttacttttgtttgtacaaatatgagccaactttatgcttctcttccctgcatccatgtagataggtaaaaattttcctttaatattttattttcattttttgggacttcccttttttaatctttcatctgtatctcttaatgaatcagtgtattggccttgcccttctcaaagttgaattttgagggcctggatcaataacatatagctgaatcaacctcaatcatagtctctttatccctaaggaacctgttttttttagttttcttatatacaacaatatccttc

SEQ ID NO: 1542 - DNA, 1328 bp, Castanea mollissima
aaaatggcttctgcagtaaatgcatcggtctctttaccatcttccacttcatcctctctaaccaccagaacttctacagtatattcagaaagagttagcttcagtaagaatatcttctattctagaaatgtctacgttggtaagaaaatggttcagattagagcccaagtcaccacagagactccagccaaagtacaaaaagtttccaagaaagatgacgagggtgtgattgtaaacaagttcaagcctaaggagccttacattggtaagtgccttctcaactccaaaattacagcagacgatgctccgggagagacttggcacatggtgttcactactgagggggaagttccttatagagaaggacaatccattggtattattgcagatggcattgacaagaatgggaaaccccacaagcttagattgtattctattgccagtagtgctcttggagactttgggaattccaaaactgtttctctgtgtgtcaagaggcttgtctacaccaatgataaaggagagatagttaaaggagtttgctcaaatttcttgtgtgacctgaagcctggggctgatgtgaaaatcacaggacctgtaggaaaagaaatgcttatgccaaaagatccaaatgccacagttataatgcttgcaaccggaactggaattgctcctttccgttcattcttgtggaagatgttttttgagaagcatgagaattataagttcaatggattggcttggcttttttgggtgttccaacaactagctcattgctctacaaggaggagtttgcgaagatgaaagagaaggcaccagaaaacttcagagttgattatgcagtgagcagagaacaaacaaatgacaagggtgagaagatgtatattcaaacccgaatggcacagtatgcagaggagctatgggagttactcaaaaaagacaacacctatgtatatatgtgtggactcaagggaatggagaaggggattgatgacataatggtctctttggctgctaaagatggcatcgactggcttgaatacaggagacaattgaagaaggcagagcaatggaatgttgaagtctattgattctattggtgttacacatatacactgaagaatcccttattatttcttgtgtgtgaaggagataggtcatcttatatgtaatttgttagaacataatctacttattttgtatagtgagtttaaaatcgcattaactactggatttagggatatcatggatgatttcatggtagaatgaattccactacttggaagttttcataatttgtagaatactaattccattgtttttccact

SEQ ID NO: 1543 - DNA, 1689 bp, Secale cereale
ccattttcttcctgactcttcacttattcagtttgtgtgttctcttcagtcttcacgccttcgtcctcggacctcgctgcttcttctatccggggaagcttctagaaacaccatctccgatccatcagcccagccaggcctacgtgctggtggaggtcgacaaggcgtgctgttccgtgccgcctccttagcggtcgcgcgaaggatgctggcgtccagggtctggtctaggtccgcgtcgcagtcctcgcccgcttccccgcgcgccttggcttccgcagcggcctcggcggcgaggtcccttctgctgaggtccggcatgccgctctcgcgggatcctcccggtctcgcagagcggccctgcgccgggatagctgaggctggggtccgcacggccgatgcgccgccgccgtgctcttcttcaggcgattcacgaggagaacatgcctgcagaagacggacatatcaaagaaatccagtgtctagtcgagccaagcctgtcggagggaaccaccatgttctttatgcaagttatctgtcacagaaccaacagaactacagatgtttttcggcttattccgaccaagacaggatagaagctgcaaacaggataatacatggtctgccaaggtgtgtgaaaattgtagaagttgggcctcgagatggactgcagaacgaaaaaaatacagtgccaacacctgtaaagattgagctcataaagagattggcaacctctggattatcagttgttgaggcaacaagttttgtctccccaaaatgggtgccacagctagctgatgcgaaggatgttatggaagtggttcggaatattacgggtgtaagctttcctgtattgactccaaacctcaagggatttgaagcagcagctgcagcaggtgcgaaagaagttgcaatatttgcgtcagcttctgaagcattttcgaagtcgaacataaactgctcgattaaagagagctttgttcgctataatgatgttgctcttgcagcaaaaaagcaagaaattcctgtacgagggtatgtttcttgtgtggttggatgcccagtagaaggatcagtaccaccttcaaatgtagcttatgttgccaaagagctttatgacatgggctgctacgaagtttcgcttggtgatacgattggagttggtaccccaggcacagttataccaatgcttgaggcagttatgtccgtcgttcccgtggaaaaacttgctgtccatttccacgacacctatgggcagtctctttcaaacatcatcgtctctctccagatgggcgtcagtgtcgtggactcctccgtcgcgggcctcggtggctgcccgtatgcaaagggcgcatcgggtaatgttgctaccgaggatgtagtgtacatgctaaacgggttgggggtcaagacgggcgtagatctgggcaaggtaatggcagccggcgagttcatctgcaagcacctggggcgccagtctgggtccaaggcagctactgccttgagcaaggtcacagcgagcgcctcaaagctatgaggctgctctcagtgctattactctgtaacatcataatggcgtgcccgtttattgtatgcagtgacccttgcagcagatacatgtacaatacataacccaaaaaagtacatagaatgaataaatggcacatactgtatgatgttctgcctaat

SEQ ID NO: 1544 - DNA, 1760 bp, Lolium multiflorum
cactccgctccttgctgactccccaggcttcacgcccaatatccgtagaagcttctagaagcactctccccgctccagctccatcagcccagccaggccaggtcgacgcggcgtgctgatccctgccgcttcctccgcggcggcgccaaggatgctggcggcgtccagggtctggtctaggtccgcgtcgccgtcctcgccggtttccccgcactccgcagcggcggcggcgagctcccttctgcagaggtccgtgatgcaggtctctccgaaatcgcaggcgcctcccggtctagctggcacgggggatcgcgcggccgatgcgccgcctccgccgtgctcttcttcagacgattttagggaagagcatgccagcagcagacgaacaaatcaaagacatccactgcctaatcgaggcaagttgatcggagggaaccaccatgttctgtatggaagttatcttccacaaaaccaacagagatgcagatactattcgttttcttctgaccaagagagaatgattgtaaacaggattatacatgatctgccaaggtttgtgaaaattgtagaagttggaccgcgagatggactgcaaaacgaaaaagatacagtgcccacacctgtaaagattgagctcataaagagattggcaacctctggattatcagttgttgaggcaacaagttttgtctccccgaaatgggtgccacagctagctgatgcaaaggatgttatggaagtggtttggaatattacgggtgtaaactttcctgtattgactccaaaccttaagggatttcaagcagccgccgcagcaggtgcaaaagaagttgcaatatttgcatcagcttctgaagcattttccaagtcaaatataaactgttcaattaaagagagccttgcccgctataatgatgttgctcttgcagcaaaaaagcaagaaattcctgtgcgagggtatgtttcttgcgtggttggatgcccagtagaaggatcagtaccaccttcaaatgtagcttatgttgccaaagagctttatgacatgggctgctacgaggtttcacttggtgatacaattggagttggtaccccaggcacggttgttccaatgcttgaggcagttatgtcggtcgttcccgtggaaaagcttgcggtccatttccacgacacctatggccagtctctttcgaacatcctcgtctctctccagatgggcgtcagtgtcgtggactcttccgtcgctggccttggtggctgcccctatgcgaagggtgcatcagggaatgttgccacggaggacgtcgtatacatgctaaacgggttggggatcaagacaggcgtcaatctgggcaaggtaatggcagccggcgagttcatctgcaagcatctggggcgccagtctgggtccaaggcagcgaccgccctgagcaaggttacagccagcgcctcaaaactatgactatgaggctgctcttactgtcgttactctgtaacatcttcatccgatgcctgttaattctaaaccctttcctgcaatgtttgttcgtgaccacctgttgcagaatatacatgtacaataccaacacaaataaaattacgtataaaagaataaaaaatgtgtttttttttgcaaaagagagcctcttttttctgttgatcatctacctacgggcctttcattctctcggctgtgtgattcagctgtaaaatctcttgtactcccaacagttattatggatcgaaaggagtacacatttttg

SEQ ID NO: 1545 - DNA, 2651 bp, Triticum aestivum
ggcatgcagctctcccaggctcctcccggtctcgcagagcggccctgcgcccggatagctgaggctgatgcgccgccgctgtgctcttcttcaggcgattcacgaggagaacatgcctgcagaagacgcacatatcaaagacatccagtgtctaatcgagccacgcctgtcggagggaaccgtcatgttctttatgcaagttatctttcacagaaccaacagaactacagatctttttcggcttcgtccgaccaagagaggatagaagctgcaaacaggataatacatggtctgccaaggtgtgtgaaaattgtagaagttgggcctcgagatggactgcagaacgaaaaaaatacagtgccaacacctgtaaagattgagctcataaagagattggcaacctctggattatcagttgttgaggcaacaagttttgtctccccaaaatgggtgccacagctagctgatgcgaaggatgttatggaagtggttcggaatattacgggtgtaagctttcctgtattgactccaaacctcaagggatttgaagcagcagctgcagcaggtgccaaagaagttgcaatatttgcgtcagcttctgaagcattttcaaagtcaaacataaactgttcaattaaagagagccttgttcgctataatgatgttgctcttgcagcaaaaaagcgagaaattcctgtacgagggtatgtttcttgtgtggttggatgcccagtagaaggatcagtaccaccttcaaatgtagcttatgttgccaaagagctttatgacatgggctgctacgaggtttcgcttggtgatacgattggagttggtaccccaggcacagttgtaccaatgcttgaggcagttatgtccgtcgttcccgtggaaaagcttgctgtccatttccacgacacctacgggcagtctctttcaaacatcctcgtctctctccagatgggtattagtgtcgtggactcctccgttgcgggccttggtggctgcccatatgcaaagggcgcatcagggaatgttgctactgaggacgtagtgtacatgctgaatgggttggggatcaagacaggcgtcgatctaagcaaggtgatctcagccggcgagttcatctgcaagcatctggggcgccagtctgggtccaaggcagctactgccttgagcaaggttaccgcgagcgtctcaaagctatgaggctgctcttagtgctgttactctgtaacatcataatgctgtgcccgtttattgtatgtcgtgatcccctgttgcagaagatacatgtacagtaccaatgcagaaagtacgtaaatgaataaatggtgcatttgatgttttgccacaaaaaaggacatttgaagccactttcatttctcctggataattcagctgttaaacctgttgtacactatgtaacacacacatgcatatgacgtgtgcaactaaatataagtttccaagagacaaaaagggtagatggccatactttcaaagatgtgcaaaattgatcacatcaattaaatcagtacaattgtctcacttctcagccgccaaaagttaacaatattcatggtcaatgtacactagcttgttaaactctacggtagatcaataatgcctccgtgaagtgagttaagaacttaagatctctctcgagttactatgtattacatctgtaccaaaatagaagacgtttttgtacttcaatttgaactgcaaaaatgtcttatattttgatatggaggtagtacatgatagggctcctgtgaataaccaaattatttacagcaattgtcaataccaactaataattactgacgattcaatcaggcatccctgtcaatgtcaagttggtttcttgcttcagcactctttgtgttttgctgaacttctctgatggtagcacgagtccttttccataggccgctaacagaagagcctctgctcgcccgtgatgtttcttcaacttgagggacagagccttatccgggaacaagattgtagcagctcgtctgctatcatccttaggtgatgcacttcgagttagcccaaagtacgatttccatgtctgtgatgcaaccggtacaacagaaaactcagatgccactagagcagcaatccacaagccatacgaaaaacctgtactccaccatcccagctttccatcagttggaaatggacttgacttttcaataaacgctgtagttcctggaggcgcatcaaggccacggagaagctgtatgatggacctggtgtctaggcgcttccgggtgagctccgacaccattatgttcacgaacgggttatcgaacacctgagaggagccgtcgggtgagagaacggcgatggcgccgcgagtgtctggatcgatcccaatcgcccagccggtgggggcgggggcggcggcggcgtcgctgccgtcggcggggagcagggagagggaggcgagccaggggtccacagcccccgcgtccgccaggagcttagccttggccctggagcgggacttcgcgggcagcgccgcaacaggagggagcaagacacgtcggtggcagcggcgtgagcggaagggcggggaaaagaaggccgcggcggcgtcccaatggagggtggagcggcggagggcggtggagcggagggcg

SEQ ID NO: 1546 - DNA, 1820 bp, Brachypodium distachyon
attgctgccgatttgccaaacatcaaccaaagccagagtggactagagtgcgcaatctccagacgcaactgctgctatctccttcctattcacgccttcgctcttacccgcttccggcctgaaactatcaaggtcgagacggacatgccgtgctgatccgcgcgcttcctttagcgctgccgccaaggatgctgagggtctggtcgaggtccgcgtcgccgtgctcgcccacttccccgcacgctttgtcttccgcagcggcggcggcgacaaggtcccttctgctcaggtccaggatgcagacaccgcaggctcctcccgatggaggccacgagccgccctgcgccaggttcgctgagacgggggatcgagcggccgatgcactgccgccgtgctctccttcaggcgatgctagggaagaatacacctgcagaagaccggcatttcaaagacagcaagtacctaattggggcaactcgtctgttggagggaaccgccatgttctttatgcaagttatctttcccagaacaaacagaactacagatgtttttcatcttcttccgaccaagagtggataggaattggaagcaggatgattcataatctgccaaggtttgtgaaaattgtagaagttgggccacgagatggactgcaaaacgaaaaaagcacagtgccaacacatgtaaagatcaagctcatacagagattggcaacctctggattatcagttgttgaggcaacaagttttgtctccccaaaatgggtaccgcagctagctgatgcgaaggatgttatggaagtggttcggaatattgcgggtgtccattttcctgtattgactccaaaccttaagggatttgaagcagctgctgcagcaggtgcaaaagaggttgcaatatttgcgtcagcttctgaagcattttccaagtcaaacataaactgttctattaaagagagccttgcccgctataatgatgttgcttgtgcagcaaaaaaacatgaaattcctgtacgagggtatgtttcttgtgtggttggatgcccggttgaaggatcggtaccaccttcaaatgtagcttatgtagcgaaagagctttatgacatgggctgctatgaggtttcactcggtgatacaattggagttggtaccccaggcaccgttgttcctatgcttgaggctgttatgtctgttgttcctgtggaaaagcttgctgtccatttccatgacacctatggccaatctctttcaaatatcctcatctctctccagatgggggtcaatgtcgtggactcctccgtggcaggcctcggtggttgcccatacgcgaagggtgcgtcagggaatgtggcgactgaggacgttgtgtatatgctgcacggattggggatcaagacgggtgtagatctgggcaaggtaatgtcagctggagagttcatctgcaagcacctggggcgtcagtctgggtccaaggcagcaatcgccttgagcaacgttaccgcgaacgcctcaaaactctgaggctgctcatctggggccagtgtgggtcgaaggcagcgaattgccttgagcaaggttaccacaagcggctcaaaactctaataaggctgctcatctggggcaccattctgggtccaaggcagcaatcgccttgagcaaggttgcagcggatggaacatgcataagttcacacctgttaattctataccctcttaccctgtatgtggtgatccccaattcagaggatgcatgtacaataccaatacagaaataaggaaagaaatagtacatatgttctggagaaatagagttacatttgct

SEQ ID NO: 1547 - DNA, 2454 bp, Brachypodium distachyon
attttaaagccatattaggcagcccaacaatcctctctctcttccttttcttctccagagcacggcacgggaactgtattgctgccgatttgccaaacatcaaccaaagccagagtggactagagtgcgcaatctccagacgcaactgctgctatctccttcctattcacgccttcgctcttacccgcttccggcctgaaactatcaaggtcgagacggacatgccgtgctgatccgcgcgcttcctttagcgctgccgccaaggatgctgagggtctggtcgaggtccgcgtcgccgtgctcgcccacttccccgcacgctttgtcttccgcagcggcggcggcgacaaggtcccttctgctcaggtccaggatgcagacaccgcaggctcctcccgatggaggccacgagccgccctgcgccaggttcgctgagacgggggatcgagcggccgatgcactgccgccgtgctctccttcaggcgatgctagggaagaatacacctgcagaagaccggcatttcaaagacagcaagtacctaattggggcaactcgtctgttggagggaaccgccatgttctttatgcaagttatctttcccagaacaaacagaactacagatgtttttcatcttcttccgaccaagagtggataggaattggaagcaggatgattcataatctgccaaggtttgtgaaaattgtagaagttgggccacgagatggactgcaaaacgaaaaaagcacagtgccaacacatgtaaagatcaagctcatacagagattggcaacctctggattatcagttgttgaggcaacaagttttgtctccccaaaatgggtaccgcagctagctgatgcgaaggatgttatggaagtggttcggaatattgcgggtgtccattttcctgtattgactccaaaccttaagggatttgaagcagctgctgcagcaggtgcaaaagaggttgcaatatttgcgtcagcttctgaagcattttccaagtcaaacataaactgttctattaaagagagccttgcccgctataatgatgttgcttgtgcagcaaaaaaacatgaaattcctgtacgagggtatgtttcttgtgtggttggatgcccggttgaaggatcggtaccaccttcaaatgtagcttatgtagcgaaagagctttatgacatgggctgctatgaggtttcactcggtgatacaattggagttggtaccccaggcaccgttgttcctatgcttgaggctgttatgtctgttgttcctgtggaaaagcttgctgtccatttccatgacacctatggccaatctctttcaaatatcctcatctctctccagatgggggtcaatgtcgtggactcctccgtggcaggcctcggtggttgcccatacgcgaagggtgcgtcagggaatgtggcgactgaggacgttgtgtatatgctgcacggattggggatcaagacgggtgtagatctgggcaaggtaatgtcagctggtgagttcatctgcaagcacctggggcgtcagtctgggtccaaggcagcaatcgccttgagcaacgttaccgcgaacgcctcaaaactctgaggctgctcatctggggccagtgtgggtcgaaggcagcgaattgccttgagcaaggttaccacaagcggctcaaaactctaataaggctgctcatctggggcaccattctgggtccaaggcagcaatcgccttgagcaaggttgcagcggatggaacatgcataagttcacacctgttaattctataccctcttaccctgtatgtggtgatccccaattcagaggatgcatgtacaataccaatacaaaaataaggaaagaaatagtacatatgttctggagaaatagagttacatttgcttattctgattgaattactgccctttctggtgtccttttatggcatatttctttcgggtgtgtaattcagtaaaagactacaaacattcaagattctacgttgctacacatggtcgtctaaacaaaaatgatcaaaataatcactgtcacataaaacagcactacaatggtctcaggctctcagccggcaatagtttaccatactcatgtcatatttacactgacttgttacactccaaaccaaaacggcatatcgctaatgcattaggggaagttgagtggattagctgatatctctgctgcaaatttacagtgcactcggtagcaacgctcaacgcttgcttcatttgagttattatgtacaccacggagcccctgggaataaccagattacttgcagcacttgtcaatgcaaaaatcaataattgatgattcagtcgagcctgccagccactgtcaagttggtttcctgtttatgtattattgtggggagctgctcttgtggtaacacgagtccttttccataggccgctaacagaagagcctctgctcgtcctg

SEQ ID NO: 1548 - DNA, 1392 bp, Festuca arundinacea
ggcacgagggagctcccttctgcagaggtccgggatgcaggtctctcagaaatcgcaggcgcctcccggtctagctggcacgggggatcgcacggccgatgcgccgcctccgccgtgctcttcttcaggcgattttagggaagagtatgccagcagaagacgaacaaatcaaagacatccagtgcctaacctaggcaagtcgattggagggaaccaccatgttctgtatggaagttatctttcacggaaccaacagagatacagatatttttcgtcttcttctgaccaagagaggatagggattgtaaacaggatgatacatgatctgccaaggtttgtgaaaattgtagaagttggaccgcgagatggactgcaaaacgaaaaaaatacagtgccaacacctgtaaagattgagctcataaagagattggcaacctctggattatcagttgttgaggcaacaagttttgtctccccgaaatgggtgccacagctagctgatgcaaaggatgttatggaagtggttcggaatattacgggtgtaaactttcctgtattgactccaaaccttaagggatttcaagcagcagccgccgcaggtgcaaaagaagttgcaatatttgcatcagcttctgaagcattttccaagtcaaatataaactgttcaattaaagagagccttgcccgttataatgatgttgctcctgcagcaaaaaagcaagaaattcctgtgcgaggatatgtttcttgcgtggttggatgcccagtagaaggatcagtaccaccttcaaatgtagcttatgttgccaaagagctttatgacatgggctgctacgaggtttcacttggtgatacaattggagttggtaccccaggcacagttgttccaatgcttcaggcagttatgtcggtcgttcccgtggaaaagcttgctgtccattttcacgacacctacggccagtctctttcgaacatcctcgtctctctccagatgggcgtcagtgtcgtggactcctccgtcgctggccttggtggctgcccctatgcgaagggtgcatcagggaatgttgccactgaggacgtcgtatacatgctaaacgggttggggatcaagacaggcgtcaatctgggcaaggtaatggcagccggcgagttcatctgcaagcatctggggcgccagtctgggtccaaggcagcgaccgccctgagcaaggttacagccagcgcctcaaaactatgactatgaggcgatgcctgttaattttaaaccctttcttgcaatgtatgttcgtgaccacctgttgcagaatgcatgtacaataccaacacaaataaaattacgtataaaagaataaaaaaaatgtgtttttcgcaaaaaaaaaaaaaaaaaaa

SEQ ID NO: 1549 - DNA, 2141 bp, Triticum aestivum
ccagaaaggagccggcggcagcgcggcgagagctcggacctcggaggaagaggtagccatggcgacaaccgcggccctccccttctcctgcgccaccaccctccagaccctgacccggaccctctccccgcgccgctccctcctcatccaccgccaccgcctccgctccctcgccgccgccgcctccccgcggctcccggaccgcgcccgcccccgcctccgccgccccgtctcggcctccgccgcgcccaacgggtcctcctccgcgggggagtacgactacgacctcttcaccatcggcgccgggagcggcggcgtgcgggcctcgcgcttcgcctccaccctctacggcgcccgcgccgccatctgcgagatgcccttctccaccatctccgcggacgacctcggcggcctcggggggacatgtgtgcttcgtgggtgcgttcccaagaaactgttagtgtatgcatccaagttctctcatgagtttgaagagtctcatggctttggatggacatatgatactgatccaaagcatgactggagcactctgatagccaacaaaaatacagagctgcaacgcctagttggcatttacaaaaatattttaaagaacgcaaacgtcgatctaattgaaggccgtggaaaggtggttgatccacatactgttagtgtggatggcaagctctacactgctaagaacatacttatagctgttggtggtcgaccatcgatgccagatatcccaggaatagagcatgttatagattccgatgctgcactagatctgccttcaaaacctgagaaaattgcaatagtgggaggtggatatattgccttggagtttgctggcatttttaatggcttaaaaagtgatgttcatgtgtttattcggcagccgaaagttttaagagggtttgatgaggaggtcagagatttcgttgctgaacagatgtctttaaggggtatcacatttcatactgaacatagtcctcaagctataaccaaatcaaatgatggtttactatctctgaagacaaacaaagaaactattggtgggttttcacatgtaatgttcgcaacaggtcgtaaaccgaatacgaagaacctcggactggaggaggttggggttaaaatggacaagaagggggctatagtggtcgatgggtattctcgaacctcggtggattcaatttgggctgttggagatgttactgataggatcaacttgactccggttgcactgatggaaggtggagcatttgcgaaaactttattcggtgatgaacctaccaaaccagagtacagagctgtaccagctgctgttttctcccaaccacccattgggcaagttggccttaccgaggagcaggctattgaagagtatggagatgttgatgtctacttgtcaaacttcagacctcttagagccactctttctggattacctgatcgtgtactaatgaagctcattgtgtgtgctactacgaacaaagttgtaggagtgcatatgtgcggtgatgatgcacctgagataatccagggaattgcaattggtgttaaagctgggttaacgaagcaagattttgatgtcactgttggcgttcacccaacatctgcagaggaatttgtcactatgaggagtccaactagaaaagttcgaagaaaaactgcagctgaggcagagtctaaggatgaggtcgtcactcagaagtagataatgccgttgaccgttgtacatagaagtcattctcgaggatgccaccggccgaaacctgactggaaatacacagctgaaacaggtgcaccgttgcccgagaaatctgtcacgacgaaccctctgaagatgtacgataacgatgagttgctacctctgttttttgccatcccatttgcacacttctttccttgctgcttgaggcttgagcacgctggtcgttgagtttctttcccccatctgctattcatgtgtaataaatggtacaatgtggctgtgtgggtgggtatctcaacctggaaacatcgctcccgaataccagtatagagtttaactacccgcaaatcgatctgtgaccagttaagtgcccgtgtttatgtcttgtatgttcctttttctgagggaaaagcaatagctttattat

SEQ ID NO: 1550 - DNA, 2119 bp, Brachypodium distachyon
ctctcccctccccacactcggaactcgagacctcggaggaagagagccatggcgaccaccgcggcgctccccttctcctgctccgccaccctccaaaccctaacccgcaccctctccccgcggcaccgcctcctcgtccaccgccgccgcttccaccgcctcccctccctcgccgccttcccgtccccaccggaccctccccgccttcgccgccccgtctcagcgtccgccgcgcccaacggatcctcctccgctggggagtacgactacgacctcttcaccatcggcgccgggagcggcggcgtgcgggcctcgcgcttcgcctccaccctctacggcgcccgcgccgccatctgcgagatgcccttcgccaccatagccaccgacgatctcggcggcctcgggggcacatgtgtgcttcgtgggtgtgttccaaagaaattgttggtgtatgcatccaagttctctcatgagtttgaagagtctcatggttttgggtggacatatgagactgatccaaaacatgactggagcactctgatagccaacaaaaatacagagctgcaacgcctagtcggtatctacaaaaatattttaaacaacgcaggagttgatctaattgaaggccgtggaaaggtggtcgatccgcatactgttagcgtggatggcaagctttacactgccaagaacatacttatagccgttggtggtcgaccgtcaatgccaactatcccaggaatagatcatgttatagattctgatgctgcactagatctaccttcaaaacctgagaaaattgcaatagtgggaggtggatatattgctttggagtttgctggcattttcaatggcttaaaaagtgacgttcatgtttttattcggcaacccaaagttctaagagggtttgatgaggaagtcagagatttccttgctgaacagatgtccttaaggggcatcacatttcatactgaacaaagtcctcaagctgtaaccaaatcaagtgatggtttgctatcactgaagacaaacaaagaaactattggtgggttctcacatgtaatgtttgcaacaggtcgcaaaccaaatacgaagaaccttgggctagaagaggttggggtcaaaatggacaggaacggtgcgatagtggtcgatgagtattctcgaacctcagtggattcaatttgggctgttggagatgttactgataggatcaatctgacgccagttgcactgatggaaggtggggcatttgcgaaaactttattcggtgatgaacctaccaaaccagattacagagctgtaccagctgctgtcttctcccaaccaccaattgggcaagttggtcttacggaggagcaggctattgaagagtatggggatgttgatgtcttcttatcaaactttagacctctcagggcaactctttctggattacctgatcgtgtactgatgaaggttattgtgtctgctgctacaaacaaagttgtaggagtgcatatgtgtggtgatgatgctcctgagataatccagggaattgcgattgctgttaaagctggcttaacaaagcaagattttgatgccactgttggcgttcacccaacatcagcagaggaatttgtcacaatgaggaatgcaactagaaaaatccgaaggagtacagcagctgaggtagaatcgaaggatgagatcgtcactcagcagtaggtcttgccgttgtacatagaaggcatattcttgagaacatatccctgctaccggactaaacctgactggaactgcaccatggtctgcattatcttagcaacgtatcaccatcacagggagaccaccgaagaagttttctgggggaagaaatggaacactgaagatgtaccacggctgtctctgtttttccctcccttcgcgtctttctttcatgcttgaggcttgagcacactgatagttgagttatttttcttaatctgctattggcaaaaacaaatttcgcttccacgggcatccttagcctagaattatcagaaggaatccagtgtagagttaattactgacctggacgtttccgagtgtattttgtcgtaaacctttttgtagcattcgatccaactttagctcagtgatc

SEQ ID NO: 1551 - DNA, 3430 bp, Brachypodium distachyon
gttcgcgcgggaaatccggaacgcaagcaaggcaaggcgcagtagcactgctctgcctctgctgcggggtaccctgcggctgcgagtgccagccgggtagcactagcgcgtcgtcctcccgtctcaaaacgttttaatactgtactgctgccattgcattttctttcttgtgcaggggttagggtttcgtgggggcgtgcgtgccctcgcctcgctccgggccggggggaagggacggccgcctcttgctcgctcgctcgcttgctgctgtccgatcacacgccggcacgccgccgcttgctcgcagctcggttccagatccgatcgggtctcgccgaccacgccgtgggcccaggtgctcccgattgggtcggcgccgggccttcctcctcgccgttgacatctccggccggctcgcgcttgcaggatgcgatcggttccgaggatagggcaatggagaatggaaccaaggctgctgatgatgttagggaagggcaattcaagctcatggagcaatatcgtgccgcaacaagcccagcctttgtacatactgctcttctctctggcttggcggacataacctgaggctcctcaggccaagcctctgcgcagcgactccttgtaagaggaagcattcgtctgcacgtgcccatcaacaactcctgcaactgttctccactcttgaacaccgatgaccttgtccgggtgctacccagtcctggatgagctatggtgatacgagtacttaccctaagtagtagtagtagtagtactatatagcactaatcttgtctcccttggctctattccatctttactgggtttatttgttgctcccttctgccaaggtgcattgctgttgaatgctactatgtcaaggttcattttggttgtctgatgtgaacagatttcggctcttttgcagctgcaagttgtgtacttgcattgttgtagcaagtgaagttatttgctgccatatgaggattgccgattatctttgttgtgaacctaagaatttgtgatgcctgtgttgaaaggatttatgctacgactaggaaggattacacttacaccccgccattgccattggctttcgaactcctattttgagaaatgccaaaaaaaatgcgtgttatacacatctactgttcgtttacgtaaacatggaagtacgccttcagtcggctgtgtgcatggttctcatcagtacgcctttccagcaaaaggaagacgaatcaaaacaaactcgtcctccacatatcatccatcgtctctcccctccccacactcggaactcgagacctcggaggaagagagccatggcgaccaccgcggcgctccccttctcctgctccgccaccctccaaaccctaacccgcaccctctccccgcggcaccgcctcctcgtccaccgccgccgcttccaccgcctcccctccctcgccgccttcccgtccccaccggaccctccccgccttcgccgccccgtctcagcgtccgccgcgcccaacggatcctcctccgctggggagtacgactacgacctcttcaccatcggcgccgggagcggcggcgtgcgggcctcgcgcttcgcctccaccctctacggcgcccgcgccgccatctgcgagatgcccttcgccaccatagccaccgacgatctcggcggcctcgggggcacatgtgtgcttcgtgggtgtgttccaaagaaattgttggtgtatgcatccaagttctctcatgagtttgaagagtctcatggttttgggtggacatatgagactgatccaaaacatgactggagcactctgatagccaacaaaaatacagagctgcaacgcctagtcggtatctacaaaaatattttaaacaacgcaggagttgatctaattgaaggccgtggaaaggtggtcgatccgcatactgttagcgtggatggcaagctttacactgccaagaacatacttatagccgttggtggtcgaccgtcaatgccaactatcccaggaatagatcatgttatagattctgatgctgcactagatctaccttcaaaacctgagaaaattgcaatagtgggaggtggatatattgctttggagtttgctggcattttcaatggcttaaaaagtgacgttcatgtttttattcggcaacccaaagttctaagagggtttgatgaggaagtcagagatttccttgctgaacagatgtccttaaggggcatcacatttcatactgaacaaagtcctcaagctgtaaccaaatcaagtgatggtttgctatcactgaagacaaacaaagaaactattggtgggttctcacatgtaatgtttgcaacaggtcgcaaaccaaatacgaagaaccttgggctagaagaggttggggtcaaaatggacaggaacggtgcgatagtggtcgatgagtattctcgaacctcagtggattcaatttgggctgttggagatgttactgataggatcaatctgacgccagttgcactgatggaaggtggggcatttgcgaaaactttattcggtgatgaacctaccaaaccagattacagagctgtaccagctgctgtcttctcccaaccaccaattgggcaagttggtcttacggaggagcaggctattgaagagtatggggatgttgatgtcttcttatcaaactttagacctctcagggcaactctttctggattacctgatcgtgtactgatgaaggttattgtgtctgctgctacaaacaaagttgtaggagtgcatatgtgtggtgatgatgctcctgagataatccagggaattgcgattgctgttaaagctggcttaacaaagcaagattttgatgccactgttggcgttcacccaacatcagcagaggaatttgtcacaatgaggaatgcaactagaaaaatccgaaggagtacagcagctgaggtagaatcgaaggatgagatcgtcactcagcagtaggtcttgccgttgtacatagaaggcatattcttgagaacatatccctgctaccggactaaacctgactggaactgcaccatggtctgcattatcttagcaacgtatcaccatcacagggagaccaccgaagaagttttctgggggaagaaatggaacactgaagatgtaccacggctgtctctgtttttccctcccttcgcgtctttctttcatgcttgaggcttgagcacactgatagttgagttatttttcttaatctgctattggcaaaaacaaatttcgcttccacgggcatccttagcctagaattatcagaaggaatccagtgtagagttaattactgacctggacgtttccgagtgtattttgtcgtaaacctttttgtagcattcgatccaactttagctcagtgatcaatcatcagtccgttcttcctgggttccaccgcctctcca

SEQ ID NO: 1552 - DNA, 2031 bp, Avena sativa
gcctctccccttcctctcccctccccgttctctcggcggcagcgcggcgagagctcgtcgcgagagagagagccatggcgacgaccgccgcgctccccttctcctgctccaccaccctacaaaccctaacccgcaccctctacccgcgccaccccctcctcatcccccgccgccgcttccaccacctccgctccctcgtcgccgccccgggccgcccgaaccctccccgcctccgcagccccatctcggcctccgccgcgcccaacggatcctcctccgccggggagtacgactacgacctcttcaccatcggcgccgggagcggcggggtgcgggcctcgcgcttcgcctccaccctctttggcgcccgcgccgccatctgcgagatgcccttcgccaccatatccgccgacgacctcggcggcgtcgggggaacatgtgtgcttcgtgggtgtgttccaaagaaactgttggtgtatgcatctaaattctctcatgagtttgaagagtctcatggctttgggtggaattacgagaccgatccaaagcatgactggagcactctgatagccaacaaaaacacagagctgcaacgcctagttggtatctacaaaaatatattaaacaatgcaggagttgatctaattgaaggccgtggaaagctaattgatccacatactgttagtgtggatggcaagctgtacactgccaagaacatacttatagccgttggtggtcggccatcgatgccaaatatcccaggaatagagcatgttatagattctgatgctgcattagacctgccttcgaaacctgaaaaaattgcaattgtgggaggtggatatattgctttggagttcgctggcattttcaatggcttaaaaagtgacgttcatgtgtttattcggcaaccaaaagtattaagagggtttgatgaggaggtcagagatttcattgctgaacagatgtctttaaggggtatcacatttcatactgaacaaagtccccaagctataaccaaatcaaatgatggtttgttatctctgaagacaaacaaagaaactattggtgggttctcacatgtaatgttcgcaacaggtcgtaaaccgaatacaaagaaccttggactggaagaggttggggtcaaaatggacaacaaaggggctatagtggtcgatgagtattctagaacctcagtggattcaatttgggccgttggagatgttactgataggatcaatctgacaccggttgcactgatggaaggtggggcatttgcgaaaactgcattcggtgatgaacctaccaaaccagatcacagagctgtaccagctgctgttttctcccaaccacccattgggcaagttggtcttactgaggagcaggctattgaagagtatggagatgttgatgtcttcatttcgaacttcagacctcttagggccactctttctggattacctgatcatgtactaatgaagcttattgtgtgtgctactacgaacaaagttgtaggtgtgcatatgtgtggtgatgatgctcctgagataatccagggaattgcaattgctgttaaagctgggttaacaaagcaggattttgatgtcactgttggcgtacacccaacttcagcagaggaatttgtcactatgaggagtccaactagaaaagtccgaagaaaaactgcagctgaggtagaatctaaggatgaggtcgtcactcggcagtagatactgtcattgaccattgtacatagaaggcattctggaggaggacgtgaccctgctaccggcccaaaacctgactagaaacctgatgaaccagtcactgaagatgtatcattacaacgattatgcttgtctgtttttttgccctcgcgatttttgcatctctttccttgaggcttgagcacgctagtagctgagttttcttcttctcttgatctgctactcgtgtaataaatggtacaaagatgttggtatcccagcctggaaatattgacgggaaaagtgaaccagtggagagttttat

SEQ ID NO: 1553 - DNA, 2119 bp, Lolium multiflorum
atcatgcatcacatcttctgggatcatccatcatctcccctccccattctctcggaagccaagcggcggcagcgcggcgagagctcgtcgggagagccatggcgacaacggcggcgctccccttctcctgctccaccaccttccagaccctaacccgcaacctctacccgcgccacccgctcctcatcccccgccgccgcctccaccacctccgctccctcgccgccgtcccgacccgtccccgcctccgccgccccgtctcggcctccgccgcgcccaacggatcctcctccacctcggagtacgactacgacctcttcaccatcggcgccgggagcggcggcgtcagggcctcgcgcttcgcctccaccctcttcggcgcccgcgccgccgtctgcgagatgcccttcgccaccatctccgccgacgacctcggcggcgtcgggggaacatgtgtgcttcgtgggtgtgttccaaagaaactgttggtgtatgcttccaaattctctcatgaatttgaagagtctcatggctttgggtggacttacgagactgatccaaagcatgattggagcactctgatagccaacaaaaatacagagctccaacgtctcgttggtatctacaaaaatatattaagcaatgcaggggtcgatctaattgaaggccgtggaaaggtggttgatccacatactgttagcgtggatggcaagctgtacactgctaagaacatacttattgccgttggtggtcggccatcaatgccaaatatcccaggaatagagcatgttatagattctgatgctgcactagacctaccttcaaaacctgagaaaattgcaatagtgggaggcggatatattgctttggagtttgctggcattttcaatggcttaaaaagtgaggttcatgtgtttattcggcaaccaaaagtattaagaggttttgatgaggaggtcagagatttcattgctgaacagatgtctttaaggggcatcacatttcatactgaagaaagtccccaagctataaccaaatcaaatgatggtttgttatctctgaagacaaacaaagaaactgtgggtgggttctcacacataatgttcgcaacaggtcgtaaaccgaatacgaagaaccttggactggaagaggttggggtgaaaatggacaacaaaggggctatagtggttgatgagtattctagaacctcagtggattcgatttgggctgttggagatgttactgataggatcaatctgacaccggttgcgctgatggaaggtggggcatttgcgaaaactgcatttggtgatgaacctaccaaaccagatcacagtgctgtaccagctgctgtattctcccaaccacccattgggcaagttggccttactgaggagcaggctattgaagagtatggagatgttgatgtctacatatcaaacttcagacctcttagggccactctttctggattacctgatcgtgttctaatgaagcttattgtgtgtgctactacgaacaaagttgtaggagtgcatatgtgtggtgatgatgctcctgagataatccagggaattgcaattgctgtgaaagctgggctaacaaagcaagatttcgatgccactgttggcgttcacccaacatctgcagaggaatttgtcactatgaggagtccaactagaaaagtccgaagagaagctgcagctgaggtagaatccaaggatgaggtcgtcactaagcagtagatattgccgctgacagttgtaaatagaagacattcttgaggacatggccttgctactggccaaaaacccgactggaaatctgagaaatctgtcagagagagctgctgaagatgcacatagcgatgactagctatgcctgtttttttgccctcgcgtttctgcatttctttccttgaggcttgaacatgctggtagttgagttatcttcttctcccgaccagaactcatgtaataaatggtacacagattttggtatcctaacctggatatattgacagggaaaagtaaaccagaagaggggttttctactgatcttgacacttaagagtacatttgttcagaaacttttcattgtcattagatataacttggcg

SEQ ID NO: 1554 - DNA, 1957 bp, Secale cereale
ccgccaccctccagaccctgacccggaccctctccccgcgccgctccctcctcatccaccgccaccgcctccgctccctcgccgcctccccgcggcgcccggaccgccccgcccttgcctccgccgccccgtatcggcctccgcctccgccgcgcccaacggatcctcctccgcgggggagtacgactacgacctcttcaccatcggcgccgggagcggcggcgtgcgggcctcgcgcttcgcctccaccctctacggcgcccgcgccgccatctgcgagatgcccttctccaccatctccgcggacgaccttggcggcctcgggggcacatgtgtgcttcgtggttgtgttccgaagaaactgttagtgtatgcatccaagttctctcatgagtttgaagagtctcatggctttggatggacatatgatactgatccaaagcatgactggagcactctgatagccaacaaaaatacagagctgcaacgcctagttggcatttacaaaaatattttaaaaaacgcaaacgtcgatctaattgaaggccgtggaaaggtggttgatccacatactgttagtgtggatggcaagctctacaccgctaagaacatacttatagctgttggtggtcgaccatcgatgccagatatcccaggaatagagcatgttatagattccgatgctgcgctagatctgccttcaaaacctgagaaaattgcaatagtgggaggtggatatattgccttggagtttgctggcatttttaatggcttaaagagtgacgttcatgtgtttattcggcaaccgaaagttttaagagggtttgatgaggaggtcagagatttcgttactgaacagatgtctttaaggggtatcacatttcatactgaacatagtcctcaagctataaccaaatcaaatgatggtttactatctctgaagacaaacaaagaaactattggtgggttttcacatgtaatgttcgcaacaggtcgtaaaccgaatacgaagaaccttggactggaggaggttggggttaaaatggacaagaagggggctatagtggtcgatgagtattctcgaacctcagtggattcaatttgggctgttggagatgttactgataggatcaacttgactccggttgcactgatggaaggtggagcatttgcgaaaactttattcggtgatgaacctaccaaaccagagtacagagctgtaccagctgctgttttctcccaaccacccattgggcaagttggccttaccgaggagcaggctattgaagagtatggagatgttgatgtctacttgtcaaacttcagacctcttagagccactctttctggattacctgatcgtgtactaatgaagctcattgtgtgtgctaccacgaacaaagttgtaggagtgcatatgtgtggtgatgatgcccctgagataatccagggaattgcaattggtgttaaagccgggttaacgaagcaagattttgatgtcactgttggcgttcacccaacatcggcagaggaatttgtcactatgaggagtccaactagaaaagtccgaagaaaaactgcagctgaggcagagtctaaggacgaggtcgtcactcagaagtagataatgccgttgacctctgtacatagaagtcattctcgaggatgccaccggcggaaacctgactggaaatacagagctaaacagtgcaccgtttgcctgagcaatctgtgacaatgaaccctctgaagatgtacgataacgatgagttgctacctctgtctttttgccctcccatttgcgcacttctttccttcctgcttttgaggcttgagcacgctggtcgttgagtttcttttccccgtctgctattcatgtgtaataaatggtacaatgtggctgtgggtatcatcaatcttgaaacatcgatccggaatactaccagtgtatagagtt

SEQ ID NO: 1555 - DNA, 2179 bp, Oryza sativa
gaatcaaacaagctcatcgtctccactctccacacatcatcgccttcgcttctcctctctccgccccacactgtcggaagtcggaagcaaagcggcggcaccgcgcgagagaggcatggcgacgaccgcgaccctccccttctcctgctcctccaccctccaaaccctaacccgcaccatccccctccgcctccgcctccaccgccgccgcttcctccaccacctcccctccctcgctgccctcccgaggctcccgctcccgcgacctcccctcctcccccacgcgcgccgccacgtctcggcgtccgcggcgcccaacggcgcgtcctccgagggggagtacgactacgacctcttcaccatcggcgccgggagcggcggggtccgggcctcgcgcttcgcctccacgctctacggcgcccgcgccgccgtctgcgagatgcccttcgccaccgtcgcctcggacgacctcggtggagtcggcggcacatgtgtgcttcgtgggtgtgttccaaagaaattattagtgtatggatccaagtactctcatgagtttgaagagtctcatggctttgggtgggtgtatgaaactgatccaaagcatgactggaacactctgattgccaacaaaaatacagagctgcagcgccttgttggcatttacaagaatattttaaacaactcaggagttactctaattgaaggccgtggaaagatagttgatccacatactgtaagtgtagatggaaagctctacactgctaggaacatacttatagctgttggtgggcgaccatcgatgccaaatatcccaggaatagagcatgttatagattctgatgctgcactggatctaccttcaaaacctgagaaaattgcaatagtgggaggtggatatattgctctggagtttgctggaattttcaatggcttaaaaagtgaggtacatgtgtttattcggcagaagaaagttttaagagggtttgatgaagaggtcagagatttcatcgctgaacagatgtctctaaggggcatcacatttcatactgaacagagtcctcaagctataaccaaatcaaatgatggtttgctatctctgaagacaaacaaagaaactattggtgggttctcacatgttatgttcgcaacaggtcgtaaaccaaacacaaagaaccttggactagaggaggttggggtgaaattggacaagaacggagcaataatggttgatgagtattctcgaacctcagttgattcaatttgggcagtgggagatgttactgatagggtcaacctgacaccagttgcacttatggaaggtggtgcatttgcaaaaacagtgtttggtgatgaacctaccaaaccagattacagagctgtaccatctgccgttttctcccaaccacccatcggacaagttggtcttactgaagagcaggctattgaggagtatggagatgttgatatctatacagcaaacttcaggccacttagggcaactctctctggattacctgatcgcattttcatgaaactcattgtgtgtgctacaacaaacaaagttgtaggagtacacatgtgtggtgaagacgcacctgagataattcagggagttgcaattgctgttaaagctgggctgacaaagcaagattttgatgccactattggcattcacccaacatctgcagaggaatttgtcacaatgagaaatgcaactagaaaagttcggagaagcacaacagatgaggtagaatctaaagataaggttgttactcagaactagtacagataggaggcattctcagagggacttctctacttccgagcagctgatttacactgggcggacaatttttttttgtagcggtatccacggaaaggaaacccatgacaggaagccagcaaacttgtatcatagcgctgactggcattctctgatcccctttttgcatctattgtagcttgaacacggtgatacactattagctgctgttttccttctcttggttgaaataagtgctgcaccatgtgagtaccacagcctggaaattttgtaagaaaaaaaagaaatattattttggtagtacaactcagcctaatctgaattttacatcatatctgtgctagcatttcctaatatgttgaaattttgcggcaaaagatgcatatttctttttga

SEQ ID NO: 1556 - DNA, 2101 bp, Oryza sativa
acatcatcgccttcgcttctcctctctcctccccacactgtcggaagtcggaagcaaagcggcggcaccgcgcgagagaggcatggcgacgaccgcgaccctccccttctcctgctcctccaccctccaaaccctaacccgcaccatccccctccgtctccgcctccaccgccgccgcttcctccaccacctcccctccctcgctgccctcccgaggctcccgctcccgcgacctcccctcctcccccacgcgcgccgccacgtctcggcgtccgcggcgcccaacggcgcgtcctccgagggggagtacgactacgacctcttcaccatcggcgccgggagcggcggggtccgggcctcgcgcttcgcctccacgctctacggcgcccgcgccgccgtctgcgagatgcccttcgccaccgtcgcctcggacgacctcggtggagtcggcggcacatgtgtgcttcgtgggtgtgttccaaagaaattattagtgtatggatccaagtactctcatgagtttgaagagtctcatggctttgggtgggtgtatgaaactgatccaaagcatgactggaacactctgattgccaacaaaaatacagagctgcagcgccttgttggcatttacaagaatattttaaacaactcaggagttactctaattgaaggccgtggaaagatagttgatccacatactgtaagtgtagatggaaagctctacactgctaggaacatacttatagctgttggtgggcgaccatcgatgccaaatatcccaggaatagagcatgttatagattctgatgctgcactggatctaccttcaaaacctgagaaaattgcaatagtgggaggtggatatattgctctggagtttgctggaattttcaatggcttaaaaagtgaggtacatgtgtttattcggcagaagaaagttttaagagggtttgatgaagaggtcagagatttcatcgctgaacagatgtctctaaggggcatcacatttcatactgaacagagtcctcaagctataaccaaatcaaatgatggtttgctatctctgaagacaaacaaagaaactattggtgggttctcacatgttatgttcgcaacaggtcgtaaaccaaacacaaagaaccttggactagaggaggttggggtgaaattggacaagaacggagcaataatggttgatgagtattctcgaacctcagttgattcaatttgggcagtgggagatgttactgatagggtcaacctgacaccagttgcacttatggaaggtggtgcatttgcaaaaacagtgtttggtgatgaacctaccaaaccagattacagagctgtaccatctgccgttttctcccaaccacccatcggacaagttggtcttactgaagagcaggctattgaggagtatggagatgttgatatctatacagcaaacttcaggccacttagggcaactctctctggattacctgatcgcattttcatgaaactcattgtgtgtgctacaacaaacaaagttgtaggagtacacatgtgtggtgaagacgcacctgagataattcagggagttgcaattgctgttaaagctgggctgacaaagcaagattttgatgccactattggcattcacccaacatctgcagaggaatttgtcacaatgagaaatgcaactagaaaagttcggagaagcacaacagatgaggtagaatctaaagataaggttgttactcagaactagtacagataggaggcattctcagagggacttctctacttccgagcagctgatttacactgggcggacaatttttttttgtagcggtatccacggaaaggaaacccatgacaggaagccagcaaacttgtatcatagcgctgactggcattctctgatcccctttttgcatctattgtagcttgaacacggtgatatactattagctgctgttttccttctcttggttgaaataagtgctgcaccatgtgagtaccacagcctggaaattttgtaagaaaaaaaagaagtattattttggtagtacaactcagcctaatctgaattttacatcatatctgtgctagcatttcc

SEQ ID NO: 1557 - DNA, 2179 bp, Sorghum bicolor
ctctccacacacacactagacgaatcatctatctggccaggcctcgcctcgcctcgcctccccgctccctcccctcccccacactctcggtctctcggaagcggcgccgccgccgccgcagcggcgaggagccagccatggcagcgcacgcgacgctccccttctcctgctcctccacgctgcaaaccctgacccgcaccctctccccgcgcgggacccaccagctccgccgcggcttcctccgcctcccctcactcgccgcgctcccgaggctcgcccgcccctgccgccgccacgtctcggcgtccgcggctgcggctcccaacggcgcctccgccgagggggagtacgactacgacctcttcaccatcggagccgggagcggcggcgtccgtgcgtcgcgctttgcttccacgctccacggcgcgcgcgtcgccatctgcgagatgcccttcgccacgatcgcctcagacgagctcggtggcctcggcggcacatgtgtgcttcgtggatgtgttccaaagaaactgctggtgtatggatccaagtactctcacgagtttgaagagtctcgtggctttggatggacatatgagactgacccgaagcatgattggaacactctcatagccaataaaaatactgagctgcagcgcctagttggcatttacaggaatattttaaacaatgcaggagtcactctgattgaaggccgtggaaagatagttgatgctcatactgtcagtgtgaatggtaagctctacactgctaagcacatactagttggtgttggtggccgaccatcgatgccagatatccctggtatagagcatgttatagattcagatgcagcactggatttgccttcaaaacctgagaaaattgcaatagtgggaggtgggtatattgctttggagtttgctggcattttcaatggcttaaaaagtgaagtccatgtgtttattcggcagaagaaagttttaagaggatttgatgaagaggttagagatttcgtcgctgaacaaatgtctttaaggggcatcacatttcatacagaagagagccctcaagctataactaaatcaaatgatggtctgttatctctgaagacaaataaagaaacttttggtgggttctcacatgtaatgttcgcaacaggtcgcagaccaaatacaaagaaccttggactggaagaggtgggggtcgaaatggataagaatggtgcgatagtggttgatgagtattctcgtacctcagttgattccatttgggctgtgggagatgttaccaatagggtcaacctgacaccagttgcactgatggagggtggggcatttgcgaaaactgtctttggcaatgaacctaccaaaccagattacagaactataccttctgctgtgttctcccaaccaccaattggacaagttggtcttactgaggagcaggcaatcgaagagtatggagatgttgatgtctttgttgccaacttcaggcctctcaaggccactctgtctggactacctgatcgtgtactaatgaagattcttgtgtgcgctacatcaaacaaagttgtaggagtgcacatgtgtggtgatgatgcacctgagataattcagggaattgcgattgctgttaaagctgggttgacaaaacaagattttgatgccaccattggcattcacccaacatctgctgaggaattcgtcacaatgaggagtgcaactagaaaaattcggaaaaaatctgcagatcaggtagaatctaaagatgaggttgtaagtaagcagtagataccaatttttcctaggaggtgttctcgggggaactattcctgttgcaggacaacagctggacggaattttggaattacacgtgcagagtagcagaaataactgctaggaatttctggaaattcatgttagggaaccagcgattctgtatcgtagtatggctgtacatacctgtccgctgagctattatcctattcctttgtcttgtacgttggaataaaatgcagcaaatgcttgccttacggtcaggaaattttgtaataagtacaaggaaatgcgccttcctaagcatttgctatgatatttgacaaacaaaattgcctgtttttcttttcaagaattgagctaatgatctctgcgtttgaatatttttttcttgtacactaaaa

SEQ ID NO: 1558 - DNA, 2033 bp, Sorghum bicolor
cctccccgctccctcccctcccccacactctcggtctctcggaagcggcgccgccgccgccgcagcggcgaggagccagccatggcagcgcacgcgacgctccccttctcctgctcctccacgctgcaaaccctgacccgcaccctctccccgcgcgggacccaccagctccgccgcggcttcctccgcctcccctcactcgccgcgctcccgaggctcgcccgcccctgccgccgccacgtctcggcgtccgcggctgcggctcccaacggcgcctccgccgagggggagtacgactacgacctcttcaccatcggagccgggagcggcggcgtccgtgcgtcgcgctttgcttccacgctccacggcgcgcgcgtcgccatctgcgagatgcccttcgccacgatcgcctcagacgagctcggtggcctcggcggcacatgtgtgcttcgtggatgtgttccaaagaaactgctggtgtatggatccaagtactctcacgagtttgaagagtctcgtggctttggatggacatatgagactgacccgaagcatgattggaacactctcatagccaataaaaatactgagctgcagcgcctagttggcatttacaggaatattttaaacaatgcaggagtcactctgattgaaggccgtggaaagatagttgatgctcatactgtcagtgtgaatggtaagctctacactgctaagcacatactagttggtgttggtggccgaccatcgatgccagatatccctggtatagagcatgttatagattcagatgcagcactggatttgccttcaaaacctgagaaaattgcaatagtgggaggtgggtatattgctttggagtttgctggcattttcaatggcttaaaaagtgaagtccatgtgtttattcggcagaagaaagttttaagaggatttgatgaagaggttagagatttcgtcgctgaacaaatgtctttaaggggcatcacatttcatacagaagagagccctcaagctataactaaatcaaatgatggtctgttatctctgaagacaaataaagaaacttttggtgggttctcacatgtaatgttcgcaacaggtcgcagaccaaatacaaagaaccttggactggaagaggtgggggtcgaaatggataagaatggtgcgatagtggttgatgagtattctcgtacctcagttgattccatttgggctgtgggagatgttaccaatagggtcaacctgacaccagttgcactgatggagggtggggcatttgcgaaaactgtctttggcaatgaacctaccaaaccagattacagaactataccttctgctgtgttctcccaaccaccaattggacaagttggtcttactgaggagcaggcaatcgaagagtatggagatgttgatgtctttgttgccaacttcaggcctctcaaggccactctgtctggactacctgatcgtgtactaatgaagattcttgtgtgcgctacatcaaacaaagttgtaggagtgcacatgtgtggtgatgatgcacctgagataattcagggaattgcgattgctgttaaagctgggttgacaaaacaagattttgatgccaccattggcattcacccaacatctgctgaggaattcgtcacaatgaggagtgcaactagaaaaattcggaaaaaatctgcagatcaggtagaatctaaagatgaggttgtaagtaagcagtagataccaatttttcctaggaggtgttctcgggggaactattcctgttgcaggacaacagctggacggaattttggaattacacgtgcagagtagcagaaataactgctaggaatttctggaaattcatgttagggaaccagcgattctgtatcgtagtatggctgtacatacctgtccgctgagctattatcctattcctttgtcttgtacgttggaataaaatgcagcaaatgcttgccttacggtcaggaaattttgtaataagtacaaggaaatgcgccttcctaagcatttgctat

SEQ ID NO: 1559 - DNA, 2794 bp, Panicum virgatum
cagacgaatcatctatctggcctcctctctccgcttcctgccttcctcccctccctagactctaggaagcggcggcgctgccgctgcggtgtggtcggccagagcgagagccacaggcttggcccagccatggcggcgcacgcgaccatccccttctcctgctcctccacgctccaaaccctatcccgctccctctcctcgcgcggggccctccaccaccgccggggcttcctccgcctcccctccctcgccgccctcccgaggctcgcccgcgccccccgcccctgccgccgccacgtctcggcgtctgccgcggcgtccccgaacggcgcctccgccgagggggagtacgactacgacctcttcaccatcggcgcggggagcggcggcgtgcgcgcgtcgcgcttcgcctccacgctctacggcgcgcgcgtcgccatctgcgagatgcccttcgccaccatcgcctcggatgagcacggcggcctcggcggcacatgtgtgcttcgtggctgtgttccaaagaaactgttggtgtatggatccaagtattcacacgtgttcgaagagtctcatggcttcggatggacatatgacactgatccgaagcatgactggagcactctcatagccaacaaaaatacagagctgcagcgcctagttggtatttacaagaatatcttaaacaatgcaggagtcacactaattgaaggccgtggaaagatagttgatcctcatactgttagcgtgaatggtaagctctacacagctaagaacatactaattggtgttggtggccgaccatcgatgccagatatccccggaatagagtatgctatagattcggatgctgcactggatttgccctcaaaacctgagaaaattgcaatagtggggggcgggtatattgctttggagtttgctggcattttcaatggcttaaaaagtgacgtccatgtgtttattcggcagaagaaagttttaagagggtttgatgaagaggtcagagatttcattgctgaacagatgtctttaaggggaatcacatttcatactgaacagacccctcaagctgtgactaaatcaaatgatctgctatctttgaagaccaataaagaaactattggtgggttctcacatgtaatgtttgcaacaggtcgtagaccgaatacaaagaaccttggactagaagaggtgggggttgaaatggataagaatggtgcgattgtggttgatgagtactcccatacctcagtcgattcaatttgggcggtgggagacgttaccaacaggattaacctcaccccaattgcattgatggagggaggggcatttgcgaaaacttgctttggtaatgaacctaccaaaccagattacagagctgtaccttctgctgtgttctcccaaccaccaattggacaagtaggtctttctgaggagcaggctattgaagagtatggagatgttgatgtattcgttgccaacttcaggcctctcagggccactctctctggactacctgaccgtgtattaatgaagattattgtttgtgctacaacagacaaagttgtaggagtgcacatgtgtggtgatgatgcacctgagataattcaggggattgcaattgctgttaaggctggcttgacaaagcaagattttgatgccactattggcattcacccaacatctgcagaggaattcgtcacgatgaggaatgcgactagaaaaattcggagaagttctgcagatcaggtagaatctaaagatgaggttgcaactaagtagtagatatcattctatgtaggagcattgtaggagtagtattcctgttccaggacaaaagcagaatgtaattttggaaatacacgggtgagtagcagtacggctagcagtttctgagaaatccatgttagcaaactagcgaaggtgtatcatagaaatgacctttttctgtcagcttgagccgttgccctatgtcttcccattatttgaaataaaatgccgcagatgtttgtcttacagtctggaaattttgtaataagtaaggaatgctgcttcatgagcattcggttatatttgtcaggcacttaacaattttaggatgatcttaacatttataaatgtttcttgtacagaaaaaaaagattatggtggggggtatggccctgtatcttgctatcgtgcacacattgtagcttccttatcattagacccaagttggatatttgaatttttacacggtttttgttgtggatctccggtgttataaataatgaacttaactgagaaccaagtatgtttgtataccatgcacgcggcacgcctgtaccgtacgtaggtgtatgtgtgcatgggtttgaacgttgaatgtctgtgccatgcttcgttgcctgtcgggcgtgtcaacttgaactggtcgcagtctgatagctcgggtagggagtcgtgcatatacaatggacttcccctcggactgtgccactgccgtactgttccgtatcacacggtgtttggctcggttctatcgatccggtcttgtgttcttggcgcgtgcatacatacgtagttactttgtaatcttgtgtatgtttcaagtttcaaccaacacggaacatactgagtaggtacgttggacttttactgttccacaagcacaggacggtccgacggtgcttgtgtgtacttgcttctcatgacctagtatcacggtcacacttggacatctgtgtggcagctagctcgggggcgactgaattagatcccttcaaactgtgtgtcattagttcaaattaaa

SEQ ID NO: 1560 - DNA, 2364 bp, Panicum virgatum
agagtaatcttctatctggcctcctctctccgcttcctcccctccccagactctaggaagcggcggcgccgccgctgcggtgaggtcggccagagcgagagccgcaggccaccgccagccatggcggcgcacgcgaccatccccttctcctgctcctccacgctccaaaccctatcccgctccctctccgcgcgcggggtcctccacctccgcgggggcttcctccgcctcccctccctcgccgccctcccgaggctcgcccgggatccccgcccctgccgctgccacgtatctgcgtctgccgcggcgtccccgaacggcgcctccgccgagggggagtacgactacgacctcttcaccatcggcgccgggagcggcggcgtgcgcgcgtcgcgcttcgcctccacgctctacggcgcgcgcgtcgccatctgcgagatgcccttcgccaccgtcgcctcggatgagcacggcggcctcggcggcacatgtgtgcttcgtggatgtgttccaaagaaattgttggtgtatggatctaagtattcacatgagttcgaagagtctcatggcttcggatggacatatgagactgatccaaagcatgactggagcactctcatagccaacaaaaatacagagctgcagcgcctagttggtatttacaagaatatcttaaacaatgcaggagtcacactaattgaaggccgtggaaagatagttgatcctcatactgttagcgtgaatggtaagctctacacagctaagaacatactaattggtgttggtggccgtccatcgatgccagatatccccggaatagagtatgctatagattcggatgctgcactggatttgccctcaaaacctgagaaaattgcaatagtggggggtgggtatattgctttggagtttgctggcattttcaatggcttaaaaagtgacgtccatgtgtttatccggcagaagaaagttttaagagggtttgacgaggaggtcagagatttcattgctgaacagatgtctttaaggggcatcacatttcatactgaacagacgcctcttgctgtaactaaatcaaatgatgatctgttatctctgaagaccaataaagaaactattggtgggttctcacatgtaatgtttgcaacaggtcgcagaccgaatacaaagaaccttggactagaagaggtgggggtcgaaatggataagaatggtgcaattgtggttgatgagtattctcgtacctcagtcgattcaatttgggctgtgggagacgttaccaataggatcaacctgaccccagttgcactgatggagggaggggcatttgcgaaaacttgctttggtaatgaacctaccaaaccagattacagagttgtaccttctgctgtgttctcccaaccgccgcttggacaagtaggtcttactgaggagcaggctattgaagagtatggagatgttgatgtcttcgttgccaacttcagacctctcaaagccactctctctggactacctgatcgtgtattaatgaagattattgtttgtgctacaacaaacaaagttgtaggagtgcacatgtgtggtgatgatgcacctgagataattcagggaattgcaattgctgttaaggctggcttgacaaagcaagattttgatggcactattggcattcacccaacatctgcagaggaatttgtcacaatgaggaatgcaactagaaaaattcggagaagttctgcagatcaggtagaatctaaagatgagattgcaactaagcagtagatatcattttacgtagaggcattgtgggaggagtattcctgttgcaggacaaaagcggaatgtaattttggaaatacacgggtgagtagcagtatggctggcagtttctgaggaatccatgttagcaaaccagcgaaggtgtatcatagaaatgacttttccctgtcagcttgagccattaccctatgtcttctgttacttgaaataaaatgcggcagaagtttgtcgtgcagtctggaaattttgtaataagtatggaatgctgcttcatgagcattcggttatatttgttaggcacttaccaattttaggatgttagctgatgatcataatatttataaatgtttcttgtacagaaaaaaaaatatgattctggtgggggtccggccctttatcttgctatcgtgctcacattatagcttcctttatcattattaggcccaagttgtaatatttgaattttacacgatttttgtcgtggatttccggtgttatatataatgggcttaagtgagaaccaagtgtgtctgtatatcgttcccaaaaaaaaaacagtatgtatgtatacagtatgcacgtggt

SEQ ID NO: 1561 - DNA, 2035 bp, Zea mays
cacaccactacaccagacgaaccgtctatctggccaggcctcgccacgcctatccgcaccctcccctcccctcccctcccctcccctactctctcggaagcggcgccgctgccgccgcagcggcgaggagccagccatggcggcgcacgcgacgctccccttctcctgctcctccacgctgcagaccctgacccgcaccctctcctcgcgcggggctcaccagctccgcgggggcttcctccgcctcccctccctcgcggcgctcccgaggctggcccacccctgccgccgccacgtctcggcgtccgctgcggcggcgcccaatggcgcctccgttgagggggagtacgactacgacctcttcaccatcggtgccgggagcggcggcgtccgcgcgtcgcgcttcgcctccgcgctctacggctcgcgcgtcgccatctgcgagatgcccttcgccacgatcgcctcggacgagctcggtggcctcggcggcacatgcgtgcttcgtggatgtgttccaaagaaattgctagtgtacgcatccaagtactctcacgagtttgaagagtctcgtggatttggatggacatatgagactgatccgaagcatgattggagcactctcatagccaataaaaatacagagctgcagcgcctggttggcatttacaggaatattttaaacaatgcaggagtcactctgatcgaaggtcgtggaaagatagtcgatcctcatactgtcagtgtgaatggtaagctctacactgctaagcacatactagttagtgttggtggccgaccatcgatgccagatatccctggtatagagcatgttatagattcggatgctgcgctggatttgccttcaaaacctgagaaaattgcaatagtgggaggtgggtatattgctttggagtttgctggcattttcaatggcttaaagagtgaagtccatgtgtttattcgtcagaagaaagttttaagaggatttgatgaagaggttagagattttgtcgctgaacaaatgtctttaaggggcatcacgtttcatacagaacagagccctcaagctataactaaatcaaatgatggtctgttatctttgaagaccaataaagaaaattttggtgggttctcacatgtaatgtttgcaacaggtcgcagaccaaattcaaagaaccttggactggaagcggtgggggttgaaatggataagaacggtgcaatagtggttgatgagtattcacgtacctcagttgattccatttgggctgttggagatgttaccaatagggtcaacctgacaccagttgcactgatggagggtggggcatttgcgaaaactgtctttggcaatgaacctaccaaaccagattacagagctataccttctgctgtgttctcccaaccaccaataggacaagttggtcttactgaggagcaggcaattgaagagtatggagatgttgatgtcttcgttgccaacttcaggcccctcaaggccactctgtctggactacctgatcgtgtattgatgaagattcttgtgtgcgctacgtcaaacaaagttgtaggagtgcacatgtgtggtgatgatgcacctgagataattcagggaattgcaattgctgttaaagctggattgacgaagcaagattttgatgccaccattggcattcaccccacatccgctgaggaattcgtcacaatgaggagcccgactagaaaaattcgaaaaagttctacagatcaggtagaatctaaagatgaggttgtaagtaagcagtagatagcattttttcctaggaggtgttctcgggggagggagtattcctgctgcaggacgacagctggacggaattttggaatacaccggcagagtagctgaaataacggctaggaatttctgagaaatttcatgttagggaaccaacgatgctgtttaatagaattggctgtacatacctgtccgccgagctattttcctgtgtcttgtacgttgaaataaaatactgcaaatgtttgccttacggtc

SEQ ID NO: 1562 - DNA, 2016 bp, Zea mays
acgcctatccgcaccctcccctcccctcccctcccctcccctactctctcggaagcggcgccgctgccgccgcagcggcgaggagccagccatggcggcgcacgcgacgctccccttctcctgctcctccacgctgcagaccctgacccgcaccctctcctcgcgcggggctcaccagctccgcgggggcttcctccgcctcccctccctcgcggcgctcccgaggctggcccacccctgccgccgccacgtctcggcgtccgctgcggcggcgcccaatggcgcctccgttgagggggagtacgactacgacctcttcaccatcggtgccgggagcggcggcgtccgcgcgtcgcgcttcgcctccgcgctctacggctcgcgcgtcgccatctgcgagatgcccttcgccacgatcgcctcggacgagctcggtggcctcggcggcacatgcgtgcttcgtggatgtgttccaaagaaattgctagtgtacgcatccaagtactctcacgagtttgaagagtctcgtggatttggatggacatatgagactgatccgaagcatgattggagcactctcatagccaataaaaatacagagctgcagcgcctggttggcatttacaggaatattttaaacaatgcaggagtcactctgatcgaaggtcgtggaaagatagtcgatcctcatactgtcagtgtgaatggtaagctctacactgctaagcacatactagttagtgttggtggccgaccatcgatgccagatatccctggtatagagcatgttatagattcggatgctgcgctggatttgccttcaaaacctgagaaaattgcaatagtgggaggtgggtatattgctttggagtttgctggcattttcaatggcttaaagagtgaagtccatgtgtttattcgtcagaagaaagttttaagaggatttgatgaagaggttagagattttgtcgctgaacaaatgtctttaaggggcatcacgtttcatacagaacagagccctcaagctataactaaatcaaatgatggtctgttatctttgaagaccaataaagaaaattttggtgggttctcacatgtaatgtttgcaacaggtcgcagaccaaattcaaagaaccttggactggaagcggtgggggttgaaatggataagaacggtgcaatagtggttgatgagtattcacgtacctcagttgattccatttgggctgttggagatgttaccaatagggtcaacctgacaccagttgcactgatggagggtggggcatttgcgaaaactgtctttggcaatgaacctaccaaaccagattacagagctataccttctgctgtgttctcccaaccaccaataggacaagttggtcttactgaggagcaggcaattgaagagtatggagatgttgatgtcttcgttgccaacttcaggcccctcaaggccactctgtctggactacctgatcgtgtattgatgaagattcttgtgtgcgctacgtcaaacaaagttgtaggagtgcacatgtgtggtgatgatgcacctgagataattcagggaattgcaattgctgttaaagctggattgacgaagcaagattttgatgccaccattggcattcaccccacatccgctgaggaattcgtcacaatgaggagcccgactagaaaaattcgaaaaagttctacagatcaggtagaatctaaagatgaggttgtaagtaagcagtagatagcattttttcctaggaggtgttctcgggggagggagtattcctgctgcaggacgacagctggacggaattttggaatacaccggcagagtagctgaaataacggctaggaatttctgagaaatttcatgttagggaaccaacgatgctgtttaatagaattggctgtacatacctgtccgccgagctattttcctgtgtcttgtacgttgaaataaaatactgcaaatgtttgccttacggtcatgaaattttgcaataaccaataagt

SEQ ID NO: 1563 - DNA, 2016 bp, Pennisetum glaucum
cctttccgcctctccgcttcctcccctccccacactcgaggaagcggcggctctcccgctgcggtgaggtcggccggagcgagagccagccatggcggcgcacgcgacgctccccttctcctgctcgtccacgctccagaccctaacccgctccctctcctcgcgcggggccctccaactccgccgcgggttccaccaccgccgccgcagcctcccctccctcgccgcgctcccgaggctcccccgccgccacgtctcggcgtccgccgcggcgtccccgaacggcgcctcccccgagggggagtacgactacgacctcttcaccatcggcgccgggagcggcggcgtgcgcgcgtcgcgcttcgcctccacgctctacggcacgcgcgtcgccatctgcgagatgcccttcgccaccgtcgccacggatgagctcggtggcctcggcggcacatgtgtacttcgtgggtgtgttccaaagaaactgttggtgtatggatccaagtactctcacgagttcgaggagtctcatggctttggatggtcatatgagactgaaccgaagcatgactggagcactctcatagccaataaaaatacagagctgcagcgcctagttggtatttacaagaatatattgaacaatgcaggagtcactctaattgaaggacgtggaaagatagttgatcctcatactgttagcgtgaatggtaagctctacactgctaagaacatactaattggtgttggtggccggccatcaatgccagatatccctggtatagagcatgctatagattcggatgctgctctggatttgccctcaaaacctgagaaaattgcaatagtgggaggcgggtatatcgctttggagtttgctggcattttcaatggcttaaaaagtgaggtccatgtgtttattcggcagaagaaagttttaagagggtttgatgaagaggttagagatttcgttgctgaacagatgtcattaaggggcatcacatttcatactgaacagacccctcaagctgtaactaaatcagatgatggcctgttatctctgaagaccaataaagaaactattggtgggttctcacatgtaatgtttgcaaccggtcgcagaccaaatacaaagaaccttggactagaagaggtgggggtcaaaatggataagaatggtgcaatagtggttgatgagtattctcgtacgtcagttgattcaatttgggctgtgggagacgttaccaatagaatcaatctgaccccagttgcactgatggagggaggggcatttgtgaaaactgtctttggcaatgaacctaccaaacctgattacagagctgtaccttctgccgtgttctctcaaccaccaattggacaagttggtcttagtgaggagcaggctatcgaagagtatggagatgttgatgtctttgttgccaacttcaggcctcttaaggccactctctctggactacctgatcgtgtattcatgaagattattgtttgtgctacaacaaacaaagttgtaggagtgcacatgtgtggtgatgacgcacctgagataattcagggcatcgcaattgctgttaaggctggcttgacaaagcaagattttgatgtcactattggcattcacccaacatctgcagaggagtttgtcacaatgaggaatccaactagaaaaattcggagaagttctgcagatcaggtagaatctaagaatgaggttgcaactaagcagtagatatcattttacataggaggcattttcagatgaagggttcctgttgcaggacagaaaccgaatggaattttggaaatgcacggtcgaatatggctagcagtttcttagaaatccatgttagcaaaccggcgatggtgcatgatagaaatggctgtttccctgtcagcttgagctaaaattaccctatttctttcatactttgatcgaaataaactgctgcaaatgtttgtcttacagcctggaatttttttgtaataagcaaggaatgc

SEQ ID NO: 1564 - DNA, 1758 bp, Secale cereale
ggagcggcggcgtgcgggcctcgcgcttcgcctccaccctctacggcgcccgcgccgccatctgcgagatgcccttctccaccatctccgcggacgacctcggcggcctcgggggcacatgtgtgcttcgtggttgtgttccgaagaaactgttagtgtatgcatccaagttctctcatgagtttgaagagtctcatggctttggatggacatatgatactgatccaaagcatgactggagcactctgatagccaacaaaaatacagagctgcaacgcttagttggcatttacaaaaatattttaagcaacgcaaacgtcgatctaattgaaggccgtggaaaggtggttgatccacatactgttagtgtggatggcaagctctacaccgctaagaacatacttatagctgttggtggtcgaccatcgatgccagatatcccaggaatagagcatgttatagattccgatgctgcgctagatctgccttcaaaacctgagaaaattgcaatagtgggaggtggatatattgccttggagtttgctggcatttttaatggcttaaagagtgacgttcatgtgtttattcggcaaccgaaagttttaagagggtttgatgaggaggtcagagatttcgttactgaacagatgtctttaagaggtatcacatttcatactgaacatagtcctcaagctataaccaaatcaaatgatggtttactatctctgaagacaaacaaagaaactattggtgggttttcacatgtaatgtttgcaacaggtcgtaaacccaatacgaagaaccttggactggaggaggttggggttaaaatggacaagaagggggctatagtggtcgatgagtattctcgaacctcagtggattcaatttgggctgttggagatgttactgataggatcaacttgactccggttgcactgatggaaggtggagcatttgcgaaaactttattcggtgatgaacctaccaaaccagagtacagagctgtaccagctgctgttttctcccaaccacccattgggcaagttggccttaccgaggagcaggctattgaagagtatggagatgttgatgtctacttatcaaacttcagacctcttagagccactctttctggattacctgatcgtgtactaatgaagctcattgtgtgtgctaccacgaacaaagttgtaggagtgcatatgtgtggtgatgatgcccctgagataatccagggaattgcaattggtgttaaagccgggttaacgaagcaagattttgatgtcactgttggcgttcacccaacatctgcagaggaatttgtcactatgaggagtccaactagaaaagtgcgagaaaaactgcagctgaggcagagtcgaaggacgaggtcgtcactcagaagtagataatgccgttgaccgctgtacatagaagtcattctcgaggatgccaccggcggaaatctgactggaaatacaggctaaacagtgcaccgttgcctgagaaatctgtgacaatgaaccctctgaagatgtacgataacgatgagttgctacctgctttttgccctcccatttgcgcacttctttccttcctgcttttgaggcttgagcacgctggtcgttgagtttcttttccccatctgctattcatgtgtaataaatggtacaatgtggctgtgtgggtatcatcaaccttgaaacatcgatcgggaatactaccagaaaaccagtgtatagagttttaacagtc

SEQ ID NO: 1565 - DNA, 1803 bp, Triticum aestivum
cgccgccatctgcgagatgcccttctccaccatctccgcggacgacctcggcggcctcggggggacatgtgtgcttcgtgggtgcgttcccaagaaactgttagtgtatgcatccaagttctctcatgagtttgaagagtctcatggctttggatgggcgtatgatactgatccaaagcatgactggagcactctgatagccaacaaaaatacagagctgcaacgcctagttggcatttacaaaaatattttaaagaacgcaaacgtcgatctaattgaaggccgtggaaaggtggttgatccacatactgttagtgtggatggcaagctctacactgctaagaacatacttatagctgttggtggtcgaccatcgatgccagatatcccaggaatagagcatgttatagattccgatgctgcactagatctgccatcaaaacctgagaaaattgcaatagtgggaggtggatatattgccttggagtttgctggcatttttaatggcttaaaaagtgacgttcatgtgtttattcggcaaccgaaagttttaagagggtttgatgaggaggtcagagatttcgttgctgaacagatgtctttaaggggtatcgcatttcatactgaacatagtcctcaagctataactaaatcaaatgatggtttactatctctgaagacaaacaaagaaactattggtgggttttcacatgtaatgttcgcgacaggtcgtaaaccgaatacgaagaacctcggactggaggaggttggggttaaaatggacaagaagggggctatagtggttgatgagtattctcgaacctcagtggattcaatttgggctgttggagatgttactgataggatcaacttgactccggttgcactgatggaaggtggagcatttgcgaaaactttattcggtgatgaacctaccaaaccagagtacagagctgtaccagctgctgttttctcccaaccacccattgggcaagttggccttaccgaggagcaggctattgaagagtatggagatgttgatgtctacttgtcaaacttcagacctcttagagccactctttctggattacctgatcgtgtactaatgaagctcattgtgtgtgctactacgaacaaagttgtaggagtgcatatgtgcggtgatgatgcacctgagataatccagggaattgcaattggtgttaaagccgggttaacgaagcaagattttgatgtcactgttggcgttcacccaacatctgcagaggaatttgtcactatgaggagtccaactagaaaagttcgaagaaaaactgcagctgaggcagagtctaaggatgaggtcgtcgctcagaagtagataatgccgttgaccgttgtacatagaagtcattctcgaggatgccatcggccgaaacctgactggaaatacacagctaaagagtgccccgttgcctgagaaatctgtgacaatgaaccctctgaagatgtacgataacgatgagtttctacctctgttttttgcccctcccatttgcgcatttctttccttcctgcttgaggcttgagcacactggtctggtcgttgagtttcttttccccatctgctattcatgtgtaataaatggtacaatgtggctgtgtgggtatcatcaatcttgaaacatcgattcgaagtactagcagaaaaccagtgtatagagtttaactacccgcagatcgatctgcgaccaagttaattacccgtgtgtatgttttgtgtgttattttctttctgattcgagggaaaagcaatagtagctt

SEQ ID NO: 1566 - DNA, 1896 bp, Tragopogon dubius
agtgagaaagagatagaaagcgtagaacaaatttcgagatatttcccttcaaattctcgtaactaaaaattccttcacgagaataccaaaagatcgcaatgacgtgaaagttcattaaattcgactcatttataatctagaaaagctgttttctgatagaagaatccatggagtgttttggagctcgaaacatgtcgacaacaatggcggtttttacttgccctagattcatgaaatgtaatatcaagcacgagttttcgctactacaacatcgacgatttactagtttatcagcgtcgtcgtcggtgaggcaaattaagtgcagcgctaaaagcgaccgttgtgtagtggagaaacaagggatttccaaagaagaggaagaagattacgtgaaggccggtggatcggagctgctttttgttcaaatgcaacagaataagtcgatggaaagccagtctagtatttccgaaaagcttccacagataccaattggagattgcgttcttgatctggttgtaatcggttgtggtcctgctggccttgctcttgctgcagaatcagccaagctagggttaaacgttggacttattgggcccgatcttccttttacaaacaattatggtgtttgggaggatgaatttataggacttggacttgaggggtgtattgaacgtgtttggagggatacccttgtatatcttgatggcaatgatcccaatcccatccgcataggtcgtgcctatggacgtgtaaatcgcgatttacttcatgaggagttgttaagaaggtgtgtggagtcgggtgttacatatctgagctccaaagtggaaagaatcactgaagctccaaatgggtacagtcttattgaatgtgaaggcaatatcaccattccgtgcaggcttgctacggttgcatctggagcagcttctggaaagcttttggaatatgagctggggggtccccgtgtttgtgtgcaaacagcttatggtgtagaggttgaggttgaaaacaatccctatgacccaaacctaatggttttcatggactacagagactacacaaaacatcaaactccatctctagaagcaaaatatccaacattcctctatgtcatgcccatgtcaccaaccaaaatcttctttgaagaaacatgtctagcttcaaaagaagccatgcctttcaatcttttgaaaaccaaactcatgtcaagattaaaaaccctcggggtccgcataacccgaacttacgaagaggaatggtcttacatcccggtaggcggatcattgccaaatacagaacaaaagaatcttgcatttggggctgcagctagtatggtgcaccctgctacagggtattcagttgtcagatcattgtcagaagctcctaactatgcagcaataattgcaaagattttaagacaaggtcattctaaagacacgcttgctcttggaaaatactccaccaatatctcaaaacaagcttgggagaccctttggccacaagaaaggaaaagacaaagagctttctttttatttggactatcattcatcgtgcaaatggatattgaggggacacgaacatttttccgtacattcttccgtttgcctacttggatgtggtggggatttctggggtcttcattatcatcaacggatttagtattatttgcgttttatatgtttataatagcacctcacagtctgagaatggggctggttagacatctactttctgatcccacaggagcaaccatggtaagagcatatattaccacaacatagattataatactgcatatatataactttaatttctgttgtatccttaatcattaattatgtttccttaatttaatcttaatcaagtttttttatgacacgtggcaatttggatgta

SEQ ID NO: 1567 - DNA, 2049 bp, Arnica chamissonis
aaagagatagaaagcgtgaccggatttcgagttatttttcttccaattttctaaacagaattatacacgagaattgaaacatcgcaatgacgtgaaagttcatcgaactaaaatcaattgtgatttgtcgatttgatttgtaactgaagaatcaatggcgtgctttggagctcgacacatgacggcaacaatggcggtttttacgtgccctagattcatgaattataacatcagacacgaattttctttactacaacactgtagatttactagcttatcattgtcgtcgtcgtcgttgaagcagattaagtgcagcgctaaaagcgaccgcttagtagtggttaaagaagcgatttctgaagcagatgaggaagattatgtgaaagccggtggatcggaactgctttttgttcaaatgcaacagaaaaagtccatggatacacagtctaggctttccgaaaagctgccaaggataccgataggagattgtatactggatttggttgtaatcggttgtggacctgctggtcttgctcttgctgcagaatcagccaagctaggcttgaatgttggacttattgggcctgatcttccttttacaaataactatggtgtttgggaggatgaatttataggtcttggacttgaggggtgtattgaacatgtttggcgggatactgttgtatatcttgatgacaacgatcccatcctcataggtcgtgcctatggacgagttagtcgtgatttacttcatgaggagttgttgagaaggtgtgtggagtcaggtgtttcatatttgagttccaaagtggaacgaatcactgaagctccaaatggccacagtctcattgagtgcgaaggcaatatcacaattccatgcaggcttgctaccgttgcatctggagcagcttcagggaaacttttgcagtatgagcttggcggtccccgtgtttgtgttcaaacggcttatggtgtagaggtcgaggttgaaagcataccctatgatccaagcctaatggttttcatggattatcgagactacaccaaacacaaatctcaatcagtagaagcacaatatccaacattcctttatgtcatgcccatgtctccaactaaagtattctttgaggaaacttgtttggcttcaaaagaggccatgccttttgagttactgaaaacaaaactcatgtcaagattgaagacaatggggatcagaataaccaaaacctatgaagaggaatggtcttatattccagtaggtggatccttaccgaataccaagcaaaagaaccttgcatttggtgctgctgctagcatggtgcatccagccacagggtattcggttgtaagatcactgtcagaagctcctaattatgcggctgtaattgcaaaaattttaggacaaggaaattcaaaacagatgcttgatcttggaagatacacatccaacatctcaaagcaagcttgggaaacactttggccactggaaaggaaaagacagagagcattctttctctttggattagcgctgatcgtccagatggatatcgaggggacccgcacattcttccgtaccttcttccgcctgcccacctggatgtggtgggggtttcttggatcttcgttatcgtcaaccgacctgctagtatttgcgttttacatgtttatcatagcaccacatagcctgagaatgggtctggttagacatttgctttctgacccgacaggagcaattatggtaaaagcgtatctcacgatataaatcactctagtcacaggcggtttagattataggcacatcttgcatatatacactaatgtgtgttgtatccttacatcaacactatcatcaattatgtttcttggagtaacactatgaagtattggaaccaagaaccagaccctagtcaccgtacagtaccgtgggcctgtttataactggtttcgtcccaaattggactaggaactagactcaaatttagggcgagaactagattgtaaacctgtcccgatgctgttgggttcgttctgttcgtcggtgttattgat

SEQ ID NO: 1568 - DNA, 1792 bp, Centaurea maculosa
accaaaaaaacaaacacacagtaatggcgtgaaactgaatccaactgattccgatttcagaatttgatttgtgaacacaagtaagaagtaaattatggagtgcgttggagctcgaaacatgacggcaacaatggctgtttttacgtgccctagattcatgaactataacatcaggcatggattttcgttgctaaaacgtcgaagttttactagtttatcgttatcgtcttcttcgttgcagaaaattaagtgcagcgctagaaccgatggctgtgtggtggttaaggaaggtatttctgaagaggatgaagaggattatgtgaaggccggtggatcggagcttttgttcgttcaaatgcaacagaataaggctatggatagtcagtctaggctttccgagaagctgccacggattccaataggagattgcgtactggatttggttgtaattggttgtggtcctgctggccttgctcttgctgcggaatcagccaagctaggcttgaacgttggacttattggtcctgatcttccttttacaaataattatggtgtttgggaggatgaattcataggacttggacttgagggctgtattgaacatgtatggcgggatactcttgtatatctcgaagacaacgatcccatcctcataggtcgtgcctatggacgagttaatcgtgatttacttcatgaggagttgttgagaaggtgtgtggagtcaggtgtttcatatctgagctcaaaagtggaaaggattactgaagctccaaatggccacagtctcatcgagtgtgaaggcaatgtcacggttccatgcaggcttgctacggttgcatctggagcagcttcaggaaaacttttgcagtatgagcttgggggaccccgtgtttgtgttcaaacagcttatggtgtagaggttgaggttgaaaacaatccctatgatccaagcctaatggttttcatggattatagggactacaccaagaatacaacacaatcttctttagaagccaaatatccaacatttctttatgccatgcccatgtctccaactaaaatattcttcgaggaaacttgcctggcttcaagagaggccatgccttttgatctattgaagacaaagctcatgtctagattaaagacattggggatccgaataaccaaaacttatgaagaggaatggtcgtatattccagtaggtggatccttgccgaatacagaacaaaagaaccttgcatttggtgctgctgctagcatggtgcatccagccacaggatattcagtcgttagatcactctcagaggctcctaactatgcagcagtaatagcaaagattttaaggcaaggccactcaaaagagatgcttgttcagggtagacagacaatgaacatctcaaagcaagcttgggaaacactttggccactggagaggaaaagacagagagcattctttctctttggcttagcactcatcgtgcaactagatattgagggcacacgaacattcttccgtactttcttccgcttgcccacttggatgtggtgggggtttctaggatcttctctatcctcaacagacctagtactatttgcattttacatgtttatcatagcacctcaaagcctgaggatggcgctggttagacatctactttcagatcccacaggaggaaccatggtaaaagcatatctcaccatataggtatgcccatcctgtatatataaattagttaactagttaatcaccttatttgtgttgcataaacacaatgatcaaattatgaagcta

SEQ ID NO: 1569 - DNA, 1791 bp, Flaveria ramosissima
cattcaaaagctattgcgaaagagatagaagtcgtgaccgtatttccagatattttcaattttcattacaacagaattattcaccatcgcaatgacgtgatgcttcatcggccttaaattaattgcgattcccttgttgatttgatccgcaactgaactgaacaatcaatggagtgcttcagagctccacacatgacgccaacaatggcgccttttacgtgccctagattcatgagttacaacaccagacacggtttttcgttactaaggcattgtaggtttaccagcttttcctcctcgttgaagcaaattaagtgtagcgctaaaagcgtggtggtgaaagaagggatttctgaagcagatgaggaagattacgtgaaagccggtggatcggaactgctttttgttcaaatgcaacagaataagcctatggatacacagtctaggctttccgaaaagctgccaaggataccgataggagactgtttgctggatttggttgtgatcggttgtggtcctgctgggcttgctcttgctgcagaatcagccaagagaggcttgaatgttggacttattggacctgatcttccttttaccaataactatggtgtttgggaagatgaatttataggtcttggacttgaggggtgtattgaacatgtttggcgggatacagttgtatatcttgataacaatgatcccatcctcataggtcgtgcctatggacgagtcagtcgtgatttacttcatgaggagttgttgagaaggtgtgtggagtcaggtgtttcgtatttgagctccaaagtggaacggattactgaagctccaaatggccagagtctcatcgagtgtgaaggcaatatcacaattccatgcaggcttgctactgtagcctccggagcagcttcgggaaaacttttgcagtatgagcttggtggtccccgtgtttgtgttcaaacagcttatggtgttgaggttgaggttgaaagcttaccctatgatccaagcctaatggttttcatggattatagagactacaccaaacataaatctcaatcattagaagcaaaatatccaacattcctttatgtcatgccaatgtctccaactaaagttttctttgaggaaacttgtttggcttcaaaagaggccatgccttttgagttattgaagacaaaactcatgtcaagattaaagacactagggatccgaattaccaaaacttatgaagaagaatggtcttatattccagtaggtggatccttaccaaatacagagcaaaagaaccttgcatttggtgctgctgctagcatggtgcatccagccacaggatattcggttgtaagatcactgtcagaagctccaaattatgcagcagtaattgcaaagattttagggaaaggaaatccaaaacagatgcttgatcttggaagaaattcaaccaatatctcaaagcaagcttgggaaacactttggccgctggaaaggaaaagacagagagcattctttctctttggattagcactgattgtccagatggatattgaggggacccgtacattcttccggactttcttccgcttgcccacttggatgtggtgggggtttcttggatcttcgctatcctcaaccgacctgatagtatttgcgttttacatgtttataatagcaccacatagcttgaggatgggcctggttagacatttgctttctgacccgacaggagcaactatagtaaaagcgtatctcacaatataaatcactctagtggcagccggtttagattatatt

SEQ ID NO: 1570 - DNA, 1675 bp, Cirsium arvense
taatggagtgcgttggagctcgaagcatcacaacggcaacaatggcggtttttacgtgccctagattcatgaactataacatcaggcatggattttcgttgctaaaacgtagaaattttagtagcttatcgttatcgttatcgtcgtcgtcgttgaagcagattaagtgcagcggtagaactgatggatgtgtggtggttaaggaagggatttctgaagaggatgaagaggattatgtgaaggctggtggatcggagcttttgtttgttcaaatgcaacagaataaggctatggatagtcagtctaggctttccgagaagctgccacggataccaataggagattgcgtactggatttggttataattggttgtggtcctgctggccttgctcttgctgcagaatcagccaagctaggcttgaacgttggacttattggtcctgatcttccttttacaaataattatggtgtttgggaggatgaattcataggacttggacttgagggctgtattgaacatgtttggcgggatactcttgtatatctcgaagacaacgatcccatcctcataggccgtgcctatggacgagttaatcgtgatttacttcacgaggagttgttgagaaggtgtgtggagtcaggtgtttcatatctgagctcaaaagtggaaaggattactgaagctccaaatggccacagtctcatcgagtgtgaaggcaatgtcacggttccatgcaggcttgctacggttgcatctggagcagcttcaggaaaacttttgcagtatgagcttgggggaccccgtgtttgtgttcaaacagcttatggtgtagaggttgaggttgaaaacaatccctatgatccaagcctaatggttttcatggattatagagactacaccaagaatacaacacaatcttctttagaagccaaatatccaacatttctttatgccatgcccatgtctccaactaaaatattcttcgaggaaacttgcctggcttcaagagaggccatgcctttcgatctactgaagacaaagctcatgtctagattaaagacattggggatccgaataaccaaaacttatgaagaggaatggtcgtatattccagtaggtggatccttgccgaatacagaacaaaagaaccttgcatttggtgctgctgctagcatggtgcatccagccacaggatattcagtcgttagatcactctcagaagctcctaactatgcagcagtaatagcaaagattttaaggcaaggccactcaaaagagatgcttgttcagggtagacagacaatgaacatctcaaagcaagcttgggaaacactttggccactggagaggaaaagacagagagcattctttctctttggcttagcactcatcgtgcaactagatattgagggcacacgaacattcttccgtactttcttccgcttgcccacttggatgtggtgggggtttctaggatcttctctatcctcaacagacctagtactatttgcattttacatgtttatcatagcacctcaaagcctgaggatggcactggttagacatctactttctgatcccacaggaggaaccatggtaaaagcatatctcaccatataggtatggccatcctgtatatataaattaattaactagttcatcaccttatttgt

SEQ ID NO: 1571 - DNA, 1905 bp, Helianthus annuus
cgcgggggtgagaagagatagaaaccgtatttctttctagatatttctcttccaattttcctaactcagagccttattataacatctcaatgacgtgaacaacattcatattgcggttcgttaactgaagaatcaatggagtgttttggagctccacacatgactgcaacaatggcggcctttacgagccctagattcatgaattatagcatcagacgccagttttcgttactcaaacactgtaggtttacgactttatcttctccgtcatcgttgttgaagaggattaggtgtagcgctaagagcgataactgtgtagcggtgaaggaaggggtttcggaagcagaaaaggaagattatgtgaaagcaggtggatcggaactggtttttgttcaaatgcaacagaataagtgtatggagacgcagtctaggctttctcagaagctgccaaggataccgataggagagtgtgtactggatttggttgtaattggttgtggtcctgctgggcttgctcttgctgcagaatcagccaagcgaggcttgaatgtcggacttattgggcctgatcttccttttacaaataactatggtgtttgggaggatgaatttataggtcttggacttgaagggtgtattgagcatgtttggcgggatactgttgtatatcttgatgacaacgagcccatcctcataggtcgggcctatggacgagttagtcgtgatttacttcatgaggagttgctgagaaggtgtgtggagtcaggcgtttcatatctgagctccaaagtggaacggattactgaagctccaaatggccagagtctcattgagtgcgaaggcaatatcacaattccatgcaggcttgctaccgttgcatctggagcagcttcaggaaaacttttgcaatatgagcttggtggtccccgtgtttgtgttcaaacggcttatggtgtagaggtcgaggttgaaagcataccctatgatccaagtctaatggttttcatggattatcgagactacacgaaaaataaatctcaatcattagaagcacaatatccaacattcctttatgtcatgcccatgtctccaactaaagtattcttcgaggaaacctgtttggcttcaaaagaagccatgcctttcgagttattgaagacaaagctcatgtcaagattaaagacaatggggatccgaataaccaaaacttatgaagaggaatggtcgtatattccagtaggcggatcattaccgaacacagagcaaaagaaccttgcatttggtgctgctgctagtatggtgcatccagccacaggatattcggttgtaagatcactgtcagaagctcctaattatgcagcggtaattgcaaagattttaggacaaggaaattcaaaacaaatggttgatcttggaagatacacaaccaacatctcaaagcaagcttgggaaacactctggccgctagaaaggaaaagacagagagcattctttctctttggattagcgctgattgtccagatggatattgaggggacccgtacattctttcggactttcttccgattgcccacttggatgtggtgggggtttcttggatcttcgctatcctcaaccgacctaatagtatttgcgttttacatgtttatcatagcaccacatagcctgagaatgggtctagttaggcatttgctttctgacccgacaggagcaactatggtaaaagcatatctcacgatataaatcactctagtcgcaatcggtttagattatttgtaggcacatcttgcatatatatatatgtataagccttatgtgtgttgtatccttacatcaacacaatcattacttatgtttcttggagcaatgttaatgaagtatgttcttgtctccaaaaaaaaaaaa

SEQ ID NO: 1572 - DNA, 1924 bp, Flaveria ramosissima
cgaaagagatagaagtcgtgaccgtatttccagatatttttgattttcatcacaacagaattcttcaccatcttaatgacgtgatgcttcatcgcccttaaatcaattgcgattcccttgttcatttgatctaactgaacccaacaatcaatggagtgctttagagctccacacatgacgccaacaatggcgcctttcacgtgccctaggttcatgacttacaacaccagaaacggcttttcgttactaagacattgtaggtttactagtttatcgtcctcgttgaagcaaattaagtgtagcgctaaaagcgtggtggtgaaagaaggggtttctgaagcggatgaggaagattacgtgaaagccggtggatcggaactgctttttgttcaaatgcaacagaataagcctatggatacacagtctaggctttctgagaagctgccaaggataccgataggagattgtttgctggatttggttgtgatcggttgtggtcctgctgggcttgctcttgctgcagaatcagccaagctaggcttgaatgttggacttatcgggcctgatcttccttttaccaataactatggtgtttgggaggatgaatttataggtcttggacttgaggggtgtattgaacatgtttggcgggatactgttgtatatcttgataacaatgatcccatcctcataggtcgtgcctatggacgagttagtcgtgatttacttcatgaggagttgttgagaaggtgtgtggagtcaggtgtttcgtatttgagctccaaagtggaacggattactgaagctccgaatggccagagtatcatcgagtgtgaaggaaatatcacaattccatgcaggcttgctaccgtcgcctctggagcagcttcaggaaaacttttgcagtatgagcttggtggtccccgcgtttgtgttcaaacagcttatggtgttgaggttgaggttgaaagcttaccttatgatccaagcctaatggttttcatggattatagagactacaccaaacataaatctcaatcattagaagcaaaatatccaacattcctttatgtcatgccaatgtctccaactaaagttttctttgaggaaacttgtttggcttcaaaagaggccatgccttttgagttattgaagacaaaactcatgtcaaggttaaagacactagggatccgaattaccaaaacttatgaagaagaatggtcttatattccagtaggtggatccttaccaaatacagagcaaaagaaccttgcatttggtgctgctgctagcatggtgcatccagccacaggatattcggttgtaagatcactgtcagaagctccaaattatgcagcagtaattgcaaagattttagggaaaggaaatccgaaacagatgcttgatcttggaagacattcaaccaatatctcaaagcaagcttgggaaacactttggccgctggaaaggaaaagacagagagcattctttctctttggattagcactgattgtccagatggatattgaggggacccgtacattcttccggactttcttccgcttgcccacttggatgtggtggggtttcttggatcttcgctatcctcaaccgacctaatagtatttgcgttttacatgtttataatagcaccacatagcttgaggatgggcctggttagacatttgctttctgacccgacaggagcaactatggtaaaagcgtatctcacaatataaatcactctagtggcaatcggtttagattataggcacatcttgcatatatgtataaaccttgtgtgttgtatccttacattcaacacagtcatcgcctatatttcttgcagtaatgctgataaagtattttctagtatcatgagacaaagcacactcactacatatgctatggctgtgcaagtgac

SEQ ID NO: 1573 - DNA, 1880 bp, Flaveria ramosissima
tccattcaaaagctgttgcgaaagagatagaagtcgtgaccgtatttccagatatttttgattttcatcacaacagaaattttcaccatcttaatgacgtgatgcttcatcgcccttaaattaattgcgattctcttgttgatttgatctgtaactgaacccaacaatcaatggagtgctttagagctccacacatgacgccaacaatggcgcctttcacgtgccctaggttcatgacttacaacaccagaaacggcttttcgttactaagacattgtaggtttactagcttatcgtcctcgttgaagcaaattaagtgtagcgctaaaagcgtggtggtgaaagaaggggtttctgaagcggatgaggaagattacgtgaaagccggtggatcggaactgctttttgttcaaatgcaacagaataagcctatggatacacagtctaggctttctgagaagctgccaaggataccgataggagattgtttgctggatttggttgtgatcggttgtggtcctgctgggcttgctcttgctgcagaatcagccaagctaggcttgaatgttggacttatcgggcctgatcttccttttaccaacaactatggtgtttgggaggatgaatttataggtcttggacttgaggggtgtattgaacatgtttggcgggatactgttgtatatcttgataacaatgatcccatcctcataggtcgtgcctatggacgagttagtcgtgatttacttcatgaggagttgttgagaaggtgtgtggagtcaggtgtttcgtatttgagctccaaagtggaacggattactgaagctccgaatggccagagtatcatcgagtgtgaaggaaatatcacaattccatgcaggcttgctaccgtcgcctctggagcagcttcaggaaaacttttgcagtatgagcttggtggtccccgcgtttgtgttcaaacagcttatggtgttgaggttgaggttgaaagcttaccttatgatccaagcctaatggttttcatggattatagagactacaccaaacataaatctcaatcattagaagcaaaatatccaacattcctttatgtcatgccaatgtctccaactaaagttttctttgaggaaacttgtttggcttcaaaagaggccatgccttttgagttattgaagacaaagctcatgtcaaggttaaagacactagggatccgaattaccaaaacttatgaagaagaatggtcttatattccagtaggtggatccttgccaaatacagagcaaaagaaccttgcatttggtgctgctgctagcatggtgcatccagccacaggatattcggttgtaagatcactgtcagaagctccaaattatgcagcagtaattgcaaagattttagggaaaggaaatccgaaacagatgcttgatcttggaagacattcaaccaatatctcaaagcaagcttgggaaacactttggccgctggaaaggaaaagacagagagcattctttctctttggattagcactgattgtccagatggatattgaggggacccgtacattcttccggactttcttccgcttgcccacttggatgtggtggggtttcttggatcttcgctatcctcaaccgacctaatagtatttgcgttttacatgtttataatagcaccacatagcttgaggatgggcctggttagacatttgctttctgacccgacaggagcaactatggtaaaagcgtatctcacaatataaatcactctagtggcaatcggtttagattataggcacatcttgcatatatgtataaaccttgtgtgttgtatccttacatcaacacagtcatcgcctatatttcttgcagtaatgctatatt

SEQ ID NO: 1574 - DNA, 1890 bp, Centaurea maculosa
aaaattccaactgaattccgatttcagaattttgattttgtgaaaactgaagcaattatggagtgcgttggagctcgaagcatcacaacggcaacaatggcggtttttacgtgccctagattcatgaactataacatcagccatggattttcgttgctaaaacgtcgaagttttagtagtttatcgttatcgttgaagcagattaagtgcagcggtagaagagatggatgtgtggtggttaaggaagggatttctgaagaagatgaagaggattatgtgaaggctggtggatcggagcttttgtttgttcaaatgcaacagaataaggctatggatagtcagtctaggctttccgagaagctgccacggataccaataggagattgcgtactggatttggttgtaattggttgtggtcctgctggccttgctcttgctgcggaatcagccaagctaggcttgaacgttggacttattggtcctgatcttccttttacaaataattatggtgtttgggaggatgaattcataggacttggacttgagggctgtattgaacatgtttggcgagatactcttgtatatctcgaagacaacgatcccatcctcataggtcgtgcctatggacgagttaatcgtgatttgcttcacgaggagttgttgagaaggtgtgtggagtcaggtgtttcatatctgagctcaaaagtggaaaggattactgaagctttaaatggccacagtctcatcgagtgtgaaggcaatgtcacggttccatgcaggcttgctacggttgcatctggagcagcttcaggaaaacttttgcagtatgagcttgggggaccccgtgtttgtgttcaaacagcttatggtgtagaggttgaggttgaaaacaatccctatgatccaagcctaatggttttcatggattatagagactacaccaagaatacaacacaatcttctttagaagccaaatatccaacatttctttatgccatgcccatgtctccaactaaaatattcttcgaggaaacttgcctggcttcaagagaggccatgcctttcgatctactgaagacaaagctcatgtctagattaaagacattggggatccgaataaccaaaacttatgaagaggagtggtcgtatattccagtaggtggatccttgccgaatacagaacaaaagaaccttgcatttggtgctgctgctagcatggtgcatccagccacaggatattcagtcgttagatcactctcagaagctcctaactatgcagcagtaatagcaaagattttaaggcaaggccactcaaaagagatgcttgttcagggtagacagacaatgaacatctcaaagcaagcttgggaaacactttggccactggagaggaaaagacagagagcattctttctctttggcttagcactcatcgtgcaactagatattgagggcacacgaacattcttccgtactttcttccgcttgcccacttggatgtggtgggggtttctaggatcttctctatcctcaacagacctagtactatttgcattttacatgtttatcatagcacctcaaagcctgaggatggcactggttagacatctactttctgatccaacaggaggaaccatggtaaaagcatatctcaccatgtaggtatggcccatcctgtatatataaactaattaactagttaatcaccttatttgtgttgcataaacacaatgatcaaattatgaagcattttcttgtatcattagcatctgctcctcccatttgggatgtgcaaaatgggcaaaatggtgttcattccttaacctatttttcacaaggttagaaatattacaaattgtctgttaaaccaggaaaaaacaagttggtttg

SEQ ID NO: 1575 - DNA, 1886 bp, Flaveria ramosissima
tccattcaaaagctgttgcgaaagagatagaagtcgtgaccgtatttccagatattttcaattttcatcacaacagaattcttcaccatctcaaattctcaatgacgtgatgcttcatcgcccttaaatcaatcgcgattccctcgttcatttcatctgtaacagcaatcaatggagtgctttagagctccacacatgacgccaacaatggcgcctttcacgtgccctaggttcatgacttacagcaccagaaacggcttttcgttactaagacattgtaggtttactagcttgtcgtcctcgttgaagcaaattaagtgtagcgctaaaagcgtcgtggtgaaagaaggggtttctgaagcagaggaggaagattgcgtaaaagccggtggatcggaactgctttttgttcaaatgcaacagaataagcctatggatacacagtctaggctttctgagaagctgccaaggataccgataggagattgtttgctggatttggttgtgatcggttgtggtcctgctgggcttgctcttgctgcagaatcagccaagcgaggcttgaatgttggacttatcgggcctgatcttccgtttaccaataactatggtgtttgggaggatgaatttataggtcttggacttgagcggtgtattgaacatgtttggcgggatacagttgtatatcttgataacaatgatcccatcctcataggtcgtgcctatggacgagtcagtcgtgatttacttcatgaggagttgttgagaaggtgtgtggagtcaggtgtttcatatttgagctccaaagtggaacggattactgaagctccaaatggccagagtctcatcgagtgtgaaggcaatatcacaattccatgcaggcttgctactgtcgcctctggagcagcttcaggaaaacttttgcagtatgagcttggtggtccccgcgtttgtgttcaaacagcttatggtgttgaggttgaggttgaaagcttaccttatgatccaagcctaatggttttcatggattatagagactacaccaaacataaatctcaatcattagaagcaaaatatccaacattcctttatgtcatgccaatgtctccaactaaagttttctttgaggaaacttgtttggcttcaaaagaggccatgccttttgagttattgaagtcaaaactcatgtcgagattaaagacactagggatccgaattaccaaaacttatgaagaagaatggtcttatattccagtaggtggatccttaccaaatacagagcaaaagaaccttgcatttggtgctgctgctagcatggtgcatccagccacaggatattcggttgtaagatcgctgtcagaagctccaaattatgcagcagtaattgcaaagattttagggaaaggaaatccaaaacagatgcttgatcttggaagacattcaaccaatatctcaaagcaagcttgggaaacactttggccgctggaaaggaaaagacagagagcattctttctctttggattagcactgattgtccagatggatattgaggggacccgtacattttttcggactttcttccgcttgcccacttggatgtggtgggggtttcttgggtcttcgctatcctcaaccgacctaatagtatttgcgttttacatgtttatcatagcaccacatagcttgaggatgggcctggttagacatttgctttctgacccgacaggagcaactatggtaaaagcatatctcacaatataaatcactctagtggctatcggtttagattataggcacatcttgcatatatgtataaaccttgtgtgttgtatccttacatcaacacagtcatcacctatatttcttgcagaaatgctgataaggtt

SEQ ID NO: 1576 - DNA, 1918 bp, Ambrosia trifida
aaaacctgcttcagatagaaaagcgtgaacaactcttttttatttcatttatttctcttccttccaattccatcccccttacacaattactaatattatccaacgacagttataaataatgacgtaaaccttcgtctacctcatttatttacttatatttaatctaactgaactgaagaagaaattaatcaatcaatggagtgttttggtggtcgacacatgtctgcaacaatgacggcctttaggctcatgaattatactagcagacgtgaggtttcgttactgcaacagtataggtttactaggaagcagcagattaagtgtagcgctaagagtgtagtggtgaaggaaggggtatctgaagcagaagaagaggattatgtgaaggcaggtggatcggaactgctgtttgttcaaatgcaacagaataagagtatggagacgcagtctaggctttctgataagctgccaaggattccgataggagaatgtgtactggatttggttgtaattggttgtggtcctgctgggcttgctcttgctgcagaatcagccaagcgaggcttgaacgtcggacttattgggccggatcttccttttacaaataactatggtgtttgggaggatgaatttataggtcttggacttgaaggttgtattgaacatgtttggcgggatactgttgtatatcttgatgacaacgatcccatccttataggtcgtgcctatggacgagttagtcgtgatttacttcatgaggagttattgagaaggtgtgtggagtcaggtgtttcatatctgagctccaaagtggaacggattacagaagctccaaatggtcagagtctcattgagtgtgaaggcaatatcacaattccatgcaggcttgctaccgttgcatctggagcagcttcaggaaaacttttacaatatgagcttggtggtccccgtgtatgtgttcaaacggcttatggtgtagaggttgaggttgaaagcataccctatgatccaagcctgatggttttcatggattatcgtgactacaccaaacataaatctcagtcattagaagcacaatatccaacattcctttatgtcatgcccatgtctccaactaaagtattctttgaggaaacttgtttggcttcgaaagaggccatgccttttgagttattgaagtcaaaactcatgtcaagattaaagactatggggatccgaataaccaaaacttatgaagaggaatggtcttatattccagtaggtggatccttaccgaatacagagcaaaagaaccttgcatttggtgctgctgctagcatggtgcatccagccacagggtattcggttgtgagatcactgtcagaagctcctaattatgcagcagtaattgcaaagattttaggacaaggaaattcaaaacaaatgcttgttcctggaagatacactaccaacatctcaaagcaagcttgggaaacactttggccactggaacggaaaagacagagagcattctttctctttggattagcgctgattgtccagatggatatcgaggggacccgtacattcttccggactttcttccgcttgcccacttggatgtggtggggttttcttggatcttcgctatcatcaaccgacctcatagcatttgcgttttacatgtttgtcatagcaccacatagcctgagaatgggtctggttagacatttgctttctgacccaacaggagcaactatggtaaaagcatatctcacgatatagtaagttcactttagttgcagttggtttagatatattataggcacatcttgcatatatgtatgtataaaccttatgtgtgttgtatccttgcatcaacacaatcatcaattatgtttcttggagtaatgctgatgaagtattttcttgtaaaaaa

SEQ ID NO: 1577 - DNA, 1734 bp, Helianthus annuus
gatatttctcttccaattttccttcctaacacagagccttttataacatctcaatgacgtgaacattcatattgcgattcgttaactgaagaatcaatggagtgttttggagctccacacatgactgcaacaatggcggcctttacgagccctagattcatgaattatagcatcagacgccagttttcgttactcaaacactgtaggtttacgagtttatcttctccgtcatcgttgttgaagaggattaggtgtagcgctaagagcgataactgtgtagcggtgaaggaaggggtttcggaagcagaaaaggaagattatgtgaaagcaggtggatcggaactggtttttgttcaaatgcaacagaataagtgtatggagacgcagtctaggctttctcaaaagctgccaaggataccgataggagagtgtgtactggatttggttgtaattggttgtggtcctgctgggcttgctcttgctgcagaatcagccaagcgaggcttgaatgtcggacttattgggcctgatcttccttttacaaataactatggtgtttgggaggatgaatttataggtcttggacttgaagggtgtattgagcatgtttggcgggatactgttgtatatcttgatgacaacgatcccatcctcataggtcgtgcctatggacgagttagtcgtgatttacttcatgaggagttgctgagaaggtgtgtggagtcaggcgtttcatatctgagctccaaagtggaacggattactgaagctccaaatggccagagtctcattgagtgcgaaggcaatatcacaattccatgcaggcttgctaccgttgcatctggagcagcttcaggaaaacttttgcaatatgagcttggtggtccccgtgtttgtgttcaaacggcttatggtgtagaggtcgaggttgaaagcataccctatgatccaagtctaatggttttcatggattatcgagactacacgaaacataaatctcaatcattagaagcacaatatccaacattcctttatgtcatgcccatgtctccaactaaagtattcttcgaggaaacctgtttggcttcaaaagaagccatgcctttcgagttattgaagacaaagctcatgtcaagattaaagacaatggggatccgaataaccaaaacttatgaagaggaatggtcgtatattccagtaggcggatcgttaccgaacacagagcaaaagaaacttgcatttggtgctgctgctagtatggtgcatccagccacaggatattcggttgtaagatcactgtcagaagctcctaattatgcagcggtaattgcaaagattttaggacaaggaaattcaaaacaaatggttgatcttggaagatacacaaccaacatctcaaagcaagcttgggaaacactctggccactagaaaggaaaagacagagagcattctttctctttggattagcgctgattgtccagatggatattgaggggacccgtacattcttccgattgcccacttggatgtggtgggggtttcttggatcttcgctatcctcaaccgacctaatagtatttgagttttacatgtttatcatagcaccacatagcctgataatgggtctagttaggcatttgcgttctgacccgacaggagcaactatggtaaaagcatatctcacgatataaatcactctagtcgcaatcggtttagattgtttgtaggcacat

SEQ ID NO: 1578 - DNA, 1468 bp, Sorghum bicolor
aaaaagaaaaccataaaacggcgttggcgaccccaccgtatccccctcgccccctcctcactgctctcgctttcgctcgccatccggagtccgcacacccccgcccggccctcgcgatgccttcggccgccgcggccgccgcggcgcctctccaccgcatcgcatgcgcgcgtcagcgcctccctcaaacctccctcttcttcctcccaccccgcgcgctccccaattccgggcgcctcaccgtcccggccccgctgcccgttcacgcgctgaggctgcctccgacggcgacgagggcggcaagccacgacgccgccacgggcgcgagatcgcccacatctggcggccagatgttggtgttcgtcccgccgcacccgctgataaagcattgggtctccgtgctgcgcaacgaacagacaccgtgcgccatcttcaagagtgccatggcagagcttggtcggctgctcatatatgaagcatccagagattggttgcctacaatcacaggagagattgaaacacccgtagctgtagctagcgttgaatttattgatccaagagagcctgttctggttgttccgatactgagagctggtcttgcactagctgaacttgcttcatcagttctgccagcaaccaagacttatcaccttggcctccgtagagatgaagaaacacttcaaccttcaatatacctgaacaacctgccagacaaaattccagaggggactcgtgtactagttgttgacccaatgctggccactggtgggacaatggttgctgctattgacttattaatcgagcgcggagttaccagcaagcagattaaagttgtatctgctgttgcatcacctcctgcactgcaaaagctcaataacaagttccctgggctccatgtgtacacaggaataattgatccggaagtaaatgagaaaggttttatagttccaggactgggggatgctggcgacagaagctttgccacataatcagactgctcaatttgattgggccagtgctcgacctgcgagaatctttgcttgagtttcacaggaatggagcaactgcgagtagaagtgttcattgctgtagattaccttcattgagattttgttccttctcagtgttacaaccagctgcctaccattttgtagctacccattctgtatgattgcgtagaatatatggctagttcaaatgtctccagatggtgaaatcttcttgagagaacaatgttccgttcaaaatgatggattattgaagttagtggtctctaatattttgccagtcgacggaatagaactgtttcattgtgttttatcttgtttatatagatcgagttaggccagtgtgcttcctagcacccctttctgtatactatattagctgcaccaaagcaaaaagctttatggatcattatgaataaatcaaacttcaaactatttttgttaaatttgaattcatcgag

SEQ ID NO: 1579 - DNA, 1595 bp, Sorghum bicolor
actcaccactgtagatgcgttggatggcctaacgaaaaccgtaatatatataagtttttttctgaaaaatgaaaaagaaaaccataaaacggcgttggcgaccccaccgtatccccctcgccccctcctcactgctctcgctttcgctcgccatccggagtccgcacacccccgcccggccctcgcgatgccttcggccgccgcggccgccgcggcgcctctccaccgcatcgcatgcgcgcgtcagcgcctccctcaaacctccctcttcttcctcccaccccgcgcgctccccaattccgggcgcctcaccgtcccggccccgctgcccgttcacgcgctgaggctgcctccgacggcgacgagggcggcaagccacgacgccgccacgggcgcgagatcgcccacatctggcggccagatgttggtgttcgtcccgccgcacccgctgataaagcattgggtctccgtgctgcgcaacgaacagacaccgtgcgccatcttcaagagtgccatggcagagcttggtcggctgctcatatatgaagcatccagagattggttgcctacaatcacaggagagattgaaacacccgtagctgtagctagcgttgaatttattgatccaagagagcctgttctggttgttccgatactgagagctggtcttgcactagctgaacttgcttcatcagttctgccagcaaccaagacttatcaccttggcctccgtagagatgaagaaacacttcaaccttcaatatacctgaacaacctgccagacaaaattccagaggggactcgtgtactagttgttgacccaatgctggccactggtgggacaatggttgctgctattgacttattaatcgagcgcggagttaccagcaagcagattaaagttgtatctgctgttgcatcacctcctgcactgcaaaagctcaataacaagttccctgggctccatgtgtacacaggaataattgatccggaagtaaatgagaaaggttttatagttccaggactgggggatgctggcgacagaagctttgccacataatcagactgctcaatttgattgggccagtgctcgacctgcgagaatctttgcttgagtttcacaggaatggagcaactgcgagtagaagtgttcattgctgtagattaccttcattgagattttgttccttctcagtgttacaaccagctgcctaccattttgtagctacccattctgtatgattgcgtagaatatatggctagttcaaatgtctccagatggtgaaatcttcttgagagaacaatgttccgttcaaaatgatggattattgaagttagtggtctctaatattttgccagtcgacggaatagaactgtttcattgtgttttatcttgtttatatagatcgagttaggccagtgtgcttcctagcacccctttctgtatactatattagctgcaccaaagcaaaaagctttatggatcattatgaataaatcaaacttcaaactatttttgttaaatttgaattcatcgagaaattaggcttgtcatccgagccaaagagatttttatagtagtttgcggcatgttc

SEQ ID NO: 1580 - DNA, 1254 bp, Saccharum officinarum
ctcgctttcgctcgccatccgtagtcccgcacacccccgccccgccctcgcgatgccttcgcccgccgcgaccgcggcggcgcctctccaccgcatagcatgcgcgcgtcagcgcctccctcaaacctccctcttcttcctcccaccccgcgcgctcctcaattccgggcgcctcaccgtcccggccccgctgcccgttcacgcgctgaggctgcctccgacggcgacgagggcggcaagccacgacgccaccacgggcgcgagatcgcccacatctggtggccagatgctggtgttcgtcccgccgcacccgctgataaagcattgggtctccgtgctgcgcaacgaacagacaccctgcgccatcttcaagagtgccatggcagagcttggtcggctgctcatatacgaagcatccagagattggttgcctacaatcacaggagagattgaaacacctatagctgtagctagcgttgaatttattgatccaagagagcctgttctggttattccaatactgagagctggtcttgcacttgctgaacttgcttcatcagttctgccagccactaagacttatcaccttggcctccgtagggatgaagaaacacttcaaccttcaatatacctgaacaacctgccagacaagattccagaggggactcgtgtactagttattgacccaatgctggccactggggggacaatggttgctgctattgacttgttaatcgagcgcggagttaccagcaagcagattaaagttgtatctgctgttgcatcacctcctgcactgcaaaagctcaataacaagttccctgggctccacgtgtacacaggaataattgatccggaagtaaatgagaaaggttttatagttccgggactgggggatgctggcgacagaagctttgccacataatcagactgctcaatttgattgggccagtgctcgacctgcgagaatctttgcttgagtttcacatgaatggagcaactgcgagtagaagtgttcattgctgtaggttaccttcatctgagattttgttccgtctcagtgttacaatcagctgcctaccattttgtagctaccaattctgtatgattgcgtagaatataaggctagttcaaatgtctccagatggcgaaatcttcttgagaacaaggttccgttcaaaatgaaggaatattgaagttagtggtctctaatatttttccagtcgacggaataaaactttttcattgtgtttt

SEQ ID NO: 1581 - DNA, 1339 bp, Panicum virgatum
cggttcggttaaccctgatcccaccacctccccatcctcactgctctcgctttcgctcgccatccgcacacccgccccgccctcgcgagtcgcgatgccttcgctcgccacggccgcggccgcgcctctccaccgccgcgcctgcgcgcgtcagcacctccctccggcctcccgctgcttcctcccctcccgcgcgctcctcaattccgcgcgcctcttcaccgccccggtcccgctgcccgtccatgcgccgagggtgccgcccacggcggcgagggcggccagccccgacgccgcggccgcgagatcgcccacatcaggcggacagatgctggtgttcgtcccgccgcacccgctgataaagcactgggtttctgtcctgcgcaacgagcagacaccctgctccatattcaagagtgctatggcagagcttggtcgtctactcatatatgaagcatccagagattggttgcctacaatcacaggagagattgaaacacctgtagctgtagctagcgttgaatttattgatccaagagagcctgttctggttattccaatactgagagctggtcttgccctagccgaacttgcttcatcagttctgccagccactaagacctatcacattggccttcgtagggatgaagaaacacttcaaccttcaatatatctgaacaacctgccagacaatattccagaggggtctcgagtgctagttgttgacccaatgctggccaccggtgggacgatcgttgctgctattgacttgttaatcgaatgtggagttaccagcaagcagattaaagtagtatctgctgttgcagcacctcctgcgctgcaaaagctcaataacaagttccccgggctccatgtgtacacaggaacaatagatcctgaagtaaacgagaaaggttttataattccagggttgggagatgctggtgacagaagctttgccacataatctgaccgcacaatttgattcagccagccatctaccatcgagtatatttgcatcagttccataagaacggagcaactgcgagtaaagaggctttcattgctgtagatgccctcatttgagattttgttcattctctgtaatacaattagctgaccaccattttgtaactaaccattatgtattattgtgtagaatataaggctagttcagatctctccagatggaaaaatctttttgaaaggacaacgctcctttcaaaatggcgcatgctggattagtgaattggcgcttcctaatatttctcctgtcgaaggaataaaaccatctcatcatgtttcacttttttataatcaagtttgggtgtgtttattt

SEQ ID NO: 1582 - DNA, 1363 bp, Setaria italica
gcaaacaaacaccccctaaatttgcgataaactaacgagtcttcagtaaaacctcagagaaaacacaggcacgcacgccaccgccacggcacctcgaagatgcgtcaagtgtactgtgcgcataacggcgcggtgaccccaccgtatcccacctcgtccccttcctcagtcctcactgctctcgctttcgctcgccatccgcacacccgccccgccctcgcgatgccttcgcccaccacggccacggccgcgtcggcgcccctccacctccgctcgtgcgcgcgtcagcacctccctccggcctcccgctgcttcctcccctcccgcgtgctcctcaattccgcacgcctcacagccccggccccgctgcccgtgcgcgtgccgagcctgcctccgacggcggcaagggcggccggccccgacgctacgagcacgagatcgcccacatccggcggacagatgctggtgttcgtcccgccgcacccgctgataaagcattgggtctccgttctgcgcaatgagcagacaccctgcgccatcttcaagagtgctatgtccgagcttggtcggctgctcatatatgaagcatccagagattggttgcctacaatcacaggagagattgaaacacctgtagctgtagctagtgttgaatttattgatccaagagagcctgttctggttattccaatactgagagctggtcttgcactagctgaacaagcttcatcagttctgccagccaccaagacctatcaccttggccttcgtagagatgaagaaacacttgaaccttcaatatatctgaacaacctgccagacaagattccagaggggactcgtgtgctagttgttgacccaatgctggccactggtgggacgattgttgctgctattgacttgttaatcgaacgtggagttaccagcaagcagattaaagttgtatctgctgttgcagcacctcctgcgctgcaaaagctcaataacaagttccctgggctccatgtgtacacaggaataattgatccagaagtaaatgagaaaggttttatagttccagggttgggggatgctggcgacagaagctttgccacatgattagactgccaattccagtggtctgccagtgagaatctttgcttgaacagagcaatggcgagtaaaagttcattgctgtagattgccttcatttgagattttgttcctgctcaatgatacatttagctgcctgccattttgtaactacccattctctatgattgcgtagaatataaggctagttcagattgtctccagatggcaaaatctttttaaaggacaaggttcctaatatttatccggtggaaagaataaaactatctca

SEQ ID NO: 1583 - DNA, 1317 bp, Setaria italica
cggcacctcgaagatgcgtcaagtgtactgtgcgcataacggcgcggtgaccccaccgtatcccacctcgtccccttcctcagtcctcactgctctcgctttcgctcgccatccgcacacccgccccgccctcgcgatgccttcgcccaccacggccacggccgcgtcggcgcccctccacctccgctcgtgcgcgcgtcagcacctccctccggcctcccgctgcttcctcccctcccgcgtgctcctcaattccgcacgcctcacagccccggccccgctgcccgtgcgcgtgccgagcctgcctccgacggcggcaagggcggccggccccgacgctacgagcacgagatcgcccacatccggcggacagatgctggtgttcgtcccgccgcacccgctgataaagcattgggtctccgttctgcgcaatgagcagacaccctgcgccatcttcaagagtgctatgtccgagcttggtcggctgctcatatatgaagcatccagagattggttgcctacaatcacaggagagattgaaacacctgtagctgtagctagtgttgaatttattgatccaagagagcctgttctggttattccaatactgagagctggtcttgcactagctgaacaagcttcatcagttctgccagccaccaagacctatcaccttggccttcgtagagatgaagaaacacttgaaccttcaatatatctgaacaacctgccagacaagattccagaggggactcgtgtgctagttgttgacccaatgctggccactggtgggacgattgttgctgctattgacttgttaatcgaacgtggagttaccagcaagcagattaaagttgtatctgctgttgcagcacctcctgcgctgcaaaagctcaataacaagttccctgggctccatgtgtacacaggaataattgatccagaagtaaatgagaaaggttttatagttccagggttgggggatgctggcgacagaagctttgccacatgattagactgccaattccagtggtctgccagtgagaatctttgcttgaacagagcaatggcgagtaaaagttcattgctgtagattgccttcatttgagattttgttcctgctcaatgatacatttagctgcctgccattttgtaactacccattctctatgattgcgtagaatataaggctagttcagattgtctccagatggcaaaatctttttaaaggacaaggttcctaatatttatccggtggaaagaataaaactatctcatcgtgttttacttttgttattataaatcgagttttatggt

SEQ ID NO: 1584 - DNA, 2000 bp, Sorghum bicolor
gcagcagcggccaactcctctctgctagtgtctcctcgccgccgccgcgccgccgcgccgaccaatcaccgcgcaattggaagcaagagagccgcaccaggagagagaagagacagtgagagtgagagcccgaggaggggcggcgcgatgggcctctcgggcgcgacgatctccgcgccgctcggctgccgtgggctgcggcgcggggcggtcggcggaggtaaggcgcggaaggcggaggcggagaggtggcggcgggcgggctggagccgacgcgtgggcggaccgaaggtgacgtgcgtggccaccgagaagcacgacgagacggcggcggtcggcgtggagttcgcggacgaggaggactaccgcaagggcggcggcggcgagctgctttacgtgcaaatgcaggccaccaagcccatggaaagccagtccaggatcgcttccaagctattgcccatatctgatgaaaacacagtacttgatttggttatcattggttgtggtcctgctggtctttctctagcctcagagtcagctaagaaaggtctcaccgtaggtctcattgggcctgaccttccattcacaaataactatggtgtgtgggaggatgaatttaaagatcttggtctagcgagttgtatcgagcacgtctggaaggatactattgtctacctagacaataacaagcccatactgattggccgttcttatggcagggtgcaccgtgacttgctccatgaggagctactgagaagatgctatgaagctggcgtgacatacctgaactccaaagtggacaagatcatagaatctccagatggacacagagtagtctgttgtgataagggtcgtgagataatttgcaggcttgccattgttgcttcgggggcagcatctggtaggcttctagagtatgaggttgggggtcctcgtgtttgcgtgcagactgcatacggagtagaagttgaggtggaaaataatccatatgatcccagcttaatggttttcatggactacagagattgtttcaaagaggaattctcacacactgaacaagaaaatcccactttcctgtatgctatgcccatgtcatccacacgagttttctttgaggaaacatgcttagcttctaaagatgctatgtcctttgatctacttaagaagaggctgatgtatcggttgaatgcaatgggagttcgtatcctgaaaatttatgaggaggaatggtcctacattcctgttggagggtccttaccaaacacagatcagaaaaatcttgcatttggtgctgcagcaagtatggtgcatcctgcaacggggtactcagtggttagatctttgtctgaggctccaagatatgcttctgtgatatccgacatcttaaataaccgagttcctgcagaatatttgcttggaaattctcaaaattacagtccatcaatgcttgcatggagaacactatggcctcaagaaaggaaacgtcagcgatccttcttccttttcggattagcgttgataatccaactgaataatgaaggcatacaaacattctttgaagcctttttcagggtgccgaaatggatgtggcggggatttcttggctcaaccctttcatcggtcgatctcatactattttcattctacatgtttgcaatagctccaaatcaattgcgaatgaacctcgtcagacatctcctctctgacccgactggctcaaccatgatcaagacctacctgaccttataaaaccttctgcaccaggctgcaagaactcttagaaactgtacagttttgtagttgtacataagttagaggggatcttgggggttccttttcttattcccgtatggcggcggatctagggggttaccatcaacactataatacgctcgaaatcttttatggttgctgtggtgatgggtgcatgatggaatggaagaagaataagagagatccggtgatggtcatggttcctgcattggccatttttaggtctt

SEQ ID NO: 1585 - DNA, 2251 bp, Sorghum bicolor
gcctcgtgggtcctgagccaatccaaaaccgccacgtgccatatccgggataccccctccagccctccctctccccgtgccgctcgtctccctccacaacggcacagcagcagcggccaactcctctctgctagtgtctcctcgccgccgccgcgccgccgcgccgaccaatcaccgcgcaattggaagcaagagagccgcaccaggagagagaagagacagtgagagtgagagcccgaggaggggcggcgcgatgggcctctcgggcgcgacgatctccgcgccgctcggctgccgtgggctgcggcgcggggcggtcggcggaggtaaggcgcggaaggcggaggcggagaggtggcggcgggcgggctggagccgacgcgtgggcggaccgaaggtgacgtgcgtggccaccgagaagcacgacgagacggcggcggtcggcgtggagttcgcggacgaggaggactaccgcaagggcggcggcggcgagctgctttacgtgcaaatgcaggccaccaagcccatggaaagccagtccaggatcgcttccaagctattgcccatatctgatgaaaacacagtacttgatttggttatcattggttgtggtcctgctggtctttctctagcctcagagtcagctaagaaaggtctcaccgtaggtctcattgggcctgaccttccattcacaaataactatggtgtgtgggaggatgaatttaaagatcttggtctagcgagttgtatcgagcacgtctggaaggatactattgtctacctagacaataacaagcccatactgattggccgttcttatggcagggtgcaccgtgacttgctccatgaggagctactgagaagatgctatgaagctggcgtgacatacctgaactccaaagtggacaagatcatagaatctccagatggacacagagtagtctgttgtgataagggtcgtgagataatttgcaggcttgccattgttgcttcgggggcagcatctggtaggcttctagagtatgaggttgggggtcctcgtgtttgcgtgcagactgcatacggagtagaagttgaggtggaaaataatccatatgatcccagcttaatggttttcatggactacagagattgtttcaaagaggaattctcacacactgaacaagaaaatcccactttcctgtatgctatgcccatgtcatccacacgagttttctttgaggaaacatgcttagcttctaaagatgctatgtcctttgatctacttaagaagaggctgatgtatcggttgaatgcaatgggagttcgtatcctgaaaatttatgaggaggaatggtcctacattcctgttggagggtccttaccaaacacagatcagaaaaatcttgcatttggtgctgcagcaagtatggtgcatcctgcaacggggtactcagtggttagatctttgtctgaggctccaagatatgcttctgtgatatccgacatcttaaataaccgagttcctgcagaatatttgcttggaaattctcaaaattacagtccatcaatgcttgcatggagaacactatggcctcaagaaaggaaacgtcagcgatccttcttccttttcggattagcgttgataatccaactgaataatgaaggcatacaaacattctttgaagcctttttcagggtgccgaaatggatgtggcggggatttcttggctcaaccctttcatcggtcgatctcatactattttcattctacatgtttgcaatagctccaaatcaattgcgaatgaacctcgtcagacatctcctctctgacccgactggctcaaccatgatcaagacctacctgaccttataaaaccttctgcaccaggctgcaagaactcttagaaactgtacagttttgtagttgtacataagttagaggggatcttgggggttccttttcttattcccgtatggcggcggatctagggggttaccatcaacactataatacgctcgaaatcttttatggttgctgtggtgatgggtgcatgatggaatggaagaagaataagagagatccggtgatggtcatggttcctgcattggccatttttaggtcttgtatcccttgtttttgctccatctctgtcttttctgtttcaagacttcttgcatgtccagtcaattacacccttattttaggttgctcaataccgagtcaaaatgtttttcccccctgtcggaacaatatttgcaaaagcaaaaa

SEQ ID NO: 1586 - DNA, 1552 bp, Solanum tuberosum
gagaaaaacacacaaactatatttgggtccctattttctttgtttccctttgattccttcttctctttggatggccggccaaacagtcattgtttccggtttgaatccggcggccattcttcagtccacaatcggcggagttccggtggcagcagcggcggagaacggccataccagaaaagttgttcctctgtcaaaagatgcccttcaggatttcatggtttcaatcataacccagaaattacaggacgataaacaacccttttatgttctagatttgggtgaagttgtttcccttatggaacaatggaactctgctttaccaaatattcgtccgttttatgctgtgaaatgtaaccctgaaccttcatttctctccatgttgtctgctatgggttccaattttgattgtgctagccgtgctgaaattgagtatgttttgtctcttggtatctcgccggaccggattgttttcgctaacccttgtaagccggaatccgatatcattttcgccgagaaaattggggttaatctcacaacttacgattccgaggatgaagtttacaagatccgtaaacatcacccgaaatgcgagcttttgcttcgaatcaaacccatgaacgacggcaacgccagatgcccaatgggtccaaaatacggcgcattaccggaagaaatcgagccgctcctccgtacagctcaagccgctagactcaccgtctccggcgtttccttccatatcggcagcggagacgccgattccaacgcttatctaggagccatagccgcagcgaaacatgttttcgaaacagcaactcaactcggaatgccaaaaatgacggtactcgacatcggcggcggatttacctccggccaccaattcacctccgctgctcccgccgtgaaatcagctctggaaacccacttccagaactccccggagctaacaatcatcgctgaaccgggtcgtttcttcgcagaaacggcgttcactttagcaacaaccatcatcggcaaaagagtcagaggtgaattaaaagaatactggatcaacgatgggttatacggatcgatgaactgtgtactttacgaccatgcgacggtgacggcgacgccattagcgtgcatgtcgaatcgtaacaacctcaactgcggcgggtcgaaaacgtttccgtcgactgtattcgggcccacctgtgatgcacttgataccgtgttgagggattaccagttaccggagctgcaggttaatgactggctggtttttcctaatatgggtgcttatacaaaagctgctggatcaaatttcaatggatttaatacatccgccattgttactcaccttgcttatgcttatccaagctaatgattaattaggcttaaattagcatggtggttgtaattttatttttttcttctaattttgtcgttgtttggtaatttatttgccaatcagcttgtagtttcttttttgtctcataagaaaagcaaggatttgccaattggatttgcttgtagttatatttcatgctaaataatccaatttcatcta

SEQ ID NO: 1587 - DNA, 1626 bp, Solanum phureja
ctctatatattatggttaacattgtttgaggtttctccgtctcaaagggaacagagaaaaacacacaaaatatatttcggtcccttttttctttgtttccctttgattccttcttctctttggatggccggccaaacagtcattgtttccggtttgaatccggcggccattcttcagtccacaatcggcggagttccggtggcagcagcgaaacaactgcataccagaaaagttgttcctctgtcaaaagatgcccttcaggatttcatggtttcaatcataacccagaaattacaggacgataaacaaccattttatgttctagatttgggtgaagttgtttcccttatggaacaatggaactctgctttaccaaatattcgtccgttttatgctgtgaaatgtaaccctgaaccttcatttctctccatgttgtctgctatgggttccaattttgattgtgctagccgtgctgaaattgagtatgttttgtctcttggtatctcgccggaccggattgttttcgctaacccttgtaagccggaatccgatatcattttcgccgagaaaattggggttaatctcacaacttacgattccgaggatgaagtttacaagatccgtaaacatcacccgaaatgcgagcttttgcttcgaatcaaacccatgaacgacggcaacgccagatgcccaatgggtccaaaatacggcgcattaccggaagaaatcgagccgctcctccgtacagctcaagccgctagactcaccgtgtccggcgtttccttccatatcggcagcggagacgccgattccaacgcttatctaggagccatagccgcagcgaaacaagttttcgaaacagcaactcaactcggaatgccaaaaatgacggtactcgacatcggcggcggatttacctccggccaccaattcacctccgctgctcccgccgtgaaatcagctctggaaacccacttccagaactccccggagctaacaatcatagctgaaccgggtcgtttcttcgcagaaacggcgttcactttagcaacaaccatcatcggcaaaagagtcagaggtgaattaaaagaatactggatcaacgatgggttatacggatcgatgaactgtgtactttacgaccatgctacggtgacggcgacgccattagcgtgcatgtcgaatcgtaacaacctcaactgcggcgggtcgaaaacgtttccgtcgactgtattcgggcccacctgtgatgcacttgataccgtgttgagggattaccagttaccggagctgcaggttaatgactggctggtttttcctaatatgggtgcttatacaaaagctgctggatcaaatttcaatggatttaatacatccgccattggtactcaccttgcttatgcttatccaagctaatgattaattaggcttaaattagtatggtggttgtaattttatttttttcttctaattttgtcgttgtttggtaatttatttgccaatcagctggtagtttcttttttgtctcataagaaaggcaaggatttgccaattggatttgcttgtagttatattttatgtctaaataatccaatttcatctattgaattttatgttcgaatgatt

SEQ ID NO: 1588 - DNA, 1616 bp, Capsicum annuum
gttttcatatatattgaattcttattttctctgtttccctttgagtcctccgaatggccggccaaacagttattgtttccgggttaaacccggcggccattcttcagtcaacaatcggcggagctcctccttctaccgccgcagctgcggcggagaacggtgacaccaccagaaaagttgttcctctatcaaaagatgcccttcaggatttcatggtttccatcataacccagaagttacaaggtgaaaagaagccgttttatgtgttagatttgggggaagttgtttccctgatggatcaatggaacgttgcgttgccgaatgttcgtccgttttatgctgtgaagtgtaatcctgaaccttcattcctttctatgttggctgctatgggttcgaattttgattgtgctagccgtgctgaaattgagtacgttttgtctcttggtatctcgccggagaggattgtattcgctaacccatgtaagccggaatccgatatcattttcgccgaaaaagttggagtcaatctcacaacttacgattcagaggacgaggtttacaagatcaaaaagcatcacccaaaatgcgagcttttgctccgtatcaaaccgatgaacgatggtaatgctagatgtccaatgggtccaaaatacggcgctttgcctgaagaaatcgagccgcttctccgtatagctcaagcttcccggctcactgtctccggcgtctccttccatatcggcagcggcgacgctgattccaacgcttatttaggcgccatagccgcagccaagcaagttttcgaaacggcagccaaattcggcatgtcgaaaatgaatgttctagacatcggcggcgggtttacctccggccaccagttcaccaccgcagcaaccgccgtgaaatcagctttacaacaacacttctctaacgaaccggagctcaccatcatagctgaaccgggtcggtttttcgcagaaacggcgttcacattggcaacaaccatcatcggaaaaagagtacgtggagatttacgtgaatactggatcaacgacgggttatacgggtcaatgaactgtgtactttacgatcatgcaacggtaacggcgacgccgttggcatgcatgtcgaatcgggtcaacctaaactgcagcgggtcgaaaatgtttccgtcgactatattcgggcccacgtgtgatgcacttgataccgtgttaagggattaccagttaccggaactgcaggttaatgactggttaatttttcctaatatgggtgcttatactaaagctgctggatcaaattttaatggatttaatacttctgccattgttactcaccttgcttatgcttatccaagttgataggatttaattagcaaggggttgtaattttatttttcttatgggtttccaattttgttgttttgttaatttatttttcaatcagcttgtagtagttttatcgttgtcccataagaaaaaaacaaggatttgcccttaataagattttgtttattttaactcttcctacttcctataaacagcaaagtggttagattagcatagtatgtaaagttagttgggtgcatgtattctattatatatattcttgggaat

SEQ ID NO: 1589 - DNA, 1621 bp, Nicotiana tabacum
ggccattacggccgggggtctcaaagggaacaagagaaacattcatattattgaatccctagtttcttttctttccctttgattccttcctctcatttacctctctcttttcttcctttgtttggatggccggccaaacaatcatcgtttccgggttgaacccggcggccattcttcagtccacaattggcggcggagcttctcctacagcggcggcggcggcggaaaacggcaccagaaaagtcatccctctctcaagagatgccttacaagatttcatgttatcaatcataacccaaaaattacaagatgagaaacaacctttttacgtgctagacttgggtgaggttgtttctcttatggaccaatggaaatctgctctcccaaatatccgtccattttacgctgttaaatgtaaccctgaaccgtcgttcctttcaattttatctgctatgggctcaaattttgattgtgctagccgagctgaaattgagtatgttttatctcttggcatttcacctgaccgtattgttttcgcaaatccatgcaaaccggaatccgatattatttttgcagcaaaagttggggtgaatcttacaacctatgattctgaagacgaggtttacaagatccgaaagcatcacccgaaatccgaactcttgctccgcatcaagcccatgctcgacggcaacgcgagatgcccaatgggcccgaaatacggcgcgcttccagaagaagtcgacccgctgctccgggcagctcaagccgcccgtctcaccgtatccggcgtctcattccacatcggtagcggagatgccgattcaaacgcttatctcggcgccatagccgcggctaaggaagtgtttgaaacagctgctaaactcgggatgtcgaaaatgactgttctagacgtcggcggcgggtttacatccggccaccagttcacaaccgccgccgtcgccgttaaatcagctttaaaacaacacttcgatgacgaaccggagttgacaatcatagctgaaccgggtcggttttttgcagagacggcgtttactttggcaacgacgattatagggaaaagagtgaggggtgaattgagggagtattggattaacgacgggctgtacggttcgatgaactgtgtactttacgaccatgcgacggtgaatgcaacgccgttagctgttctgtcgaatcgtagtaacgttacctgcggcgggtcgaaaacgtttccgacgactgtgtttgggcccacttgtgatgctcttgatactgttttaagggattaccagttaccggagctgcaggttaatgattggctggtttttcctaatatgggtgcttatactaaagctgctgggtccaattttaatggatttaatacttccgccattgttactcacctcgcttattcttatccaagctgatgaaccacctgtattaggaattactaccgtggttttgatggttttttccttttttgggtatcttttttttaattttgttgtttttggtagtaatttatattccaaatcagcttgtaattctcttgtatgccataagaatgcaaggatttgctaattgtgattttctctaatatggaagtttttaaaattagttt

SEQ ID NO: 1590 - DNA, 1636 bp, Nicotiana benthamiana
ggtttccccgtctcaaagggaacaagagaaacacaatattcatattattgaatccctagtttcttttctttccctttgattccttcctctcgattacctctctctttttcttcctttgtttggatggccggccaaacaatcatcgtttccgggttgaacccggcggccattcttcagtccacaattggcggcggagctttccctacagcggcggaggcggcggcggaaaatggcaccagaaaagtcatccctctctcaagagatgccctacaagatttcatgttatcaatcataacccaaaaattacaagatgagaaacaacctttttacgtgttagatttgggtgaggttgtttctcttatggaccaatggaaatctgctctcccaaatatccgtccattttacgctgttaagtgtaaccctgaaccgtcgttcctttcaattttatctgctatgggctcaaattttgattgtgctagccgtgctgaaattgagtatgttttatctcttggaatttcacctgaccgtattgttttcgcaaatccatgcaaaccggaatccgatattatttttgcagcaaaagttggggtgaatcttacaacctatgattcagaagacgaggtttacaagatccgaaagcatcacccgaaatccgaactcttgctccgaatcaagcccatgctcgacggcaacgcgagatgcccaatgggcccgaaatacggcgcgctcccagaagaagtcgacccgctgctccgggcagctcaaaccgcccgtctcaccgtctccgttgtctcattccacatcggtagcggagatgccgattcaaacgcttatctcggcgccatagccgcggctaaggaagtgtttgaaacagctgctaaactcgggatgtcgaaaatgactgttctagacgtcggcggcgggtttacatccggccaccagttcacaaccgccgccgtcgccgttaaatcagctttaaaacaacacttcgatgacgaaccggaattggcaatcatagctgaaccgggtcggttttttgcagagacggcgtttactttggcaacgacgattatagggaaaagagtgaggggtgaattgagggagtattggattaacgacgggctgtacggttcgatgaactgtgtactatacgaccatgcgacggtgaatgcaacgccgttagctgttctgtcgaatcgtagtaacgtcacctgcggcaggtcgaaaacgtttccgacgactgtgtttgggcccacttgtgatgctcttgatactgttttaagggattaccagttaccggagctgcaggttaatgattggctggtttttcctaatatgggtgcttatactaaagctgctgggtccaattttaatggatttaatacttccgccattgttactcacctcgcttatgcttattcaagctgatgaaccacctgtattaggaataactaccgtggttttgatggtcttttttccttttttgggtatctttttcttaattttgttgtttttggtagtaatttatattccaaatcagcttgtaattctcttgtatgccataagaatgcaaggatttgctaattgtgatttgctcaaatatggaagtttataaagttagttattagataaatct

SEQ ID NO: 1591 - DNA, 1413 bp, Nicotiana benthamiana
gtctcaaagggaacaagagaaacacaatattcatattattgaatccccagtttctttttctttccctttgattccttcctctcaattacctctctcttttcttcctttgtttggatggccggccaaacaatcatcgtttccgggttgaacccggcggccattcttcattcaacaataggcggcggagcttctcctacagcggcggcggcggcggaaaacggcaccagaaaagtcatccctctctcaagagatgccttacaagatttcatgttatcaatcataacccaaaaattacaagatgagaaacaacctttttacgtgttagatttgggtgaggttgtttctcttatgaaccaatggaaatctgctctcccaaatatccgtccattttacgctgttaagtgtaaccctgaaccgtcgttcctttcaattttatctgctatgggctcaaattttgattgtgctagccgtgctgaaattgagtacgttttagcccttgggatttcacctgaccgtattgtttttgcaaatccatgcaaaccggaatccgatattatttatgcagctaaagttggggtgaatttgacaacctacgattccgaagatgaggtttacaagatccgaaagcatcatccaaaatccgaactcttgctccgaatcaagcccatgttcgacggcaacgcgagatgtccaatgggcccaaaatacggcgcgcttccagaagaagtcgaaccgctgctccgcgcagctcaggccgcccggctcaccgtctccggcgtatccttccacattggaagtggagacgccgattcaaacgcttatctcggcgccataggtgcggttaaagaagtgtttgaaacagctgctaaactcgggatgtcgaaaatgactgttttagacgtcggaggcgggtttacatccggccaccagttcacaaccgccaccatcgccgttaaatcagctttaaaacaacacttcgatgacgaaccggaattggcaatcatagctgaaccgggtcggttttttgcagagacggcgtttactttggcaacgacgattatagggaaaagagtgaggggtgaattgagggagtattggattaacgacgggctgtacggttcgatgaactgtgtactatacgaccatgcgacggtgaatgcaacgccgttagctgttctgtcgaatcgtagtaacgtcacctgcggcaggtcgaaaacgtttccgacgactgtgtttgggcccacttgtgatgctcttgatactgttttaagggattaccagttaccggagctgcaggttaatgattggctggtttttcctaatatgggtgcttatactaaagctgctgggtccaattttaatggatttaatacttccgccattgttactcacctcgcttggcaacgacaatta

SEQ ID NO: 1592 - DNA, 1022 bp, Solanum phureja
gtgttgttaagttcctattctacccttatatatacgactaaatcgatggtctcctcacagtttcagccatggcttccatgatcgaatctgcttgggcgtttcttcttgcaaattttagtgatttccaattgacttctcttggaggtttcattgttcatgagagtgccttcttcttgtctggaatcccattcatcctttttgaaagggcagggtggtttggcaagtacaaaattcagaaaaagaccaacaccccggaagctcagcagaaatgtattactcgtctgctgatgtttcatttttgtgttaatcttccaatcctgattgttacgtatccgctctttaaattcatggggatgcgatctactcttccattgccgtcctggaaagtagtttcaacccaagttttattctatttcatcttggaggatttcgtattttactggggacacagggttttacatacgaaatggctctacaagcatgtccacagtgtccatcatgagtatgctacaccatttggtttgacatctgagtatgctcaccctgctgaaattctcttccttggatttgctacggtaattggtcctgcaatcacggggccacatttgataacgttatatctatggatctcacttagaatcctcgagacagtcgaggcacattctggataccatttcccctggagcccatcaaacttcttgccattatatggagggtctgattttcatgattaccatcatcggctgctctacacaaagtctggcaactactcatcgactttcgtttacatggactggttatttggtactgataagggttacagaaagttgaagatgctgaaggagcaagagtgcaacaaagcaatgtaaacaagatgggaaagtagagggggaataaaattacatgtttgtttgagtgtataagaatagtattgtacacattctattagtaatgctgggattaataatgtaaggattagttatgttggcactagtaatgcaagaattaattataacatgcac

SEQ ID NO: 1593 - DNA, 1059 bp, Solanum tuberosum
ggtgttgttaagttcctattctacccttatatatacgactaaatcgatggtctcctcacagtttcagccatggcttccatgatcgaatctgcttgggcgtttcttcttgcaaatttcagtgatttccaattgacttctcttggaggtttcattgttcatgagagtgccttcttcttgtctggaatcccattcatcctttttgaaagggcagggtggtttggcaagtacaaaattcagaaaaagaccaacaccccggaagctcagcagaaatgtattactcgtctgctgatgtttcatttttgtgttaatcttccaatcctgattgttacgtatccgctctttaaattcatggggatgcgatctactcttccattgccgtcctggaaagtagtttcaacccaagttttattctatttcatcttggaggatttcgtattttactggggacacagggttttacatacgaaatggctctacaagcatgtccacagtgtccatcatgagtacgcgacaccatttggtttgacatctgagtatgctcaccctgctgaaattctcttccttggatttgctacggtaattggtcctgcaatcacggggccacatttgataacattatatctatggatctcacttagaatcctcgagacagtcgaggcacattctggataccatttcccctggagcccatcaaacttcttgccattatatggagggtctgattttcatgattaccatcatcggctgctctacacaaagtctggcaactactcatcgactttcgtttacatggactggttatttggtactgataagggttacagaaagttgaagatgctgaaggagcaagagtgcaaagctgagggcaaagcaatgtaaacaagatgggaaagtagagggggaataaaattacatgtttgtttgagtgtataagaatagtattgaacagattctattagtaatgctgagattaataatgtaaggattagttatgttggcactagtaatgcaagaattaattataacatgcaccacataattctaaaaaaatggatttgt

SEQ ID NO: 1594 - DNA, 967 bp, Solanum melongena
acagtttccagccatggcctccatgatcgaatctgcttggacgtatcttcttacaaatttcagtgatttccaattgacttgtctgggaggtttcattgttcatgagagtgccttcttcttgtctggactccctttcattctttttgaaagggcaggatggtttggcaagtacaaaattcagaaaaagaataacaccccggaagctcaggagaaatgcattactcgtctgctgctgtatcatttttgtgttaaccttccaatcctgatcgtaacatatcccctctttaaattcatgggaatgcgagctagtcttccattgccatcctggaaagtgatttcagcccaaattttattctatttcatcttggaggattttgtgttttattggggacacaggattttacacacaaaatggctctacaagcatgtccacagtgtccatcatgagtacgcgaccccgtttggtttgacatctgagtatgctcaccctgctgagattctcttccttggatttgctacaataattggtcctgcaatcacgggtccgcatttgataacattgtatctatgggtctcacttagagtcctcgagacagtcgaggcacattctggttaccatttcccctggagcccgtcaaacttcttgccgttatatggagggtcggattttcatgactaccatcatcgactgctctacacaaagtctggcaactactcatcgactttcgtttacatggactggatatttggtactgacaagggttacagaagattgaaaatgctgaaggagcaggaacatgaagctgagggcaaagtaatgtaaacaagaagggaaagtaatgggggaataaatctatgatgccgggatgtataagaatagtattgaacaaattgtattagtaccgttggaattgataatgcaagaattagttatgctgttattaataatgcaaagattagttgtaac

SEQ ID NO: 1595 - DNA, 1142 bp, Capsicum annuum
cttgatcgaatctgcctggacgtatcttattacaaatttcagcgatttccagttgacttgtcttggaggtttcattgttcatgagagtgtcttcttcctgtctggactccctttcattctttttgaaagggcagggtggtttggcaagtacaaaattcagaagaagaataacaccccggaagctcagacgaaatgtattactcgtctggtgatgtatcatttgtgtgttaatcttccaattctgcttgtaacatatcctgtatttaaattcatggggacgcgatctactcttccattgccgtcctggaaagtggttgcaacgcaaatattattctatttcatcatagaggattttgtattttattggggtcacaggattttacataccaaatggctctacaagcatgtccacagtgtccatcatgagtacgcaacaccatttgggttgacttccgagtatgctcaccctgctgaaattctcttcctcggtgctgctacaatagttggtcctgcactcacggggccgcatttgataacaatatacctatgggtctcacttagaatccttgagacagttgaggcacattctggataccatttcccctggagcccgtcaaacttcttgccattatatggagggtctgattttcatgattaccatcatcgactgctctacacaaagtccggcaactactcatcgacatttgtttacatggactggatatttggtactgataagggttacagaaaattgaagtcgctgaaggagagcgaacgtgaagctgaaggcaaagtaatgtaaaacaaggtggaaagtaggggaataagactatgatgcctgcttgggtatcacacaatgggtttccagcagatcagcatacaactatagcccaaggttcagattgttgtacctaatcaccttgtgcgcttcttgtattcatcagtggtttctggagaacattttatgtttaggtggatcacttaaaagcttgtactggagaacctttttttttttccctgtaaacacctcccttttttttttttttcccctgtaaacacctccccatcccctttcatctctccccctctgcccccttctttttacaagaagcatacctggtgaaatctcataaaatgaggtg

SEQ ID NO: 1596 - DNA, 1059 bp, Nicotiana benthamiana
agatcgaatctgtttcaacaatggcttccatcattgaatctgcttggacgtatctcatttcaaatttcagtgatttccaattgacttgtcttggtgggtttgttcttcatgagagtatcttcttcttgtctggactcccgttcattctttttgaaagagcaggatggtttggaaagtacaaaattcagaagaagaataacagcccggaagctcaggagaaatgtatcactcgtctgctgatgtatcatctttgtgttaatctcccaatcctgcttggatcatatcctgtctttaaattcatggggacgcgaagtagtcttccactgccatcctggaaagtgatttcaacacaaataatattctatttcatcttggaggattttgtgttttattggggacacaggattttacatacgaaatggctctacaagcatgtccacagtgtccatcatgagtatgcaacaccatttgggttgacttctgagtatgctcaccctgctgaaattctcttccttggatttgctacaataattggtcctgcaatcacgggcccccatttgataacattatatctttgggtctcacttagagtccttgagacagttgaggcacattccgggtaccatttcccttggagcccgtcaaacttcttgccactatatgggggggctgattttcatgattatcatcatcgactgctctacacgaagtccggcaactactcatcaacatttgtatacatggactggatatttggtactgacaaaggttacagaaaattgaagtccctgaaggaaaatgaacgtttcgaagctgagggcaaagaaatgtgaagaagatgggaaagggaataaaactatgccttcttgggcatcgcattacgggtttccggttaaaatagtatataggccaaggctcaaattgttgtaactagtcatcttgtgcgcttgttgtattcgtctgtggttttaagagagacatttttatgttaaggtggatcaattagaagtttgtcctggagaactttctccctggaaaaaaaaaagctcccctcttttt

SEQ ID NO: 1597 - DNA, 1014 bp, Nicotiana tabacum
  misc_feature (930)..(930): n is a, c, g, or t
gaatctgtttcaacaatggcttccatcattgaatctgcttggacgtatctcatttcaaatttcagcgatttccaattgacttgtcttggtgggtttgttcttcatgagagtgtcttcttcttgtctggactcccgttcattctttttgaaagagcagggtggtttggaaagtacaaaattcagaagaagaataacagcccggaagctcaggagaaatgtatcactcgtctgctgatgtatcatctttgtgttaatctcccaatcctgcttggatcatatcctgtctttaaattcatggggacgcgaagtagtcttccactgccgtcctggaaagtgatttcaacacaaataatattctatttcatcttggaggattttgtgttttattggggacacaggattttacatacgaaatggctctacaagcatgtccacagtgtccatcatgagtacgcaacaccatttgggttgacttctgagtatgctcaccctgctgaaattctcttccttggatttgctacaataattggtcctgcaatcacgggcccccatttgataacattatatctctgggtctcacttagagtccttgagacagttgaggcacattccgggtaccatttcccttggagcccgtcaaacttcttgccactatatgggggggctgattttcatgattatcatcatcgactgctctacacgaagtccggcaactactcgtcaacatttgtatacatggactggatatttggtactgacaaaggttacagaaaattgaagtccctgaaggaaaatgaacgtttcgaagctgtgggcaaagaaatgtgaagaagatgggaaagggaataaaactatgccttcttgggcatcacattacgggtttccggtagaaatagtatataggccaagggtcaaattgttgtaactagncatcttgtgcgcttgttgtattcgtctgtggttttaagagaaacatttttatgttaaggtggatcaattagaagattgtgctgg

SEQ ID NO: 1598 - DNA, 1094 bp, Petunia hybrida
gcggggaattcctcagagtttcaccatggcttccatgattgaatctgcttggacgtatcttattaaaaacttcagcgatttccaattgacttgtcttggaggtttcattcttcatgagagtgtgttcttcttgtctggacttcccttcattctttttgaaagggcaggctggtttggcaaatacaaaattcagaagaagaataacacatctgaagctcaggagaaatgtatcgctcgtctgctgctgtatcatttctgtgtgaatctgccactcttgcttgcatcataccctgtctttaaattcatgggcacgcgaagtagtcttccattaccatcctggaaagtggtctccacacaaatcatattctatttcatcttggaggatttcgtattttattggggacacaggattttacatacaaaatggctctacaagcatgtccacagtgtccatcatgagtatgcaacaccatttggattgacttctgaatatgctcatcctgttgaaattctcttccttggatttgctacagtaattggtcctgcaatcacggggccacatttaataacactatggctctggatctcacttagagtcctcgagacagttgaggcacattgtggttaccattttccttggagcccctcaaacttcctgccattatatggggggtctgattatcatgattatcatcatcggttgctctatacaaagtccggaaactactcatccacatttgtttacatggactggatatttggtactgacagaggttacagaacgttgaaggcggtgaagagcaatgaaatgtaaaagagatggaaaaaggggtatcagattttaacagcataggcatcacgccaatggataggtttccataaggcagaatgttgtaactagtagtaaatcattttatgttcagacgaataatttagatgcttgtgctgaagaattttgcctactcaataaacctgcgaccccccctccccttagtatctcatgattgtaagttcctgtctgagtttttaactcagatggtaacttaagtttgtaagtatgtgcacctcaattagtatatatatattacttgcac

SEQ ID NO: 1599 - DNA, 1250 bp, Solanum phureja
gcaaatattcgctgacagtctgtctcatcttcgtggaacccactttgttctctctagtgcgcctctttaaacacctggcctatatactctctctctctcgtagtatctacttccacaactcctctctctctccggcaggccggcgatcgggtcaaacctcattgtttgaccatggcttccgtgattgaatctgcttggacgtatctgattacaaatttcaatgacttccaattggcttgtcttggaagtttctttcttcatgaaagcgtcttcttcttgtctggacttcctttcattcttctagaaagggcaggatggttgagcaaatacaaaattcagacaaaaaataatactcctgcagctcaggagaaatgcatcactcgcctgttgctgtatcatttttgtgttaatctcccacttatgatggcatcctatccagtctttaaattaatggggatgcgaaatactcttccgttgccgtcctggaaagtgatctctacgcaagtattattctactttatcctggaggattttgtattctattggggacacaggattttacatactaaatggctctacaagcatgtccacagtgtccatcacgagtatgcaacaccatttggattgacctctgaatatgctcaccctgctgaaattctttttcttggatttgctacaatagttggtccaatcatcactgggccccatttgataacattatggttgtggatgatacttagagtccttgagacagttgaagcacattgtggttaccatttcccctggagcctctcaaactttttgccattatatgggggggctgattttcatgactatcatcaccgactgctctatacaaagtctggaaattattcttcaacatttgtttacatggactggctatttggtactgacaagggttacagaagattgaaagtgctgaagagtgatgcatgtgaagctgaggggaaagaaatgtagagatgtgaaagggtaagttttggctggtctggcattgcaagacgggcttctgtacaagagcgtataggtgaaggtttctgttgttgatacctcagttttatgtgcttgtgttcaattgtagttttgacgtgaacatcgtcttctttgtagtgtcatcttagaaattagaagcatgtcttggaaaattttctccttgcaaatgtgtctgcctttgttctggctatttacgttattcaagttccattatttaccatgtttcttctcattga

SEQ ID NO: 1600 - DNA, 1435 bp, Solanum lycopersicum
aaaggcacatgtggttgtctctggatcaagtagttggccgtgagcaaatattcgctgacagtctgtcttcatcttcgtggaacccactttactctctctagtgcgcctctattaacacctgccctatatactctctctctctcgtagtttctacttccagaactcatctctctctccggcaggccggcgattgggtcaaacctcattgtttgaccatggcatccatgattgaatctgcttggacgtatctgattacaaatttcaatgacttccaattggcttgtcttggaagtttctttcttcatgaaagtgtcttcttcttgtctggacttcctttcattcttctagaaagggcaggatggttgagcaaatataaaattcagacaaaaaataatactcctgcagctcaggagaaatgtatcactcgcctgttgctgtatcatttttgtgttaatctcccgcttatgatggcatcctatccagtcttcaaattaatggggatgcgaaatactcttccgttgccgtcctggaaagtgatctctacgcaagtattattctactttatcctggaggattttgtattctattggggacacaggattttacatactaaatggctctacaagcatgtccacagtgtccatcacgagtatgcaacaccatttggattgacctctgaatatgctcaccctgctgaaattctttttcttggatttgctacaatagtgggtccaatcattactgggccccatttgataacattatggttgtggatgatagttagagtccttgagacagttgaagcacattgtggttaccatttcccatggagcctatcaaacttcttgccattatatgggggggctgattttcatgattatcatcaccgactgctctacacaaagtctggaaattattcttcaacatttgtttacatggactggttatttggtactgacaagggttacagaagattgaaggtgctgaagagtgatgcatgtgaagctgagggtaaagaaatgtagagatgtgaaagggtaagttttggctggtctggcattgcaagacgggcttatgtacaagagcgtataggtgaaggtttctgttgttgatacctcagttttatgtgcttgtgttcgattgtagttatggcatgaacatcatctactttgtagtgtcatcttagaaattagaagcatgtcttggaaaatttctccttgcaaatgtgcctgcctttgtttcggctatttacattattcaagttccattatttacatgtttcttctcattgatgggtgacctatattggaaccaacttaatctgatttttgtgatctcaactacaatgccctgaatctgtcggttaatatactggtccttggagtagtgaaaacaatctttcatgtctagagaaaaaagttgctagtcattatta

SEQ ID NO: 1601 - DNA, 1379 bp, Solanum lycopersicum
agttggccgtgagcaaatattcgctgacagtctgtcttcatcttcgtggaacccactttactctctctagtgcgcctctattaacacctgccctatatactctctctctctcgtagtttctacttccagaactcatctctctctccggcaggccggcgattgggtcaaacctcattgtttgaccatggcatccatgattgaatctgcttggacgtatctgattacaaatttcaatgacttccaattggcttgtcttggaagtttctttcttcatgaaagtgtcttcttcttgtctggacttcctttcattcttctagaaagggcaggatggttgagcaaatataaaattcagacaaaaaataatactcctgcagctcaggagaaatgtatcactcgcctgttgctgtatcatttttgtgttaatctcccgcttatgatggcatcctatccagtcttcaaattaatggggatgcgaaatactcttccgttgccgtcctggaaagtgatctctacgcaagtattattctactttatcctggaggattttgtattctattggggacacaggattttacatactaaatggctctacaagcatgtccacagtgtccatcacgagtatgcaacaccatttggattgacctctgaatatgctcaccctgctgaaattctttttcttggatttgctacaatagtgggtccaatcattactgggccccatttgataacattatggttgtggatgatagttagagtccttgagacagttgaagcacattgtggttaccatttcccatggagcctatcaaacttcttgccattatatgggggggctgattttcatgattatcatcaccgactgctctacacaaagtctggaaattattcttcaacatttgtttacatggactggttatttggtactgacaagggttacagaagattgaaggtgctgaagagtgatgcatgtgaagctgagggtaaagaaatgtagagatgtgaaagggtaagttttggctggtctggcattgcaagacgggcttatgtacaagagcgtataggtgaaggtttctgttgttgatacctcagttttatgtgcttgtgttcgattgtagttatggcatgaacatcatctactttgtagtgtcatcttagaaattagaagcaagtcttggaaaatttctccttgcaaatgtgcctgcctttgtttcggctatttacgttattcaagttccattatttacatgtttcttctcattgatgggtgacctatattggaaccaacttaatctgatttttgtgatctcaactacaatgccctgaatctgtcggttaatatactggtccttggagtagtgaaaacaatctttcatgtctag

SEQ ID NO: 1602 - DNA, 1255 bp, Echinacea purpurea
atccagggggagtgaggcattcatgaatggtatataaatctaaccattattctatttctaatcacaagtacaaacaagcagtgtgcacgggctcagattcgtttcctccaatctgttcttcattcttcaccggattccatgacttcaatcatcgaatctggctggacgtatttgatcaccaatttcagtgactttcagctggcatgccttggaagttttttgcttcatgaatctgtcttcttcttatcgggccttcctttcatttactttgaaagggctggatggctcagcaagtacaaaatacagacgaagcataacaccactgaagcacaagataaatgcatcactcgcctactgttgtatcatttctgtgtcaatctgcctgttatgattgcttcttatcctgtttttagattcatgggaatgcgaagtagtcttcctttgccatcctggaaagtaatgtcgacacaaatactattctacttcattgtggaagattttatattttactggggacacaggatcttacatactaaatggttatacaaacacgtccacagtgtccatcatgagtatgcaacacctttcggattgacctcagaatacgctcaccctgctgaaattctattccttggtttcgccacaattttcgggcccgccattacgggcccacatctgataacactttggttgtggatggtagttagagttttggagacagttgaagcacattgtggttatcattttccatggagcccttctaactttcttcctttatacggcggttccgattttcatgactatcatcaccgactaatctacactaagtctggcaactactcatcaacttttgtctacatggactggctatttggtactgacacagggtacagaaaactgaaggcgttaaagagtgaagaggaagacaaatataaagagcattaacatgccctaaaaatggattgttttcgccatggactgtgacaaaggtcctgtcttttcttaattgtgaattcgtttattattgcaatttttgtcttgtatcctgtatgtgcgcatcctcaacaaaatgagggcacttgatcctctatacgttgtcctgtttgttgtagatcgtttaaagacttttaagacccatgctcgcccactaaattgatctctttcttcttagaaccttgttaagactccgttaagaacatccacagtggcgtgtccggttcaggtcaaaacgggtgttattcttggtttggttggt

SEQ ID NO: 1603 - DNA, 1140 bp, Cichorium intybus
tatccggggagtgagggattcgtgaatgggacaaatacaagtggagtgaccacgagctttgattcatttcacaatctgttcttcccctttctcttgtcgtcatctgttctggctggatcctggccggattccatggcttcaataatcgaatctggttggacgtatttgatcacaaacttcagtgactttcaattagcttgccttggaagttttttgcttcatgaatcagtcttcttcttatctggacttcctttcatttacttagaaagagcaggatggttcagcaaatacaagattcaggtgaagaataacaccactgaagctcaaaataaatgcatcactcgcttactattgtatcatttttgtgtcaatctccccgttatgattgcttcatatcctgtcttcagattcatgggaatgcgaagtagtcttccattgccatcctggaaagtaatatcaacacagatcctattctacttcattgtcgaagattttatattttactggggacacagaattttacataccaaatggctgtacaagcatgtccacagtatccatcatgagtatgcaacacctttcggattaacctcagaatatgcacaccctgctgaaatattattccttggttttgctactattttcggtcctgccatcacgggcccacatctcataacactttggttgtggatggtagtgagagttctagaaacagtagaggcacattgtggttatcatttcccatggagcccctcaaatttccttcctttatatggaggttctgactttcacgactatcatcaccgacttatctacaccaaatccggcaactactcatcaacttttgtctatatggactggttatttggtaccgacagcgggtacagaaaactgaaggcactgaagagtgaaggggaagtcacatataaagagaattgaggaagggaagaaaagtcttttttttcgtgtgacaaaggtcgctttgcttttttttctttttttttttaatgtgatttgtttcaggatttttaacgttgttgattccaaattcctttttagtactaaaagaaacttgctgaatagcaagtactgttttttttgttccttcaaacatgtgcatgaaaaaactggttaatgaaa

SEQ ID NO: 1604 - DNA, 1012 bp, Nicotiana tabacum
  misc_feature (580)..(580): n is a, c, g, or t
  misc_feature (773)..(773): n is a, c, g, or t
tctctctctcacacacacacatacacacactttctagcgctctctctctctctccttctctctctctgcggctggctggctggccggagatcgagtcaatcctcattgtttgaccatggcttccatgatcgaatctgcttggacgtatctgattacaaattttagcgactttcaattggcttgtcttggaagtttctttcttcatgaaagtgtcttcttcttgtctggacttcctttcattcttctcgaaagggcgggatggttgagcaaatacaagattcagacaaaaaataatagcccagcagctcaggagaaatgcatcactcgcctgctgctgtatcatttctgtgttaatctcccacttatgatggcatcatatccggtctttagattaatggggatgcgaagtactctcccgttgccgtcctggtactttcaggaaagtgatctcaacacaagtattcttctactttatcctagaggattttgtattctattggggacataggatattacatactaaatggctctacaagcatgtccacagcgtccatcacgagtatgcaacaccatttggatngacttctgaatatgctcaccctgctgaaattctcttccttggatttgctacaatagtgggtccagccatcactgggccccatttgataacattatggttgtggatggtgcttagagtccttgagacagttgaggcacactgtggttaccatttcccttggagcctctcaaacttcctgccattatatggaggngctgattttcatgactatcatcaccggctgctctatacgaagtctggaaactattcatcaacgtttgtttacatggactggttatttggtaccgacaagggttacagaagattgaaggagctgaagaatgatgcatgtgaaattgagggaaaagaaatgtaaagcgacgagaaaagggtaagctttggctggtctgtcatcacaagatgggtttctgttagaacttggaagcttgtctt

SEQ ID NO: 1605 - DNA, 958 bp, Ambrosia trifida
tattatatacatctaattacaagtacaagtagtgagtgtgcacgacctcagattcatctcatcaatctgttcttcttctatccttcattggattccatgacttcattcatcgaatctggttggacgtatttgatcaccaatttcagcgactttcaattggcatgccttggaagctttttgcttcatgagtcggtcttcttcttatcaggacttcctttcatttacttagaaagggctggatggctcagcaagtacaaaattcagactaaacataacaccactgaagctcaagataaatgcatcactcgcctactgttatatcatttttgtgtcaatctgcctgttatgattgcttcttatcctgtttttagattcatgggaatgcgaagtagtcttccattgccatcctggaaagtaatgtcgacacagatactgttctacttcattgtggaagattttatattttactggggacacaggatcttacatactaaatggctatacaaacatgtccacagtgtccatcatgagtatgcaacacctttcggattgacctcagaatacgcacaccctgctgaaattttgttccttggtttcgccacaattttcgggcctgccatcacaggcccacatctgataacactttggttgtggatggtagtgagggttttggagacggttgaagcacattgcggttatcatttcccatggagcccctcaaattttcttcctttatacggaggttccgattttcatgactatcatcaccgacttatctacactaaatctggcaactactcgtcaacttttgtctacatggactggctatttggtaccgacacagggtacagaaaactgaaggcgttaaagagtgaagaggaagacaagtataaagagaattaaggggctctcaaaaaatggattttagactgttttcgccatgcatcgtgacaaaggt

SEQ ID NO: 1606 - DNA, 2031 bp, Solanum lycopersicum
atccgtataacttattctctctgttttcctccatccaaaaaaaaacagcaaaattcccaaaatctatatcaaattaatcttcaattcttgcaaatttcttcaagatttttcagttttcgaacacccaattgactaaaataatggaaaaagatctcagattttgaacatttttgaagaaaaaagaaacaaagaagctagataaaaggggatatacttgaaaatggagtgtgttggagctcaaaatgttggagcaatggcagtttttacgcgtccgagatttaaaccgttggtcgggaggagagttatgccaagaaaaaagcaatctttttggcgtatgagtagtatgaaagtaaaatgtaatagcagtagtggtagtgatagttgtgtagttgataaagaagattttgctgatgaagaagattatataaaagccggtggttcgcaacttgtatttgttcaaatgcagcagaaaaaagatatggatcagcagtctaagctttctgatgagttacgacaaatatctgctggacaaaccgtactggatttagtggtaatcggctgtggtcctgctggtcttgctcttgccgcggagtcagctaaattggggttgaacgtggggctcgttgggcctgatcttcctttcacaaacaactatggtgtatgggaggacgagttcaaagatcttggtcttcaagcctgcattgaacatgtttggcgggataccattgtatatcttgatgatgatgaacctattcttattggccgtgcctatggaagagttagtcgccattttctgcacgaggagttactcaaaaggtgtgtggaggcaggtgttttgtatctaaactcgaaagtggataggattgttgaggccacaaatggccagagtcttgtagagtgcgagggtgatgttgtgattccctgcaggtttgtgactgttgcatcgggagcagcctcggggaaattcttgcagtatgagttgggaggtcctagagtttctgttcaaacagcttatggagtggaagttgaggttgataacaatccatttgacccgagcctgatggttttcatggattatagagactatgtcagacacgacgctcaatctttagaagctaaatatccaacatttctctatgccatgcccatgtctccaacacgagtctttttcgaggaaacttgtttggcttcaaaagatgcaatgccattcgatctgttaaagaaaaaactgatgctacgattgaacacccttggtgtaagaattaaagaaatttacgaggaggaatggtcttacataccggttggtggatctttgccaaatacagaacaaaaaacacttgcatttggtgctgctgctagcatggttcatccagccacaggttattcagtcgtcagatcactttctgaagctccaaaatgcgcctctgtacttgcaaatatattacgacaaaattatagcaagaacatgcttactagttcaagtatcccgagtatatcaactcaagcttggaacactctttggccacaagaacgaaaacgacaaagatcgtttttcctatttggactggctctgatattgcagctggatattgaggggataaggtcatttttccgcgcattcttccgtgtgccaaaatggatgtggcagggatttcttggttcaagtctttcttcagcagacctcatgttatttgccttctacatgtttattattgcaccaaatgacatgagaaaaggcttaatcagacatcttttatctgatcctactggtgcaacattgataagaacttatcttacattttagagtaaattcctcctacaatagttgttgaatcagaggcctcattacttcagattcataacagaaatcgcggtctctcgaggcattgtatataacattttcactaggttaatatgcttgaataagttgcatagtttcagtttttgtatctgcttctttttttgtcctagatcatgtattgatccaatctatatacattgccaatatatataaattttacaatattgcta

SEQ ID NO: 1607 - DNA, 2148 bp, Solanum phureja
tgtagaaaaaaaaaagtcttgaattattgtcaagatgaaataactccagcaaatcaaatccatccacgtgtccattcatgaaataaaaattgtacacatcagcaaaaaacttccctcctccctatccatataactattctctctgttttcccctcttgtccatccaaaaaaacagcaaaattcccaaatctatatcaaattaatcttcaattcttgcaaatttcttcaagatttttcaattttcaaacatccaattaaccaaaataatggaaaaagatcacagattttgaacatttttgaagaaaaaaaaaaacaaagaagctagagaaaggggatatacttgaaaatggagtgtgttggagctcaaaatgttggagcaatggcggtttttacgcgtccgagattgaaaccattagttgggaggagaattatgccaagaaaaaaacaatctttttggcctatgagtagtatgaaagtgaaatgtaatagtagtagtggaagtgagagttgtgtagttgataaagaagattttgctgatgaagaagattatataaaagccggtggttcgcaacttgtttttgttcaaatgcagcagaaaaaagatatggatcagcagtctaagctttctgatgagttgcaacaaatatcagctggacaaactgtactggatttagtggttattggctgtggtcctgctggtcttgctcttgccgcggagtctgctaaattggggttgaacgtggggctcgttgggcctgatcttcctttcacaaataactatggcgtatgggaggatgagttcaaagatcttggtcttcaagcctgcattgaacatgtttggcgggataccattgtatatcttgatgatgatgatcctattcttattggccgtgcctatggaagagttagtcgccatttactgcatgaggagttactcaaaaggtgtgtggaggcaggtgttttgtatctaaactcgaaagtggataggattgttgaggccacaaatggccacagtcttgtagagtgcgagggtgatgttgtgattccctgcaggtttgtgactgttgcatcgggagcagcctcggggaaattcttgcagtatgagttgggaggtcctagagtttctgttcaaacagcttatggagtggaagttgaggtcgataacaatccatttgacccgagcctgatggttttcatggattatagagactatgtcagacacgacgctcaatctttagaagctaaatatccaacatttctctatgccatgcccatgtctccaacacgagtctttttcgaggaaacttgtttggcttcaaaagatgcaatgccattcgatctgttaaagaaaaaactgatgttacgattgaacaccctcggtgtaagaattaaagaaatttacgaggaggaatggtcttacataccagttggaggatctttgccaaatacagaacaaaaaacacttgcatttggtgctgctgctagcatggttcatccagccacaggttattcagtcgtcagatcactgtctgaagctccaaaatgcgccttcgtgcttgcaaatatattacgacaaaatcatagcaagaatatgcttactagttcaagtaccccgagtatttcaactcaagcttggaacactctttggccacaagaacgaaaacgacaaagatcgtttttcctatttggactggctctgatattgcagctggatattgaggggataaggtcatttttccgcgcgttcttccgtgtgccaaaatggatgtggcagggatttcttggttcaagtctttcttcagcagacctcatgttatttgccttctacatgtttattattgcaccaaatgacatgagaagaggcttaatcagacatcttttatctgatcctactggtgcaacattgataagaacttatcttactttttagagtaaattcctcctacaatagttgttgaatcagaggcctcattacttcagattcataacagaaatcgcggtctctcgaggccttgtatataacattttcactaggttaatatgcttgaataagttgcacagtttcagtttttgtatctgcttcttttttgtccaagatcatgtattgatccaatttatatacattgccagtatatataaattttataa

SEQ ID NO: 1608 - DNA, 1771 bp, Nicotiana benthamiana
tatatatactcaaaaatggagtgtgttggagctcgaaattttgctacaatggcggtttttacgtgtccgagattcaattcattagaaagaaggagaattataccaagaaaaaagcaaccattttggcctatacatatgaaagtgaagtgtagtggaagtgatagttgtgtagtagttaaagaagattttgctgatgaagaagattatataaaagctggtggttcagaacttgtttttgttcaaatgcagcagaataaagacatggatctgcagtctaagctttctaataagttgcgacaaatatcagctggacaaactatactggatttggtggtcatcggctgtggtcctgctggtcttgctcttgctgcggagtctgctaaactcggattgaacgtggggctcgttggtcctgatcttcctttcacaaataactatggtgtttgggaggatgagttcaaagatcttgggcttcaagcatgcattgaacatgtttggagggataccattgtatatcttgatgattccgatccaattcttattggtcgtgcttatggaagagttagtcgccatttactgcacgaggagttactcaaaaggtgtgtggaggcaggtgttttatatcttaactcgaaagtggataggatcgttgagtccacaagtggccacagtcttgtggagtgcgagggcgatattgtgattccctgcaggtttgtcactgttgcatctggagccgcctcaggaaaattcttgcaatacgagttgggaggtcctcgggtttctgttcaaactgcttatggagtggaagttgaggtggataacaatccatttgatccaagcgtgatggttttcatggattatagagactatgtcagacacgacgctcaatctttagaagctaaatatccaacatttctatatgccatgcccatgactaaaacaagagtctttttcgaggaaacttgtttggcttcaaaagatgcaatgccatttgatcttttaaagaaaaaactgatgttacgattgaacacattgggcataaaaattaaaaaaatctacgaggaggaatggtcttacataccagttggtggatcattaccaaacaccgagcaaaaaacacttgcatttggcgctgctgctagcatggttcatccagctacaggttattcagttgttcgatcactgtccgaggcgccaaaatgtgcctccgtacttgctaatattttaagacaaaatcatgtcaaagacatgctcatcagttcaagtaccacaagtatctcaactcaagcttggaacaccctttggccacaagaacgaaaaaggcaacgatcgtttttcctatttggattggcactcatattgcagctggatattgaggggattaggtcattttttcgcgcattcttccttgtgccaaaatggatgtggcaaggatttcttggctctagtctttcatcggcagacctcatgttatttgccttctacatgtttattattgcaccaaatgacatgagaaaaggcctaatcagacatctattatctgatccaactggtgcaaccatgataagaacttatcttacattttagagtaattccgagcctcatcattttagattcagaggagaaatcactgccttttgtatataacatttcactagattatattaatatgctcaaataaattacaggaattcaattttgtatctacttctttgtccaaatgtattgatccgttgaattctattagctataatgaataatagatggtttt

SEQ ID NO: 1609 - DNA, 2048 bp, Nicotiana benthamiana
gtctcaacattttcagaacgaaataactgcagcaaatcaaatcgactcacgtgtcatttttgtgaaataacagtaacacatcagcaaaaagcttccctccttcctatccataacttcactctctgtccatccaaaaaaccagcaaagactcacaaaactccattttaatttcagcttcaattcttgctattttttcatgcattttcaattttcaaaatcccattaaaccaaaagaatgaatgaaaatctcatattttgaaaaacttgagaaaagaaaaataaaaccgaggagtcagaaagagtatatatacattggagctcaaaaatggagtgtattggaggtcaaaattttgctacaatggcggtttttgcgtgtccgagattcaaatcattaggaaaaaggagaattatgccaataaaaaagcaactattttggcctatacatatgaaagtgaagtgtcgtggaagtgatagttgtgtagtagttaaagaagattttgctgatgaagaagattatataaaagctggtggttcagaacttgtttttgttcaaatgcagcagaataaagacatggaactgcagtctaagctttctaataagttgcgacaaatatcatcagctggacaaactatactggatttagtggtcattggctgtggtcctgctggtcttgctcttgctgcggagtctgctaaactcgggttgaacgtggggctcgttggacctgatcttcctttcacaaataactatggtgtctgggaagacgagttcaaagatcttgggcttcaagcgtgcatcgaacatgtttggcgagacaccattgtatatcttgatgatgccgatccaattcttattggacgtgcttatggaagagttagtcgccatttactgcacgaggagttactcaaaaggtgtgtggaggcaggtgttttatatcttaactcgaaagtggataggatcgtggagtccacaagtggccacagtcttgtggagtgcgaaggcgatattgtcattccctgcaggtttgtcactgttgcatctggagccgcctcaggaaaattcttgcaatacgagttgggaggtcctcgggtttctgttcaaactgcttatggagtggaagttgaggtggataacaatccatttgatccaagcgtgatggttttcatggattatagagactatgtcagacacgacgctcaatctttagaagctaaatatccaacatttctatatgtcatgcccatgactaaaacaagagtctttttcgaggaaacttgcttggcttcaaaagatgcaatgccatttgatctgctaaagaaaaaactgatgttacgattgaacacattgggcataaaaattaaaaaaatctacgaggaggaatggtcttacataccagttggtggatctttgccaaatacagagcaaaaaacacttgcgtttggcgctgctgctagcatggttcatccagctacaggttattcagttgtcagatcactgtccgaggcgccaaaatgcgcctccgtacttgctaatattttaagacaaaatcatgccaagaacatggttacaagttcaagtaccataagtatctcaactcaagcttggaacaccctttggccacaagaacgaaaaaggcaacgatcgtttttcctatttggattagcactcatattgcagctggatattgaggggattaggtcatttttccgcacattcttccgtgtgccaaaatggatgtggcaaggatttcttggctctagtctttcctcagcagatctcatgttatttgccttctacatgtttattattgcaccaaatgacatgagaaaaggactaatcagacatctgttatctgatccaactggtgcaaccatgataagaacttatcttacattttagagtagattcagatgagaaatcactgccttttgtatatagcatttcactagattatattaatgtgctcaaataaattacaggaactccagatgtattatcacattgaactctattagcttcaataaatgaatgatgattttgctgataa

SEQ ID NO: 1610 - DNA, 1110 bp, Arabidopsis lyrata
cttcttttaacacttcgaaaagtttatgccccgctgtggtaaccaccgagcagcttttgaaatggacggtaccacttaccaaagattcccaaagatcaatatccgtgagcttaaagatgactacgccaagtttgagcttcgtgaaaccgacgtttcaatggccaacgctctccgtcgcgtaatgatctccgaagtccccaccatcgcaatagatctcgtcaacatcgaggttaattcctctgttctcaacgacgagttcattgctcaacgacttggtctcatccctctcactagcgagcgtgctatgagcatgcggttctgtcaagattgtgatgcttgtgatggagaaggacaatgcgagttttgctctgttgagtttccgcttagtgctaagtgtgttactgaccaaaccctagatgttactagtagagatctctacagtgctgatcctactgttactcctgttgatttcactattgactcgtctgcttctgattcaagcgagcaaaagggaattaccattgtgaaactgcgcaggggacaagagttgaagcttaaggcgatagcgaggaaaggaattgggaaagatcatgcaaaatggtctcctgcagctactgttacgtttatgtatgagcctgacattattatcaatgaagacttgatggacactttgacagacgaggagaaaatagacttgattgagagcagtccaaccaaagtttttggcattgatccagtcaccagacaggttgtggtggttgatcctgaagcatacacttacgatgaagaagtgatcaagaaagcagaagccatgggaaaaccaggactcattgagatctatccgaaacatgatagttttgtattcactgttgagtccacaggtgcactgaaggcttcccagctggtactaaatgccatagacatcctgaagcagaagcttgatgcaatctgtctctcagatgacactgtagaagctgatgatcagtttggtgaactcagtgcccatatgcgtggaggatgaactcgtggctaattcgataacaacatgtgaagatcagagtaatatattaattgtaggggcactgtcttattcgataacaacatgtgaag

SEQ ID NO: 1611 - DNA, 1236 bp, Arabidopsis lyrata
tatcttcttctccggcgaagaaattgaaaagtcattatccctaaaaccctaataaagctcaacactcgtcagaaaccaccgagcagcttctgcaatggacggtgccacttaccaaagattcccaaagatcacgatccgtgagcttaaagatgactacgcaaagttcgagcttcgtgaaaccgacgtatccatggccaacgctctccgtcgcgttatgatctccgaagtcccaacagtcgcaatagatctcgtcgaaatcgaagttaattcctctgttctcaacgacgagttcattgctcatcgattaggtctcattcctctcactagcgagcgtgctatgagcatgcggttctctcgagattgtgatgcttgtgatggagatggacagtgcgagttttgctctgttgagtttcggcttagtgctaagtgtgttactgaccaaaccctagatgttactagtagggatttgtacagtgctgatcctactgttactccggttgatttcactattgactcgtctgcttctgattcaagcgagcaaaagggaattatcattgtgaaactgcgtcggggacaagagttgaagcttagggcgatagcgaggaaagggattgggaaagatcatgcaaaatggtctcctgcagctactgttacgtttatgtatgagcctgacattattatcaatgaagatatgatggacactttgtcagacgaggaaaaaatcgacttgattgagagcagtcctaccaaagtgtttggcattgacccagtcaccagacaggttgtggtggttgatcctgaagcatacacttatgatgaagaagtgatcaagaaagctgaagcaatggggaaaccggggctcattgagatccatccgaaagatgatagttttatattcactgttgaatccacaggtgcagtgaaggcttcccagctggtgctaaatgcgatagatatcctgaagcagaagcttgatgcagtccgtctctcagatgacactgtagaagccgatgatcagtttggtgaactcggtgcccatatgcgtggaggatgaactcatggttaattcaagctctttgttttacccgtttgtttcgggtttaagtttcttcaagaccagactagtatattaaccgtagccgcactggcttgttagaatgaagcaacattcttctgtttgttccggagctatgatccttctgttcctgaatcttgttaagttaggttattgttagt

SEQ ID NO: 1612 - DNA, 1251 bp, Arabidopsis lyrata
ttctcctaatttttatcttcttctccggcgaagaaattgaaaagtcattatccctaaaaccctaataaagctcaacactcgtcagaaaccaccgagcagcttctgcaatggacggtgccacttaccaaagattcccaaagatcacgatccgtgagcttaaagatgactacgcaaagttcgagcttcgtgaaaccgacgtatccatggccaacgctctccgtcgcgttatgatctccgaagtcccaacagtcgcaatagatctcgtcgaaatcgaagttaattcctctgttctcaacgacgagttcattgctcatcgattaggtctcattcctctcactagcgagcgtgctatgagcatgcggttctctcgagattgtgatgcttgtgatggagatggacagtgcgagttttgctctgttgagtttcggcttagtgctaagtgtgttactgaccaaaccctagatgttactagtagggatttgtacagtgctgatcctactgttactccggttgatttcactattgactcgtctgcttctgattcaagcgagcaaaagggaattatcattgtgaaactgcgtcggggacaagagttgaagcttagggcgatagcgaggaaagggattgggaaagatcatgcaaaatggtctcctgcagctactgttacgtttatgtatgagcctgacattattatcaatgaagatatgatggacactttgtcagacgaggaaaaaatcgacttgattgagagcagtcctaccaaagtgtttggcattgacccagtcaccagacaggttgtggtggttgatcctgaagcatacacttatgatgaagaagtgatcaagaaagctgaagcaatggggaaaccggggctcattgagatccatccgaaagatgatagttttatattcactgttgaatccacaggtgcagtgaaggcttcccagctggtgctaaatgcgatagatatcctgaagcagaagcttgatgcagtccgtctctcagatgacactgtagaagccgatgatcagtttggtgaactcggtgcccatatgcgtggaggatgaactcatggttaattcaagctctttgttttacccgtttgtttcgggtttaagtttcttcaagaccagactagtatattaaccgtagccgcactggcttgttagaatgaagcaacattcttctgtttgttccggagctatgatccttctgttcctgaatcttgttaagttaggttattgttagtcg

SEQ ID NO: 1613 - DNA, 1326 bp, Arabidopsis thaliana
tcttctcctatctccttctccggcgaagaaattgaaaattcattatccctaaaaccctaataaaggtccagagagtcgtcagaaaccaccgattagcttttgaaatggacggtgccacataccaaagattcccaaagatcaagatccgtgagcttaaagatgattacgccaagttcgagcttcgtgaaaccgacgtttctatggccaacgctctccgtcgcgtaatgatctccgaagtccctaccgtcgcaatagatctagtcgaaatcgaggttaattcatctgtactcaacgacgagttcattgctcatcgattaggtctcattcctctcactagcgaacgtgctatgagcatgcgtttctctcgagattgtgatgcttgtgatggagatggacaatgcgagttttgctctgttgagtttcggcttagttctaagtgtgttactgatcaaaccctagatgttactagtagggatttgtacagtgctgatcctactgttactcctgtggatttcactattgactcgtctgtatctgattcaagcgagcacaagggaattatcattgtgaaactgcgtcggggacaagagttgaagcttagagcgatagcgaggaaagggattgggaaagatcatgcgaaatggtctcctgcagctactgttacgtttatgtatgagcctgacataattattaatgaagatatgatggatactttgtcagacgaggaaaagatcgacttgattgagagcagtcctaccaaagtgtttggcatggatccagtcaccagacaggttgtagtggttgatcctgaagcatacacttacgatgaagaagtgatcaagaaagctgaagcaatggggaaaccgggactcattgagatcagtccgaaagatgacagttttatattcactgttgagtccacaggtgcagtgaaggcttcccaactggtactaaatgccattgatcttctgaagcagaagcttgatgcagtccgtctctcagatgacaccgtagaagcggatgatcagtttggtgaactcggtgcccatatgcgtggaggatgaactcaagtgattaattcgagctctttgttatacctgtttgtttcaggttttgagtttcttctggagcagactgatattaaccgtagtggcactgtcttgtttgataacatgtgaagtggcagtcttctatttgttctggacctctgatccctctgttcctgaatcttgttaagtttggttgttgttagttgttagactcgctcgtaacgaaaataaacgcaaggattaaattcaatacattgaacaagtatgattaaaatgg

SEQ ID NO: 1614 - DNA, 1339 bp, Eutrema parvulum
tctctcactctgctccatcttcggcgaagaaagttaagaaaaccctctggattgatcatcctaaaaccctaaaaaagctccaaaggaatcagaaatcaccgagctttgagatggacactggtgccacttaccagagattcccaaaggtgaagatccgtgagcttaaagatgactacgccaagttcgagcttcgtgataccgatgtgtccatggccaatgctctccgtcgcgtaatgatctccgaagtccccaccgtcgcaatcgatctcgtcgaaatcgaggttaattcctctgttctcaacgatgagttcattgctcatcgattaggtctcattcctctcactagcgagcgtgctatgagcatgcgcttctctcgagattgcgatgcttgcgatggagatggacagtgcgagttctgctctgttgagtttcgtcttagcgctaaatgtgtcactgaccaaacccttgatgttactagtagggatttgtatagtgctgaccctactgttactcctgtcgatttcggcatcgattcttctggaactgattcaaccgagcaaaggggaattatcatagtgaaactgcgccgtggacaagaactgaagcttagggcgatagcaaggaaaggaatcgggaaagatcacgcaaaatggtctcctgcagctactgttacgtttatgtatgaacctgacataaatattaatgaagatatgatggacactttgacagacgaggaaaagatcgacttgattgagagcagcccgaccaaagtttttggctttgattcagccaccagacaggttgtggtggttgatccggaagcatacacttacgacgaagaagtggtcaagaaagcagaagccatggggaaaccggggctcattgagatccatccaaaagatgacagttttatattcactgttgaatccacaggtgcagtgaaagcgtcgcagctggtactgaacgccatagatatcctgaagcaaaagctcgatgcagtccgtctgtcagatgacactgttgaagctgatgatcagtttggtgaacttggtgcccacatgcgtggaggatgagcttgtggtaaacttgagctccatattttgcctgtgtgtttcgggtttgagtttattttgaactattaaccgtagcagtacactcttgttagataacaacttgtgaagcagtgatccttttgttcttgaatcttgttattatgtgaattaagactaaagtctattcttgcaccatgtgtttaggacatgagctggctatatatcggatgccattacctgaacggttatgtttcgaaaagaaagagcaaaattgtaataatttgggt

SEQ ID NO: 1615 - DNA, 1301 bp, Eutrema parvulum
ctgctccatcttcggcgaagaaagttaagaaaaccctctggattgatcatcctaaaaccctaaaaaagctccaaaggaatcagaaagcaccgagctttgagatggacactggtgcctcttaccagagattcccaaaggtgaagatccgtgagcttaaagatgactacgccaagttcgagcttcgtgataccgatgtgtccatggccaatgctctccgtcgcgtaatgatctccgaagtccccaccgtcgcaatcgatctcgtcgaaatcgaggttaattcctctgttctcaacgatgagttcattgctcatcgattaggtctcattcctctcactagcgagcgtgctatgagcatgcgcttctctcgagattgcgatgcttgcgatggagatggacagtgcgagttctgctctgttgagtttcgtcttagcgctaaatgtgtcactgaccaaacccttgatgttactagtagggatttgtatagtgctgaccctactgttactcctgtcgatttcggcatcgattcttctggaactgattcaaccgagcaaaggggaattatcatagtgaaactgcgccgtggacaagaactgaagcttagggcgatagcaaggaaaggaatcgggaaagatcacgcaaaatggtctcctgcagctactgttacgtttatgtatgaacctgacataaatattaatgaagatatgatggacactttgacagacgaggaaaagatcgacttgattgagagcagcccgaccaaagtttttggctttgattcagccaccagacaggttgtggtggttgatccggaagcatacacttacgacgaagaagtggtcaagaaagcagaagccatggggaaaccggggctcattgagatccatccaaaagatgacagttttatattcactgttgaatccacaggtgcagtgaaagcgtcgcagctggtactgaacgccatagatatcctgaagcaaaagctcgatgcagtccgtctgtcagatgacactgttgaagctgatgatcagtttggtgaacttggtgcccacatgcgtggaggatgagcttgtggtaaacttgagctccatattttgcctgtgtgtttcgggtttgagtttattttgaactattaaccgtagcagtacactcttgttagataacaacttgtgaagcagtgatccttttgttcttgaatcttgttattatgtgaattaagactaaagtctattcttgcaccatgtgtttaggacatgagctggctatatatcggatgccattacctgaacggttatgtttcgaaa

SEQ ID NO: 1616 - DNA, 1106 bp, Brassica juncea
aagagagatggacagtggtgccacttaccagagattcccaaaggtgaagatccgtgagctcaaagatgactacgccaagttcgagcttcgtgacaccgatgtttccatggcgaacgctctccgccgcgtcatgatctccgaagtcccaaccgtcgcaatcgatctggtcgaaatcgaggttaattcctctgttctcaacgacgagtttatcgctcatcggttaggtctcatccctctcaccagcgaacgtgcgatgagcatgcgcttctctcgagactgcgatgcttgcgatggagatggacagtgcgagttctgctctgttgagtttcgtcttagcgctaaatgtgtcactgaccaaaccctagatgttactagtagggatctctacagtgctgatcctactgttactcctgttgatttcggtgattcatctggagctgattcaagcgagcaaagaggaatcatcatagtgaaactgagacgtggacaagaactgaagcttagggcgatagcaaggaaaggaatcgggaaagatcacgctaaatggtctcctgcagccactgttacgttcatgtatgagcctgacatagttatcaatgaagatatgatggacactttgacagacgaggaaaagattgacttgattgagagcagcccgaccaaagtttttgactttgatgcagtcaccagacaggttgtggtggttgatccagaagcatacacttacgatgaagaagtgatcaagaaagcagaagccatggggaaagaggggctcattgagatacgtcccaaggatgacagttttatattcactgttgaatccacaggtgcagtgaaggcttcgcagctggtactaaatgccatagatctcctgaagcagaagctcgatgcagtccgtctctcagacgacactgttgaagctgatgatcagtttggcgaactaggtgcacatatgcgtggaggatgagcgtgtggttcatttgggctccatgtttttccccgtttgtttcgggtttgagtttatgtttggaccagggcaatctattttaccgtagcgggacactcttcttagataactacttatgaagcaggtggtcttctgtttt

SEQ ID NO: 1617 - DNA, 1167 bp, Brassica oleracea
  misc_feature (603)..(603): n is a, c, g, or t
  misc_feature (741)..(741): n is a, c, g, or t
  misc_feature (763)..(763): n is a, c, g, or t
  misc_feature (765)..(765): n is a, c, g, or t
  misc_feature (795)..(795): n is a, c, g, or t
  misc_feature (850)..(852): n is a, c, g, or t
  misc_feature (867)..(867): n is a, c, g, or t
  misc_feature (879)..(879): n is a, c, g, or t
  misc_feature (924)..(924): n is a, c, g, or t
  misc_feature (969)..(969): n is a, c, g, or t
  misc_feature (993)..(993): n is a, c, g, or t
  misc_feature (1020)..(1020): n is a, c, g, or t
  misc_feature (1026)..(1026): n is a, c, g, or t
  misc_feature (1041)..(1041): n is a, c, g, or t
  misc_feature (1053)..(1053): n is a, c, g, or t
  misc_feature (1060)..(1060): n is a, c, g, or t
  misc_feature (1063)..(1063): n is a, c, g, or t
  misc_feature (1067)..(1067): n is a, c, g, or t
  misc_feature (1073)..(1073): n is a, c, g, or t
  misc_feature (1076)..(1076): n is a, c, g, or t
  misc_feature (1080)..(1080): n is a, c, g, or t
  misc_feature (1085)..(1085): n is a, c, g, or t
  misc_feature (1091)..(1091): n is a, c, g, or t
  misc_feature (1093)..(1093): n is a, c, g, or t
  misc_feature (1096)..(1096): n is a, c, g, or t
  misc_feature (1102)..(1102): n is a, c, g, or t
  misc_feature (1104)..(1104): n is a, c, g, or t
  misc_feature (1107)..(1107): n is a, c, g, or t
  misc_feature (1117)..(1118): n is a, c, g, or t
  misc_feature (1123)..(1123): n is a, c, g, or t
  misc_feature (1128)..(1128): n is a, c, g, or t
  misc_feature (1131)..(1131): n is a, c, g, or t
  misc_feature (1136)..(1136): n is a, c, g, or t
  misc_feature (1139)..(1139): n is a, c, g, or t
  misc_feature (1148)..(1148): n is a, c, g, or t
  misc_feature (1158)..(1158): n is a, c, g, or t
  misc_feature (1163)..(1163): n is a, c, g, or t
gaccactctagctcttcaccttcagcgaagaaagttaagaaactctctctctccggattgttcagactaaaaccctaaaaagctagagagatggacagtggtgccacttaccagagattcccaaaggtgaagatccgtgagctgaaagatgactacgccaagttcgagcttcgtgacaccgatgtctccatggcgaacgctctccgtcgcgttatgatctcggaggtccccacggtcgcaatcgatctggtcgaaatcgaggttaattcctctgttctcaacgatgagttcattgctcatcggttaggtctcatccctctcactagcgagcgtgcgatgagcatgcgcttctctcgagactgcgatgcttgcgacggagacggacagtgcgagttttgctctgttgagtttcgtcttagcgctaaatgtgtcactgaccaaaccctagatgttactagtaaggatctgtacagcgctgatcctactgttactcctgttgatttcggtgattcatcgggagctgattcaagcgagcaaaggggaatcatcatagtgaaactgagacggggacaagaactgaagcttagggcgatagctaggaanggaatcgggaaagatcacgctaaatggtctcctgcagccactgttacgttcatgtatgagcctgacattattatcaatgaagatatgatggacactttgacagacgacgaaaagattgacttgattgagagcagcccnaccaaagtttttgactttgatncngtcaccagacaggttgtggtggttgatccngaagcatacacttacgatgaagaagtgatcaagaaagcagaagccatggggaaannngggctcattgagatncgtccgaaagangacagttttatattcactgttgaatccacaggtgcagtgaaggcntcgcagctggtactgaatgccatagatctcctgaagcagaagctngatgcagtccgtctctcagacganactgttgaagctgatgatcagtttggngaactnggtgcacatatgcgnggaggatgagcntgtggtnaanttgngctccntgntttnccagnttgttncnggnttgagntnatnttggaccagnncaatnttttnacngtagnggnacactcttnttagataacnacttntgaa

SEQ ID NO: 1618 - DNA, 1375 bp, Brassica rapa
ctaccactctatctcttcaccttcagcgaagaaactctctctctctctctctctctctctccggattgttcagacaaaaaccctaaaaacctcgagagatggacagtggtgccacttaccagagattcccaaaggtgaagatccgtgagctgaaagatgactacgccaagttcgagcttcgtgacaccgatgtctccatggcgaacgctctccgtcgcgttatgatctccgaggtccccacggtcgcaatcgatctggtcgaaatcgaggttaattcctctgttctcaacgatgagttcattgctcatcggttaggtctcatccctctcaccagcgagcgtgcgatgagcatgcgcttctctcgagactgcgatgcttgcgacggagacggacagtgcgagttttgctctgttgagtttcgccttagcgctaaatgtgtcactgaccaaaccctagatgttactagtaaggatctgtacagcgctgatcctactgttactcctgttgatttcggtgattcatctggagctgattcaagcgagcaaagaggaatcatcatagtgaaactgagacgtggacaagaactgaagcttagggcgatagcgaggaaaggaatcgggaaagatcacgctaaatggtctcctgcagccactgttacgttcatgtatgagcctgacattatcatcaatgaagatatgatggacactttgacggacgacgaaaagattgacttgattgagagcagcccgaccaaagtttttgactttgatgctgtcaccagacaggttgtggtggttgatccagaagcatacacttacgatgaagaagtgatcaagaaagcagaagccatggggaaacaagggctcattgagatccgtccgaaagatgacagtttcatattcactgttgaatccacaggtgcagtgaaggcttcgcagctggtactgaatgccatagatctcctgaagcagaagctcgatgcagtccgtctctcagacgacactgttgaagctgatgatcagtttggcgaactaggtgcacatatgcgtggaggatgagcgtgtggttcatttgggctccatgtttttcccggtttgtttcgggtttgagtttatgtttggaccagggcaatctattttaccgtagcgggacactcttcttagataactacttaggaagcatgtggtcttctgttttggcccctgcaaactgatcccttcttaaatcttgttattatgtgcttcagactaaagtttattcttgctccatgtgtttatcacatgacatgacccggctatagaaccgatgccatttacctgaacggttatgtttcgaaataagagggaaaaaattgtactaatttggctatagatct

SEQ ID NO: 1619 - DNA, 1286 bp, Brassica napus
ctctctctccggattgttcagactaaaaccctaaaaagctagagagatggacagtggtgccacttaccagagattcccaaaggtgaagatccgtgagctgaaagatgactacgccaagttcgagcttcgtgacaccgatgtctccatggcgaacgctctccgtcgcgttatgatctcggaggtccccacggtcgcaatcgatctggtcgaaatcgaggttaattcctctgttctcaacgatgagttcattgctcatcggttaggtctcatccctctcactagcgagcgtgcgatgagcatgcgcttctctcgagactgcgatgcttgcgacggagacggacagtgcgagttttgctctgttgagtttcgtcttagcgctaaatgtgtcactgaccaaaccctagatgttactagtaaggatctgtacagcgctgatcctactgttactcctgttgatttcggtgattcatcgggagctgattcaagcgagcaaaggggaatcatcatagtgaaactgagacggggacaagaactgaagcttagggcgatagctaggaaaggaatcgggaaagatcacgctaaatggtctcctgcagccactgttacgttcatgtatgagcctgacattattatcaatgaagatatgatggacactttgacagacgacgaaaagattgacttgattgagagcagcccgaccaaagtttttgactttgatgctgtcaccagacaggttgtggtggttgatccagaagcatacacttacgatgaagaagtgatcaagaaagcagaagccatggggaaacaagggctcattgagatccgtccgaaagatgacagttttatattcactgttgaatccacaggtgcagtgaaggcttcgcagctggtactgaatgccatagatctcctgaagcagaagctcgatgcagtccgtctctcagacgacactgttgaagctgatgatcagtttggcgaactaggtgcacatatgcgcggaggatgagcgtgtggtttaatttgtgctccatgttttccccagtttgtttcgggtttgagtttatgtttggaccagggcaatctattttaccgtagcgggacactcttcttagataactacttatgaagcaggtggtcttctgttttggcccctgcaaactgatcccttcttaaatcttgttattatgttattcagactaaagtttattcttgctccatgtgtttatgacatgacccggctatagaaccgatgccatttacctgaacggttatgtttcgaaataaga

SEQ ID NO: 1620 - DNA, 1236 bp, Brassica napus
ctagataaaccctaaaaagactagagagatggacagtggtgccacttaccagagattcccaaaggtgaagatccgtgagctgaaagatgactacgccaagttcgagcttcgtgacaccgatgtctccatggcgaacgctctccgtcgcgttatgatctccgaggtccccacggtcgcaatcgatctggtcgaaatcgaggttaattcctctgttctcaacgacgagttcattgctcatcggttaggtctcatccctctcaccagcgagcgtgcgatgagcatgcgcttctctcgagactgcgatgcttgcgacggagacggacagtgcgagttttgctctgttgagtttcgccttagcgctaaatgtgtcactgaccaaaccctagatgttactagtaaggatctgtacagcgctgatcctactgttactcctgttgatttcggtgattcatctggagctgattcaagcgagcaaagaggaatcatcatagtgaaactgagacgtggacaagaactgaagcttagggcgatagcgaggaaaggaatcgggaaagatcacgctaaatggtctcctgcagccactgttacgttcatgtatgagcctgacattatcatcaatgaagatatgatggacactttgacagacgacgagaagattgacttgattgagagcagcccgaccaaagtttttgactttgatgctgtcaccagacaggttgtggtggttgatccagaagcatacacttacgatgaagaagtgatcaagaaagcagaagccatggggaaacaagggctcatcgagatccgtccgaaagatgacagtttcatattcactgttgaatccacaggtgcagtgaaggcttcgcagctggtactgaatgccattgatctcctgaagcagaagctcgatgcagtccgtctctcagacgacactgttgaagctgatgatcagtttggcgagctaggtgcacatatgcgtggaggatgagcgtgtggttcatttgggctccatggtttccccgtttgtttcgggtttgagtttatgtttggaccagggcaatctattttaccgtagtgggacactcttcttagataactacttatgaagcaggtggtcttctgttttggcccctgcaaactgatcccttcttaaatcttgttattatgtgattcagactaaagtttattcttgctccatgtgtttatcacatgacatgacccggctatagaaccgat

SEQ ID NO: 1621 - DNA, 1397 bp, Raphanus sativus
  misc_feature (1179)..(1179): n is a, c, g, or t
  misc_feature (1203)..(1203): n is a, c, g, or t
  misc_feature (1218)..(1218): n is a, c, g, or t
  misc_feature (1228)..(1228): n is a, c, g, or t
ggaccttcagggaagaaggaaagttaagaaactctctctctctctctctgcttcaccttcattcgaaaaccctaaaaagttaagagagatggacagtggtgccacttaccagagattcccaaaggtgaagatccgtgagctcaaagatgactacgccaagttcgagcttcgtgacaccgatgtttccatggcgaacgctctccgtcgcgttatgatctccgaagtccccacggtcgcaatcgatctggtcgaaatcgaggttaattcctctgttctcaacgacgagttcatcgctcatcgattaggtctaatccctctcactagcgaacgtgcgatgagcatgcgcttctctcgagactgcgatgcttgcgatggagatggacagtgcgagttttgctctgttgagtttcatcttagagctaaatgtatcactgaccaaaccctagatgttactagtagggatctctacagtgctgatcctactgtcactactgttgatttcggtctcgattcatctggagctgactcaagcgagcaaaggggcattatcatagtcaaactgagacgtggacaagaactgaagcttagggcgatagcaaggaaaggaatcgggaaagatcacgctaaatggtctcctgcagccactgttacgttcatgtatgagcctgacattgttatcaatgaagatatgatggacactttgacagacgaggaaaagattgacttgattgagagcagcccgaccaaagtttttgactttgatgcagtcaccagacaggttgtggtggtcgacccagaagcatacacttacgatgaagaagtgatcaagaaagcagaagccatggggaaaccagggctcattgagatccgtccgaaagatgacagttttatattcactgttgaatccacaggtgcagtgaaggcttcgcagctggtactaaatgccatagatctcctgaagcagaagctcgatgcagtccgtctttcagacgacactgttgaagctgatgatcagtttggcgaactaggtgcacatatgcgtggaggatgagcgtgtggttaatttgggatctccatgtttttcccgtttgtttcgggtttgagtttatgttggaccagggcaatctattttccgtagcggtacactcttgttagataacaacttgtgaagcagtggtnttctgttcttgccccttcaaactnaaccttcctttcttnaatcttgttnttacgtgattcagactaaagtctattcttgctccatgtgtttatgacatgaggtggctatagatccgatgccattatcagttatgtttcggaatgagaggaaaaaaatcgtaccaatttggctatggatctatattccattaacaattacaataatcacttcaatggct

SEQ ID NO: 1622 - DNA, 1369 bp, Eutrema halophilum
atggaagaagacgaaggcaagaaggacttcttaagggtttcctttacttcttcttcttcgacgaataaagttaagaaaccctctggtttcatcaaagctaaaaccctaaaaaagttccagaggagtcagaaagctccgagctttgagatggacactggtgcctcttaccaaagattcccaaaggtcaaaatccgtgagcttaaagatgactacgccaagttcgagcttcgtgagaccgatgtatcaatggccaacgctctccgtcgcgttatgatctccgaggtcccaaccgttgcaatcgatctcgtcgaaatcgacattaactcatctgtgctcaacgacgagttcatcgctcatcgattaggtctcatccctctcactagcgaacgcgctatgagcatgcgcttgtcccgagattgcgattcttgtgatggagatggacagtgtgagttctgctctgttgagtttcgtctacaagctaaatgtgtcactgaccaaaccctagatgtcactagtagggatctttacagtactgatcctactgtcactcctgtcgatttcactctcgattcgtctggaactgattcaagcgagcaaaggggaattatcatagtgaagctgcgccggggacaagaattgaagcttagagcgatagctaggaaaggaattgggaaagatcatgcaaaatggtctcctgcatctactgttacgtttatgtatgagcctgacatcaacattaatgaagatatgatggatactttgacagaagacgaaaaaattgacttgattgagagcagcccgaccaaagtctttggcattgatccagtcactagacaggttgtggtggttgatccggaagcatacacttacgatgaagaggtgattaagaaagctgaagccatggggaaaccggggctcattgagatccatccgaaagatgacagttttatattcactgttgaatcaacaggtgcagtgaaggcttcgcagctggtactgaacgccatagatatcctgaagcagaagcttgacgcagtccgtctctcagacgacactgtagaagccgatgatcagtttggtgaactcggtgctcatttgcgtggaggatgagcttgtggtagacttgaggtccatgttttgcccgtttgattcgggtttgagtgtcttttggactaccagtatattaaccgtaggggcacactcttgttagataacaacttgtgaagcattgagtcttctgttgtccctgacctgtgatcatttcgttcttaaatcttgttattaagtgaattgaaactaatttctattcttgaattacgtttaggacatgagctggcttatagaaccgatgcgattacctgaacggttt

SEQ ID NO: 1623 - DNA, 1368 bp, Eutrema halophilum
atggaagaagacgaaggcaagaaggacttcttaagggtttcctttacttcttcttcttcgacgaataaagttaagaaaccctctggtttcatcaaagctaaaaccctaaaaaagttccagaggagtcagaaagctccgagctttgagatggacactggtgcctcttaccaaagattcccaaaggtcaaaatccgtgagcttaaagatgactacgccaagttcgagcttcgtgagaccgatgtatcaatggccaacgctctccgtcgcgttatgatctccgaggtcccaaccgttgcaatcgatctcgtcgaaatcgacattaactcatctgtgctcaacgacgagttcatcgctcatcgattaggtctcatccctctcactagcgaacgcgctatgagcatgcgcttgtcccgagattgcgattcttgtgatggagatggacagtgtgagttctgctctgttgagtttcgtctacaagctaaatgtgtcactgaccaaaccctagatgtcactagtagggatctttacagtactgatcctactgtcactcctgtcgatttcactctcgattcgtctggaactgattcaagcgagcaaaggggaattatcatagtgaagctgcgccggggacaagaattgaagcttagagcgatagctaggaaaggaattgggaaagatcatgcaaaatggtctcctgcatctactgttacgtttatgtatgagcctgacatcaacattaatgaagatatgatggatactttgacagaagacgaaaaaattgacttgattgagagcagcccgaccaaagtctttggcattgatccagtcactagacaggttgtggtggttgatccggaagcatacacttacgatgaagaggtgattaagaaagctgaagccatggggaaaccggggctcattgagatccatccgaaagatgacagttttatattcactgttgaatcaacaggtgcagtgaaggcttcgcagctggtactgaacgccatagatatcctgaagcagaagcttgacgcagtccgtctctcagacgacactgtagaagccgatgatcagtttggtgaactcggtgctcatttgcgtggaggatgagcttgtggtagacttgaggtccatgttttgcccgtttgattcgggtttgagtgtcttttggactaccagtatattaaccgtaggggcacactcttgttagataacaacttgtgaagcattgagtcttctgttgtccctgacctgtgatcatttcgttcttaaatcttgttattaagtgaattgaaactaatttctattcttgaattacgtttaggacatgagctggcttatagaaccgatgcgattacctgaacggtt

SEQ ID NO: 1624 - DNA, 1298 bp, Eutrema halophilum
ggaaatcagagggaaaaggaaagcaccgagctttgagatggacactggtgcatcttaccagagattcccaaaggtgaagatccgtgagcttaaagatgactacgccaagttcgagcttcgtgagaccgatgtatccatggccaacgctctccgtcgcgtcatgatctccgaggtccccaccgttgcaatcgatctggtcgaaatcatgattaattcctctgttctcaacgatgagttcatcgctcatcgattaggtctcatccctctcaccagcgagcgtgctatgagcatgcgtttctctcgcgattgcgatgcttgcgatggagacggacagtgtgagttctgctctgttgagtttcagcttggcgcaaaatgtgtcacagaccaaacccttgatgtcactagtagggatctgtacagtgctgatcctactgttactcctgtcgatttcgctaccgatccttctgcaactgattctagcgagcaaaggggaattatcatagtgaagctgcgccgtggacaagaattgaagcttagggcgatagcaaggaaaggaatcgggaaagatcacgcaaaatggtctcctgcagctactgtgacgtttatgtatgagcctgacataaacattaatgaagacatggtggatactttgacagacgaggagaaattcgacttgattgagagcagcccgaccaaagtatttggcattgatccagtcaccagacaggttgtggtggttgatccggaagcatacacttacgatgaagaagtgatcaagaaagcagaagccttgggaaaaccggggctcattgagatccacccgaaagatgatagctttatattcactgttgaaaccacaggtgcagtgaaggcttcgcaactggtactgaatgccatagacatcctgaagcagaagcttgatgcagtccgcctctcagacgacactgtagaagctgatgatcaatttggtgagctcggtgcccatatgcgtggaggatgagcttgtggtaaattcgagctccatgttaacaagactagtgtaggggcacattcttgttagatagcagcttgtgaagcaatggtcttctgtttgtcactgacctttgatcatttcgttcttgaatgtggttattaagtgagttcaaactaatgtcgtaaaagctcgagtaaagaagaagttgttccttagtaatgtaatgacatgcttcacagctggtacagaatgcttcataactcagacgacactatagaagcttacgaacaatttggttttttaatatgatacgctattttttagt

SEQ ID NO: 1625 - DNA, 1324 bp, Eutrema halophilum
gagaaacccctaaatagagttgcagaggaaatcagagggaaaaggaaagcaccgagctttgagatggacactggtgcatcttaccagagattcccaaaggtgaagatccgtgagcttaaagatgactacgccaagttcgagcttcgtgagaccgatgtatccatggccaacgctctccgtcgcgtcatgatctccgaggtccccaccgttgcaatcgatctggtcgaaatcatgattaattcctctgttctcaacgatgagttcatcgctcatcgattaggtctcatccctctcaccagcgagcgtgctatgagcatgcgtttctctcgcgattgcgatgcttgcgatggagacggacagtgtgagttctgctctgttgagtttcagcttggcgcaaaatgtgtcacagaccaaacccttgatgtcactagtagggatctgtacagtgctgatcctactgttactcctgtcgatttcgctaccgatccttctgcaactgattctagcgagcaaaggggaattatcatagtgaagctgcgccgtggacaagaattgaagcttagggcgatagcaaggaaaggaatcgggaaagatcacgcaaaatggtctcctgcagctactgtgacgtttatgtatgagcctgacataaacattaatgaagacatggtggatactttgacagacgaggagaaattcgacttgattgagagcagcccgaccaaagtatttggcattgatccagtcaccagacaggttgtggtggttgatccggaagcatacacttacgatgaagaagtgatcaagaaagcagaagccttgggaaaaccggggctcattgagatccacccgaaagatgatagctttatattcactgttgaaaccacaggtgcagtgaaggcttcgcaactggtactgaatgccatagacatcctgaagcagaagcttgatgcagtccgcctctcagacgacactgtagaagctgatgatcaatttggtgagctcggtgcccatatgcgtggaggatgagcttgtggtaaattcgagctccatgttaacaagactagtgtaggggcacattcttgttagatagcagcttgtgaagcaatggtcttctgtttgtcactgacctttgatcatttcgttcttgaatgtggttattaagtgagttcaaactaatgtcgtaaaagctcgagtaaagaagaagttgttccttagtaatgtaatgacatgcttcacagctggtacagaatgcttcataactcagacgacactatagaagcttacgaacaatttggttttttaatatgatacgctattttttagt

SEQ ID NO: 1626 - DNA, 1200 bp, Brassica rapa
tcggcgagaaaccctttggatcctaaaaccccaaaaagaccacaacgagctttacacatggacaccggcgccacttaccagagattcccaaaggtgaagatccgcgagctcaaagacgactacgccaagttcgagctccgcgacaccgacgtatccatggccaacgccctccgccgcgtcatgatctccgaagtccccaccgtcgcgatcgacctcgtcgagatcgaggtcaactcctccgtcctcaacgacgagttcatcgctcatcgcctcggtctcatccctctcaccagcgagagggctatgaacatgcgcttctctcgagactgcgatgcttgcgacggagatggacagtgcgagttttgctccgttgagtttcatcttagcgccaaatgtgttacggaccaaaccctggatgttactagtagggatttgtacagtgctgatgctactgttactcctgttgacttcggcgtcgattcatctggagttgctgattcaggcgagcaaaggggaattataatagtgaaactgcggcgtggacaagaactgaagctaagggcaatagcgaggaaaggaatcgggaaagatcacgcgaaatggtctcctgcagctacggttacgtttatgtatgagcctgacattattatcaatgaagatatgatggacactttgacggacgaggaaaagatcgacttgattgagagcagccctaccaaagtttttgactttgattctgtcaccagacaggttgtggtggttgatccggaagcatacacttacgatgaagaagtgatcaagaaagcagaagccatggggaaagtggggctcgttgagatacgtccgaaagacgacagttttatattcactgttgaatccacaggtgcagtgaaggcctcgcagctggtactgaatgctatagttctcctgaagcagaagctcgacgcagtccgtctctcagacgatactgttgaagctgatgatcagtttggtgaactcggtgcacatatgcgtggagggtgagcttgcggtaaacttgagctacttagtttggcagtttgtcctgggattaagataatattttaactgtagtggtacactcttgttagaaaacaatttgggaaacagtggtctcttgtttttacctgacatctgatcatcttgttattatgtgaattcacactagtcttatttttgcac

SEQ ID NO: 1627 - DNA, 954 bp, Brassica napus
cggcacgaggaaggtgaagatccgcgagctcaaagacgactacgccaagttcgagcttcgcgacaccgacgtatccatggccaacgccctccgccgcgtcatgatctccgaagtccccaccgtcgcgatcgacctcgtcgagatcgaggtcaactcctccgtcctcaacgacgagttcatcgctcatcgcctgggtctcatccctctcaccagcgagagggccatgagcatgcgcttctctcgggattgcgatgcttgcgacggagatggacagtgcgagttttgctccgtcgagtttcatcttagggctaaatgtgttacggaccaaaccctggatgttactagtagggatttgtacagtgctgatgctaccgttactcctgttgacttcggcgtcgattcatctgattcaggcgagcaaaggggaattatcatagtgaaactgcggcgtggacaagaactgaagctaagggcaatagcgaggaaaggaatcgggaaagatcacgcgaaatggtctcctgcagctacggttacgtttatgtatgagcctgacataattatcaacgaagatatgatggacactttgacggacgaggaaaagatcgacttgattgagagcagccctaccaaagtttttgactttgattcagtcaccagacaggttgtggtggttgatccggaagcatacacttacgatgaagaagtgatcaagaaagcagaagccatggggaaagtggggctcattgagatacgtccgaaagacgacagttttatattcaccgttgaatccacaggtgcagtgaaggcctcgcagctggtactgaatgccatagatctcctgaagcagaagcttgatgcagtccgtctctcagacgatactgttgaagctgatgatcagtttggtgaactcggtgcacatatgcgtggaggatgagcttgtggtaaacttgagct

SEQ ID NO: 1628 - DNA, 1284 bp, Arabidopsis thaliana
ccaaatttcttcttcttctccggcgaagaaatcgaaaagtcattaccctaagagtcccagagtcgtcagaaggaacagcttttgaaatggacggtgtcacctaccaaagattcccaacggtgaagatccgtgagcttaaagatgactacgccaagttcgagcttcgtgaaaccgacgtttcaatggccaacgctctccgtcgcgtaatgatctccgaagtccccaccatggcaatccatctcgtcaaaatcgaggttaattcctctgttctcaacgacgagttcattgctcaacgacttagtctcatccctctcactagcgagcgtgctatgagcatgcggttctgtcaagattgtgaagattgtaatggagatgaacattgcgagttctgctctgttgagtttccccttagtgctaagtgtgttactgaccaaaccctagatgttactagtagggatctctacagtgctgatcctactgttactcctgttgatttcactagtaactcatctacttctgattcaagcgagcacaagggaattatcattgcgaaactacgcaggggacaagagttgaagcttaaagcattagctaggaaaggaattgggaaagatcatgcgaaatggtctcctgcagctactgttacgtatatgtatgagcctgacattattatcaatgaagagatgatgaacactttgacagatgaggaaaaaattgacttgattgagagcagtcctaccaaagtgtttggcattgacccagtcaccggacaggttgtggtggttgatcctgaagcatacacttacgatgaagaagtgatcaagaaagctgaagcaatggggaaaccgggactcattgagatccatccgaaacatgatagttttgtattcactgttgagtccacaggtgcattgaaggcttctcagctggtactaaatgccattgatatcctgaagcagaagcttgatgcaatccgtctctcagataacactgtagaagccgatgatcagtttggtgaactcggtgcccatatgcgtgaaggatgaaatcgtagctctttttttacctgtttgatcagggtttaagtttcttctagaccagactaatatattaaccgtagcggcactgccttgtttgatagcaacatgtaaagtggcagtcttgtctttgttcccgacctctgactgatccttgtgttcctgaaccttgttatgttgggttatttttagtcgttgaactctctcgtaattggcgttttttttgttgtcattgttaagaatgggt

SEQ ID NO: 1629 - DNA, 1259 bp, Theobroma cacao
ctattttaggctttttagctccagagccaaaaaccattcaatcaaatttcagaaatggagggagtctcctaccagcgattccccaaggtcaaaatccgcgaactgaaagacgactatgcaaaattcgagcttcgcgacaccgacgcctccatggccaacgccctccgtcgcgtcatgattgccgaggtccccaccatcgcaatcgacctcgtcgaaattgaagtcaactcctccgtccttaacgacgagttcattgcccaccgcctcggcctcatccctctcaccagcgaacgcgccatgtcgatgcgattctcgcgtgactgtgacgcatgcgacggtgacggccagtgcgagttctgctccgtcgagttccatcttcgtgccaaatgcatgaccgatcaaaccctcgatgttaccagcaaggatctctatagttccgatcatacggttgttcccgtcgatttcaccgattccgctggctacgattcctctgagcaaagggggattatcattgtgaagttacggcgagggcaagaattgaggctgagggcaattgcgaggaaaggtatagggaaagaccatgcgaaatggtcaccggctgcgactgtgactttcatgtatgaacctgagattcatatcaatgaagatatgatggaaaccttgacgcttgaggagaagcaaagctttgttgagagtagtcctactagagtctttgatattgatcctaatacccaacaggttgtggtggttgatccagaggcatatacctacgatgatgaagtgctaaagaaagctgaagctatgggaaagccaggccttgtggagatttatgcaaaagaagacagtttcatttttactgttgaatccactggtgcgatcaaagcttctcagttggtacttaatgctatagaagtcctcaaacagaagctggatgcagttcgcctgtctgaggatactgtggaagctgatgatcaatttggtgaacttggtgctcatatgcgaggaggatgatccacttgtaaaaaagctgctcattgacatttttatgtttttggagaagacatgtttacatcttactaacttcctctttttttagaattcttaaatatctttgggtacaattgactacttgttttctttgtgaaacttgtcagcagatatgctatccattttaaacttaagcagcttgtgaagcacggactgacaaatgatttagcttgtactattactttgctcaaactaccagccgttttatttgt

SEQ ID NO: 1630 - DNA, 2007 bp, Theobroma cacao
acagtaggaggatttagcaagtagcgtgttagctaaggaagaaacgacgtcacttggtactcaagtgagtgtaacaagccgacacgacaatcgaccaaaaccccattttgggtttgtcaactcttctgttcctcttcgcttacaggttctattttaggctttttagctccagagccaaaaaccattcaatcaaatttcagaaatggagggagtctcctaccagcgattccccaaggtcaaaatccgcgaactgaaagacgactatgcaaaattcgagcttcgcgacaccgacgcctccatggccaacgccctccgtcgcgtcatgattgccgaggtccccaccatcgcaatcgacctcgtcgaaattgaagtcaactcctccgtccttaacgacgagttcattgcccaccgcctcggcctcatccctctcaccagcgaacgcgccatgtcgatgcgattctcgcgtgactgtgacgcatgcgacggtgacggccagtgcgagttctgctccgtcgagttccatcttcgtgccaaatgcatgaccgatcaaaccctcgatgttaccagcaaggatctctatagttccgatcatacggttgttcccgtcgatttcaccgattccgctggctacgattcctctgagcaaagggggattatcattgtgaagttacggcgagggcaagaattgaggctgagggcaattgcgaggaaaggtatagggaaagaccatgcgaaatggtcaccggctgcgactgtgactttcatgtatgaacctgagattcatatcaatgaagatatgatggaaaccttgacgcttgaggagaagcaaagctttgttgagagtagtcctactagagtctttgatattgatcctaatacccaacaggttgtggtggttgatccagaggcatatacctacgatgatgaagtgctaaagaaagctgaagctatgggaaagccaggccttgtggagatttatgcaaaagaagacagtttcatttttactgttgaatccactggtgcgatcaaagcttctcagttggtacttaatgctatagaagtcctcaaacagaagctggatgcagttcgcctgtctgaggatactgtggaagctgatgatcaatttggtgaacttggtgctcatatgcgaggaggatgatccacttgtaaaaaagctgctcattgacatttttatgtttttggagaagacatgtttacatcttactaacttcctctttttttagaattcttaaatatctttgggtacaattgactacttgttttctttgtgaaacttgtcagcagatatgctatccattttaaacttaagcagcttgtgaagcacggactgacaaatgatttagcttgtactattactttgctcaaactaccagccgttttatttgtgtttctgctttgttttatctgtatggtagcattttacttttcacctcaagtggcagttaaaagttttatgtcaggataaagtttcacttttggtatttgtcaaattgtcaaccaagctgaaaaatgattactacactattttcatgtgactgaaattcatccttgttaagcatctttgcttcaatctgtagtgggctttaacttgtccgctctgattttatgtaaattttgacgagcaattctccattgatatatagctttctaaatatgaattttcttttgtatgtgtataataccttttcgacctcattgaaggtttcattgaataaggtctcctcttagagatctttttgttcaaggtttaatggagtttgcattattctcacgacatggctgtcctaagctgggtaaccaacagagtggtcattgaaacaagttgcgtcagttcatttagtatgttagctaggcttgtttactaatcagacaagtcaagttcaccgatgagctgttgctcagcttttatgagtgatgcaatgtcctattgcgcagagtgttcttggactgtattaagaagagatgtaatcaatcaggtttaaaaag

SEQ ID NO: 1631 - DNA, 1576 bp, Ricinus communis
tcataattgccaaaaccccgaatcatagagttttagagcagaaaaacaatcaaaataccccgagacacacacataaacagtgtgttacagagagaaacgtcaaaggaaaatggaaggagcatcctaccaacgctttccaagaatcaaaatccgagaactcaaagacgactactgcaaattcgagctccgagacacagacgcgtcaatggccaacgcgcttaggcgcgtgatgatagcagaagtacccactgtcgctatcgacctggtcgaaatcgaagttaactcttcagttctgaacgacgaattcatcgctcatcgtctcggtcttattcctcttaccagtgaacgtgcaatgagcatgcgcttctcacgtgattgtgacgcttgtgatggtgatggtcaatgtgattattgctctgttgagtttcaccttcgtgctaaatgtatcactgatcaaaccctagatgttactagtaaggacttgtatagctctgatcacacagtcgttcctgttgatttttccgattcttctggttatgattcctctgagcaaagggggattattattgtgaagctgcgaagagggcaggaattgagattgagagcaattgctaggaaagggattgggaaggatcatgcaaaatggtcacctgcagcgactgtaacattcatgtatgagccagatattcatatcaacgaggatctgatggaaagtttgtcacttgaggagaaacagagttgggttgaaagtagtcctactaaagtgtttgatatcgatcctaatactcaacaggttgtagtggttgatcctgaagcatacacttatgatgaagaagtaatcaagaaagcagaatctatggggaagccagggcttgtgaatatccaggccaaggaagacagttttatattcacagttgaatcaactggtgcaattaaagcttctcagctggtactcaatgccatagaaattctgaaacaaaaattggatgctgttcgcctttcagaggacactgtggaagctgatgatcaatttggagagctaggtgcccacatgcgcggaggatgatctagtttgcaaatagagttattagttgatccttgttggcccctaagaaaattatcaccttctgttttactatgcgtcatttacaatatcttatgctaactgcatctcttttatgccatgtacatctctgcatctgtatgagacattgacttctacctactgtactaggcaacgatgcttattactttgatacagagagtgccatgattatgatgcagaatcttggtgctctaacttggattcttggttgccctgctcaacaatgtgagccaagtccagatggcatctttttttacccccttgaaattatgctggatgggattcttcatgattttagatatcacaaaaaaaagaaaaagaggatgtatgatagatgttttcacaactatgactttagaagacacactgacttgctgaattttacaagatgttttgtttaatgaaatgaaaattttcttatccctgtgaatgaagtagcattttgcagcttgagatgggtggagataatat

SEQ ID NO: 1632 - DNA, 1354 bp, Gossypium raimondii
cattttccttccattgcagagccgaagacctcaaatccattcaaaaaaaataaaaatggagggaatatcgtaccagcgattccctaaggttaaaatcagagagctgaaggatgactacgctaaatttgagcttcgcgataccgatgcctccatggccaatgccctccgccgcgtcatgatctccgaggtccccaccatcgctattgacctcgtcgaaatcgaagtcaactcctccgtccttaacgacgagttcattgcccatcgcctcggtctcatccctctcaccagcgaacgcgccatgtctatgcgcttctcccgtgactgtgacgcttgcgacggtgacggtcagtgcgagttctgctccgttgagttccatcttcgcgccaaatgcatttccgatcaaaccctcgacgttaccagcaaggatctctatagttcggaccatactgttgttcccgtcgatttcaccgataacgctggctacgattccactgagcctagagggattattattgtgaagttacggcgagggcaagaactgaggctgagggcaattgctaggaaagggatagggaaagatcacgccaaatggtcacctgctgcgacggtgacttttatgtatgaacctgagattcatatcaatgaagatttgatggaaagcttgacgcttgaagagaagctaagctttgttgagagcagtccaactaaagtctttgacattgacccaaatacccaacaggttgtggtggttgatccagaggcgtatacctatgacgatgaggtgctaaagaaagctgaagctatgggcaagcccggtcttgtggagatatatgccaaagaagacagtttcatctttacagttgaatccactggtgcgatcaaagcttctcagttggttcttaatgctatagaaatcctgaaacagaagctggatgcagttcgcctgtctgaggatactgtggaagctgatgatcagtttggtgaactaggtgcccatatgcgaggaggatgatctgcttgtaattaagaactagccattgacatttgtaggtttcagaaaaggcgtgtttacatctaactaacttccttttgtttaaaactcttgagatattttgggtagaacagactacttgttttccttgatgaaaattgtcagctatatgccatctgttttaaacttaaaagccagcaaagcatggacgtagcttattactttgtccaaactatcagcctttgtatttatgtttctgctttgttgtttcttcccactagtgattcatcagtgagcttttagctggttgaaatgtatagtagcatttcgcttttcgcctctattgtatgtcgagattaagtt

SEQ ID NO: 1633 - DNA, 1396 bp, Gossypium hirsutum
cagactcaagccctgccctatagcagtttccttccattgcagagccgaagacctcaaatccatttaaaaaaaataaaaatggagggaatatcgtaccagcgattccctaaggttaaaatccgagagctgaaggatgactacgctaaatttgagcttcgcgataccgatgcctccatggccaatgccctccgtcgtgttatgatctccgaggtccccaccatcgctattgacctcgtcgaaatcgaagtcaactcctccgtccttaacgacgagttcattgcccatcgcctcggtctcatccctctcaccagcgaacgcgccatgtctatgcgcttctcccgtgactgtgacgcttgcgacggtgacggtcagtgcgagttctgctccgttgagttccatcttcgggccaaatgcatttccgatcaaaccctcgacgttaccagcaaggatctctatagttcggaccatactgttgttcccgtcgatttcaccgataacgctggctacgattccactgagcctagagggattattattgtgaagttacggcgagggcaagagctgaggctgagggcaattgcgaggaaagggatagggaaagatcacgccaaatggtcacctgctgcgacagtgacttttatgtatgaacctgagattcatattaatgaggatttgatggaaagcttgacgcttgaagagaagctaagctttgttgagagcagtccaactaaagtctttgacattgacccaaatacccaacaggttgtggtggttgatccagaggcgtatacctatgacgatgaggtgctaaagaaagctgaagctatgggcaagccaggtcttgtggagatatatgccaaagaagacagtttcatctttacagttgaatccactggtgcgatcaaagcttctcagttggttcttaatgctatagaaatcctgaaacagaagctggatgcagttcgcctgtctgaggatactgtggaagctgatgatcagtttggtgaactaggtgcccatatgcgaggaggatgatctgcttgtaattaagaactagccattgacatttgtaggtttcagaaaaggcgtgtttacatctaactaacttccttttgtttaaaactcttgagatattttgggtagaacagactacttgttttccttgatgaaaattgtcagctatatgccatctgttttaaacttaaaagccagcaaagcatggactgacaaatgatttagcctgtggcttattactttgtccaaactatcagcctttgtatttatgtttctgcttagttgtttcttgccaccagtgattcatcagtgagcttttagctggttgaaatgtatagtagcatttcgcttttcgcctctattgtatgtcgagattaagttt

SEQ ID NO: 1634 - DNA, 1567 bp, Gossypium raimondii
aggaaaaacaaaacgacatcgttgcagtatgcaatgaataaccaataagaagccgacacgataagcaaccaaaaccccccagttgggttttaaggaacgcagactcaagccctgccctttagcattttccttccattgcagagccgaagacctcaaatccatttaaaaaaaataaaaatggagggaatatcgtaccagcgattccctaaggttaaaatccgagagctgaaggatgactacgctaaatttgagcttcgcgataccgatgcctccatggccaatgccctccgtcgtgttatgatctccgaggtccccaccatcgctattgacctcgtcgaaatcgaagtcaactcctccgtccttaacgacgagttcattgcccatcgcctcggtctcatccctctcaccagcgaacgcgccatgtctatgcgcttctcccgtgactgtgacgcttgcgacggtgacggtcagtgcgagttctgctccgttgagttccatcttcgcgccaaatgcatttccgatcaaaccctcgacgttaccagcaaggatctctatagttcggaccatactgttgttcccgtcgatttcaccgataacgctggctacgattccactgagcctagagggattattattgtgaagttacggcgagggcaagaactgaggctgagggcaattgcgaggaaagggatagggaaagatcacgccaaatggtcacctgctgcgacggtgacttttatgtatgaacctgagattcatatcaatgaggatttgatggaaagcttgacgcttgaagagaagctaagctttgttgagagcagtccaactaaagtctttgacattgacccaaatacccaacaggttgtggtggttgatccagaggcgtatacctatgacgatgaggtgctaaagaaagctgaagctatgggcaagccaggtcttgtggagatatatgccaaagaagacagtttcatctttacagttgaatccactggtgcgatcaaagcttctcagttggttcttaatgctatagaaatcctgaaacagaagctggatgcagttcgcctgtctgaggatactgtggaagctgatgatcagtttggtgaactaggtgcccatatgcgaggaggatgatctgcttgtaattaagaactagccattgacatttgtaggtttcagaaaaggcgtgtttacatctaactaacttccttttgtttaaaactcttgagatattttgggtagaacagactacttgttttccttgatgaaaattgtcagctatatgccatctgttttaaacttaaaagccagcaaagcatggacgtagcttattactttgtccaaactatcagcctttgtatttatgtttctgctttgttgtttcttcccactagtgattcatcagtgagcttttagctggttgaaatgtatagtagcatttcgcttttcgcctctattgtatgtcgagattaagtttccctttggcttcgtcaagttgtcatctaggtttaaaaatggtggctacagctacggtagaaacttacgtggttgcaactttattactcca

SEQ ID NO: 1635 - DNA, 3094 bp, Gossypium raimondii
tacttcatcaaagctttttaaggcgcagagccaaataacatcatcaaaataatttgaaaaaaaagaaaaagaaaaaatggaaggagcttcgtaccagcgattcccaagggtcaaaatccgggaactcaaagatgactacgctaaattcgagctccacgacaccgatgcttccatggccaacgccctccgccgcgtcatgatcgccgaggttcccaccatagctatcgatctcgtcgaaatcgaagttaactcttccgtcctcaacgacgagttcatcgcccatcgactcggtctcatccctctcactagccaacgcgccatgtcgatgcgattctcgcgtgactgtgacgcctgcgacggtgacggacagtgcgagttctgctccgtcgagttccatcttcgcgccaaatgcataagcgatcaaacactggatgtcaccagtaaggatctttacagttccgatcatacggttgttcccgtcgatttcaccgattccgctggctacgaatcctctgaacaaagggggattatcatcgtgaaattgcggcgagggcaggagttgaggctgagggcaattgcgaggaaagggataggaaaagatcatgcgaaatggtcacctgccgcgactgtgactttcatgtatgaacctgagattcacatcaatgaagatatgatggataccttgacccttgaggagaagcaaagctttgtcgacagtagtcctactagagtctttgacattgatcctaatacccaacaggttgtggtggttgatccagaagcatatacctatgacgatgaagtattaaagaaagctgaagctatgggcaagccggggctcgtggagatatatgccaaagaagacagtttcattttcactatcgaatctaccggtgcggtcaaagcttcccagttagtccttaatgctatagaaatccttaaacagaagctggatgcagttcgcctctctgaggatactgtggaagctgatgatcagtttggtgaactaggtgctcacatgcgaggaggttgattcgcttgtaagtaaaaacagatttcatccgcattgttgctgactgctcttctaatctttaggtacagaatcgactaccttttttttttcttccctttttcctcctcaaattttgtcaccacatttgccatctattctaaacttaaaagcctttgaagcatatggattgacaaatgatttagcttggtatttatgttactgcttttttgtttcatcacaccatcgattcagcagcaagctcttaaccggatgaagtatatggatgccatttggttgggtttggcttaatatatcatttgagcaactaactccttcaatttaagcaaccttctcctattccaactacttgaagagcttggaacaacatcccaatagcttttacctttcatggcatattcttgaacccaagcaatccgtaaacaaccttcctcaataagaatggattgcaccagttgcaagtgacgagccttgttcgattcctcaagtcttctcagccccaacccaccctttgatttaggtgaacaaatcaactgccagcagacccttgctccataagcatagcaatcctttcctttccaaaagaatcaagcacaaacttgggagattcctttaaaaacaaattttggcataagaaactgttcgcaccaggaagcttgaatactaaaatcacagcttcgatgagttgaagccaaccaacatagctaagatgcctagtagaccagccattggttttagctataatttcctccatcgaaggaccacaatcagagaatgtcaacgacctagacacaattggcaccctctaataacgcacaggcaccttaccaactttaaaatcgataatggtcttcatggcctccagttcttctaaagataccccaacaacaaaaagttaacttttagaagcattaggttgtagtccagagagcaggtagaattcctctaagatacaccaaataccaacaacagaattagtagaaccttagcaaagatgaggaggtcatctgcaaaggagaggtgggaaagccgaaccctgagacacttgggatgaaacttaaacacaccataagcaactactaccatcaggagtgtggacaagacattcattgcaatagcaaatagatagggagaaagaggatctccctgccttgctccccttgccccttcaaagaatccaatgagaacctaggagaagtgatgcaactagcaatccacttgacaaattgctcaaggaatcccatggctctcaatacagaaataacaaaattccaactcaaagagtcaaatgccttctaaaggtacaccttaagggcacatctatgagaaataaactttctactatatcccctcatcaactcctggggaagtagagtgttgtcaataatgtttctgctttgaataaaagcactctgattgctttgaataaaagaccttggagatacacttataaactgtgttacaacatgaaataggcctaaactgtttaatatgatttggattctcaaatttaggaacaaatgaaataatagtagtattgaaagcagtcgataactatgaggtggtgaacaaatactgcacaacaccaataagatcctcaccaacaatttttcatgctgatgtgctttatcattcccgtgctcaaaaattggtgtcttgatctatggtgatgggcctaaccatatcattctaagcagccatagacaatgtaggaagaatatctctaagcaattgatcagcaacaccaatgagccctttatcaacttgaataaatcttagaagtaatctgtttatgagattctggtttattacccctatcatcaaacaaagctctgatagaatacatgttcctcttgacagcaatagcattatgaaaaaacttggtactctgatcacctactccgatccaattcatccaagccttttgtctgtagaaactttccccggcatcttgtaaacttgggaactcagattgtaattgatcactcatagtttcaatttgaccctatcagacaacatatcaagctgagctctttttggttcaactctttcccattgtactct

SEQ ID NO: 1636 - DNA, 1232 bp, Manihot esculenta
aaacccctgacgttcccttcaccttcacacagaaatggaaggagtatcataccagcgcttccccagggtgaaaatccgagagctcaaagatgactatgccaaattcgagctccgagacaccgacgcctccatagccaacgctcttcgccgcgtcatgattgctgaggttcccaccattgccatcgaccttgtcgaaatcgaagttaactcctctgtcctcaacgacgagttcatagctcaccgccttggcctcattcctctcaccagcgaacgtgccatgagcatgcgcttctcccgtgactgtgacgcatgcgacggggacggccagtgcgagtattgctcagtcgagtttcacctgcgtgctaaatgtatcaccgaccaaaccttagacgtcacgagcaaggacttatacagctctgatcacactgtagttcctgtcgatttctccgatcctgcaggctatgattcacccgatcagaagggaatcatcattgtgaagcttcgccgcgggcaagaactgaggctgagagccatcgccagaaaagggattggaaaggatcacgcaaaatggtctcctgcggcaactgtaactttcatgtatgagccggatattcatatcaatgaggatttaatggaaactttgacacttgaggaaaaacaaagttgggtcgaaagtagtcctaccaaagtgtttgacatcgatcccgttacccaacaggttgttgtggttgatccggaagcatacacatatgacgatgaagtgattaagaaagcagaagctatggggaagctcgggcttgttgatatcagtgcaaaggaagacagttttatattcacagttgaatcaactggtgcaattaaagcttctcagttggtgctcaatgccatagaagtcctaaaacaaaagctggatgctgttcgcttgtcagaagatacagtggaagctgatgatcagtttggtgaactgggtgctcatatgcgtggaggatgatccagtttgcaaatggagttatcagtttgattagatctatcttttttggcctctaagatagtgataaccttccttctatttttctctaacatactgtatcctatgctaactgcatctctttcctgctttgtacatacatgcatctcaatgagacattaacttctacatactgtatggggcaccttgctatttattttggatatataagagagtgccgtaatcttgatgctcatactttagg

SEQ ID NO: 1637 - DNA, 1265 bp, Sarracenia psittacina
gaagaactcgcaaagatggaaggtgcatcgtaccagcgattcccgaaggtgaagatccgagagctgaaagacgactactgcaaattcgagctccgggacaccgacgcgagcatggcgaacgctctccggcgcgtcatgatcgccgaggtcccgacgatcgccatcgatctggtggagatcgaggttaactcgtccgttctcaacgacgagttcatcgctcatcggctagggctcatccccctcaccagcgaccgggcaatgagtatgcgcttctccagggactgcgacgcctgcgacggcgacggccagtgtgagttctgctccgtggaattccatctccgggccaaatgcatcaatgatcaaaccctagatgtcaccagtaaggatctctacagttccgaccacaccgttgttcccgtggatttctccgattccggctctggtattgacactcctgagcagaggggaattataattgtgaaattacgccgtggccaagaactgaggctgagagccatagccagaaaaggcattggaaaagaccatgcaaaatggtcacctgctgcaactgttactttcatgtatgagccggatattcatatcaatgaagatatgatggagactttgacacttgaggagaaaataagttgggttgagagcagtccaaccaaagtgtttgatattgatcctaccactcagcaggttgtaattgttgatcccgaggcatacacgtacgatgatgaagtgatcaagaaagcagaggcaatggggaagccaggactcgtcgagatctatgcaaaagaagacagttttatatttacagtggagtctagtggtgcggtcaaagcttctcagttggtgcttaatgcaatagaaattctcaaacaaaagctggatgcagttcggctttcagaggatactgttgaagccgacgaacagtttggtgagttgggtgcacatatgcgaggagggtgatctctttgttagaccaggtttttcggttcatttgcttggatttgaagcatgtcaagttgctttttccgtccctagtcacagactaactgttggttctttccaagttgtttcgtagccgtctctcaaaaaggttatggacgctaatcttatcatctgtacggacgtttttaaacttgaaacttcttgcgacaacaattaaccagtgttctctccttgtttgaatttgtcgagttgcacatgtcacatgctttcgatagaatttagttctgtgctgtaaaagtatcatgttg

SEQ ID NO: 1638 - DNA, 2533 bp, Vitis vinifera
atcaaccctactcggcccctttcgcaccatctgatttccctccctccaaattcgatgtttccatttcccctgaccaaagcatctgtctgagacaaacagggaggtagaagaagaagaagaagagcagcaatggaaggagtatcctaccagcgtttcccaaaaatcaagatccgggaagtcaaggacgactacgccaagttcgagctccgtgagaccgatgccagcatggccaacgctctccgccgtgtcatgatcgccgaagttcccaccgttgccattgaccttgtcgaaatcgaggttaactcctctgttctcaatgacgagttcatcgcccaccgactcggactcattcctctcaccagtgagcgagccatgtccatgcgattctctcgcgactgtgacgcatgcgacggtgacggccagtgcgagttttgttccgtcgagttccatttgcgcgccaaatgcatgaccgacgaaacccttgatgttactagcaaggacctcatcagttccgaccatactgttgtccctgttgacttctccgattcctctggctacgattccgccgataagaagggaattataattgtgaagctgcggcgagggcaagaactgaggctgagagctattgccagaaaggggattgggaaggaccacgcgaaatggtcaccggcggctactgttacttttatgtacgagcctgagattcatatcaatgaagatttgatggaatctttgacgcttgaggagaaaacaagttgggttgagagcagtcccacaaaagttttcgacattgatgctagttcccaacaggttgttgtggctgatgctgaggcatacacttatgatgatgaagtgctcaagaaagcagaagctatggggaagccagggcttgtggagatctatgccaaagaagacagttttatattcacagttgaatctactggtgcaatcaaagcttctcagttggtgctcaatgcaatagatgttcttaaacaaaagcttgatgcagtgcggctatcagaggatacggtagaagctgatgatcaatttggtgaactcggtgctcatatgcgaggaggatgatcattttggaccaaacccacaagctgtcaagatgtccttggtgtgccatttggaaatgtttctgggcaggctgtcatggaatatgatgattttcccttagtagcaggattcttctatatagttggaaaaaagaagagagaaaggtcggggttggactacaggggaattggttcttttcccatccttacttggaagacatcatgtgcttatttgggacaaacagtattctttcttccagatggaaagaatcttaccttgagaggtgacacttctgtttcttaattttcctacccagatctcaatgatgaacttatatgattctcaaagcttgtggggcattagatttctcatcatagtatgacatacagatggatcccaatattttgtactctagagaatgaattgttacttaagatacaataatgttataatagcctaataggtagatctagttattagactccttggtttatggttggatatggagaacttgcatagctattctttacttgctacatgtacaaactgttttttgttgctagatttcctagttgttcctctggtacttttcaaagttggattatgttttaagagatctggcttgcattgtgttgagcttaaagttttgcacaagattggacaatttaatgcaataatcagcaacaagaggtttaggctatcacaaatgtgggtgcaggaaagtttttcttttgaatcctatatatatatatatatatttatattggctgctcttgatgattattggttgggaagggtttaaattaatcattcagaggcaatccctgtagcaagttaggttgaagtttgcaaatacacactctttgttggaggaagaattagatgcttggtatctttagaaaattaccaaacaggtgcatttttcttgaataacatagcaattattggttggtagaaatatggttgaggatgctgattcaggtttctccgcaccagttgaagaagttagttgatgttgggtgtgtttctgtcatgggtttagtgaaaaccatggttctcttgttagataggcttaattattattgaattgagagttaagctcttgagttttgtgtttcaaatgcagcatggtttcagaattaaatactagctacaatgttttcctgtgataaattggacttccaaagttactgaagttaaacaggaatttctttggatgaaaaatgatttcgcagtcttcaaactattatccaacaaggcagccttaccaattagtacggaggtcacaaattggtcctgaggatccatggattcaatatccagaacacttgattgttggattatctgaatgaaaaggagggaatgaactgtattgaaagttgtaacataaaattttcaaattgggttcacaggccttgattgtgaaatgcgtcatgcgtgactctggattgtagcaaaaaaaacccca

SEQ ID NO: 1639 - DNA, 1243 bp, Gossypium hirsutum
agtacttcatcaaagcttttaaggcgcagagccaaataacatcatcaaaataatttgaaaaaaggaaaatatggaaggagcttcgtaccagcgattcccaagggtcaaaatccgggaactcaaagacgactacgctaaattcgagctccacgacaccgacgcttccatggccaacgccctccgccgcgtcatgatcgccgaggttcccaccatagccatcgacctcgtcgaaatcgaagttaactcttccgtgctcaacgacgagttcatcgcccatcgactcggtctcatccctctcactagccaacgcgccatgtcgatgcgattctctcgtgactgtgacgcctgcgacggtgacggacagtgcgagttctgctccgtcgagttccatcttcgcgccaaatgcataagcgatcaaacactggatgtcaccagtaaggatctatacagttccgaccatacggttgttcccgtcgatttcaccgattacgctggctacgaatcctctgaacaaagggggattatcatcgtgaaattgcggcgagggcaggagttgaggctgagggcaattgcaaggaaagggataggaaaagatcatgcaaaatggtcacctgccgcgactgtgactttcatgtatgaacctgagattcacatcaatgaagatatgatggataccttgacccttgaggagaagcaaagctttgtcgacagtagtcctactagagtctttgacattgatcctaatacccaacaggttgtggtggttgatccagaagcatatacctatgacgatgaagtattaaagaaagctgaagctatgggcaagccggggctcgtggagatatatgccaaagaagacagtttcattttcactatcgaatctaccggtgcggtcaaagcttcccagttagtccttaatgctatagaaatccttaaacagaagctggatgcagttcgcctctctgaggatactgtggaagcagatgatcagtttggtgaactaggtgctcacatgcgaggaggttgattcgcttgtaagtaaaaaaagatttcatccgcatttgttgctgactgctcttccaatctttaggtacacaatcgactaccttttttttttcttccctttttcctcctcaaattttgtcaccacatttgccatctattctaaacttaaaagcctttgaagcatatggattgacaaatgatttagcttggtatttatgttactgcttttttgtttcat

SEQ ID NO: 1640 - DNA, 3254 bp, Gossypium raimondii
aaaattttaaagtaccaataaattcgaaaagtttacatcagaattttacagggattaaatgataaatttgagcataatagaaggaccaaaataaaaatttaaccaaaacaaaatgtcagtttacgacgtcgttcacttctccattgaagcttaaaaccttcatagttaggttttaaaaaactctacttcatcaaagctttttaaggcgcagagccaaataacatcatcaaaataatttgaaaaaaaagaaaaaatggaaggagcttcgtaccagcgattcccaagggtcaaaatccgggaactcaaagacgactacgctaaattcgagctccacgacaccgacgcttccatggccaacgccctccgccgcgtcatgatcgccgaggttcccaccatagccatcgacctcgtcgaaatcgaagttaactcttccgtcctcaacgacgagttcatcgcccatcgactcggtctcatccctctcactagccaacgcgccatgtcgatgcgattctctcgtgactgtgacgcctgcgacggtgacggacagtgcgagttctgctccgtcgagttccatcttcgcgccaaatgcataagcgatcaaacactggatgtcaccagtaaggatctatacagttccgaccatacggttgttcccgtcgatttcaccgattacgctggctacgaatcctctgaacaaagggggattatcatcgtgaaattgcggcgagggcaggagttgaggctgagggcaattgcgaggaaagggataggaaaagatcatgcgaaatggtcacctgccgcgactgtgactttcatgtatgaacctgagattcacatcaatgaagatatgatggataccttgacccttgaggagaagcaaagctttgtcgacagtagtcctactagagtctttgacattgatcctaatacccaacaggttgtggtggttgatccagaagcatatacctatgacgatgaagtattaaagaaagctgaagctatgggcaagccggggctcgtggagatatatgccaaagaagacagtttcattttcactatcgaatctaccggtgcggtcaaagcttcccagttagtccttaatgctatagaaatccttaaacagaagctggatgcagttcgcctctctgaggatactgtggaagctgatgatcagtttggtgaactaggtgctcacatgcgaggaggttgattcgcttgtaagtaaaaacagatttcatccgcatttgttgctgactgctcttccaatctttaggtacacaatcgactaccttttttttttcttccctttttcctcctcaaattttgtcaccacatttgccatctattctaaacttaaaagcctttgaagcatatggattgacaaatgatttagcttggtatttatgttactgcttttttgtttcatcacaccatcgattcagcagcaagctcttaaccggatgaagtatatggatgccattttggttgggtttggcttaatatatcatttgagcaactaactccttcaatttaagcaaccttctcctattccaactacttgaagagcttggaacaacatcccaatagcttttacctttcatggcatattcttgaacccaagcaatccgtaaacaaccttcctcaataagaatggattgcaccagttgcaagtgacgagccttgttcgattcctcaagtcttctcagccccaacccaccctttgatttaggtgaacaaatcaactgccagcagacccttgctccataagcatagcaatcctttcctttccaaaagaatcaagctcaaacttggaagattcctttccaaactgtttgcaccaggaagattgaatactaaaatcacagcttcgatgagttgaagccaaccaacatagctaagatgcctagtagaccagccattggttttagctataatttcctccatcgaaggaccacaatcagagaatgtcaacgacctagacacaattggcaccctctaataacgcacaggcaccttaccaactttaaaatcgataatggtcttcatggcctccagttcttctaaagataccccaacaacaaaaagttaacttttagaagcattaggttgtagtccagagagcaggtagaattcctctaagatacaccaaataccaacaacagaattagtagaaccttagcaaagatgaggaggtcatctgcaaaggagaggtgggaaagccgaactctgagacacttgggatgaaacttaaacacaccatatgcaactactaccatcaggagtctggacaagacattcattgcaatagcagatagatagggagaaagaggatctccctgccttgctccccttgcccctttaaagaatccaatgagaacctaggagcagtgatgcaactagcaatccacttgacaaattgctcaaggaatcccatggctctcaatacagaaataacaaaattccaactcaaagagtcaaaagccttctaaaggtacaccttaagggcacatctatgagaaataaactttctactatatcccctcatcaactcatggggaagtagagtgttgtcaataatgtttctgctttgaataaaagcactctgattgctttgaataaaagaccttggagatacacttataaactgtgttacaacatgaaataggcctaaactgtttaatatgatttggattctcaaatttaggaacaaatgaaataatagtagtattgaaagcagtcgataactatgaggtggtgaacaaatactgcacaacaccaataagatcctcaccaacaatttttcatgctgatgtgctttatcattcccgtgctcaaaaattggtgtcttgatctatggtgatgggcctaaccatatcattctaagcagccatagacaatgtaggaagaatatctctaagcaattgatcagcaacaccaatgagccctttatcaacttgaataaatcttagaagtaatctgtttatgagattctggtttattacccctatcatcaaacaaagctctgatagaatacatgttcctcttgacagcaatagcattatgaaaaaacttggtactctgatcacctactccgatccaattcatccaagccttttgtctgtagaaactttccccggcatcttgtaaacttgggaactcagattgtaattgatcactcatagtttcaatttgaccctatcagacaacatatcaagctgagctctttttggttcaactctttcccattgtactct

SEQ ID NO: 1641 - DNA, 1426 bp, Citrus clementina
caaaaaccctgattttgggtttaaagaactacacacaatcagcaaaaaacccgtattccctcggtatagctatttggcattcgctaagcaacgagagcgaacgacgatggatggcgcgtcgtaccagcgattcccgaaggtcaaaatccgcgagctcaaagacgactacgccaaattcgagctccgggacaccgacgcctccatggccaacgcgcttcggcgcgtgatgatcgctgaggtccccaccatcgccatcgacctcgtcgaaatcgaggtcaactcctccgtcctcaacgacgagttcatcgctcaccgcctcggcctcattcccctcaccagcgaacgcgccatgagcatgcgcttctcacgtgactgcgacgcctgtgacggtgacggccagtgcgagttttgctcggtcgagttccacttgagagccaagtgtcactccgaccagaccttggatgtcaccagtaaggatttgtacagttccgatcattcggttgttcccgtcgattttgttgatcctgctggctacgattccacggatcagcaaagggggattatcattgtaaagttgcgtcgtgggcaagaattgaggctgagagcaatagccaggaaggggatcggcaaagatcatgcaaaatggtcacctgctgcaactgttacattcatgtatgaaccggagatccacatcaatgaagatttgatggaatctctttcacttgaggaaaaacaaagctgggttgaaagtagccctaccaaagtgtttgacattgatcctaatactggacaggtttatgtggtcgatgctgaggcatacacttatgatgatgaagtgataaagaaagccgaggctatgggaaaaccaggactcgtggagatctatgccaaagaagatagttttatattcactgttgaatctactggtgcaattaaagcgtctcagctggtactgaatgccatagaagtcctgaagcaaaagctggatgcagttcgcctctctgaggacacagtagaagctgatgatcagtttggtgaacttggagcacatatgcgaggaggatgattcgtcagtaacaggactgattcgtcagtttggtgaacttgtgtgttgaaggatctagtaaattaaatgaatccataactaaccaaatgttttaactatcataatggatgaatctgttttctgcaatcgttcttaaacatttagaagacagttaacattattatcttgtttggacttcacgtcaaaggttaccaacttccctaccgagcatgtaagcagtgtattagattatgccaatagatggcgattaatttggaactattatatgctcttgtagttcctgttgtttatactgtttaaggctgtgcatatattttggtatcatcgcatctcggtctaatgaattatattttaatataa

SEQ ID NO: 1642 - DNA, 1230 bp, Gossypium hirsutum
gccaaataacatcatcaaaataatttgaaaccatgaaaaagaaaaaatggaaggagcttcgtaccagcgattcccaagggtcaaaatccgggaactcaaagacgaatacgctaaattcgagctccacgacaccgatgcttccatggccaacgccctccgccgcgtcatgatcgccgaggttcccaccatagctatcgatctcgtcgaaatcgaagttaactcttccgtcctcaacgacgagttcatcgcccatcgactcggtctcatccctctcactagccaacgcgccatgtcgatgcgattctcgcgtgactgtgacgcctgcgacggtgacggacagtgcgagttctgctccgtcgagttccatcttcgcgccaaatgcataagcgatcaaacactggatgtcaccagtaaggatctttacagttccgatcatacggttgttcccgtcgatttcaccgattccgctggctacgaatcctctgaacaaagggggattatcatcgtgaaattgcggcgagggcaggagttgaggctgagggcaattgcgaggaaagggataggaaaagatcatgcgaaatggtcacctgccgcgactgtgactttcatgtatgaacctgagattcacatcaatgaagatatgatggataccttgacccttgaggagaagcaaagctttgtcgacagtagtcctactagagtctttgacattgatcctaatacccaacaggttgtggtggttgatccagaagcatatacctatgacgatgaagtattaaagaaagctgaagctatgggcaagccggggctcgtggagatatatgccaaagaagacagtttcattttcactatcgaatctaccggtgcggtcaaagctttccagttagtccttaatgctatagaaatccttaaacagaagctggatgcagttcgcctgtctgaggatactgtggaagctgatgatcagtttggtgaactaggtgctcacatgcgaggaggttgattcgcttgtaagtaaaaacagatttcatccgcattgttgctgactgctcttctaatctttaggtacagaatcgactaccttttttttttcttccctttttcctcctcaaattttgtcaccacatttgccatctattctaaactgaaaagcctttgaagcatatggattgacaaatgttttagcttggtatttatgttactgcttttttgtttcatcacaaagaagaa

SEQ ID NO: 1643 - DNA, 3224 bp, Vitis vinifera
aaataattgaaaatcatcaaccctactcggcccctttcgcaccatctgatttccctccctccaaattcgatgtttccatttcccctgaccaaagcatctgtctgagacaaacagggaggtagaagaagaagaagaagagcagcaatggaaggagtatcctaccagcgtttcccaaaaatcaagatccgggaagtcaaggacgactacgccaagttcgagctccgtgagaccgatgccagcatggccaacgctctccgccgtgtcatgatcgccgaagttcccaccgttgccattgaccttgtcgaaatcgaggttaactcctctgttctcaatgacgagttcatcgcccaccgactcggactcattcctctcaccagtgagcgagccatggccatgcgattctctcgcgactgtgacgcatgcgacggtgacggccagtgcgagttttgttccgtcgagttccatttgcgcgccaaatgcatgaccgacgaaacccttgatgttactagcaaggacctcatcagctccgaccatactgttgtccctgttgacttctccgattcctctggctacgattccgccgataagaagggaattataattgtgaagctgcggcgagggcaagaactgaggctgagagctattgccagaaaggggattgggaaggaccacgccaaatggtcaccggcggctactgttacttttatgtacgagcctgagattcatatcaatgaagatttgatggaatctttgacgcttgaggagaaaacaagttgggttgagagcagtcccacaaaagttttcgacattgatgctagttcccaacaggttgttgtggctgatgctgaggcatacacttatgatgatgaagtgctcaagaaagcagaagctatggggaagccagggcttgtggagatctatgccaaagaagacagttttatattcacagttgaatctactggtgcaatcaaagcttctcagttggtgctcaatgcaatagatgttcttaaacaaaagcttgatgcagtgcggctatcagaggatacggtagaagctgatgatcaatttggtgaactcggtgctcatatgcgaggaggatgatcattttggtaaaaaggactcatcatctgataaattaggtttctgggagatcaattcccttccatttgctttatggaattttcttcattggaaattctgttctgacttgatgttttctgtcttgcccttactgtgcattccagtcttatttcttgtaagtttccccatttgtctgggcgacaattagcttttactaaccttctagaggttgttatcaaacatgtcacctgttttaaattaaacctgtaagaatgcatttacatgccatatagcttgcatctatccctcttgtgttggaaccatgttatagtgtgttttttggatttttcgcatcacagggttggttttttgacgccttgtttggttcggggaagaaggggcgaaggagtccagattacacatttgttgtttgctgatgacacgttggtcttttgtgaagctaaagaggatcagttgacacacctatgctggctgctaatgtggtttgaggctttgtcagggttgaaagtgaatatggaaaagagtgaattgattctagttggtagagttgaaaatgtgggagagttagttgatgaatttggttataaggtccacctacctaggaatgcctttaggtgctccttttaaatctagtggtgtttgggatggaatagaggaaagattcaaaaggagattggctatgtggaagcgacaatacatttcaaaaggaggaaggattaccttaattcggagtactttgtcaacttgctaatctatttcatgtccatcttccaaatttcaagggcggttaggataagactggaaaaaatacaaagagattttctgtggggaggaggcgctcttgagcaaaaacctcacttagtaaggtggtcgattgtgtgtgatgataaaggtaaaggagggttgggggtaaagagtcttgggttgttcaataaggctctcctgggaaagtgggcatggcgttttgctaatgagaaaacggccttatggaatcaggtgattagaaggaagtatggagaggagaaaggaggatggagatcttgtgagattagggaggcttatggggttggtttgtggaaagctataaataaggtgggacaatttgtaacccctttttttggctatgaggtgggggatggtaagaatgtgaggttttggaaagataagtggtgtggtaccagccctttaagcgagactttcccttctttattttccatagcatcatcaaaagaggcatgggtgaatgaagtgtggacagccgaggtggataggaggggaagttggactcctactttcaataggccgtttaatgattgggaattggaagaagtgggaaggttacttaggtgtttggaaggaaagatggtgagggtggatgaggaggacagggtgagatgggtggaatcaaaggatggggtttttttggtaaagtccttgtatagggcaatgcagccggtgttgtcagcttggtttccttcaaagattatttggatgtcttatgctcaacccaagataagcttctttgcgtgggaggcgtcctggggtagagtcctaactttggaccatctgcaaaagaggggttggactttggcaaataggtgctttctttgccaaaagtgcagggagtcgattgaccacctcctccttcattgtgaaagaacaagggaggtgtggaccttgctcctctctttttttggagtctcttgggtttttccgcattcggttaaggaaactctaataggttggagaggttcctttatgggcaagaagaggaaggtgacgtggcttttgggaccgttatgcttgttttgggtcatttggaaggctagaaattcaattgcttttgaggacggggtgctatctatacaaaagctgaaaatttcctttgtgtatttgctatggtcggaaaccaaagtgtggataaaagatggtccttcgaccttattagattttatagattgggtgtgcatgtattaagaaagagggttttttgtgctttcatagaggggtgggttcttttgtaagggggtgagtcgttttttttctatactgtaactatttgagtcgcttctttagcgtctctttttcaatacatatatcacttactgatcaaaaaagaaaaa

SEQ ID NO: 1644 - DNA, 1394 bp, Citrus sinensis
acacaatcagcaaaaaacccgtattccctcggtatagctatttggcattcgctaagcaacgagagcgaacgacgatggatggcgcgtcgtaccagcgattcccgaaggtcaaaatccgcgagctcaaagacgactacgccaaattcgagctccgggacaccgacgcctccatggccaacgcgcttcggcgcgtgatgatcgccgaggtccccaccatcgccatcgacctcgtcgaaatcgaggtcaactcctccgtcctcaacgatgagttcatcgctcaccgcctcggcctcattcccctcaccagcgaacgcgccatgagcatgcgcttctcacgtgactgcgacgcctgtgacggtgacggccagtgcgagttttgctcggtcgagttccacttgagagccaagtgtcactccgaccagaccttggatgtcaccagtaaggatttgtacagttccgatcattcggttgttcccgtcgattttgttgatcctgctggctacgattccacggatcagcaaagggggattatcattgtaaagttgcgtcgtgggcaagaattgaggctgagagcaatagccaggaaggggatcggcaaagatcatgcaaaatggtcacctgctgcaactgttacattcatgtatgaaccggagatccacatcaatgaagatttgatggaatctctttcacttgaggaaaaacaaagctgggttgaaagtagccctaccaaagtgtttgacattgatcctaatactggacaggtttatgtggtcgatgctgaggcatacacttatgatgatgaagtgataaagaaagccgaggctatgggaaaaccaggactcgtggagatctatgccaaagaagatagttttatattcactgttgaatctactggtgcaattaaagcgtctcagctggtactgaatgccatagaagtcctgaagcaaaagctggatgcagttcgcctctctgaggacacagtagaagctgatgatcagtttggtgaacttggagcacatatgcgaggaggatgattcgtcagtaacaggactgattcgtcagtttggtgaacttgtgtgttgaaggatctagtaaattaaatgaatccataactaaccaaatgttttaactatcataatggatgaatctgttttctgcaatcgttcttagacatttagaagacagttaacattattatcttgtttggacttcacgtcaaaggttaccaacttccctaccgagcatgtaagcagtgtattagattatgccaatagatggcgattaatttggaactattatatgctcttgtagttcctgttgtttatactgtttaaggctgtgcatatattttggtatcatcgcatctcggtctaatgaattatattttaatataa

SEQ ID NO: 1645 - DNA, 1357 bp, Panax ginseng
aaatctctacccgaggtttaaccttcacgcagagaaagtaaagtatagagaaaatggaaggaggagcgtcgtaccagcgatttcccacggtgaagatcagagaactcaaagatgactacgccaagttcgagctccgggacaccgacgccagtattgccaacgctctccggcgagtaatgatcgccgaggttccgaccgtcgccatcgatttggtagaaatcgaggtcaactccactgtactcaacgacgagtttctcgctcaccgcctcggtctaattcctctcaccagcgaacgagccatgagcatgcgcttttcacgtgactgcgacgcctgtgacggtgacggccagtgcgaattttgctccgtcgagttccatttgcgggccaagtgtatcaacgaccaaaccttggatgttactagcaaggatctctacagttctgaccatactgttgttccggttgacttctctgattcctctggctacgaaaattctgaacaaaggggaataataattgtgaagttacgccgtgggcaagaactgaagttgagagctattgccaggaaaggaattggcaaggatcatgccaagtggtcacctgccgcaactgttactttcatgtatgaacctgccattcatatcaatgaagatatgatggagagtttaacacttcaagaaaaacagagtttcattgatagcagtccaaccaaagtgtttgatattgatcctgaaacccaacaggttaaggtggttgatgctgaggcgtacacttatgatgatgaagtgctcaagaaagctgaagctatggggaagccaggacttgtggaaatttatgcaaaagaagacagttttattttcacagttgaatccactggtgcgatcaaagcttcgcagttggtgctcaatgctatagacatcctgaaacagaagcttgatgcagttcgcctgtcagatgacactgtagaagctgatgaacagtttggggaattgggtgcacatatgcgtggagggtgatccttcatggtgccaggattctttggattagcatttttagagttcaactgatttccatcgacttttggaacttacgattagttttttatttacaaccggaggatgctaataatcttttgtaagtatgtcatgttttatgttcttgatagatttacctagtcatttcgctcttggacttgtttgcaggtggtctacagttgcataacataactataagcctgcatctttacatctttgttgaaatcatttcgtgctgtgtttattgcaaattaagtagaagtactagttaaaaaggatataaacgtttttaagtgacaactgagtaattttatttattcctttta

SEQ ID NO: 1646 - DNA, 1403 bp, Vaccinium corymbosum
ttctaaaaaaacgtgataccctcgcactcagtcacagacacagagagagagagagagggagagggagaggacgataatggagggcgcatcgtatcagcgattccctagggtaaaaatccgggagatgaaagacgactactgcaagttcgagctccactcgacggacgcctccatggccaacgccctccgccgcgtgatgatcgccgaggtccccaccgtggccatcgacctcgtagagatcgaggtcaactcgtccgtactcaacgacgagttcatcgcccaccgcctcggcctcatcccactcaccagcgaccgagccatgagcatgcgcttctcgcgtgactgcgacgcttgcgacggcgacggacagtgcgagttctgctccgtcgagtttcacttgagggccaagtgcattaatgaccaaaccctagatgtgaccagtaaggacttgtatagttcggaccatactgttgtccctgttgatttctctgattctggatctggtattgagaattccgaacaaagggggattatcattgtgaaactacgccgcgggcaagaactgaggctgagagccatagctagaaaaggaattggaaaagaccatgctaaatggtcacctgcagcaactgttactttcatgtatgagcctgagattcatatcaatgaagatatgatggatactttaacactggacgagaaaaagagttgggttgagagcagtccaaccaaagtgtttgacattgatcctaatactcagcaggttgtagtagttgatccagaggcatacacgtatgatgatgaagtgatcaagaaagcagaggcgatggggaagtcaggactagttgagatatatgccaaagaagacagttttatattcaccgtggaatcaactggcgcaatcaaagcttctcagctggtactcaatgcaatagatattctcaaacaaaagctggatgcagtacgcctatcggaggataccgtagaagcagatgaacaatttggtgagctgggtgcacatatgcgaggagggtgatccgtttatctgaccggaatccttggctggtctgagaaagtcaaattacttccatttgcttactgagctgtgtttgtatcgaggtggctctctgctccctgcaagtttgtgattactaagattaagaatgctaatttcattttctgtacttcgtattcaaacttgtggtaacaattgacttgtgttttccgtctttcgctcttgtgtggctgaacatgtttcatgcttttgaattaagctcacaagaagtgcaaattaccgtaggatattgtcttaatgtaggctatgtttggaccgtcttgtgctgcccttgttggtatatcatgttgtggttcacttgatgcatttattcgaggaatgggttgca

SEQ ID NO: 1647 - DNA, 1364 bp, Lactuca sativa
ggactagcttttatctcaaatttataaagggccaaattataatttgacgcatatgacactggttctataggcaacgggaagagggttttacagagaaccagggttttcaaaccctagagagagaaacaaaagagttaacgaaaatggaaggagcttcataccagagattccccaaggtgaaaatccgtgaactgaaagatgactacgccaaatttgagctccgggaaaccgacgccagcgtggccaatgcactccgccgtgtcatgattgccgaggttccgaccatcgccatcgatcttgttgaaatcgaagtcaactcttctgttctcaatgacgagttcatcgcacatcgtcttggccttatcccgctaacaagcgagcgtgccatgagcatgcgcttctcccgcgactgcgatgcctgtgacggtgatggccaatgcgagttctgttctgttgagtttcatctgagagctaagtgtataaatgatcaaaccctagatgttacgagtaaagatctttacagctctgaccataccgttgtgcctgttgatttctccgataccagctctggcttcgaaaatcctgaagatcagagggggatcacaattgtaaaacttagaaaagggcaagaactgaggctaagggcaatagctagaaagggaattggaaaagatcatgcaaaatggtcacctgctgcaactgtaactttcatgtatgagcctgaaatccacatcaatgaagaaatgatggaaactttatcacttgaggaaaaaacaagtgttgttgaaagcagccccacaaaagtctttggcataaatccccacacacaacaggtggaggtggtggatcctgaagcatacacgtatgatgatgaggtgttgaagaaagtggaagccatggggaaaccagggcttgttgagatttatgcaaaagaagatagttttatatttacagtggagtcaacgggtgcagtcaaagcatctcaattggtgttgaatgccattgaagttctgaagcagaagcttgatgcggttcgtttgtctgaagatacggttgaagctgatgaccagtttggtgaattgggtgctcatatgcgaggaggataggattaggatatgacttctgtccattctgtttaaaatgactaaattgcccttgcttttttctctttatttggaatttggaatatgatgttttctgttaaaagatccaagggggtattagtagtttaactgctgtgatttcaaccgagtatcaattggtctctgatgtttagttttaaatatcacataaaggacaggtcaaaatagtaatttcatatccatgatgtttgaatataagcaacaaaatgaaaaccagaggca

SEQ ID NO: 1648 - DNA, 1098 bp, Tragopogon dubius
gcgggggcaactctgcgggtgggttttagagaagagggttttcaaaaccctagagagagaagacagagggaacgaaaatggaaggtgcatcataccagaggttccccaaggtgaaaatccgtgaactcaaagatgattacgccaaatttgagctccgggaaactgacgctagcatggccaacgcactccgccgtgtaatgattgccgaggttccgaccatcgccatcgatctagttgaaatcgaagtcaactcctccgttctcaacgacgagttcattgcacatcgtctcggccttatccctctcaccagcgagcgtgccatgagtatgcgcttctcacgtgattgcgatgcctgtgacggcgacggccagtgcgagttctgctctgttgagtttcatctgagagctaagtgtataaatgatcaaaccctagatgttacgagtaaagatctgtacagctctgaccacaccgttgtgcctgttgacttctccgatactagctctggctttgaaaatcctgaagatcagaggggaataacgattgtaaaactgcgaaaagggcaagaactgagattgagagcaatagctagaaagggaattggaaaagatcatgccaaatggtcacctgctgcaactgtgactttcatgtatgagcctgagattcacatcaatgaagaaatgatggagtctttatctcttgaagagaagactagtgtagttgaaagcagccctactaaagtttttggcataaatccgcacactcaccaggtggatgtggtggatccagaagcgtacacgtacgatgatgaagtactgaagaaagtggaagccatggggaaaccaggacttgtggaaatatacgcaaaagaagacagttttatcttcacagtcgagtcaacgggtgcggtcaaagcttcacagttggttctgaacgcgattgaagttctgaaacagaagctggacgcggttcggttgtctgaagataccgtggaagccgatgatcaatttggtgaattgggtgctcatatgagaggaggatgaaagatgatcttctcttttttttaatctacttgcaatgctaaaagatgatcgattgttt

SEQ ID NO: 1649 - DNA, 1290 bp, Cucurbita pepo
agagagtagggagccatggaaggggcatcgtaccagcgctttcccaaggtgaagatccgagagctcagagatgactatgccaaattcgagctccatgacactgatgttagcatggccaacgccctccgtcgcgtcatgatcgctgaggtccccaccatcgccatcgacctggtagaaattgaagtgaactcctcagttcttaacgatgagttcatcgcccatcgccttggtctcattcccctcactagcgagcgtgccatgtctatgcgcttctctcgcgactgtgatgcttgtgatggtgatggccagtgcgagttttgctctgtcgagtttcaccttcgtgccaagtgccactctgaccaaaccctagacgtctccagcaaggatctctatagttctgatcacactgttgtccctgttgatttctctgattctgcagcagctgctggtgaagcgcttgataccaaaggaataatcattgtgaagctacgtcggggtcaagaattgaggttgagagccatagccaggaagggcattggtaaagatcatgcaaaatggtcgccagcagcaactgtcacattcatgtatgaaccaagcattcacatcaatgaagacctaatggaaacattaacactcgaggaaaagacttcctgggttgaaagtagcccaaccaaagtctttgaattggatcctgttacccaccaggttctggtggttgatccagaggcatacacttatgatgatgaagtgattaagaaagcagaagcaatgggtaaagctggactagtggatatcactgcaaaagaagatagttttatcttcacagttgaatctaccggtgcaataaaagcttcccagttgatactcaatgccatagatattctgaaacagaaactggatgcagtccgcctttcagacgatactgtagaagcagatgatcagtttggtgagttaggtgcacatatgcgaggtggatgatccagataccaggccttcccatatgtttctaggaggttaggtcaactgtaattttgttttcctgaacaatctagtttttctgtactgatgagcctggtttagtgcattctttttcacatattggatgcacatgtagcttccggagataattataatgtagtatctttggcattggttggctcatcctcatgtttgacctggttcaatgtattatggatgatcgttaattcagcttcttccttgggggtttttttccccaggcatgccttgattattaattttccagagctgcttccttagggtggtgacttg

SEQ ID NO: 1650 - DNA, 1376 bp, Castanea mollissima
ctttatagtgtgagagagagagagagagagagaaacctcggagacaagaaacatcatggacggaggaatgtcgtaccagcgattcccgaaggtgaagatcagggaaatgaaggacgacatggtcaagttcgagctacgagagacggacgccagtgtggccaacgcgcttcggcgcgtgatgatcgcggaggtcccgaccgtcgccatcgacctcgtcgaaatcgaggtgaactcctctgtcctcaacgacgagttcattgctcaccgactcggtctcatcccactcaccagtgaccgagccatgagcatgcgcttctcgcgtgactgtgacgcttgcgacggtgacggccagtgcgagttctgctccgtcgagtttcacctccgtgcaaagtgcctcactgaccaaaccctcgatgttaccagcaaagacctctatagctccgaccacaccgtcgttcctgttgagttctccgatcccaatgaccctggcgagcaaaggggaattatcattgtgaagttacgtcgtggacaagaactgaggctgagggctatagccagaaaagggattggtaaagatcacgcaaaatggtcacctgcagctactgtcacatttatgtacgaaccaacgattagaatcaatgaagacttgatggaaactttgtcactcgaggagaaaagaacctggattgatagtagtcctaccaaagtttttgacatagaccccgttacccaacaggtggtagtggttgaacctgaggcatacacttatgatgatgaagtgatcaagaaagcagatgctatggggaagtcagggcttgtagagattgaagccaaagaagacagctttatattcactgtagaatctactggtgcaatcaaagcttctcagttggtactcaatgccatagaaatcctcaaacaaaagctggatgcagttcgcctgtcagatgatactgtagaagccgatgatcagtttggcgaactaggtgctcatttgcgaggaggatgatgctgtttgtgaaaagagatgaatcaattgttcctttttaagttttaggagatcaattgaatttcattcggtttttgggatttggtcatgtgctgtactaactacatcttccatttttcttgttaacttgtgctgtggttgctagttactcccctccaaaacagaaacctttgctaatctgtttaaagcaatgtatgtccttgatctctggagaaatttaacctatattttctttgtgaacttgtcatgtcatgacacataacctacaagcaaaacctgtacactctgcttactagcggtcatggcatttagcttgtacttcaccgcatattacttaacatgtatacttgtgcttattgttagatac

SEQ ID NO: 1651 - DNA, 1183 bp, Tropaeolum majus
tggagggcgcatcgtatcagcgattcccaaagtgaaaatcagggaaatgaaggacgacatgtgtaagttcgagctccgtgatacagatgcctcagtggctaacgcgctccgtcgtgtcatgatatcagaggttccaacggttgcaatcgacctggtggaaattgaggtaaactcttcagtgcttggcgacgagtttatcgctcaccggcttggtctgattcctctcacaagtgaacgagcaatgagcatgcgtttctctcgcgactgtgatgcttgcgatggtgacggccagtgcgagttctgctctgttgagtttcatcttagggctaagtgcttgaccgaccaaacgctagatgttactagcaaagatttgtacagttctgatcacactgttgttcccgtggatttcaccgataatgcgggctatgattcttctgagcagagggggatcattattgtgaagttacgtcgtggccaggaactaaggctgagggcgatagccagaaaaggtattggcaaagatcatgcaaaatggtcacctgcagctacagtaacttttatgtatgaaccagatatccatataaacgaggatttgatgcaaactttaacacttgaggagaagctggcttggattgaaagcagtcctactaaagtatttcatcttgatcctaatacccatcaggttgtagtggctgatgctgaagcatatacttatgatgatgaggtgatcaagaaggcagaagctatgggaaagccagggcttgtggaggtctatgccaaagaagacagtttcatattcaccgttgaatctactggtgcaatcaaagcttctcagttggttttgaacgccattgatatcctgaagcaaaagctagatgcagttcgcttatctgaagacacagtagaagctgatgatcagtttggtgaacttggtgctcatatgcgaggtggatgatccagttaggaaagccaacactggtcaaaagttcatcagttcccatttgtttgtactaactgttattccattttcgattagtttgcggatcctacctatttatctgtttagaggcccttagattgtgggaaacaatccgaacatccattttaaacaaaatttatatcactcatcgcctatttgaaattttttaggttcaccccaatagaagacctaaattatgcacag

SEQ ID NO: 1652 - DNA, 1518 bp, Glycine max
caaattaacgaaattgagtatttatcatttaaattaagagcccgaacgcttggggtttggaaaagggttttacattttattcgttctccggtgagaaacagaaacacacagaagacagagtgagacgcttctcacgatggagggaggagtatcctacgcgcgcatgcctcgggtcaaaatccgcgagctgaaggacgactacgccaagttcgagctccgcgacaccgacgcgagcatcgccaacgcgctgcggcgcgtgatgatcgcggaggtgccgacggtcgccatcgacctcgtggagatcgaggtcaactcctcggtgctcaatgacgagtttatcgctcacaggctgggcctcatccccctcactagcgagcgcgccatgtccatgcgcttctcacgtgactgcgacgcgtgcgacggtgacggacagtgcgagttttgctccgtcgagtttcatcttagggttaagtgcatgactgatcagaccctcgatgttacgagcaaggacctctacagttctgaccctactgtcagtcccgttgatttctctgacccctctgccactgactccgacaacaacagggggattatcattgtgaagttgcggcgcggacaagagctgaagctgagagcgatagctaggaaggggattgggaaggatcatgctaaatggtcacctgctgcaactgtcactttcatgtatgaaccggagattcatataaatgaggatttgatggaaaccttgactctggaagagaaaagagaatgggttgacagtagtccaacccgtgtctttgaaattgatccagtgacacaacaggtgatggtggttgatgctgaggcatacacatatgatgatgaggtgcttaagaaagcagaagctatgggcaagcctgggcttgtagaaatcattgcgaggcaggatagcttcatattcactgtggagtctactggagcggttaaagcttctcaattggttctaaatgccatagaaattctcaagcagaagctggatgctgtgaggctatctgaagatacagtggaggctgatgatcagtttggcgagcttggtgcacatatgcgaggaggttgattaatttgttagaaggatatcagacttgtttcccacaacttgtttcccggaacttgtttcttacttgtctttaactgaatacctgcagaacgtattaacttgttgagccaaggatgctaattagtaattactgtgattaccatttgaagatagatagttatctttcacattttattttacttagcttgccagaaacagtggttaccatatggtatttttttaatcacacaaactggagctctatcctcttgtcatctggcttggggagagggataggattaaacggattaagcagtctcccaaagagttaggatcacttaggctgcgaagcttttagaatattttaccgagtatttatcatgtttgttttctttattgtttataatggtcaaaagggataacttattggtttgtgaacaaat

SEQ ID NO: 1653 - DNA, 1446 bp, Glycine max
acgcttggggtttggaaaagggttttacattttattcgttctccggtgagaaacagaaacacacagaagacagagtgagacgcttctcacgatggagggaggagtatcctacgcgcgcatgcctcgggtcaaaatccgcgagctgaaggacgactacgccaagttcgagctccgcgacaccgacgcgagcatcgccaacgcgctgcggcgcgtgatgatcgcggaggtgccgacggtcgccatcgacctcgtggagatcgaggtcaactcctcggtgctcaatgacgagtttatcgctcacaggctgggcctcatccccctcactagcgagcgcgccatgtccatgcgcttctcacgtgactgcgacgcgtgcgacggtgacggacagtgcgagttttgctccgtcgagtttcatcttagggttaagtgcatgactgatcagaccctcgatgttacgagcaaggacctctacagttctgaccctactgtcagtcccgttgatttctctgacccctctgccactgactccgacaacaacagggggattatcattgtgaagttgcggcgcggacaagagctgaagctgagagcgatagctaggaaggggattgggaaggatcatgctaaatggtcacctgctgcaactgtcactttcatgtatgaaccggagattcatataaatgaggatttgatggaaaccttgactctggaagagaaaagagaatgggttgacagtagtccaacccgtgtctttgaaattgatccagtgacacaacaggtgatggtggttgatgctgaggcatacacatatgatgatgaggtgcttaagaaagcagaagctatgggcaagcctgggcttgtagaaatcattgcgaggcaggatagcttcatattcactgtggagtctactggagcggttaaagcttctcaattggttctaaatgccatagaaattctcaagcagaagctggatgctgtgaggctatctgaagatacagtggaggctgatgatcagtttggcgagcttggtgcacatatgcgaggaggttgattaatttgttagaaggatatcagacttgtttcccacaacttgtttcccggaacttgtttcttacttgtctttaactgaatacctgcagaacgtattaacttgttgagccaaggatgctaattagtaattactgtgattaccatttgaagatagatagttatctttcacattttattttacttagcttgccagaaacagtggttaccatatggtatttttttaatcacacaaactggagctctatcctcttgtcatctggcttggggagagggataggattaaacggattaagcagtctcccaaagagttaggatcacttaggctgcgaagcttttagaatattttaccgagtatttatcatgtttgttttctttattgtttataatggtcaaaag

SEQ ID NO: 1654 - DNA, 1337 bp, Helianthus annuus
agagtgagaaacaaaccctagagagaggcacacacacagaagaaccaacaatggacggagcatcataccagaggttcccgaaggtcaaaatccgcgagctcaaagacgactacgtgaaatttgagctccgagaaaccgacgcaagcatggcgaacgcactccggcgagtcatgatcgcagaagttcccacaatcgccatagatttggttgaaattgaggtcaattcgtccgttctcaacgacgagttcatcgctcatcgtctcggtcttataccgcttacgagcgagcgtgcgatgagcatgcggttctcacgtgactgcgatgcttgtgacggtgacggacagtgtgagttttgttctgtggagttccatttgagagctaagtgtattaatgatcagacgcttgatgttacgagtaaggatttgtatagctcggatcatacggttgtgcctgttgatttttcggatcctgggtctggttttgagaatcctgaagatcaaaggggcatcactattgtgaaactccgcaaaggccaagaactgaggctaagagcaatagccagaaaaggtattggtaaagatcacgcaaaatggtcacctgctgcaaccgtcactttcatgtacgagcccgagattcacatcaacgaagaaatgatggagaccttatcactcgaagaaaaaacaagtgtcgttgaaagcagccccacaaaagtcttcgccttaaaccctcaaactcagcaggtggaagtggtggatcccgaggcatacacgtatgacgatgaagtgctgaagaaggtggaagctatggggaaacccgggctcatcgaaatctatgcaaaagaagacagttttatcttcaccgttgaatcaaccggtgcagtcaaagcttctcagctggtgatcaacgccattgatgttttgaaacagaagcttgatgccgttcgcctgttggaggacactgttgaagctgatgaccagttcggtgaattgggtgctcatatgcgaggaggttgattttagcttatctttgttatgtctgaatgttaatctaccgtcagtttcgttcgtatggaaaactgggattttttttatgttaatcttaagcagattgtagggtgtttttattccactttgggtagtgcaacactgagatgcagatgaaaagccattgtttttgtttattttctgatcaccaagttttcgataaaagtcccgaatgaaagcatttgtagcgtgagagcacccttttaatggaatcgaatctgatcctagagctgaaacaaacctgagttgtatgctcctgatattttatgtttctattactgagacttaactttt

SEQ ID NO: 1655 - DNA, 1494 bp, Glycine max
atttaatttaatccccgcaaaatatattattgagaggggtgatgaatattaagttagaataaaggatccgaacgtttggggggggttttgagaagggttttacattttattcgttctccggtgaaacagaaacagagagagagagtgagaaaaaacgaaacgatggagggaggagtctcctacgcgcgcatgcctcgtgtcaaaatccgcgagctgaaggacgactacgccaagttcgagctccgcgacaccgacgcgagtatagccaacgcgctgcggcgcgtgatgatcgcggaggtgccgacggtcgccatcgacctcgtggagatcgaggtcaactcgtcggtgctcaacgacgagttcatcgcgcacaggctcggcctcattcccctcacgagcgagcgcgccatgtccatgcgcttctcacgtgactgcgatgcctgcgacggtgacggacagtgcgagttttgctccgtcgagtttcatcttagggtaaagtgcatgaccgatcagaccctcgatgttacgagcaaggatctctacagttctgaccctactgtgagtcccgttgatttctctgacccctctgccactgactccccagacaacaacagagggattatcattgtgaagttgagacgcggacaagagctgaagctgagagcgattgctaggaaggggattgggaaggatcatgctaaatggtcacctgctgcaactgtcactttcatgtatgaaccagagattcatataaatgaggatttgatggagaccttgactctggaagagaaaagggaatgggttgacagtagtccaacccgtgtctttgaaattgatccagtgacacaacaggtcatggtggttgatgctgaggcatacacatatgatgacgaggtgcttaagaaagcagaagctatgggcaagcctgggcttgtagaaatcattgcgaggcaggatagcttcatattcactgttgagtctaccggagcagttaaagcttctcaattggttctaaatgccatagaaattctcaagcagaagttggatgctgtgcggctatctgaagatacagtggaggccgatgatcagtttggtgagctaggtgcacatatgcgaggaggttgattaatttctgttagaaggatatcagacttgtttcccagaacttgtttcttgtctttaactgaatacctgcagaatgtattaacttgttgagccaaggatgctaattagtaattacattgattaccatttgaagatagatagctatctttcacatttatattacttagcttgccagaaacagtggctaccatatgattttattttttttaatcacacaaacagtagctctatcctcctcatatcatctgtggcttggggagagggatatgattaaacggattaagtagttttcccaaagagttaggatcacttaggctgtgaagcttttagaatattttaccgagtatttatcatgtttgttttcttttt

SEQ ID NO: 1656 - DNA, 2022 bp, Glycine max
caggactatccgctacccagtggatgaagctgaacttgtggaaaaaaatttaatttaatccccgcaaaatatattattgagaggggtgatgaatattaagttagaataaaggatccgaacgtttggggggggttttgagaagggttttacattttattcgttctccggtgaaacagaaacagagagagagagtgagaaaaaacgaaacgatggagggaggagtctcctacgcgcgcatgcctcgtgtcaaaatccgcgagctgaaggacgactacgccaagttcgagctccgcgacaccgacgcgagtatagccaacgcgctgcggcgcgtgatgatcgcggaggtgccgacggtcgccatcgacctcgtggagatcgaggtcaactcgtcggtgctcaacgacgagttcatcgcgcacaggctcggcctcattcccctcacgagcgagcgcgccatgtccatgcgcttctcacgtgactgcgatgcctgcgacggtgacggacagtgcgagttttgctccgtcgagtttcatcttagggtaaagtgcatgaccgatcagaccctcgatgttacgagcaaggatctctacagttctgaccctactgtgagtcccgttgatttctctgacccctctgccactgactccccagacaacaacagagggattatcattgtgaagttgagacgcggacaagagctgaagctgagagcgattgctaggaaggggattgggaaggatcatgctaaatggtcacctgctgcaactgtcactttcatgtatgaaccagagattcatataaatgaggatttgatggagaccttgactctggaagagaaaagggaatgggttgacagtagtccaacccgtgtctttgaaattgatccagtgacacaacaggtcatggtggttgatgctgaggcatacacatatgatgacgaggtgcttaagaaagcagaagctatgggcaagcctgggcttgtagaaatcattgcgaggcaggatagcttcatattcactgttgagtctaccggagcagttaaagcttctcaattggttctaaatgccatagaaattctcaagcagaagttggatgctgtgcggctatctgaagatacagtggaggccgatgatcagtttggtgagctaggtgcacatatgcgaggaggttgattaatttctgttagaaggatatcagacttgtttcccagaacttgtttcttgtctttaactgaatacctgcagaatgtattaacttgttgagccaaggatgctaattagtaattacattgattaccatttgaagatagatagctatctttcacatttatattacttagcttgccagaaacagtggctaccatatgattttattttttttaatcacacaaacagtagctctatcctcctcatatcatctgtggcttggggagagggatatgattaaacggattaagtagttttcccaaagagttaggatcacttaggctgtgaagcttttagaatattttaccgagtatttatcatgtttgttttcttttttgtttataatggtcaaaagggataactcattggtttgtgaacaaatgaaaaaagtaacgtgatctttctattacaaggagaggccaaattgcagtttttgaagtcttaaattgaatcgcaactacaattacgaccattttctttttatcgacagctgttggcgattatggccatatcggtaagtttccctaggccataatctgtaagttttcctacaactgtagtaattgcaaggaaagaacatggcgcgtttaatgagttattaagacaagatggactagaaaagtagcttgtgtccagaccgtgtgagaattcagcttcagtaaacttacgatttagtgcccgagattaattcgctaattctataaaaatggctcattagagtcttttctttgctgtattatttattgtcattttatatatatatataaacaaattacaataccaggaatgaaaatagtgatatctggcaaattttacc

SEQ ID NO: 1657 - DNA, 1410 bp, Quercus alba
ctcgcgtgtcggaattcccgggatccaaattttgggttttatcactttatagtttgagagagagagaaacctcggagacagaaacatcatggacggaggaatgtcgtaccagcgattcccgaaggtgaagatcagggaaatgaaggacgacatggtcaagttcgagctacgagagacggacgcgagtgtggccaacgcgcttcggcgcgtgatgatcgcggaggtcccgaccgtcgccatcgacctcgtcgaaatcgaggtcaactcctctgtcctcaacgacgagttcatcgctcaccgactcggtctcatcccactcaccagtgaccgagccatgagcatgcgcttctcgcgtgactgtgacgcttgcgacggtgacggccagtgcgagttctgctccgtcgagtttcacctccgtgcaaagtgcctcactgaccaaaccctcgatgttaccagcaaagacctttacagctccgaccacaccgtcgttcctgttgagttctctgatcccaatgaccctggcgagcaaaggggaattatcattgtgaagttacgtcgtggacaagaactgaggctgagggctatagccagaaaagggattggtaaagatcacgcaaaatggtcacctgcagctactgtcacatttatgtacgagccaacgattagaatcaatgaagacttgatggaaactttgtcactcgaggagaaaagaacctggattgacagtagtcctaccaaagtttttgacatagatcccgttacccaacaggtagtagtggttgaacctgagttatacacttatgatgatgaagtgatcaagaaagcagatgctatggggaagtcagggcttgtggagattgaagccaaagaagacagttttatattcactgtagaatctactggtgcaatcaaagcttctcagttggtactcaatgccatagaaatcctcaaacaaaagctggatgcagttcgcctgtcagatgatactgtagaagctgatgatcagtttggtgaactaggtgctcatttgcgaggaggatgatgctgtttgtaaaaagaagatgaatcaattgttccttttaggttctaggagatcaattgaatttcattaggtttttgggacttggtcatgtgctgtactaactacatcttccatttttcatgttaacttgtgctgtgctagttactcccctccaaaacagaaacctttgctaatctgtttaaagcaatgtatgtccttggatctctggagaaattttcctatattttctttgtgaacctgtcatgtcatgagacattacctacaagcaaaacctgtacactctgcttactagtggtcatggcatttagcttgtactgcactgcatattacttaacatgtatacttgtgcttattgtaagatactgtca

SEQ ID NO: 1658 - DNA, 1271 bp, Quercus alba
aaattttgggttttatcactttatagtttgagagagagagaaacctcggagacagaaacatcatggacggaggaatgtcgtaccagcgattcccgaaggtgaagatcagggaaatgaaggacgacatggtcaagttcgagctacgagagacggacgcgagtgtggccaacgcgcttcggcgcgtgatgatcgcggaggtcccgaccgtcgccatcgacctcgtcgaaatcgaggtcaactcctctgtcctcaacgacgagttcatcgctcaccgactcggtctcatcccgctcaccagtgaccgagccatgagcatgcgcttctcgcgtgactgtgacgcttgcgacggtgacggccagtgcgagttctgctccgtcgagtttcacctccgtgcgaagtgcctcactgaccaaaccctcgatgttaccagcaaagacctttacagctccgaccacaccgtcgttcctgttgagttctctgatcccaatgaccctggcgagcaaaggggaattatcattgtgaagttacgtcgtggacaagaactgaggctgagggctatagccagaaaagggattggtaaagatcacgcaaaatggtcacctgcagctactgtcacatttatgtacgagccaacgattagaatcaatgaagacttgatggaaactttgtcactcgaggagaaaagaacctggattgacagtagtcctaccaaagtttttgacatagatcccgttacccaacaggtagtagtggttgaacctgagttatacacttatgatgatgaagtgatcaagaaagcagatgctatggggaagtcagggcttgtggagattgaagccaaagaagacagttttatattcactgtagaatctactggtgcaatcaaagcttctcagttggtactcaatgccatagaaatcctcaaacaaaagctggatgcagttcgcctgtcagatgatactgtagaagctgatgatcagtttggtgaactaggtgctcatttgcgaggaggatgatgctgtttgtaaaaagaagatgaatcaattgttccttttaggttctaggagatcaattgaatttcattaggtttttgggacttggtcatgtgctgtactaactacatcttccatttttcatgttaacttgtgctgtgctagttactcccctccaaaacagaaacctttgctaatctgtttaaagcaatgtatgtccttggatctctggagaaatttttcctatattttctttgtgaacctgtcatgtcatgagac

SEQ ID NO: 1659 - DNA, 1235 bp, Solanum melongena
agcaagcaacaacaatggagggcgttacataccagagattcccaaaggttaaaatccgtgaagtcaaagacgattacatgaaattcgagctccgggacaccgacgccagcatagcaaacgctctccggcgtgtaatgatagctgaagtacccacaatagctatagacctagttgaaatcgaggtcaattcctcggttctcaacgacgagttcatttctcatcgtttagggcttattccgcttacgagtgaacgagcgatgagcatgagattctcacgtgactgtgatgcttgtgatggtgatggacaatgtgagttctgttcagttgagttttatctccgggtgaaatgtttgagtgaccagacgcttgatgttactagcaaggatttgttgagttctgatcatacggtggttccggtggattattcgggtgcttcctcgggttttgataatactcctaataagggaatcataattgtgaagctacgacgtggacaggagttaaggttaagagctatagcacggaaaggaattggcaaagatcatgcaaaatggtcgcctgcagcaactgtgactttcatgtatgaaccagacatctatatcaatgaggacatgatggaatccttgactcttgaggaaaaaacagaattagttgagagtagtcccacaaaagtcttcgccattgaccctgaaagcaaacaggttattgtggttgatcccgaggcatatacttatgatgatgaggtgctcaagaaagttgaagccatgggaaaacctggacttgtagagatacatgccaaggaagatagttttattttcactgttgaaacaactggtgcagttaaagcttcacaattggtgctcaatgcaatagaagtgctgaagcagaagttggatgcagtacgcctttcagatgacactgtggaagcagacgatcagtttggagagttgggtgctcatatgcgtggagggtaaaacctcattggttgattccaacttcttcactggtgaaaaactgtttaacttctctcctgtaacaagacatccttgaaacttaacttgaccgatgatggaaaactggaaatgtagagcactgtttctgtttctttttaagtatatgttttagtccatcatcttgtactgaaaaactgaacttttgttggatttcatctcgcgattgatcatcaatccccgtctatgtactaactaaatgtgctttttaagacgcgctatgat

SEQ ID NO: 1660 - DNA, 1206 bp, Centaurea maculosa
cgggggacagaagaaggggttttcccaaccctagagagagaaaaccaaaccctagagagagaaacaaagcaaagcaacaatggaaggtgctgcatcataccagaggttccccaaggtcaaaatccgtgagctcaaagacgactacgccaagttcgagctccgggagaccgacgccagcatggccaacgccctccgccgtgtcatgatcgccgaggttccgaccatcgccatcgatctcgttgaaatcgaggtcaactcctccgttctcaacgacgagttcatcgcgcaccgcctcggcctcatcccgctgacgagcgagcgcgccatgagcatgcggttctctcgcgactgcgacgcctgtgacggtgacggccagtgcgagttttgttccgtggagtttcatctgagagccaagtgtataaatgatcaaaccctagatgttaccagtaaggatctgtatagctctgaccacacggttgtgccggttgacttctccgattccggctctggatttgagaataatgaagatcagaggggaatcacgattgtgaagctgcgcaaagggcaagaactgaggctaagagcaatagctcgaaagggaatcggaaaagatcacgccaagtggtcacctgctgcaactgtcactttcatgtatgaacctgagattcacattaacgaagaaatgatggagacgttatcacttgaggagaaaacaagtgttgtggatagcagccctaccaaagtgtttggcattaacccccatacccagcaggtggaggtggtggatcgtgaggcatacacgtatgacgatgaagtgctgaagaaagtggaagcaatggggaaaccaggactagtggaaatctatgcaaaagaagacagtttcatcttcacggtggagtccacaggtgcagtgaaagcatctcagttggtgcttaacgcaattgaggttctgaaacagaagctggatgcagttcgactgtcagaggataccgtagaagctgatgaccaatttggcgaattgggagctcatatgcgaggaggatgaccaactaattaccatttcgttggcttaatgtcttcagacttgttatctactgctgcttatttctctatgtcaatgtactaggaatcatcatcagtaatcaatcttcatgctttcaactggacttgattgatgactgacatgggtgtggctgtttcatgctg

SEQ ID NO: 1661 - DNA, 1182 bp, Cichorium intybus
ggcgggctacaaagcacgggaagagggttttagagaactggggttttcaaaccctagagagagaaacacctaagggaacgaaatggaaggagcttcataccagagattccccaaggtcaaaatccgtgagctgaaagatgattacgccaaatttgagctccgggaaaccgacgctagcgtggccaatgcactccgtcgcgtcatgattgccgaggttccgaccatcgccatcgatctcgttgaaatcgaagtcaactcttctgttctcaacgacgagttcattgcacatcgtctcggtcttatccctctcacaagcgagcgtgcgatgagcatgcgtttctcacgtgactgcgatgcgtgtgatggtgatggccagtgcgagttctgttctgttgagtttcacctgagagctaagtgtataaatgatcaaaccctagatgttacgagtaaagatctttacagctctgaccacaccgttgtacctgtcgatttctccgataccggctctggcttcgacaatcctgaagatcagagaggaatcacgattgtcaaactgcgcaaagggcaagaattaaggctaagggcaatagctcgaaagggaattggaaaagatcacgccaaatggtcacctgctgcaactgtgactttcatgtatgagcctgagattcatatcaatgaagaaatgatggaaactctatcacttgaagaaaaaacaagtgtagttgatagcagccccactaaagtcttcggcataaatccacacacactgcaggtggaggtggtggatcctgaggcatacacatatgatgatgaagtgttgaagaaagtgaaagccatgaataaaccaggacttgtggaaatatatgcaaaagaagatagttttatatttacagttgagtcaacgggtgcggtcaaagcatctcaattggtgttgaatgcgattgaggttctgaaacagaagctggatgcggttcggttgtctgaggacacggttgaagctgatgaccagtttggtgaattgggtgctcatatgcgaggaggatgaagatgagcatattgtttgttgggtaggctatctcatgtttaaaatgaccaaattgcacttggtgtttctttatttggaatactgttgttatctgctaaaagatccaaggggctactagtaattaactgctgtttctc

SEQ ID NO: 1662 - DNA, 1240 bp, Nicotiana benthamiana
agtactatttcacttccaaaaccctcccaccaaaaacacaaagcagaagcaacaatggagggcgtctcgtaccagagattcccaaggatcaaaatccgtgaagttaaagacgactacatgaaattcgagctgcttgacaccgacgccagcatagccaacgcgcttcggcgcgtgatgatagcagaagtcccaacaatcgccattgacctcgttgaaatcgaggtcaattcttcggtcctcaacgacgagttcatatctcatcgtctggggctcatccctctcactagcgaacgcgcaatgagcatgcgtttctcgcgtgactgtgacgcgtgtgacggtgacggacagtgcgagtactgttccgttgagttttacctccgtgtcaagtgcctcagtgaccagacgcttgatgttactagcaaggatttgttgagttcggatcatactgttgttcctgtagattattccgatgcttcctccggttttgataattctaccaataagggaatcataattgtgaagctacgtcgtgggcaggagttaaggctaagagcaatagcacgaaaaggaattgccaaagatcatgcgaaatggtctcctgcagcaactgtcactttcatgtatgaaccagatatctacatcaatgaggacatgatggagaccttgtctctcgaggagaaaagagaattagtagacagtagtcccacgaaagtctttggcattgatcctgaaactgaaaacaaggttattgtagttgatcctgaggcatacacttacgatgatgaggtgcttaagaaatgtgaagccatgggaaaacctggacttatagagatacatgccaaggaagatagttttattttcactgttgaaacgactggcgcagttaaagcttcacaattggtactcaatgcaattgaagtgctgaagcagaaattggatgcagtacgcctttcagatgacacagtggaagcagatgatcagtttggagagttgggtgcacatatgcgcggagggtaaaaccgcattggtcaatttgcacttcctcacttgttaaaactgttgatgtttaatatgtcttgtagggacaagaaatccgtgaactatttaacacattttcccttttgaacttaccttaactggtgatggaaatgtaggagactgcttttgtttgttgaaagtaaatggttttttcccctcatcttgtactgatagaatttgttggatatcacatttcaatgga

SEQ ID NO: 1663 - DNA, 1265 bp, Citrullus lanatus
gagagtgagctagaacgacagaggtgggagacatggaagggagttcgtaccagcggtttccaaaggtgaaaatccgggaactccgagatgattacgccaaattcgagctccgcgacaccgacgccagcatggccaacgccctccgtcgcgtcatgatcgccgaggtgcccaccatcgccattgacctggtagaaattgaagtgaactcttctgttctcaacgacgagttcatcgctcatcgccttggtctcattcctctcaccagcgagcgtgccatgtccatgcgcttctctcgcgactgtgatgcttgcgatggtgatggccagtgcgagttttgctctgttgagtttcaccttcgtgccaagtgccactccgaccaaaccctagacgtcaccagcaaggatctctatagttctgatcacactgttgtccccgttgatttctctgattctgctgcagctagtggtgaagcgttggataccaaaggaataatcattgtgaagctacgtcgtggtcaagagttgcggctgagagccatagctaggaagggcattggtaaagatcatgcaaaatggtcgcctgcagcaaccgtgacattcatgtatgagccaaacattcacatcaatgaagacctaatggaaacattaaccctagaggaaaagagaacttgggttgaaagttgcccaaccagagtatttgaattggatcctgttactcatcaggttatggtggttgatcctgaggcatacacttatgatgatgaggtgattaagaaagcagaagctatgggtaaagctggactagtggatattactgcaaaagaagatagttttatcttcacagttgaatctaccggtgcaatcaaagcttcccagttgatactcaatgccatagatatcctgaaacagaagctggatgcagtccgtctttcagacgatactgtagaagcagatgatcagtttggtgagttaggtgcacatatgcgaggtggatgatccaaataccagccttacccatatgtttgtaggaggtgagactaacttgaattttgttttctggacaatctggttttttgtatgaatgaacttggtttagtgcagtctttttcacatatttgatgcattcccctagcttctggaaatgattaaaatgtagtatctttggcattatctgacacggattcgtggattataaatgatagttaattcagcttctactatcttcaggcaatgctttgattattaatttttccagggctgcttcct

SEQ ID NO: 1664 - DNA, 1143 bp, Fagus grandifolia
agcatcagtgttgcttcctactccaaaacccactgagagaaaagcatggacggaggaatgtcttaccagcggttccccaaggtgaagatccgtgaagtcaaggacgacatcatgaagttcgagctacgagagaccgatgccagcttggccaacgcgctgcggcgcgtgatgatcgccgaggtcccaaccatcgccatcgaccttgtcgagatcgaggtcaactcctccgtcctcaacgacgagttcatcgcccacagactcggcctcatccctctcaccagcgaacgcgctatgagcatgcgcttctcacgtgactgcgacgcctgcgacggcgacggccagtgcgagttctgctccgtcgagttccacctccgcgccaaatgcctcaccgaccaaaccctagatgtcacaagcaaggacctctacagctccgaccacaccgtcgtccccgtggactttctccgatcccaacgagcctggcgagcaaaggggaattatcatagtgaagttgcgtcgtggacaagaactgaggctgagggctatagcgagaaaagggattggtaaagatcatgcaaaatggtcacctgcagctactgtcacattcatgtatgaaccaatgattagaatcaatgaagacttgatggaatctttgtcactcgaggataaaagaagctggattgagagtagtcctaccaaagtctttgaaatggaccctattacccaacaggtagtggtggctgaacctgagtcctacacttatgatgatgaagtgatcaagaaagcagaggctatggggaagtcagggcttgtggagattgaagccaaagaagacagtttcatattcactgtagaatctactggtgcaatcaaagctactcagttggtactcaatgccatagaagtcctcaaacaaaagctcgatgcagttcgcctgtcagatgacactgtggaagctgatgatcagtttggcgaactaggtgctcatatgcgaggaggatgatcctgttggtaaaaagagatgaatcaattggtcctttcagcttcttggagatcaattgaatttcattcggtttttgggacttgttcatatgctgtactaactgcatcttcctttcctcattttaacttgtgctgtggatgact

SEQ ID NO: 1665 - DNA, 1179 bp, Taraxacum officinale
agggttttcaaccctagtgagagagcgatgcaaaagagggaacgaaatggaaggagcttcataccagaggttccccaaggtcaaaatccgtgaacttaaagatgactacgccaaatttgctcagagaaaccgacgccagcatggccaatgcactccgtcgcgtcatgatagccgaggttccgaccatcgccatcgatctcgtcgaaatcgaagtcaactcatctgttctcggagacgagttcattgcacatcgtcttggccttattcctctcactagcgagcgtgccatgagcatgcgcttctcgcgtgactgcgatgcctgtgacggcgacggccagtgcgagttttgttccgttgagtttcatctgagagctaagtgtataaatgatcagactctagatgttacgagcaaagatctatacagctctgaccacaccgttgtgcctgttgacttctccgattccagctctggcttcgaaaatcctgaagatcagaggggaataacgattgtaaaactacgcaaagggcaagaactgagactaagggcaatagctcgaaaaggaattggaaaagatcatgccaaatggtcacctgctgcaactgtcaccttcatgtacgagcctgaaatccacatcaacgaagaaatgatggaaacactatcgctcgaggaaaaaacaagcgttgttgaaagcagccccaccaaagtcttcggcatcaatccccacacacaacaggtggaggtggtggaccctgaggcgtacacatacgatgatgaggtgttgaagaaagtggaagccatggggaaacctggacttgttgagatttacgcaaaagaagatagttttattttcacggtagagtcaacgggtgcggtcaaagcgtctcaattgttgttgaatgccattgaagttctgaaacagaaattggatgcggttcgattgtctgaagatacagtagaaggtgatgaccagtttggtgaattgggtgctcatatgagaggaggtggatgaagattgttgtgttgactagttttcttttatgcccctttgaaattgaccgaattggactttgtgttttctttatttggaatgctgttgttatctgttaaaagatccaagggggtactagtaattaactgatgtttctcatggtttcaagaatttcaggcgaccaggtttc

SEQ ID NO: 1666 - DNA, 1854 bp, Cicer arietinum
gtatctttttaaattacaataactgttatgatttaatattttttggaggaaaaaggtggaaaattgacttgttctgtactgattattgagtgtgtttggagagaaaaagtttagaaaggaatagatgaaatgacaaattgatccctaaagaatagagagtagagaaaagtagcagtgaatattgagcaagcacattcgggggtttgcgaaaggggttttaagaaagccaaccacaacacacatttcttcttcttacgctctgctcaacatcaaactatggagggtgcatcatacgcacgcatgcctcgtgtcaaaatccgcgagcttaaagatgattacatgaaattcgaacttcgcgacaccgacgctagcgtggccaacgcgcttcggcgcgtgatgatatcagaagttcccaccatcgccatagacctagttgaaatcgaggtaaactcctccgtcctcaatgacgagttcattgctcacagactcggtctcattcctcttacaagtgaacgtgctatggccatgcgtttctcacgtgactgtgacgcttgtgatggtgatggacagtgtgagtattgttccgttgaatttcatcttagggttaagtgtattactgatcagacacttgatgttactagtaaggatctttatagctctgatcacactgttgttcctgttgatttctctgctgacccttcttctcttgaatcttctgatggcagggggattataattgtgaagttgaggagaggtcaggagctgaggctgagagcaattgctaggaaggggattggtaaggatcatgccaaatggtcaccagcagcaactgttactttcatgtatgaaccagatattcatataaatgaggatttgatggagtctttgacacttgaggagaaaagagagtgggttgatagtagtcctactcgtgtgtttgatattgatcccgtcacacaacaggtgatggtggtggaccctgaggcatacagttatgatgacgaggtgattaagaaagcggaagctatgggaaagcctggactagttgaaatcactgcaaagcaggatagcttcatattcacagttgaatctactggagcagttaaagcttctcaattattgttaaatgccattgaaattctcaagcagaagctagatgcagtccggctatctgaagatacagtggaggctgatgatcaatttggtgagctaggtgcacatatgcgaggaggatgatttagaaggatttcagacatgtttttatggacttgtttgttgcaagtcatttttaactgaacagctggaatatgtgctctacctctttgaaccaatgatgctaactgttattagtaactcttgaagataaactcaggtttatggcttgctagaaacagtgattagcattttttgaatttttttgattatgtgcgcacactcagtcacagggatgagattacatgatttattataatctcccaaagaacataggaatccgatttattaaactaatttgaagctttgggttattaaagtcaatagttgaaccaatgagccatgtttttattaaaaatgtataatttaaatctgtaagattttatttatttccaagcataagagcttttccgacactaggttcatactcgattgtaacatgtttatggtgcgcataatataataactaactaacagagggagatgaagtaaatggtgtattgggaaagcaagggtagcttgttaatgtgatttttgtgtatgaaatggttttgtacatcaaaagacgtttatgcacagtatcagcattagatgtaaagcaacttcgagccatttaggttcataattgtattgttggagtaa

SEQ ID NO: 1667 - DNA, 1482 bp, Echinacea purpurea
cggccgggggattgcaacatcgattagcagctcgtagcctccttcattttataatacaatacaatacaatatgggcagacagacttggctcaatagctcaaaaaacaggcccaaatggcaaaaacaagaaagcgtgtgtgaatacagtgcttctttctatcttcttctattctgtttctgtaagggttttcaaaaccctagagagagaaacaagcaaacaaacagaaaaccctagagagagaaacaaacaacaatggagggtgcatcgtaccagaggttccccaaagtcaaaatccgcgagctcaaagacgactacgtcaaattcgagctccgagaaaccgacgccagcatggccaacgcactccgtcgcgttatgatcgccgaggttcccacaatcgccatagatctggtcgaaatcgaggtaaactcttctgttctcaacgacgagttcattgcacatcgtctcggtctcattcctctcaccagcgagcgtgccatgagcatgcgcttctcacgtgactgcgacgcctgtgacggtgacggccagtgcgagttttgttcggttgagtttcatctcagagctaagtgtattaatgaccagacgcttgatgttacgagtaaggatttgtatagctcggatcatactgttgtgcctgttgatttctctgattctggctctggttttgagaatcctgaagatcaaaggggcatcaccattgtgaaacttcgcaaaggacaagaactgaggctaagagctatagctagaaagggtattggaaaagatcatgcaaaatggtcacctgctgcaactgtcaccttcatgtatgagcccgagattcacatcaatgaagaaatgatggagactttatcacttgaagataaaataagtgtagttgagagcagccctaccaaagtctttgccttaaatccccaaactcagcaggtggaagtggtggatcctgaggcatacacgtatgatgatgaagtgctgaagaaagtggaagccatggggaaaccggggctcattgaaatctatgcaaaagaagacagttttatcttcacagttgaatcgactggtgcaatcaaagcttctcagctggtgattaacgccattgaggttctgaaacagaagctggatgcggttcgcctgttggaggacactgttgaagctgatgaccagtttggggaattaggcgctcacatgcgaggaggttgaccatttggccttaactttatctttagtatctatgaatgtcaatctacttttagtttatttggtatggaagaccgggttctctttgtaatttttatcaaatcgtagggtgttttatatctcacttttgccatatttgaaagcttgaaaggagatcacaaaatcactctattgtgttgcaattatgcctgttcatgggttgtcgatgggacctagaccgctttgcttgtaaaaccctgtccttgaaccagagcaaccgctgatcatca

SEQ ID NO: 1668 - DNA, 1356 bp, Centaurea maculosa
  misc_feature (96)..(96): n is a, c, g, or t
  misc_feature (406)..(406): n is a, c, g, or t
  misc_feature (562)..(562): n is a, c, g, or t
  misc_feature (634)..(634): n is a, c, g, or t
  misc_feature (861)..(861): n is a, c, g, or t
  misc_feature (1200)..(1200): n is a, c, g, or t
  misc_feature (1319)..(1320): n is a, c, g, or t
atcggaggagggttttgcagaaccagaagaaaggggttttcccaaccctagagagagaaaaccaaaccctagagagagaaacaaagcaaaagcaanaatggaaggtgctgcatcataccagaggttccccaaggtcaaaatccgtgagctcaaagacgactacgccaagttcgagctccgggagaccgacgccagcatggccaacgccctccgccgtgtcatgatcgccgaggttccgaccatcgccatcgatctcgttgaaatcgaggtcaactcctccgttctcaacgacgagttcatcgcgcaccgcctcggcctcatcccgctgacgagcgagcgcgccatgagcatgcggttctctcgcgactgcgacgcctgtgacggtgacggccagtgcgagttttgntccgtggagtttcatctgagagccaagtgtataaatgatcaaaccctagatgttaccagtaaggatctgtatagctctgaccacactgttgtgccggttgacttctccgattccggctctggatttgagaataatgaagatcagaggggaatcacnattgtgaagctgcgcaaagggcaagaactgaggctaagagcaatagctcgaaagggaatcggaaaagatcangccaagtggtcacctgctgcaactgtcactttcatgtatgaacctgagattcacattaacgaagaaatgatggagacattatcacttgaggagaaaacaagtgttgtggatagcagccctaccaaagtgtttggcataaacccccatacccagcaggtggaggtggtggatcgtgaggcatacacatatgacgatgaagtgctgaagaaagtggaagcaatgggganaccaggactggtggaaatctacgcaaaagaagacagtttcatcttcacggtggagtccacaggtgcagtgaaagcctctcagttggtgcttaacgcgattgaggtactgaaacagaagctggacgcagttcgactgtcagaggataccgtagaagctgatgaccaatttggtgaattgggtgctcatatgcgaggaggatgaccaactaattaccattttttggcttaatgtcttcagacttgttatctactgctgcttatttctctatgtcaatgtactaggaatcatcatcagtaatcaatcttcatgctttcaactggacttgattgatgactganatgggtgtggctgtttcatgctgtttttatgggcaatggatccatatagcattgtaggttaacatgcaacctgatctctaaacattgatccttagattaactaagaagctgtttataannacggtacctgggtgtttacttggtaagcctttgagc

SEQ ID NO: 1669 - DNA, 1090 bp, Flaveria ramosissima
aaaaaccacagagataacaacaatggaaggagcatcataccagaggttccccaaggtcaaaatccgtgagctcaaagacgattacgtcaaattcgagctccgtgaaaccgacgccagcatggccaacgccctccgtcgcgtcatgatctccgaggttccgacaatcgccatcgacctcgttgaaatcgaggtcaactcttctgttctcaacgatgagttcatcgcacatcgccttgggcttatacctcttacgagtgagcgtgcgatgagtatgcgattctcgcgtgactgcgatgcgtgtgatggtgatggtcagtgtgagttttgttcggttgagtttcatctgagggccaagtgtatcagtgatcagacgcttgatgtcacgagtaaggatctttatagctcggatcatactgttgtgcctgttgatttctcggattcgggtgctggctatgagaaccctgaagatcagagaggaatcacaattgtgaaacttcgcaaggggcaagaactgaggctaagagcaatagctagaaagggtattggaaaagatcatgcaaaatggtcacctgctgcaactgtgactttcatgtatgagccagagattcacatcaatgaagaaatgatggagactttatcacttgaagagaaaacaagtgtagttgagagcagtccaaccaaagtctttgccttaaatccccatactcaccaggtggaggtggtggatcctgaggcatacacatatgatgatgaagtgctgaagaaagtggaagccatggggaaaccggggcttattgaaatctatgcaaaagaagacagttttatcttcacagttgaatcaactggtgcaatcaaagcttctcagttggtgattaatgccattgaggtcctgaaacagaagctggatgcagtgcgcctgttagaggacactgtagaagctgatgatcagtttggggaattaggtgctcatatgcgaggaggttgatcttaacttcatctttatcgtatctgaatgtcaatctgctgtcagtttctttggtatggaaaactgggatttctgtatgttattttcatcaaattgtagggtttc

SEQ ID NO: 1670 - DNA, 1038 bp, Flaveria ramosissima
gtgtgcttccaccttcatcaactgagggttttgtaaaccctagagctcgagaagaaccacagagattacaacaatggaaggagcatcataccagaggttccccaaggtcaaaatccgtgagctcaaagacgattacgtcaaattcgagctccgtgaaaccgacgccagcatggccaacgccctccgtcgcgtcatgatatccgaggttccgacaatcgccatcgacctcgttgaaatcgaggtcaactcttctgttctcaacgatgagttcatcgcacatcgccttgggcttatacctcttacgagtgagcgtgcgatgagtatgcgattctcgcgtgactgcgatgcgtgtgacggtgatggtcagtgtgagttttgttcggttgagtttcatctgagggccaagtgtatcagtgatcagacgcttgatgtcacgagtaaggatctttatagctcggatcatactgttgtgcctgttgatttctcggattcgggcgctggctatgagaaccctgaagatcagaggggaatcacaattgtgaaacttcgcaaggggcaagaactgaggctaagagcaatagctagaaagggtattggaaaagatcatgcaaagtggtcacctgctgcaactgtgactttcatgtatgagcctgagattcacatcaatgaagaaatgatggagactctatcacttgaagagaaaacaagtgtagttgagagcagtccaaccaaagtctttgccttaaatccccatactcaccaggtggaggttgtggatcctgaggcatacacgtatgatgatgaagtgctgaagaaagtagaagccatggggaaaccagggcttattgaaatctatgcaaaagaagacagttttatcttcacagttgaatcaactggtgcaatcaaagcttctcagttggtgattaatgccattgaggtcctgaaacagaagctggatgcagttcgcctgttagaggacactgtagaagctgatgaccagtttggggaattaggtgctcatatgcgaggaggttgatc

SEQ ID NO: 1671 - DNA, 1262 bp, Catharanthus roseus
ctaaccacagtagcctgaaaaaccaaaaccctcgctcattagatcagagctccggccgacaaatcaatatggacggcgtgtcctaccagaggtttcctagagtcaaaatccgtgaacttaaagacgattttgcaaagttcgagcttcgggataccgatgcgagcatagccaacgctctgcggcgtgtgatgatagcagaagttccaacggtggctatcgacttggttgaaattgaggttaactcctccgtattgaatgacgagttcattgctcacagattagggctcattccgctcaccagtggccgagcaatgagcatgcgtttctctcgtgactgcgacgcttgtgacggagatggccaatgtgactattgctctgttgagtttcatctcagagccaagtgcattaacgatcaaaccctagacgtcaccagcaaggacctcattagtgctgacccctctgttgttccggttgatttctcagattcatctggatttgataactccgagaacagaggaattataattgtgaagctgaggcgtggtcaagaactacatctgagagctattgcaaggaaaggaattggcaaggatcatgccaaatggtctcctgcagcaacagtgactttcatgtatgagcctgatatttacatcaatgaagagatgatggagagattatctctggagcagaaaaggagtattgttgacagtagtcccaccagagtatttgatgttgatgagaaaactggacagtttgttgtggttgatgccgaggcatatacttacgatgacgaagtactcaagaaatgtgaatcaatgaatttgcccggactcatagaaatacgtcccaaagaagatagttttatctttacagttgagactactggtgccgttaaggcttctcagttagttctcaatgccattgacattttgaagcagaaactggatgcagttcgcttgtctgatgacactgtggaagcagatgaccagtttggtgaattgggtgctcatatgcggggtggctgacccagatgacaggagaatgatatttaattagttgtatgtaaattctgctgttatgcttattgcttgaagcatgggaattttacttctgatccaattatatcacccactggactatgcatgtcttttctaactatctataacctattatccgagtattctatctgtcaaagcattttagcaacctaaaatggtgcaacaaagccagcatttgtttaaaattgttgctaatcatgagat

SEQ ID NO: 1672 - DNA, 1251 bp, Eucalyptus grandis
gcgacgattccacaatacagtagcagagaaaagctctcgagctctctcggttctccgacgatggaagggggcggcggcgcgtcgtaccagcggttcccggtggtgaaggtccgggagacgaaggacgactacctcaagttcgagctccgggggacggacgccagcgtggccaacgccctccgccgcgtcatgatcgcggaggtccccaccatcgccatcgacctcgtcgagatcgaggtcaactcctccgtcctcaacgacgagttcatcgcccaccgcctcggcctcgtccccctcacctccgaccgcgccatgtccatgcgcttctcccgcgactgcgacgcctgcgacggcgacggccagtgcgagttctgctccgtcgagttccacctccgcgccaagtgcatgaccgaccagaccctcgacgtcaccagcaaggacctcatcagctccgaccacaccgtcgtccccgtcgacttctccgacgccctcgccgacgattccgccgagcagaagggaattactattgtgaagcttcgccgagggcaagagctaaggctgcgagcaatagcaagaaaaggaattggcaaagatcatgcaaagtggtcccctgcagccaccgtgacattcatgtatgaacctgaaattcacatcaatgaagatttagtggaaaccttgtcccttgaggaaaaacaaagttgggtggaaagcagtcccaccaaagtgtttgacattgatccaaatactgagcaggtgctagtggttgatcctgaggcttacacttatgatgaagaagtaataaaaaaagctgaagccatggggaagccaggtcttgtggagatatatgcgaaggaggacagttttatattcactgtcgaatccactggagcaattaaagcttcacagttggtactcaatgccatagacgtgttgaagcaaaaactggatgcagttcgcttatcagaagatacagtggaagctgatgatcaatttggggagctaggcgctcatatgcgcggaggatgattggactgtaaaatagcgtatttttagacctgatctttaaatgtttctagtggatcttcatggaacccttttaatctgttttagcgacaccaaattatcagccagtgatttcaatctttcttatgttttgtgcctgtttggtaaaactaatttatgttcgtcggaacaactatttctgttattttgtttcaggaaaacaaaaaaaaaaaaaagtgtatggtaaaa

SEQ ID NO: 1673 - DNA, 1321 bp, Artemisia annua
aacttacataaccaaactctctacacacaccgtcatcactaccaaccaacactccactagggtttaatacacacacaaattcaaaacacacacccttctcaaaactcaaaaccctaaccccaaaaccaaaaaaaaaaaaatggacggccaaaaatcctaccaacgctacccaacaatcaaaatccgagaactcaaacacgactacgccaagttcgaactccgcaacaccgacgcctccgtcgcaaacgccctccgtcgcgtaatgatttccgaggtccccactatcgcaatcgacttagtcgaaatcgaggtgaactcatccgtcttaaacgacgagtttatcgcgcataggctgggattgattcctttaaccagtgagcgtgcgatgagtatgcgattttcgcgcgattgtgacgcgtgtgatggggatgggcaatgtgagttttgttcggtggagtttcatttgagggctaagtgtattaatgataatacgttggatgtgactagtaaggatttgtatagtagtgatcatacggttgtgcccgttgatttctcgggcgatgttggttttgatagcggcgaggagcagagggggatcacgattgtgaaactacgcaaagggcaagagctgaggctaagagcaatagctagaaagggaattggaaaagatcatgcaaagtggtcacctgctgcaactgtcactttcatgtatgagcctgagattcatatcaatgaagaaatgatggagactttgtcactagaggagaagactagcgtggtagaaagcagccctactaaagtctttggcatcaatcctcatacccagcaggtggaagtggtggatccagaagcatacacatacgatgacgaagtgctaaagaaggttgaggccatggggaaaccaggactagttgaaatttatgccaaagaggacagtttcatcttcactgttgaatccacgggtgcagttaaagcctctcagctggtgattaatgccattgatgtcctgaaacagaagcttgatgcagttcgcctgtctgatgaaacggttgaaacggatgaccaatttggcgaattaggtgcccatatgcgaggaggatgataaccctctcttgttggttcaagtttgttatcctttgtgtgcttaaaatgcccatgaagcacatggtgtcactacttgtaattctgttaatgattctaggtactgctacttgtttctcaatgttaaggttaatgtacttatcaatcgtctaggattagtctattatgctttcaagtgactcctttggtatggaaagcagtctctctttagcttgggcct

SEQ ID NO: 1674 - DNA, 982 bp, Cucumis sativus
tcatggaagggagttcgtaccagcgatttccaaaggtgaaaatccgagaactccgagatgactacgccaaattcgagctccgggacaccgatgccagcatggccaacgctctccgtcgcgtcatgattgccgaggttcccaccattgccattgatttggtagaaattgaagtgaactcctctgttctcaacgacgagttcatcgcccatcgcctcggtctcattcccctcaccagcgagcgtgccatgtccatgcgcttctctcgggactgtgatgcttgcgatggtgatggccagtgtgagttttgctctgtcgagtttcaccttcgcgccaagtgccactccgaccaaaccctagacgtcaccagtaaggatctctatagttctgatcacactgttgtccccgttgatttctccgattctgctgcagctactggtgaagcgctggataccaaaggaataatcattgtgaagctacgtcgcggtcaagagttgaggctgagagccatagctaggaagggtattggaaaagatcatgcaaaatggtcgcctgcagcaactgtgacattcatgtatgaaccgagcattcacatcaatgaagacctaatggaaacattaactctagaggaaaagagaacttgggttgaaagttgtccgactagagtatttgaattggatactgtcactcatcaggttatggtggttgatccagaggcatacacttatgatgatgaggtgattaagaaagcagaagctatgggtaaagctggattagtggatattacggcgagagaagatagttttatcttcacagtggaatctacaggtgcaatcaaagcttcccagttgatactcaatgccatagatattctgaaacagaagctggatgcagtccgtctttcagatgatactgtagaagcagacgatcagtttggtgagttaggtgcacatatgcgaggtggatgatccaaacaccaccaggc

SEQ ID NO: 1675 - DNA, 1257 bp, Euonymus alatus
gattctcgtctcgggaagggaacgacaatggatgggggaatttcgtaccagaggtttccaagggtgaagatccgggagataaaggatgactacctgaagtttgaactgcgggacacggacgcgtcgatggcaaacgcgctgcggcgcgtgatgattgctgaggtgccgacgatcgccatcgacttggtcgagatcgaggttaactcctccgtcctcaacgacgagttccttgcccatcgtttggggctcattcctcttatcagcgaacgcgccatgagcatgcgcttctcccgcgactgtgatgcctgcgatggcgacggccagtgtgagttctgctctgtcgagttccacctccgtaccaagtgccactctgaccaaaccctcgatgttactagcaaagatttgatcagctcagatcactcggttgtaccggtcgatttctccgatttggctggctacgattcttctgagcagaggggaattatcattgtcaagttacgccgtggacaagaacttaggctacgtgctatagcaaggaaagggattggtaaagaccatgcaaaatggtctcctgcagcaacagtcaccttcatgtatgaaccagagattcacatcaatgaagaaatgatgcaaaccttgacacttgaggagaaaattgccttagttgaaagcagtccaaccaaagtgttgggaatggagaatcaacaggttgtagtggttgatccggaggcatatacctacgatgatgaagtgctgaagaaagcagaatctatgggtaagccagggcttattgagatcaatgctagagaagacagttttatattcacggtggaatcaactggtgctattaaagcttcccagttactacttaatgccatagaaatcctcaaacagaagctggatgcagttcgactgtctgaggacactgttgaagctgatgatcaatttggtgagctaggtgcccatatgcgaggtggatgatgttggtaaaccgagtgatcaattaaaacatttgtaggctagtatctgctcatatgcttatttccttttaaatgtcatgtggatgctaatttctgtcctgcatgtttatgtgttctcctatgttctaactttgcctaatggccattttccatgtgtgacttgctgcacagatttttcctttttttgttttccctatgtacgacagcttgtccatttactctgtctgtcacgtttgtttggaaagaaccatcgatcattgatcatgaatacaatcac

SEQ ID NO: 1676 - DNA, 1339 bp, Panax ginseng
ccccgttacggtctctagtcaggcgttaccggcggctacgaatctctctgttataattgcgaaggtttgggagtggggccgagtcgtcgggttcgcagtttggtcgacgaggatccagatagtcttgtactcgcgtgaccaacacttcacagttacaaaagaggagagagaaaatggaaggagcttcttaccagcgatttccgaccgtgaagatcagagaactgaaagatgactacgccaagttcgagctccgagacaccgacgccagcattgccaacgccctccggcgagtcatgatcgccgaggttcccattgttgccatcgatttggttgaaattgaggttaactctactgtactaaacgacgagttcattgctcaccggctcggtctcattcctcttaccagcgaacgagccatgagcatgcgcttctcacgtgactgcgacgcctgtgatggtgacggccagtgcgagttctgttccgtcgagttccatttgcgggcaaagtgtatcaacgatcaaaccctagatgttactagcaaggatctctacagctcggaccatactgttgttcctgttgatttctctgattcctctggctacgaaaattctgaacaaaggggaataataattgtgaagcttagccgtggacaagaactgaagctgagagccattgcacgaaaaggaattggcaaggatcatgccaagtggtcatctgctgcaactgttactttcatgtatgaacctgccattcatatgaatgaagatatgattgagagtttaacactacaagacaaacaaagtttcgtcaatagcagtccaaccaaagtctttgaaattgaccctgaaacccaacaggttaaggttgttgatcccgaggcatacacgtatgatgatgaagtgctcaagaaagccgaagctatggggaagccaggacttgtggaaatctatgcaaaagaagacagtttcattttcacagttgaatccactggtgcgatcaaagcttcacagttggttctcaatgctattgatatcctgaaacagaagctggatgcagtttgcctgtcagatgacactgtggaagctgatgaacagtttggggaattgggtgcgcatatgcgtggagggtgatccatggagtcccaggattgttcagatattatgatgtagttttcaattaacagcccatgggtgctatcatcttttgtaagtatgtcctatgtcatgtttctggtatatttaccaactttatttttctcttcgacttgtttgcagttcagacactaacataacatgtgcagtaatttggaatagattgcatctttacattcttgttgaaa

SEQ ID NO: 1677 - DNA, 1489 bp, Vigna unguiculata
gaattttgataatataatttagaaaaataaaagtagttatccattgcttatgacgatgctagccctgtagtaagaacataaactaaaaagtttgggttttgaaaagggtttttacatttttcagagttgtctgaaagaggaagagcagagagagtgtgaggcgatggagggtgcatcgtatgcgcgcatgccgagggtgaaaatccgcgagctgaaggatgattatgccaagttcgagctccgggatacggatgcgagtatcgcgaacgcgctgcggcgcgtgatgatcgcggaggtgccgacgatcgcgattgatctggtggagatagaggtgaattcgtcggtactgaacgacgagttcatagcgcacagactcggactcattccgctcacgagtgagcgagccatgtccatgcgcttctcacgtgactgcgacgcgtgtgacggcgacggccagtgtgaattctgctccgtggagtttcaccttagggttaagtgtatgactgaccaaaccctcgatgtctccagcaaagacctttacagttccgacccctccgtcgttcccgtcgatttctctgaccctgcttcctccgattcttccgagagcaggggggttatcattgtgaagctgaggcgaggacaagagctgaggctgagagcgatagctaggaaggggattggcaaagatcatgccaagtggtcacctgctgcaactgtcactttcatgtatgaaccagagattcatataaatgaggacttgatggagacactgactcttgaggagaaaagagaatgggttgatagcagccctacacgtgtgtttgaaattgatccagtaacacaacaggtaatggtggttgacgctgaggcatactcatatgatgatgaggtgctcaagaaagcagaagccatggggaagcctgggcttgtggaaatcattgcaagacaagatagcttcatattcacagttgaatctactggagcaattaaaacttctcaattagtactaaatgccatagaaattctcaagcagaagctggatgctgtgcggctatctgaagatacagtggaggctgatgatcagtttggtgagctaggtgcacatatgcgaggaggataactgagttgattgtattagaaggatatcaaatttgtttcactgaacttgtttctttcttcttttacttaactgaatagctgcagcaagtgttaacttggtgagtcgaagatgctaattactattttcccccttgaagaacaacatagatagttgttatgtttcactcttatcattaggtagattcatgcacacaaaagttctatcctcttcccatgcttgcttcctttattttgtttataatggtggaaaggaaaaactcgaatctgcatggcttaagcagctccaagtcctttaaaagcttttgtccttttgttgtttggatcctgtaagcttaccatatactcgatattatggaattcctcttcaatt

SEQ ID NO: 1678 - DNA, 1621 bp, Nicotiana benthamiana
cgctttgtaagttgcattcacctattatttataaatcggaatcattcttgtgacttataaatcgctttcataattgcaacttattgataacgtttgtatccaatctgtaaatatcccaaacccagaggctcaacaagcaaattccatactctttaaaaatttacaaaacccagccaaagtatacctcggaactatttcagtgccaaaaccctcccaccaaaaacaaagcagaagcaaaaatggagggcgtctcgtaccagagattcccaaggatcaaaatccgtgaagttaaagacgactacatgaaattcgagctgcgcgacaccgacgccagcatagccaacgcgcttcggcgcgtgatgatagcagaagtcccaactatcgccattgacctcgttgaaatcgaggtcaattcttcggtcctcaacgacgagttcatatctcatcgtcttgggctcatccctctaactagcgagcgcgcaatgagcatgcgtttctcgcgtgactgtgacgcgtgtgacggtgacggacagtgtgagtattgttccgttgagttttacctccgtgtcaagtgccttagtgaccagacgcttgatgttactagcaaggatttgttgagttcggatcatactgttgttcctgtcgattattctgatgcttcctccggttttgataattctaccaataagggaatcataattgtgaagctacgacgtgggcaggagttaaggttaagagcaatagcacggaaaggaattgctaaagatcatgcgaaatggtctcctgcagcaactgtgactttcatgtatgaaccagatatctacatcaatgaggacatgatggagaccttgactctcgaagagaaaagagaattagtagacagtagtcccacagaagtctttggcattgatcctgaaaacaaggttattgtagttgatcctgaggcatacacttacgatgatgaggtgcttaagaaatgtgaagccatgggaaaacctggacttatagagatacatgccagggaagatagttttattttcactgttgagacaactggggcagttaaagcttcacaattggtactcaatgcaatagaagtgctgaagcagaaattggatgcagtacgcctttcagatgacactgtggaagcagatgatcagtttggagagttgggtgcacatatgcgcggagggtaaaacctcgttggtcaatttgaacttcctcgcttgttaaaactgttgaaagtgttgatgtttaatatgtcttgtaaggacaagaaatccatgaactacttaacccatcttccctttagggacttaccttggctggttatgaaaatgtaggagactgcttttgtttgttgaaagtaaatggttttttcccctcatcttgtactgatagaatttgttggatatcacatctcaatggatcatcaattcctagctatgtattgaccaaatactgactacatgtgcttgcttgggcactgtgtccgctgaggggtcgtttggtagggtgtataagaataatactccctccagttcacaataagtgatcagtttactttttcattttggttcaaaataagtgttcagttatgtaataaaaaaatattctaatt

SEQ ID NO: 1679 - DNA, 1426 bp, Prunus mume
acaaaaagccccaaaaccctctccacagccactccaaaccccttctctctctctctcagagaccgttaagctctgagacggtgctgtgagaaactcggacagacatagagaaatggaaggcaaatcgtaccagaggctaccacgggtcaaaatccgtgaaatgcgtgacgactacatgaagttcgagctccgcgacaccgacgccagcgtcgccaacgctctccggcgagtgatgatcgccgaggtccccaccgtcgccatcgacctcgtcgagatcgagatcaactcgtccgtgcttaacgacgagttcatagcccacagactcggcctcatcccattgacatccgcccgagccatgagcatgcgcttctcacgtgactgcgacgcctgcgacggcgacggccagtgcgagttctgctccgtcgagtttcatcttcgcgccaagtgccattccgaccaaaccctagacgtcactagcaaggaccttctcagctctgaccacaccgtcgtccccgtcgatttctccgattccgccggcatggaatcttccgaacaaaaagggattatcattgtgaagttgcgaagggggcaagagctgaggctaagggccattgccagaaaagggattggcaaagatcatgccaagtggtcacctgcagccactgtcactttcatgtatgaacccgatatttgaatcaatgaggagttgatggatatgttgactcttgatgagaagaaggcttgggttgaaagtagtcctaccaaagtctttgactttgatcctaaaaccgagaaggtcgtggtggttgatcctgaagcatacacctatgatgatgaagtgatcaagaaagcagaagctatggggaagcctgggcttgtggatatcattgcaaaagaagatagttttattttcacagtggaatctactggtgcggtcaaagcttctcagttgttactcaatgccatcgaagtcctgaaacagaaactggatgcagtgcgcctttctgaggatactgtagaagctgatgatcagtttggtgaattaggtgctcatatgcgaggaggatgatccaattaggtgctaaacggatctttcatagatttcgatgggacatgtttatatgctgcgcttgctgtctttactaatttcactctactgtggatgctaatctattatctgctatgcatgtctttggatatatgccagaccattcgcatctgtgtttgttgtcggagtcgtcgtcgtaatagacaatgcttaactctagtgtagctttcattttatatttaccctttgttgtagaatctccacgtatattctgtgtgaaaacttgaagcatgaattcaaaatttaaagaaacttgggtgctgggatgaaagataatactggaaatgatttgacgtttggaatttggtagaaatatct

SEQ ID NO: 1680 - DNA, 1306 bp, Solanum phureja
cgtaaatgagaaggatcaatatataagtcgagtactctatacaaatttcacactgaacaaagcagagagcaaaaccctcaaacacaaagcaagcaacaatggagggcgtctcctaccagagattcccaaagataaaaatccgtgaagttaaagacgatttcatgaaattcgagctccgagaaaccgacgccagtatagctaacgctctccggcgtataatgatagctgaagtacctactatagccatagacctagttgaaatcgaggtcaattcctctgttctcaacgatgagttcatttctcatcgtttagggcttgttccgctaacaagtgaacgagcgatgagcatgcgcttctcacgtgactgtgatgcttgtgatggtgatggacaatgtgagtactgttcggttgagttttatctacgggtgaaatgtcttagtgaccagacgcttgatgttactagcaaggatttgttgagttctgaccatacggttgttcctgttgattactcggatacttcctcgagttttgataatactcctaacaagggaatcataattgtgaagctacgacgtggacaggagttaaggttaagagctatagcacggaaaggaattggcaaagatcacgcaaaatggtcacctgcagcaactgtgactttcatgtatgaaccagagatctacatcaatgaggacatgatggaatctttgactctcgaggagaaaacagaattagttgagagtagtcccacaaaagtctttggcattgatcctgagaacaaacaggttattgtcgttgatcctgaggcatatacttatgatgatgaggtgctcaagaaagctgaagccatggggaaacctggagttgtagagatacatgccaaggaagatagttttattttcactgttgagacaactggcgcagtcaaagcttcacaattggtgctcaatgcaatagaagtgctgaagcagaagttggatgcagtacgcctttcagatgacaccgtggaagcagacgatcagtttggagagctgggcgctcatatgcgtggaggttaaaaaccgcgaaaactgttcatgtttaatatatctcctgtaacaagacatccttgaactacttacccattttccctttagaaacttacctcaactgatcatggaaacgtagggcactgtttctgtttcgtttaagtacatgtttttgtccatcatcttgtactgatactgaactttcgttgaatttcatctcgcaattgatcatcactccccgtttatggattttgttttgagttgagagtctatcaaaa

SEQ ID NO: 1681 - DNA, 1283 bp, Nicotiana tabacum
  misc_feature (679)..(679): n is a, c, g, or t
  misc_feature (681)..(681): n is a, c, g, or t
  misc_feature (714)..(714): n is a, c, g, or t
  misc_feature (753)..(753): n is a, c, g, or t
  misc_feature (760)..(760): n is a, c, g, or t
  misc_feature (1100)..(1100): n is a, c, g, or t
  misc_feature (1129)..(1129): n is a, c, g, or t
  misc_feature (1168)..(1168): n is a, c, g, or t
  misc_feature (1190)..(1190): n is a, c, g, or t
tacctcagtactatttcacttccaaaaccctcccaccaaaaacacaaagcagaagcaacaatggagggcgtctcgtaccagagattcccaaggatcaaaatccgtgaagttaaagacgactacatgaaattcgagctgcgcgacaccgacgccagcatagccaacgcgcttcggcgcgtgatgatagcagaagtcccaactatcgccattgacctcgttgaaatcgaggtcaattcctcggtcctcaacgacgagttcatatctcatcgtctgggtctcatcccgctcactagcgagcgcgcaatgagcatgcgtttctcccgtgactgtgacgcgtgtgacggtgacggacagtgcgagtattgttccgttgagttttacctccgtgtcaagtgccttagtgaccagacgctcgatgttactagcaaagatttgttgagttcggatcatactgttgttcctgtcgattattccgatgcttcctccggttttgataattctaccaataagggaatcataattgtgaaactacgacgtgggcaggagttaaggttaagagcaatagcacggaaaggaattgctaaagatcatgcgaaatggtctcctgcagcaactgtgactttcatgtatgaaccagatatctacatcaatgaggacatgatggagaccttgactctcnangagaaaagagaattagtagacagtagtcccacnaaagtctttggcattgatcctgaaaacaaggttattgtngttgatnctgaggcatacacttacgatgatgaggtgcttaagaaatgtgaagccatgggaaaacctggacttatagagatacatgccaaggaagatagttttattttcactgttgaaacgactggcgcagttaaagcttcacaattggtactcaatgcaatagaagtgctgaagcagaaattggatgcagtacgcctttcagatgacaccgtggaagcagatgatcagtttggagagttgggtgcacatatgcgcggagggtaaaacctcattggtcaatttgaacttcctcacttgttaaaactgttgaaagtgttgatgtttaatatatgtcttgtaaggacaanaaatccatgaactacttaacccattttcnctttaggacttaactggtgatggaaatgtaggagactgnttttgtttgttgaaagtaaatngttttttcccatcatcttgtactgatggaatgttgttggatatcaaaaaaaaaagcgccgctgagggtacctgtcctctccaatgaaatgact

SEQ ID NO: 1682 - DNA, 1066 bp, Ambrosia trifida
caaaaccacaacaatggaaacagcaacctaccaacgtttcccaaaggtcaaaatccgtgaactaaaagacgactacgtgaaattcgagctcaaacaaaccgacgccagcatggctaacgctctccgtcgagtaatgatcgcagaggtccccacaatcgcaatcgacctagtggagatcgaagtcaactcatcagtactcaacgacgagtttattgcccatcgattgggtcttattccgttgactagtgagcgtgcaatgagcatgcggttctcacgtgactgtgacgcgtgtgatggggatgggcagtgtgagttttgctcagttgagtttcatttgagagctaagtgtattggggatcagactttggatgttactagtaaggatttgtatagttcggatcatacggttgttccggttgatttttcggactccggtgctgggtttgagaatgctgaggatcagaggggcatcaccattgtgaaacttcgcaaagggcaagaactgaggctaagggcaatagcaagaaagggaattggaaaagatcacgcaaaatggtcgcctgctgcaactgtcactttcatgtatgagcccgagattcacatcaatgaagaaatgatggagactttgtcgcttgaagagaaaacaagcgtagttgagagcagcccaaccaaagtctttgccttaaatccccatactcagcaggtggaagtggtggatcccgaggcatacacgtatgatgatgaagtgctgaagaaagtggaagctatggggaagcctgggctcattgaaatctatgcaaaagaagacagttttatcttcacagttgaatctactggtgcaatcaaagcttctcagctggtgattaatgccattgatgttctgaaacagaagctggatgcggttcgcctgttggaggacacagttgaagctgatgaccagttcggggagttgggcgctcatatgcgaggaggttgaccatttgacctttaactttttctttagtatctctgaatgtcaatctagtgtcagtttctttggtatggaaactgggttatgttattttaa

SEQ ID NO: 1683 - DNA, 1131 bp, Arnica chamissonis
acaacagagagaacgaaaatggaaggagcatcgtaccagaggttccccaaggtcaaaattcgtgagctcaaggacgactacgtcaaattcgagctccgagaaaccgacgccagtatggctaacgcactccgccgcgtcatgatcgcagaggttccgaccatcgccatcgaccttgttgaaatcgaggtaaactcttccgttctcaatgacgagttcatcgcacatcgtcttggccttatacctctcacaagtgagcgtgccatgagcatgcgcttctcacgtgactgcgatgcctgtgacggtgacggccagtgcgagttctgctctgttgagtttcatctgagagctaagtgtataaatgatcaaacacttgatgttacgagtaaagatctttatagctctgaccacactgttgtgcctgttgagttctctgattctggcgctggctatgaaaatcctgaagatcagaggggtatcacaattgtgaaacttcgcaaaggccaagaactgagactaagagcaatagctagaaaggggattggaaaagatcatgcaaaatggtcacctgctgcaactgtgactttcatgtatgagcctgagattcacatcaatgaagaaatgatggagactttatcacttgaagagaaaacaagtgtagttgagagcagccctactaaagtgtttgccttaaatccccaaactcatcaggtggaggtggtggatcccgaggcatacacatatgatgatgaggtgctgaagaaagtggaagccatggggaaaccaggacttgttgaagtctatgcaaaagaagacagttttatcttcacggttgaatcgactggtgcagtcaaagcttctcagttggtgattaatgccattgatgtcctgaaacagaagctggatgcagttcgcctgttagaggataccgtagaagcagatgaccagtttggggaattaggtgctcatatgcgaggaggttaacttaactttacctttatgatgtctgaaacgtcatggaaaactgggtttttgttcttgttttatcaaattgtagggtgtcttatttctttcactttcgctatattcgaaaactaagaatgatccttagataactgttggtgttgcaacaac

SEQ ID NO: 1684 - DNA, 1249 bp, Platanus occidentalis
gtatggggagtataaaaacggtaggtaaataaaccctagaacctcatagccaattagacgaaaatcccataaaccctaaccctcaatctctgtctgtgagggggagagtgagcgagcgaccgaccgagatggagggggcatcttaccagagatttcccaaggtgaagataagggagatgaaggatgactacctcaagttcgagcttcgggagacggatgttagcatggcgaatgctcttcgccgtgtgatgctggcagaggtccccaccatcgccatcgacctggtcgaaattgaggccaactcgtcggtgcttaatgatgagttcatcgcccaccgactgggtctcatccctctcaccagtgaccgtgccatgggcatgcggttctcccgtgactgcgatgcctgtgacggtgatggccaatgtgagttctgctctgttgaattccacctccatgtccgctgtgactccgatcagacccttgacgtcaccagccatgacctcttgagctctgatccctccgttgtccctgttgatgtcgcgcagcgctctggctccgccggttacgaaggttctgagcagcggggaataataattgtgaaactacgacgtgggcaagaattgagactgagagcaatagctcgcaaagggattgggaaagaccatgcaaaatggtctcctggtgcgaccgttacttttatgtatgaaccagatattcatattaatgaagatttgatggaaacattgacacttgatgagaaaagagactggattgaaagtagccctacaaaagtttttggcattgatcctaatacgcaacaggtcatagtggtcgaccccgaggcatacacttacgatgaagaagtgatcaagaaagcagaagccatggggaagccaggactggtagaaatctatgctaaagaggacaattttatttttacagttgaatcgactggtgccatcaaagcttctcagctggtcatcaatgcaatagaaatccttaagcaaaagctggatgcggttcgcctgtctggtgatactgaagaagctgatgatcagtttggagaactaggtgcgcacatgcgaggaggatgaacagtttggtgaactggggcttcttcactcagttttttgagcacgttatactatctaaatgtaaaacataaagccttcttagggtaaaaactaaacggaaagcctagttatttaggattattataggtctagatggcttctatgtttgactgcta

SEQ ID NO: 1685 - DNA, 1272 bp, Solanum lycopersicum
ataagttgagtacttgttacaaatttcacttttagcagagcagagagcaaaaccctcaatactcaaagcaagcaacaatggagggcgtttcgtaccagagattcccaaagataaaaatacgtgaagttaaagacgatttcatgaaattcgagctccgggacaccgacgccagtatagctaacgctctccggcgtataatgatagctgaagtacctactatagctatagacctagttgaaatcgaggtcaattcctctgttctcaacgatgagttcatttctcatcgtttagggcttgtgccgctaacaagtgaacgagcgatgagtatgcgtttctcacgtgactgtgatgcttgtgatggtgatggacaatgtgagtactgttcggttgagttttatctacgggtgaaatgtcttagtgaccagacgcttgatgttactagcaaggatttgttgagttctgaccatacggttgttcctgttgattactccgatgcttcctcgagttttgataatactcctaataagggaatcataattgtgaagctacgacgtggacaggagttaaggttaagagctatagcacggaaaggaattggcaaagatcacgcgaaatggtcacctgcagcaactgtgactttcatgtatgaaccagagatctacatcaatgaggacatgatggaatccttgactctcgaggagaaaacagaattagttgagagtagtcccacaaaagtctttggcattgaccccgagaacaaacaggttattgtcgttgatcctgaggcatatacttacgatgatgaggtgctcaagaaagctgaagccatgggaaaacctggagttgtagagatacatgccaaggaagatagttttattttcacagttgaaacaactggcgcagtcaaagcttcacaattggtgctcaatgcaatagaagtgcttaagcagaagttggatgcagtacgcctttcagatgacaccgttgaagcagacgatcagtttggagagctgggcgctcatatgcgtggaggttaaaaaccgcgaaaactgttcatgtttaatatatctcctgtaacaagacatccttaaactaacttacccattttccctttagcaacttacctcgactgatgatggaaacgtaggacactctttctgtttcgcttaagtacatgtttttgtccattgttttgtactgatactgcacttcctccgttggatttcatctcgcaattgatcatcaatcccccgtctatggattttgtttcga

SEQ ID NO: 1686 - DNA, 1280 bp, Aquilegia formosa
gcagagaaagaaagagagagaaagaatggaggttggaggtggagcatcgaaccaacgatttccaaagataaagattagagagatgaaagatgaatatttgaaatttgaattacgtgaaacagatgcaagtatggcaaatgcattaagacgtgtaatgatagcagaagtaccaacaatagcaattgatttagttgaaatagaagtaaattcatctgttcttaatgatgaatttatatcacatcgtcttggtttaataccacttacaagtgatagagctatgggtatgagattttcacgtgattgtgatgcttgtgatggtgatggtcaatgtgaacattgttctgttgaatttcatcttgatgttagatgtgatcaagatcaaacacttgatgttactagtgctgatcttattagtactgatccttctgttattcctgttgatgttgctgctaaatctagctcttctgcttatgatgcttctgagaacaagggcattataatcgtgaagttacgccgaggtcaagagttaaggctgagagccattgctaggaaaggaattggcaaagatcatgctaagtggtcacctgctgctactgttacattcatgtatgaacctgaaatccgcatcaatgaagaaatgatggaaagcttaagcattgatgacaagagaagctggattgagagtagccccaccaaagtttttgacattgatcctaatactcagcaggttgtggtggttgatcccgaggcatatacatatgacgaagaagtgatcaagaaggctgaagcaatgggaaaaccaggtctcattgagattgaagccaaagaggatagctttatcttcacagttgaatctactggtgccgtcaaagcttctaagctggtggtcaacgcaatagaagtccttaagcaaaagttggatgcggttcgtttatctgatgatactgtagaagctgacgatcagtttggtgaacttggagtacatatgcgaggaggatgatcactctggaggatcaatttcacatatgtgaggcattttgtctattttggagttttgttgtaggtaacacaactataatatgcttgctaacttcatgggaacacacttgttaatggttagagatgctacttatatttcacatctagcttgtcgcactaatgattgtaaagatttactgtaactcttttggacctgggtctttggcattttatgcattgccttcttgaatgcgcactctagtgtgcatgaatgtctattaccctcagcgacacaactttat

SEQ ID NO: 1687 - DNA, 1359 bp, Phaseolus vulgaris
gtttgggttttgaaaagggtttttacatttttcagcactgtctgagagaggaagagtagacagagagaggcgatggagggtgcatcgtatgcgcgcatgccgagggtgaaaatccgcgagctgaaggatgattacgccaagttcgagctccgggacacggacgcgagtatcgcgaacgcgctgcggcgcgtgatgattgcggaggtgccgacgatcgctatcgacctggttgagatagaggtgaattcttcggtgctgaacgatgagttcatagctcacagactcggactcattccactcacgagtgagcgagccatgtccatgcgcttctcacgtgactgcgacgcgtgcgacggcgacggccagtgtgagttctgctctgtggagtttcaccttagggttaagtgtatgactgatcaaaccctcgatgtctccagtaaagatctttatagttccgacccttccgtcgttcccgtcgatttctctgaccctgcttctactgattcttccgagagtaggggggttatcattgtgaagttgaggcgaggacaagagctgaggctgagagcgatagctaggaagggaattggcaaagatcatgccaagtggtcacccgctgcaactgtcactttcatgtatgaaccagagattcatttaaatgaggacttgatggagacactgactcttgaggagaaaagagaatgggttgatagcagtcctacacgtgtgtttgaaattgatccagtaacacaacaggtaatggtggttgattccgaggcatactcatatgatgatgaggtgattaagaaagcagaagccatgggaaagcctgggctagtggaaatcattgcaaggcaggatagcttcatattcacagttgaatctactggagcaattaaatcttctcaattagtactaaatgccatagaaattctgaagcagaagctggatgctgtgcggctatctgaagatacagtggaggctgatgatcagtttggtgagctaggtgcacatatgcgaggaggatgagtgattgattgtattacaaggatatcaaatttgtttccctgaacttgtttctttcttcttgtactcaactcaatagctgcagcatgtgttaacttgttgagttgaaaatgctaattactacccccctccaacaacaaccttgatacttatgttatctttcactcttatcattaggcagaatcatgcacacaaaagttctatcctcttctcatgtttgcttcctttattttgtttagtctcaagattgtggttagaatgctggaattggtagcctcatccaccacaatatagtgattaaacaacattcatacatcgtgatatttcagattc

SEQ ID NO: 1688 - DNA, 1412 bp, Phaseolus vulgaris
gttatccattattcaaagaggtgttatccctcgtataagaacacaaattataaatgtttgggttttgaaaagggtttttacatttttcagcactgtctgagagaggaagagtagacagagagaggcgatggagggtgcatcgtatgcgcgcatgccgagggtgaaaatccgcgagctgaaggatgattacgccaagttcgagctccgggacacggacgcgagtatcgcgaacgcgctgcggcgcgtgatgattgcggaggtgccgacgatcgctatcgacctggttgagatagaggtgaattcttcggtgctgaacgatgagttcatagctcacagactcggactcattccactcacgagtgagcgagccatgtccatgcgcttctcacgtgactgcgacgcgtgcgacggcgacggccagtgtgagttctgctctgtggagtttcaccttagggttaagtgtatgactgatcaaaccctcgatgtctccagtaaagatctttatagttccgacccttccgtcgttcccgtcgatttctctgaccctgcttctactgattcttccgagagtaggggggttatcattgtgaagttgaggcgaggacaagagctgaggctgagagcgatagctaggaagggaattggcaaagatcatgccaagtggtcacccgctgcaactgtcactttcatgtatgaaccagagattcatttaaatgaggacttgatggagacactgactcttgaggagaaaagagaatgggttgatagcagtcctacacgtgtgtttgaaattgatccagtaacacaacaggtaatggtggttgattccgaggcatactcatatgatgatgaggtgattaagaaagcagaagccatgggaaagcctgggctagtggaaatcattgcaaggcaggatagcttcatattcacagttgaatctactggagcaattaaatcttctcaattagtactaaatgccatagaaattctgaagcagaagctggatgctgtgcggctatctgaagatacagtggaggctgatgatcagtttggtgagctaggtgcacatatgcgaggaggatgagtgattgattgtattacaaggatatcaaatttgtttccctgaacttgtttctttcttcttgtactcaactcaatagctgcagcatgtgttaacttgttgagttgaaaatgctaattactacccccctccaacaacaaccttgatacttatgttatctttcactcttatcattaggcagaatcatgcacacaaaagttctatcctcttctcatgtttgcttcctttattttgtttagtctcaagattgtggttagaatgctggaattggtagcctcatccaccacaatatagtgattaaacaacattcatacatcgtgatatttcagat

SEQ ID NO: 1689 - DNA, 1382 bp, Medicago truncatula
cattggggggtttcagaaagaaaagggttttaagaacgcacatttcttctccttcattcatctttctcctcaacaatggaaggcgcgtcatacgcacgcatgccgcgcgtcaaaatccgtgaactcaaagacgactacatgaagttcgagcttcgcgacactgacgccagcgtcgccaacgcgctacggcgcgtgatgatctccgaagtcccaaccgtcgccatcgaccttgttgaaatcgaagtgaactcttccgttctcaacgacgagttcattgctcacagactcggtctcattccactcacaagcgaacgtgccatggccatgcgcttctcacgtgactgtgatgcttgtgatggtgatggacagtgtgagtattgttcagttgagtttcatcttagggttaagtgtataacggatcagacgcttgatgttagtagtaaggatcttattagctccgatcataccgttacaccggtggatgttcctggtggtgatgcttctattgaatctgatggaagggggattatcattgtgaagttgaggagaggtcaggagctgaggttgagagcgattgctaggaaggggatcgggaaggatcatgccaaatggtcaccagctgcaactgttactttcatgtacgaaccagacattcacatcaatgaggatttgatggagtctttgacacttgaggagaaaaaggagtgggtggatagtagtccaactcgtgtctttgatattgatcctgttacacagcaggtgatggtagttgaccctgaggcatatagttatgatgacgaggtcatcaagaaagcagaagcaatgggaaagcctgggcttatagaaataactgcaaagcaagatagcttcattttcacggttgaatctaccggagcagtgaaagcatctcaattattgctaaattccattgaaattctcaagcaaaagctggatgctgtgaggctatctgaagacaccgtagaagctgatgatcagtttggtgagctgggtgcacatatgcgaggaggatgattttgaaggatttgagacgtgtccctggaacttgttttgtgtgttgcatgtcgacagttgaaatatgtgttaactcgttgaacctaagataatttactactgtgttaggtacttgaagataaactagatctaagttacttggcttgctagaaacagtggttagcttaactctttgaatcaaatatgtgctcacacttaaagtgatgggtttattcagctcaattcagtcacgattaagttgaagctttggttattaaagtcacttgttgaaccctgtatatacaacttaaatccgtaagattttatttagttcaatcgaagcgtaaaggcaaactccagttcttggttca

SEQ ID NO: 1690 - DNA, 1356 bp, Medicago truncatula
ggggggtttcagaaagaaaagggttttaagaacgcacatttcttctccttcattcatctttctcctcaacaatggaaggcgcgtcatacgcacgcatgccgcgcgtcaaaatccgtgaactcaaagacgactacatgaagttcgagcttcgcgacactgacgccagcgtcgccaacgcgctacggcgcgtgatgatctccgaagtcccaaccgtcgccatcgaccttgttgaaatcgaagtgaactcttccgttctcaacgacgagttcattgctcacagactcggtctcattccactcacaagcgaacgtgccatggccatgcgcttctcacgtgactgtgatgcttgtgatggtgatggacagtgtgagtattgttcagttgagtttcatcttagggttaagtgtataacggatcagacgcttgatgttagtagtaaggatcttattagctccgatcataccgttacaccggtggatgttcctggtggtgatgcttctattgaatctgatggaagggggattatcattgtgaagttgaggagaggtcaggagctgaggttgagagcgattgctaggaaggggatcgggaaggatcatgccaaatggtcaccagctgcaactgttactttcatgtacgaaccagacattcacatcaatgaggatttgatggagtctttgacacttgaggagaaaaaggagtgggtggatagtagtccaactcgtgtctttgatattgatcctgttacacagcaggtgatggtagttgaccctgaggcatatagttatgatgacgaggtcatcaagaaagcagaagcaatgggaaagcctgggcttatagaaataactgcaaagcaagatagcttcattttcacggttgaatctaccggagcagtgaaagcatctcaattattgctaaattccattgaaattctcaagcaaaagctggatgctgtgaggctatctgaagacaccgtagaagctgatgatcagtttggtgagctgggtgcacatatgcgaggaggatgattttgaaggatttgagacgtgtccctggaacttgttttgtgtgttgcatgtcgacagttgaaatatgtgttaactcgttgaacctaagataatttactactgtgttaggtacttgaagataaactagatctaagttacttggcttgctagaaacagtggttagcttaactctttgaatcaaatatgtgctcacacttaaagtgatgggtttattcagctcaattcagtcacgattaagttgaagctttggttattaaagtcacttgttgaaccctgtatatacaacttaaatccgtaagattttatttagttcaatcgaagcgtaaag

SEQ ID NO: 1691 - DNA, 1331 bp, Cajanus cajan
agaggagaaaagggaacgtttggggtttcagaaagggtttttatattccttcttattcttcttccgcttcttccctcaaacagagagaggaaacaactacgatggagggtgtatcgtacgcgcgcatgcctcgggtgaaaattcgcgagctgaaggacgattacgcgaagttcgagctgcgcgatacggacgcgagtatcgcgaacgcgctgcggcgcgtgatgatcgcggaggtgccgacgatcgcgatcgacctggtggagatcgaggtaaactcttcggtgctcaacgacgagttcatagcgcacaggctcggcctcattccgctcactagcgagcgtgcaatgtccatgcgcttctcacgtgactgcgacgcctgcgacggcgacggccagtgcgagttctgctccgtcgagtttcatcttagggttaagtgtatgactgaccagacactcgatgtctccagcaaggacctctacagttccgaccattccgtcgttcccgtcgatttctctgacccttctaaccatgaatccagcgacaacaggggaattatcattgtgaagttgaggcgaggacaggagctgaggctgagggcgatagctaggaaggggattggcaaagatcatgccaaatggtcacctgctgcaactgtcactttcatgtatgaaccagagattcatataaacgaggacttgatggagacattgactcttgaagagaaaagagaatgggttgatagtagtcctactcgtgtgtttgaaattgatccagtaacacaacaggtcatggtggttgacgctgaggcatacacatatgacgatgaggtgcttaagaaggcagaagctatgggcaagccagggcttgtagaaattattgcgaggcaggatagtttcatattcacagttgaatctactggggcaattaaagcttctcaattagtactaaatgccatagaaattctcaagcagaagctggatgctgtgcggctatctgaagatacagtggaggcagatgatcagtttggtgagctaggtgcacatatgcgaggtggatgatcaagtctgcttgaaggatatcaaacttgtttccttgaacttgtttcttgcatgtcgtatttgtctgaatagttgtagcatgtgttaacttgttcagcttgagccaaatatgcaaatgattagtgttacctcttgaagatagatggtgatgcttcacatttatgttacctagcttggcggcggtggttagcatgtagtatgtttttggctaaaatatatattttatctcttatctttaaatcaaatttaattctggtcttttatcttttaaaa

SEQ ID NO: 1692 - DNA, 1199 bp, Solanum tuberosum
gaagcaaaaccctcaaacacaaagcaagcaacaatggagagcgtctcgtaccagaggttcccaaagataaaaatccgtgaagttaaagacgatttcatgaaattcgagctccgggaaaccgacgccagtattgctaacgctctccggcgtataatgatagctgaagtacctactatagctatagacctagttgaaatcgaggtcaattcctctgttctcaacgatgagttcatttctcatcgtttagggcttgttccgcttacaagtgaacgagcgatgagcatgcgcttctcacgtgactgtgatgcttgtgatggtgatggacaatgtgagtactgttcggttgagttttatctccgggtgaaatgtcttagtgaccagacgcttgatgttactagtaaggatttgttgagttctgaccatacggttgttcctgttgattactcggatacttcctccagtttcgataatactcctaataaggggatcataattgtgaagctacgacgtggacaggagttaaggttaagagctatagcacggaaaggaattggcaaagatcatgcgaaatggtcacctgcagcaactgtgactttcatgtatgaaccagagatctacatcaatgaggacatgatggaatccttgaccctcgaggagaaaacagaattagttgagagtagtcccacaaaagtctttggcattgaccctgaaaacaaacaggttattgtcgttgatcctgaggcatatacttatgatgatgaggtgctcaagaaagctgaagccatgggaaaacctggagtggtagagatacatgccaaggaagatagctttattttcactgttgagacaactggcgcagtcaaagcttcacaattggtgctcaatgcaatagaagtgctgaagcagaagttggatgcagtacgcctttcagatgacaccgtggaagcagacgatcagtttggagagctgggcgctcatatgcgtggaggttaaaacctcattggttaaaaaccgcgaaaactgttcatgtttaatatatctcctgtaacaagacatccttgaactacttacccattttccctttaggaacttacctcaactgatcatggaaacgtaggtttctgtttcgtttaagtacatgtttttgtccatcatcttgtactgatactgaactttcgttgaatttcatctcgcaattg

SEQ ID NO: 1693 - DNA, 1372 bp, Prunus persica
ctctacagccactctgtcttcttcacccaaaccccttctctctctctctctctctctctctctctctctctctctctctcggacagttaagcttggagacgttactgtgagaaactcggagagacatagagaaatggaaggcaaatcgtaccagaggctaccgcgggtcaaaatccgtgaaatgcgtgacgactacatgaagttcgagctccgcgacaccgacgccagcgtcgctaacgcgctccggcgagtgatgatcgccgaggtacccaccgtcgccatcgacctcgtcgagatcgagatcaactcgtccgtgcttaacgacgagttcatagcccacaggctcggactcatcccattgacctccgaccgagccatgagcatgcgcttctcacgtgactgcgacgcctgcgacggcgacggccagtgcgagttctgctccgtcgagtttcatcttcgcgccaagtgccattccgaccaaaccctagacgtcaccagcaaggaccttctcagctctgaccacaccgtcgtccccgtcgatttctccgattccgccggcatggaatcctctgaacaaaaagggattatcattgtgaagttgcgaagggggcaagagctgaggctaagggccattgccagaaaggggattggcaaagatcatgccaagtggtcacctgcagccactgtcactttcatgtacgaacctgatattcgaatcaatgaggagttgatggatatgttgactcttgatgagaagaaggcttgggttgaaagtagtcctaccaaagtctttgactttgatcctaaaaccgagaaggtcatggtggttgatcctgaagcatacacctatgatgatgaagtgatcaagaaagcagaagctatggggaagcctgggcttgtggatatcattgcaaaagaagatagttttattttcacagtggaatctactggtgctgtcaaagcttctcagttgttactcaatgccattgaaatcctgaaacagaaactggatgcagtgcgcctttctgaggatactgtagaagctgatgatcagtttggtgaattaggtgctcatatgcgaggaggatgatccaattggtaagcagagctcctaaatggatctttcatagatttcgatgggacaattgacttccatttacttggtgggacatgtttatgtgcctttacaaatttcactctactgtggatgctaatctattatctgctatgcatgtctttggatatatgccagaccgttcgcatctgtttgttgtcagagtcgtcgtcccatgtcgtcgcaaatgtttaagcgaaacacagacaatgctcaactctagtgtagctttcattttatatttaccctttgttgtag

SEQ ID NO: 1694 - DNA, 1391 bp, Trigonella foenum-graecum
gacaaaagggttttaagaacccacatttcttcttcacattcttctttctcctctgctcgtcaagggttagcaatggaaggcgcgtcgtacgcacgcatgccgcgcgtcaaaattcgtgaactcaaagacgattacatgaagttcgagcttcgtgacaccgacgcaagcgttgccaacgcgctccggcgcgtgatgatttccgaagtacccaccattgcaattgaccttgttgaaatcgaggtgaactcttctgtcctcaacgacgagttcatcgctcacagactcggtctcattccactcacaagcgaacgtgccatggccatgcgattctcacgtgactgtgatgcttgtgatggtgatggacagtgtgagtattgttcagttgagtttcatcttagggttaagtgtattacggatcagactctggatgtttctagtaaggatctttatagctctgatcatactgttgttccggtggatttctctggtggtggtgatgcttctactgaatctgatggcagggggattataattgtgaagttgaggagaggtcaggagctgaggctaagagcgattgctaggaaggggattggtaaggatcatgccaaatggtcgccagcagcaactgttactttcatgtacgaaccagacattcacatcaatgaggatttgatggaatctttgacactcgaggagaaaaaggagtgggtggatagtagtcctactcgtgtctttgatattgatcctgtcacacagcaggtgatggtagttgaccctgaggcgtatagttacgatgatgaggtgattaagaaagcagaagcaatgggaaagcctgggcttatagaaatcactgcgaagcaagatagcttcatattcacggttgaatctactggagcagtcaaagcatctcagttactgcagaatgccattgaaattctcaagcagaagctggatgctgtgaggctatctgaagatactgtggaggcggatgatcagtttggtgagctcggtgcacatatgcgaggaggatgattttgaaggatttgagacgtgtttccctcagaacttgttttgtcgcgttgcatgccgtttttaacccaacagttgaaatatgtggttaactcgttgaacctatgctcatttacgactgtcttaggtacttgaagataaactagttttaagttacttggcttgctagaaacagtggttagcttaactctttgaatcaaatatgcactcacttaagtgatgggtttattatactcaattcagtcacgattaagttgaagctttgggttattaaagtcacttattgaaccgtgtatatacaacttatatccgtaagattttctttatttcaatcgaagcataagagcaactccaatgcttgg

SEQ ID NO: 1695 - DNA, 1229 bp, Ipomoea nil
ggggttttagagtatttgctgagaagtgagagaggaacgaggaagacaacaatggagggtgcatcgtaccagaggttcccaaagataaaaatccgggaagtgaaggacgactacatgaagtttgagcttcgcgacaccgacgctagcgtggccaacgcgcttcggcgcgtgatgatcgccgaggtgcccaccatcgccatcgacctcgtcgaaatcgagtgcaactccaccgtcctcaacgacgagttcatcgcccaccgcctcggcctcatccccctcaccagcgagcgcgctatgagcatgcgcttctcgcgtgactgcgacgcctgcgtacggcgacggccagtgcgagtattgctccgtcgagttctacctccgcgtcaagtgcatcactgaccaaaccctagatgtcaccagcaaggacctcctcagctccgaccacaccgtcgttcccgtcgattactctgatccttcgtccggcttcggtaattccgagtctaaggggataattattgttaagctacgccgtggacaagagttgaggctcagagcaattgcacggaaaggaattggcaaggatcatgcaaagtggtcacctgcagcaactgtgacatttatgtatgagccagaaatctatatcaatgaagacatgatggacacattgacacttgaggaaaaaagaagtattgttgacagcagtcccaccaaagtgtttgacatcgaccctgttacccaacagattgttgtggttgatgctgaggcatacacctacgacgatgaggtgctcaagaaaattgcgtctatggacaaacccgggcttatagaaatccatgccaaggaagatagcttcatcttcacagtcgaatccacgggtgcaatcaaagcttctcagctcttcctcaatgcaatcgatgttttgaagcggaagttagacgcagtgcgcctgtcagaggatacggtggaagcagatgaccaatttggagagttgggtgcacacatgcgagggggttaattgcaacccgagcctgatcaactcctgtgctctgtactttgttatgacagttgaccttaacttttctatttcttatgagtgtagtatgttggatgttagactaataacttgtccttcttctctacctgtgctttagatttaatcatgaaactggtgaccaaagtgtgtttgttttgccagtgcatattcttgtttctcaaggaaatggacaaaacac

SEQ ID NO: 1696 - DNA, 1431 bp, Lupinus angustifolius
atgcatcagggttttacaaaatctgagttttttggaatagcagaaagggttgagacttgagagttgagactgagaaagagcgatggaaggtgtatcatacgcgcgcatgcccagggtcaaaatccgcgaactcaaagacgactacgccaaattcgagctccgcgacaccgacgccagcatcgccaacgcgctccggcgcgtgatgatagcagaagtacccacaatcgccatcgacctcgtggaaatcgaaacaaactcttctgtcctgaacgacgagttcctagcgcaccgtttagggcttattcctctaacaagcgagagagcaatgtcgatgcggttctcgcgtgactgcgacgcgtgtgacggtgacggacagtgcgagttttgctccgtcgagtttcatctcagagtgaagtgtatgactgatcaaacactcgatgtgacgagcaaggatctcataagttctgatcatactgttactcctgttgattttaatgactcttctctcattgaatcatctgatgttaacactaatagggggattataattgtgaagttaaggagaggacaagagctgaagctgagagcaatagctaggaagggtattggtaaagatcatgctaaatggtcgcctgcggccactgtcactttcatgtatgaaccagaaatccacattaacgaggatttgatggagtctttgacacttgaggagaaaaaagaatgggttgaaagtagtcctacccgtgtatttgacattgatccagtaactcaagaggttttggtggttgaccctgaggcatacacctatgatgatgaggtgattaagaaagcagaagcaatgggcaaacctgggcttgtagagatcaatgcaaaacaggatagtttcatattcacagttgaatctaccggcgctgttaaagcttctcagctactactgaatgccatagaaattctcaagacgaagctggatgccgtgcggctatctgaagatacagtggaggctgatgatcagttcggggagctaggtgcacatttgcgaggaggatgatcgagtcgattgaaggatttcactcttttgttttactgaacttgtttgttgcatgttgtgtttaaatgaatagctgcagcatgtgctactcattgaaccagatatgttaattgtcaaaattgtcccttagacatttatttttcaaattttaagtcaaaaagtggctacaatgtgatatatctattatccttttcttgtgtcacttgtgggagatggtaggtttatgtgtacatgtgaagcatccttgctttcattccatccggggttcagtactttagtagtcttcaaaagttaggaattagtatgcattcttagaatactagttaaatgtattggtggcagagctaatttcgttatataatgaattataagcaaatggaatt

SEQ ID NO: 1697 - DNA, 1479 bp, Lupinus angustifolius
agtacaaagttgaggttttacaaaatctctattcttcttctctaaggtttagaataactatcagagagttaacagtgagagagcgatggaaggtgtatcatacgcgcgcatgcccagagtcaaaatccgtgaactcaaagacgactacgccaaattcgagctccgcgacaccgatgccagcatcgccaacgcgctccggcgcgtgatgatcgccgaagtacccacaatcgccatcgacctggtcgaaatcgaaactaactcgtcggtgctgaacgacgagttcctagcgcaccggttagggttgattcctctgacgagtgagagagcaatgtcgatgcgattctcgcgtgactgtgacgcgtgtgatggtgatggacaatgcgagttttgttccgttgagtttcatctgagagtgaagtgtatgactgatcagacactagatgtgacgagcaaggatctcataagttctgatcatactgttactccggttgattttaatgattcttctcttattcaatcttctgatgctattactaatagggggattataattgtgaagttaaggagaggacaagagctgaagcttagagcaatagctaggaagggtattggtaaagatcatgctaaatggtcgcctgcggcaactgtcactttcatgtatgaaccagaaatccacataaacgaggatttgatggagtccctgacacttgaggagaaaaaagaatgggttgaaagtagtcctacccatgtgtttgacattgacgtcgttactcaacaggttacagtggttgaccctgaggcatatacctatgatgatgaggtgattaagaaagcagaagcaatgggcaaacctgggcttgtagaaatcaatgcaaaacaggatagcttcatattcacagtcgaatctactggtgctgttaaagcttctcagttactactaaatgccatagaaattctcaagacgaagctggatgctgtgcggctatccgaagataccgtggaggctgatgaccagtttggtgagctaggtgcgcatttgcgtgggggatgatgaagtcgatataaggaatttactcttgttttcctgaacttgtttgttgcatgctgtgtttaactgaatagctgccagcatgtgcttcctcattgaaccaaagatgctaattgtcattatgatcccttttatataaactatctttcaagtttaagccagttaaacagtgctaccatgtaatgtaatctattttctttttcttgttatgtttatgtttacacttgaagcagttatgctttcattccatcaactattaagtagataagggtagaaaagcatctttgtcatctgtggcaaagggtagaaatagaaaagcattagtgattgagactaactgcttattttcaccacttacaatgtgtttaatggtggttttatttgtgagtgcttggaatgctagaactggtggaagttgtcagttaatagaa

SEQ ID NO: 1698 - DNA, 1154 bp, Ambrosia trifida
acggaccagtatacaacgacagagacgcgggaacgacaggtttacaaaacctaagagaagagaaacaacaaaacaagagagagaacaaaccacaacaatggaaacagcaacttaccaacgtttcccaaaggtcaaaatccgcgaactaaaagacgactacgtcaaattcgagctcaaacaaaccgacgccagcatggctaacgctctccgtcgagttatgatcgcagaggtccccacaatcgccatcgacctagtggagatcgaggtcaactcatcggttttaaacgacgagtttattgcgcatcgattggggcttattccgttgactagtgaacgggcaatgagcatgcggttctcacgtgactgtgacgcgtgtgatggggatgggcagtgtgagttttgctctgttgagtttcatttgagggctaagtgtattggggaccagactttggatgtgactagtaaggatttgtatagttcggatcatacggttgttccggttgatttttcggactcgggtgcggggtttgagaatgttgaggatcagaggggcatcaccatagtgaaacttcgcaaagggcaagaactgaggctaagggccatagcaagaaaggggattggaaaagatcacgcaaaatggtcgcctgctgcaactgtcactttcatgtatgagcccgagattcacatcaatgaagaaatgatggagaccttgtcacttgaagagaaaacaagtgtagttgaaagcagcccaaccaaagtctttgccttaaatcctcacactcagcaggtggaagtggtggatcccgaggcatacgcgtatgatgatgaagtgctgaagaaagtggaagctatggggaaacccgggctcattgaaatctatgcaaaagaagatagttttatcttcacagttgagtctactggtgcaatcaaagcttctcagctggtgattaatgccattgatgtgctgaaacagaagctggatgcggttcgcctgttggaggacactgttgaagctgatgaccagttcggggagttgggtgctcatatgcgaggaggttgaccatttgaccctaactttatatttagtatctctgaatgtcgatctactgtcagtttctttggtatggaaaactgggttatgttgttttaatcag

SEQ ID NO: 1699 - DNA, 1323 bp, Malus domestica
caaaaccctccacgctcattccgtcttctgcaccaaaacccctctctcttctctctctcttctctctctccctcggacagtctgacgagtgagaatggaaggcaaatcgtaccaaaggctcccgcgcgtcaaaatccgcgaaatgcgtgacgactacgtgaagtttgagctccgcgacactgacgccagcgtcgccaacgcgcttcgccgcgtcatgattgccgaggtccccaccgtcgccatcgacctcgtcgagatcgagattaactcctccgtcctcaacgacgagttcatcgcccaccggcttggcctcatccccctcacctccgaccgcgccatgagcatgcgcttctcacgtgactgcgacgcctgcgacggcgacggccagtgcgagttctgctccgtcgagttccatctccgcgccaagtgccactccgaccaaaccctagatgtcaccagcaaggacctcctcagctccgaccacaccgtcgtccccgttgatttctctgattccgccggcttggaatcctccgaacaaaagggaattatcattgtgaagttgcgaagggggcaggaactgaggctgagggccattgccagaaaggggattggcaaagatcatgctaagtggtcaccggcagccactgtcactttcatgtatgaacccgacattcgaatcaatgaggagctgatggatactttgactctggaggagaagaaggcttgggttgatagtagtcctaccaaagtctttgacattgatcctaaaaccgacaaggtcgtggtagttgatcctgaagcatacacctatgatgatgaagtgatcaagaaagcagaagctatggggaagtctggggcttgtggatatcagtgcaagggaagatagctttatattcacagtggaatctaccggtgcgattaaagctgctcagttacttctcaatgccatagaagtcttgaaacagaagctggacgcagtgcgcctttctgaggatactgtagaagccgatgaccagtttggtgaattaggtgcacatatgcgaggaggatgatccaaatggggaaagagctctgaaattgatcctccgtagatttcaacgagataaatggcttcagtttactttgtgggacatgtttatttgctgggcttactgccaatacgaatcccccctataatgtggatgctaatttattttgtgctatgctttatccttgcattttgaagcaaaacgtgttgcggatgattgaactctagtagagctagctatatatattagcttttgttgcagtcgtcaaggttgaaccaagtattgtttttgcaaa

SEQ ID NO: 1700 - DNA, 1375 bp, Valeriana officinalis
gggattgatttgtttggtcatctttgtcaacctatatcggtttttcagttgtgtacgttggcgccgcggagttggtgaaatttaaaaagaggaggtcccgtaggagtgtaactgtgtaatccaaacttttttacttgcgccgatccgattcctgattttccatttgtaaatgtgtgcaatcgtggaatgtgtagaactcggataattcactctgaagagaaaatggaaggaaatctcttaccagcgatttcccagagtgaagatcagagaactcaaagacgactatgcgaagttcgagctcagagacacagatgcaagcatggccaacgctctccgccgagttatgatctctgaagttccgacaatcgccattgatctcgtcgaaatcgaggtcaactccagtgttctcaatgacgagtttctggctcatcgtctcggcttgattccgctcactagcgagaaagctatgtccatgcgtttctcacgtgactgcgatgcttgtgatggagatggtcagtgtgagttctgttctgttgagtttcatttgagatccaaatgcctgaatgatcaaactttggatgttaccagcaaggatctctacagctctgatcataatgttgtcccggttgattttggtgacagtggcctggatactaatactgaatccaaaggaataataattgtgaaacttcgacgtggacaagaactgaggctgagggcaatagcaagaaaaggaattggcaaagatcatgctaagtggtcacctgcggctacagtcactttcatgtatgaacctgagatccatatcaacgaagatatgatggccactctttcacttgaggatatagaaaaaatagttgaaagcagtccaactagggtttttgctattgatcctgacaccaaacagatggttgtagttgacgcagaggcgtatacatacgacgacgaagtgctgaaattcgtagaagcaatgggaatgcctgggcttatcgagatatacgcaaaagaagacagttttattttcacagtggaatcaacaggcgccataaaagcttcgaatcttgttttgaatgctattgagatcttgaaacagaagcttgatgctgttcgtctcgctgaagatgcagttgaagctgatgatcagtttggtgagttgggtgcacatatgcgtggaggttaactggttaagttagttatttctgtttgtaaccgttttaactgctgtgcgtgctaacattctacgcgttattatgttattttaggggaaagtaaacccttgtttgcctggatttttaatgatgggttttgtattgttgctagaaatatgaatgtgtagtgctagtaaccttaatactttacatgtttatttagcttg

SEQ ID NO: 1701 - DNA, 1208 bp, Tripterygium wilfordii
cgttcgcattctcttgtctcgagtagggaacgacaatggatgggggagtgtcgtaccagaggtttcccagggtgaagatccgggagatgaaggacgactacctgaagtttgaactgcgagatactgacgcgtcaatagcaaacgcgctgcgtcgcgtgatgatagctgaggtgccgacgatagccatcgacctggtcgagatcgaggtcaactcctccgtccttaacgatgagttcattgcccatcgtttgggctaattcctcttaccagtgatcgcgccatgagcatgcgcttctcccgtgactgtgacgcctgcgacggcgacggtcaatgtgagttctgctctgtcgagttccatcttcgcgccaagtgtcactctgaccaaaccctcgatgttacgagcaaagatttatacagctcagatcattcggctgtacctgtcgatttctccgatttggctggctacgagtcttctgagcagaggggaattatcattgtcaagttacgccgtgcacaagaacttaggctacgtgcaatagcaaggaaagggattggtaaagaccacgcaaaatggtctcctgcggcaacagtcaccttcatgtatgaaccagagattcatatcaacgaagagatgatgcaaaccttgacacttgaggagaaagtggccttagttgaaagcagtccaaccaaagtattgggcatggattctaatcaacaggttgtagtggttgatccggaggcatatacttatgacgatgaagtgctcaagaaagcagaatctatgggtaagccagggcttattgagattaacgctagagaagacagttttattttcacggtggaatgtactggtgctatcaaagcttcccagttgctacttaatgccatagaaatcctgaaacagaagttggatgcagttcgactatccgaggacactgttgaagctgatgatcaatttggtgagctaggtgcccatatgcgaggtggatgatgatgatgatgttgttggttaaccaagtgatcaatttaaacatttgtaagctcgtacctgctgatatgctgcaactgcacattttcctttcaaatctcatgtggatgccaatttatgacctccatgtttatgtatgcacccaagtcctaacttctgtttggaaagaaccatcaatcatttatcatgaatacattcaggggtttttgtttaggtaagg

SEQ ID NO: 1702 - DNA, 1283 bp, Fragaria vesca
gagagagagagagacagagagagagaggatggaggggaagtcataccagaggttccctcgggtcaaaatccgtgaaatgaggcacgactacctcaagttcgagctccgcgacaccgacgcgagcgtcgccaacgcgctccggcgcgtgatgatcgccgaggtccccaccgtcgccatcgacctcgtcgagatcgaaatcaactcctccgtcctcaacgacgagttcatcgcccaccgcctcggcctcatccccttgaccagcgaccgcgcaatgagcatgcgcttctcacgtgactgcgacgcttgcgacggcgacggccagtgcgagtactgctccgtcgagttccacctccgcgcccgctgccactccgaccaaaccctcgacgtcaccagcaaggagctcctcagctccgaccacaccgtcgtccccgtcgatttctccgatgcctccggttacgaagcctccgaacagaggggaattatcattgtgaagctgcgaagggggcaagaactgagactgagggctattgctagaaaagggattgggaaagatcacgctaagtggtcacctgcggctactgtcactttcatgtatgaacctgacattcgtatcaatgaggagatgatggacacattgtcactcgaggacaaggcagcttgggttgatagcagtcctaccaaagtctttgagattgatcctaatactggcaaggtcgtggtggttgatcctgaagcatacacgtatgatgatgaagtgatcaagaaagcagaagctatggggaagcctgggcttgtggacatcactgccaaagaagacagttttatattcacagtggaatctactggtgcaattaaagcttctcagctgctactcaatgccatagaaatcctgaaacagaagcttgatgctgtgcgcctttctgaggatactgttgaagccgatgatcaatttggtgagttaggtgcacatatgcgaggaggatgatctaatttttaaatgaagctcgaaaattggtcttcttgtgatgtctatgggatcaatctttactgttttgtttgtcggaaatgttcataactgcctgtactgatttcattaggttggctactaaactattttcccctaaccatgccctcagatatcttgagctccttgtgctaggatagtagtatcgatgtatggccgtgcaatcaagaattctgctaggttatataagttaatgacagacttctacttacaggatttcggaaacaattttctcacaaccatggtgccttcttcagtt

SEQ ID NO: 1703 - DNA, 1105 bp, Tabernaemontana elegans
gtcgtaccagaggtttccccgagtgaaaatccgtgaaatcaaagacgactttctgaagttcgagcttcgggatactgattccagcatagcgaacgctctgcggcgcgtgatgatagccgaggtcccgacaatcgccatcgacttggtggagattgaggttaattcgtccgtattgaacgacgagttcatcgcgcatagactcggtctcattccgctcatcagtgagcgagctatgagcatgcggttctcgcgtgactgcgatgcttgtgacggagatggccaatgcgagtattgctcggttgagtttcatctcagagccaagtgcattaacgatcaaaccctagacgtcaccagcagagaccttatcagttctgacccctctgttgtccctgttgatttctcagatttatcctccggatttgataactctgagaacagaggaattataatcgtgaagctacggcgtgggcaagaacttaagctgagagctatagccaggaaaggaattggcaaggatcatgccaaatggtcgcctgcagctactgtcactttcatgtatgagcctgatatatacatcaatgaggagatgatggacaaattgactcttgaccagaaaaggattattgttgaaagtagtcctaccaaagtgttcgatgttgatgagaaaactggacagtttgttgtggctgatgccgaggcatatacctatgatgacgaagtgcttaagaaatgtgaagccatgaataagccaggacttatagaaatacagcccaaagaagatagctttgtctttactgttgagtccactggtgccattaaagcatctcaattagttctcaatgccttagacattctgaagcagaagctggatgcagttcgcttgtctgatgacactgtcgaagctgatgatcagtttggggaattgggtgctcatatgcgaggtggctgatccaagtaacaggagaaagatatttagttttgttgcatgtaaattcttctaccatggttattacttaatgcaccagaattttactcctgactgaatcattaatgactggactatgcacgtcttatttcactagctgtaaccgattatccaagtact

SEQ ID NO: 1704 - DNA, 1209 bp, Capsicum annuum
tggacggtgtctcgtaccaacgtttcccccgtatcaaaatccgcgaagtgaaacacgactacatgaaattcgagctccgagacacagattccagcatagctaacgcacttcgtcgcataatgatagccgaagtcccaaccatagcaatcgacctcgtagaaatcgaagtgaattcttctgtattaaacgacgagtttatttcacatcgtttaggtttaataccattaacgagtgagcgtgctatgagtatgaggttttcgcgtgattgtgatgcttgtgatggtgatggacagtgcgagtattgttcggttgagttttacttgagggttaagtgtttgagtgatcagacacttgatgttactagcaaggatttgttgagttcggatcatactgttgttcctgttgattactctgatggtcttgataatgctactaataagggaatcataattgtgaagctacgacgtggacaggagttaaggttaagagctatagcaaggaaaggaattggcaaagatcacgcaaaatggtcgcctgcagcaactgtgactttcatgtatgaaccagagatctacattaatgaggacatgatggagtccttgactctcgaggagaaacaagaattagttgacagtagtcccacaaaagtctttgccattgaccctgagaacaaacaggttattgtggttgatcccgaggcatatacttagatgatgaggtgctcaagaaagctgaagccatgggaaaacctggacttgtagagatacatgccaaggaagatagttttattttcacggtcgagacaactggtgcagttaaagcttcacaattggtgctcaatgcaatagaagtgttgaagcagaagttggatgcagtacgtctttcagatgacaccgtggaagcagacgatcagtttggagagttgggtgcacatatgcgcggagggtaaaacctcgtcggttgattttgaacttcttcactgattaaaatctgctaaaatcatcgatgttaaatatatgtctggtaacaagacatccatgaactacttacccattttccctttaggacgacttatctcgactgatgatggaaatgcaggaaactgtttctgtttgttgaaaggactatgtttttgtccatcatcttgtactgatagtactaaacttttgttggattccatctcacaatggatcatcaatcccctcgtgc

SEQ ID NO: 1705 - DNA, 1106 bp, Ambrosia trifida
ttcccaaaggtcaaaatccgtgaactaaaagacgactacgtgaaattcgagctcaaacaaaccgacgccagcatggctaacgctctccgtcgagtaatgatcgcagaggtccccacaatcgcaatcgacctagtggagatcgaagtcaactcatcagtactcaacgacgagtttattgcccatcgattgggtcttattccgttaacaagtgagcgagcaatgagcatgcggttctcacgtgactgtgacgcgtgtgatggggatgggcagtgtgagtttgctcagttgagtttcatttgagagctaagtgtattggggatcagactctggatgttactagtaaggatttgtatagttcggatcatacggttgttccggttgatttttcggactccagtgctgggtttgagaatgctgaggatcagaggggcatcaccattgtgaaacttcgcaaagggcaagaactgaggctaagggcaatagcaagaaagggaattggaaaagatcacgcaaaatggtcgcctgctgcaactgtcactttcatgtatgagcccgagattcacatcaacgaagaaatgatggagactttgtcacttgaagagaaaacaagtgtagttgagagcagtccaaccaaagtctttgccttaaatccccatactcagcaggtggaagtggtggatcccgaggcatacacgtatgatgatgaagtgctgaagaaagtggaagctatgggaacccgggactcattgaaatctatgcaaaagaagacagtttatcttcacagttgaatctactggtgcaatcaaagcttctcagctggtgattaatgctattgatgttctgaaacagaagctggatgctgttcgcctgttggaggacacagttgaagctgatgaccagttcggggagttgggtgctcatatgcgaggaggttgaccatttgaccctaactttatctttagtatctttgaatgttctttggtatggaaaactggatcatgttattttaatcagattgtagggtgtttttatttcagtttttgttatgtttggaactaagaatgatccttagataacggtatcaaaatattggtgttgaactacta

SEQ ID NO: 1706 - DNA, 1051 bp, Ambrosia trifida
cccaaaggtcaaaatccgcgaactaaaagacgactacgtcaaattcgagctcaacaaaccgacgccagcatggccaacgctctccgtcgagtaatgattgcagaggtccccacaatcgcaatcgacctagtggagatcgaggtcaactcatcggttttaaacgtatgagtttattgcgcatcgattgggtcttattccgttgactagtgaacgggcaatgagcatgcgcttctcacgtgactgtgacgcgtgtgatggggatgggcagtgtgagttttgctcagttgagtttcatttgagggctaagtgtattggggaccagactttggatgtgactagtaaggatttgtatagttcggatcatacggttgttccggttgatttttcggactcgggtgcggggtttgagaatgttgaggatcagaggggcatcaccatagtgaaacttcgcaaagggcaagaactgaggctaagggccatagcaagaaagggaattggaaaagatcacgcgaaatggtcgcctgctgcaactgtcactttcatgtatgagcccgagattcacatcaatgaagaaatgatggagactttgtcgcttgaagagaaaacaagtgtagttgagagcagcccaaccaaagtctttgccttaaatccccatactcagcaggtggaagtggtggatcccgaggcatacgcgtatgatgatgaagtgctgaagaaagtggaagctatggggaaacccgggctcattgaaatctatgcaaaagaagacagttttatcttcacagttgaatctactggtgcaatcaaagcttctcagctggtgattaacgccattgatgttctgaaacagaagctggatgctgttcgcctgttggaggacactgttgaagctgatgaccagttcggggagttgggtgcgcatatgcgaggaggttgaccgtttgaccctaactttatctttagtatctctgaatgtcaatctactttcagtttctctggtacgcaaaactgggttatgttgttttaatcagattgtagggtgtttttattt

SEQ ID NO: 1707 - DNA, 1194 bp, Flaveria ramosissima
tttctaagccctagagctcgatagaaaccacagagataacaacaatggaaggagcatcataccagaggttccccaaggtcaaaatccgtgagctcaaggacgattacgtcaaattcgagctccgtgaaacggacgccagtatggctaacgccctccgtcgcgtcatgatcgccgaggttccgacaatcgccatcgacctcgttgaaatcgaggtgaactcttctgttctcaatgatgagtttatcgcacatcgtcttgggcttatacctcttacgagtgagcgtgctatgagtatgcgattctcgcgtgactgcgatgcctgtgatggtgatggccagtgtgagttttgttctgttgagtttcatttgagggctaagtgtatcagtgatcagacgcttgatgttacgagtaaggatctttatagctcggatcatactgttgtgcctgttgatttctcggattcgggcgcgggctatgagaaccctgaagatcagaggggaatcacaattgtgaaacttcgcaaggggcaagaactgaggctaagagcaatagctagaaagggtattggtaaagatcatgcaaagtggtcacctgctgcaactgtgactttcatgtatgagcctgagattcacatcaatgaagaaatgatggagactttatcacttgaagagaaaactagtgtagttgagagcagcccaaccaaagtctttgccttaaatccccacactcaccaggtggaggtggtggatcctgaggcgtacacgtacgatgatgaagtgctgaagaaagtggaagccatggggaaacctggtcttattgaaatctatgcaaaagaagacagttttatctttacagttgaatcaactggtgcaatcaaagcttctcagttggtgattaatgccattgaggtcctgaagcagaagctggatgcagttcgcctgttagaggacactgtagaagctgatgagttcgtaggtttggggaagttagggtgctcaatatgcgaggaggttcgatctttaaacttcattctttatgtatcttgaatgtcaatgtgctgtctagtttcttggatacggaaaactggctttcttatcgtttattttctactaaagtttggttagggttttcgtagtttatttgacttttgtctattatttctaaagctaagatgattcggtagcgtatggttag

SEQ ID NO: 1708 - DNA, 1279 bp, Sesamum indicum
tgtccgactcgcatacccggaaaagggtttaaatcaaaagttcaaaaccctcatagagagagagagagagagagagagaggcgagccaaaatggagggtgtttcataccagagattcccgaagatcaaaatccggacggtgagagacgatttcatgaagttcgagctaagggacacagacgccagtatcgccaacgcgctccgccgcgttatgatcgctgaagttcccaccattgctattgatttggtggaaatcgaggtgaactcgtcggtcctcaacgatgagttcatcgctcatcgtctcgggctcattccacttaccagcgagcgtgctatgtccatgcgcttctcccgagattgcgacgcctgcgacggagacggccagtgcgagtattgctccgtcgagttccatttacgagccaagtgcattaatgaccagactcttgatgttacctctaaggacctttacagctctgaccacaccgttgttccagttgatttctccgattcgtctactggatttgataacacggagaataggggaatcatcattgtgaagctgcgtcgtggtcaggagctggttttaagagccatagctcggaaaggaattggcaaagatcatgctaaatggtcacctgctgctactgttactttcatgtatgaacctgaaatctatataaatgaagagatgatggaaggcttaacccttgaggagaagaaagagtttgttgatagcagccccacaaaagtgtttgacattaatcccaatacccaccaggtttatgttcatgatgctgaagcatatacgtatgatgatgaggtgcttaagaaagctgaagcaatggggaaacctggccttgtggagatccatgccaaggaagatagtttcattttcacagttgagacaacgggcggaataaaagcttctcaattgtttttgaatgccatagatgtcctgaagcagaagttggatgctgttcgcttgtcatcagacacggtggaagctgatgaacagttcggagagttgggagcacatatgcgtggaggttgatatgtctcgtttagcagaggttgatttgttgtcccaattaacttgtcagtatgaaatcgatgacagtcctgtaagtaattcaaatttgcccagagttgaatttccttcattgtacgtggaaaactcacctgtgagtgtacaatatctcgaaggataactgtttccaccttttgtttgatggataatcaggttcggtgcctcttacattcctagtttaatgttcagtcat

SEQ ID NO: 1709 - DNA, 1185 bp, Ocimum basilicum
tgtgggggcgagaaaagggtttaatcaaaaacccttggggagcgtgtgtggaaaaatccgaaaatggagggtgcttcttaccagagattccccaaaatcaaaattcggacggtcagagatgacttcatgaagttcgagctgcgggagaccgacgccagcatcgcgaacgccctccgccgcgtgatgatcgctgaagtccccacaattgctattgatttggtggaaatcgaggtcaactcttccgtcttgaacgacgagtttatcgcccaccgccttggccttatcccgctcatcagtgaccgcgccatgtccatgcgcttctcccgcgactgcgatgcctgcgacggcgacggccagtgcgagtactgctccgtcgagttccatctacgcgccaaatgcatcaatgaccagactctcgatgttacctccaaggatctctacagctccgaccacactgttattccagtcgatttctcagattcctcgtccggaattgatagctcggatactcggggaatcatcattgtgaagcttcgtagaggtcaagaactgatcttgagagccatagcacgaaaagggattggcaaagatcatgccaaatggtcacctgctgcaactgtcacttttatgtatgaacctgagatctacatcaatgaagagctgatggaaaccttgaccctcaaggagaaacaagagtttgttgaaagcagtcccacaaaagtatttgacattaatccccataccggacaggtttttgttcatgatgccgaggcttatacatatgatgatgaagtgcttaagaaagccgaagcaatggggaaacctgggcttgtggagatccatgccaaggaagacagtttcatattcacagttgagacaactggagccataaaagcttctcagttgttactcaatgccattgagatcctgaagcagaagctggatgccgttcgcttgtcagcagacacggtggaagctgatgagcagtttggtgagttgggagcacatatgcgtgggggctgatttctctgtttgaaaggctcacaacttatccttcactttaattaactcaagtgtatgaaatctaatgcttagctctgtaattacttcatgtttctcctgactcgatcttccttttcatgttaaagattgtcatgtagtagtgtcgcaaaaactttttcttgt

SEQ ID NO: 1710 - DNA, 1217 bp, Lippia dulcis
gcgcgagcgagcgagagacaggagaatcgaaaatggagggcgtttcataccagagattcccaaagatcaaaatccggacggtgagagacgacttcatgaagttcgagctgcgcgaaaccgacgcgagcatagccaatgctctccgccgcgtgatgatcgcggaagttcccacaatcgccatcgatttggtggaaattgagtcgaattcgtcggttctgaacgatgaatttatcgcccaccgcctcggtctaattcccctgaccagccagcgtgccatggccatgcgattctcccgcgactgtgacgcctgcgacggtgacggccagtgcgagtactgttcggtcgagtttcatctgcgggcgaagtgcattagcgaccagacgcttgatgtaacctctaaggacctttacagctctgaccacactgtggttccagttgatttctccgattcatctgctggaattgataacacggagaataggggaatcattatcgtaaagctgcgtcgtggtcaggagctggttttaagagcaatagctcggaaaggaattggcaaagatcatgctaaatggtcacctgctgcaactgtcaccttcatgtatgaacctgagatttatatcaatgaagagttgatggagaccttaacccttgaggagaaaaacgagtttgttgatagcagccccacaaaagtgtttgaaattaaccaacaaacccaacaggtttatgttcatgatgctgaagcatacacatacgatgacgaggtgcttaagaaagctgaagcaatgggaaaacctggccttgtagaaatccatgccaaggaagacagtttcattttcacagtcgaaacaaccggtgcaataacagcatctcaattgtttctcaatgccatagatgtcctgaagcaaaaactggatgctgttcatttgtcatccgacactgttgaagccgacgagcagtttggagagttgggagcacatatgcgtggtggttgattactgatgttgttcatgcatatgaggtttggctttctacctttaatgaactttagagaattttaaatttaatctaagatctgtaattatttaatgcttctcctaagtcgaatttccttgttgcttacaaaatattcaagtgtaagatgcaatgtgttgtagaaattatgaactaattatggttttgttgtgaaactagctgatggttgaacttgttccaactga

SEQ ID NO: 1711 - DNA, 1278 bp, Humulus lupulus
cttacaccacctgtccgctcttcaaaatccccaaaattgagtgctagagaaatccaattcgaacccgttagggttccaccattaccaaaactatggaaggtaaatcgtaccagaggtttcccaaggtcaaaatccgagaaatgaaggacgattttctcaagttcgagctccgagacaccgacgccagcatggccaacgcactccggcgcgtgatgatcgccgaggtgcccaccatcgctatcgacctggtggagatcgaggtcaactcttctgttctcaacgacgagttcatcgcccaccgtcttggcctcatcccactcaccagtgaccgtgccatgtccatgcgcttctctcgtgattgcgatgcctgtgatggagatggccagtgtgagttctgttccgtcgagtttactcttcgcgccaggtgcgttgaagatcgaaccctagatgtcaccagtaaggacctcctcacccctgaccacaccgttgtcccagttgacttctctgaccccgctggtgacgaatccaccgagcataggggggttatcattgtgaagttacgccgtggacaagaactgaggctgagagccatagccagaaagggaattggcaaagatcatgcaaagtggtcacctgcggctactgttagttttatgtatgaaccagacattcgaatcaatgaagagttgatggaaactttaacgctggaggagaaaaaaagttaggttgaaagtagccctaccagagtgtttgagcttgatcccgaaacccatcaggtgtatgtgtttgatgctgaggcatacacttacgatgatgaagtgataaaaaaagctgaagctatggggaagcctgggcttgttgacatcactgccaaagaagatagctttatttttactgttgagacaactggtgcagttaaagcttctcagctggtgatccatgccattgaaatcctgaaacaaaagcttgatgcagtacgtctctcagaggatacagtagaagctgatgatcaatttggtgaattgggtgcacacatgcgaggaggatgatgtgatccgggtggttccaagttttgtaggtttctggaaattcagctgacacccttttgcgttgtggaactttgttcatatatatgcttcatcaactgcaatgtacttatttggccgaactcttggtatctatcattttctgcgggacataaattctctcaatgaggtttgctatctttcactttgatgtaaaaacatatgggcaatgaatgatgaatccacatatttt

SEQ ID NO: 1712 - DNA, 1183 bp, Orobanche aegyptiaca
ccctctgcggaacggagataacgagcgtaagtcgataatggagggcgcttcgtatcagagattcccaaaggtcaaaatccgtacggtgagggacgacttcatggaattcgagcttcgcgaaaccgaccccagcatcgccaacgcgctccgccgggtgatgatcgccgaggtcccgacaatcgccatcgatttggtcgaaatcgaagtgaactcttcggtcctgaacgacgagttcattgcacaccggttagggctcattcccctcgtcagcgagcgagccatggccatgcgcttctcgcgtgactgcgactcctgcgacggcgacggccagtgcgaatactgttccgtggagttccatctgcgcgccaagtgcattaacgaccagacgcttgatgtcacctctaaggaccttatcagttccgaccacaccgttgttcccgttgatttctccgattcctcctctggtgttgataacgcggagcataggggagtcattattgtgaagcttcgtcgtggtcaagagctgaatttacgagccatagctcggaaaggaattggaaaagatcatgctaaattggtcctgcagcgactgtcacttttatgtacgaacctgagatttatatcaacgaagagttgatggagaccttaacccttgatgagaaaatggatttcgttgaaagcagccccacgaaagtgtttgaaatttaatccccagtacccaacaggtttatgttcacaatgctgaggcatatgcgtacgatgatgaggtgctcaagaaagctgaggcaatggggaaaccgggcttagtcgaaatccatgcgaaagaagatagtttcattttcactgtcgagacaactggcgcagtaaaagcttctcaattgtttctaaatgccattgacattttgaagcagaaattggatgccgttcgtttgtcgtccgacactgtggaagctgatgagcagtttggagagttgggagctcatatgcgtgggggttgatcaacggttttattcggtcatgtgatattatatttgtgtacttctataagttagtatgaatcctgatctgaagtttttgtagttatttctgagattcttggagttgaatttcccctgttgcacctggaaaattagcctgtatgtgatacagtgtctgtaggaggacaagtaattctgatgcttat

SEQ ID NO: 1713 - DNA, 1350 bp, Triphysaria pusilla
gaaataaaaatataaattttgtagagcaacgtacaactcacactcatccccaacacaaactttgctgttttgtactcagaaaagggtttaatcaaaacccttcaattgggagagataaagacgggaagaaatcgaaaatggaaggcgcttcataccagagattcccaaaggtcaaaatccgggtcgtgaaagacgactttatgaagttcgaactgcgtgaaaccgacgtcagcatcgccaacgccctccgccgcattatgatcgccgaggtcccaactatcgccattgatttggtcgaaatcgaggtgaactcgtcggtcttgaacgacgaattcttagcccaccgcctcggcctcattcccctcaccagcgagcgctccatggctatgcgcttctcgcgtgactgcgatgcttgcgatggtgacggccagtgcgagtactgctccgtcgagttccatctgcgcgccaagtgcattaacgaccagacgcttgatgtcacctcgaaggatctctacagctcggaccacactgttgttcctgttgatttctctgattcctcatctgggcttgataacgcggagaataggggaatcattattgtgaagctgcgccgtggtcaggagctcaatttgcgagccatagctcggaaaggaattggcaaagatcatgctaaatggtcacctgcagcaactgtcactttcatgtacgaacctgatatttatatcaacgaagagttgatggagaccttaacccttcaggagaaaaaggacttcattgaaagcagccccactaaagtgttggagattaatcccaataccgaacaggtttatgttcacgatgctgaagcatatgcctatgacgacgagttgcccaagaaagctgatgcaatggggaaacctgggctaatcgaaatcactcccaaggaagatagcttcattttcacagttgagacaactggcgcaatgaaagcttctcaattgtttctcaacgccatagatattttgaagcagaagttggatgccgttcgtttgtcggcagacactgttgaagccgatgagcagtttggagagttgggagcacatatgcgtggcggctgaaatgtgtgctgatggctaatatgttttttattcacgcttgtggcattttgttgtccacttcagtttaacttagtatgattcctgatctatgttttgtaactatttcaagattcttggaattgattttcctttctgaacattgtattgctccacctgtacgtggttcagtgtgtagttggataactaattttgatgtttatgaaactagctgataacaggttctgggcttggagcaattacattccatccgatc

SEQ ID NO: 1714 - DNA, 1369 bp, Triphysaria pusilla
aggaataaaaatataaattttgtagagcaacgtacaactcacactcatccccaacacaaactttgctgttttgtactcagaaaagggtttaatcaaaacccttcaattgggagagataaagacgggaagaaatcgaaaatggaaggcgcttcataccagagattcccaaaggtcaaaatccgggtcgtgaaagacgactttatgaagttcgaactgcgtgaaaccgacgtcagcatcgccaacgccctccgccgcattatgatcgccgaggtcccaactatcgccattgatttggtcgaaatcgaggtgaactcgtcggtcttgaacgacgaattcttagcccaccgcctcggcctcattcccctcaccagcgagcgctccatggctatgcgcttctcgcgtgactgcgatgcctgcgacggcgacggccagtgcgagtactgctccgtcgagttccatctgcgcgccaagtgcattaacgaccagacgcttgatgtcacctcgaaggatctctacagctcggaccacactgttgttcctgttgatttctctgattcctcatctgggcttgataacgcggagaataggggaatcattattgtgaagctgcgccgtggtcaggagctcaatttgcgagccatagctcggaaaggaattggcaaagatcatgctaaatggtcacctgcagcaactgtcactttcatgtacgaacctgatatttatatcaacgaagagttgatggagaccttaacccttcaggagaaaaaggacttcattgaaagcagccccactaaagtgttggagattaatcccaataccgaacaggtttatgttcacgatgctgaagcatatgcctatgacgacgagttgcccaagaaagctgatgcaatggggaaacctgggctaatcgaaatcactcccaaggaagatagcttcattttcacagttgagacaactggcgcaatgaaagcttctcaattgtttctcaacgccatagatattttgaagcagaagttggatgccgttcgtttgtcggcagacactgttgaagccgatgagcagtttggagagttgggagcacatatgcgtggcggctgaaatgtgtgctgatggctaatatgttttttattcacgcttgtggcattttgttgtccacttcagtttaacttagtatgattcctgatctatgttttgtaactatttcaagattcttggaattgattttcctttctgaacattgtattgctccacctgtacgtggttcagtgtgtagttggataactaattttgatgtttatgaaactagctgataacaggttctgggcttggagcaattacattccatccgatcaacaaaaaaaaaaaaaaa

SEQ ID NO: 1715 - DNA, 1675 bp, Cannabis sativa
caaaacgacagctttaagtttaagtgccacgtcgtggtaatcgattgaaaggccaaaaccctttgtttgggttttaagaacccttttcacttttcagtacgacacacaccacaaaattcccaatttcagagctcggaaatctaattcgaaccccttagggttccaccattactaaaattatggaaggaaaatcgtaccagaggtttcccaaggtcaagatccgagaaatgaaggacgattacctcaagttcgagctccgagacaccgacgccagcatggccaacgcactccgtcgcataatgatcgccgaggtgcccaccattgctattgacctcgtagagattgaggtcaactcttccgttctcaacgacgagttcattgcccaccgtcttggcctcatcccactcaccagtgaccgcgccatgtccatgcgcttctcacgtgattgcgacgcctgtgatggtgatggccagtgtgagttttgctctgtcgagtttactcttcgctgcaggtgcattgaagatcgaaccctagatgttaccagtaaggacctcgtcacccctgaccacaccgttgtcccagttgacttctctgactcagctggtaacgaatccaacgagaataggggggttatcattgtaaagttacgtcgtggacaagaactgaggctaagagccatagccagaaaagggattggcaaagatcatgcaaagtggtcgcctgcggcaactgttagttttatgtatgaaccagacatcagaatcaatgaggagctgatggaaactttaacgctggaggagaaaagaagttgggttgaaagtagccccaccagagtgtttgagctcgatcctgaaacccatcaggtgtgtgtgtacgatgctgaggcgtacacttacgatgatgaagtgatcaaaaaagctgaagctatggggaaacctgggcttgttgatatcactgccaaagaagatagcttcattttcactgttgagacaactggtgcagttaaagcttctcagcttgtgattcacgccattgaaatcctgaaacaaaagcttgacgcagtacgcctctcagatgatacagtagaggctgatgatcaatttggcgaattgggtgctcacttgcgaggaggatgatatgatcccgctggttccaagttttcaattgacttttgtaggtttatgaaaattcagctgacacccttttgcgttgtggaactttgttcatagattatgcttcatcaactgcaatgtacttattctgtgcttttggtattaatcattttctgcgggacataggttttctcaatggggggctttgctatctatcactttgatgtagaaacatatgggcaatgaatgatgaatccacatattttatggcttgctgcatctaaagcctacttttatgggagtttaaatgttgcctctagatctgaacaatttcatcttcttacaattgggataactaacatgacaatcttggatgttgtttatctgggtttcttacaaaatagttctttcacaccttatccaaatccaacttgctcttttctttctttcttatttttctttttctctcttgatgggattctttgagtgcctctaccatgaaacaaatgcatgtttataaaagttctcatgcttttttcttttctacatttaaatttcgaatt

SEQ ID NO: 1716 - DNA, 1523 bp, Populus trichocarpa
attagtgctctctctctctctctctctcctcacgcacgcacacaggcaactccaaaacccacaacaatggaaagcgtctcctaccaacgcttcccaaaaatcaaaatccgagaaatgaaagatgactacttaaaattcgagctccgtgaaaccgacgcgtcaatggccaacgctcttaggcgcgtcatgatcgccgaagttccaacaatcgcaatcgacctcgttgaaatcgaagtgaactcatcggtcttaaacgacgagttcattgctcaccgactcggcctcattcctctcaccagtgagcgcgctatggggatgcgattctcgcgtgactgtgacgcttgtgatggtgacggccagtgtgagtattgctctgttgagtttcatttgagagctaagtgtataacggaccagacgcttgatgttaccagtaaggatctgtacagttcggatcatgccgttattcctgttgatttctctgatccttctgacgctaatgatcctttcgatcatacagagacgcagagggggattattattgtgaagttgcgccgtgggcaagaactgaggctgagggccatagctaggaaagggattgggaaagatcatgcgaaatggtctcctgcagcaactgtaactttcatgtatgaacctgagattcatatcaatgaagatttgatggagactttgacacttgaggaaaaattaagttggattgaaagcagtcctaccaaagtttttgatattgacaaagttacccaacaggttgtagtggttgatcctgaggcctatacttatgatgatgaagtgattaagaaagcagaagctatggggaaacggggactcattgatattcgtgccaaggaagacagtttcatatttactgtggaatctactattgagattttaaaacaaaagcttgatgctgttcgactttctgatgacactgttgaagccgatgatcagtttggtgagcttggtgttcacatgcgcggaggttgatcgagctggtaaatgccacctcatggctagactaccaatttacttcctttgcttttatgcaattctatttgctgtactaacagcatgcttgtcatgcacaaatggatgataatctgttttctgctaggttatgtacttcttgatgggacattaacatctaccagcttttttggaacttgcagtgacaagaggaccttcttaacatatatatagtttttctatttggcatgttgaaattgtatacggtaggcaaattgttggatgacaatttgctttgcacaattttttctcatttaaaacattacaggtaagcagtatgaaaaaaatctgcatgcttatcggtgatgcatcaatgcgtattgcctcatatagtatagaattgaagcaagaaggcaacatacctgatcaggttgctttgtttcatacactgttctctctgattaaaagtttaagatgttcatttgcttggattaaaaaatgttctacatgcatacgtaggatatattcaacaatgtgctagc

SEQ ID NO: 1717 - DNA, 910 bp, Camellia sinensis
gacggtaagagagagagagagagagagagagagaagatggagggagcttcgtaccagcgatttccgaaggtgaagattcgagagctgaaggacgattactgcaagttcgagctccgagacaccgacgcgagcatggccaacgctctccgccgagtcatgatcgccgaagtcccgaccatcgcaatcgaccttgtagaaattgaggtcaactcgtccgtactcaacgacgagttcatcgctcaccgcctagggctcatccccctcaccagcgaccgagccatgagcacgcgcttctccagagactgcgacgcctgcgatggcgatggacagtgcgagttctgctccgtcgagttccatttgagggccaaatgcatcaacgaccaaaccctagatgttactagcaaggacctctacagctccgaccacaccgttgttcctgtcgacttctctgattccagttctggctttgacaataccgaacagaggggaattataatagtgaaattacgacgggggcaggaactgaggttgagagccatagccagaaaaggcattggcaaagaccacgcaaaatggtctcctgcagcaactgttactttcatgtatgagccagagattcatatcaatgaagaattgatggagactttgtcacttgaggagaaaacaagttgggttgaaagcagtcctacaaaagtgtttgacattgatcctaatacccagcaggttgttgtagtcgatcctgaggcatacacgtatgatgatgaagtgatcaagaaagcagaggcaatgggtaagccaggactcgttgagatctatgccaaagaagacagttttatattcacagtggaatctactggcgcatcaaagcttctcaattgttgcttaatgcaatagaagacctcaaacaaaa

SEQ ID NO: 1718 - DNA, 1211 bp, Amsonia hubrichtii
tcctccaaaaccctcagaggtccggccgacgaacgaaaatggaaggcgtgtcgtaccacaggtttcccagagtgaaagtccgggaaatcaaagacgattttctgaagtttgagcttcgtgatactgatgccagcattgcgaacgctctgcggcgcgttatgatagccgaggtcccaacaatcgccatcgacttggtggagattgaggttaactcgtccgtgttgaacgacgagttcatcgctcacagacttggtctcattccactcaccagtgagcgggctatgagcatgcgtttctcacgtgactgcgacgcttgtgacggtgacggccaatgtgagtactgctcggttgaatttcatctcagagctaagtgcattaacgatcaaaccctagacgttaccagtagggatctcatcagctctgatccctctgttgtccccgttgattactcagattcatcttctggatttgataacaccgagaacagaggaattataattgtgaagctacggcgtgggcaagaacttaggctgagagctatagccaggaaaggaattggcaaggatcatgccaaatggtctcctgcagcgactgtcactttcatgtatgagcctgatatttacattaatgaggagatgatggatagattaaccctagaccagaaaaggagtatcgttgaaagtagtcctaccaaagtatttgatgttgatgagaaaactggacagtttgttgtggttgatgctgaggcatatacttatgacgacgaagtgctcaagaaatgtgatgccatggataagtccggactcctagaaatacaccccaaagaagatagttttatctttactgttgagtctactggtgcaattaaatcttctcagttagttctcaatgccatagacattctgaagcagaagctggatgcagttcgcttgtctgatgacactgtagaagccgatgatcagtttggggaattgggtgctcatatgcgaggtggctgaaccaagaaaaaggaaaaagatattcagtttgttgtatgtaaattctgctattatttgttgcgccaaaattctaatgctgactaagttatttatcactggactttgcatgtctcgattcacttgctataagctattgctcaaatactcttatctgacaaagcttatgagcaacccagaaccttttttggttttagcaatagagccaacctttgt

SEQ ID NO: 1719 - DNA, 1022 bp, Eschscholzia californica
ggacggaatatcgtaccagagatttccaaaggtgaaaattagggaaatgaaagacgaatacatgaagtttgagctccgagaaactgatccaagcatggctaacgctctccgtcgtgtaatgattgcagaagttcccaccattgctattgaccttgttgaaatcgaggttaactcaactgttctcaacgacgagttcattgctcaccgactcggtctcatccctctcaccagtgagcgtgctatgggtatgcgtttctcacgagattgtgacgcttgtgacggtgacggccagtgcgagtactgctccgtcgagtttcatctctccgttcgctgtgattcagatcaaaccgttgatgttaccagtgctgatctccttagctctgatccttctgttgtccctgtcgacgttgctgctcgttcaggttcttcaggctttgattccactgaaaatagggggattataattgtgaagttacgtcgtgggcaggagttgagattgagagctatagcaagaaaggggattgggaaagatcatgcaaaatggtctcctgctgcgactgtaacgttcatgtatgaaccagacattcacatcaatgaagaaatgatggaaagcttatctctggaggaaaagaaaagttgggttgaaagtagtcctaccaaagttttcgacattgatcccaatacccaacaggttgtagttgtagattcagaggcgtatacatatgatgacgaggtgatcaagaaagcagaggcaatgggaaagccagggttagtagagatctatggaagagaagatagtttcatcttcactgttgaatcaactggtgctgttaaagcttctcagattgtaatcaatgcaatagaagtcatcaagcagaagctggatgcagttcgcctctctgaagatactgaaggagctgatgagcagttggtgagctgggagcacacatgcgtggaggatgatcatattgagaagcagctgcaagtcacgggcacaaaatgcagatataaaaaaggttcgt

SEQ ID NO: 1720 - DNA, 1160 bp, Chenopodium quinoa
ctctccctcacaaaaaccctgctatcaaaaacctccgaaatccaaaaccctaacaacaatggagggaatctcctaccaacgcttcccccaaatcaaaatccgagaaatgcgagatgatttcatgaaattcgagctcaagaaaaccgattcaagcgtcgccaatgcacttcgccgcgttatgatcgccgaagttccgaccgtcgccgtcgatctcgtcgaaatcgaagttaactcctccgttctcaacgacgagttcattgctcaccgactcggcctcatccctcttgtcagcgagcgtgcaatggccatgcgcttctcccgcgactgcgacgcttgcgacggtgatgggcagtgcgagtattgctcggtggagttccatcttcgggctaagtgtattggtgatcaaacgctagatgttactagcaaggatttgctgagttctgatcacaccgttactcctgttgatttctctgaggctcctgcttctgatgatgctactgataatcgaggaatcataattgtgaagttgcgtaaaggtcaagaattgaagcttagagcaatagctagaaaaggcattggaaaagatcatgccaaatggtctcctgctgctacagtaacctttatgtatgagccagagattcttatcaatgaggatatgatggaatccttgtcacttgaacaaaagaaagagtgggttgaaagcagtcctactaaagtctttgacattgatcctaatactcaacaggtagttgtagttgatcctgaggcctatacctatgatgatgaggtgattaagaaagccgaagctatggggaagtctgggcttgtagagatttacccgaaagaggacagttttatattcacagttgagtctactggtgcagtcaaggctcctcaactattactcaatgcaattgaagtcctaaaacagaagcttgatgcagttcggctgcctgaagacaccgtggacgctgatgattttggtgaattaggtgcccacatgcgaggcggttgattagcttggtacagtttgtctaattttatatcctcgtgtatgattgagacaatcctcaacttgttcattacctactggatattaaactcggtgtaatgtaatcctaatctcaatccctaagaccctaactcccaagaagtggcct

SEQ ID NO: 1721 - DNA, 1430 bp, Chenopodium quinoa
ctctccctcacaaaaaccctgctataaaaaacctccgaagtccaaaaccctaacaacaatggagggaatctcctaccaacgcttcccccaaatcaaaatccgagaaatgcgagatgatttcatgaaattcgagctcaagaaaaccgattcaagcgtcgccaatgcacttcgccgcgttatgatcgccgaagttccgaccgtcgccgtcgatctcgtcgaaatcgaagtcaattcctccgttctcaacgacgagttcattgctcaccgcctcggcctcatccctctcgtcagcgagcgtgcgatggccatgcgcttctcccgcgactgcgacgcttgcgacggtgatggacagtgcgagtattgctcagtggagtttcatcttcgggccaagtgtattggcgatcaaaccctagatgttactagtaaggatttgctgagttctgatcacacggttactcctgttgatttctctgaggctcctgcttctgatgatgctactgataatcgaggaatcataattgtgaagctacgtaaaggtcaagagttgaagcttagagcaatagctagaaaaggcattggaaaagatcatgccaaatggtctcctgctgctacagtaacctttatgtatgagccggagattctcatcaatgaggatatgatggaatcattgtcacttgaacaaaagaaagagtgggttgaaagcagtcctactaaagtctttgacattgatcctaatactcaacaggtagttgtagttgatcctgaggcctatacctatgatgatgaggtgattaagaaagccgaagctatgggaaagtccgggcttgtagagatctacccgaaagaggacagttttatattcacagttgagtctactggtgcagtcaaggctcctcaactattactcaatgcaattgaagtcctaaaacagaagcttgatgcagttcggctgcctgaagacaccgtggacgctgatgattttggtgaattaggtgcccacatgcgaggcggttaattagcttgtgaaaagcagagtctaaagctttgacaaactgtaaaatgccgcgtcatcctgttatagcaaccatatgataaggtattaaggtgttcttgcttcttagtccctactccctactgcacattcagtgccagttatttaattatgctcctaactaccttacacttttgttggttaattgtcccttaattcagtatattttggaatgtctagttttgtttgtgttatgaatttgaaatgagttatttgtgacagctgctctaattgactcttcaacatcagcaattatactgcctgatttgagacaaattatagtactgatttgtcatctatgtagtaagctaactcttgatttcctccaagcttttgatgataaaatttggttttgtaggacaccccaaacccaactgtt

SEQ ID NO: 1722 - DNA, 1140 bp, Beta vulgaris
aaagttctaggctttgctcttcccaatatccttcatcgcttccccgaacttcttcccaaaccccagcggagggttttaggctttgctcttctctattctctctgttcactctcttcccccttccacaaaaacccaaaaacttcagtaaccctaacaatggagggagtatcataccaacgatttccgcgcataaaaatccgagaaatgagagacgactacctgaaattcgagctccgcgacaccgattcaagcgtcgctaacgctctccgtcgagttatgatcgccgaagttcctactgtcgctgttgatctcgtcgaaattgaagttaattcttcagttctcaacgacgaattcatcgctcatcgtctcggactcatccctctcaccagtgatcgtgccatgtccatgcgattttcccgtgactgtgacgcttgcgacggtgacggtcagtgcgagtattgctctgtggagtttcatcttcgtgcgaagtgtattggagatcaaaccctagatgttactagtaaggatttattgagctccgaccatactgttactcctattgatttctctgattctcctgctgctgatgatgcttccgataacagaggaatcataattgtgaaattacgtaaaggtcaagagttaaagcttagagcaatagctagaaaaggcattggaaaagatcatgccaaatggtctcctgctgcaacagtcacctttatgtatgaaccggagattcttatcaatgaagatttgatggaaaccttgacacttgaacaaaaaaaagcgtgggttgaaagcagtcctaccaaagtctttgacattgatcctaatactcaacaggtggttatagttgatccagaggcttatgcttatgatgacgaggttattaagaaagctgaagctatgggaaagccagggctcgtagagatctacccgaaggaggacagttttatcttcacagttgagtctaccggtgcagtcaaggcctatcaactagtgcttaacgccattgaaatcctgaagcaaaagctagacgcagttcgcttgcctgaagacacagtggatgctgatgattttggtgaattaggtgcccatatgcgaggtggttgattatcgtggtaaacccttggttaatta

SEQ ID NO: 1723 - DNA, 1149 bp, Vinca minor
ccctcacagaccacctccggcaactggcgaaacgaccatggacggcggcgtttcatcccaacggcaaaggtttcctcgaatcaaaatccgagaaagcaaagacgacttcatgaaattcgagcttcgcgataccgacgcgagcatagcgaacgctctccggcgtgtgatgatagcggaggttccgacaatcgccattgatttggttgaaatcgaggtgaactcgtcggttttgaacgatgagttcatagctcatcgattaggtctaattccagtcactagtagtcgagcaatgagcatgcggttctcgcgtgactgcgacgcgtgtgacggtgacggccaatgcgagtattgctcggttgagtttcatcttagagctaagtgtattaatgatcaaaccctagatgttactagtagagaccttatcagttctgatccatctgttgttccggtggatttctcagattcatctggatttgaaaatgctgagaacagaggaattataattgtgaagctaagacgtgggcaagaacttatgctaagagctatagcaaggaaaggaatcggcaaggatcatgccaaatggtctcctgcagcaactgtgacttttatgtatgagcctgatatttatatcaatgaggagatgatggaaaaattatcacttgaccagaaaaagagtattgttgaaagtagtcctaccaaagtttttgatgtcgatgacaaaactggacggtttcttgtggctgatgccgaggcatatacttacgatgacgaagtgctgaagaaatgtgaagctatgagtatgccaggactcatagaaatacatcccaaagaagatagttttatcttcactgttgagacaactggtgctgttaaggcttctcagttatttcttaatgccatagacattctgaagcagaagctggacgcagttcgcttgtccgacgatactgtggaagctgatgatcagtttggtgaattgggtgctcatatgcgaggcggctgacccaaatcacaggagaaagctatttattttgttgcatgtaaattctgatattatgcttgttgcttgatggtctgagctgattatatccatcaccggtttatgcatgtcttgtttaactagctattatcctagtactctatctgaca

SEQ ID NO: 1724 - DNA, 1073 bp, Euphorbia peplus
tcctaccagcgcttccccagagtcaaaatccgggaactcaaagacgactactgcaagttcgagctccgggacaccgatgcatcaatagccaacgcgctccggcgcgtgatgatcgccgaagtcccgacagtcgccattgacctcgtcgaaatcgaagtcaacacttccgttctcaatgacgagttcatcgcccatcgtctcggtctcatccctctcgtcagcgaccgtgccatgagcatgcgcttctcacgtgactgtgattcctgcgacggcgatggccaatgcgagtattgctccgtcgagtttcatctccgggcgaaatgtattacggatcaaaccctagatgttactagtaaggatttgattagttctgatcataccgttacgcctgtcgattttagtgattcgaccggttatgatcctgctactgaaccgagggggattactattgtgaagcttcgacgggggcaagaactgaaattgagagctattgcgagaaaagggattgggaaagatcatgctaaatggtctcctgctgcgactgtgactttcatgtatgagccggatattcatattaatgaggatatgatggagactttgtcgttggaggataagcagagttgggtggatagtagtcctactaaggtgtttgccattgatgaaaatactcaacaggttgtaacaatcgatcctgaagcatacacttatgatgaagaagtgctcaagaaggcagatgctatggggaagtcagggcttgtgtctattcaagcaaaggaagatagctttatattcactgttgaatcaactggtgctattaaatcttcacagttgctactcaatgccatagaagtcctgaaaacaaagctggatacggttcgcctttcagaagacacagtagaagctgatgagcaatttggtgagctgggtgctcatatgcgtggcgggtgatccagttaacagatagttttatcagttgagttttgttatcctctaggatagttatgatcttccatttgccattttcaaactccctttaaccacccttccccacaatgcgagatattgctatgttc

SEQ ID NO: 1725 - DNA, 1188 bp, Vinca minor
aaagacgaccatggacggccttacatcccaacgacaaaggcttcctcgaatcaaaatccgtgaactcaaagacgatttcatgaaattcgagcttcgagataccgacgcgagcatagcaaacgcgctacgacgcgtgatgatagcggaggttccgacaatcgccatagatttagtcgaaatcgaggtgaactcgtcggtgttaaacgacgaattcatagctcatcgactaggtctaattccagtcaccagtagtcgtgctatggccatgcgattctcgcgtgactgtgacgcgtgtgacggtgacggccaatgcgagtattgttcggttgagtttcatcttagagctaagtgtattaatgatcaaaccctagatgttactagtagagaccttatcagttctgatccatctgttgttccagtggatttctcagattcgtctggatttgaaaatgctgagaacagaggaattataattgtgaagctaagacgtgggcaagaacttatgctaagagctatagcaaggaaaggaatcggcaaggatcatgccaaatggtcccctgcagcaactgtgacttttatgtatgagcctgatatctatatcaatgaagagatgatggagaaattaacacccgaccagaaaaggagtattattgaaagtagtcctaccaaagttttcgatatggatgacaaaactggacggtttcttgtggctgatgccgaggcatatacttatgatgacgaagtactgaagaaatgtgaagctatgagtatgccaggactcatagaaatacatcccaaagaagatagttttatcttcactgttgagacaactggtgccgttaaggcttctcagttatttcttaatgccatagacattctcaagcagaagctggatgcagttcgcttgtccgacgacactgtggaagctgatgatcagtttggtgaattgggtgctcatatgcgaggcggctgacccaaatcactggagaaagatatttactttattgtttgtaaattctgatattacgttagttacttgattctcctgggctaatcatatccatcactggaccatgcatgtcttgcttaactctagctattagctaattatcctagtactctatctgacaaagcttttgagcaacgtaaaactgcttaacaatgcctgcatttgctgttggacgttat

SEQ ID NO: 1726 - DNA, 1270 bp, Plantago ovata
ggggaactaaaccctagagtgaggctctgaactcctgtaaacctccaacaatggaaggcggtgtttcgtaccagaggttcccgaggatcaaaatccgcaccgtgagagatgacttcatgaaattcgagctccacgacaccgatgtcagcatcgccaacgctctccggcgcgtgatgatctccgaggttccgacgattgccattgacctggtcgaaatcgaggtcaactcatccgtgctgaacgacgagttcatcgctcaccgcctcggtctcatccctctcaccagtgagcgtgccatggggatgcgcttctcccgtgactgcgacgcttgtgacggtgacggtcaatgcgagttctgttccgtcgagtttcatctccgtgccaagtgcatgggtgataccaccaccgatgtcacttccaaggaccttatcagctctgaccacactgttgttgctgtcgatttctccgattctggatacgatgctaccgaaaataagggaatcataattgtgaagctacgccggggccaagagctggtgttaagggccatagcccggaaaggaattggtaaagatcatgccaaatggtcacctgcagcaactgtcaccttcatgtatgaaccacgcattgatattaacgaagagttgatggcaaccttgtcacttgaagagaagcaggcattcatagagagcagccctacaaaagtgtttgacctcaatcctcaaggacaggtttttgttcatgatgctgaggcatatacctatgatgatgaagtgcttaagaaagctgaagcaatggggaaacctggactagtggacatccaagctaaggaagatagtttcatattcacagtcgagtccactggtgcgataaaagcttcacaattgtttctcaatgccatagaaatcctgaagcgcaagttggatgccgtccgcctgtctgcagacactgtagaagctgatgagcagtttggtgagttgggagcacatatgcgtggaggctgattgttagagttcaggaaaactgtcttttcatcatactcaactctgagacaatcgaacctatgggtatgagattcactggaatcatgtaattatctcaaacttatttctgggtgaaccttctaagtcgatgtggaaaatttgatctaggatgctgcactaatctgtagaattgcacgaatgtgcttatgagtaattgcattgctagtgtgttccaaacatgcttccaaacaagttaccagaatggtagaatttaatgttgttgtctg

SEQ ID NO: 1727 - DNA, 1280 bp, Arachis hypogaea
ggggactccgtttgctgctactatgaactctgcgtagcaaagaccacacagtgactgagtgagggtttcgttaagaagcttccagaacaatggaaggccaatcctacgcccgcatgccgcgcgtgaagatccgcgagctgagggacgactacgcgcgcttcgagctccgcgacaccgacgcctccatcgccaatgcgctccggcgcgtgatgatcgccgaggtcccaaccatcgccatcgacctcgtcgaaattgaggtgaactcgtccgtactcaacgacgagttcatcgctcaccgactcggactgatccctctcacaagcgaccgggcgatgagcatgcgcttctcacgtgactgcgacgcatgtgacggcgacggccagtgcgagttttgctccgtcgagttccaccttatggctgtttgcaggaacgatgagacgcaagatgttacgagctccgatctcatcagctctgaccacaccgttgttcctgttgattattctgaatctgctgcctccattgatgcttctgatggcataagcggcaataagaagggagggattacaattgtgaagttgcggaaaggtcaagaggtgaagctgagggcaattgctaggaaggggattggcaaagatcatgcgaagtggtcaccggctgcaactgttactttcatgtatgagccggagattcacataaatgaggatttgatggagagcttgacacttgaggagaaaaaagaatgggttgaaagtagtcctacccctgttttcgagattgatcaagtaacacaacaggttatggtggttgatgccgaggcatacacctatgatgatgaggtcatcaagaaagctgaagcaatggggaagcccggccttgtagaaatcaatgcaaaacaggatagctttatattcactgtggaaactactggagccataaaagcttctcagttgttgctaaatgccattgaaatcctgaagcagaagctggatgctgtacggctatctgaggacacagttgaggctgatgatcaatttggtgagctgggtgcacatatgcgaggaggttgatcaaaattattgttagatagcattgcaaagtttttattgttgaatatgttggtacattgtattaaccaaggatgctgattatctcaccttttgtcatgtggagatagagaactttcaactttgtgtaactttgcaaacagtggctagcttatggtaacattttttagagctattgcattctagcaaagtacaactaattagtttcttcacaat

SEQ ID NO: 1728 - DNA, 1232 bp, Arachis hypogaea
actccgtttgctgctactatgaactctgcgtagcaaagaccacacagtgactgagtgagggtttcgttaagaagcttccagaacaatggaaggccaatcctacgcccgcatgccgcgcgtgaagatccgcgagctgagggacgactacgcgcgcttcgagctccgcgacaccgacgcctccatcgccaatgcgctccggcgcgtgatgatcgccgaggtcccaaccatcgccatcgacctcgtcgaaattgaggtgaactcgtccgtactcaacgacgagttcatcgctcaccgactcggactgatccctctcacaagcgaccgggcgatgagcatgcgcttctcacgtgactgcgacgcgtgcgacggcgacggccagtgcgagttttgctccgtcgagttccaccttatggctgtttgcaggaacgatgagacgcaagatgttacgagctccgatctcatcagctctgaccacaccgttgttcctgttgattattctgaatctgctgcctccattgatgcttctgatggcataagcggcaataagaagggagggattacaattgtgaagttgcggaaaggtcaagaggtgaagctgagggcaattgctaggaaggggattggcaaagatcatgcgaagtggtcaccggctgcaactgttactttcatgtatgagccggagattcacataaatgaggatttgatggagagcttgacacttgaggagaaaaaagaatgggttgaaagtagtcctacccctgtttttgagattgatcaagtaacacaacaggttatggtggttgatgccgaggcatacacctatgatgatgaggtcatcaagaaagctgaagcaatggggaagcccggccttgtagaaatcaatgcaaaacaggatagctttatattcactgtggaaactactggagccataaaagcttctcagttgttgctaaatgccattgaaatcctgaaacagaagctggatgctgtacggctatctgaggacacagttgaggctgatgatcagtttggtgagctgggtgcacatatgcgaggaggttgatcaaaattattgttagatagcatggcaaagtttttattgttgaatatgttggtacattgtattaaccaaggatgctgattatctcaccttttgtcatgtggagatagagaactttcaactttgtgtaactttgcaaacagtggttagcttatggtaacattttttagag

SEQ ID NO: 1729 - DNA, 1199 bp, Silene vulgaris
ccaaccaccatggacggcggcttaacaacctaccaacgcttcccgcgcatcaaaatccgcgaaatgcgttccgacttcatgaaattcgagctccgcgacaccgacgcgtcagtcgcgaacgctctacgacgcgtaatgatctccgaagttccgacaatcgccattgatttagtcgaaatcgaggttaattcatccgtactaaacgacgagtttatagctcataggttagggttaattccgttaactagcgaacgagctatggcgatgagattctcgcgtgattgtgacgcgtgtgatggtgatggacaatgcgagttttgttcagtggagttttatcttagggctaaatgtgttcaagatcaaaccctagatgttactagtaaagatttgattacttctgatcatactgttactcctgtcgatttcgccgattttccttcttctgatggtgcttctgataacaagggaattataattgtgaagttacgtaaaggtcaggaattgaggctgagagcaatagctagaaagggtattgggaaagatcatgccaaatggtctcctgcagcaactgtcacttttatgtatgaaccagagattcatattaatgaagatatgatggaaagcttatcgctggaacagaaaagagagtgggttgatagcagtcctactaaagtctttgacattgatcctaattctcaacaggtggtggttgttgaccccgaggcctatacatacgacgatgaggtgctaaagaaagctgaagccatgggaaaggcaggactcgttgaaatttatccaagagaggactcgtttatattcactgttgaatcaaccggtggagtcaaggcatctcaactggtacttaatgcaattgaaattctgaagcaaaaactagacgcagttcggttggctgaagatgcagtagatgccgatgattttggagaattaggcgctcatgtgagatgatgctgattctcaactggtaaaacttgcttaaaatatcacctccaattagcaatccttaacatgtttaattcctgctggatgttcttgtttgtaaaatgcgatgctgattgtagtttcatagaagtagcgttctgtttaatttcccctaacgatcacttggcatagactactgttttttactgcatcctgtatatcttccaatgtgcatcttctgttctgactaatgcttaact

SEQ ID NO: 1730 - DNA, 1244 bp, Lotus japonicus
cttcttctcattcactctttgctccgtcgttccacagtagcagacactgagaaagaaacgatggagggtgtttcctacgcgcgcatgccgcgagtgaaaatccgagaactcaaggacgacatggcgaggttcgagcttcgcgacaccgacgccagcatcgccaacgcgctgcggcgcgtgatgatatcggaggtgccgacgatagccatcgacctggtggaaatcgaggtgaactcgtcggtgctcaacgacgagttcatcgctcacaggctcggcttgattccgctcaccagcgagcgagccatggccatgcgattctcacgtgactgcgacgcttgtgacggtgatggacagtgcgagttttgctccgtcgagtttcatcttagggttaagtgcatgactgatgagacgcttgatgttaccagcaaggatctctatagttctgatcacaccgttgtccctgttgatttctctcctgatacttcttctgattccgctgtgaacaaggggattataattgtcaagctgaggagaggacaagagctgaggctgagagcaatagctaggaagggcattggcaaagatcatgccaaatggtcgcctgcagcaactgtttccttcatgtatgaaccagaaattcacatcaatgatgatttaatggagacattgacacttaaggagaaaaaagaatgggttgaaagttgtcctacccatgtgtttgacattgatgcaaacacgcaaaaggtatatgttcatgaagctgaaaattactcgtatgatgatgaggtgattaagaaagctgaagctatgggcaagcccgggcttgtagaaatcactgcaaagcaggatagcttcatctttatagttgaaactaccggagcagttaaagcttctcaattagtgctaaatgccattgaaattctcaagcagaagctggatgctgtgcggctatctgaagatacggtggaggctgatgatcaatttggtgagctaggtgcacatatgcgaggaggatgatccagttaattagaaggatttaactttttgtttcactgaacttgtttgtgtgacatgttgtctttaactgagtagctgcaacatttgtgtactctttgagccaaagatgctaattactgttactacttgagagattgactcagattatgtcattcggctcgtctgaaaccaagggctagcatgtggtgttttttgaattgtaattacaattttatcattcctgcatc

SEQ ID NO: 1731 - DNA, 1222 bp, Silene vulgaris
tacaagctttccaacaatggagggcctcgcaacctaccaacgctttccacgcatcaaagtccgcgaaatgcgcaacgacttcatgaaattcgagctgcgtgacactgacgcgtctatggctaacgcattacgccggattatgatctccgaagttccgacaatcgccattgatcttgttgaaatcgaggttaactcgtctgtgttaaacgacgagtttatcgcacataggctaggtctcatccctctcaccagcgaacgcgccatggccatgcgattctcgcgtgactgtgacgcgtgcgatggtgatggacagtgtgagttttgttctgttgagttttatcttagggctaaatgtgttcaggatcaaaccctagatgttactagcaaggatttgattacttctgatcatactgttactcctgttgatttctccgattttccgtcttctgatggcgctactgatggcagaggaatcataattgtgaagttacgcaaaggccaggaattgaggctgagagcaatagccaggaagggtattgggaaggatcatgccaaatggtctcctgccgcgactgtcacatttatgtatgaaccagagattcatattaatgaagatatgatggaaagcttgaatcttgaacagaaaaaagagtgggtcgaaagcagtcctacgaaagtctttgacattgatcctaattctcaacaggtggtggtggttgatcctgaggcctatacgtatgatgatgaggtgattaagaaagcagaagctatgggaaaaccgggactcgttgagatttatcctagagaggactctttcatattcactgttgagtctacgggtggagtcaaggcatctcaactggtgcttaatgcaattgaaattctgaagcaaaagctggatgctgttcgcttgtctggggacgtgatggatgctgatgatttgggagacttaggtgctcatatctgaggatgatgattgatgattaactggtaactttcttaatgtgctaatctccatcaatcctaatatatgaccatggcagtataatcctaacttgtttcattcgttcgagatgttcaagtttagataatgtaatgctgatcttggtttttaagaggtggcctgcgttttcactttagctaacaatcacttggcatagacactgttattatgtgcaacatgtaaaatgtgcgatgtacatcttctaattagtcgtcttct

SEQ ID NO: 1732 - DNA, 1329 bp, Papaver somniferum
tggagggaatgtcatatcagagatttccaaagataaagataagagaaatgaaagatgaatacctgaaatttgagttaagagaaactgatgtaagtatggcaaatgcacttcgtcgtattatgatagctgaagtaccaacaatagctattgaacttgttgaaatcgaagttaattcaactgttctgaacgatgagtttttagcacatcgactcggtcttattccacttactagcgataaagctatgggtatgagattctcccgtgattgtgatgcatgtgatggtgatggtcagtgcgaatattgttctgttgagtttcatttatctgttcgttgtgaccaagatcagactcttgatgttactagtgctgatcttcttactgctgatcctaatgttattcctgttgatgttgctaatgctgctcgttctacaagctttgattctgctgaaaacaagggaattataattgtgaagctgcgtcgtgggcaggaattgagattgagagctatagctagaaaagggattgggaaagatcatgccaaatggtcacccacggctactgttacattcatgtatgaaccagacatccacatcaatgaggacatgatggcaaccttgactcttgaagagaaacaaagttgggttgaaagtagccctaccaaagtttttgatattgatcctaatacccaacaggtcatagtggttgatcctgaggcgtacacatacgatgatgaggtgatcaagaaagcagaagcgatgggaaagccagggcttgtggaaattactgggagagaagatagttttattttacagttgaatctacaggtgctgtgaaagcttcccaaattgtcttaaatgccatcgaggtccttaaacagaagcttgatgcagttagactctctgaggatactgaagaagccgacgatcaattcggggaactcggagctcatatgcgaggagggtaaagaatctctttcggtgaaggctttagtttcttctgcatattagaaacttctgttgttgaatctgactaattatgacatcacagacattccataatacctccaaagaacacttctaacattggttttgaagttgtgcccttctatgttcagaattaggtagactttggcagtgaggaactgaagggcacacatcttatccttatgaattagcggaagtagttaacagttattagtgttctcttatcgtcttttaagttgaggtggttactttggttttaatggaaaactgtgctttacagaactttttaaattgcatccatacaaatacagcaatgggtatcaacagagaatagaggacaaaaata

SEQ ID NO: 1733 - DNA, 1506 bp, Papaver somniferum
ccagggttttcatagatggagtctggaatctcataccaaagatttccaaaaatcaaaatccgaagcatgagagatgactacatgaaatttgagctacgcgacaccgatccaagcatggcgaacgctctccgccgtatcatgatctccgaagtcccaacaatagcaatcgacctagttgaaatcgaagttaactcaactgttttgaacgatgagtttatagctcatcgactgggtcttattccactcgtcagcgaccgtgccatggagatgagattctctcgtgattgtgatgcatgtgatggtgatggtcaatgtgcgtattgttctgttgagtttcagttatctgtgaggtgtgatgaagatcagacagtagatgttaccagtgctgatttaattagttctgatcttatggtcgttcctgttgatgttgcgctcgccgctgcaaggtcggaggggtttgattcggctgagaataagggaattataattgtgaagctgcgacgagggcaagagttgagattgagagccatagctcgaaaagggattgggaaagaccatgctaaatggtcacctgctgctactgtcacttacatgtatgaaccagatattcatatcaatgaggatatgatggagagcttaactcttgaagagaagcaagactgggttgaaagtagccctactaaagtttttgatatcgattctaatacccaacaggtcaaagtgtatgacgctgaagcgtacacatatgatgatgaggtgatcaaaaaggcagaagctatgggaaagcccgggcttgtggaaattacagcgagagaagatagctttatttttacggttgaatctacaggtgctgtgaaagcttctcaaattgtaatcaatgcaattgaggtccttaagcagaagctcgacgctgttcgtctctctgaagacaccgtagaagctgatgatcaattcggggaactgggagcacacatgcggggagggtggagttgtctatagattaatactttcgacggggaagatctcttagctttcttctataggttaacattgttgatgggggtagaacgtctagcttttcagtgtccgtcctgtaggcttcagttttttttgcatgtaggaaacttctcctgttgaatctaagtaaatatgatattactataaatattggaacatatctaacattagtggtttaaaattacaaccttttaagttcagaattatctagagttctgacagtagggggtgaaggacagataatcctgcaataggtgataattttggtggtctcttgcatgtaaaaatcgtagttaatggaaagatcacgttgcagttatatttggttcacaagtattttgttgatagcagctcaatttggaagatatcgtatttgttggttgttttagtgttcagttattggttgctttgctgttcttctgccatggaacatgcaaagtagtttaaagattgttcatgaaattcagtatattctgcattaaacatttg

SEQ ID NO: 1734 - DNA, 1453 bp, Brassica rapa
gacctttgaatcatttcttcttctatataaacttgctttgcgtattctctctcatcttcaaaaccgtataaagaaaaataataacaataataattcgaagaaaaagaaagaaaaaataaaaagcttcctttcttcagtttctatcaatcgattctccgcggccatgcttcttgggttcttcgtttgatacgtaaaggctctctcttttacatctcttggtgtgatccatgggcgcgaatatctcaggcgttacgccggagtttgaccggagcagtgaacccagattatccgatttgccggagaactgtgtagcgctgatcatgatgcggcttgacccgccggagatttgtcggctcgctcgtctcagcagggtcttccgtcgcgcgtcgtcagctgatttcgtgtgggagtcgaagctgcctccgagttaccgagctattgcgcggaaggtgttcgacgaaattactctgaggaagttgttgataaagaaggatctttacgcgaagctctgtaggcctaatctcttcgagggtggcacaaaggagctgtggattgataagaacactggtcgtctctgtgtattggtttcttcaaaggcgttaaggattactggaattgatgatcggagatactggagtcatatcccaaccgatgaatccaggttccactcagttgcgtatgttcaacagatatggtggttcgaagtaggaggagagtttgagatccagtttccatccggaacatacagtctcttcttccgcatccagctcgggaaaacatcaaagagacttggacggagaatctgcaactccgaccacatccacggatgggacattaaacctgttaggttccagctcgcaacttcagacaaccaacaagctgtttcgctgcgttatctgaacaacaaccctggacactggagtcactatcacgtcggagatttcaaggtggtaaatccagatgtatcaacaggagtcaagttctcgatgactcaaattgattgcactcacacgaaaggtggcttgtgcatagactctgttcttatagtacctaaagaaaatgcaagaaaggtcgttgaatcagaatagttatttttttgtgtagatatagagtgagattgttgtaaatggtgagaataatctttttttttttcatattgatctggaacttgtacacatggttgggttgtctctggttttgtctgtagttacagtggttgtaagagattaaagttattgaacttgaacatagaagaatccttttagctatgtagaaacagagtcttgttcagagtattaagtatcatataagagttatcattattactgcataggagcaacatagactcatgagactacttgaacacaacaggttcactaatgaatatgaaacacaattattatgaaggcccagcttcttcttgcttcaaggtgtctttaacttggggcgtccc

SEQ ID NO: 1735 - DNA, 1237 bp, Eutrema parvulum
gtagaagaagataatactaacaataattcaaagaataagaaaaaaaaaagcttcctttttgttatttgagtttctgtcgattgattggttaaatcctgtcatcttcatttttttgtttccctcgattctccgcggccatgaaatcgtgattcgaatttaggtttctcgtttgatacggaaaggctctctctttccattttgttgatatgggcgcgaatatctcaggtggtttgccggagtttgaccggaacggtgaaggttactcgaggaaacccagattagaggatttgccggagaactgtgtagcgttgattatgatgcggcttgatccgccggagatttgtcgacttgctcgtctcaacagggtcttccgtcgcgcatcgtcagctgatttcatatgggaatcgaagtttccttcaaattatcgagttatcgcacggaaagtgtttgatgaaattactctgaagaaattgataaagaaggatctttacgcgaagcttactcggcccaaactcttcgacggtgggacaaaggaattgtggatagataagaacacgggtcgtctttgtgtatcgatttcttcaaaggcacttaggattacaggaatcgatgaccggagatactggagtcaaatcccaaccgatgaatccaggttccagacagttgcatatgttcaacagatatggtggtttgaagtaggaggagagtttaagatccagttcccatctggaacatacagtctcttcttccgtatccagctaggtaaaacatcaaagagacttggacggagaatctgcaactctgaacacattcacggatgggacataaaacctgtgaggttccagcttgcaacttcagacaaccaacaggctgtttcactgtgttatctggacaacaaccctggaaactggagtcactatcacgtcggggatttcaaagtggaaaatccagatatattaactgaaatcaagttcttgatgactcaaatcattgcactcacacgaaaggtgggctgtgcatagactctgttcttatattacctaaagaaggtgccaaaaaggtcgttggatcagaatagttttttttgtagagatagagtgaggttgttgtaaatggtgagaagaatcttttttcagtgaaacattcacaatagtggtttctctcagatctggaacttgtacacatggttgtgttgtctctggttttgtctgtagttacaaggttgtcgtgattgtaa

SEQ ID NO: 1736 - DNA, 1356 bp, Arabidopsis thaliana
ataattgttaggctcaggagaattgaccttttgaatatttcatacggttaaaaaattcttctatatataaagttgctttgaatattttgtagtctctgtatgttcaaaaccgtttaacaataacaacaacaaaaagcttccttttttgttttttgagttttcgtcgatcgattggtttaaatcctgtcgtatcaatttgttctcgattctccgcgaccatgcaaatttagggtcttcgttttgtttgatgggcgcgaatatctcgggaggttcaccggagtttgaccggaacgatgacgtttactcgaggaaactcagattggtggatttacctgagaattgtgtagcgttgattatgacacggcttgatccacctgagatttgccggcttgctcgtctcaacaggatgttccgtcgcgcttcctcagctgatttcatttgggaatcaaagttgcctgcgaattatcgtgttattgcacacaaggtgttcgatgaaattactctgacgaaattaataaagaaagatctttatgcaaagcttagccagcctaatctcttcgacgatggcacaaaggaattgtggatagataagaacacgggtcgtctttgtttatctatttcttcaaaggcactaaggattactggaattgatgatcggagatactggagtcatatcccaactgatgaatccaggttccagtcagctgcttatgttcaacagatatggtggtttgaagtaggaggagagtttgagatccagtttccatctggaacatatagtctcttcttccgtatccagctcggtaaaacatcaaagaggcttggaaggaggatctgcaactctgaacacattcatggatgggacataaaacctgtaaggttccagctcgccacttcggacaaccaacaagctgtatcattgtgttatctgaacaacaaccctgggagctggagtcactatcacgttggagatttcaaagtgacaaatccagatgtatcaacaggaatcaaattctccatgactcaaatcgattgcactcacacgaaaggtgggctatgcatagactctgttcttatattacctaaagaatgtgcaaaagaagtcattggatcacaatagttttgtagatatagagtgagattgtttgtaaagggtgagagattatttttcagtgaaacattcactatactgtttttttttcttgatctgggctgcattctcaagatgaatctcagatctggaactgtgtacacatggttgggttgtctctagttttgtctgtagttacaaggtggtcgtgattgtaaatactacttctccattcagagattattacacttgcttgcttcttcata

SEQ ID NO: 1737 - DNA, 1244 bp, Eutrema parvulum
gtagaagaagataataataacaatggaacaaaaataaaagcagcttccttttttttttttgagttttctatcgattgattagttaaaattctggcataccaagtttcttctttctcgattctccgcggccatgcaattgagattcgagtttaaggttttcgtttgatacggaaaaggtctatccatttgtttgtgtgataatgggcgcgaatatctcaggtggtttcccggagtttgaccggaacggtgaaggttactcgaggaaacccagattggtggatttaccggagaattgtgtcgcgttgattatgatgcggcttgatccaccggagatttgccgtcttgctcgtctcaacagggtcttccgtcgcgcgtcgtcagctgatttcatatgggattcgaagttgccttcgaattatcgtgtttttgcacggaaagtgtttgatgaaattactcttaggaaactgattaagaaagatgtttatgctaagctttgccggcccaatttattcgacggtggcacaaaggaattgtggatagataagaacacaggcaaactttgtgtgtcgatttcttcaaaggcactaagaattaccggaattgatgatcggagatactggagtttgatcccaaccgatgaatccaggtttcagtcagttgcatatgttcaacaggtatggtggtttgaagtaggaggagagttcgagatccagtttccacctggaatatacagtctcttctttcgtatccagctcgggaaaacatccaagagacttggacgtagaatctgcaactctgaacacattcacggatgggacataaagcctgttaggttccagcttgcaacttcagacaaccaacaagctgtttcactctgttatgtagacaacaaccctggaacctggagtcactatcacgtcggggatttcaaagtggaaaatccagatatattaactgaaatcaagttcttgatgactcaaatcattgcactcacacgaaaggtgggctgtgcatagactctgttcttatattacctaaagaaggtgccaaaaaggtcgttggatcagaatagttttttttgtagagatagagtgaggttgttgtaaatggtgagaagaatcttttttcagtgaaacattcacaatagtggtttctctcagatctggaacttgtacacatggttgtgttgtctctggttttgtctgtagttacaaggttgtcgtgattgtaaatacatttttttg

SEQ ID NO: 1738 - DNA, 1371 bp, Arabidopsis lyrata
caggattatataattgttaggctcaggagaattgacctttgaatatttcatacggttaaaaaaattcttctatataaactgaagatgctttgaatatttgtattctctgtgtatgttcaaaaccgtataattaacaaccaaaaaaagaaagcttcctttatttgtttttttgagttttcgttgatcgattggttaattctgtcatatcaatttgttctcgattcttcgcggccatgcaaatttaatgttttcgtttgtttttggtggtgattatgggcgcgaatatctctggaggtttgacggagtttgaccgggacggtgacgtttacgcgaggaaacccggattggtggatttaccggagaattgtgtagcgttgattatgatacggcttgatccaccggagatttgtaggcttgctcgtctcaataggatgttccgtcgcgcttcgtcagctgatttcatatgggaatcaaagttgccttcgaattatcgtgttattgcacacaaggtgtttgatgaaattactctgaggaaattaattaagaaagatctttatgctaagcttagccggcctaatctcttcgaagatggcacaaaggaattgtggatagataagaacacgggtcgtctttgtttatctatttcttcaaaggcactaaggattactggaattgatgatcggagatactggagtcatatcccaaccgatgaatccaggttccagtcagttgcttatgttcaacagatatggtggtttgaagtaggaggagagtttgagatccagtttccatctggaacatacagtctcttcttccgtatccagctcggtaaaacatcgaagaggcttggaaggaggatctgcaactctgaacatattcatggatgggacataaaacctgtgaggttccagctcgccacttcagacaaccaacaagctgtttcattttgttatctgaataagaaccctgggagctggagtcactatcacgttggagatttcaaagtgacaaatccagatatatcaaccggaatcaaattctcgatgactcaaatcgattgcactcacacgaaaggtgggctatgcatagactctgttcttatattacctaaagactgtgcaaaagaagtcattggatcacaatagttttgtagatatagagtgagagattgttgtaaagggtgagagaatatttttttcagtgaaacattcactatactctgcttttttcttgatctgggatgcattctcaagatgaatctcagatctggaacttgtgtacacatagttgggttgtctctagttttgtctgtagtgattgtaagtacaagttctccattcagagattataacactttttgcttcttctttt

SEQ ID NO: 1739 - DNA, 1316 bp, Eutrema halophilum
gtagaagaagataataataacaatggaacaaaaataaaagcagcttcctttttttttttatgagttttctatcgattgattagttaaaattctggcataccaagtttcttctttctcgattctccgcggccatgcaattgagattcgagtttaaggttttcgtttgatacggaaaaggtctatccatttgtttgtgtgataatgggcgcgaatatctcaggtggtttcccggagtttgaccggaacggtgaaggttactcgaggaaacccagattggtggatttaccggagaattgtgtcgcgttgattatgatgcggcttgatccaccggagatttgccgtcttgctcgtctcaacagggtcttccgtcgcgcgtcgtcagctgatttcatatgggattcgaagttgccttcgaattatcgtgtttttgcacggaaagtgtttgatgaaattactcttaggaaactgattaagaaagatgtttatgctaagctttgccggcccaatttattcgacggtggcacaaaggaattgtggatagataagaacacaggcaaactttgtgtgtcgatttcttcaaaggcactaagaattaccggaattgatgatcggagatactggagtttgatcccaaccgatgaatccaggtttcagtcagttgcatatgttcaacaggtatggtggtttgaagtaggaggagagttcgagatccagtttccacctggaatatacagtctcttctttcgtatccagctcgggaaaacatccaagagacttggacgtagaatctgcaactctgaacacattcacggatgggacataaagcctgttaggttccagcttgcaacttcagacaaccaacaagctgtttcactctgttatgtagacaacaaccctggaacctggagtcactatcatgtcggagatttcaaagtggaagatccagatttattaacacgaatcaaattctccatgactcaaatcgattgcactcacacgaaaggtgggttatgcatagactctgttcttatattacctaaaaaatgtgcacaagaggccattggatcaaaatagtttagtagatatagtttgagatttttgttgtaaatggtgagtgaatcttctactgtgaaatattcactatactggctttttcttgatctgggctgcattctcaggatgaatctcagatctggaacttgtgtacacatggttggcttgtctctagttttgtctgtagttacaagatggtcgtgattgtaaatacaaatttttctccatgtagagattatatataatagttccttgtttttgca

SEQ ID NO: 1740 - DNA, 1315 bp, Eutrema halophilum
gtagaagaagataataataacaatggaacaaaaataaaagcagcttcctttttttttttatgagttttttatcgattgattagttaaaattctggcataccaagtttcttctttctcgattctccgcggccatgcaattgagattcgagtttaaggttttcgtttgatacggaaaaggtctatccatttgtttgtgtgataatgggcgcgaatatctcaggtggtttcccggagtttgaccggaacggtgaaggttactcgaggaaacccagattggtggatttaccggagaattgtgtcgcgttgattatgatgcggcttgatccaccggagatttgccgtcttgctcgtctcaacagggtcttccgtcgcgcgtcgtcagctgatttcatatgggattcgaagttgctttcgaattatcgtgtttttgcacggaaagtgtttgatgaaattactcttaggaaactgattaagaaagatgtttatgctaagctttgccggcccaatttattcgacggtggcacaaaggaattgtggatagataagaacacaggcaaactttgtgtgtcgatttcttcaaaggcactaagaattaccggaattgatgatcggagatactggagtttgatcccaaccgatgaatccaggtttcagtcagttgcatatgttcaacaggtatggtggtttgaagtaggaggagagttcgagatccagtttccacctggaatatacagtctcttctttcgtatccagctcgggaaaacatccaagagacttggacgtagaatctgcaactctgaacacattcacggatgggacataaagcctgttaggttccagcttgcaacttcagacaaccaacaagctgtttcactctgttatgtagacaacaaccctggaacctggagtcactatcatgtcggagatttcaaagtggaagatccagatttattaacacgaatcaaattctccatgactcaaatcgattgcactcacacgaaaggtgggttatgcatagactctgttcttatattacctaaaaaatgtgcacaagaggccattggatcaaaatagtttagtagatatagtttgagatttttgttgtaaatggtgagtgaatcttctactgtgaaatattcactatactggctttttcttgatctgggctgcattctcaggatgaatctcagatctggaacttgtgtacacatggttggcttgtctctagttttgtctgtagttacaagatggtcgtgattgtaaatacaaatttttctccatgtagagattatatataatagttccttgtttttgc

SEQ ID NO: 1741 - DNA, 2129 bp, Arabidopsis lyrata
cggagaacaaaaatcagtcttatctctaagtcataatcatgaaattgatcatcatcatcatcatcgacccaaccgcttaaacctctctctttctttctctctaatctcaaatggtactattgcattcgatgacgtcgcttcttctagtgttcttcttcctctccggcgtttctccggttatctctgacggttccgatcaccgttacaaggtcggtgatgatgttcctctttacgctaacaaagtcggtccgtttcataatcccagtgaaacatatagatactttgatcttccgttctgttcatcagctcctgttaaggagaagaaggaagctctaggggaagttcttaatggagatcggttagtcagtgcaccgtacaaacttgagtttttgggtgagaagaattctgaagttgcatgtaggaagaggttgagtagagaagatgttgctaagtttcgtgatgtgattgcgaaagactactactttcagatgtattatgatgacttgcccatctggggattcctggggaaagttttcaaggagggaaaaactgacccatctgagtataaatattatctcttcaatcatctacagtttgagattttctataataaggaccgagttattgaaattattgtgagaacagaccagaatttccttgtggacttgactgaggacaaggaagtccaagtggatttcacatatactgttcgatggaaggaaacagaaatcccattcgagaagaggatggagaaatactcactggcttcatcaatgccacatcacttggaaatccattggttctccatcattaactcatgtgtcacagttcttctcttgactggtttccttgcgacgattcttatgcgagtcttaaagaatgattttgtcaagtatgcacatgatgaagaggcagtcgatgaccaagaagagactgggtggaaactgatccatggtgatgtatttaggttccccaaacacaaatccctactggctgcagcccttggttctggcacacaattgtttacactagctgttttcatcttcatgcttgcgttagtcggtgtcttttatccctacaaccgtggagcgttgtttactgcattagtggtcatatatgcacttacttcagggattgccggttatactgctgcttctttctattgccagctagaaggaactaattgggttaggaatgttatactgactggaagccttttctgtggacctcttttgctcactttctccttccttaatactgttgcaattgcttaccaagccactgcagcattgccatttgggacaattgtggttattttccttatatgggcacttgttacttcaccattgttaatactgggaggtattgctgggaagaacagaaaatccgagtttcaagctccttgtcgtaccacaaaatatccaagagagatcccaccaatgcgttggtacaggagaacacttccgcagatggctatggctggttttttaccgttcagtgccatttacatcgagctttactacatatttgccagtgtttggggtcacagaatatacaccatctatagtattctgtctatcgtcttccttattcttgtcatagtcactgctttcatcacggttgcattgacatacttccaacttgctgctgaagaccatgagtggtggtggagatcattgctatgtggtggatcaacgggcttattcatatacgcctactgcttgtattactactatgcacggtcggatatgtcagggttcatgcagacttccttcttctttggctacatggcttgcatctgctacggattcttcctcatgctcggggcaatcggattccgtgcttcccttctctttgtccgtcacatttaccgctcaatcaagtgcgagtaaaacttggaagattattcactccctcaactactagcgatgatgaatgaggccgatggccatcgatccggtgaggttgtctatttttttttttttcagatctttcatttttagttattttcttgtgggatgatgtccttgcgactaatagtgagacagtaggtacgaaaacttcaagtttctcatagattttttcccacaaaatagtgaaagagtaatactaattctactaatacaagc

SEQ ID NO: 1742 - DNA, 2146 bp, Eutrema halophilum
ataagttatcatgatcatcgacccaaccgcttaaacctctcaaagcatctctcactctctctcatagctaaattcagaatccatggagaagccagcgtcgcgtgtgctgctgccttcgcttctactggtcctcttcatctacggcgttgctccggtgatatccgacggctccgatcaccgttacaaagtcggtgatgatgttccgctttatgctaataaagtcgggccgtttcacaatccgagtgaaacataccgatactttgatctaccattctgttcatcagctccggttaaggaaaagaaggaagctcttggggaagttctcaatggagatcggttagtcagtgcaccctacaaacttgaatttttgggtgagaagaactctgaagttgcatgcagaaagaggttgagtagagaagatgttgctaaatttcgagatgtgatcaccaaagactactactttcagatgtattatgatgacttgcccatctggggattcctgggaaaagttgtaaaggatggcaaatctgacccatccgagtataaatattatctattcaatcacctacagtttgagattttctacaataaggaccgtgttattgaaatcattgtgagaacagaccagaacttcctcgtggacttgactgaggacaaggaagtcgaagtggatttcacatacacagttcggtggaaagaaacagaaattccattcgagaagaggatggagaaatactcactggcttcctcaatgccgcatcacttggaaatccactggttctcgatcattaactcatgtgtcactgtccttctcttgactggcttccttgcaactattctcatgagagtcttgaagaatgattttgttaagtatgcacatgatgaagaggcagctgatgaccaagaggagactggctggaagttgatccatgctgatgtatttaggttcccaaaacacaaatccctgctggctgcagcccttggttctggcacacaattgtttacactggctgttttcatatttatgcttgcattggtcggtgtcttttatccctacaaccgtggggcattgtttactgcattggttgtcatatatgcactcacttcaggaatcgccggatatactgctgcttctttctattgccagctagaaggaactaattgggttaggaatcttatgctgactggaagccttttctgtggacctcttttactaactttctccttccttaatactgttgcgattgcttaccaagccactgcagcgttgccattcgggacaattgtggttattttccttatatgggcactggttacttcaccattacttatattgggaggtatcgccgggaagaatagaaaacccgagtttcaagctccttgccgtaccacaaaatatccaagagaaatcccaccattgcgctggtaccggagaacacttccgcagatggctatggctggttttttgccgttcagtgccatttacatcgaactttactacatttttgccagtgtttggggtcacagaatttacaccatctatagtattctctctatcgttttccttattctcgtcatagtcactgctttcatcacagttgcattgacttacttccaacttgcttctgaagaccatgagtggtggtggagatcattgctatgcggtggatcaacaggcttattcatatacgcctactgcttgtattactactatgcacggtcagatatgacagggtttatgcagacctccttcttctttggctatatggcttgcatctgctatggattcttcctcatgctcggggcaatcggattccgtgcttcgcttttctttgtccgtcacatttaccggtccataaagtgcgagtaaaaattgaagattacttcactctcttcaactattccactatagtgatgtagcggtggtggatgcggccgagggcaatcgatccggtgaagttgtccatttttttactgtttatgataatttttcattttctaagtttttttttgtcttttttttggtattcggttgtgaggatattgtccttgagaacgataatgagatagtaggaaaagaacacttaatgtttcacttagattttttccccaaaaaaaagtggtacaccacattgccattctcaaa

SEQ ID NO: 1743 - DNA, 2323 bp, Gossypium raimondii
attatttaacactatcaccaaataaatctctctttttctctatataacatatcttacaaaatacaagatttaaaccggtttccgatctcattcaaatccttaataaccggcgatcaaaatggatagaataagggcgtttttggtagccgtggcgattgtcaccttatgcggcgtacctcaggtcagatccaccgcttccgatcatcgttacaaagctggtgatgaagttcctctttatgctaataaagtaggtccttatcacaatcccagtgagacctaccgttacttcgattttccgttctgttcctcagctcccgtgaaggagaagaaggaagctttgggtgaagtattgaatggcgatcgactagtgagtgcgccttataaacttgagtttttgacggagaaagaggctgaaattgcttgtaaaaggaagcttacgagggatgaagtggtcaagttcagaaaagctgtctcgaaagactattacttccagatgtactacgatgaccttcccatttggggtttcttggggaaagttgaaaaggaagggaagaccgatccagctgattacaaatattacctctttaagcatctcgtttttgagatccatcataacaaggatcgtgtcattgagatcactgttcgatctgatcccaacgcccttgtggatctcactgaagatgtaccagttgatgtggattttatgtacactgttaaatggaaggaaaccaacactccttttgagaaacggatggacaagtactcgctatcttcttccttgccacaccatttggaaatccactggttctcaatcatcaactcatgtgtcaccgttttgttattgactggtttcctggccaccattcttatgcgagtcctgaagaatgatttcatcaagtatgcacatgatgaggaatcggcagatgaccaggaggagtctgggtggaagtatattcatggtgatgtgttcagataccccaagcacaagtccttgtttgccgccgcccttggttctggcacccagctcttcactcttacaagtttcatttttatccttgctctagttggggtcttttatccatataatcgaggagctcttttcactgctctggtcgtcatttatgcccttacatctggcattgctgggtacactgcagcttctttctattgccagctagaaggaacaaattgggtgagaaacttattactaaccggaagcttgttttgcggacctctttttgtcacattttgctttcttaatactgtcgcaattgcttataaagccacagcagcattgccatttggaaccattgtggtgatttttctcatatgggctctggtcacttcacctttattagtattaggaggtattgctgggaagaatagtaaggcggagtttcaagccccttgtcgcaccacaaaatatcctagagagatcccaccattgccttggtaccggaaaactattcctcagatggcaatggcaggtttcttgccattcagtgctatctatattgaactttactacatatttgccagcgtgtggggacataggatctacaccatatacagcatcctgtttattgtctttatcattctcttgattgtcactgcttttatcactgtggctttgacttattttcaacttgctgctgaagaccatgagtggtggtggaggtccttcctttgtggtgggtctaccgggctgttcatatacgcctactgtttgtattattacaatgcacggtcagacatgtcaggcttcatgcaaacttcgttcttctttgggtacatggcctgcatttgctatggcttcttcctcatgcttggggctattggcttccgtgcatctctgctctttgttcgacacatttaccgttcaatcaagtgtgagtaggaagttggatggtcttccctgttcacaagaagtaagcatacttttgctttatcagaaccagttgataggtagtttatcaaaagattctacgatgatgattacgaaaagagcagaccggaagcgcgtgggtgctttgggctgctttggcagtgttgtatgaaatatgaaccattctaaaccatagttgatgccaacaaaaactttgcattcctcacttcaccattcccattttgtttacaattattattatttttgttggagtgaaaacatgttgaatattgagatgcatacttctaggacgagcttttgttattacgcagtcattttcatgttgttagctctaaaaacaataacatatatctacattttgcaatcaattcgtcgcattttgtgttgggtcccgatttggtagtgttctaaaatttc

SEQ ID NO: 1744 - DNA, 2243 bp, Olea europaea
tgtatcttcatgtatacataattgtattgcaatataactccataactttcagtctgtgtgtgaaaaatagcagaaaaagtggaagcgaagaagatgatgggaggtggattgttcgccgtcgttttgatcgtattgtgtacctcaattcaggtgagatcggacggatcagatcacaaatacaaagtcggagatccggtgcctctttacgcgaataaagttgggccttttcataaccctagtgaaacataccgcttctttgatcttcccttctgttccccagctcatccaaaagaaaagaaggaagctcttggggaagtgttgaatggagatcgtctcgtcagtgctccttataaactagactttctgcaagataaagactctgaaattgtttgcaaaaagatattatccaaggaagaagtaggacagttccgaactgctgtcttaaaagattactatttccaaatgtattatgacgacttgccgatttggggattcttggggaaagttgagaaggaaggaaaatccgatcccagcgagtataaatattatctattcaaacatctccatttcgagatcttttacaataaagatcgagttattgagattaatgcacgaactgaccctaatgcccttgtagacctctcggaggataaggaagttgaagtagagttcatgtactcagtaaaatggaaggaaacaaatactccttttgagaagagaatggagaagtattcacagtcttcttcactacctcatcacttggaaatccattggttctcaataatcaactcatgtgtgacagttctcctcttaactggtttcctggccactattcttatgcgggtcctcaaaaatgattttgtcaagtatgctcatgatgaggagacagctgatgatcaagaggaaactgggtggaagtatattcatggcgatgtattcaggtatccaaagtacaaatctttgtttgcggctgcccttggttctggaacccagttgtttacactcacgatctttattttcatccttgcactcgttggtgtattttatccatacaaccgtggagctctgttcactgcactggttgtcatttatgctcttacatctgggattgctggctatactgcatcctctttttattgccaactagaaggaactaactgggtcagaaatttattgttgactggaagtctgttttgcggtccgctgcttcttacatttagcttccttaatactgttgccattgcttacagtgcaactgcagcattgccatttggtactattgtggtcatctttcttatatgggcccttgttacatcacctttgttagttttgggtgggatcgcagggaaaaacagcagagcagagtttcaagctcctgttcgtaccacaaaatacccacgagagatcccaccgctaccttggtatcgtggaactcttcctcagatggcaatggctggattcctgcctttcagcgccatatatattgagctttactacatatttgccagtgtgtggggccacaggatctataccatttacagtatcttatttatagtcttcatcatcctcttgattgttactgcttttattaccgtggctttgacgtacttccagcttgctgccgaagaccatgagtggtggtggaggtctttcctctgcggtggatcaactgggctattcatctatggctactgcctgtattactattatgcacgatctgatatgtcaggcttcatgcaaacctcattcttcttcggatacatggcttgcatttgctatggcttctttctcatgcttggtgcagttggttttcgtgcagcgctcttctttgtccgtcatatataccgctcgatcaagtgcgagtagtaagtcatcagctggtcagtcttccatgttctacagaatgctgcataaatatggtaaggcaatttgtgatgaaagataacgatataggacaataggacttctaaagtgggatattgtattatcttactacgtcagcgttgaatacatttggtcatttttgatttacagctcgacaatttacggagttatgctagctttagtgttttccgaattttggcttttaaatactaaatgaaatgatagaataggctcatgagaatggcgtacgtgaatataatgtttatattgtatttaaggtcgtttgcagattctgtttccattcgtccttgtcaactatgaataattatttcagtagtaatttcattattcaagctaag

SEQ ID NO: 1745 - DNA, 2320 bp, Solanum lycopersicum
ttgaggttcactcttcacaaaaagcgcgtgaagtaaaatccaactccctctcctcctccatatctatttccccatttcatttctcagggaaatcgagatctgtgctcacacccccaccccctctaaaccccctacccctaccccttcaaaattcatatatacaacattgatgtgcacaaaattcgtgaaggaaatggagaagatggcgttgtacgtcgtcgttttgctaatcatctgctatgcatcgccggcgagatcagacggttccgatcataagtataaatccggagatcaggttccactttatgctaacaaagtcggtccgttccataatccgagtgaaacataccgcttctttgaccttcctttttgtactccagatcatgtaaaagagaagaaggaagcccttggtgaggtcttgaatggtgaccgattggtcagtgccccttacaagcttgactttttgtatgataaggactcagaaatagtttgcaagaagaagttgtccaaggaagaagtttctcaattccgcagcgctgttgctaaagactactacttccaaatgtattacgatgacctgcccatttggggtttcttagggaaagttgacaaggaaggaaagtctgaccccagcgagtacaaatactacttgtttaaacatcttcattttgagatcttttacaatgatgatcgtgtgattgagatcaatgcacgaactgatcctaatgccctggtagatattacagaggataaggaggttgatgttgacttcatgtatactgtaaaatggaaagagacaaaaacaccttttgataagaggatggagaagtactcacagtcttcctcgttgccgcatcacttggaaatccattggttctcaattatcaattcctgtgtgacagttcttctcttaactggttttcttgccacaattcttatgcgggtccttaagaatgactttgtcaagtatgcacatgatgaggaggcggctgatgaccaagaagaaactgggtggaaatacatccatggtgatgtgtttaggtacccaagtcacaaatccttgatggctgcagcacttgggagtggcacacagttattcacattgaccatctttattttccttctctcacttgttggtgttttctatccatacaaccgtggagctttattcacggcactggtcgtcatatatgctctcacatctggtattgcaggctatactgctgcctctttctattgccagctagaagggacaaactgggtcaggaatttgatattgaccggagccttgttttgtggacccctgtttctcacgttctgtttccttaacagcgtagcaattgcatacagtgccactgctgcactgccttttggaaccattgtggtcatctttctcatatgggctcttgtgacatcacctttacttgtattgggagggatagctggaaagaacagcagggctgagttccaagctccttgtcgaaccaccaaatacccaagagagatcccaccattaccttggtaccgcggaactctacctcagatggcaatggctgggtttttgcctttcagtgccatatatatcgaactttactatatatttgcaagtgtttggggtcacagaatttacaccatatacagcatcttatttatagtcttcatcattcttataattgtcactgcttttattaccgtggccttgacatactttcaacttgctgctgaagatcatgaatggtggtggagggctttcctttgtggtggatcgactggacttttcatctatggctactgcttgtattactattatgcccgttccgatatgtctggcttcatgcaaacctcattcttctttggatacatggcttgcatctgctatggtttcttcctcatgctggggactgtgggtttccgtgcagccctattttttgtccgtcatatataccggtcaatcaagtgcgagtaggaagctggtacgacggtcgtacagaatgctttacagatgtggtagggcaatgtggtatcccagaagaccttgtaggatctcttgagaatgatgaagcatgtattatcttacaccggaaagttaagaactttttgccatttttcatttacatctcagcaatttatatcgattaataggggtatattagagtttctgttccatattgcaacacaattatcctaatcttgtctagtattattcctttttactgcattggacaaactttgagctataaattgtactggtcccaagttccagaagattgtatcaaaaatgtgtcattcatttattttatgttctaaatctcgctttcaa

SEQ ID NO: 1746 - DNA, 2121 bp, Olea europaea
atctgccctctcactctctctgctcattatctctctatatctacatgtatgcatttgcgtgtattactaaataaattcatatcttttcagtcagtgtatgtgtgaaaaaagtcgcagaaacaatggaagcgaagaagatgatggaaggtggattgtacgccgtcgttttgatcctattgtgcacctcaattcaggtgagatcggacggatcagaccataaatacaaagtcggagatccggtgcctctttacgcgaataaagttggaccttttcataaccctagtgaaacataccgcttctttgatcttcctttctgttcaccagctcatccgaaagagaagaaggaagctcttggggaagtgttgaatggagatcgtctcgtcagtgctccttataaacttgactttttgctagataaagactctgaaattgtctgcaagaagaagttgtcaaaggaagaagcagcgcagttccgcagtgctgtctcaaaagattactatttccaaatgtattatgacgatttgcccatctggggtttcttggggaaagttgagaaggaaggaaaatctgaccccagcgagtataaatattatctattcaaacatatccatttcgagatcttttacaataaagatcgagttattgagattaatgcacgaactgaccctaatgcccttgtagacctctctgaggataaggacgttgaagtagagttcatgtactcggtaaaatggaaagaaactaatactccttttgagaagagaatggagaagtattcacagtcttcttcactgcctcatcacttggaaatccattggttctcaataatcaactcctgtgtgacagttctcctcctaactggtttcctggctactattcttatgcgagtccttaaaaatgattttgtcaagtacactcatgatgaggagacagctgatgatcaagaggaaactgggtggaaatacatccatggtgatgtattcaggtatccgaagtacaaatctttgtttgcggcagcccttggttctggaactcagttgtttaccctcacgatctttattttcatccttgcactggttggtgtattttatccatacaatcgtggagctttgttcaccgcactggttgtcatttatgcccttacatctgggattgctggctatactgcatcatctttttattgccagctagaaggaactaattgggtcagaaatttattgttgactggaggtctattttgcggtccgctgcttcttacattttgcttccttaatacggttgccattgcttacagtgcaactgctgcactgccatttggtactattgtggtcatctttctcatatgggctcttgttacatcacctttgttagtcttgggtgggattgcaggaaaaaatagcaaagcagagtttcaggctcctgttcgtaccacaaaatacccacgagagatcccaccactaccttggtatcgtggaactctgcctcagatggcaatggctggattcttgcctttcagtgctatatatattgaactttactacatatttgccagtgtgtggggccacagaatctataccatttacagtattttatttatagtcttcattatcctcttgattgttactgcttttattactgtggcattgacgtacttccagcttgccgccgaagaccatgagtggtggtggaggtctttcctttgcggtggatccactgggctatttatatatggctactgcctgtattactattatgcacgatctgatatgtccggcttcatgcaaacctcgttcttctttggatacatggcttgcatttgctatggtttctttctcatgcttgggacagtcggtttccgtgcagcactcttttttgttcgccatatataccggtcaatcaagtgcgagtagtaagtcggtaggtcagtcttccatgttctacagaatgctgtataaatatggtaaggcaatttgtgatgaaagaggaccacataggacaataggacttctaacgtgggatattgtactatcttcctacccccgtgttgaatacattgtcattttcatttttcagctcaacaatttactgagttatgctagctttggagttttctgaaaaaag

SEQ ID NO: 1747 - DNA, 2419 bp, Mimulus guttatus
attaaatgagatcgagatctgtgctactttctctctctaaaattcctctcctctttctaaaactgtaatatttcaggtccactgaattataaacccatttcactctgcgactctttacggtgttttgtgaaccaaaaatggcgagaggaggagagtggcgcgccgtcgttttgctgctcctttgcactgcttttccggcggcgagatccgacggatcagatcacaagtacaaagtcggcgatccggtgccgctgtatgcaaacaaggtcggcccttttcacaaccctagcgaaacataccgttactttgatctcccattttgttctccaggtgatgttaaagataaaagtgaagctcttggtgaagtgctaaatggagatcgtttggtcagtgctccatacaagcttgactttctggctgacagagagtcagaagtcatttgtaaaaagcagctgtcaaaggaagaagttgctgtgtttcgaagtgcggtagcaaaagactactattttcaaatgtactatgatgacttgcccatatggggtttcctcggaaaggttgacaaggaaggcaaagctgatcccagcgagtacaaatattacctatttaagcatctccatttcgaaatattttataacaaggatcgtgtgattgagatcaatgcacgcacagaccccagtgctcttgtagaccttactgaagataaggaagttgatgtggagttcgtgtactctgccaaatggaaagagactaatattgcttttgagaagaggatggagaagtactctcattcttcttcactacctcgccacttagagatccattggttttcaattatcaattcatgcgtgactgttctcctcctcactgggtttcttgctacgattttgatgcgtgtgctaaaaaatgattttgtcaaatatgcccatgacgaggaggcagcagatgaccaagaagaaactgggtggaaatacattcatggtgatgttttcaggttcccgaagtacaagtctttgtttgctgctgctcttggaagtggcactcagctatttaccctggcgacttttatattcttacttgctcttgttggtgtattttatccttacaaccgtggagctctttttactgcactggtggtcatatatgctcttacgtctggcattgcaggctatacagcggccgctttctattgccagttagaggggacaaattgggtccggaatttattactaactggaggcctgttctgtgggccactttttctcacattctgcttcctaaacactgttgccattgcttatcatgcaactgccgctctcccatttggtaccattgtggtgatttttctgatatgggctcttgtgacgtcacctttattagtgttgggagggattgcaggaaagaacagtaaggcagagtttcaagctcctgttcgtaccacaaaatatcctagagagattccgccgctcccttggtaccgttcaactgtgcctcagatggctatggccggcttcttgccattcagtgccatctatattgaactttactacatatttgccagtgtctggggtcacaggatttacaccatttacagtattttattcattgtcttcattatcctcctgattgtcactgcatttattactgtggcgttgacatacttccaacttgctgctgaagatcatgaatggtggtggaggtctttcctttgtggtggatcaacgggcttgttcatttacggctactgtctgtattactactatgcacggtcggatatgtcgggctttatgcagacctcattcttctttgggtacatggcttctgtgtgctatgctttcttcctaatgctcggagctgtaggtttccgtgcctctttattctttgttcgccacatataccgctcgataaagtgcgaatgagaaatgggatttgacagaagaagaatattgttgatttgtgagaatggcggtgtatcgtacgataggtaaagtggcatgacaaaggtattgaaaatggcagtattctgtaggaaaatctccactgtggaagcatttctgagcaaaagaagtagtttactgtctaaacttatatcaaataatagtgtatggttttcgttatttgctatagtttcaatttttcttttttttctaaaagattttgtatgaaaagatatgaaagaggttaacaaatttgatcagtgcattccggcgggtgttgcgtatttccagtggcgtatttgagtagaaaatgccgcttttggtaaattacggccaccctgaggtaacgtcaaattaccaaaaaacccctcacgtttgagtaattacagtcaccctcttaactatgaatcttcttatacgtccacctttatcgtgttaaattcaatataaccttttaaattacgtggaatgttctctagttcgta

SEQ ID NO: 1748 - DNA, 2343 bp, Populus trichocarpa
aaagcttctattgacacgggggcacaaccgtgacaaaccaaaggagtctccaaatttataagtctcgcttcctcgatctatctctttatgcatctgtgtctgtgagatacagttagagaaagaaaatggagaagaaactagtgccttgtttggtagtctctattttgatattttgcagtgtgacccatgttagatcagatgcatctgatcatcgttacaaagtaggagaggatgtccctctttatgtcaacaaggttggaccgtttcacaatcccagtgaaacataccgctattttgatcttcctttctgttcatcaggtccgacaaaggacaagaaggaagcccttggtgaagtgttgaatggtgatcgtctagtcactgccccatacaaacttgactttttaaatgacaaagactctgaaattgcttgcagaaagaggttgacaaaggagcaagttgctcagttccgggaagttgtttccaaggactactacttccaaatgtattatgacgacttgcccatttggggtttcttagggaaagttgacaaggaaagaaaaaatgacccaagcgaatacaaatattacctctttaaacatcttcactttaccatcttttacaacaaggatcgtgtcattgagatcactgcacaatctgatcttaacaatgttgtggacctgactgaagataaggaagttgatgtggagtttatgtactcagttaaatggaaggaaacagaaattccatttgagaaaaggatggagaagtattcgcagtcttcttcactgcctcatcacttggaaattcattggttttccattattaactcatgtgtgacagttctcctcttgactggttttcttgccacaattctcatgcgagtcctgaagaacgattttgtcaagtatgctcatgatgaggagtcagctgaagaccaagaagagactgggtggaagtacatccatggtgatgtatttagatatccaaagtataagtctttgcttgcagcagcagttggctctggcacccagctgtttaccctcacaattttcattttcgtgcttgcactagttggtgtcttttatccttataatcgtggagctctatttactgcactggttgtcatatatgctctgacagctgggattgcaggctacactgcagcctctttcttttgccaactggaaggaacaaattgggtcaggaacttgttgctaactggagccctgttttgtggtcctctgtttctcaccttttgctttcttaatactgttgcaattgcatatagtgccactgcagcattgccatttggaacaatagtggtgatatttcttatttgggctctggtaacaacaccattgctggtactgggtgggattgcagggaagaatagcaaggctgagtttcaggctcctgtccgcaccactaaatatcccagagagattcctcagttgccttggtatcggaaaacacttcctcagatggccatggcaggattcttgcctttcagtgcaatatatattgaactttactacatatttgccagtgtttggggtcacaggatctacaccatatacagcatcttgttcattgtcttcatcattctcttgattgtcactgcttttataacagtggcgttgacatatttccaacttgctgctgaagaccatgagtggtggtggaggtctttcctctgtggtggatcaactggcctgttcatttatggctattgcttgtattactactatgccagatcagatatgtccggcttcatgcaaacctcatttttctttggctacatggcctgtgtttgttacggtttcttcctcatgcttggcagtattgggttccgtgcttccttgttctttgtccgccacatctaccgttcaatcaagtgcgagtaggaagtcatatggtcttccttatgttcagagaagccacagttggctgggaaaacttgttctgggatcgcaggagctttatgctactcttggaggatgatggcacgttccatggaggacttctgtaataaccttttttttataggagaggaacatgtagggctttagaatgctgttaaagaatttgcagtgcttcaatgtgagataatccatcattttgaatgtattctatcactgttagaagccgtagagtttgtgttactggtagcagtacttcgaaaattcttgtctccacaatttattatagttgcaaaatacatgttctgtcatttattatcataggctggactagaaaacttgagtatgaggatcgtctgttttgtcttttgttctaggggaaacatggctgttcatttttctaatttcactatttttgtttcaa

SEQ ID NO: 1749 - DNA, 2233 bp, Nicotiana benthamiana
acacacacaaaaagttgtagttatataatcacatagtgatctccataaagttcgttagggaaatggagaagaagaggacgatggcgtggtacgtcgtcgttttgctgattgtcagctgtgcatcgccggtgagatcagacggttcagatcacaagtacaaagccggagatccggttcctctttatgctaacaaggtcggtcctttccataatcccagtgaaacataccggttcttcgatcttcctttttgtgctccagcccatgtgaaggagaaaaaggaagctcttggtgaggttttgaatggtgatcgattggtcagtgccccttacaagcttgactttatgtacgacaaggactcagaaatagtttgcaagaagaagttgtcaaaggaagaagttgctcaatttcgcagtgctgttgctaaagactactacttccaaatgtattatgatgacttgcccatttggggtttcttagggaaagttgataaggaaggaaaatctgaccccagcgactacaaatattacctgtttaaacatctccattttgagatcttttccaacaatgatcgtgtgattgagatcaatgcacgaactgatcctaatgccttggtagatatcacagaggataaggaggttgatgtggaattcatgtactctgttaaatggaaagagacaaaaacaccttttgataagaggatggagaagtactcacagtcttcatcgttgccacatcacctggaaattcattggttctcaattatcaattcctgcgtgacagttcttctcttaactggttttcttgccacaattcttatgcgggttcttaagaatgactttgtcaagtatgcacatgatgaggaggcagctgatgaccaagaagaaactggatggaaatacatccatggtgatgtttttaggtacccaaattacaaatctgtgttggctgcagcacttggtagtggtacccagctatttacactgaccatctttattttccttctctcccttgttggtgttttctatccatacaaccgcggagctttattcacggcattggtcgtcatatatgctctcacatctggaattgcaggctatacagcttcctctttctattgccagctagaagggacaaactgggtcaggaatttgttattgactggaggcttgttttgtggacccctgtttctcacgttctgtttccttaacagtgtagcaattgcatacagtgctactgctgcactgccttttggaactattgtggtcatctttctaatatgggctcttgtaacgtcacctttgcttgtactgggagggatagctggaaagaacagcaaggctgaattccaagctccttgccgaaccactaaatacccaagagagatcccaccattaccttggtaccgcggaactctacctcagatggcaatggctggatttttgcctttcagcgccatatatatcgaagtatactatatatttgcaagtgtttggggtcacaggatctacacaatatacagcatcttatttatagtcttcattattcttataattgtcactgcttttataactgtggcgttgacatattttcaacttgctgctgaagatcatgaatggtggtggagggctttcctttgtggtggatcgactggactcttcatctacggctactgcttgtattactattatgcccgttctgatatgtctggcttcatgcaaacctcattcttctttgggtacatggcttgcatctgctatggtttctttctcatgctcgggactgtaggttttcgcgcggccctgttttttgtccgtcacatataccggtcaatcaagtgcgagtaggaagctggtgagaaggtcttctgtctcttacagaatcctttacagatctggtatctggtattcaagaagaccatgtaggatggtaggatctcttgagatgaagcatgtactatcttatgccggaaattttaagaactttttgccatttttcattttacagctcaacagtttatatcgattagtagatttagagtttcctcattccatattctaatccttccaacacattatcctagtctgtctagtattccttttactgcattttgggcaaactttgagctataattgtactggtcccaagtttcaaaagaatgtatgaaatgagccattcactcgttgagcaatgcccaatttgtttgactcttgattccaacttcagtattttgcta

SEQ ID NO: 1750 - DNA, 2204 bp, Theobroma cacao
ttcatccatttttctacacttccctttcccttactctcttcgtccacccaaaaatgaaaaacctcggcaattgtccgacgtttctaatcctcggagttttattcttctgttgtctttcccatgttagatccgacgcctccgaccaccgttacaaagacggtgatcctgtcccgctctacgccaataaggtcggcccgttccacaaccccagtgaaacctatcgctactttgatctgcccttctgttctccagatcatttaaaggagaagaaagaagcgttaggtgaggtcttgaatggtgatagactcgtaaacgctccttataaacttaactttagagaggaaagagattcttatgttgtttgtaagacgaagctttcaaaagaagaggttgccattttccgtaaggtggttgacaaggattattatttccaaatgtactatgatgatttacctatctggggttttattggaaaagttgataaggagggaaaagctgatccgagcgagtacaagtatttcctttacaagcatatccagttcgatatactttataacaaggatcgcgtaattgagatcagtgctaagatggatcctcattcgcttgtggacttgactgaggataaggaagttgatgccgagtttatgtatactgtgaaatggaaggagactgagactcctttcgagaagaggatggacaagtactccatgtcttcttctttgccacatcatttggagattcattggttttctatcatcaactcttgcgtgacggtgctccttttaacgggtttccttgcaacgattctcatgcgggtcttgaagaatgatttcattaagtatggtcaagatgaagaagcagctgatgaccaagaagagactggatggaagtatattcatggagatgtattccgattcccaaagttcaaatctttgtttgctgctgctcttggatctggaacacagctgttcactttaacggttttcatttttatgcttgcattggttggtgtcttctatccgtacaatcgcggtgctctgtttactgccctagtggttatatatgcacttacatcaggtattgcaggatatacagctacttctttctactgtcagcttgaaggaaagaactgggttaggaatctgttattgactggctgccttttctgtgggcccttatttctcacattctgcttccttaacacggttgctattgcatacagagcaactgctgcactgccttttggaactattgtagtaatagtcctcatatggacactagtgacatctcccttgcttgttctgggtggtattgctggaaaaaatagcaaggctgagttccaagctccctgccgcaccacaaagtatcctcgagagattccaccattgccttggtacaggagtgcgattcctcagatggcaatggctggatttcttccatttagtgctatttacattgagctttactacatatttgccagtgtctggggccacaggatctataccatatacagcatcttgtttattgtcttcatcatcctgctgattgtcactgcttttataactgtggctttgacatatttccaacttgcagccgaagatcatgaatggtggtggaggtctttcctttgcggtggatcaactggcctctttatctatgcctattgcttgtattattactatgcacgatcagatatgtctggttttatgcaaacctcgttcttctttggttacatggcttgcatctgctatggattcttcctgatgctcgggacagtgggtttccgtgcctcgctgctctttgttcgtcacatatacaggtccatcaagtgtgagtagagggtttagttgtcccttaacatttccatcaatgctgtcatagagaagtctatgattatgatctttgttagaaattagctggaagattgccctaattgtcatgagcaaatggggatgctatactatgcctaaagggatatctgtaagatctgcacgtgggtggctaggcattggagaacttttaggcatcatgtgtttattattaatatttgctttgtatgtaaccatgagacggatttgtgtaggatgctgttattttttatacctctctaccgggaaaaaaagatgctcaattagttttcttttaccgactgttttgagttgactttaaaagattgcgttgcaaaataaatgattattttccga

SEQ ID NO: 1751 - DNA, 2087 bp, Chenopodium quinoa
tctacatttctgcgatttgactccagaattcaagagaaagaggagagagaaactgaggttttgcgcaacaatggagaaatccaaggccactttaatggtggccattgttattctgctcttttctggttttattcaagtgagatccgatggttctaatcatcgttacaaagctggagaacaagttcctctttacgccaacaaagtcggccctttccacaaccctagtgaaacatatcgatattttgatcttccattctgtattccagatcatgtcaaggagaagaaagaagctcttggtgaagtattaaatggagatcgtctagtcagtgctccctacaagcttgatttccttgtggacaaggactcagaagtcatctgcaagaaaaagttgtcaaaggaagacattgttcaatttagagatgcagtagccaaagattactattttcaaatgtactatgatgacttgccaatctgggggttccttggcaaagttgacaaggagggcaaactggatccaagcgagtacaagtattatttatataagcatatccattttgacatcttctacaacaaggaccgtgttattgaaatcaatgtccgaactgatcccaactctttggtggacattactgatgataaggaagtggatgtagaatttatgtattctgtgaagtggaaagagacaaacaccccatttgagaagagaatggataaatactcacagtcttcctctcttcctcatcatttagagatccattggttctctatcataaactcatgtgtcacagtgcttctcctgactggatttcttgccacaattctcatgcgagtgcttaagaatgattttgttaagtatgcacacgatgaagaaacagctgaagaccaggaagaaactggttggaaatatattcatggggatgtgttcaggtttcccaagtacaaatcagtgctggcagctgctcttggatctggtactcagctatttactctgacggtattcatattcttgcttgcactagttggagtgttttatccttacaaccgaggagcactgttcacagcactggttgttatctatgctcttacatctggcattgctggttatactgcaacctccttttattgccagctagaaggatcaaactgggttaggaatctgttgctgactggtttcttgttctgtggtcctctgtttctcactttttgcttcctcaacactgttgcgatagcataccatgctactgctgctcttccatttggcacaataatggttatacttcttatctggactcttgtaacttcaccgttgcttgtattgggtgggatcgctggaaagaatagcaaggctgagttccaagctccttgtcgcacaacaaagtaccccagagaaattccaccactgccgtggtaccgagggactcttcctcagatggcaatggctgggtttttaccattcagtgcgatatacatagagctctactacatctttgccagtgtttggggacacaggatttacacaatttatagcattttgttcattgtcttcattattttgattatagtcactgctttcattactgttgctttgacatacttccaacttgctgctgaagaccatgagtggtggtggaggtccttcctatgcggtggttctacagggctatttatatatggctattgcctatactactattatgcccgctctgatatgtctgggttcatgcagacatcatttttcttcggctacatggcctgcatatgctatggcttcttccttatgcttggaatggttggcttccgtgctgcactcttttttgtccgtcatatatatcggtcaatcaaatgcgagtagataggtggtgcgacttcaatgttggaccaatgtttttgttctgtaggcttagtaggacagcgatgttctttgtattgtaacctatgcctgacctcattcaggactcaggagaaagagtttgtaatcttatatagacttgcctctttgatttttatatgcacgatcttgcttatacgttaatcctctcacataattcacatagtaatatagtacagtataatagtatattagtatt

SEQ ID NO: 1752 - DNA, 2141 bp, Chenopodium quinoa
aaatcaaatctaaaacccttatttctcaatcttcatctcgagattcgatctattttctctcgatttctcttcttcaattccgtattttttctgtgatttggagggagaaattgatagattttgaagaaaatggtgaaatcgatggccactttaatggtggccgtttttgcagtggtgttgatttctggtgttagtcgtgtgagatctgatgcttctgatcatcgttacaaagctggtgaagctgttcctctttacgccaataaagtcggccctttccataaccctagtgaaacataccgctatttcgatcttccattctgtgttccagatcatgtgaaagaaaagaaggaagctctaggtgaagtattgaatggagatcgtctggtcagtgctccttataagcttgactttctagtggacaaagattcagaacttatttgcaagaaaaaaatgacaaaggaagaagtaactaagtttagagatgcagtatcaaaagattactacttccaaatgtattatgacgatttgccaatatgggggttccttggtaaagctgacaaggaaggcaaactagacccaagcgagtacaagtattatttgtataagcatattcattttgacatcttttacaacaaggaccgtgttattgaaatcaatgttcgaactgatcccaactctttagttgacattactgaggataaagatgtcgatgtggaatttatgtacaccgtaaagtggaaggagacaaacaccccttttgagaagaggatggataaatattcacaatcttcttctcttcctcatcatctagagatccactggttttccattattaactcatgtgtcactgtactactcctgactggatttcttgccacaattcttatgcgagttcttaagaacgattttgtcaagtatgcacatgatgaggaaacagcagaagatcaggaagaaactggatggaagtatatccatggggatgtatttaggtttccaaagtaccaatcgttacttgcagcttctcttggatctggcacccagctgtttacccttacgttttttatatttctactcgctttagttggagtgttttacccatataaccgaggagccctgttcacagcccttgttgtcatttacgctctcacatctggaattgctggctacactgcaacctccttttattttcaattggaaggaacaaactgggtaaggaacctgttgttgacgggttgcctgttttgtgggcctctgtttctgaccttctgtttcctaaacacggtagcaattgcatatcatgctactgccgctcttccttttgggaccattgtggtgattcttcttatctggacacttgtaacatcaccattgcttgttttgggtggaattgctggaaagaatagcaaagccgagttccaagctccttgccgtactacaaagtaccccagagaaattccaccactaccatggtaccggggaactcttcctcagatggcaatggctggatttttgcctttcagtgcaatttacatagagctctactacatatttgccagtgtctggggtcaccggatttacactatatacagcatcttgttcatcgtcttcattatattgattatagtcaccgctttcatcactgtggcattgacatacttccaactcgcagctgaagatcatgagtggtggtggagagccttcctgtgtggtggttccactggtctatttatctatggctattgcttatattactactatgcgcgctctgatatgactggtttcatgcaaacatcatttttcttcggctatatggcttgcatttgctacggcttcttcctcatgcttggaactgttggtttccgtgcctcacttctgttcgtccgccatatttaccgatctatcaaatgtgaatagataagcgatggaactataggtttgtgccggtgtcgtctttgttctgtacaccatcaccagtaatgatccatctggtgttgtaaccgacttctaatctgatcagggagaagtattcttttaaacttgatctgcatctttgccgttgcagttttagctacacacgagatcttgcccccaaatccttttataaaattggctggatgaagaaaatagtttcagttctggag

SEQ ID NO: 1753 - DNA, 2567 bp, Prunus mume
gagaagcgttagacgcaccctacggcataaggtaggcaccaaagcgtcggtgaggcatcaaacatcttaggatgtggtgaggcactccgtctccgtcacccgctgctccccgttttggcttaatattataattttaacctctaataattaataaaaattatgagcgtattaagcttaacttctatattttattaagccccaagtaaatatataaaccaaaccaaaggaggcccaaacccaaaatcagatatatattgaacgtgtttgtctgtctctgcagagattagagagtgagaatggggaagaccatggcggtgggagtgccagtcatcatcgccttgttaattctgtgcggtgtggatctggtcaggtcagacgcgtcggatcatcggtacaaggaaggagatttagtccctttgtatgctaacaaggtgggccccttccacaaccccagcgaaacgtaccggtattttgatctcccattctgctcaccagataaggtgaaagagaagaaggaagctctgggtgaagtattaaatggggatcgtttagtcagtgccccttacaaactagagttccaaaagcataaagattcggaagtagcttgcaaaagaacaataaaaaaggaagaagtggcccggttcagatctgctgtcaacaaggactattactttcagatgtattatgatgacttgcccatttggggtttcataggaaaagttgacaaggaaggcaaagacccgagcgaatacaagacctacctgtataagcatattcattttgatatctcttacaacaaggaccgtgtgattgaaatcaatgttcgaacagatccaaatgcactggttgaccttacagaggataaagaaattgatgtcgaattcatgtatactgtaaaatggaaggaaacaaccactccttttgataagaggatggataagtattctcagtcctcatcgctgccgcatcatttggagatccattggttctcgattataaattcatgtgtgacagttctcctcttgactgggtttcttgccacaattctcatgcgagtgcttaagaatgattttgtcaaatatgcccatgatgaagaagcagctgaagaccaggaagagactggatggaaatacattcatggagatgtatttagatttcccaagtacaagtctctgtttgcagcagctctgggttcaggcacccaactatttacccttacgatattcatttttatacttgctcttgttggcgtgttttatccatacaaccgaggggctctatttactgctctagttgtcatttatgcactcacatcaggaattgcaggatatactgctacttcattttattgccagctagagggaacaaactgggttaggaatctattgttgacgggatgcctcttctgtggacctctgttccttacattctgctttttgaatactgttgcaattgcttatacggccactgccgcgcttccctttggcactattgtggttatagttctaatttggacacttgtaacatcacctttgctagtgttaggaggtattgccggaaagaacagcaaagccgagttccaagctcctgtccgcacgactaaatatcccagagagattccacctttaccttggtaccgggcaacaatccctcaaatggcaatggctggttttctgcctttcagtgctatatacattgaactgtactacatttttgccagtgtgtggggtcacaggatttacaccatttacagcatcttgtttattgtgtttatcattcttctgatagttactgctttcattactgtggcattgacatatttccaacttgctgctgaggaccatgagtggtggtggagatctttcctctgcggtggatctactggcatatttatctatgcctattgtttgtattactactacgcacgctcggatatgtcaggatttatgcaaacatcattcttctttggttacatggcatgcatctgctatggtttcttcctcatgcttggaactgtaggcttccgtgcagctttgctttttgttcgtcacatataccgatccatcaagtgtgagtaggtagttgttctccaagaatcaatcatcatgggagatgtattttctggtgtttttcatctcgtaggcacctacctccttgtagagaagtttccttaaaattaattttgtagtgcctcgtgtactaaagaagtgtcatgagatatcttgctttccagagcaatgtgttagatcacaatatggtcgactattcatagagacagtttgtatcattacctttcaagctttgcaatacattctttaaatatcttcctctttccttcgtatcgttatagagttacccaatgttctctcatgctctctctctctctctctctctgtgttttgtaaatacatggcatattattattggctgctgcttaatacttgtggaagcagctgctacatgcaaactaagatcataaaaaagggccaactaagaacgccgaaccaaagaacaaggaaatttaaaaataaaaaaggatttatcaacttcgtggtaagaacaaggca

SEQ ID NO: 1754 - DNA, 2053 bp, Arabidopsis lyrata
aaactcagatctcacgattttcttccttcacataaacacaccatcatgagattaccaacgtcgctgctcctctttatcggagctctcatcttctccggcgccggaaatgtcagatccgatgcctcagaccaccgttacaaggacggcgactccgttcctctctacgccaacaaagtcggtccgtttcacaatcccagtgagacgtatcgctatttcgatctcccattttgtattccagatggtgtgaaagataagaaggaagctcttggtgaggttttgaatggggataggcttgttagtgctccatacaagcttaactttagagaggagaaagactcagatgtttactgccgaaagaagcttagcagagaacaagtcgaacagtttcgaagagctgttgaaaaagattattactttcagatgtattatgatgatttgcctatctggggattcattggaaaggttgacaaagagagcaaatctgatccgagcgagttcaaatatttcctctacaagcacatccaatttgagattttgtataacaaggatagagtgattgaaatcaatgctagaatggatcctcattcgcttgtggatcttactgaggataaggaagtcgatgctgagtttatgtacactgtgaaatggaaggaaactgagactccttttgagaaaagaatggacaagtatgctatgtcttcttctcttccacatcacttggaaatccactggttctccattattaactcctgcgtcactgtcctccttttgactggtttccttgcaaccatcttgatgcgggttctcaagaatgatttcatgaagtatgctcaagatgaggaagctgctgatgatcaagaggaaactggatggaaatacattcacggagatgtcttccgtttcccaaagcacaaatctctctttgctgcatctctcggcagcggtacccagttgttcactctgaccatcttcattttcatgctttcacttgttggagtgttctatccatacaaccgtggagcactcttcaccgctttggtcgtgatctacgctctcacatctggaattgccggatacactgcctcctctttctactgtcaactcgaaggaaagaattgggtgagaaatttgctgcttacgggaggtctcttctgtggcccactattcctcaccttctgtttcctaaacacagttgcaattgcctacagtgcaactgccgctcttccctttggaaccattgtagtgatcgtcctcatatggacactagtcacttcacctttacttgtgttgggtggtattgccggtaaaaacagcaaagctgagttccaagctccagtccgcaccactaagtatcctcgggagatcccgccactcccatggtacaggagtgctatacctcagatggccatggccggatttcttcctttcagtgccatctacatcgagctatattacatctttgccagtgtttggggccatcgtatctacaccatttacagcatcctcttcatcgtcttcatcatcctgttgatcgtcactgcttttataacagttgcccttacttacttccaactcgctgctgaagatcatgaatggtggtggagatcattcctatgtggtggatcgactggtctgttcatctacgcttactgcttatactattactacgcaagatcagacatgtccggtttcatgcaaacatccttcttcttcggttacatggcttgcatttgttacggtttcttcctcatgcttggaactgttggcttccgcgctgctctcctcttcgtccgccacatttaccggtcgattaaatgcgagtaaaactgttgctgccaatccaccttcccttacgatttttggtagaacaaagaagatgataatctgtcattaggtagataaagaagaagacttcttcgaagccagaaaccgaataccaaaatcgctctatgatcacatttttttttccttttgttataatgtcttgtgtcagtttgtttttttgtgatatgatttagagacgaaactatgtttgtttaggtgaattctttct

SEQ ID NO: 1755 - DNA, 2380 bp, Triphysaria pusilla
gtcaggtcatccaacgtacccccactctctccttaccgcgtggtttatttgtcttcaatttttattctactaaatgagatcgagatctgtgctcttcctctaagagtttctctcttattcatttagatctctgctactgaatccaaaacccaattctgtctcagcgtcctatttcttataaacgtaatggcgagaggagagtggccattcgttgttctgctgctgctgtgcatcgcaatcccggcggtaagatctgatggatctgatcacaagtacaaaatcggagattcggttccgctgtatgccaataaggttgggccatttcacaaccctagtgaaacgtaccgttactttgacctcccattctgctccccaggtaatgtgaaagataaaagtgaagctcttggtgaagttctgaatggagaccgtttggttagtgctccatacaagcttgactttttggttgacaaagagttggaagtaatctgtaagaggcagctgtcaaagaaagatgttgccgagttccgaagtgcggttgcaaaagactactattttcaaatgtactatgatgacttgccgatatggggtttcctggggaaggttgacaaggaaggcaaagctgatcctagcgagtacaagtattacctatttaagcatctccattttgaaatcttttataacaaggaccgtgtgattgagatcaacgcacgtacggaccccagtgctcttgttgaccttactgatggtaaggaagttgatgtggagtttatgtactctgcgaaatggaaggaaaccaacatagcttttgacaagaggatggagaagtactcacattcttcctcacttcctcggcacttggagatccattggttttcaattatcaattcatgtgtgactgttctccttcttactggattccttgccacaatattgatgcgagtacttaaaaatgatttcgtcaagtatgcccatgatgaggaaacagcagacgaccaagaagaaactgggtggaaatacattcatggtgatgttttcaggttcccgaaatacaaatctttattttctgctgcccttggaagtggcacacagctctttaccctggcgacctttatattcttactcgctcttgttggtgtattttatccctataaccgaggagctctttttaccgcactagtggtcatatacgcactcacatctggcattgcaggatatacagcagcctctttctattgccagttagagggaacaaattgggtccggaatttattattgactggaggcttgttctgtgggccactttttctcacattttgcttcctcaacacagttgccattgcttaccatgctactgctgcacttccttttggtacaattgtggtgatttttctgatatgggctcttgtgacatcacctttattagtgttggggggaatagcagggaagaatagtaaggcagagtttcaagctccttgtcgtaccacaaagtatccgagagagattccaccattgccttggtatcgtggaacacttccgcaaatggctatggccggatttttgccattcagtgccatctacattgaactctactatatatttgctagtgtttggggtcataggatttacaccatttacagtattttattcatagtattcattatcctcttgattgtcactgcatttataacggtggctttgacatactttcaacttgctgctgaagatcatgaatggtggtggaggtcattcctatgtggtggatcaactggattgtttatttatgcatattgcctttattactactatgcacgatcggatatgtcgggctttatgcagacctcatttttctttgggtacatggcttgtgtctgctatgcattcttcctaatgctgggggctgtaggttttcgtgctgctttgttctttgtgcgccatatatatcgctctataaagtgtgaatgagaaatcagaatactgcaatatttccaagctcgacagaggattataccgagtgggtgaatggttttatcatgtgactgattcgtaaaagtgaaagacagtcggattaatattgcatttaggttttacttgtttaagcatttcctgagaacaaagtacttattgtctaggacttatgaaaacttcatcaaacttttggaagttctttttttgttttttacttgtttttaaagatatcgaaggggtgatatgttcgctcttcagtgtcatgcccatttaacatctctttttatgctattagtgcatttttaggatgttattttgtgtaagatatctaccgatgggtttgtgttgagcttgggattaatagcaaatctcgaaataaaaatacgtatgttattatttaagaaaaaaaaaaaaa

SEQ ID NO: 1756 - DNA, 2593 bp, Populus trichocarpa
ctgaaaattctcaaaacttctaggattgcgcatggacttccaaagcaaaacctcgtttatcgtggtcataattttttttttcatgaacgcatttaaaaataaaaataatttttttttaattactctcctaatctctttctcgttatttgaggaaggcctcattttttacacgaaccattttagatttgttggagccacaacccataaagtctccatctttataaatctctctcctctctctctcaccccataactatcttactctctcttctctttttgtgagttacagtaattgaaaatggagaagaaactagtgccttgtttggtttcatttgttttgatattgtgcagcgtgtcccatgttagatcagatgcatctgatcatcgttacaaagttggagatgatgtccctctctatgttaacaaggttggaccttttcacaatcccagtgaaacataccgctactttgatctgcctttctgctcatcaggtcctacaaaggacaagaaagaagcccttggtgaagtgttgaatggggatcgtttagtcactgccccatacaaacttgactttttaaatgacaaagattctgaagttgcatgcaaaaacacgctgacaaaggaacaagttgctcagttccgagaagcagtttccaaggactactacttccaaatgtattatgatgacttgcccatttggggtttcttagggaaagttgataaggaacgcaagaatgaccctagtgaatacaaatattacctgtttaagcatcttcactttaccatcttttacaataaggatcgtgtcattgagatctctgcacaatctgatctgaacaatgttgtggaccttactgaagataaagaagtcaatgtggagttcatgtattcagttaaatggaaggaaacagatataacatttgagaaaaggatggacaagtattcacaatcttcttcacttcctcatcacttggaaattcattggttctcaattattaactcatgtgtgacagttctcctcttgactggttttcttgccacaattctcatgcgagtcctgaagaatgattttgtcaaatatgctcatgatgaggagtcagctgaagaccaagaagagactgggtggaagtacatccatggtgatgtatttagatatccgaagtataagtctttgcttgcagcagcagttggctctggcacccagctgtttaccctcacaattttcattttcgtgcttgctctagttggtgtcttttatccttataatcgtggagctctatttactgcactggttgtcatatatgctctgacagctgggattgcaggctacactgcagcctctttcttttgccaactggaaggaacaaattgggtcaggaacttgttattaactggagccctattttgtggacccctgtttctcactttctgctttcttaataccgttgcaatcacgtatagtgccactgcagcattgccatttggaacaatagtggtgatatttcttatttgggctctggtaacaacaccattgctggtactgggtgggattgcagggaagaatagcaaggctgagtttcaggctcccgtccgcaccactaaatatcccagagagattcctcagttgccttggtatcggaaaacacttcctcagatggccatggcaggattcttgcctttcagtgcaatatatattgaactttactacatatttgccagtgtttggggtcacaggatctacaccatatacagcatcttgttcattgttttcatcattctcttgattgtcactgcttttataacagtggcgttgacatatttccaacttgctgctgaagaccatgagtggtggtggaggtcgttcctttgtggtggatcaactggattgttcatttatggctattgcttgtattactactatgcaagatcagatatgtcaggcttcatgcaaacctcctttttctttggctacatggcctgtgtttgctatggtttcttcctcatgcttggcagtattgggttccgtgcctccttgttttttgtccggcacatttaccgttcaatcaagtgcgaatagcaagccatatcatcttcagtatgttcaatgggtgaagcagcagttggctgggaaatctgctcctggattgatggagttcaatgtcacaacttttgagaatgctggcacatcacatgtaggacttttaagatcttttataggaagggaatcaagggattgtgtaggactttagaatgcagttaatgatttgtaagcacaagctgtctgtttggagtcaattgtaagctaccgccgttatttaacagaaaacaagtgccccattgtcggcaatggcgagtctcagacaattacagctatggtgccgatacataatggtaacggccgttattgtaaaaataactggtcaataacggactactcactcatatgattgttgtcttcgcattttggtttcaagtttcacacttcacctcttctgatagttataatatagtgcttaatgcttatatgatatttaactaatgaatccttattatcttacatgtaaaaacgtcaaggaatttatatcctcaagga

SEQ ID NO: 1757 - DNA, 2126 bp, Solanum lycopersicum
gatacatatatatatatatattcatgtatacaacggagatggagaagaagatgatgagttacgtcgtcgttttgatcgttttgtgttgtggtgttactccggcgagatcggacggttccgatcataagtacaaggccggagatcaggttactatgtatgctaacaaggttggtcctttccataatccaagcgaaacgtaccgattctttgatcttccattctgtgcaccagctcatgtgactgagaaaaaggaagctcttggtgaagtcttaaatggtgatcgattggtcagtgctccttacaagctcgactttatgtacgacaaggactcagaaatagtgtgcaaaaagaagttatcgaaggaagaagtttctctattccgtaatgccgttgccaaggactattacttccaaatgtattatgatgacttgcccatttggggtttcttaggtaaagtcgataaggagggaaaaacagatcccagcgagtacaaatattacctgtttaaacatctccattttgagatcttttacaacaatgatcgtgtggttgagatcaatgcacgaactgatcctaatgccttggttgatatcacagaggataaggaagtagatgttgactttatgtactctgtgaaatggaaggagtcaactactccttttgagaagaggatggaaaaatactcacagtcatcatcaatgccacatcacttggaaatccattggttctcaattatcaactcctgtgtgacagttcttctcttaactggttttctcgcaacaattcttatgcgcgttcttaagaatgactttgtcaagtatgcacatgatgaggaggcagctgatgaccaagaagaaactgggtggaaatacattcatggtgatgtttttaggtatccgaagtacaaatcgttgttggctgctgctgttggttctggtacccaactctttacaatgaccatctttattttcattcttgcacttgttggtgttttctatccttacaatcgtggagctttattcactgcactggttgtcatatatgctctcacgtctgggattgctggctatactgcatccgctttctactgtcaactagaaggaacaaactgggtcaggaacttgatattgactggggcattgttttgtggaccgctgtttctcacattctgctttcttaactccgttgctatcggctacactgccactgctgcgctaccttttggaaccatcatggtcatttttctaatatgggctcttgtaacatcacctttgctcgtattgggagggatagctggaaagaatagtaaatctgaattccaagctccttgtcgtaccaccaagtatccaagagagataccgccatcgccttggtaccgtggaactctgtctcagatggcaatggctgggtttttgccttttagtgccatatatattgaactttactacatatttgcaagtgtttggggtcacagaatttacacaatttacagtatcttgtttatagtcttcattatccttctaattgtcaccgcttttataaccgtggcattgacatacttccaacttgctgctgaagatcacgaatggtggtggagggctttcctttgtggtggatcaactggactgttcatctacggatactgcttgtattactattatgcacgttccgatatgacagggttcatgcaaacctcattcttcttcgggtacatggcttgcatctgctatggtttctttctcatgctcgggtctgttggtttccgtgcagccctattctttgtccgtcacatatatcgatcgatcaaatgcgagtaaagttgttgtctgtggtcttctacatctcacagattgctttccagatttggtaaaggccacaatcaggtgtcaaataggagcatgtaggagaattcattttcttgaaaagaagcttgtattatcatacaatgacaaatttttttcatatataactaggcatttttcatttgcagctcaaaagtttacaacaatgatgtttgaggagggtaggatgtacgtagagtcgtagaccttatccctgcagccttacctttgctaggtagagattattttcagtagatccgcgaacagctgaaaactcagttttct

SEQ ID NO: 1758 - DNA, 2195 bp, Arachis hypogaea
gcttcgtttctttgtgtgtttattaacccctttgcttcttctcttccctttcgtcttttctcttcaaaccttctcttctctctctttctctctctgacccttctcttcgtaaatcgaagaggtggaagaagaagaagaagaaactaaaacacaacaatgaggaagaatcatcacctgcttcctcttctgttgctctcactcaccttcctctcattctccaccgtcagatccgattcctcagatcacagatacaaggaaggaaatatcgtccctctatacgcaaacaaagttggccctttccacaacccaagtgagacatatcgatattttgatctaccattctgcctgccagatgatttgaaggagaagaaagaagctcttggtgaggtcttaaacggtgaccgtttggttagtgctccttacaagttagagttccagcaggataaggactccgtgccagtttgcaagaagacactgaagaaggaagatgtcgccaagttccgagcagcagttcgcaaagactactacttccagatgtactatgatgacttgcccatttggggtttcattggaaaagttgataaggagggaaaggatccaagtgattacaagtactacctgtacaagcacattcactttgacatatattataacaatgatcgcgtcattgagatcaatgtgcgaacggatccaaatgcacttgtggatgtcacagaggataatgaggttgaggtggagttcttgtatactgtgaagtggaaggagactaacacccccttcgagaagcggatggataagtactcacaatcatcatcgctaccccatcatttggaaatccactggttctcgattatcaactcatgtgtgacggtcctgctgctgactggtttccttgcaacaattctgatgcgggtccttaagaatgactttgtcaagtatgcccatgatgaggaagctgctgaggaccaagaagagactggttggaaatatattcatggagatgtatttagatttccaaaatacaagtctctatttgcagctgcccttggatctggtacccaattgtttacccttacggtattcatattcatcttggcacttgttggagtcttttacccatacaaccgaggtgctctgtttaccgcacttgttgtcatttatgctctcacttcaggaattgctggctatacagcaacatctttctactgtcaattagaaggatcaaactgggttaggaatcttctattgactgggtgcctcttctgtggaccattgtttctcacattttgcttcctgaacactgttgcaattgtttacaatgctactgcggccctcccatttggtacaattgtggttatagttctgatatggacactggtcacatctccattgcttgtgttgggtgggattgctgggaagaatagcaaggctgaatttcaggctccctgccgtacaaccaagtatccaagggagattccacctttgccatggtatcggggaacaattccccagatggcaatggccgggtttttgcccttcagtgcaatatacattgaactatactatatatttgccagtgtttggggtcacaggatttacaccatctacagtatactgttcattgtcttcatcattctcttgattgttactgctttcattactgtggcattgacttacttccagcttgctgctgaggatcacgagtggtggtggagatcattcctctgtggtggttcaactggcttatttatctatgcctactgtctgtattactactatgctcgctcggacatgtctggattcatgcagacgtcatttttctttggatacatggcatgcatatgctatggtttcttcttgatgcttggaactgtcggattccgtgcggctttactctttgtccgccacatatatcgatccatcaagtgcgagtaaggcattttgtcctgaccggtcatcatcacaggtcctttagaagagctgttgtcttcatttcataggcattctgtagaaaattatagtaattttggtgttcctttctgtactataaggggaagctgggttgggttgggttggttcggggttgtttctagcttccagggaaacttgttagatcaccacaaagggtgcttttggaaaaaacgtctgtactaccatatctttaaccaaacacttgcaataccttcattttcctc

SEQ ID NO: 1759 - DNA, 1802 bp, Nicotiana benthamiana
aaatggagaagaagaagaggacgatggcgtggtacgttgtcgttttgcttattgtcagctgtgcatcgcctgtaagatcagacggttcagatcacaagtacaaagctggagatccggttcctctttatgctaacaaggtcggtcctttccataatcccagtgaaacataccggttcttcgatcttcctttttgtgctccagaccatgtgaaggagaaaaaggaagctctaggtgaggtcttgaatggtgatcgattggtcagtgccccttacaagcttgactttatgtacgacaaggactcagaaatagactcagaaatagtttgcaagaagaagttgtcaaaggaagaagttgctcaatttcgcagtgctgttgctaaagactactacttccaaatgtattatgatgacttgcccatttggggtttcttagggaaagttgataaggaaggaaaatctgaccccagcgagtacaaatattacctgtttaaacatctccattttgagatcttttccaacaatgatcgtgtgattgagatcaatgcacgaactgatcctaatgccctggtagatatcacagaggataaggaggttgatgtggaattcatgtactctgttaaatggaaagagacaaaaacaccttttgataagaggatggagaagtactcacagtcttcatcgttgccacatcacctggaaattcattggttctcaattatcaattcctgcgtgacagttcttctcttaactggttttcttgccacaattcttatgcgggttcttaagaatgactttgtcaagtatgcacatgatgaggaggcagctgatgaccaagaagaaactggatggaaatacatccatggtgatgtttttaggtacccaaattacaaatctgtgttggctgcagcacttggtagtggtacccagctatttacactgaccatctttattttccttctctcccttgttggtgttttctatccatacaaccgcggagctttattcacggcattggtcgtcatatatgctctcacatctggaattgcaggctatacagcttcctctttctattgccagctagaagggacaaactgggtcaggaacttgttattgactggaggcttgttttgtggacccctgtttctcacgttctgtttccttaacagtgtagcaattgcatacagtgctactgctgcactgccttttggaactattgtggtcatctttctaatatgggctcttgtaacgtcacctttgcttgtactgggagggatagctggaaagaacagcaaggctgaattccaagctccttgtcgaaccaccaaatatccaagagagatcccaccattaccttggtaccgcggaactctacctcaaatggcaatggctggatttttgcctttcagcgccatatatatcgaactttactatatatttgcaagtgtttggggtcacaggatctacacaatatacagcatcttatttatagtcttcattattcttataattgtcactgcttttattactgtggcgttgacatactttcaacttgctgctgaagatcatgaatggtggtggagggctttcctttgtggtggatcgactggacttttcatctacggctactgcttgtattactattatgcccgttctgatatgtctggcttcatgcagacctcattcttctttgggtacatggcttgcatctgctatggtttctttctcatgctcgggactgtaggtttccgtgccgccctattttttgtccgtcacatataccggtcaatcaagtgcgagtaggaa

SEQ ID NO: 1760 - DNA, 2212 bp, Prunus mume
ggtttgttcattctctcactttatcagttgaaaatatcactcgtatcttcttctccgtcaagaccatgaagaacctctcgacgattctcgtccttgccattttaatcacgtgctgcgttacccgcgtcagatcggacgcctccgatcaccgctacaatgatggcgacgccgtccctctctacgccaataaagtcggcccctttcacaaccccagcgaaacgtatcggtattttgatctccccttctgctcagcaggtgatgtgaaggagaagagggaagcacttggagaggtactgaatggagatcgtcttgttagtgctccttataaacttgagttcagaaaagagaaggacactgaagttgcttgtagaaggaagctgaccaaggaagaagttgctcagtttcgaactgctgtgaaaaaagactactacttccagatgtattatgatgacttgcccatctggggttttttgggaaaggttgacaaggaaggaaaaactgacccaagtgaatacaaatattttctatacaagcatatccaattcgaagttatgtacaacaaagaccgtgtaattgaaatcggggccaagatggatccccattctgttgtggacttgacagaggacaaggatgttgatgcagatttcatgtacactgtaaaatggagggagacaaatattcccttcgagaataggatggataaatactcacagtcctcttcgctgccgcatcacttggaaattcattggttctcaatcataaattcatgtgtcacagttctcctcttgacgggttttcttgcaaccattctcatgcgggtcctgaagaatgatttcatgaagtatgcacaagatgaggaagctgctgatgaccaagaagagactggatggaagtacattcatggtgatgttttccggttccccaagcacaaatctttgttcgctgctgcccatggttctggaacccagctgttcactctcacaattttcatttttatgctcgcactagttggtgtattttatccatacaaccgaggagctttattcactgcacttgtggtcatatatgcactcacttctggcattgcgggatatactgcaacttctttctattgtcaacttgaaggaacaaactgggtgagaaatttattacttactgggtgccttttctgtgggcctctgttcctgacattctgcttccttaacactgttgcaattgcttatagtgcaactgcagctcttccttttggtactattgtggtaattgtccttatttggacattggtaacatcaccattgcttgtcttgggtggcattgctgggaaaaacagcaaggctgagttccaagctccttgccgcaccacaaagtatcctcgagaaattccccctcttccatggtacagaacgaccattcctcagatggcaatggcagggtttctccctttcagtgcaatatatattgaactttactacatatttgccagtgtctggggtcacaggatttacaccatctacagcattctgtttattgtttttattattcttttgattgtcactgcctttataactgtggctttgacctatttccaacttgctgctgaagatcatgagtggtggtggaggtcttttctatgtggcggatctactggcctctttatctatggctactgcttgtattattactatgctcgatcggatatgtctggttttatgcaaacctcgttcttctttggttacatggcttgcatttgctatggcttctttctcatgcttggtaccgtaggctttcgtgccgctctgctgtttgttcgtcacatttataagtctatcaagtgtgaataggggggttgtttcttccgattttttttattttttttttaaatgataggaaaaagtctatgaattttgttagaaggtaggtgagagtgccttcagaagcggaagcagaggaagcaagctttccgaagtaaaagtgtttggagacttgtgttgtgcgtttgcttcaggcatggggaacgtgtgggcattgttggggtttcctttaactattttcactatatgtatctatggacgcgttaatataggcagcagccttgtatgtccacattttacttgctctctgaaatgactttttccatgttactcgttcgtgagtttggtagcatcatctaaaactgtcttcatctcttacatgcgaaacaaataaatcggag

SEQ ID NO: 1761 - DNA, 2111 bp, Eutrema halophilum
gcgttcgtcccaaatataaagcaaaatcagatctcacgattttttcccttcaacagaaacaccatgaaaataccgacgacgctgctcctcttggtcggagctctcatcttctccggcgccgggaatgtcagatccgatgcctccgaccaccgttacaaggaaggtgactccgttccgctctacgccaacaaggtcggcccgtttcacaatcccagtgagacgtatcggtatttcgatctgcctttctgtgttccagagggtgtgaaagataagaaggaagctcttggtgaggttttgaatggggatcgacttgttagtgctccatacaagcttaacttcagagatgaaaaagactcggagatatactgcaagaagaagcttagcagagaagaagttgaacagtttcgaagggctgtcgaaaaggactactacttccagatgtactatgatgatttgcctatctggggattcattggaaaggttgacaaagagagcaaatcagatccgagcgagttcaaatatttcttgtacaagcacatccagtttgagattttgtacaacaaagaccgtgtgatcgaaatcaatgctagaatggatcctcattcgcttgtggatctcactgaggacaaggaagtcgatgcagagtttatgtacactgtgaagtggaaagaaaccgagactccttttgacaagagaatggagaagtacgccatgtcttcttctcttccacatcacttggaaatccactggttctccatcataaactcatgcgtcactgtccttctcttgactggtttccttgcaaccatcttgatgcgggtcctcaagaatgatttcatgaagtatgctcaagacgaggaagctgctgatgatcaagaggaaactggatggaaatatattcatggggatgtgttccggttcccaaagcacaaatctctctttgctgcatctctcggtagcggtacccaattgttcactctcaccatattcatcttcatgctttcacttgttggagtgttttatccatacaaccgaggagcactcttcactgctttggtcgttatctacgctctcacatctggaatcgccggatacaccgcttcctctttctactgtcaactcgaaggaaagaactgggtgagaaacttgttgctcaccggttgtctcttctgtggcccactattcctcaccttctgcttcctaaacacagtcgcaatcgcctacagtgcaaccgccgctcttccctttggaaccattgttgtgatcgtccttatatggacactagtgacttcgcctttgcttgtattgggtggtatcgccggtaaaaacagcaaagcggagttccaagctcctgtccgcaccactaagtatcctcgggagatcccgccactcccatggtacaggagtgctgttcctcagatggccatggctggttttcttcctttcagtgccatctacatcgagctttactacattttcgctagtgtctggggtcaccggatctacaccatctacagcatcctcttcatcgtcttcatcattctcatcatcgtgactgcttttataaccgtcgctttgacttacttccaactcgctgctgaagatcacgaatggtggtggagatcattcctatgcggtggatcgactggtctgttcatctacgcgtactgcttatactactactacgcaagatcagacatgtccggtttcatgcaaacctccttcttcttcggttacatggcttgcatttgttacggtttcttcctcatgctcggaaccgttggcttccgtgccgctcttctctttgtccgccacatttaccggtcgatcaaatgcgagtaaggtatggttgctgccaatcactttcctcacaaagctccccgtatgatttttggtagaacgaagaagatgaaaaagaagatccgtccttttaggtagataaaagacttgttttaaagccagaaaccaaatatcaagtggcttataaggtttgattttcttagggctatttgcttaagtttctttttcccttcttcttaaaatgtttctgtgacactttgtgttgtttagttgagtctcttttctctgcttctactatagtgttttctctc

SEQ ID NO: 1762 - DNA, 2148 bp, Arabidopsis thaliana
ctcttctcccaaataaaaaaagttactcagatctcacgatttgagcagaatacgcaatgaggacaccgacgacgattctccttcttgtcggagctatcctcttctccggcgccggctatgtcagatccgacgcctccgaccaccgttacaaggaaggagacaccgttcctctctacgccaacaaggtcggcccatttcacaatccaagtgagacgtatcgatattttgatcttcccttctgtatcccagagggtgtgaaagagaagaaggaagctcttggcgaggttctaaacggggatcggctagttagcgctccatacaagctcaacttcagagatgaaaaagagtctgaggtatactgcaacaagaagttgagtaaagaagaggtcaaacagttcagaaaagctgttgagaaggactactacttccagatgtactatgatgatctacctatctggggattcattggaaaggttgacaaggatatcaaatctgatccgagtgaattcaaatatttcttgtacaagcacattcagtttgagattctatacaataaggaccgtgtgatcgagatcagtgctagaatggatcctcattcgcttgtggatctcactgaggataaggaagttgatgcagagtttatgtacactgtgaagtggaaggaaactgagactccttttgagaaaagaatggagaagtactctatgtcttcttctcttccacatcatttggaaatccactggttctccattattaactcctgtgtcactgtccttcttttgactggattccttgcaactatcttgatgcgagtcctcaagaacgatttcatgaagtatgctcaagatgaggaagctgctgatgatcaagaggaaactggatggaagtacattcatggcgatgtgtttcggttccctactcacaattctttatttgctgcatcgctcggtagtggcactcaattgttcacgctcaccatatttattttcatgcttgctcttgttggagtgttctacccatacaaccgaggagcactctttaccgctttggtggtcatttacgctctcacttctggaattgccggatacacatctgcctctttctactgtcaacttgaaggaaaaagctgggtgaggaacttgttactcactggatgtctcttctgtggcccattattcctaaccttttgcttccttaacaccgtagccatcacctacactgcaaccgctgcattaccctttggaaccattgtggtgatcgtccttatatggactctagttacctcacctttactcgttttgggtggtatcgcgggtaaaaacagcaaagcagagttccaagcaccatgccgtacaaccaaatatcctcgtgagattccaccactcccttggtacagaagtgctattcctcagatggccatggctggttttcttcctttcagtgccatctacatcgagctttactacattttcgctagtgtctggggtcaccggatctacaccatctacagcatcttattcatcgttttcatcattctcatcatcgtcactgcttttataaccgttgccttgacttacttccaactcgctgctgaagatcaccaatggtggtggagatcattcctatgtggtggatcgaccggtttgtttatctacgcatactgcttatactattactacgcacgatcagacatgtcgggttttatgcaaacctcgtttttcttcggatacatggcttgcatttgctacggattcttcttaatgctcggaacagttggcttccgcgcagccctcctctttgtccgtcacatttaccggtcgatcaaatgcgagtaagaaggtctgtacaccaatcttcttatgttgatttccttcttcttcttctgccttcttacgaattttgcttagaacaaagaagataaagagataggttgttagaaagaagagagacacaaagacaatgtctgattattttctaaagaagcatctcttctcattagaggttttagcgagagtctctcttcttctctctttattttgggctacagaaattaaattacttgtatcctttctatatattttacctattgtaaaagactatcaatacctttgaattcgagtttctttgtatctaataaatttcaaaaca

SEQ ID NO: 1763 - DNA, 2144 bp, Vitis vinifera
atctctgttcggttcagttgaaatctgaaatctcaaagaaatggagagggctatggcgattctggtggtcgccgttctgatcttactttgtggaagccaagtgagatccgatgcttccagtcatcgctacaaagctggagaggccgttccgctctacgccaacaaggtcggccccttccacaaccccagcgaaacctaccggtatttcgatcttccattctgcgtgccagctcatcttaaagagaagaaagaagctcttggtgaggtgttgaatggagatcgtcttgtcagtgctccatacaaacttgacttcctaagagagaaagactctgaagttgtttgcaaaaagaagcttaaaaaagaagaagttgctcagttccgagctgcagttgctaaggactattacttccaaatgtactatgatgacttgccaatatggggttttattggaaaggttgacaaggagggcaaagctgacccaagcgagtacaagtatttcttgtacaagcacattcaatttgatattcgttataacaaggatcgtgtgattgagatcaacgcccgaaccgaccctcattctatggttgacgtgacagatgataaggatgttgatgtggagttcatgtacactgtcaaatggacagaaactgatgctccttttgagaagaggatggagaagtactctcaaacttcttcaatgccacatcacttggagattcattggttctcaattataaactcttgcgtgacagtactcctcttaaccgggtttcttgcgacgattctcatgcgagtccttaagaatgattttattaagtatgctcatgatgaagaatcagccgatgaccaagaagaaactggatggaagtacattcatggtgatgtattccggtacccaaagtacaaatccttgtttgctgctgctcttggatctggcacccagttatttacacttacggtgttcatttttatacttgcattagtgggtgtattttatccatacaaccgaggagcacttttcactgcactggtggtcatctatgctcttacatctggcatagcaggatacacagcaacctctttctattgtcagcttgaaggaaccaactgggttaggaatctgctgctgacaggatgccttttctgtgctcctctgttccttacattctgcttccttaacactgttgcaattatttacagtgcaactgcagcactcccctttggcacaattgtggtaattgtccttatatggacattagtgacatcaccattgcttgtgttgggtgggattgctgggaaaaatagcaaggctgaattccaagctccttgccgcactacaaagtatccccgagagattccggcactgccttggtacaggagcactattcctcagatggcaatggcagggtttttgccttttagtgccatctacattgagctttactacatatttgctagtgtatggggtcacaggatctacaccatatacagcatcctgtttatcgtcttcattattcttctgatagtcacagcttttattactgtggctctgacatactttcaacttgctgctgaagatcatgaatggtggtggaggtcttttctttgtggtggatcaacaggcttgtttatctatggctactgcttgtattattactatgcacggtcagatatgtcaggtttcatgcaaacttcgttcttctttgggtatatggcttgcatctgctatggcttcttcctcatgcttggaactgtaggttttcgtgcatcattgctctttgttcgtcatatatacaggtctatcaagtgtgagtagtggtaggtggtattccaggcaaattcttctgtctttatattctatataaattgtcgtagagaaaggtctatgatttttgttattagaaggtagtttggagagtgcctcagatttcagaagaagctaatgtgataatgaagaatactttcgcaaatgggcctcctaaatccatgtccaagtgtttgcttggcttcctgaaagctgttgcacaataaagggatcagttgatgttagtgtggtatctgtaatctgagacaattttatttggggtagatgtttgtatcatcatcacttacaccttcaaactgcaaaatgaattctctctttt

SEQ ID NO: 1764 - DNA, 2167 bp, Eutrema parvulum
cttctccgaaataaaaaacaaactcagatctcacgatttggaagagaaaacacaatgaggacaccgacgatgctgctcctctatgtcggagctctcatcttctccggcgctggctatgtcagatccgacgcatcagaccaccgttacaaggaaggagacaccgttcctctatacgccaacaaggtcggcccatttcacaacccaagtgagacgtatcggtattttgatcttcccttctgtatcccagagggcgtgaaggagaagaaggaagctcttggtgaggttctgaatggtgatcggcttgttagcgctccatacaagctcaacttcaaagatgaaaaagagtctgaggtctactgcaaaaagaagcttagtaaagaagaggtcaaacagttccgaaaagctgttgagaaggactactactttcagatgtattatgatgacctgcctatctggggattcattggcaaggttgacaaggagatgaaatctgatccgagtgaatacaaatatttcctgtacaagcacatccagtttgagattctgtacaacaaagaccgtgtgatcgaaatcagtgccagaatggatcctcactcgcttgtggatctcacagaggacaaggaagtcgatgcagagtttatgtacactgtgaagtggaaggaaacggagactgcgtttgagaaaagaatggagaaatactctatgtcttcttctcttccacatcacttggaaatccactggttctccattattaactcctgcgtcactgtccttcttttgactggattccttgcaactatcttgatgcgagtcctcaagaacgatttcatgaagtatgctcaagacgaggaagctgctgatgatcaagaagaaactggatggaagtacattcatggcgatgtgtttaggttcccaacgcacaattctttgtttgccgcatcacttggtagtggtacccaattgttcactctcaccatattcattttcatgcttgctcttgttggagtgttctatccatacaaccgaggagcattgtttaccgctttggtggtcatttacgctctcacttctggaatcgctggatacacatccgcctcgttctactgccaacttgaaggaaaaagctgggtgagaaacttgttactaactggatgtctcttctgtggccctttattcctaaccttttgcttccttaacaccgttgccatcacctacactgcaaccgcagcattaccctttggaaccattgtggtaatcgtccttatatggactcttgtcacgtcgcctttgcttgtcttaggtggtatcgcaggtaaaaacagcaaagcggagttccaagcgccttgtcgcacaaccaaatatccacgtgagattccgccactcccttggtacagaagcgctgtacctcagatggccatggctggttttcttcctttcagtgccatctacatcgagctttactacattttcgctagtgtctggggtcaccggatctacaccatctacagcatcctctttattgtcttcataattctcatcatcgtcactgcttttataaccgttgccttgacttacttccaacttgctgctgaagatcaccaatggtggtggagatcattcctatgcggtggatcgaccggtttgtttatctacgcctactgcttatactattactatgcccgatcagacatgtctggttttatgcaaacctcgtttttcttcggatacatggcttgcatttgctatggattcttcttaatgcttggaactgtcggcttccgtgcagcccttctcttcgttcgtcacatataccggtcgatcaaatgcgagtaagaagtctttacaccaatcttcttacgttggttttcttcttcttcttctgcctcacgaattttgctagaacaaagaggacaaagagataacttgttcgaaagaagagagacacaagacaaatgtctgattattttcttaaaatagcatccttctcagtagaggttttactttaggtgagtctctcttcttctctctttattttgagctacagaaattaaattacttgtatccaatttccatatatttttacgtattgtaaaagacgaaaatacctttttcactgctttattggagtttctttgtatctaataaatgtcaaaactcttttttttcc

SEQ ID NO: 1765 - DNA, 2350 bp, Mimulus guttatus
cactctcccattaccgcgcgtggcatgattaacttcaaaattcatccatcttacagctaaatgagatcgagatctgtgctactctttctctctctaaaattcctctcctcgttttaaaactgtatttcacattataaacccattttcagtctgcgactcttactcgtttgtgacaaaaaaatggcgataggaggcgagtggcacgtcgtcgttttgctgctcctgtgcactgcttttcctgcggtaagatccgatgcatcagatcacaagttcaaagtcggagatccggtgccgctgtatgcaaacaaggtcggcccatttcataaccctagcgaaacataccgttactttgatctcccgttctgttctccaggtaatgtcaaagataaaagtgaagctcttggtgaagtgctaaatggagaccgtttggtcagtgctccatacaagcttgattttctggctgacaaagagtctgaagtcatctgcaaaaagcatctctcaaaggaagaagttgctgtgtttcgaagtgcggtagcaaaagactactattttcaaatgtactatgatgacttgcccatatggggtttcctcggaaaggttgacaaggaaggcaaagctgatcccagcgagtacaagtatcacctatttaagcatctccattttgaaatattttataataaagatcgtgtgattgagatcaatgcacgcacagaccccaatgctcttgtagatcttaccgacgataaggaagttgatgtggagttcgtgttctctgccaaatggaaggaaactaacattgaattcgataagaggatggagaagtactctcattcttcttctcttcctcgccacttagagatccattggttttcaattatcaattcgtgcgtgactgttctcctcctcactgggttccttgctacgattttgatgcgtgtgctaaaaaatgattttgtcaaatatgcccatgacgaggaggcagcagatgaccaagaagaaactgggtggaaatacattcatggtgatgttttcaggttcccaaagtacaagtctttgtttgctgctgccctcggaagtggcacacagctatttaccctgacgacttttatattcttacttgctcttgttggtgtattttatccttacaaccgtggagctctttttactgcgctggtggtcatatatgctcttacatctggcattgctgggtatactgcatcatctttctattgccagttagaaggaacaaattgggtcagaaatttattacttagtggaggtctgttctgtggtccgctttttctcacattctgcttcctaaacactgttgccattgcttaccatgcaactgccgctctcccgtttggtaccattgtggtgatttttctgatatgggctcttgtgacgtcacctttattagtgttgggaggtattgcaggaaagaatagtaaggcagagtttcaagctccagttcgtaccacaaaatatcctagagagattccaccgctaccttggtaccgttcaaccgtgcctcagatggctatggccggcttcttgccattcagcgcaatctatattgaactgtactacatatttgccagtgtctggggtcacaggatttacaccatttacagtattttattcattgtcttcattattctcctgatcgtcactgcgtttattactgtggcgttgacatacttccaacttgctgctgaagatcatgaatggtggtggaggtctttcctatgtggtggatctaccggcttgtttatctatagctactgcctttattactactatgcgcgatcggatatgtcaggcttcatgcaaacctcattcttctttgggtacatggcttgtgtatgctatgctttcttcctaatgctcggagctgttggtttccgtgctgctttattctttgtgcgccacatataccgctcgataaagtgcgaatgagaaatgagatttatccatattcctgccaaagtccaacagaagaagaatatgtagatcgcgggaaaaaggccgcgtgctatatgacgcaagtactgaaggaaaatgtctgttagggttttacgtattatgaaaggcatttatgagtaaaatgtagtttatttgtcgaaacttatatatcgaacggtagtgtagggtttttgactattcactatagtaggttgttcatcttttgaaaagattttgtataacaagacattaaagaggtgaaatattgttggcacttgcttcagttaacaaacatctctgtttattttgatcagtgcatttcatttaatttaaatttaaatggaatcaaataaatagtgaatgatggccaattgtgatcgactaa

SEQ ID NO: 1766 - DNA, 2173 bp, Gossypium raimondii
tctcatcatatatatattgcgttgcagaatttcacaaatcctatcacacgtcttcctttttctctcattattatcctacccaaaatgagaaactttggcaactctccggcctttgtaatcctcggagtttttatcctctcttgtgtttcccatgttagatccgacgcctccgaccaccgttacaaagaaggtgaccctgtccctctctacgccaacaaggtcggccctttccacaaccccagtgaaacctatcgctactttgatctgcccttctgttctccagatcatgtaaaggagaagaaagaagcattaggtgaggtattgaatggagatcgactcgtcagtgctccttataaactgaattttaaagaggaaaaagattcttccgttgtttgtaagaagaaactttcaaaggatgaggttgtctttttccgaaaggcggtcgaaaaagattattatttccaaatgtactatgatgatttgcctatctggggttttattggcaaagttgataaggaaggaaaagctgatcccagtgagtacaagtattacctttacaagcatatccagtttgatgtactctataacaaggaccgtgttattgagatcagcgcaaggatggatccacatttgctcgtggacttgactgaggataaggaagttgatgctgagtttatgtacactgtgaaatggaaggaaactgatactccttttgagaagaggatggagagatattccatgtcttcttctttgccgcatcatttagagattcattggttttcaattatcaactcttgtgtgacggttctccttttgactggtttccttgcaacaattctcatgcgggtcttgaagaatgatttcattaagtacggtcaagatgaagaagcagctgatgatcaagaagagactggatggaagtatattcatggagacgtattccgtttcccaaagtacaaatctctctttgctgctgctctcggatctggaacacagctgttcactttaacggtcttcatttttatgcttgcactggttggtgtcttttatccatacaacagaggagctctatttactgccctggtggtaatatatgccctcacgtcagggattgcaggctacgtagcaacttctttctactgtcagcttgaagggacaaactgggttaggaatctgttattgactggctgccttttctgtgggcccttgtttcttacattctgcttccttaacacagttgccattgcatacagtgcaactgcagcactgccttttggaactattgtagtaatagtcctcatatggacactcgtgacatctccattgcttgttctgggtggtattgctggcaaaaatagcagggctgagttccaagctccttgccgcaccacgaagtatcctcgagaaattccaccattgccttggtacaggagtgccattcctcagatggcaatggctggatttcttccatttagtgctatttacattgaactttactacatattcgccagtgtttggggccacaggatctatactatatacagcatcttgtttattgtattcataatccttctgattgtcacagcttttataactgtggctttgacatatttccaacttgctgctgaagatcatgaatggtggtggaggtctttcctctgtggtggatcaactggtctctttatctatgcctactgcttgtattattactatgcacgatcagatatgtctggttttatgcaaacctcgttcttctttggttacatggcgtgcatctgctacggattcttcctcatgctggggacagtgggtttccgtgcctcgctattctttgtgcgtcacatatacaggtctatcaagtgcgagtaggggttttagttgtcccttgccatttcccagcaattctgtcagagaaaaaaatctatggtttttgttagaaaattaactggaagattgaatgtcaattaacaaatgaggcatgctttgactatgcttaatggagatctacgaaatcattgtgtttattaatattttgactgtacgtaaagatgttgacagatttgtgtaggttgctgttactttaatacctctttggctcttttcaaccaaccaaagatctgtcctgtccctttacttgatgcagaaatccagttttctttaacagtctagttta

SEQ ID NO: 1767 - DNA, 1945 bp, Nicotiana benthamiana
agatctgtgctcttacctcccctctcccccactcaccccctaaacttctctatgtctaacaatatatacatacaacacacgcacgcagtaatatatacattcaatgaagaagaagatgacggtgacgtgttacgtcgtcgctttgataattttgtgttgtgttttaccggcgaggtcggacggttctgatcataagtacaaggccggagatccggtgcctttgtatgctaacaaggttggtcctttccataacccgagtgaaacgtaccgtttctttgatcttcctttctgtgcaccggctcatgtgaaagagaaaaaggaagctcttggtgaagtcttgaatggtgatcgattagtcagtgctccttacaagcttgactttatgtacgacaaggactcagaaatagtgtgcaaaaagaatttatccaaggaagaagtttctcaattccgcagtgctgttgctaaggactattacttccaaatgtattatgatgacttgcccatttggggtttcctagggaaagttgataaggatggaaaatctgaccccaacgaatataaatattatctgtttaaacatctccatttcgagatcttttacaacaacgatcgtgtggttgagataaatgcacgaactgatcctaatgccctggtagatatcacagaggacaaggaagtagatgttgacttcatctactctgtgaaatggaaggagacacctactccttttgagaagaggatggaaaaatactcgcagtcttcatcattgccacatcacctggaaattcattggttctcaattatcaactcctgtgtgacagttcttctcttaactggttttcttgccacaacttatgcgcgtccttaagaatgactttgtcaagtatgcacatgatgaggaggcagctgatgacctagaagaaagtgggtggaaatacattcatggtgatgtttttaggtacccgaagtataaatcattgttggctgcagcacttggttctggtactcaactctttacactgaccatctttattttcattcttgcacttgttggaattttctatccttacaaccgcggagctttattcactgcactagtcgtcatatatatgctctcacgtctggcattgctggctatactgcagcctcgttctattgccaactagaagggacaaactgggttagaaacttgatattgactggggggttgttttgtggaccactgattctcaccttctgctttcttaactccgttgccattggctacagtgccactgctgcactgccttttggaaccattgtggtcatctttctaatatgggctcttgtaacatcacctttgcttgtcttgggtgggatagatggaaagaactgcaaagcggagttccaagctccttgtcgtaccacaaagtatccaagagagatcccgtcattgtcctggtaccgcggaactctgcctcaaatggcgatggctgggtttttgcctttcagtgcgatatatattgaactttactacatatttgcaagtgtttggggtcacaggatttacacaatctacagtatcttgtttatagtcttcattatccttttaattgtcactgcttttataacggtggcgttgacatactttcaacttgctgctgaagatcatgaatggtggtggagggcattcctttgtggtggatcaactgggctgttcatctatggatattgcttatattactattatgcacattcggatatgacaggcttcatgcaaacctcattcttcttcggatacatggcttgcatctgctatggtttctttctcatgctcgggaacgttggtttccgcgcggctctatttttcgttcgtcacatataccgatcaatcaagtgcgagtagagttattgggtggtcttccatgtcttacagattgctttgcaaatttggtagggcaatctg

SEQ ID NO: 1768 - DNA, 2245 bp, Populus trichocarpa
ggcctctttttgacacgaaggttaaccgttttagcatcttgaagtcttcttcgagccacagcctgaaaagtatccatctttataactctctctctctatctctctatgctctgtttatgagttacagagagcgaaaatggagatgaaactagtgccttgtttggtagtctctattttgatcctatgcaatgtgacccgtgttagatcagatgcatctaataatcgttacaaagtaggtgatgatgtccctctttatgttaacaaagttggaccttttcacaatcccagtgaaacataccggtatttcgatcttcctttctgttcatcaggtcctacaaaggacaagaaggaagcccttggtgaactgttgaacggggatcgtttagtcactgccccatacaaacttgactttttaaatgacaaagactctgaaattgcttgcaaaaacaagctgacaaaggagcaagttgctcagttccgagaagcagtttccaaggactactacttccaaatgtactacgatgacttgcccatttggggtttcatagggaaagttgaaaaggaaggcaagaatgaccctagcgaatacaaatattacctctttaagcatcttcacttcaccatcttttacaacaaggatcgtgtcattgagataactgcactatccgatcagaaaaatgttgtggagctgactgaaaataaggaagttaatgtggagttcatgtattcagttaaatggaaggaaacagaaattccatatgagaaaaggatggagaaatattcacaatcttcttcactgcctcatcacttggaaattcattggttctcaattattaactcatgtgtgactgttctcctcttgactggttttcttgcaacaattctcatgcgagtcctgaagaatgattttgtcaagtatgctcacgatgaggagtcagctgaagaccaagaagagaccgggtggaagtacatccatggtgatgtatttagatatccgaagtataagtctgtacttgcggcagcagttggctctggcacccagctgtttactctcacaattttcattttcttactcgctctagttggtgtattttatccttataatcgcggagctcttttcaccgccctggttgtcatatatgccctcacagccggaattgcaggctacactgcagcctctttcttttgccaactggaaggaacaaactgggtcaggaacttgttgttaactggaggtctgttttgcggacctctgctcctcacattcagctttcttaatactgttgcaatcacatatagtgccactgcagcattgccttttggaaccatagtggtgatatttcttatttgggctttggtaacaacaccattgctggtacttggtgggattgctgggaagaatagcaaggctgagtttcaggctccttgccgcaccactaaatatccgagagagattcctttgttgccttggtatcggaaaacacttcctcagatggccatggctgggttcttacctttcagtgcaatctatatcgaactttactacatatttgccagtgtttggggtcacaggatctacaccatatacagcatcttgttcattgtcttcatcattctcttgattgtcactgcttttataacagtggcattgacatatttccaacttgctgctgaagaccatgagtggtggtggaggtctttcctctgtggtggatcaactggattgttcatttatggctattgcttgtattactactttgcaagatcggatatgtccggcttcatgcaaacctcatttttctttggctacatggcttgcgtttgttatggtttcttcctcatgcttggctccattggtttccgtgcttccttattttttgtccgccacatttaccattcaatcaagtgcgaatagcaagtgatatggtgttcatcatgttcaatgagaggagatgcagcaggtggcttggaagacatgctctgggatttcaagggctttatgccactgccttggagaatgattgcagattacatgtaggactttttgttatattatcttttatagtagaatatgtaggactttatatcatgcagtgcttgaatgtgagcacaagccgtctgttttgagtgtattgtaaggcattaaccgttatttaacggaaccctttttcagtgctatattgctgttaagtgcgtgtgttacaaataattcaagataatgatagctacacatattattttaaca

SEQ ID NO: 1769 - DNA, 2336 bp, Glycine max
gtgagcgtgaggtaaaacatcaaacattacagtgtggcggtgagtctacgtcactcaccccttttctttgtttctttccctcttccgtttattaacactcataccgcaccctcttcttcttcctctctttctctcttcttcgtcgctggccttgcctttcaagatccaaacctcttcccaatgaggaacctctctttcttcttcttcttcttcttcaccttcttcgccgccgtcagatctgatccctcagatcaccgctacaaagaaggcgaccccgtccctctctacgccaacaaagttggccccttccacaaccctagcgaaacctaccgttacttcgaccttcccttttgtgaaccaggtgatttgaaagagaagaaggaggcgctcggggaggtgctgaatggggaccgtttggttagcgcgccatacaagctggagttccagcgcgacaaggagttggtttccgtgtgcgacaggaagctctccaaacaggacgtggctcggttcagatccgcggtgaggaaggactactacttccagatgtactacgacgaccttcctatttggggcttcatagggaaggttgacaaggaagggaaggaccccagtgattataggtacttcctgtataagcacattcacttcgacgtcttctacaacaaggacagggtcattgagatcaatgtgcgcaccgatcccaatgcgctggtggatctcaccgaggatgctgaggttcaggccgagtttttgtacacggttaagtggaaggagactaacacgccattcgagaagaggatggacaagtactcgcagtcttcatcgctgccgcatcatttggaaatccactggttctcgattatcaactcctgtgtgacggtgttgctcttgaccgggttcctcgccaccattttgatgagggtgctcaagaatgattttgtcaagtatgcacatgatgaggagtctgcagaggatcaggaagagactgggtggaaatatatccatggggatgtgtttaggttccccaagtttaagtctctgtttgcggctgcgcttggatctggcactcagttgtttacccttacggtgttcatattcatattggcgcttgttggtgtgttttatccatacaatcgaggggcgctgtttactgcacttgttgtcatatatgcacttacttcagggattgctggatacactgcaacttcattctattgtcagttggaaggaacaaactgggttaggaatctgctgttgactggatgccttttctgtggacctctgtttctgactttctgctttctgaacactgttgcaattgcttacaaagctactgctgctcttccatttgggacgattgtggttatagttctcatatggtcacttgttacgtctcctttgcttgtattgggaggcattgccgggaagaatagcaaggctgaatttcaagctcctgttcggacaactaaatatccaagggagattccacctctgccttggtatcgtggaacaattcctcagatggcgatggcaggatttttgcctttcagtgctatatacattgaactttactatatatttgccagtgtttggggccacagaatttacaccatctacagcatcctgttcattgtcttcatcattctcttgattgttactgctttcatcactgtggcattgacatacttccagcttgctgctgaggatcatgagtggtggtggagatcattcctatgtggtggttcaactgggttatttatctatgcctactgtctgtattactactatgcacgctccgacatgtctggattcatgcagacctcatttttcttcggatacatggcctgtatatgctacggtttcttcttaatgcttggaactgttggattccgtgctgctttgctctttgtccgccacatttatcgatccattaagtgtgagtaggcattttgtcctctcaagtccactagagcaattgtcttcatttcatagggaattctgtagaaaaattatagtaattttgcagttcttttgtgtactataagggaagctgggttgggtgggtttctggcttccagagcaacttgttagatggcaaagggtgcttttggggataacgtctgtgtactaccatctctttaaccaaactcttgcaatactttttggtccttatgaacattcttcaacatgtcaattttctaccggtgtcaacatttaagttttccataaagattattgcaaatccaaattgtaacacatctggggcatctctacattaaaagtgttggaaatcttatcagatattacctgcgagtacctattttgagacagaaaat

SEQ ID NO: 1770 - DNA, 2305 bp, Glycine max
aacattacagtgtggcggtgagtctacgtcactcaccccttttctttgtttctttccctcttccgtttattaacactcataccgcaccctcttcttcttcctctctttctctcttcttcgtcgctggccttgcctttcaagatccaaacctcttcccaatgaggaacctctctttcttcttcttcttcttcttcaccttcttcgccgccgtcagatctgatccctcagatcaccgctacaaagaaggcgaccccgtccctctctacgccaacaaagttggccccttccacaaccctagcgaaacctaccgttacttcgaccttcccttttgtgaaccaggtgatttgaaagagaagaaggaggcgctcggggaggtgctgaatggggaccgtttggttagcgcgccatacaagctggagttccagcgcgacaaggagttggtttccgtgtgcgacaggaagctctccaaacaggacgtggctcggttcagatccgcggtgaggaaggactactacttccagatgtactacgacgaccttcctatttggggcttcatagggaaggttgacaaggaagggaaggaccccagtgattataggtacttcctgtataagcacattcacttcgacgtcttctacaacaaggacagggtcattgagatcaatgtgcgcaccgatcccaatgcgctggtggatctcaccgaggatgctgaggttcaggccgagtttttgtacacggttaagtggaaggagactaacacgccattcgagaagaggatggacaagtactcgcagtcttcatcgctgccgcatcatttggaaatccactggttctcgattatcaactcctgtgtgacggtgttgctcttgaccgggttcctcgccaccattttgatgagggtgctcaagaatgattttgtcaagtatgcacatgatgaggagtctgcagaggatcaggaagagactgggtggaaatatatccatggggatgtgtttaggttccccaagtttaagtctctgtttgcggctgcgcttggatctggcactcagttgtttacccttacggtgttcatattcatattggcgcttgttggtgtgttttatccatacaatcgaggggcgctgtttactgcacttgttgtcatatatgcacttacttcagggattgctggatacactgcaacttcattctattgtcagttggaaggaacaaactgggttaggaatctgctgttgactggatgccttttctgtggacctctgtttctgactttctgctttctgaacactgttgcaattgcttacaaagctactgctgctcttccatttgggacgattgtggttatagttctcatatggtcacttgttacgtctcctttgcttgtattgggaggcattgccgggaagaatagcaaggctgaatttcaagctcctgttcggacaactaaatatccaagggagattccacctctgccttggtatcgtggaacaattcctcagatggcgatggcaggatttttgcctttcagtgctatatacattgaactttactatatatttgccagtgtttggggccacagaatttacaccatctacagcatcctgttcattgtcttcatcattctcttgattgttactgctttcatcactgtggcattgacatacttccagcttgctgctgaggatcatgagtggtggtggagatcattcctatgtggtggttcaactgggttatttatctatgcctactgtctgtattactactatgcacgctccgacatgtctggattcatgcagacctcatttttcttcggatacatggcctgtatatgctacggtttcttcttaatgcttggaactgttggattccgtgctgctttgctctttgtccgccacatttatcgatccattaagtgtgagtaggcattttgtcctctcaagtccactagagcaattgtcttcatttcatagggaattctgtagaaaaattatagtaattttgcagttcttttgtgtactataagggaagctgggttgggtgggtttctggcttccagagcaacttgttagatggcaaagggtgcttttggggataacgtctgtgtactaccatctctttaaccaaactcttgcaatactttttggtccttatgaacattcttcaacatgtcaattttctaccggtgtcaacatttaagttttccataaagattattgcaaatccaaattgtaacacatctggggcatctctacattaaaagtgttggaaatcttatcagatattacctgcgagtacctattttgag

SEQ ID NO: 1771 - DNA, 2217 bp, Eutrema halophilum
tttgattgaagtctggtatataaatatcgtcgttatttcctccatttatcattcttcgaaataaaaaacaaactcagatctcacgatttggaggagaaaacacaatgaggacaccgacgctgctgctcctctttgtcggagctctcatcttttccggcgccggctatgtcagatccgacgcatcagaccaccgttacaaggaaggagacaccgttcctctctacgccaacaaggtcggcccatttcacaacccaagtgagacgtatcggtattttgatcttcccttctgtgtcccagagggtgtgaaagagaagaaagaagctcttggtgaggttctgaatggtgatcggcttgttagtgctccgtacaagctcaacttcagagatgaaaaagagtctgaagtgtactgcaaaaagaagcttagtaaagaagaggtcaaacagttccgaaaggctgtcgagaaggactactacttccagatgtattatgatgatctgcctatctggggattcattggaaaggttgacaaggatatcaaatctgatccgagtgaatacaaatatttcctgtacaagcacatccagtttgaaattctatacaacaaagaccgtgtgatcgaaatcagtgccagaatggatcctcattcgcttgtggatctcactgaggacaaggaagttgatgcagagtttatgtacactgtgaagtggaaggaaaccgagactccgtttgagaaaaggatggagaagtactctatgtcttcttctctaccacatcacttggaaatccactggttctccatcataaactcctgcgtcactgtccttttgttgactggattccttgcaactatcttgatgcgagtccttaagaatgatttcatgaagtatgctcaagacgaggaggctgctgatgatcaagaagaaactggatggaagtacattcatggcgatgtgtttagattcccaacgcacaattctttgtttgccgcatcacttggtagtggtacccagttgttcactctcaccatattcattttcatgcttgctcttgttggagttttctatccatacaaccgaggagcactctttaccgctttggtggtcatttacgctctaacttctggaatcgctggatacacatccgcctctttctactgccaacttgaaggcaaaagctgggtgagaaacttgttactcactggatgtctcttctgtgggcctttattcctaaccttttgcttccttaacaccgtagcgatcacctacactgcaaccgcagcattaccctttggtaccatcgtggtaattgtcctaatatggactctagtcacatcgcctttactcgtgttaggtggtattgctggtaaaaacagcaaagcagagttccaagcaccatgccgcacaaccaaatatccccgtgagattccgccactcccttggtacagaagcgctgttcctcagatggccatggctggttttcttcctttcagtgccatctacatcgagctttactacattttcgctagtgtctggggtcaccggatctacaccatctacagcatcctcttcatcgtcttcatcattctcatcatcgtgactgctttcataaccgtcgccttgacttacttccaactcgctgctgaagatcaccaatggtggtggagatcattcctatgcggtggatcgaccggtttgtttatctacgcgtactgcttatactattactacgcgcgatcagacatgtcgggttttatgcaaacatcgtttttcttcggatacatggcttgcatttgctacggattcttcttaatgcttgggactgttggcttccgcgcagctctccttttcgtccgtcacatttatcggtcgatcaaatgcgagtaagaagtctttacaccaatcttcttacgttggttttcttcttcttctgcctcacgaattttgctagaacaaagaggacaaagagataacttgttcgaaagaagagagacacaagacaaatgtctgattattttcttaaaatagcatccttctcagtagaggttttactttaggtgagtctctcttcttctctctttattttgagctacagaaattaaattacttgtatccaatttccatatatttttacgtattgtaaaagacgaaaatacctttttcactgctttattggagtctctttgtatctaataatagccataactcttatttttccctt

SEQ ID NO: 1772 - DNA, 2408 bp, Populus trichocarpa
gttaattaaaggaagccgtctttcgacacgaaggcacagccctaaggagttcccaaatttataaccctgcctgatctctcgctcgatgcatctgtgagatacagagagaaaatggagaagaaactagttccttgtttggtagtctctattttgatcctatgcagtgtgacccttgttagatcagatgcatctgataatcgttacaaagtaggagaggacgtccctctctatgtcaacaaggttggaccttttcacaatcccagtgaaacataccggtatttcgatctgcctttctgttcatcgggtcctacaaaggacaagaaggaagcccttggtgaactgttgaatggggatcgtttagtcactgccccgtacaaacttgactttttaaacgacaaagactctgaaattgcttgcaaaaacaagctgacaaaggagcaagttgctcagttccgagaagcaatttccaaggacttctacttccaaatgtactacgatgacttgcccatttggggtttcatagggaaagttgaaaaggaaggcaagaatgaccctagcgaatacaaatattacctccttaagcatcttcacttcaccatcttttacaacaaggatcgtgtcattgagataactgcactatccgatccgaaaaatgttgtggacctgactgaagataaggaagttaatgtggagttcatgtattcagttaaatggaaggaaacagaaattccatatgagaaaaggatggagaaatattcacaatcttcttcactgcctcatcacttggaaattcattggttctcaattattaactcatgtgtgactgttctcctcttgactggttttcttgcaacaattctcatgcgagtcctgaagaatgattttgtcaagtatgctcacgatgaggaatcagctgaagaccaagaagagaccgggtggaagtacatccatggtgatgtatttagatatccaaagtataagtctgtacttgcggcagcagttggctctggcacccagctgtttactctcacatttttcattttcttactcgctctagttggtgtcttttatccttataatcgtggagctcttttcactgcattggttgtcatatatgcccttacagctgggattgcaggctacactgcagcctctttcttttgccaactggaaggaacaaactgggtcaggaacttgttgttaactggaggtctgttttgcggacctctgctcctcacgttcagctttcttaatacagttgcaatcacatatagtgccactgcagcattgccttttggaaccatagtggtgatatttcttatttgggctttggtaacaacaccattgctggtacttggtgggattgctgggaagaatagcaaggctgagtttcaggctccttgccgcaccactaaatatccgagagagattcctttgttgccttggtatcggaaaacacttcctcagatggccatggctgggttcttacctttcagtgcaatctatatcgaactttactacatatttgccagtgtttggggtcacaggatctacaccatatacagcatcttgttcattgtcttcatcattctcttgattgtcactgcttttataacagtggcattgacttatttccaacttgctgctgaagaccatgagtggtggtggaggtctttcctctgtggtggatcaactggcttgttcatttatggctattgcttgtattactactttgcaagatcagatatgtccggcttcatgcaaacctcatttttctttggctacatggcctgcgtttgttatggtttcttcctcatgcttggaagcattggtttccgtgcttccttgttctttgtccgccatatttaccactcaatcaagtgcgagtaggaagtcatatggttttcattgtgttcagtgagtaggatcccttactttctcttagcaggcttaattgaaggaaactctgctcatttgtattgatgaaggtagtcttctatcgtttcgcattatgttacaggagaagcaacagttggctgggaaaatgtcttctgggattgcaggagcctttatcccactactttgaaggatgaccgcacatcaaatggaggacttctgtaataacctttttttgataggagaggaacatataggaccttagaatgctgttataagaatttgtggtgcttaaatgtgagcacaagccatcgttttgaatgtattctagaactgtaagaagccttagaatttgtgttcctggtagcagcactttgaacattcttatttccacaatttattacagcagcaagatatatttcccatcattcatttatttcgggggttaaactagaaaacttgagcatggcgatgaaacctaaccggtaatttttaaaaatatgcaagtaatt

SEQ ID NO: 1773 - DNA, 2301 bp, Populus trichocarpa
aaaaaaatataaaaacaaaaaaaaaatctcactccttgtgttaattaaaggaagccgtctttcgacacgaaggcacagccctaaggagttcccaaatttataaccctgcctgatctctcgctcgatgcatctgtgagatacagagagaaaatggagaagaaactagttccttgtttggtagtctctattttgatcctatgcagtgtgacccttgttagatcagatgcatctgataatcgttacaaagtaggagaggacgtccctctctatgtcaacaaggttggaccttttcacaatcccagtgaaacataccggtatttcgatctgcctttctgttcatcgggtcctacaaaggacaagaaggaagcccttggtgaactgttgaacggggatcgtttagtcactgccccatacaaacttgactttttaaatgacaaagactctgaaattgcttgcaaaaacaagctgacaaaggagcaagttgctcagttccgagaagcagtttccaaggactactacttccaaatgtactacgatgacttgcccatttggggtttcatagggaaagttgaaaaggaaggcaagaatgaccctagcgaatacaaatattacctctttaagcatcttcacttcaccatcttttacaacaaggatcgtgtcattgagataactgcactatctgatcagaaaaatgttgtggagctgactgaaaataaggaagttaatgtggagttcatgtattcagttaaatggaaggaaacagaaattccatatgagaaaaggatggagaaatattcacaatcttcttcactgcctcatcacttggaaattcattggttctcaatcattaactcatgtgtgactgttctcctcttgactggttttcttgcaacaattctcatgcgagtcctgaagaatgattttgtcaagtatgctcacgatgaggaatcagctgaagaccaagaagagaccgggtggaagtacatccatggtgatgtatttagatatccaaagtataagtctgtacttgcggcagcagttggctctggcacccagctgtttactctcacaattttcattttcttactcgctctagttggtgtattttatccttataatcgcggagctcttttcaccgccctggttgtcatatatgccctcacagctggaattgcaggctacactgcagcctctttcttttgccaactggaaggaacaaactgggtcaggaacttgttgttaactggaggtctgttttgcggacctctgctcctcacgttcagctttcttaatactgttgcaatcacatatagtgccactgcagcattgccttttggaaccatagtggtgatatttcttatttgggctttggtaacaacaccattgctggtacttggtgggattgctgggaagaatagcaaggctgagtttcaggctccttgccgcaccactaaatatccgagagagattcctttgttgccttggtatcggaaaacacttcctcagatggccatggctgggttcttacctttcagtgcaatctatatcgaactttactacatatttgccagtgtttggggtcacaggatctacaccatatacagcatcttgttcattgtcttcatcattctcttgattgtcactgcttttataacagtggcattgacatatttccaacttgctgctgaagaccatgagtggtggtggaggtctttcctctgtggtggatcaactggattgttcatttatggctattgcttgtattactactttgcaagatcagatatgtccggcttcatgcaaacctcatttttctttggctacatggcttgcgtttgttatggtttcttcctcatgcttggctccattggtttccgtgcttccttattttttgtccgccacatttaccattcaatcaagtgcgaatagcaagtgatatggtgttcatcatgttcaatgagaggagatgcagcaggtggcttggaagacatgctctgggatttcaagggctttatgccactgccttggagaatgattgcagattacatgtaggactttttgttatattatcttttatagtagaatatgtaggactttatatcatgcagtgcttgaatgtgagcacaagccgtctgttttgagtgtattgtaaggcattaaccgttatttaacggaaccctttttcagtgctatattgctgttaagtgcgtgtgttacaaataattcaagataatgatagctacacatattattttaacacctgtttttttagaatatattaaaataatattttttaatttt

SEQ ID NO: 1774 - DNA, 2263 bp, Solanum lycopersicum
ctttctcttctacacacaacaaaggaaaattccactgtacctaaaaagagagtttcaaaggaagaaacaatctttggtatttttgttttcttcttctgtatgtgagtaaagaaaaaaatggcgaggaagagtagaatggggtgtgggaattacgctgtcgtattggtgcttttgttctttggggctatgaaagtgagatcggattcatcagaccataagtataaatctggagaagaagtccctttgtatgcaaataaagttggtccttttcataatccgagcgaaacatatcgctactttgatcttcctttttgttctccaggtcatgtaaaagataaaactgaagctcttggtgaggtgttgaatggagatcgtttagtcactgctccatacaaacttgacttcacaaatgatcgagaaaccgaggtagtttgcaagaagacattgtcaaaggaagaagttgcaagattccgtgatgctgttgccaaggactactacttccagatgttctatgatgaccttcctatttggggtttcattggtaaggtagataaggaggggaaagctgaccccagtgagtacaaatattacctatttaaacatcttcattttgacatccatcacaacaaagaccgtgtgattgaagtcaatgcacgaactgaccccaatgcgctagtggacataactgaagataaggaaattgatgtagacttcatgtactctgtaaaatggaaggaaacagaaatcccttttgagaaaaggatggaaaagtactcgcagacttcagctttaccacatcatttggagatccactggttctctatcattaattcttgtgtcacagttctgctcttaactggtttccttgctactattctgatgcgcgtccttaaaaatgactttgtcaaatatgcccatgatgaggaagcagctgatgaccaagaagaaactgggtggaagtacattcatggtgatgtgtttaggtacccgaagcagaagtcactttttgcagcagccctgggttctggcacacagttgtttaccctggcaattttcatatttatacttgcgcttgttggtgtgttttacccctacaaccgaggagctcttttcacagctttggtggttatttatgctcttacatcaggaattgcaggctatactgcagcatcattctattgtcaacttgaagggaaaaattgggtaaggaacttgttgttgacaggaggtctgttctgtgggccgctgcttctaactttctgcttccttaattctgttgcaattggttatcatgccactgcagcacttccttttggtaccatcgtggtcattttcctcatatgggcccttgtgacatcaccattgcttgtcttgggaggaattgcaggaaagaatagcaaggcagaatttcaagctccaactcgaacaacgaagtatccgagagagataccacaattaccatggtatcgcggagctcttcctcagatggcaatggctgggttcttgcctttcagcgctatctacattgaactctactacatatttgccagcgtgtggggtcataggatttacacgatttacagtatcttattcatagttttcatcattctgatcattgtcactgcatttattacggtggctttgacatacttccaacttgctgcggaagaccatgaatggtggtggaggtcattcgtttgtggtggatcaaccggcttgttcatctatggctactgcctgtattactattatgcccgatcagacatgtcaggtttcatgcaaacctcattcttctttggttacatggcttgcatttgctatgccttctttctcatgcttggaactgttggtttccgagctgctttgtttttcgtccgccacatataccgttcaatcaagtgcgagtaagatgcagaattccacattagcctggttcaaccggggcttgtgtttttggtgtaaaaatcgtcaacgtgcttggagtagtgcaacacatgttagatccatttagaatttgtgtggagcaacaaagcagaagaaaatatgttgacagaagaagttcgaatcaatgctctttttattgagtttagaacaaacttacaaagagtctataattagtttttagcttcagcttaattttcctagttttaaccttcttaatatatagaatatggttctgttaattgcatcctaagctgtttatgttccaatttgtcgtgttattcatacttgttacagtcacctagttttcaacgcttcaaac

SEQ ID NO: 1775 - DNA, 2407 bp, Phaseolus vulgaris
gtgtaccaaactgagaacccaaacaatgggtggttaaagcagcgtttgggcagagagaaatagaagaaggaattgtgtgcgtgaggtaaaacatcaaacgttacagtgtggcggtgagtctacgtcacttgataatactcattcgcgttttccgtttattagcactcaaaccgcacctcttctccttcgtctcttctcttctcttcttcgtcggtggggttggatttcgagatccaaacctcttcccaatgaggaacctcttctcttcctcctcttccttctgcctcctcctcttcaccgccttcgccgcgctctccgccgtcagatctgactcctcagatcaccgctacaaacaaggcgacatcgtccctctctacgccaacaaagtcggccccttccacaaccctagtgaaacctaccgttatttcgaccttcctttctgtcctccagttgatttgaaagaaaagaaggaggcgcttggggaggtgctgaatggggaccgtttggttagcgcgccatacgttctagaatttcaacgtgacaaggagtcggttcatgtttgcgacgctaagctatcgaaaaaggatgtggcgaggttcagatctgctgtccgtaaggactactacttccagatgtactatgacgaccttcccatttgggggttcattgggaaggtggacaaggaagggaaggaccctagtgagtataggtatttcctgtataagcacattcactttgatgtgttctacaacaaggacagggtcatcgagatcaatgtacgcactgatcccaatgccctcgtggatctcactgaggatgctgaggtgaatgccgagtttcagtatacggtgaagtggaaggagaccaacacgccctttgagaagaggatggataagtactcacagtcgtcatcgctgcctcatcatttggaaatccactggttctcaattatcaactcatgtgtcacggtgcttctcttgactgggttcctcaccaccattttgatgagggtgctcaagaacgattttgtcaagtatgcacatgatgaggagactgcagaggatcaggaagagactggctggaaatatatccatggggatgtgtttaggtttcccaagttcaagtctctatttgcagctgcgcttggatctggcactcagttgtttacccttactttgttcatattcatattggcacttgttggagtgttttatccatacaatcgaggagcgttatttactgcacttgttgtcatatatgcacttacttccgggattgccgggtatactgcaacttcattctattgtcagctggaaggaacaaactgggttaggaatctgctgttgacaggatgccttttctgtggtcctctgtttctgacgttctgctttttgaacactgttgcaattgcttacaaggcgactgctgccctcccatttgggacaattgtggttatagttctgatatggacacttgttacatctcctttgcttgtattgggagggatagctgggaagaacagcaaggttgaatttcaagctcctgttcgcacaactaaatatccaagggagattccacctctgccatggtatcgtggaccaattcctcagatggcgatggcaggatttttgccttttagtgctatatacattgaactttactatatatttgccagtgtttggggccacagaatttataccatctacagcatcctgttcattgtcttcatcattctcttgattgttactgctttcattactgtggcattgacatacttccagcttgctgctgaggatcatgagtggtggtggagatcattcctttgtggtggttcaactgggttatttatctatgcctactgtctgtattactactatgcacgctccgacatgtctggattcatgcagacctcattttttttcggatacatggcctgcatatgttatggtttcttcttgatgctgggaactgtaggattccgtgctgcattgctctttgtccgccacatttatcgatccatcaagtgtgagtaggcattttgtcctctcgagtccactagagctattgtcttaatttcatagggcattctgtagaaaattatagtaattttgcagttctttctcgtgtactataagggaagctgggttgggtgggtttctagcttccagagcaactttttaaatggcaaagggtgcttttgggataacgtctgtgtactaccatatctttaaccaaactcttgcaatactttttggtccttttgaacgaacgttcttcttcatgtcaattttctacctttgtcaaaacatttaagttttccttagagattatggtaaatccatgttgtaacacgtttctctacgtgaaaagatttagaaatcttatcagatattattttatctcccag

SEQ ID NO: 1776 - DNA, 2169 bp, Arabidopsis thaliana
aaaaatataaagcaaactcagatctcacgattttcttcttcctctcacattaacacacatcatcatgagattaccaacgacgctgctcctctttatcggagctctcatcttctccggcgccggaaatgtcagatccgatgcctccgaccaccgttacaaggacggtgactccgttcctctctacgccaacaaggtcggcccctttcacaatcccagtgagacgtatcgctatttcgatctccccttttgtattccagagggtgtgaaagataagaaggaagctcttggtgaggttttgaatggggataggcttgttagtgctccatacaagcttaactttagagatgagaaagactcagaggtgtactgtaaaaagaagcttagtagagaagaagttgaacactttcgaagagctgttgaaaaagattattactttcagatgtattatgatgatttgcctatttggggattcattgggaaggtggacaaagagagcaaatctgatcctagcgagtttaaatattttctctacaaacacatccagtttgagattttgtacaataaggatcgggtgattgaaatcaatgctagaatggatcctcattcgcttgtggatcttactgaggataaggaagtcgatgctgagtttatgtacactgtgaagtggaaggaaactgagacttcttttgagaaaagaatggataagtatgctatgtcttcttctcttccacatcacttggaaatccactggttctccattattaactcctgcgtcactgtccttcttttgactggtttccttgcaaccatcctgatgcgggtcctcaagaatgatttcatgaagtatgctcaagatgaggaagctgctgatgatcaagaggaaaccggatggaaatacattcatggagatgtcttccggttcccaaagaacaaatctctctttgctgcatctcttggtagcggtacccagttgttcactctgaccatcttcattttcatgctttcacttgttggagtgttctatccatacaaccgtggagcactcttcactgctttggtcgttatctatgctctcacatctggaattgccggatacactgcctcctctttctactgtcaactcgaaggaaagaattgggtgagaaatttgctgctaactggaggtctcttctgtggcccactatttctcaccttctgcttcctaaacaccgttgcaatcgcatacagtgcaactgccgctcttccctttggaaccatcatagtgatcgtcctcatatggacactagtcacttcgcctttacttgtgttgggtggtattgccggtaaaaacagcaaagctgagttccaagctccagtccgcaccactaagtatcctcgggagatcccgccactcccatggtacaggagtgctgtaccgcagatggccatggctggatttcttcctttcagtgccatctacatcgagctatattacatctttgccagtgtttggggccatcgtatctataccatttacagcatcctcttcatcgtcttcatcatcctgttgatcgtcactgcttttataacagttgcccttacttacttccaactcgctgctgaagatcatgaatggtggtggagatcattcctatgtggtggatcgactggtctgtttatatatgcgtactgcttatactactactacgcaagatcagacatgtctggtttcatgcaaacatccttcttcttcgggtacatggcttgcatttgttacggtttcttcctcatgcttggaaccgttggcttccgcgctgctctcctcttcgtccgccacatttaccggtcgattaaatgcgagtaaaactgttactgccaatcaccctcccccttacgatttttggtagaacaaagaagatgataatctgttcttaggtagataaagaagaagacttcttcgaagccagaaactgaataccaaatcgctctgtggtcacattttttttcctttttgttaaaatgttttgtggcagtttgttttctgtgatatgatttatagacgaaactatgtttgtttaggtgaagtctttctcttctctactactttagagagttatcttctttttttggtaattaattaagataactttgtaaccttttttttattgatctatatatattctaaagacg

SEQ ID NO: 1777 - DNA, 2053 bp, Eutrema parvulum
ctccaaaatataaagcaaaatcagatctcacgattttccctcacagaaacaccatgaaaataccgacgacgctgctcctctttatcggagctctcatcttctccggcgccggaaatgtcagatccgatgcctccgaccaccgttacaaggaaggcgactccgttccgctctacgccaacaaggttggcccgtttcacaatcccagtgagacgtatcgctatttcgatctcccattctgtgttccagagggtgtgaaagataagaaggaagctcttggtgaggttttgaatggggaccggcttgttagtgctccatataagcttagcttcagagatgaaaaagactcagagacatactgcaaaaagaagcttagcagagaagaagtcgaacagtttcgaagggctgtcgaaaaggattattacttccagatgtactatgatgatttgcctatctggggattcattggaaaggtcgacaaagagagcaaagcagatccgagcgagttcaaatatttcctctacaagcacatccaatttgagattttgtataacaaggaccgagttatcgaaatcaatgctagaatggatcctcattcgcttgtggatctcactgaggacaaggaagtcgatgcagagtttatgtatactgtgaagtggaaggaaaccgagacctcgtttgagaaaagaatggataagtacgccatgtcgtcttctcttccacatcacttggaaatccactggttctccattataaactcctgcgtcactgtcctgcttttgaccggtttccttgctaccatcttgatgcgagtcctcaagaatgatttcatgaagtatgctcaagatgaggaagctgctgatgatcaagaggaaactggatggaagtacattcacggggatgtgttccgattccctaagtacaaatcactctttgctgcatctctcggtagcgggacccaattattcactctcaccatatttatcttcatgctttcacttgttggagtgttctatccatacaaccgaggagcgctcttcaccgctttggttgttatctacgctctcacttctggaatcgccggatacaccgcctcctctttctactgtcaactcgaaggaaagaactgggtgagaaatttgttgctcactggaggtctcttctgtggaccactattcctcaccttctgcttcttaaacaccgttgcaatcgcctacagcgcaaccgctgctcttccctttggaaccattgttgtgatcgtcctcatatggacactagtcacttcgcctttgcttgtattgggtggaatcgctggtaaaaacagcaaagcagagttccaagctccttgccgcaccactaaatatcctcgggagatcccgccactcccatggtacaggagtgctatacctcagatggccatggctggttttcttcctttcagtgccatctacatcgagctatattacatctttgccagtgtttggggccatcggatttatactatttacagcatcctcttcattgtcttcatcatcctcttgatcgttaccgcttttataaccgttgccctgacttacttccaacttgccgctgaagatcatgaatggtggtggagatcattcctatgcggtggatcgactggtttattcatctatgcgtactgcttatactattactacgcaagatcagacatgtccggcttcatgcaaacctccttcttcttcggatacatggcttgcatttgttacggtttcttcctcatgcttggaacggtgggcttccgcgccgctctcctcttcgtccgccacatttaccggtcgatcaaatgcgagtaaaagtgttgctgccaatcactccgtcaaaaagcttcccttacgattttttggtagaacgaagaagatgaaaaagagttccgtcctttaggtagataaagacttcttttaaagccagaaaccaaaaatatcaaatggctttaaggttttattttcttagggctgttttattataagtggtcaagttttttttgcctttctttttaaaatgtttgtgtgaaact

SEQ ID NO: 1778 - DNA, 2180 bp, Nicotiana benthamiana
tcaaagagagactttttcatttatgtgagtgagaaacccaaaaaatggtgaagaagaacagtatggggtgtggtgattacgtcgtcgttttggcgcttttgctctttggagctacgattgtgagatcagattcatcagatcacaaatacaaaaatggagaagaagttcctttatatgcaaacaaagttggcccttttcataaccctagtgaaacatatcgctactttgatcttccattttgttctccaggtcatgtgaaagataaaacagaagctcttggtgaggtgttgaatggggatcgtttagtcactgctccgtacaagcttgactttctaagtgatcgagaaactgaagttgtttgcaagaagtcattgtcgaaagaagaagttgcaagattccgtgacgctgttgccaaggattactacttccagatgttctatgatgatctgcccatttggggtttcattggtaaggtagataaggagggaaaatctgaccccagtgagtacaaatactacctttttaaacatcttcattttgacatccatttcaacaacgatcgcgtgattgaagttaatgcacgaactgaccccaatgccctcgtcgacataaccgaaggtaaggaagttgatgtagacttcatgtactcggtcaaatggaaggaaacggacatcccttttgagaaaaggatggaaaagtactcgcagacttcagctttaccacatcatttggagatccactggttctctatcattaattcttgtgttacagttcttcttttaactggtttccttgccacaattctgatgcgagtccttaaaaatgactttgtcaaatacgcccatgacgaggaatcagctgatgaccaagaagaaactgggtggaagtacattcacggcgatgtgtttaggtacccgaagcggaactcactttttgcagcagccctgggttctggcacacagttgtttaccctgacaattttcatattcatacttgcgcttgttggtgtgttttacccctacaaccgaggagctcttttcacagctttggttgttatttatgctcttacatcaggaattgcaggctatactgcagcatcattctattgccaacttgaaggaaaaaattgggtaagaaatttgttgttgacaggaggtctgttctgtggaccgctgtttctcacattctgcttccttaatactgttgcaattgcttatcatgcaactgcagcacttccattcggtaccatcgttgtcattttcctcatttgggcccttgtgacatcaccattgctcgtcttgggaggaatcgcaggaaagaatagcaaggcagaatttcaagctccatgtcgaacaacgaaatatccaagagagataccacaattaccctggtatcgtggagctcttcctcagatggcaatggctgggttcttgcctttcagcgccatctacattgagctctactacatatttgccagcgtgtggggtcataggatttacaccatttacagtatcttattcatagttttcatcattctgatcattgtcactgcatttatcacggtggctttgacgtacttccaacttgctgcagaagatcatgaatggtggtggaggtctttcctttgtggtggatcaactggtctgttcatctacggatactgcctgtattactattatgcccgatcagacatgtcaggcttcatgcaaatctcattcttctttggttacatggcttgcatatgctacgccttctttctcatgctcggaactgttggtttccgggcggctttatttttcgtccgccacatataccgttcaatcaagtgcgagtaagatgcagaattccacagtgtcttggttcaactggagcctgtgtttttggtgtaaaaattgtcaacatgcttggagtagtgcagcacatttcctgatatacaaagggttaggtccatttagaattggtttggagcaaaacaaagaagaagatatgtcgaagaagaagatgctcaaatcagttttcaggtggcagctttatgttgaacagtggtttttattgtgtttaggaactctgtgtaacaatgagtctattagttagctcagcttatttatcctagttttaacctttttgatatataaactatggctttgttaattgcattcttagctgtttatgctccaagt

SEQ ID NO: 1779 - DNA, 2121 bp, Gossypium raimondii
cttttcattctggtttttcgacactccaaattttcagatttcctttcctttctcaccggaaaatgaaaaacatgggcgactttccgacgtttctagtcgtcgcacttttgatcttcagttgtctttcctatgttagatccgacgcttccgatcaccgttacaaggacggtgacgctgtacctctttacgccaataaggttggcccctttcacaaccccagtgaaacctatcgctacttcgatctacccttctgttctccagatcatgtaacggagaagagagaagctttaggtgaggttttgaatggagatcgactcgtgagtgctccttataaattgaattttaaagaggaaaaagattcttctgttgtttgtaagaagaagcttttaaaagatgaggttgcctttttccgaaaggctgttgacaaggactattatttccaaatgtactatgatgatttgccaatctggggttttatcggaaaagttgataaggaaggaaaaactgatccgagcgagtacaaatatttccttttcaagcatatccagttcgatgtcctttataacaaggaccgtgttattgaggttaatgcaaggatggatcctcactcgcttgtggacttgaccgaggataaggaagttgatgctgagttcatgtattctgcgaaatggaaggaaactgaaactccttttgagaaaaggatggacaagtactcaatgtcttcttctttgccacatcatttggagattcattggttttcgattatcaactcttgcgtcacagttctccttttgactggtttccttgcaacgattctcctgcgggttttgaagaatgatttcatcaagtatggtcaagatgaagaagcagctgatgaccaagaagaaactggatggaaatatattcacggagatgtattccggttcccaaagtacaaatctttgtttgctgctgctcttggatctggaactcagctgtttactttaaccgttttcatttttatgcttgcattggttggtgtcttttatccgtacaatcgaggagctctattcactgcccttgtggtcatatatgcacttacatcaggaattgcaggatatactgcaacttctttctattgtcagcttgaaggaaacaactgggttaggaatctcttattgactggctgtcttttctgtggtccgttgtttctcacattctgcttccttaacacggttgctattgtatacagtgcaactgctgcactgccttttggaactattgtagtaatagtccttatatggacactagtgacatctccattgcttgttctgggtggaattgctggcaaaaatagcaaggctgagttccaagctccttgccgcaccacaaagtatcctcgagagattccaccattgccatggtacaggagtgccattcctcagatggcaatggctggatttcttccttttagtgccatctacattgagctttactacatattcgccagcgtttggggccacaggatctatactatatacagcatcttgtttattgtcttcatcatccttctgattgtcactgcttttataactgtggctttgacatacttccaactcgctgctgaagatcatgaatggtggtggaggtctttcctctgtggtggatcaactggtatctttatctacgcttactgcttgtattattactacgctcgatcagacatgtctggatttatgcaaacctcgttcttctttggttatatggcctgcatctgctacggattcttcctcatgctcgggacagttggtttccgtgcctcgctactctttgtccgtcacatatacaggtctatcaaatgcgagtgacaggttatttttcatttccttccattctgtcatagaaaatattctatgatttttgttagatatttagcaggaattggagaagtgccttaaattgacagctagcaaatagttgatgcatatgggtggcagagggccttggattaagttttaggcatcatctatttattaatatttgggttctatataaacaccatgagacagatttgtttaggatgctgttatttttatacttttatcatataaaattgatcctttttttttttcttgatgattc

SEQ ID NO: 1780 - DNA, 1779 bp, Ricinus communis
atgagctataatccattaaccattctcattctcttactttcaatctcaagttctttactccacgttagatcagatacctccgatcaccgctacaaagaaggtgaccctgttcctttctacgccaacaaagttggtccctttcataatcccagtgaaacatatcgctattttgatctacccttttgtgttccagatcatctgaaagagaaaaaagaagctcttggtgaggttttgaatggagaccgtttagttagtgctccatatacacttaactttagagatgataaagtatcagcacccgtttgtcagaagaaactttcgaaggaggatgttgcacaatttagatctgcaattgctaaagattattacttccagatgtattacgatgatctaccaatttggggtttcattggaaaagttgttaaagatggtaaggatgaccccagtgagtataaatacttcctttaccaacatgtccaattcgatgttctttataataaggatcgcgtgattgaagtgggtgtccgaatggatcctaattcaatgttggatctgacggaggacaaggaagtcgatgtggagtttctttatactgtgaagtggaaggaaacagataatacttttgagaatagaatgaagaaatactcattgtcttcttcactgccacatcacttggaaatccattggttttctattataaactcatgtgtgacagtgctccttttaactggttttcttgccacaattctcatgcgtgtcttaaagaatgattttgtgaaatatgcacaagatgaggaagaagctgatgatcaggaagagactggatggaagtacattcatggcgatgtatttaggtatcctaaatacaaatctttgtttgctgcagcccttggttctggcacccagctgttcacgctgactctatttatttttattcttgcactggttggtgtattttatccatacaaccgaggagctctatttactgcactggtggtcatatatgcacttacatctgggattgctgggtatactgcaacttctttctactgccagctggaaggaaataactgggtgaggaatcttttgctgacaggatgccttttctgtgggcctctattcctcacattctgcttccttaacactgtagccattgtttatagtgcaactgcagcattgccttttggcactattgtggtcatagtccttatatggacactagtaacttctccgttgcttattttgggtggtattgctggaaaaaatagcaaggctgagtttcaagctccttgccgtaccacaaaatatcctcgagagattccacaattgccttggtacaggagtgctcttcctcagatggcaatggcaggttttcttccttttagtgccatctacatcgagctttactacatttttgccagcgtttggggtcacaggatctataccatttacagcatcttgtttattgtcttcattattcttgtgattgtcactgccttcataaccgtggctttgacctacttccaacttgctgctgaagatcatgaatggtggtggaggtcttttctctgtgggggatcaactgggctgttcatctatgcctactgcttgtattattaccatgctcgatctgaaatgtctggcttcatgcaaacatctttcttctttgggtacatggcctgtatatgctacggcttctttctaatgcttggaacagtgggtttccgtgcatcgctgttctttgttcgccacatatacaagtcgattaaatgcgagtag

SEQ ID NO: 1781 - DNA, 2224 bp, Centaurea maculosa
tgggatactttgttgattttatacgcaaatcgcaagagagaagaaaactccttttggggatccagttttttcattacacaaagagacagagaagagagagtgtgagatctagatctctattatatatccatatatcatatatatctatatatctatcagttagtagtatatgtgaagaaagaagaagaagaagaagaagaagaagaagaagaagaagatgatggagattgtagcattgtttgtgatatccagtctactactgctgggatcagtcacatctgatgcttcaaatcacaaatacaaaagtggagatgtcgttcctctctatgccaataaggttggccctttccaaaatccaagtgaaacataccgctattttgatctaccattctgtttgccaggtgatttgaaagagaaaaaggaagcacttggagaagtattaaatggtgaccgtttagttagtgctccatacaaacttgatttcttggttgacaaagattctgagtttatttgcacgaagaaactgacaaagcaagaagtggctaagttccggaaatccattgcgaaggattactactttcaaatgtactttgatgacttgccactctggggtttcatcgggaaatatgagaaaaccgagtccaatgagcaaaaatactacctctttaagcatctgcagtttgaagtactctacaacaagaatcgtgttattgaggtgaatgtccggactgatccaagtgcccttgtggatgttacggaagacaaggaagttaacgtcgacttcatgtacacagtcagatggaaggagactagcattccttttgaaaagaggatggagaagtactcgcacaattcttctctaccacatcatttggaaatacattggttctcaattattaattcttgtgtgacggtgctccttttaactggtttccttgccacaattctcatgcgggtgctcaagaatgattttgtaaagtatgctcatgatgaggaaacggctgaggatcaagaagaaactggatggaaatacatacatggtgatgtcttcagatacccaaagttcaaatctttatttgctgctgcccttggttctggttcccagctatttgcccttacaatctttatcttcatacttgcactggttggtgtcttttatccatataatcgaggagctctgttcaccgcattggttgtcatatatgctctcacatctggaattgctggatatactgcatcttctttctattgccagcttgaaggaacaaactgggtaaggaatttgctgttgactggaagcctcttctgcggaccccttttccttacgttctgcttcctgaatacggttgcaattgcctacagtgcaacagcagcattgccgtttggaacgattgtggtaatagcccttatatgggcgttagtgacatcaccattgctagttttgggtgggattgcaggcaagaatagcaaggcagagttccaagctccgtgtcgcacaaccaaatatccaagagagattccaccattgccatggtaccggggaactcttgctcagatgggaatggctggctttcttccattcagtgctatctacatcgaactctactatatatttgcaagtgtatggggtcacagaatttacaccatctacagcatcttgtttatcgtcttcatcattcttgtgattgtcactgcctttattaccatagcattgacatacttccaactggctgctgaagatcacgaatggtggtggaggtctttcctttgtggaggatcaacggggctgttcatctatgggtattgcttgtattactactatggccgttcagatatgacaggattcatgcagacctcattcttctttgggtacatggcatgcatctgctacggcttctttctcatgcttggcaccattggcttccgtgctgcactcttctttgttcgacatatatatcgttccatcaagtgcgagtgagtgagcgagcgagtaacaaacacatcagatatatctgtagaatttgtaagacagacgtattacatatgttcgatctaggagaccatttcattttattctatatatatatatggagttcaattttcctttttctttttctttcctatcttcgtacattgctataaagcgtacataatataccatacctcatagatcaatgattcattaaatataacaacagtttctcacaattgattcctacctatc

SEQ ID NO: 1782 - DNA, 2160 bp, Medicago truncatula
cttcactcactaatcttcaccttccttcttttttccctctttattatcaacacacttcacattcttcatcttcctatatacaccccctctttttctattcaacccactctcttcactttcacatcaacaacttcaattcaattttgaagttattaccaatcttcaatggcgaagatgaatccattattcatcctcgccttcttcttcttcttctccaccgtcagatctgattcatcagataaacgttacaaagaaggagatcttgttcctctattcgctaacaaagttggtccttttcataatccaagtgagacgtatcggtattttgatctgccattttgtataccagatcatttgaaagagaagaaagaagcactgggtgaagtattgaatggggataggttggttagtgctccttatcagctcgagttccaaaaggacaaggactctctgtcggtttgcaagaagacacttacaaaagaagaagtggcgaattttcggtccgctgttcgtaaagactactactttcagatgtattatgatgatttgcctatttggggtttcatagggaaggttgataaggaagggaaagaccctagtgattatagatactacctttacaagcacatccattttgatatattttacaacaaggatcgtgttattgagatcaatgtgcgaacggatccaaatgcccttgtggatgttacagaggacaatgaagttgatgtagagtttttctatactgtgaaatggaaggagactaacactcccttcgagaagcggatggacaagtactctcagccgtcctcgctaccccatcatttggaaatccactggttttcgattatcaattcgtgcgtcacagtcctcctcttgactggttttcttgcaactattttgatgcgtgtccttaagaatgattttgtcaagtatgcacatgatgaagagactgcagaggatcaggaagagactggctggaaatacatccacggtgatgtttttaggtttcccaagttcaaatctgtatttgcagccgctcttggatctggtacccaactgtttacccttacggtgttcatattcatattggcacttgttggtgtattttatccgtacaaccgaggggctctattcactgcacttgttgttatatatgcactcacttcaggaattgctggctatactgctacctcattctattgtcaactggaaggaacaaactgggttcggaatctactattgaccggatgccttttctgtgggcctctatttcttacattttgctttctgaacactgttgcaattgtctacaatgctactgccgctctcccattcggcacaattgtcgttatagttctcatatggacacttgttacgtctcctctacttgtattgggagggattgctgggaagaacagcaaggctgaattccaagctccagtccgcacaactaaatatccaagggagattcctcctttgccatggtatcggggagcaattcctcagatggcaatggcaggatttttgcctttcagtgctatttacatcgaactttattatatatttgccagtgtctggggccacagaatttacacaatctacagcattctgtttattgtcttcatcattctcttgattgttactgctttcattactgtggcattgacatacttccagcttgctgctgaagatcatgaatggtggtggagatcattcctatgcggtggttcaactggattatttatctatgcctattgtctgtattactactatgcccgctccgatatgtctggtttcatgcaaacctcatttttctttggatacatggcctgcatatgctttggtttcttcttgatgcttggaactgttggattccgtgcagcattgttctttgtccgccacatataccgatccatcaagtgcgagtaggcattttgtcatctcttattgtcttcatttcataggcattctgtagaaaagttatagtaattttgcagttctgtgtactatataagagaagctgggttgggtgggtttgtagcttccagagcaacttgttagatcacaaaagaaacttttttggagataacgtctgtactaccatatttttaactaaactcttgaaatactttattttttggaatcatttgaacacaa

SEQ ID NO: 1783 - DNA, 2242 bp, Cicer arietinum
gtgaggcggtgagtctacgtcacttcactcactcatcttccttcattcactctttctctcttttcttccattttattaacacaaacacacttcatttcattcattcatatatgcaccccccatctttttctttgactccttcattttgagagttgaaggaaaccaagtaataattaacaacaacccttaacggcgaagatgaataataatcattcactattcatcatcgccttcttcttcttcatttcatctctattctccaccgttagatctgattcctcagatcaccgtttcaaagaaggagatctcgttcctctcttcgctaacaaagttggtccttttcataatccgagtgagacatatcgttattttgatctgccattctgtataccagatcatttgaaagagaagaaggaagcgttgggcgaagtgttgaatggggatcgtttggttagtgctccttatcagcttgagtatcgacgagacaaggagtcggtgtcagtttgcaagaagaaacttacgaaagaagatgtggggaagtttcgatctgccgttcgtaaggactactactttcagatgtattatgatgatttgcctatttggggtttcatagggaaggttgataaggaagggaaggaccctagtgattatagatactacctttacaagcacattcactttgatatcttttataacaaggatcgtgttattgagatcaatgtgcgtaccgatccgaatgcccttgtggatgttacggaggataatgaagttgatgtggagtttttctatactgtgaaatggaaggagactaacactcccttcgataagagaatggacaagtactctcagtcgtcctcactgccccatcatttggaaattcactggttctcgattatcaattcgtgcgtcacagtcctcctcttgactggttttcttgcaactattttgatgcgggtccttaagaacgattttgtcaagtatgcacatgacgaggaggttgcagacgatcaggaagagactggctggaaatacatccacggtgacgtgtttaggtttccgaagttcaagtctgtatttgcagctgctcttggatctggtacccaactgtttacccttacggtgtttatattcatattggcactcgttggtgtattttatccgtacaaccgaggggctctatttactgcacttgttgtcatatatgcactcacttctggaattgctggctacactgcaacctcattctattgtcaactggaaggaacaaactgggttaggaatcttctattgactggatgccttttctgtggacctctatttctgacattttgctttctgaacactgttgcaattgtctacaatgctactgctgccctcccattcggcacaattgtcgttatagttctcatatggacacttgttacgtctcctctacttgtattaggaggcattgctgggaagaacagcaaggctgaattccaagctcccgttcgcacaacgaaatatccaagggagattccgcctttgccatggtatcgcggaacaattcctcagatggcgatggcaggatttttgcctttcagcgctatatacatcgaactttattatatatttgccagtgtttggggtcacagaatttacacaatctacagtattctgtttattgtcttcatcattctcttgattgttactgctttcattactgtggcattgacatacttccagcttgctgctgaggatcatgaatggtggtggagatcattcctatgcggcggttcaactggattatttatctatgcctattgtctgtattactactatgcacgctccgatatgtctggattcatgcagacctcatttttctttggttacatggcctgcatatgctatggtttcttcttgatgcttggaactgttggattccgtgcagcgttgttctttgttcgtcacatataccgatccataaagtgcgagtaggcattttgtcctctcaaagtcctctagagctattgtcttcatttcataggcatcatgtagaaaattatagtaattttgcagtacttctgtgtactataagggagaagctaggttgggtgggttcctagcttccagagcaaattgttagaacacaaagggttcttttggagataacttttgtactaccatgtctttaaccaaactcttgaaatactttaattttttgggtctatttgaacgtaattcttggcaattattctagctt

SEQ ID NO: 1784 - DNA, 2193 bp, Lupinus angustifolius
ttattaactccccattcttcctccatttccttctcactcctcataccaaaccaaaccttctcttttcttcttcttcttcttcatcttcttttcgaatgtgaatccaacactagagtagaatagaagaacaaagcataacaaaatgaaaacactctcattctttctcttattcacattcatcacttcttcttctctctacaccgtcagatccgatccatcaaatcaccgttaccaacaaggagatcttgttcctctctatgccaataaagttggtccttttcataatccaagtgagacatatcgttattttgatctaccattctgtttgccaggtgatttgaaagagaaaaaggaagctcttggtgaagtcttaaatggagatcgtttggttagtgctccttataaactcgagtttcaacaagacaaagagtccgtagcagtttgcaagaagacactcaagaaggaagatgttgccctgtttcgatctgctgtccgaaaggactactactttcagatgtactatgatgatttgcctatttggggattcattgggaaaatcgataaggagggaaaagatccaagtgattataagtactacctttaccagcatattcactttgacatcttttacaacaaggaccgtgtcattgaaatcaatgtgcgaacagatcctaatgctcttgtggaccttacagaggataatgaagttggtgtcgaatttttgtatactgtaaaatggaaggagactaacactccttttgacaatcggatggacaagtactctaaatcatcctcactgccccatcatttggaaatccactggttctcaattataaactcatgtgtgacggtcctccttctaaccggttttcttgcaactattctgatgcgggtccttaagaatgattttgtcaagtatgctcatgatgaggaatctgcagaagatcaggaagagactggctggaaatatatccatggagatgtctttaggtttcccaagtataagtctatattcgcagctgcccttggatccggttcccaactttttacccttacggtattcatattcatcttggcacttgttggtgtattttatccatacaatcggggggcactatttaccgcacttgttgtcatatatgcactcacttcaggaattgccggctatactgcaacctcaatctattgtcaactggaaggaacaaactgggttaggaatctgctattgactggatgcattttctgtggtcctctgtttctcacattttgctttctgaacaccgttgcaattacttacaacgctactgctgccctcccattcggcacaattgtagttattgttctcatatggactcttgttacgtctcctctgcttgtgttgggtgggattgctgggaagaatagcaaggctgaatttcaagctccctgccgcacaactaaatatccaagggagattccatcgttgccatggtatcgcggaacaattccacagatggcaatggccggatttttgcctttcagtgcgatatacattgaactttactacatttttgctagtgtttggggtcacaggatttacaccatctatagcatcctgttcattgttttcatcattctcttgattgttactgctttcattactgtggcgttgacatacttccaacttgctgccgaggaccatgagtggtggtggagatcattcctttgtggtggttcaaccggcttatttatttacgcctattgtctgtattactactatgcacgctccgatatgtctggattcatgcagacctcatttttcttcggatacatggcatgcatatgctatggtttcttcttaatgcttggaactgttggattccgtgcagcattgttctttgtccgtcacatatatcgatccatcaagtgcgagtaggttttttgtcctcacaagccctttagagctattgccttcattccataggtgaatttgtagaatattatagtaattttgctgttaaattgtactataaggggaagctggattgggtgggtttctagcttcgagagcaaattgttaaatcacgaagggtactttttggggagaatgtttgtactaccatatttttaaccaatcttgcaatattttttccctttctttctgaacttgcattatcttgtcaattttatagcctttctattttttgtccccag

SEQ ID NO: 1785 - DNA, 2211 bp, Phaseolus vulgaris
gtagtgaataaattggttgctggttgtccttatttgtttctctatccatctatctgatctgattgtgagtgcagatcaagagcaatgggaaggagcgggttggctttggttctcgcgattctgatctctttgcagggaacaatcctcgtcagatccgatgcctccgatcaccgttacaaggaaggagaccacgttcctctttacgccaacaaagttggtccctttcacaacccaagtgaaacttatcggtactttgacctgccattctgtgtaacaggtaacgagaaagaaaagaccgaagctcttggtgaggtgttgaatggcgatcggcttgttagtactccttatgaacttgatttccgaacagagaaagacgctaagcttgcatgcagtcggaagctcaaaaagcaggaagttgctcagtttcgagaagcagttaagaaggactattatttccagatgtattatgatgacttgccaatctggggatttattgggacggttgataaggaagggaaaactgatcctagcgagtacaagtattttctttacaagcacattcagtttgatattctgtacaacaaggatcgagtggttgagatcagtgcccggatggatcctaattctgtggtggatctgactgaggataaagaggttgatgttgattttaggtacacagcaaaatggaaggaaactgatactcctttcgagaagagaatggaaaagtactctcaatcttcttctttgcctcatcacttagagattcactggttctcgatcataaactcctgtgtaacagtgcttcttttgactggttttctggcaaccattctcatgcgtgtattgaagaatgactttatgaaatacgctcaagatgaggaagctgctgatgatcaagacgagacagggtggaaatacattcatggtgatgtttttcggtttccaaagcataaatctttgtttgcagcatcccttggttctggtactcagttattcacacttacaatcttcatttttatgctagcactggttggtgtgttttatccatataaccgaggtgctttatttactgcactggtggtcatatatgctctcacatctggcattgcgggctacactgctacttccttctacattcaacttgaagggtctaattgggttaggaacttattgctcacaggatgcctcttttgtgggccccttttccttatgttctgcttccttaacacagttgcaattgtttatagtgcaactgctgccctgccatttggcacaattttggtgatagtcctaatatggacattggtaacttcaccactgcttgtgttgggtggtattgcaggtaaaaatagcaaatctgagttccaagcacctgtccgcactacaaaatatccccgagaaattccaccactgccttggtacaggagtacccttccccagatggcaatggcaggatttctcccatttagtgccatctacatagagctgtactacatttttgcaagtgtatggggccacagaatttataccatctacagcatactattcatcgtttttattattctgttgattgtcactgctttcatcactgtggctctgacatacttccaacttgctgcggaggatcatgaatggtggtggaggtctttcctctgcggtggatcaactggcttgttcatctacggctattgcttgtattactactacgcacgatcagatatgtctggttttatgcaaacttcgttcttcttcggttacatggcctgcatctgctatggtttcttcctaatgcttggtagtgtaggtttccgtgcctccctgctttttgttcgtcacatatacaggtccatcaagtgtgagtagctggtggctgaaggtgttcgtaaagtttatattatctgttaggtgaagagaagaaaggtccatgattttttttttcttttgctgtcataagataggttatatagtgtgtacctggaaactagagaagcttagactcctttcatgaattggtgtcatgctttctctataactgcacaggcttgcactcgaggaagtttttggaccatggaacttaatctttcattactgtagtcacttaaattaatttgaagtagcttgtactaattaatttctctgctctgaaaatcaccatttacatttagtatctacctaagatatattctttactgggttataagggtgtggaaa

SEQ ID NO: 1786 - DNA, 2218 bp, Phaseolus vulgaris
gtaatttgcgtgaaaattgtagtgaataaattggttgctggttgtccttatttgtttctctatccatctatctgatctgattgtgagtgcagatcaagagcaatgggaaggagcgggttggctttggttctcgcgattctgatctctttgcagggaacaatcctcgtcagatccgatgcctccgatcaccgttacaaggaaggagaccacgttcctctttacgccaacaaagttggtccctttcacaacccaagtgaaacttatcggtactttgacctgccattctgtgtaacaggtaacgagaaagaaaagaccgaagctcttggtgaggtgttgaatggcgatcggcttgttagtactccttatgaacttgatttccgaacagagaaagacgctaagcttgcatgcagtcggaagctcaaaaagcaggaagttgctcagtttcgagaagcagttaagaaggactattatttccagatgtattatgatgacttgccaatctggggatttattgggacggttgataaggaagggaaaactgatcctagcgagtacaagtattttctttacaagcacattcagtttgatattctgtacaacaaggatcgagtggttgagatcagtgcccggatggatcctaattctgtggtggatctgactgaggataaagaggttgatgttgattttaggtacacagcaaaatggaaggaaactgatactcctttcgagaagagaatggaaaagtactctcaatcttcttctttgcctcatcacttagagattcactggttctcgatcataaactcctgtgtaacagtgcttcttttgactggttttctggcaaccattctcatgcgtgtattgaagaatgactttatgaaatacgctcaagatgaggaagctgctgatgatcaagacgagacagggtggaaatacattcatggtgatgtttttcggtttccaaagcataaatctttgtttgcagcatcccttggttctggtactcagttattcacacttacaatcttcatttttatgctagcactggttggtgtgttttatccatataaccgaggtgctttatttactgcactggtggtcatatatgctctcacatctggcattgcgggctacactgctacttccttctacattcaacttgaagggtctaattgggttaggaacttattgctcacaggatgcctcttttgtgggccccttttccttatgttctgcttccttaacacagttgcaattgtttatagtgcaactgctgccctgccatttggcacaattttggtgatagtcctaatatggacattggtaacttcaccactgcttgtgttgggtggtattgcaggtaaaaatagcaaatctgagttccaagcacctgtccgcactacaaaatatccccgagaaattccaccactgccttggtacaggagtacccttccccagatggcaatggcaggatttctcccatttagtgccatctacatagagctgtactacatttttgcaagtgtatggggccacagaatttataccatctacagcatactattcatcgtttttattattctgttgattgtcactgctttcatcactgtggctctgacatacttccaacttgctgcggaggatcatgaatggtggtggaggtctttcctctgcggtggatcaactggcttgttcatctacggctattgcttgtattactactacgcacgatcagatatgtctggttttatgcaaacttcgttcttcttcggttacatggcctgcatctgctatggtttcttcctaatgcttggtagtgtaggtttccgtgcctccctgctttttgttcgtcacatatacaggtccatcaagtgtgagtagctggtggctgaaggtgttcgtaaagtttatattatctgttaggtgaagagaagaaaggtccatgattttttttttcttttgctgtcataagataggttatatagtgtgtacctggaaactagagaagcttagactcctttcatgaattggtgtcatgctttctctataactgcacaggcttgcactcgaggaagtttttggaccatggaacttaatctttcattactgtagtcacttaaattaatttgaagtagcttgtactaattaatttctctgctctgaaaatcaccatttacatttagtatctacctaagatatattctttactgggttataa

SEQ ID NO: 1787 - DNA, 2218 bp, Glycine max
gtagtgaataaattgcttgcttgttgtccttgtctgtttctttttctttatctatctgatctgaatgcgaagaacgaacgagagtgcagcgccagcggcaatgggaaggagcactttggctttggttctcgcgattctgatctctttgcagggaaccccccacgttagatccgatgcctccgatcatcgttacaaggacggagactccgttcctctttacgccaacaaagtcggtccctttcacaaccccagtgaaacgtatcggtactttgacctgccattctgtgtaacaggtcatgagaaagataagactgaagccctcggtgaggtgttaaatggcgatcgccttgttagtgctccttatgaacttagtttcaagaaggagaaagactctaaggttgtatgcaagaggaagctcacaaaggagcaagttgctcagttccgagaagcagttaagaaggactattatttccagatgtactatgatgacttgccgatctggggatttattgggacggttgacaaggaagggaaaactgaccctagtgagtacaagtattttctttacaagcacattcagttcgatattcattacaacaaagatcgagtcattgaaatcagtgcccggatggaccctcattctgtggtggacctgactgaggataaagatgtagatgttgagttcgtgtacactgcaaaatggaaggaaacagagactccttttgagaagagaatggataaatactcccagtcttcttctttgccacatcacttggagattcactggttctcaatcataaattcctgtgtaacagttcttcttttgactggttttctggcaaccattctcatgcgtgtattgaagaatgactttatgaagtatgctcaagatgaggaagctgctgatgatcaagaggagacaggatggaagtacattcatggggatgttttccggtttccaaagttcaagtctttcttttcagcagcccttggttctggtactcaattattcacacttacaatcttcatttttatgcttgcactggttggtgtgttttatccatataaccgaggcgctttatttactgcactggtggtcatatatgctctcacatctggcatcgctggctacactgctacttccttctatattcaacttgaagggactaattgggttaggaacttattgctgacaggatgcctcttttgtggccccctattccttatgttctgtttccttaacacagttgcgattgcttatagtgcaactgctgccctgccatttggcacaattgtggtgattgtcctaatatggacattggtaacttcaccattgcttgtgttgggtggtattgctggtaaaaatagcaaaactgagttccaagcacctgtccgcactacaaaatatccccgagagattccacctctgccttggtacaggagtaccattccccagatggcaatggcaggatttcttccttttagtgccatctacatagagctgtactacatttttgccagtgtatggggccacagaatttatacgatctacagcatactcttcattgtcttcattattctgttgattgtcactgctttcatcactgtggctttgacatacttccaacttgctgctgaggatcatgaatggtggtggaggtctttcctttgtggtggatcaactggcttgttcatctacggctattgcttgtattactactatgcacgatcagatatgtctggttttatgcaaacttcgttcttctttggttacatggcctgtatctgctatggcttcttcctcatgctcggtagcgtaggattccgtgcctccctgctctttgttcgtcacatataccggtccatcaagtgtgagtagctggggtttgaaggtgttggtaaagttcatattatttctgttaggagaagagaaaagggtctgttattatttttttcttttgctgtcataaggtaggttatatagtgtgtacctggaaactagagaagcttagactctattcatgaattggtgtcatgctatctctataactgcacaggcttgcacttgaggaagtttttggaaccatgggatttaactttgattactgtagtcactgaaatttatttgaagtagcttgtactaattaattgtcttctctgcaaatgaccatttaatatgattagctagttacatatattcttaaatggtttataatgt

SEQ ID NO: 1788 - DNA, 2537 bp, Theobroma cacao
ttgcttctcactctttaggacttgtaactagttggtgtcagtcatacactttgctataaaatataaaaataaaataaaataaatactagaataaaagttgttccctttccttcctatcgagaccccaacacgtttttgcataaacttgatctctggactcttggtgaggtaatggagagaataagggcgtgtttggtagcgttgatcgttctcagcctctgcggcgtaccccaggtgagatccagtgcttctgatcatcgttacaaagctggagctgaagttcctctctacgccaataaatgagacatactgttatttcgattttccattctgttcatcagcccccgtgaaggaaaagaaggaagctctcggcgaagtgttgaatggagatcgattagtgagtgccccttacaaacttgactttttgagtgacaaagaggctgagattgcctgcaaaaagaagctgacaaaggaagaagtcgccaagttccgaagtgcagtttcaaaagactattacttccaaatgtattacgacgacctccccatttggggtttcttagggaaagttgataaggaagggaaggttgatcccagcgagtacaaatattatctctttaagcatctcatattcgagatcctttacaacaaggatcgtgtcattgagattactatgcaatctgatcccaacgcccttgtggacctcaccgaagatgaacaagtcaatgtggatttcatgtacactgttaaatgaaaggaaacggaaactccgtttgagaagaggatggacaagtactcgctatcttcttcgttgccacaccacttagaaatccactggttctcaattatcaattcatgtgtcaccgttctgctattgactggtttccttgctaccattcttatgcgagtccttaagaatgatttcgtcaagtatgcacatgacgaggaatcaacagatgaccaggaagagactgggtggaagtacattcatggtgatgtgttcaggtacccaaagcacaagtctttgtttgcagcggctcttggttctggcacccagctctttactttttggggtcttttacccatataatcgaggagctttgttcactgctctggttgtcatttatgcacttacttctggaattgctggctacactgctgcctctttctattgtcaactagaaggaacaaattgggtgagaaacttattactgactggaggcttgttttgtggacctcttttgatcacattttgctttctcaacactgttgcaattgcttataaaaccactacagcattgccatttggaactattgtagtgatttttctcatatgggctctagtcacatctcctctattagtattaggaggtattgctgggaaaaatagcaaggcagagtttcaagccccttgttgcaccacaaaataccccagagagattccactgttgccttggtaccgcaaaacttttcctcagatggcaatggcaaggttcttgccgttcagtgctatctatattgaactttactacatatttgccaatgtgtggggacataggatctacaccatatacagcatcctgtttattgtctttatcattctcttgattgtcacggcttttatcactgttgctttgacttattttcaacttgctgctgaagaccatgagtggtggtggaggtccttcctttgtggtgggtctaccgggttgttcatatatgcctactgtttgtattactacaatgcacgatcagacatgtcaggcttcatgcaaacctcattcttctttgggtgcatggcgtgcatttgttatggtttcttcctcatgcttggggccattggcttccatgcttctctgttctttgttcgtcacatttaccgttctatcaagtgtgagtaggaagatggacggtgttccctgtttactagagaaagagcagattgggacaatgtgcttcagcccatgtttgctgccaagggatattgcaatgttgtatgaaatatgaatcatgtagggttaccttatttgattacgacaaccagatgccaacaaaaacttgtatttctgagttgactcattacacgactcaacaattccttttatttttgtttttaatttttatattggggagaatcatactgaatattaggatgctttaggaataacttggtgctgttatacatgtaaacccgaatgaattgttcatcttcaccatgttagctctagaattagtaacatattgcaatctctatgttggtcaaggttttgggaagtgattcagagtgaacaccagttgggaacaacgaaggccgggtttttgacatgaaatctctgaaaccatttagttaaaaataatttaatttcttgaaattgaaattaaaacatgtggattggtaggttgcaagtgatttttgcatggttcgatcacaacgtcaaaatattaagtggtaacagatgaatcataattaatttagctggcaaatcgactttttttttattttataaaattttaacgcaattgtctttacaacttgtaaa

SEQ ID NO: 1789 - DNA, 1862 bp, Panax ginseng
gatctgtgtgtttatgtgactgaaaatggagcagaagatgggcttgttattcatggtgtcatttctggtgatgatgagcagtgcatcactagtaagatcgagtgcatcaactcacaaatacaaagctggtgatcaagttcctctttacgtcaacaaagtcggtcctttccaaaaccctagcgagacgtaccgttacttcgatcttccgttctgtatgccaggttcaactcatttacttgataaaccggaagctcttggtgaagttttgaatggagatcgtttagttagtgccccctaccagctcaactttttagttgagaaagattcggaaattgtttgcaggaagacgctgacaaaggaagaagtttctaaattccgaagtgctgttgccaaggactactattttcagatgtactatgatgacttgcccctttggggtttcttggggaaggctgagaaggatgccaaagccgatcccggcgaaatcaaatattatctatttaagcatcttcattttgaggtattttacaataaggatcgtgtcattgaggttaacgtacgaactgaccctagtgctcttgtggaccttacggaagacaaggaagttgatgcagactttatgtacactgtcaagtggaaagaaacacacactccttttgagaaaagaatggacaagtactcacagtcgtctaatatgccacatcatttggagatacattggttctcaatcattaattcctgtgtgacagttcttctcttaactggttttcttgccacaattctcatgcgagttcttaaaaatgattttgttaagtatgctcatgatgaagagactgctgaggaccaagaagaaactggatggaagtacatccatggtgatgttttccggtacccaaagtacaaatctgtgtttgctgcagctcttggttctggcacccaactatttgccattgcaatattagttttcatgcttgcactggttggcgtattctatccatacaaccggggagctttgtttactgcgctggttatcgtatatgcgctcacatctgggtttgcaggctatactgcagcctcgttctattgccaactggaaggaacaaactgggtaaggaatctgttgttgaccggaagtctcttttgtgggcctctgtttctcacattctgctttcttaataccgttgcaattgcttacaatgccactgcggctctgccatttggtacaattgtggtgatagttcttatatgggccctagtgacgtctcctttgctagtcttgggtggaattgctggaaagaacagcaaggcggagtttcaagctcctgttcgaaccacaaagtatcccagggagattccaccattgccttggtatcgtggaactcttcctcagatggcaatggctgggtttctgcctttcagcgctatctatattgaactctattatatatttgccagcgtttggggtcacaggatttacaccatttacagcatcttattcattgtcttcatcattcttctgattgtaacggctttcattaccgttgcattgacatattttcaacttgctgctgaggaccatgaatggtggtggaggtctttcctttgtggtggatcaactgggctgttcatttatggctattgcttgtattactactatgcacgatcagatatgaacggtttcatgcaaacctccttcttctttgggtacatggcttgtatttgctatggtttcttctcatgctcgggaccgtcggtttccgtgcatcactgttttttgttcgtcacatagtatcgctcaatcaagtgtgagtaatgagaaagttgggtggtacttcaagttcaaaactaagcttttcaaatgt

SEQ ID NO: 1790 - DNA, 2106 bp, Panax ginseng
tatatatatatatatatattatatttgtatgatctgtgtgtttatgtgactgaaaatggagcagaagatgggcttgttattcatggtgtcattactggtgatgatgagcagtgcatcactagtaagatcgagtgcatcaaatcacaaatacaaagctggtgatcaagttcctctttacgtcaacaaagtcggtcctttccaaaaccctagcgagacgtaccgttacttcgatcttccgttctgtatgccaggttcaactcatttacttgataaaccggaagctcttggtgaagttttgaatggagatcgtttagttagtgccccctaccagctcaactttttagttgagaaagattcagaaattgtttgcaggaagacgctgacaaaggaagaagtttctaaattccgaagtgctgttgccaaggactactattttcagatgtactatgatgacttgcccctttggggtttcttggggaaggctgagaaggatgccaaagccgatcccggcgaaatcaaatattatctatttaagcatcttcattttgaggtattttacaataaggatcgtgtcattgaggttaacgtacgaactgaccctagtgctcttgtggaccttacggaagacaaggaagttgatgcagactttatgtacactgtcaagtggaaagaaacacacactccttttgagaaaagaatggacaagtactcacagtcgtctaatatgccacatcatttggagatacattggttctcaatcattaattcctgtgtgacagttcttctcttaactggttttcttgccacaattctcatgcgagttcttaaaaatgattttgttaagtatgctcatgatgaagagactgctgaggaccaagaagaaactggatggaagtacatccatggtgatgttttccggtacccaaagaacaaatctgtgtttgctgcagctcttggttctggcacccaactatttgccattgcaatattagttttcatgcttgcactggttggtgtattctatccatacaaccggggagctttgtttactgcactggttatcatatatgcgctcacatctgggtttgcaggctatactgcagcctcgttctattgccaactggaaggaacaaactgggtaaggaatctgttgttgaccggaagtctcttttgcgggcctctgtttctcacattctgctttcttaataccgttgcaattgcttacaatgccactgcggctctgccatttggtacaattgtggtgatagttcttatatgggccctagtgacgtcacctttgctagtcttgggtggaattgctggaaagaacagcaaggcggagtttcaagctcctgttcgaaccacaaagtatcccagggagattccaccattgccttggtatcgtggaactcttcctcagatggcaatggctgggtttctgcctttcagcgctatctatattgaactctattatatatttgccagcgtttggggtcacaggatttacaccatttacagcatcttattcattgtcttcatcattcttctgattgtaacggctttcattaccgttgcattgacatattttcaacttgctgctgaggaccatgaatggtggtggaggtctttcctttgtggtggatcaactgggctgttcatttatggctattgcttgtattactactatgcacgatcagatatgaacggtttcatgcaaacctccttcttctttgggtacatggcttgtatttgctatggtttctttctcatgctcgggaccgtcggtttccgtgcatcactgttttttgttcgtcacatatatcgctcaatcaagtgtgagtaatgagaaagttgggtggtacttcaagttcaaaactaagcttttcaaatgttggacgccaatcttggatcgaagaggaccatgtaggacagtaggacttcatagtacaaatgcttgtattattttacaatggcatcatgtgggaactgttatcctcgttttgcattatagctcaaaattttatgttctactagttatacattcttcctaaaaatatgatatttgttcactgttctaatattaaatatcaggatggatacatggta

SEQ ID NO: 1791 - DNA, 2068 bp, Centaurea maculosa
tgcagcagacacacaccaacaagatgttgaagaagatggtggcgatccggtggttgctggtggcgttactggtggttttccccatccaacaagttcgatcaggttcctcagatcacaagtacaaacctaacgatgaagtccctatttacgctaacaaagtcggccccttccataaccctagtgaaacataccggttttttgatctaccgttctgtctaccagctcacttgaaggagaagccggaagctcttggtgaagtactgaatggagatcgtttggtcagtgctccttataagctgccatttatggttgaaaaggactcggaaattgtttgcagaaagaaactgacaaaggaggaagtatctaaattccgaagtgctgttgccaaggattattactttcagatgtactatgatgacttgccttctggggcttttgggaaggttgaaaaggacaaaactgatcccagtgaggaaaagtattacctctttaagcaccttcactttgagatccactacaataaggatcgtgtcatagagataaatgcaaaagccgatcctaatgccgttgtggatctgactgaagacaaggagattgaggtagagtttatgtacacggtcaggtggaaagaaacagacattccttttgagaataggatggagaagtactcccagtcttcttcacaaccacatcatcttgagatccattggttttcaattattaactcctgcgtgacagttcttctcttaaccggtttccttgccacaattcttatgcgagtccttaagaatgactttgttaagtatgctcatgatgaggaggcagctgatgaccaagaggaaactgggtggaagtacattcatggtgatgttttcaggtacccgaagtacaagtccctttttgctgcatcccttggttctggaacccagctattttcccttgcactttttatctttgcactggctcttgttggtgtattctatccatataaccgaggagctctgtttaccgcgctagttgtcatatatgctcttacttctgggattgcaggctacactgcagcctccttttatcaccagctagaaggaactaactgggtgaggaacttactgttgactggctgcctgttttgtggacctctgtttctgactttctgctttctaaacaccgttgcaattgcttatactgcaactgctgctctgccatttggtaccattgtggtgatcgttttgatatggactttggtgacatcgcctttgctggtattggggggtattgcaggaaagaacagcaaggctgagtttcaggctccagttcgcaccacaaagtatccgagagagatcccaccgttgccttggtacaggaagactattcctcagatggccatggctggttttctccctttcagtgcaatctacatcgagctttactacatatttgccagtgtgtggggccacaggatatataccatatacagcatcttatttatcgtttttatcatcctcctcattgttactgcctttatcaccgtggcattgacgtatttccaacttgctgccgaagaccatgaatggtggtggaggtctttcctctgtggtggttcaactggtgttttcatctatgggtattgcctgtattactactatgaacgttctgacatgtcaggattcatgcaaacctcatttttctttggttacatggcttgcatctgttatggtttctttctcatgcttgggacagtcggtttccgtgcggctttgttctttgtccgccacatctaccgctcaatcaagtgtgaatagatgttaatgttcagtctacgatgctcagacaggagctggctgattctgtggccattgctgctgatgctggaagggtgaaaccatgaaagctgtgagaaccaccaacttacatgttgaatgatgttttcatatatacttgtttgtgttgtttggtttggaaataggaagaaactttgaaaatccctagtcaattttggacgcatatacagaccattttcattttgaacctgtagtttgtaattaaagtttgtacaagtccagttatt

SEQ ID NO: 1792 - DNA, 2221 bp, Glycine max
atactgaataaatttcttgcttattgtccttgtctgtttctttttctttatccatctgatctgaatgcgaagaacgaacgagagtgcagcggcaatgggtagaagcactttggctttggttctcgcgattctgatctcttttcagggaacccacgttagatccgatgcctccgatcaccgttacaaggatggagactccgtccctctttacgccaacaaagttggtccctttcacaaccccagtgaaacgtatcggtactttgacctgccattctgtgtaacaggtcatgagaaagaaaagactgaagccctcggtgaggtgttgaatggcgatcgccttgttagtgctccttacgaacttagtttcaagaaggagaaagactctaaggttgtatgcaagagaaagctcacaaaggagcaagttgctcagttccgagaagcagttaagaaggactattatttccagatgtattatgatgatttgccgatctggggatttattgggacgattgacaaggaagggaaaactgaccctagtgagtacaagtattttctttacaagcacattcagtttgatattctgtacaacaaagatcgtgtgattgaaatcagtgcccgaatggatcctcattctgtggtggacctgactgaggataaagatgttgatgttgagttcatgtacactgcaaaatggaaggaaacagatacatcttttgagaagagaatggataaatactctcagtcttcttctttgccacatcacttggagattcactggttctcaatcataaactcctgtgtaacagttcttcttttgactggttttctggcaaccattctcatgcgtgtattgaagaatgactttatgaagtatgctcaagatgaggaagctgctgatgatcaagaggagacaggatggaaatacattcatggtgatgttttccggtttccaaagcacaagtctttcttttcagcagcccttggttctggtactcagttattcacacttacaatcttcatttttatgcttgcactggttggtgtgttttatccatataaccgaggtgctttatttactgcactggtggtcatatatgctctcacatctggcattgctggctacactgctacttccttctatattcaacttgaagggactaattgggttaggaacttattgctgacaggatgcctcttttgtggccccctattccttatgttctgtttccttaacaccgttgccattgcttatagtgcaactgctgccctgccatttggcacaattgtggtgatagtcctaatatggacattggtaacttcaccattgcttgtgttgggtggtattgcaggtaagaatagcaaaactgagttccaagcacctgtccgcactacaaaatatccccgagagattccacctctgccttggtacaggagtaccattccccagatggcaatggcaggatttcttccttttagtgccatctacatagagctgtactacatttttgctagtgtatggggccaccgaatttataccatctacagcatactcttcattgtcttcattattctgttgattgtcactgctttcatcactgtggctttgacgtacttccaacttgctgctgaggatcatgaatggtggtggaggtctttcctttgtggtggatcaactggcttgttcatctacggctattgcttgtattactactatgcacgatcagatatgtctggttttatgcaaacttcgttcttcttcggttacatggcctgcatctgctatggcttcttcctcatgcttggtagtgtaggtttccgtgcctctctgctctttgttcgtcacatatacaggtccatcaagtgcgagtagatgggagttgaacgtgttggtaaagttcatattatttctgttaggaaaagagaaaagggtctgttaattttttttcttttgctgtcataaggtaggatatatagtgtgtacctggaaactagagaagcttagactccattcatgaattggtgtcgtgctatctctataacagcacagggcttgcacttgaggaagtttttggaaccatgggatttaatctttgattactgtagtcactgaaatttatttgaagtagcttgtactaattaatttgtcttctctgaaaatggccatttaatatgattatactgacctagctaggtatattctataatggtttataatgtagaa

SEQ ID NO: 1793 - DNA, 2716 bp, Cicer arietinum
ataaaaaataggaaagaatatttacttgaatagataaggttaacggatcatatagaataggacaaaacttatattttttagtaaaaaagttgaacttaattttgatttagtaaaaaataggtgattttagttgacccgaaaaattgcagtgaaaaaataaataaattgattgttgtgatatattcatttgtttgaatcttgcgacagagaagaaagaaaatgggaaggagcaaggtgttagttttgtggatcctaatctctctttctcttctcgctactcacgttagatctgatgcctccgatcaccgttacggcgacggagatcccgttcctctttacgctaacaaagtcggtccctttcataaccccagtgaaacgtatcgttaccttgacctcccattttgtgtaacaggtcacgagaaagagaagactgaagcgcttggtgaggtgttgaatggagatcgccttgttagtgctccttatgaacttcactttagaaaggagaaagattctaatgttgtgtgcaagaagaagctcacaagggaggaagttaatcagttcagagaagcggttaaaaaggattattatttccaaatgtattacgatgatttgccaatctggggatttattggaactgttgacaaagaaggaaaaactgaccctagcgagtataagtattttctttacaagcacattcagtttgatgttctgtataacaaagatcgtgtgattgaagtcagtgcccgaatggatcctcattctgtggtggacctgactgaggacaaggaaattgatgttgagtttatgtatactgtgaaatggaaggaaactgatattccttttgagaagagaatggacaaatattctcagtcttcttctctgccacatcacttggagattcactggttctccatcataaactcctgtgtaacagttcttcttttgactggttttctggcaaccattctcatgcgtgtcttgaagaatgactttatgaaatatgctcaagacgaggaagctgctgatgatcaagaggagacaggatggaagtatattcatggtgatgttttccggtttcctaagtataagtccatatttgcagcagcccttggttctggcactcagttgttcactctcacaatattcatttttatgcttgcacttgttggtgtattctatccctacaaccgaggagctttatttactgcactggtggtcatatatgctctcacatctggcattgctggctatactgctacttccttctatattcaacttgaagggagtaattgggttagaaacttattgctgacaggatgcctcttttgtggcccccttttccttatgttctgcttccttaacactgttgcaattgcttatagtgcaactgcggcacttccttttggtacaattttggtgatagtcctaatatggacgctggtaacttcaccattacttgtattgggtggcattgcaggtaaaaatagcaaaacagagttccaagcacctgtccgtactacaaaatatccccgagaaattccacctctgccttggtacaggagcaccattccccagatggcaatggcaggatttctccctttcagtgccatctacatagagctgtactacatttttgctagtgtctggggccacaggatttatactatctacagcatactcttcatcgtctttattattctgctgattgtcactgctttcatcactgtggctttgacatactttcaacttgctgcggaagatcatgaatggtggtggaggtcttttctttgtgggggatcaactggcttattcatttatggctactgcttgtactactactatgcacgatcagatatgtctggttttatgcaaacttcattcttctttggttacatggcttgcatctgctacggcttctttctcatgctcggtagcgtaggtttccgtgcctctctgctctttgtccgccacatatacaggtccatcaagtgtgagtagttgtggctgaatgttttggtaaggttatatattatttctgttaggtaatgagaaaaagtctacgaatttcttttcctgtcataaggtaggttatatagtgtacctgataacaagggaagctttgactcctctgaattagtgtcatgttattctctgcactttaattgcacatgcttgacacttgaggtagattttggatccatggatttatatgttttattactgtagttactgaaatttatttgaagtagattgtactaattaacttttctgtctgatttgagataatgactatttactattattatcccctgtcaaggtattgttatatggtttctagtcgacaaatacacacaaaaatagcgtttgaataatgtggcatgcattggattttagttaagaatatgtttgtttttgttaaacattaagatgaaatttgatgtgtaaaatgctgaaatcatgacacctgaattatatgattccttacttgggttggggaaccaaataagaaattgagtaatactaactgcaactacaaacaattcaattaatttccgaaaggtttgctattggagaaatggtagtgcaaaattatcttgtgacggaggggatccaaattggataaagtcagttacaaatgcatgatttagttgtgtgtgttttttttttgggtacacagtgaaggtaatgcattctgaacttacaatctcttgcatac

SEQ ID NO: 1794 - DNA, 2165 bp, Zea mays
cttcagatctcccttcccttccgttcctgttcctctctattaagcagcaagcaaagcgccactctcaatccacctcaggcctcgctcagatctctccgcccgggtccatcttcccaccccaaaccttctcccgcctctctcgtcaacgccgcccgacgagagggatggcggccttgcgggctccggccgcaacgctcctcgtcctcctcgccctagcggcggccggcggcgtggcggccgacggctccgatcaccggtacaagattcgcgagcccgtcccgctctacgccaacaaggtcggcccatttcacaatcccagtgaaacatatcgatatttcgacctgcctttctgctctcctgacaaagtgaaggagaagagcgaggcccttggggaggttctcaatggggatcggttagttgatgcgccttacaagcttgatttccgtgacgaagttgagtccaaggcagtttgctcaaagaagcttactacagaggatgtagtgaagttccggaatgcagtggctaaggactactacttccagatgtactatgatgatctcccactgtggggcttcatcggtaaagttgagaagggcggcaaggatgatccgagcgagtggaaatactatctgtacaggcacatcatcttcgacatcctatacaacaacgaccgggtgatcgaaatcaatgtgcacactgatcagagtgcattggttgacctgacagaggataaggagaccaatgtggaattcctgtactcagccaagtggaaggagacaccaacaccattcgagaagaggatggagaagtactccagctcctccaacatgccacaccacctggaggttcattggttctcaattataaactcttgtgttactgtcctcctcctcacagggttccttgcaactatcctcatgcgagtattgaagaatgattttgtcaagtatgcccatgatgaggaagcagccgatgaccaggaagagtctggatggaagtatatccatggtgatgtcttcaggttcccaaagaataagtcgctattttccgctgctcttggcacaggaactcaactatttgctctcacaacctttatattccttcttgcacttgtcggagtattctatccttacaaccgtggtgcactatttactgcattggttgtcatttatgcactcacttcaggaattgctggatacattgctacctctttctattgtcagttggaggggacaaactgggtgaggaacttgctattgacaggatgcctattctgtggacctctcttcctgacattttgcttcttgaacaccgttgctattgcttatagtgccacagcagcactgccctttggcactatctgtgtcattgtgctcatctggaccttggtcacatttcctttgcttgttttgggaggtattgctggcaaaaacagcaaaagtgaattccaagctccttgccgtaccacaaaataccccagggagattcctccacttccgtggtaccggagaactattccacagatggctatggccgggtttttgcctttcagtgccatatacatcgagctgtactacatctttgctagtgtttggggccacaggatttacacaatctacagcattctgtttattgtctttatcatcctccttatcgtcactgcattcatcacagttgcactgacatacttccagcttgctgctgaggaccatgagtggtggtggaggtcattcctatgcggaggatcaactggatttttcgtatacggctactgcctgtactactactatgcgcgatcggatatgtctggcttcatgcagacatctttcttctttggctacatggcctgcatctgctatgcattcttcttgatgcttgggatggtgggcttccgtgcctccttgttctttgtccgccacatatacaaatctatcaagtgtgagtgagctgttgttggaagatcaagagcagcagagctgtacccgtttttggtgccaccgagaagtcccaaatatagaaaaaaaatggtttgctctcgcgtgcaacaggagcagctagtgattgccatgtttcagattaggccattatttatagtaacagctaatgaacctataaatttgttccgttcatgggactgctatgataaaatcgtctttttttgtccg

SEQ ID NO: 1795 - DNA, 2190 bp, Panax ginseng
gtttccagtcctggatttgcccttgcagggagatcgagacctgtgcgtcctatatatatacatattatattcgcatgatctgtgtgtttatgtgactgaaaatggagcagaagatgggcttgttattcatggtgtcatttctggtgatgatgagcagtgcatcactagtaagatcgagtgcatcaactcacaaatacaaagctggtgatcaagttcctctttacgtcaacaaagtcggtcctttccaaaaccctagcgagacgtaccgttacttcgatcttccgttctgtatgccaggttcaactcatttacttgataaaccggaagctcttggtgaagttttgaatggagatcgtttagttagtgccccctaccagctcaactttttagttgagaaagattcggaaattgtttgcaagaagacgctgacaaaagaagaagtttctaaattccgaagtgctgttgccaaggactactattttcagatgtactatgatgacttgcccctttggggtttcttggggaaggctgagaaggatgccaaagccgatcccagtgaaatcaaatattatctatttaagcatcttcattttgaggtattttacaataaggatcgtgtcattgaggttaatgtacgaactgaccctagtgctcttgtggaccttacggaagacaaggaagttgatgcagactttatgtacactgtcaagtggaaagaaacacacactccttttgagaaaagaatggacaagtactcacagtcgtctaatatgccacatcatttggagatacattggttctcaatcattaattcctgtgtgacggttcttctcttaactggttttcttgccacaattctcatgcgagttcttaaaatgattttgttaagtatgctcatgatgaagagacagctgaggaccaagaagaaactggatggaagtacatccatggtgatgttttccggtacccaaagtacaaatctgtgtttgctgcagctcttggttctggcacccaactatttgccattgcaatattagttttcatgcttgcgctggttggcgtattctatccatacaaccggggagctttgtttactgcgctggttatcgtatatgcgctcacatctgggtttgcaggctatactgcagcctcgttctattgccaactggaaggaacaaactgggtaaggaatctgttgttgaccggaagtctcttttgtgggcctctgtttctcacattctgctttcttaataccgttgcaattgcttacaatgccactgcggctctgccatttggtacaattgtggtgatagttcttatatgggccctagtgacgtctcctttgctagtcttgggtggaattgctggaaagaacagcaaggcggagtttcaagctcctgttcgaaccacaaagtatcccagggagattccaccattgccttggtatcgtggaagtcttcctcagatggcaatggctgggtttctgcctttcagtgctatctatattgaactctattatatatttgccagtgtttggggtcacaggatttacaccatttacagcatcttattcattgtcttcatcattcttctgattgtaacggctttcattaccgttgcattgacatattttcaacttgctgctgaggaccatgaatggtggtggaggtcttccttgtggtggatcaactgggctgttcatttatggctattgcttgtattactactatgcacgatcagatatgaacggtttcatgcaaacctccttcttctttgggtacatggcttgtatttgctatggtttctttctcatgctcgggaccgtcggtttccgtgcatcactgttttttgttcgtcacatatatcgctcaatcaagtgtgagtaatgagaaagttgggtggtacttcaagttcaaaactaagcttttcaaatgttggacgccaatcttggatcgaagaggaccatgtaggacagtaggacttcatagtacaaatgcttgtattattttacaatggcatcatgtgggaactgttatcctcgttttgcattatagctcaaaattttatgttctactagttatacattcttcctaaaaatatgatatttgttcactgttctaatattaaaaaaaaaaaaaaaaaaaaaaaaaaaaaaaaaaaaaaaaaaaaaaaaaaaaaaaaaaacaaaaa

SEQ ID NO: 1796 - DNA, 2037 bp, Panax ginseng
cctatatatatacatattatattcgcatgatctgtgtgtttatgtgactgaaaatggagcagaagatgggcttgttattcatggtgtcatttctggtgatgatgagcagtgcatcactagtaagatcgagtgcatcaactcacaaatacaaagctggtgatcaagttcctctttacgtcaacaaagtcggtcctttccaaaaccctagcgagacgtaccgttacttcgatcttccgttctgtatgccaggttcaactcatttacttgataaaccggaagctcttggtgaagttttgaatggagatcgtttagttagtgccccctaccagctcaactttttagttgagaaagattcggaaattgtttgcaagaagacgctgacaaaagaagaagtttctaaattccgaagtgctgttgccaaggactactattttcagatgtactatgatgacttgcccctttggggtttcttggggaaggctgagaaggatgccaaagccgatcccagcgaaatcaaatattatctatttaagcatcttcattttgaggtattttacaataaggatcgtgtcattgaggttaatgtacgaactgaccctagtgctcttgtggaccttacggaagacaaggaagttgatgcagactttatgtacactgtcaagtggaaagaaacacacactccttttgagaaaagaatggacaagtactcacagtcgtctaatatgccacatcatttggagatacattggttctcaatcattaattcctgtgtgacggttcttctcttaactggttttcttgccacaattctcatgcgagttcttaaaaatgattttgttaagtatgctcatgatgaagagacagctgaggaccaagaagaaactggatggaagtacatccatggtgatgttttccggtacccaaagtacaaatctgtgtttgctgcagctcttggttctggcacccaactatttgccattgcaatattagttttcatgcttgcgctggttggcgtattctatccatacaaccggggagctttgtttactgcgctggttatcgtatatgcgctcacatctgggtttgcaggctatactgcagcctcgttctattgccaactggaaggaacaaactgggtaaggaatctgttgttgaccggaagtctcttttgtgggcctctgtttctcacattctgctttcttaataccgttgcaattgcttacaatgccactgcggctctgccatttggtacaattgtggtgatagttcttatatgggccctagtgacgtctcctttgctagtcttgggtggaattgctggaaagaacagcaaggcggagtttcaagctcctgttcgaaccacaaagtatcccagggagattccaccattgccttggtatcgtggaagtcttcctcagatggcaatggctgggtttctgcctttcagtgctatctatattgaactctattatatatttgccagtgtttggggtcacaggatttacaccatttacagcatcttattcattgtcttcatcattcttctgattgtaacggctttcattaccgttgcattgacatattttcaacttgctgctgaggaccatgaatggtggtggaggtctttcctttgtggtggatcaactgggctgttcatttatggctattgcttgtattactactatgcacgatcagatatgaacggtttcatgcaaacctccttcttctttgggtacatggcttgtatttgctatggtttctttctcatgctcgggaccgttggtttccgtgcatcactgttttttgttcgtcacatatatcgctcgatcaagtgtgagtaatgagaaagttgggtggtacttcaagttcaaaactaagcttttcaaatgttggacgccaatcttggatcgaagaggaccatgtaggacagtaggatttcgcagtacaaatgcttgtattattttataatggcatcatgtgggactcgttttgcattatagctcaaaattttatgttctactagttatagattcttcc

SEQ ID NO: 1797 - DNA, 2291 bp, Zea mays
gccactcgcaatcgcaacccaccaccctcaggtcaggcctcgctcagatctctccgccctcgtcccccctcacaccccaaaccctcggcccgcctctctcgtcaacgccgcccgacgagagcgatggcggcctcgccggccgcggccgcggcactcctcatcctcttcgccctcggggcggccggcggagtggcggccgacggctccgaccaccggtacaagatgtacgagcccgtcccgctctacgccaacaaggtcggccccttccacaatcccagtgagacatatcgttacttcgacctgcccttctgctctcctgagaaagtgaaggagaagagcgaggcccttggcgaggtcctcaatggggatcggctagttgatgcgccttacaagcttgatttccgttcggaagttgagtccaaggcggtttgctcaaagaagcttaccaaagaggatgtagtgaagttccggaatgcagtagcgaaggactactacttccagatgtactatgatgatctcccactgtggggcttcattggtaaagttgagaagggaggcaaggccgatccgagcgagtggaagtactacctgtacaggcacatcatcttcgatatcctgtacaacaacgaccgggtgattgaaatcaatgtgcacactgatcagagtgctttggttgacctgacggaggataaggagacaaatgtggatttcctgtactcagtcaagtggaaggagacaccaacaccatttgagaagaggatggagaagtactccagctcctccaacatgccgcaccacctggaggttcattggttctcaattataaactcttgtgttactgtcctcctcctcacagggttccttgcaacaatcctcatgcgagtattgaagaatgattttgtcaagtatgcccatgatgaggaagcagctgatgaccaggaagagtctggatggaagtatattcatggtgacgtcttccggttcccaaagaataagtcgctattttccgctgctcttggcacaggaactcaattatttgcactcacaacctttatatttcttcttgcacttgttggagtattctacccttacaaccgtggtgcactatttactgcattggttgtcatctatgcactcacttcaggaattgctggatacgttgctacctctttttattctcagctggaggggacaaactgggtgaggaacttgctattgacaggatgcctgttctgtggacctctcttactgacattttgcttcttgaacactgttgctattgcttatagtgcaacagcagcactgccctttggcactatctgtgtcattgtgctcatctggaccttggtcacgtttcctttgcttgttttgggtggtattgctggtaaaaacagcaaaagtgagttccaagctccttgccgtaccacaaaataccccagggagattcctccacttccctggtaccggagaaccattccacagatggctatggctgggttcttgcctttcagcgccatatacattgagctatactacatctttgctagtgtttggggccacaggatctacacaatctacagcattctgtttattgtcttcatcatcctccttattgtcaccgcgttcatcactgttgcactgacatacttccagcttgctgctgaagaccatgagtggtggtggaggtcattcctttgcggaggatcaactgggtttttcgtgtacggctactgcctgtactactactatgcgcgatccgacatgtctggcttcatgcagacatctttcttctttggctacatggcctgcatctgctatgcattcttcttgatgctcgggatggtgggcttccgcgccgccctgttctttgtccgccacatatacaaatcaatcaagtgtgaatgagctgttgctggggagacgaagagcagcagagttgtacccgtttttggtgccccaccgagaggtcccagatatagaaaaggttagctctcgcatgcgacaggagcagctagagattgccatgtttcagagtaggccaattatttataggaacaggtaatgaacctataaatttgttctgtttttgtgactgctgtgataaaaagaccgtctgttccttcgtcctatgtatcatctcctagtgacgtcagacagcactataactttgttggaaccgtgacatgcctgaatatctgtggaaaaagaaacccgtgttatgttgttatatatgttctctaaagcatagaataatagaagtgtagacctctagtgtggcaggttcatctgta

SEQ ID NO: 1798 - DNA, 2318 bp, Lolium multiflorum
acccatcagatctccatcctcctcccgaggtctctctccctctctattaagaagcacaagcaaaggcgccactcagatctcccctccccgtcttccacccctcgtgccccgagccctcccgcctcgcgcccgtcaacgctgccgcccggggagagatggcatcgccggcggcgggccggcggccgcggcgctcctcctcctgctcgccttcgccgtggccggcgtcctcgccgacggctccgaccaccgctacaagtccggcgaccccgtcccgctctacgccaacaaggtcggccccttccacaaccccagcgagacgtaccggtacttcgacctccctttctgctcccccgaggaggtgaaggagaagaaggaggcgctgggcgaggtactcaacggggaccggctggtcgacgcgccctacaagctcggcttccgcaccgactacgactccaaggcggtctgctccaagcggctcaccaaggaggacgtggcccggttccgcgcctcggtcgccaaggactactacttccagatgtactacgacgacctcccgctctggggcttcatcggcaaggtcgacaagggcaacaagctgcccccctccgagtggaagtactacctctacaagcacatcatcttcgacatcctctacaacgccgaccgcgtcatcgagatcaacgtgcacaccgaccagagcgccctcgtcgacctcaccgacgacaccgagagggacgtcgagttcctttacactgtcaagtggaaggagactgcaacgccgtttgagaagaggatggagaagtactcaagctcgtccaacatgccgcaccacctcgaggttcactggttctccattattaactcctgcgtcaccgtcctgctcctcactggcttcttggccaccatcctcatgcgagtgctcaagaatgattttgtcaaatatgcccatgatgaggaagcagttgatgaccaagaagagtctggatggaagtacattcatggtgatgtcttccgcttccccaagaacaagtcattgttttcggctgctcttggcactggaactcagttgtttgctctgacaacctttatattcctgcttgcacttgttggagtattctacccttacaatcgtggtgcacttttcactgcattggtcgtcatctatgcacttacttcaggaattgctgggtacattgcaaccgcgttctattgccagctcgagggaacaaactgggtgaggaatttgctattaacaggatgcctgttttgtggacctctcttcctgacattctgctttttgaacactgttgctattgcttatagtgcaacggctgcattgccattcggcaccatctgtgtcattgtgctcatctggaccttggttacatttcctctactagttttgggtggcattgcgggtaaaaacagcaagagtgaattccaagctccttgccgtaccaccaaataccctagggagattcctccacttccctggtaccggacaacagttccacagatggctatggctggatttttgcctttcagtgctatatatattgagctctactacatctttgcaagtgtttggggccaccgaatttacaccatttacagcatcctctttatagtctttatcatcctcctcatcgtcactgccttcattactgttgcgctgacatacttccagcttgctgctgaagaccatgagtggtggtggaggtcattcctaattggaggatccactggatttttcgtctatggctactgtctgtactactactatgcacgatcggatatgtctggcttcatgcagacatccttcttctttggctacatggcctgcatctgctacgcattcttccttatgctcggcatgataggtttccgtgccgccttgttctttgttcggcacatatacaagtccatcaagtgtgagtaaactgcgatggagaatgaagagcagcagagttgtactcctttttggtgccctctaagaagtcccagtatagaaaaggttagctctcgcgtgcaacaggaagcaactagagaggttggcatgtttcagattaggccattattcataggaacaggtaatgaacctataaatttgttgttctgtttgtgcgactggtatgataaattgtcttttccttcctcccatgtattatctcctatgtgacatccggacagtattactttgttgaaccatgaccctacatgaatatctatggaagctcttattatgttatgtcatatttgctatggcagaataacagaagtgtagagatgattcctcaaaaagggcatgtccagtcaat

SEQ ID NO: 1799 - DNA, 2119 bp, Panax ginseng
cagtggtatcaacgcagagtacatggggccttacagggagatcgagatctgtgagccctaattctcccactcctctctctttatataatccatattcacataatctgtgtgtgttttatgcctgtgtgagtgaaaatggagcagaagatatgttcgttgttcatggtggcattactggtgatgaccagtgcatcgctagtgagatcgagtgcctcaaatcacagatacaaaccacgggatccggtacctctttacgtcaacaaagttgggccttttcaaaaccctagtgagacataccgttattttgatcttccgttctgtatgccaggttcaactcatttgcttgataaaccggaagctctgggtgaagtattgaatggagatcgattagttagtgccccataccagctcgactttttacttgacaaagactcggaaattgtttgcaagaagaggctgacaaaggaagaagtttctaaattccgaagtgctgttgcgaaggactactattttcagatgtactatgatgacttgcccctctggggtttcttggggaaagctgagaaggacgctaaagctgatcccagcgagaacaaatattatctatttaagcatcttcattttgaggtactttacaataaggatcgtgtcattgaggttaatgtacgaactgacccaagtgctcttgtggaccttacggaagacaaggaagttgatgcagtctttatgtacactgtcaaatggaaagagacaaacactccttttgacaaaagaatggataagtactcacagtcgtctaatatgccacatcacttggaaatacattggttctcaatcattaattcctgtgtgacagttctcctcttaactggctttcttgcgacgattcttatgcgagttcttaaaaacgactttgtcaagtatgctcatgatgaagagacagctgaggaccaagaagaaactggatggaagtacatccatggggatgttttccggtacccgaagtacaaatctgtgtttgctgcagctcttggttctggcacccagctatttgctattgcaattttagttttcatgcttgcactggttggtgtattctatccatacaaccgaggagctttatttactgcgctggttatcatatatgcgcttacatctgggtttgcgggctatactgcagcctctttctattgccaactggaaggaacaaactgggtaaggaatctgttgttgactggaagtctcttttgtggacctctgtttctcacattctgctttcttaataccgttgcaattgcttacaatgccactgcggcactgccatttggtacaattgtggtgatagctcttatatgggccctagtgacatcacctttgctagttttgggtgggattgctggaaagaatagcaaggcagagtttcaagctcctgttcgaaccacaaagtatcccagggagattcctccattgccttggtatcgtggaactcttcctcagatggcaatggctgggtttctgccttttagtgccatctatattgagctttactatatatttgccagtgtgtggggtcacaggatttacaccatttacagcatcttattcatcgtcttcataattcttctgattgtaacggctttcattaccgtggcactgacatattttcaacttgctgctgaggaccatgaatggtggtggaggtctttcctttgtggtggatcaactgggttgttcatttacggctattgcttgtattactactatgcacgatcagatatgaatggtttcatgcaaacctccttcttctttgggtacatggcttgcatttgctatggattctttctcatgcttgggactgttggtttccgcgcatcactgttttttgttcgccacatatatcggtcgatcaagtgcgagtagcgagtctttaagctcaagagtgtgctatacaaatgtcgagtgccaatctcagagcaaagaagaccatttaggacaataggacttgtcagcacgaacacttgtaatattttacagttgcatgcatcatgtggaaaaggttatctttgttttgtgttacagctcaaaattttatgttatattagttatagattcttcttaa

SEQ ID NO: 1800 - DNA, 3414 bp, Panicum virgatum
cgcctcagatctctccgccccgtctccctccttccaccccccaaaccctcgccccgcctcccctcgtcaacgccgcccgacgagagcgatggcggcctcgccggccgcggccgcggcgctcctcgccctcctcgccctcgcggcggccggcggcgtggcggccgacggctccgaccaccgctacaaggccggcgagcccgtcccgctctacgccaacaaggtcggccccttccacaaccccagtgagacatatcggtacttcgacctgcctttctgctctcctgagaaagtgaaagagaagagcgaggcccttggtgaggtcctcaatggggatcgcttggtcgatgcaccttacaagcttgatttccgtgtggacattgaatccaagccggtttgctcaaagaagctcaccacggaggatgtggtcaagttccggaatgcagtagctaaggactactacttccagatgtactatgatgatctcccactatggggtttcattggtaaagttgagaagggaggcaaggctgacccgagcgagtggaagtactacctatacaggcacatcatcttcgatatcctctacaacaacgatcgggtcatcgagatcaatgtgcacactgatcagagtgcattggttgacctgacagaggataaggagaccaatgtggatttcctttactcggtcaagtggaaggagacacctacaccatttgagaagaggatggaaaagtattccagctcctccaacttgccacaccacctggaggttcattggttctcgattataaactcttgtgttacagtcctcctcctcacagggttccttgcaacaatcctcatgcgagtactgaagaatgattttgtcaagtatgcccatgatgaggaagcagctgatgaccaagaagagtctggatggaagtacattcatggtgatgtcttcaggttccccaagaataagtcgctattttccgctgctcttggcacaggaactcaactatttgccctcacaacctttatattcctgcttgctcttgttggagtattctacccttacaaccgcggtgcattgtttactgcattggttgtcatctatgcactgacttcaggaattgctggatacattgctacctctttctactgtcagctggaggggacaaactgggtgaggaacttgctgttgacaggatgcctcttttgtggacctctcttcctgacattctgcttcttgaacacagttgctattgcttatagtgcaacagcagcattgccgtttggcactatctgtgtcattgtgctcatctggaccttggtgacatttcctttgctcgttttgggaggtattgctggtaaaaacagcaaaagtgaattccaggctccttgccgtaccacaaaataccccagggagattcctccacttccctggtaccggaaaacaattccgcagatggctatggctggatttttacctttcagtgccatatacattgagctgtactacatctttgccagtgtttggggccacaggatttacacaatctacagcattctctttatcgtctttatcatcctccttattgtcactgctttcatcactgttgcactgacgtacttccagcttgctgccgaagatcatgagtggtggtggaggtcgttcctatgtggaggatcaactggtttctttgtctatggctactgcctgtactactactatgcacgatcggatatgtctggtttcatgcagacatctttcttctttggctacatggcctgcatctgctatgcattcttcttgatgcttgggatggtgggcttccgcgctgccttgttctttgtccgccacatatacaaatccatcaagtgcgaataagctgtttgtcagaggatgaagagcagcagagttgtacctgtttttggtgccactgagaagtccaaatatagagattgccgtgtttcagattaggccattatttataggaacaggtaatgcacctataaatttgttatgttatgtgtctgctgtgataaaaatcgtcttacccttcgtcctatgtattatcccttagtgacgtcagacagtaactttgttggaaccatgacatgcctgaatatctgtggaagacccatgttgtgttctgtcatattctctaaagcgtaataacagatgtgtagagacgatgcctctagagggggtaagtccatttatacgtgtatccattgcttcattgtgaactgttgaaatggcagtcatttttggcactcatgactcatgagctttttgtatttttcaaaatttatcaccattcacaggattgggactcgctgcttccttggccgcggtccggttttccagcttgttcaattgctcatgtttcgattaattgttccacaatcaaactgtcatgacttaccaggatcaacatgctccgctagttgaccacacgtcgcagttgcagttgcagctgccaagtggcaggagtgcggctagcggcgataggctgacgatgtggtggatggatacagctcatctttgtatggatcccactacttttctggctgatgatattgcacagtttgaaggagctgaattctacaggtccagaattgagacttcacgttcccgataagcaccagcgtgatgttgcagctgcaaacttgcaatgcaaccctcgcggcggagctcacgcctttcgcgtcggagcctcaaccccacataatatcgcaaaatccaagatccctgtcggtcatggatgtccccttgtccggaggtggcgagtgcatgcctacacggtgacgcagcgcgggggccgcgggggcggacggcacgaacctgcccgatctctatctcgcgcggcacagcacaacacaacaaaaccgcaggaaggcatgacctgggcctctacctttggtggtgaccatccctttttgttcctgcatcggaactggcatcaatcaagcaggtaaacgccacagccccaagcgtaaaacccgcacgttacagcccccgtaaacgtgaaggaatccaaagcgaaaaaaaaacaagccacgtcactgaagatcactgtagtactccaccaccctccagcagcgctcctcacgttctccgccgacatggacgccttctgcaccgagactgccagtacaccgaatatttctttgtttttaccgatcgggcacgcacgcatttcatgagggaggccgagcgaggcgccagctccaacgaggcatagacgtgtatatatacgccgtgcccggcatgtcctgggacaccaacaaagccaagaggtgtcgacgacactcggacgcgcacgcggcacgcctaacgccgggactccgggagggttgagttgtgtgttggggaatggggaccatgagcgccgccaccgagcgagccccgtgcggcctgccgcggat

SEQ ID NO: 1801 - DNA, 2075 bp, Panax ginseng
acagggagatcgagatctgtgagccctaattgtcccactcctctctctttatataatccatatgcacataatctgtgtgtgatttatgcctgtgtgagtgaaaatggagcagaagatatgttcgttgtttatggtggcattactagtgatgaccagtgcatcgctagtgagatcgagtgcctcaaatcacagatacaaaccacgggatccggtacctctttacgtcaacaaagttgggccttttcaaaacccaagtgagacataccgttattttgatcttccgttctgtatgccaggttcaactcatttgcttgataaaccagaagctctgggtgaagtattgaatggagatcgattagttagtgccccataccagctcgactttttacttgacaaagactcagaaattgtttgcaagaagaggctgacaaaggaagaagtttctaaattccgaagtgctgttgcaaaggactactattttcagatgtactatgatgacttgcccctctggggtttcctggggaaagctgagaaggacactaaagctgatcccagcgagaacaaatattatctatttaagcatcttcattttgaggtactttacaataaggatcgagtcattgaggttaatgtacgaactgaccctagtgctcttgtggaccttacggaagacaaggaagttgatgcagtctttatgtacactgtcaaatggaaagagacaaacactccttttgacaaaagaatggataagtactcacagtcgtctaatatgccacatcacttggaaatacattggttctcaatcattaattcctgtgtgacagttctcctcttaactggctttcttgcgacgattcttatgcgagttcttaaaaacgactttgtcaagtatgctcatgatgaagagacagctgaggaccaagaagaaactggatggaagtacatccatggggatgttttccggtacccgaagtacaaatctgtgtttgctgcagctcttggttctggcacccagctatttgctattgcaattttagttttcatgcttgcactggttggtgtattctatccatacaaccgaggagctttgtttactgcgctggttatcatatatgcgcttacatctgggtttgcgggctatactgcagcctctttctattgccaactggaaggaacaaactgggtaaggaatctgttgttgactggaagtctcttttgtggacctctgtttctcacattctgctttcttaataccgttgcaattgcttacaatgccactgcggcactgccatttggtacaattgtggtgatagctcttatatgggccctagtgacatcacctttgctagttttgggtgggattgctggaaagaatagcaaggcagagtttcaagctcctgttcgaaccacaaagtatcccagggagattcctccattgccttggtatcgtggaactctttctcagatggcaatggctgggtttctgccttttagtgccatctatattgagctttactatatatttgccagtgtgtggggtcacaggatttacaccatttacagcatcttattcattgtcttcataattcttctgattgtaacggcttttattaccgtggcactgacatattttcaacttgctgctgaggaccatgaatggtggtggaggtctttcctttgtggtggatcaactgggttgttcatttacggctattgcttgtattactactatgcacgatcagatatgaatggtttcatgcaaacctccttcttctttgggtacatggcttgcatttgctatggattctttctcatgcttgggactgttggtttccgcgcatcactgttttttgttcgccacatatatcggtcgatcaagtgcgagtagcgagtctttaagctcaagactatgctatacaaatgtcgagtgccaatctcggagcaaagaagacaatttaggacaataggacttgtcagcacgaacacttgtaatattttacagttgcatgcatcatgtggaaaaggttatccttgttttgtgttacagctcaaaattttatgttatattagttata

SEQ ID NO: 1802 - DNA, 2026 bp, Sorghum bicolor
cccgcgcctgcgtccccttgtccgcgtccctcctcccaccccccaaaccctcgcccgcctctctcgtcaacgccgcccgacgagagcgatggcggcctcgccggccccggccgcggccgcagcgctcctcgtcctcctcgccctcgcggcggccggcggcgtggcggccgacggctccgaccaccggtacaagatgaacgagcccgtcccgctctacgccaacaaggtcggccccttccacaatcccagtgagacatatcgttacttcgacctgcctttctgctctcctgagaaagtgagggagaagagtgaggcccttggcgaggtcctcaatggggatcggttagttgatgcgccttacaagcttgatttccgtttagaagttgagtccaaggcagtttgctcaaagaagcttaccgtagaggatgtagtgaagttccggaatgcagtggcaaaggactactacttccagatgtactatgatgatctcccattgtgggggttcattggtaaagttgagaagggaggcaaggctgatccgagcgagtggaaatactacctgtacaggcacatcatctttgatatcctatacaacaacgaccgggtgatcgaaatcaatgtgcacactgatcagagtgcattggttgacctgacggaggataaggagaccaatgtggaattcctgtactcagtcaagtggaaggaaacaccaacaccattcgagaagaggatggagaagtattccagctcctccaacatgccacaccacctggaggttcattggttctcaattataaactcttgtgttactgtcctcctcctcacagggttccttgcaacaatcctcatgcgagtattgaagaatgattttgtcaagtatgctcatgatgaggaagcagctgatgaccaggaagagtctggatggaagtatatccatggtgatgtcttccggttcccaaagaataagtcactattttctgctgctcttggcacaggaactcaactatttgccctcacaacctttatatttcttcttgcacttgttggagtattctacccctacaaccgtggtgcactatttactgcattggttgtcatctatgcactcacttcaggaattgctggatacgttgctacctctttctattgtcagctggaggggacaaactgggtgaggaacttgctattgacaggatgcctgttctgtggacctctcttcctgacattttgcttcttgaacactgttgctattgcttatagtgcaacagcagcattgccctttggcactatctgtgtcattgtgctcatctggaccttggtcacatttcctttgcttgttttgggaggtattgctggcaaaaacagcaaaagtgaattccaagctccttgccgtaccacaaaataccccagggaaattcctccgcttccctggtacaggagaactgttccacagatggcaatggccgggtttttgcctttcagtgccatatacatcgagctatactacatctttgctagtgtctggggccacaggatttacacaatctacagcattctgtttattgtcttcatcatcctccttattgtcactgcattcatcactgttgcactgacatacttccagcttgctgctgaggaccatgagtggtggtggaggtcattcctatgcggaggatcaactggatttttcgtgtacggctactgcctgtactactactatgcgcgatcagacatgtctggcttcatgcagacatctttcttctttggctacatggcctgcatctgctatgcattcttcttgatgcttgggatggtgggcttccgtgcggccttgttctttgtccgccacatatacaaatctatcaagtgtgagtgagcggttgttggaagatgaagagcagcagagttgtacccgtttttggtgcccactgagaagtctcaaatatagaaaaggttagctctcgcgtgcaacaggagcagctagagattgccatgtttcagattaggccattatttataggaacag

SEQ ID NO: 1803 - DNA, 2954 bp, Panicum virgatum
atctctccgccccgtctccctcctcccaccccccaaaccctcgccccgccctcccctcgtcaacgccgcccgacgagagcgatggcggcctcgccggccgcggccgcggcgctcctcgccctcctcgccctcgcggcggccggcggcgtggcggccgacggctccgaccaccgctacaaggccggcgagcccgtcccgctctacgccaacaaggtcggccccttccacaaccccagtgagacgtatcggtacttcgacctgcctttctgctctcctgagaaagtgaaagataagagcgaggcccttggtgaggtcctcaatggggatcgcttggtcgatgcaccttacaagcttgatttccgtgtggacctcgaatccaagccggtttgctcaaagaagctcacaacggaggatgtggccaagttccggaatgcagtagctaaggactactacttccagatgtactatgatgatctcccactatggggtttcattggtaaagttgagaagggaggcaaggccgacccaagcgagtggaagtactacctatacaggcacatcatctttgatatcctctacaacaacgaccgggtcatcgagatcaatgtgcacactgatcagagtgcattggttgacctgacggaggataaggagaccaatgtagaattcctttactcggtcaagtggaaggagacacctacaccatttgcgaagaggatggagaagtattccagctcctccaacttgccacaccacctggaggttcattggttctcgattataaactcttgtgttacagtcctcctcctcacagggttccttgcaacgatcctcatgcgagtactgaagaatgattttgtcaagtatgcccatgatgaggaagcagctgatgaccaagaagagtctggatggaagtatatccatggtgatgtcttcaggttccccaagaataagtcgctattttccgctgctcttggcacaggaactcaactatttgccctcacaacctttatattcctgcttgctcttgttggagtattctacccttacaaccgcggtgcattgtttactgcattggttgtcatctatgcactgacttcaggaatcgctggatatgttgctacctctttctactgtcagctggaggggacaaactgggtgaggaatctgctgttgacaggatgcctcttctgtggacctctcttcctgacattctgcttcttgaacacagttgctattgcttatagtgcaacagcagcattgccatttggcactatttgtgtcattgtgctcatctggaccttggtgacatttcctttgctcgttttgggaggtattgctggtaaaaacagcaaaagtgaattccaagctccttgccgtaccacaaaataccccagggaaattcctccacttccctggtaccggaaaacaattccgcagatggctatggctggatttttgcctttcagtgccatatacattgagctgtactacatctttgccagtgtttggggccacaggatttacacaatctacagcattctctttattgtctttatcatcctccttattgtcactgctttcatcaccgttgcactgacgtacttccagcttgctgccgaagatcatgagtggtggtggaggtcgttcctatgtggaggatcaactggtttctttgtctatggctactgcctgtactactactatgcacgatcagatatgtctggtttcatgcagacatctttcttctttggctacatggcctgcatctgctatgcattcttcttgatgcttgggatggttggcttccgcgctgccttgttctttgtccgccacatatacaaatccatcaagtgcgaatgagatgcttgttgaagatgaagagcagcagagttgtacctgtttttggtgccactgagaagtccaaatatagaaaaggttagctctcgcgtgcaacaggagcagctagagattgccgtgtttcagattaggccattatttataggaacaggtgagaacctataaatttgttatgtttatgcgactgctgtgataaaaaatcgtctttcccttcgtcctatgtattatccccctagtgacgtcagacagtaactttgttggaaccatgacatgcctgaatatctgtggaagacccatgttgtgttctgtcatattctctaaaacataataacagatgtgtagagactatgcctctggagggggcaagtccatttatacgtgtatccattgcttcattgtgaactgttgaaatggcagtcatgtttggtactcatgagctttctgtattttcaaaatttatcagctttcacaggattgtggaagccatcaaactgtcttgactcatgttgaccgctgcttccttggccacggtccggttttccgctcaattgctcctgtttcgattaattttttccacaatcaaactgtcttgacttgccaggatcaacatgctctgctagttgcccacacgtcgcagttgcagctgccaaagtggcaggagtgcggctagcatgaaggcgataggctcacgatgtggtggatggatacagctcatgatcatctttgtatgggtcccagtactacttttctcgctgaatgctacaggtccagaattgagacttcccgataaacaccagcatgatgttgcagctgcaaacttgcaatgcaaccctggcggagctcatgcctttcgcgtcggagcctgaaacccacataatatagcaaaatccaagctccctgtcggtcatggatgtccccttgtccggaggtggcgagtgcatgcctacacggtgacgcagcgcggggccgcgggggcggacggcatgaacctgcccggtctctatctcgcgcggcacagtacaacacaacaaagccgcgcaggatggcatgacctgggcctcccccctcacaccttggtggtgaaacgccacagc

SEQ ID NO: 1804 - DNA, 2366 bp, Setaria italica
tccgtccctctctattaagcagcaagcaaagcgccactcgcaatcccgcaagtctcagatctctccgccccccgtctccgtctctcttccacccccaaaccctcctcgccccgcctccctcgtcaacgccgcccgacgagagcgatggcggcctcgccggccgcggccgcggcgctcctcgccctcctcgccctcgcggcggccggcggcgtggcggctgacggctccgaccaccgctacaaggccggcgagcccgtcccgctctacgccaacaaggtcggccccttccacaaccccagtgagacgtatcggtactttgacctgcctttctgctctcctgagaaagtgagggagaagagcgaggccctgggtgaggtccttaatggggatcggctggtcgatgcaccttataagcttgatttccgtgtggaccttgactccaggtcggtttgctcaaagaagctcaccacggaggatgtggccaagttccggaatgcagtagctaaggactactacttccagatgtactatgatgatctcccactatggggtttcattggtaaagttgataaggaaggcaaggctgacccgagcgagtggaagtactacctatacaagcacatcatcttcgatatcctcttcaacaatgaccgggtgatcgagatcaatgtgcacactgatcagagtgcattggttgacctgacggaggataaggagaccaatgtggaattcctttactcggtcaagtggaaggagacacttacaccatttgagaagaggatggagaagtattccagctcctccaacttgccacaccacctggaggttcattggttctcgattataaactcttgtgttacagtcctcctcctcacagggttccttgcaacgatcctcatgcgagtactgaagaatgattttgtcaagtatgcccatgatgaggaagcagctgatgaccaagaagagtctgggtggaagtatatccatggtgatgtcttccggttccccaagaataagtcactattttctgctgctcttggtacaggaactcaattatttgccctcacaacctttatattcctgcttgcacttgttggagtattctacccttacaaccgtggtgcattgtttactgcattggttgtcatctatgcgctcacttcaggaattgctggatacattgctacctctttctattgtcagctggaggggacaaactgggtgaggaacttgctattgacaggatgcctgttttgtggacctctcttcctgacattctgtttcttgaacacagttgctattgcttatagtgcaacagcagcattgccctttggcacgatctgtgtcattgtgctcatctggaccttggtgacatttcctttgctcgttttgggaggtattgctggtaaaaacagcaaaactgaattccaagctccttgccgcaccactaaataccccagggagattcctccacttccctggtaccggcaaacaattccccagatggctatggctgggtttttgcctttcagtgccatatacattgagctgtactacatctttgctagtgtttggggccacaggatttacacgatctacagcattctctttatagtctttatcatcctccttatcgtcactgctttcatcactgttgcactgacgtacttccagcttgctgctgaagaccatgagtggtggtggaggtcattcctatgtggaggatcaaccggtttctttgtatatggctactgcctgtactactactatgcacgatcagacatgtctggcttcatgcagacctctttcttctttggctacatggcctgcatctgctatgcattcttcttgatgctcgggatggtgggcttccgtgccgccttgttctttgtccgccacatatacaaatccatcaagtgtgagtgagctgtctgttggaagatgaagagcagcagagttgtacccgtttttggtgccactaagaagtcccaaatatagaaaaggttagctctcgcgtgcaacaggagcagctagagattgccgtgtttcagattaggccattatttataggaacaggtaatgaacctataaatttgttatgtttatgccactgctgtgataaagatcgtcttttccttcgccctatgtactatctcctagtgacgtcagacagtaccataacatttgttggaaccatgacatgcctgaatatctgtggagtacccgtgttgtgttgtcttgtgtgctctaaagcaaaataacagatgtgtagagacgatgccacttgaggggcaagtccatttatacgtgtattcactgcttcattgtgaactgttaaaatggcagtcattttttgtactcatgag

SEQ ID NO: 1805 - DNA, 2346 bp, Brachypodium distachyon
tcttctcccctctctattaagaagcgccactcagatctccccgcccgaaccccccccccccccccccccccccccccccgcctctgcctccctcgtcaacgcagcacgaggacgagcgcgatggcatcgccggccgcgggcgcggcctcggcggtcctcctcttgctcgccttcgccgtggcgggggtgctctccgacggctcggaccaccgctacaagtccagcgagcccgtcccgctctacgccaacaaggtcggccccttccacaaccccagtgagacgtatcggtacttcgacctccctttctgctctcccgaaaaagtgaaggagaagagtgaagcccttggggaagtcctcaatggggatcgtttggttgatgcaccgtacaagcttgatttccgtgtggatcttgactccaagccggtttgctcaaagaagctcaccaaggaggatgttgcaaagttccggaactcagtagctaaggactactacttccagatgtattatgatgatcttccactgtggggtttcattggtaagctggaaaagacagccaaggccgacccgagtgagtggaagtattacctatacaggcacattatctttgacatcctctacaacaatgaccgggtgattgagatcactgtgcatactgaccagagtgcactggtcgacctgacggaggataaggaggctaatgtggagttcctttacactgtcaagtggaaggagacagcaacaccatttgagaagaggatggagaagtactccagttcctccaacctcccgcatcacctggaggttcattggttctcgattatcaactcttgtgttacggttcttctcctgacagggttcttggcgacaatcctcatgcgagtactgaagaatgattttgttaagtatgcccatgatgaagaagcagctgatgaccaagaagagtctggatggaagtatatccacggtgatgtcttccggttccccaagaacaagtcattgttttcggctgctcttggcactggaactcagctgtttgctctaacaacctttatattcttgcttgcacttgttggagtattctacccttacaaccgtggcgcacttttcaccgcattagtcgttatctatgcactcacttcaggaattgctgggtacattgctacctctttctattgccagctagagggaacaaactgggtgaggaacttgctattaacaggatgcctgttctgcggacctctattcctgacattctgtttcttgaacacggttgctattgcttatagtgcaacggcagcattgccattcggcactatctgtgtcattgtcctcatctggaccttagttacatttcctcttctagttttgggaggcattgctgggaaaaacagcaaaagtgaattccaagccccttgccgtaccaccaaatacccgagggagatacctccacttccctggtaccggacaacagttccacagatggctatggctggatttttgcctttcagtgctatatatatcgagctgtactacatctttgctagtgtgtggggccaccgaatttacaccatttacagcattctcttcatagtcttcatcatcctccttatcgtcactgccttcattactgttgcactgacatactttcaacttgctgctgaagaccatgagtggtggtggaggtcattcctatgcggaggatcaactggattttttgtttatggctattgtctgtactactactatgcgcgatcagatatgtctggcttcatgcagacatctttcttctttgggtacatggcctgcatctgctatgcattcttcctgatgctgggcatggttggtttccgtgctgccttgttcttcgttcggcacatatacaagtccatcaagtgtgagtaaactgttgttagaggatgaagagcagcagagtttgtactcctttttggtgccgctaagtcccagtatagaaaaggttagctcttgcgtgcaacaggaagcaactagagattgccatgtttcagattaggccattattcataggaacaggtaatgaacctataaatttgctctctttgtgcgactgctgtgataaattgtcttttccttcagcccgtgtatgatctctgtgacatcaagacggtattactttggaccataacctacatgaatatctgtgaaagttcttattatgttatgtcatatttcctatggcagaataacacgagtgtagagatgatgcctcaagaagggcatgtccagtcagagttgtaccgttatacgtgtatcctttgcttcctgtgtatgtattgtgagatgttccgatgttaaaatatagtatacccc

SEQ ID NO: 1806 - DNA, 1468 bp, Brassica rapa
ggtggagaaagagtgatgtagcaaaaccacaatcatatttgtggctatcgtttctccatccaaaaccaaaataacacacaaacctcatctctccaccattagcagtttatcacagagagagagaggagctgattcctatggctgctgcttcactttctgcgaatcaaggtttactaggaacttccttctatggaggttgggggagttcaatctccggcgaggattaccacaccatgctcgccaagacaactgcgccacggcaaaactttgctaaactctcacggaaacccatcagagtacagccaatgatgaagaatgtcaacgaaggcaaaggcttgttcgctcctctagtcgttgtcaccaggaacatagtaggcaagaagaggttcaatcagcttagaggcaaagccattgctttacactctcaggtgattacagagttctgcaaatcgataggagctgatgcaaagcagagacaaggattgattaggcttgctaagaagaatggagagaggcttggcttcctcgcttgagatccctccctcttcttctcgtctctgtatacaatcatcttcttcttcttcttgtctcctgtctagatgtattttttccaaacctctttgaaaacataaactgccattctcattctcaaagttatctgcatcactctctgagatgatattactctttgaaacccacattaatcttatatgtataaaacaaaaaaattacacttttgttctcagaaaaataaaatgtcagagctgaatagtattcttggtaacacagatacaatcatgtaaaactctggaaactgtctttaagcctaatcataactttgaaacaattaacagatacaaaaagatgggtaagctttctttttgagataatatcaattctcgtcaaagaaagaatctccaggatcaggaggagaggtactgagacgcatgcgcaaatccccacagctgcagatttttaacaacatgaacatgaattgctttacttcaagattcattgtataattattatgtagaacttgatatgttacctcgacattcttcaattcaaactctgcgctgctagctaagcattcgttgccaaatgtttcagaaggtccacttgttgctttcaaccttgttcaagtagaaacataaaaaaaaaaacgattaaaaatgggagttttcaaaataagatggagcaacaagaatgtgccttacaaatcttcgtctaaacatagggcaaagcttcctccacctccaaaagccaaaaactcattcatacacatgtagtaatatcggttggcacctgcacaaaatttaaccaagaaggtcacttgagtacatatccttgaggggcttcactttctagttcagggatgatcatacataaattacatgaagagctcttctaaataacagaaagatttcaacttccacaacatacccttaacaagttacttgccccttcc

SEQ ID NO: 1807 - DNA, 703 bp, Brassica napus
ggtggagaaagagtgatgtagcaaaaccacaatcatatttgtggctatcgtttctccatccaaaaccaaaataacacacaaacctcatctctccaccattagcagtttatcacagagagagagaggagctgattcctatggctgctgcttcactttctgcgaatcaaggtttgctaggaacttccttctatggaggttgggggagttcagtctgcggcgaggattaccacaccatgctcgccaaaacaactgcgccacggcaaaactttgctaaactctcacggaaacccatcagagtacagccaatgatgaagaatgtcaacgaaggcaaaggcttgttcgctcctctagtcgttgtcaccaggaacatagtaggcaagaagaggttcaatcagcttagaggcaaagccattgctttacactctcaggtgattacagagttctgcaaatcgataggagctgatgcaaagcagagacaaggattgattaggcttgctaagaagaatggagagaggcttggcttcctcgcttgagatccctccctcttcttcttgtctctgtatacaatcatcttcttcttcttcttgtctcctgtctagatgtattttttccaaacctctttgaaaacataaactgccattctcattctcaaagttatctgcatcactctctgagatgatattactctttgaaacccacatta

SEQ ID NO: 1808 - DNA, 677 bp, Brassica napus
caggctgattcctatggctgctgctgcttcactttctgcgagtcaaggtttactaggaacttcattctatggaggttggggaagttcaatctgcggcgaggattaccacaccatgctcgccaaaacaactgcgccacggcaacactttgcaaaactctcacggaaacccatcagagtacagccaatgatgaagaatgtcaacgaaggcaaaggcttattcgctcctctagtcgttgtcaccaggaacatagtaggcaagaagaggtttaatcagcttagaggcaaagccattgctttacactctcaggtgattacagagttctgcaaatcgataggagctgatgcaaagcagagacaaggattgattaggcttgctaagaagaatggagagaggcttggcttcctggcttgagatcccttcctcttcttcttgtctctgtatacaatcctcttcttcttcttgtttcctgtctagatgtattttttccaaacctcttttaaaacataaactgccattctccttctcaaagttatcttcatcactctctgagatgatattactctttgaaacccacattaatcttatatgtataaaacaaaaaaattacacttttgtcgacccaacaggcgactacaggcatacccgcctaccgagactgtcatcctgatcttccgga

SEQ ID NO: 1809 - DNA, 607 bp, Raphanus sativus
ggagcagtcgatagagaagctgattcctatggctgctgctgcttcactttctgcgaatctaggaacttccttctacggaggttggggaagttcaatctccggcgaggattaccacaccatgctcgccaaaacaactgcgccacggcaacactttgctaagctgtcacggaagccaatcagagtacaaccaatgatgaagaatgtcaacgaaggcaaaggcttattcgctcctctagtcgttgtcactagggacatagtaggcaagaagaggtttaatcagcttagaggcaaagccattgctttacactctcaggtgattacagagttctgcaaatcgataggagctgatgcaaaacagagacaaggactgattaggcttgctaagaagaatggagagaagcttggcttccttgcttgacatccattcctctctgtatactacaaactcctcttcttcttcttgtttcctctttaaaatagaaactgcattttctcatttatgaatgttattatgtgcatcatcactctgataacaatactactcttttgaaacaagatgaatcttttatatatatgtatatgacaaaatatcacaatcgttctcgga

SEQ ID NO: 1810 - DNA, 1063 bp, Brassica juncea
ataacttttaattccgttgattgattcaaaagttatgaataggctttgtatctgtgttactgagaatactaattcagctgtatacttttgttatttccgagactgtaactcaacaatagtgttattgtttgttatataagattcatctggtttcaagagtgattgatacaactttcagaatgagaatgggagtttctgtttcaaaagaggtttgaacaaaatacatctagacaggaagaagaagaagattctcaatcaagcgaggaagccaagtctctctccattcttcttagcaagcctaatcaatccttgtctctgtttcgcatcagctcctatcgatttacagaactctgtaatcacctgagagtgtaaagcaatggctttgcctctaagctgattaaacctcttcttgcctactatgttcctagtgacaacgacaagtggagcgaataagcctttgccttcgttgacgttcttcatcatcggttgtactctgatgggtttccgagagactttagcttgtttaggtggcgcagttgttttggcgagcatggtgtggtaatcatcgcctgagattgagcttccccaaacaccatagaaggatgttccgagtaaaccttgatttgcagaaagtgaagcagcggcagccataggaaccggctcgggcttcaatctctctctccccccctgggtgatgctaatggtgtagagaaaaagagagtaagtgattgtggttcgtttttggtgaggacgagggtgttgacgactctgttgaaaaggttgttgacattgtcgataccttcaggcttcaggagcagcccacttacgacaagaaggggttcatcgcctatatcaagaagtacatcaagcttttgacgcccaagctcaccccggaacagcaggaggagtttaagaagggtattgagggtgctaccaagtacttgctccccaagctcaaggacttccaattctttgttggggaggggatgcacgatgacagcactatcgtctttgcttactacaaggagggtgcaactaacccaacgtttttgtactttgcaca

SEQ ID NO: 1811 - DNA, 997 bp, Eutrema parvulum
agaatgaatgatcgcacggtggagaaagaatgatgtagaagaaccgcgttaacacaagaatcatatttgtggctctgctttctccatccaaaccaaaacctcgtccacaccaaaatgctaaactcaaaatcaaaccacaaacactcaacttctccttctctctaccattagaaatcgatcagagagtgagagaagacgaagctgagaatcctatggctactgcttcactttctgcgaatcaaggtttactcggaacatccttctatggaggttggggaagttcaatctccggagaggattaccacaacatgctcgccaaaacaacgtctccacagcaacaagctagagtctcacgaaaacccatcagagtacaaccgatgatgaagaatgtcaacgaaggcaaaggcttatttgctcctcttgtcgttgtcactcgcaacgtagtagggaagaagaggtttaatcagcttagaggcaaagccattgctttacactctcaggtgattactgagttctgtaaatcgataggagctgatgcgaaacagagacaaggattgattaggcttgctaagaagaatggagagaggcttggcttccttgcttgattgagaatcttagatctttctctgttcttgtctgtatacaatcctcttcttgttgttcttgtctagatgtgttttgttcaaacctataatctttaagaaacagaaactgccgttctcattctgaatgttgtgtgcatcactctgagatactgttcttgaaaccagatggaatctgatatatatatatgaaaaacagtaacactaatgttgagttacagtctcggaaaaaagatcatagctgaattagtattctcagtaacaaagatacatatcatgtaaagcctgaaatctgttttaccctaatcataactttgaaacaattaacggattcaaaaagatggtaagcttttttgaggtatatcgattctcgatcaagaaagtgaactccaaga

SEQ ID NO: 1812 - DNA, 637 bp, Brassica oleracea
  misc_feature (595)..(596): n is a, c, g, or t
gcgtccgacctcgtctccacagaaaacgaaccacaaacacttactttctctttctctccacctttagcatcacccagggagagagagattgaagcccgagccggttcctatggctgccgctgcttcactttctgcacatcaaggtttactcggaacatccttctatggtgcttggggaaattcaatctcaggcgatgattaccacaccatgctcgccaaaacaactgcgccaaggcagcaagctaaagtttcacggaaactcatcagagtacaaccaatgatgaagaatgtcaacgaaggcaaaggtttattcgctccacttgtcgttgttactagggacatagtaggcaagaagaggtttaatcagcttagaggcaaagccattgctttacactcgcaggtgattacagagttctgtaaatcgataggagctgatgcgaaacagagacaaggattgattaggcttgctaagaagaatggagagaggcttggcttcctcgcttgatttgagtatatcttcttcttgttcctgtctagatatattttgttcaaacctctcttaatacaagaactcccattctcattccgaaagttnnacaatcttatataacaaacaataacactattgttgagttac

SEQ ID NO: 1813 - DNA, 804 bp, Brassica napus
aaacacttactttctctttctctccacctttagcatcacccagggagagagagattgaagcccgagccggttcctatggctgccgctgcttcactttctgcacatcaaggtttactcggaacatccttctatggtgcttggggaaattcaatctcaggcgatgattaccacaccatgctcgccaaaacaactgcgccaaggcagcaagctaaagtttcacggaaactcatcagagtacaaccaatgatgaagaatgtcaacgaaggcaaaggtttattcgctccacttgtcgttgttactagggacatagtaggcaagaagaggtttaatcagcttagaggcaaagccattgctttacactcgcaggtgattacagagttctgtaaatcgataggagctgatgcgaaacagagacaaggattgattaggcttgctaagaagaatggagagaggcttggcttcctcgcttgatttgagtatatcttcttcttgttcctgtctagatatattttgttcaaacctctcttaatacaagaactcccattctcattccgaaagttgtatcaatcttatataacaaacaataacactattgttgagttacagtctcggaagtaaaaaatatcacagctgaattagtagtctcagtaacacaggtacaaaacctattcataacttttgaaacaattaacggaattaaaaagatggataagctttctattgaggtatatcgattctcgaccaagaaagggatcttcaagttcatgagaagaggtattgagacgcatgtgcaaatccccagag

SEQ ID NO: 1814 - DNA, 758 bp, Eutrema halophilum
agaatcatatatgtggctctcctttctccatccaaaccaaatcaacacccaaacctcgtccacaccaacaatgttcaacacaaaatcaaaaccacaaacactcaatttctccttctccctaccattaacatcaaatcagtgagaaagagagaagccaaagctgatttctatggctactgcttcgctttctgcaaatcaaggattactcggaacttccttctgtggaggttggggaaactcaatctccggcgacgattaccacaacatgctcgccaaaacctctgcgccaccgcaacaagctcgagtctcaagaaaacccatcagagtacagccgatgatgaagaatgtcaatgaaggcaaaggtttatttgctcctctcgttgttgtcactcgcaacgtagtaggcaagaagaggtttaatcagcttagaggcaaagctattgctttacactctcaggtgattactgagttctgtaaatcgataggagctgatgcgaaacagagacaaggattgattaggcttgctaagaagaatggagagaggcttggcttcctcgcttgattttcatcatctgctcttgtctgtatacaatcctctttcttgttgttcttgtctagatgtattttgtccaaaacgtataatctttgaaacagaaactgccactctcgttctgaaaaattgtgtgcatcactactcttaaagctagatgaaattctgatatatataacaaataataacactattgtagagtttcagt

SEQ ID NO: 1815 - DNA, 767 bp, Eutrema halophilum
caaaactcgagaatcatatatgtggctctcctttctccatccaaaccaaatcaacacccaaacctcgtccacaccaacaatgttcaacacaaaatcaaaaccacaaacactcaatttctccttctccctaccattaacatcaaatcagtgagaaagagagaagccaaagctgatttctatggctactgcttcgctttctgcaaatcaaggattactcggaacttccttctgtggaggttggggaaactcaatctccggcgacgattaccacaacatgctcgccaaaacctctgcgccaccgcaacaagctcgagtctcaagaaaacccatcagagtacagccgatgatgaagaatgtcaatgaaggcaaaggtttatttgctcctctcgttgttgtcactcgcaacgtagtaggcaagaagaggtttaatcagcttagaggcaaagctattgctttacactctcaggtgattactgagttctgtaaatcgataggagctgatgcgaaacagagacaaggattgattaggcttgctaagaagaatggagagaggcttggcttcctcgcttgattttcatcatctgctcttgtctgtatacaatcctctttcttgttgttcttgtctagatgtattttgtccaaaacgtataatctttgaaacagaaactgccactctcgttctgaaaaattgtgtgcatcactactcttaaagctagatgaaattctgatatatataacaaataataacactattgtagagtttcagt

SEQ ID NO: 1816 - DNA, 788 bp, Raphanus sativus
ggattgactaatctgattaaaaagaactaaatgatcggacggtggaatggggtagaaaaaattgatacagcaagttaaagaatcaaaattgtggctctcgtttctccatccaaatcacaacaccagccaaacctcgtccacaccataaccattcagctccaaaatcaaaccacaaacactcgatttctctccaaccattggcatccatcagagggagaatcccgagccgattcctatggctgctactgcttcactttctgcgaatcaaggtttacttggaacatccttctatggtggttggggaaactcaatctcaggcgatgattaccagatcaaaacaactgcgccacctaaacaagctagagtctcacgaaaacccatcagagtacaaccgatgatgaagaatgtcaacgaaggcaaaggcttattcgcaccacttgtcgttgtcactaggaacatagtaggcaagaagaggtttaatcagcttagaggcaaagccattgctttacactctcaggtgattacagagttctgtaaatcgataggagctgatgcgaaacagagacaaggattgattaggcttgctaagaagaatggagagaggcttggcttcctcgcttgattcagaatcttcttcttgttcctgtctagatgtattttgttcaaacctctcttaatacagaaactcccattctcattctgaaagttgtatcaatatcactcttgaaaccagatgattcttatataacaaacaataacacaattgttaagttacagtttcggaaata

SEQ ID NO: 1817 - DNA, 733 bp, Arabidopsis lyrata
agaatcatatttgtggctctggtttctccatccaaaccaaaccaacacccaaaccttgtccacaccaaaatgctaaactcaaaatccaaccacacacactcaatttctcttcctctctaccattaacatcaaagagcgagagaagctgattgattatggctgctgcttcgatttctgcaactggatgtaatcaaactttgctcagaacttccttctatggaggttggggaagttccatctccggagaagattaccaaaccatgctctccaagacagttgcgccaccgcaacaagccagagtctcacgtaaagcaatcagagcagtacctatgatgaagaatgttaatgaaggcaaaggcttatttgcaccacttgtcgttgtcacacgcaacatagttggcaagaagaggtttaatcagcttagaggaaaagccattgccctacactctcaggtgatcactgagttttgcaaatcgattggagcagatgcaaaacagagacaagggcttatcaggcttgctaagaagaatggagagaggcttggtttccttgcttaggtcttaaaaagaacaaatctttctctctgcttttgtctgtatacactcactctcctcttgttgttgttgtctagatgtattttgtccaaacctataatcttgatttttgttacattgccttttgagggttactcaacacacataactgctgccattctcatctgaaagttgtgtca

SEQ ID NO: 1818 - DNA, 724 bp, Arabidopsis lyrata
agaatcatatttgtggctctggtttctccatccaaaccaaaccaacacccaaaccttgtccacaccaaaatgctaaactcaaaatccaaccacacacactcaatttctcttcctctctaccattaacatcaaagagcgagagaagctgattgattatggctgctgcttcgatttctgcaactggatgtaatcaaactttgctcagaacttccttctatggaggttggggaagttccatctccggagaagattaccaaaccatgctctccaagacagttgcgccaccgcaacaagccagagtctcacgtaaagcaatcagagcagtacctatgatgaagaatgttaatgaaggcaaaggcttatttgcaccacttgtcgttgtcacacgcaacatagttggcaagaagaggtttaatcagcttagaggaaaagccattgccctacactctcaggtgatcactgagttttgcaaatcgattggagcagatgcaaaacagagacaagggcttatcaggcttgctaagaagaatggagagaggcttggtttccttgcttaggtcttaaaaagaacaaatctttctctctgcttttgtctgtatacactcactctcctcttgttgttgttgtctagatgtattttgtccaaacctataatcttgatttttgttacattgccttttgagggttactcaacacacataactgctgccattctcatctgaaa

SEQ ID NO: 1819 - DNA, 769 bp, Arabidopsis thaliana
agaatcatatttgtggctctggtttctccatccaaacaaaaacaacacccaaaccttgtccacaccaaaatgttaaactcaaaatccaaccacacacacacaatttctcttcctctctaccattaacatcgatcagaaagaccgagagagagagggagaagctgattgattatggctgctgcttcgatttctgcaataggatgtaatcaaactttgctaggaacttccttctatggaggatggggaagttccatctccggagaagattaccaaaccatgctctccaagacagttgcgcctccgcaacaagccagagtctcaaggaaagcaatcagagcagttccaatgatgaagaatgtcaatgaaggcaaaggcttatttgcacctctagttgttgtcacacgcaacctagtaggcaagaagaggtttaatcagctcagaggaaaagccattgccttacactctcaggtgatcactgagttttgcaaatcgattggagcagatgcaaaacagagacaagggcttatcaggcttgctaagaagaatggagagaggcttggtttccttgcttaggtcttaaaaagaacaaatctttctctctgcttgtgtctgatatatacactcacaactcctcttgttgttcttgtctagatgtattttgtccaaacctataatcttgatttttgttacattgcctttgagggttactcaaacacacataactgctgccattctcatctgaaaagttgttcaataaggtcttagctga

SEQ ID NO: 1820 - DNA, 597 bp, Arabidopsis thaliana
acacacacacaatttctcttcctctctaccattaacatcgatcagaaagaccgagagagagagggagaagctgattgattatggctgctgcttcgatttctgcaataggatgtaatcaaactttgataggaacttccttctatggaggatggggaagttccatctccggagaagattaccaaaccatgctctccaagacagttgcgccaccgcaacaagccagagtctcaaggaaagcaatcagagcagttccaatgatgaagaatgtcaatgaaggcaaaggcttatttgcacctctagttgttgtcacacgcaacctagtaggcaagaagaggtttaatcagctcagaggaaaagccattgccttacactctcaggtgatcactgagttttgcaaatcgattggagcagatgcaaaacagagacaagggcttatcaggcttgctaagaagaatggagagaggcttggtttccttgcttaggtcttaaaaagaacaaatctttctctctgcttgtgtctgatatatacactcacaactcctcttgttgttcttgtctagatgtattttgtccaaacctataatcttgatttttgtt

SEQ ID NO: 1821 - DNA, 2009 bp, Brassica rapa
agagctgtcatctccgagactcatgcgagtcaggttctctctctgtctcaccctcttttcttcctctcctttcctttccccacaccaccgacaattctctccgcatctggacacaccatccatcatctccgacaaaagtcgtctgtctctgatcatcgcaatgcacgctctaaaggacaaagtctcccagaagctttcgaatctcttcgccgattccccttcccaatctgcatctcctcgccattccctcaccgattctcccaaggcttcagggaaatcgtttacttcctatttctcatttggtgctcgaaacgagaacgaagacaccgaatctgaatcaccaccacctcctcctcctccaattagaacagacagctacgagtctgttgagaattgcaaaaagaaccaagcttcttcgacaacggtcggtaatgatgactacgaaggagagatgaaggagttaacagagagctctgcttttatctctcctgacttgtgcgagttcttgcacgcgtgtcttcctaatatcgttagaggatgcaaatgggtcttggtatacagtacgttgaagcatgggatatcgcttcgtacgcttctgcgtaaaagtgctgagcttcctggtccttgtttgctggttgctggagacaaacaaggtgcggtttttggtgctatgctggaatgtccgttaacaactactcctaagaggaaatatcagggtacaagccagacatttttgttcacaactatttatggtcaacctcgcatatttagacctaccggtgccaaccgatattactacatgtgtatgaatgagtttttggcttttggaggtggaggaagctttgccctatgtttagacgaagatttgttgaaagcaacaagtggaccttctgaaacatttggcaacgaatgcttagctagcagcgcagagtttgaattgaagaatgtcgagctgtggggatttgcgcatgcgtctcagtacctctcctcctgatcctggagattctttctttgacgagaattgatattatctcaaaaagaaagcttacccatctttttgtatctgttaattgtttcaaagttatgattaggcttaaagacagtttccagagttttacatgattgtatctgtgttaccaagaatactattcagctctgacattttatttttctgagaacaaaagtgtaatttttttgttttatacatataagattaatgtgggtttcaaagagtaatatcatctcagagagtgatgcagataactttgagaatgagaatggcagtttatgttttcaaagaggtttggaaaaaatacatctagacaggagacaagaagaagaagaagatgattgtatacagagacgagaagaagagggagggatctcaagcgaggaagccaagcctctctccattcttcttagcaagcctaatcaatccttgtctctgctttgcatcagctcctatcgatttgcagaactctgtaatcacctaaacaaaacaaaatacaaacttattgattctttcttctttgcactaagttttcaagatctaatttagagaatgatgaattttaaacctgagagtgtaaagcaatggctttgcctctaagctgattgaacctcttcttgcctactatgttcctggtgacaacgactagaggagcgaacaagcctttgccttcgttgacattcttcatcattggctgtactctgatgggtttccgtgagagtttagcaaagttttgccgtggcgcagttgtcttggcgagcatggtgtggtaatcctcgccggagattgaactcccccaacctccatagaaggaagttcctagtaaaccttgattcgcagaaagtgaagcagcagccataggaatcagctcctctctctctctgtgataaactgctaatggtggagagatgaggtttgtgtgttattttggttttggatggagaaacgatagccacaaatatgattgtggttttgctacatcactctttctccaccgtcc

SEQ ID NO: 1822 - DNA, 555 bp, Brassica oleracea
  misc_feature (20)..(21): n is a, c, g, or t
gagagcgtccggggaagttnntctgcggcgaggattaccacaccatgctcgccaaaacaactgcgccacggcaacactttgcaaaactctcacggaaacccatcagagtacagccaatgatgaagaatgtcaacgaaggcaaaggcttattcgctcctctagtcgttgtcaccaggaacatagtaggcaagaagaggtttaatcagcttagaggcaaagccattgctttacactctcaggtgattacagagttctgcaaatcgataggagctgatgcaaagcagagacaaggattgattaggcttgctaagaagaatggagagaggcttggcttcctggcttgagatcccttcctcttcttcttgtctctgtatacaatcctcttcttcttcttgtttcctgtctagatgtagtttttccaaacctcttttaaaacataaactgccattctccttctcaaagttatcttcatcactctctgagatgatattactctttgaaacccacattaatcttatatgtataaaacaaaaaaattacacttttgttctcagt

SEQ ID NO: 1823 - DNA, 6084 bp, Arabidopsis lyrata
tggatacagtacagttgtgttttttaattggtctatctttctctcaaagttttctcatcgtctttgctccttttaaagactctgtactatatttccatgagttgcagctgataaagctactctgcttattcattactctgtttcgccaaaagaaggagaatcaagaaacattatggagaggccaagagcccctccatctcccttgaatgatacggagccattaactgaacgtagatcccttgagattttcaaccctcagagtggaaaagagacacatggatcaacttcttcttcgttaaagccgcctcttgatggcaaaagcaaaggcagcagtagtaagtggatggagtttcaagattccgctaagatgactgaaagaaccgctgaatggggaatatcagctattaagccggactccggagaagatggcattagtttcaaggtgtccagtgaagcggaacgaagcaagaacatgtctaggaggtcttccgaagaatcaacatcttctgaatcaggggccttccctagagtatcccaggagctcaaaaccgctctttccacgttgcagcagacttttgttgtttctgacgccacacaaccacactgtcccatagtgtatgccagcagtggattcttcaccatgactggttattcttccaaggaaattgttggaagaaactgccggtttctgcaagggccagacactgacaagaatgaggttgccaaaatcagagattgtgtcaagaatggaaagagttactgtggaaggctgttaaactacaaaaaggacggaacacccttctggaatcttctcacagtcactcctatcaaggacgaccaaggaaacaccatcaagtttattgggatgcaggttgaagttagcaaatacacagaaggggtaaatgataaagtattgaggcctaatggactctccaaatccttgattcgatatgatgctcgccagaaggagaaagctttggattccatcacagaggttgtgcagacaataagacatcgcaagtctcaagttcaggaatccgtgagcaatagtaatatggtgacgcctgatagttctactacacctggtagacaaaatagacaatcagatgaggcttcaaagtcattcaggacacctggacgtgtttctactccaacagggacgaagctcaaaagctctagtaacaagcatgaagatctcttacgtatggaacctgaagaattgatgttgagcacagaagtaatagggcagagggacagttgggacctatcagatagagaaagggatatacgccaagggattgatctagctaccactcttgagcgcatagagaaaaatttcgtcatcagtgatcctcgtctccctgataatcccattatttttgcatcagacagctttcttgaactgacagagtatacacgcgaggaaattttggggagaaattgtcggtttcttcaggggccagagacagatcaagcgactgtccagaagataagagacgcaattagagaccagacggagataactgtgcagttgataaactacactaaaagcggaaagaaattctggaatttattccacttgcaacctatgcgtgatcaaaagggagagcttcaatacttcatcggtgtgcagcttgatggaagtgatcatgtagagcccctccaaaatcgtttgtctgagagaacagagatacaaagttctaaattggtgaaagctacagccacaaatgtagatgaagctgtcagagaacttccagatgctaatacgcggcccgaggacctgtgggctgcacactcgaagcctgtctatcctctacctcacaataaggagagtacgtcctggaaagcaataaaaaagatccaagcgggtggagaaacagtgggactacatcattttaaaccaataaaaccgctgggctctggtgatactggcagtgttcatttggttgagctgaagggtacaggtgaattatatgccatgaaagcaatggagaaagcaatgatgttgaatcgtaacaaggctcaccgagcatgcatcgaaagggagatcatttcccttctggatcatcctttccttcccactctctacgcttcttttcagacatctacacacgtttgtttgattacagacttctgcccaggtggagagttgtttgcactgcttgacagacaacctatgaaaatattgacagaggactctgcaaggttttatgcagcagaggtcgtaatcggcttagaatatcttcactgcttaggaattgtatatcgagacctgaagcctgaaaatatactgctcaagaaggatggacacattgtattggctgactttgatttatcattcatgacgacctgcacaccccagcttattattccagctgcacctagcaaacgaaggagatccaagagtcaaccactacccacattcgttgcagaaccaagtacccagtcaaactcgttcgtaggaactgaagaatacattgcgcctgagataatcacgggtgctggtcatacaagtgctattgattggtgggcactgggtatcttgttgtatgagatgctttatggtcgcacacctttcaggggtaagaataggcaaaagacatttgccaacatcttgcacaaagatctcaccttccccagcagtatccctgtgagtcttgtatgtagacagttgatcaacacgttgttaaatagagatccgagcagccggttaggatccaaaggtggggcaaatgagataaagcagcacgctttcttccgcggtatcaattggcctctcatacgaggcatgagtcctccaccactggatgcaccattgaacataatcgagaaagatccgaatgccaaagatattaagtgggaagatgatggagtgcttgtgaattctacggacttggacattgacctcttctaatcccactctttctctctgcttttgattctcatattatgcaaaacttttcttctcaataaaagccaaggtgttgttgtacttgtagatgtttttacatataaacggctcgtttcatgtttttccatttcttctaatcaacaacgataaacatacaacaacaaacttgagagttttttttggagccttgttgttaataatgatgttaagtgtcataagcccattataaggcccaccaaatggcccaccaaatggcccaccaaatggcccattagtagttgggagaaatgtctttgagaagtccaaccacctgctgcatcgttggtcgcttccatggcagatcggcggtacacaagtaccctatcttcaccgcctccgcgatttcatcctctggaactatctctctcatcgtcggatcaatggctctcaatccttgtccctgcctcactaaccctctcacccaattcaccaagtcctcctccggcttcttcccactcacgagctcaagcaaaacaactccgaagctatacacatcggattctaatgtcggagaagcatttcgctcctgttccggtgatgtgtacccgtctaaactttcggaaccgggaaattcctcgtccaagagtttgactaatccaaagtctgctaagcgtggctcctggctagagtctaaccagattgttgcagccttcacttctccgtggaccattggaggaatgcagccatggtgaaggaaagctaatgccctcgctgtccccaaagctatcttatgccgtagtctccacggtgcagaatcgtctgcgttgttatggagtaaactttgcaaattaaccatgtctaggtcctcgtagattgcaattctttgctctgtggctatacagtatccacagagcggggcaagatttgggtgattgatcctggcgagacgttcaaaagcaatcgagacttctgtatcagtcaatgtgcttccactggggacaacttttatagctgctctgaatccattgggtaggactgctccataagtaggaccagacttgccttccgacaacaatgcgcctctatcgaagttgaaagtcgcagcctttaggtctgcaagcgtcatcttcatcaatggcttgtcgatcattaccacagggatttgtgttgcgtgcttgacatcggtggttgagtcattttggtctggggagttgggttctgtgttgtttatggctagctttgttgcccaagttcttgattttcttctacctctcaagactacaagtatgagcaatagtcctacaagtaagaacgccattgagattgctaacgccaaaccaatcttaagccctgtcttcttcttgttgactttctttccttttgtaacaattggctttgcagcgaaggggcagttatttgtagagttaatgaatgatctctgtattgtttcttgtgagaagttggggatgcaaaaggttagattgttgtaagagaagttaaacctttgcatcatggggagtttctccagaatcggccttgggatgtctccgtctagcttattcagcgagagatcaagtacttcaatgttcttgaggctcagcataggcacatggccagtgagattattggaggagagatcaagaaccttcagctgactcagccgcgagatttcactcggaatgatattagtgagattggtccttgataggttcagataatgtagcgctgaaagcttgccgatttgcgggaacttctgtgctctgaatcgattgcacgcgaggttaaggtgtcccagcttatgagctgaactcaaaccattgaatatatgaccgacaaagctattatcagacaagtcaagatgaatcagactagaccagttgtgtttgtggccgggtattaactgcaagatatgctcatcaaatcggttttcactgagatcaactgtttccacgttttcatgcaagactcctatcaatgaaccctgaaacagattccttgaaaggttcaagctttttagttgtgggaaagctgaaccaaaaccgacaggcagaggcccgctgagccggttggatgagaggtcgatggagactagagatcggcaatggaggagtcctggagggacgccagactgaaagtcattgttgtggagcttgagagttgttagattgacaagggagcttatagcagcagggatttcaccagagaagctgttgaaagaaagatcaagggtgtgaagcgacatgaaattgccgatattactgggaagatgctcagaaatccggttggaggagagattgagactctcgagcaagctgagactccacaaatccgagggcagagacgtaatcttgtttccactgagatctaaagtttggagcttactcattttgccaatagtgttgtcggggatcgaaccagacaggtccaacccagaagcggaaatatggagcacattctctccagagtcacagacgaccactcctggccatgaacatgaagaagaaaatgtgtgagcttggggataattgggtaatctcaatgcggagaagaagctggagagataataagcgtcggtgttaggatctaggctcgtcagatgcttgacgaagaaggagaagaacagaagagatccccatagagacaacctcataatttggtgttgtctggagctggagaaaagtggatgggaaagctcagaaagaagacagactgtgtgaaaagaagaaaagacataatggaatcacggggcagagaggtgatgatagtttagaatacattgagatccctttcacgtgcacagcttcaaaaaaaataaaaaatcagagcttttagcagaagttaagaaattcagaagaagaagaagataagggttgaaaagtttgggagagttccggagttgagagttgagtttttggttgtatcgtatatggacactggagaaagtgggaggagaagagagtcgttgaaagtcaaaaaaagagatatgtggagattataattaggtaaagtatttgctagtgagttataagaaaatatgaaaatggaatctgtctcagaccttttgtgaatttttcaaatcccaaagttgtcaatggatttggtgagtggaggagtgggtggttgttgtggtttctcatttcagcagtatttccttattaatgtaaaaattcactgtttttttttttggggttttc

SEQ ID NO: 1824 - DNA, 5984 bp, Arabidopsis lyrata
tggatacagtacagttgtgttttttaattggtctatctttctctcaaagttttctcatcgtctttgctccttttaaagactctgtactatatttccatgagttgcagctgataaagctactctgcttattcattactctgtttcgccaaaagaaggagaatcaagaaacattatggagaggccaagagcccctccatctcccttgaatgatacggagccattaactgaacgtagatcccttgagattttcaaccctcagagtggaaaagagacacatggatcaacttcttcttcgttaaagccgcctcttgatggcaaaagcaaaggcagcagtagtaagtggatggagtttcaagattccgctaagatgactgaaagaaccgctgaatggggaatatcagctattaagccggactccggagaagatggcattagtttcaaggtgtccagtgaagcggaacgaagcaagaacatgtctaggaggtcttccgaagaatcaacatcttctgaatcaggggccttccctagagtatcccaggagctcaaaaccgctctttccacgttgcagcagacttttgttgtttctgacgccacacaaccacactgtcccatagtgtatgccagcagtggattcttcaccatgactggttattcttccaaggaaattgttggaagaaactgccggtttctgcaagggccagacactgacaagaatgaggttgccaaaatcagagattgtgtcaagaatggaaagagttactgtggaaggctgttaaactacaaaaaggacggaacacccttctggaatcttctcacagtcactcctatcaaggacgaccaaggaaacaccatcaagtttattgggatgcaggttgaagttagcaaatacacagaaggggtaaatgataaagtattgaggcctaatggactctccaaatccttgattcgatatgatgctcgccagaaggagaaagctttggattccatcacagaggttgtgcagacaataagacatcgcaagtctcaagttcaggaatccgtgagcaatagtaatatggtgacgcctgatagttctactacacctggtagacaaaatagacaatcagatgaggcttcaaagtcattcaggacacctggacgtgtttctactccaacagggacgaagctcaaaagctctagtaacaagcatgaagatctcttacgtatggaacctgaagaattgatgttgagcacagaagtaatagggcagagggacagttgggacctatcagatagagaaagggatatacgccaagggattgatctagctaccactcttgagcgcatagagaaaaatttcgtcatcagtgatcctcgtctccctgataatcccattatttttgcatcagacagctttcttgaactgacagagtatacacgcgaggaaattttggggagaaattgtcggtttcttcaggggccagagacagatcaagcgactgtccagaagataagagacgcaattagagaccagacggagataactgtgcagttgataaactacactaaaagcggaaagaaattctggaatttattccacttgcaacctatgcgtgatcaaaagggagagcttcaatacttcatcggtgtgcagcttgatggaagtgatcatgtagagcccctccaaaatcgtttgtctgagagaacagagatacaaagttctaaattggtgaaagctacagccacaaatgtagatgaagctgtcagagaacttccagatgctaatacgcggcccgaggacctgtgggctgcacactcgaagcctgtctatcctctacctcacaataaggagagtacgtcctggaaagcaataaaaaagatccaagcgggtggagaaacagtgggactacatcattttaaaccaataaaaccgctgggctctggtgatactggcagtgttcatttggttgagctgaagggtacaggtgaattatatgccatgaaagcaatggagaaagcaatgatgttgaatcgtaacaaggctcaccgagcatgcatcgaaagggagatcatttcccttctggatcatcctttccttcccactctctacgcttcttttcagacatctacacacgtttgtttgattacagacttctgcccaggtggagagttgtttgcactgcttgacagacaacctatgaaaatattgacagaggactctgcaaggttttatgcagcagaggtcgtaatcggcttagaatatcttcactgcttaggaattgtatatcgagacctgaagcctgaaaatatactgctcaagaaggatggacacattgtattggctgactttgatttatcattcatgacgacctgcacaccccagcttattattccagctgcacctagcaaacgaaggagatccaagagtcaaccactacccacattcgttgcagaaccaagtacccagtcaaactcgttcgtaggaactgaagaatacattgcgcctgagataatcacgggtgctggtcatacaagtgctattgattggtgggcactgggtatcttgttgtatgagatgctttatggtcgcacacctttcaggggtaagaataggcaaaagacatttgccaacatcttgcacaaagatctcaccttccccagcagtatccctgtgagtcttgtatgtagacagttgatcaacacgttgttaaatagagatccgagcagccggttaggatccaaaggtggggcaaatgagataaagcagcacgctttcttccgcggtatcaattggcctctcatacgaggcatgagtcctccaccactggatgcaccattgaacataatcgagaaagatccgaatgccaaagatattaagtgggaagatgatggagtgcttgtgaattctacggacttggacattgacctcttctaatcccactctttctctctgcttttgattctcatattatgcaaaacttttcttctcaataaaagccaaggtgttgttgtacttgtagatgtttttacatataaacggctcgtttcatgtttttccatttcttctaatcaacaacgataaacatacaacaacaaaccttgttgttaataatgatgttaagtgtcataagcccattataaggcccaccaaatggcccattagtagttgggagaaatgtctttgagaagtccaaccacctgctgcatcgttggtcgcttccatggcagatcggcggtacacaagtaccctatcttcaccgcctccgcgatttcatcctctggaactatctctctcatcgtcggatcaatggctctcaatccttgtccctgcctcactaaccctctcacccaattcaccaagtcctcctccggcttcttcccactcacgagctcaagcaaaacaactccgaagctatacacatcggattctaatgtcggagaagcatttcgctcctgttccggtgatgtgtacccgtctaaactttcggaaccgggaaattcctcgtccaagagtttgactaatccaaagtctgctaagcgtggctcctggctagagtctaaccagattgttgcagccttcacttctccgtggaccattggaggaatgcagccatggtgaaggaaagctaatgccctcgctgtccccaaagctatcttatgccgtagtctccacggtgcagaatcgtctgcgttgttatggagtaaactttgcaaattaaccatgtctaggtcctcgtagattgcaattctttgctctgtggctatacagtatccacagagcggggcaagatttgggtgattgatcctggcgagacgttcaaaagcaatcgagacttctgtatcagtcaatgtgcttccactggggacaacttttatagctgctctgaatccattgggtaggactgctccataagtaggaccagacttgccttccgacaacaatgcgcctctatcgaagttgaaagtcgcagcctttaggtctgcaagcgtcatcttcatcaatggcttgtcgatcattaccacagggatttgtgttgcgtgcttgacatcggtggttgagtcattttggtctggggagttgggttctgtgttgtttatggctagctttgttgcccaagttcttgattttcttctacctctcaagactacaagtatgagcaatagtcctacaagtaagaacgccattgagattgctaacgccaaaccaatcttaagccctgtcttcttcttgttgactttctttccttttgtaacaattggctttgcagcgaaggggcagttatttgtagagttaatgaatgatctctgtattgtttcttgtgagaagttggggatgcaaaaggttagattgttgtaagagaagttaaacctttgcatcatggggagtttctccagaatcggccttgggatgtctccgtctagcttattcagcgagagatcaagtacttcaatgttcttgaggctcagcataggcacatggccagtgagattattggaggagagatcaagaaccttcagctgactcagccgcgagatttcactcggaatgatattagtgagattggtccttgataggttcagataatgtagcgctgaaagcttgccgatttgcgggaacttctgtgctctgaatcgattgcacgcgaggttaaggtgtcccagcttatgagctgaactcaaaccattgaatatatgaccgacaaagctattatcagacaagtcaagatgaatcagactagaccagttgtgtttgtggccgggtattaactgcaagatatgctcatcaaatcggttttcactgagatcaactgtttccacgttttcatgcaagactcctatcaatgaaccctgaaacagattccttgaaaggttcaagctttttagttgtgggaaagctgaaccaaaaccgacaggcagaggcccgctgagccggttggatgagaggtcgatggagactagagatcggcaatggaggagtcctggagggacgccagactgaaagtcattgttgtggagcttgagagttgttagattgacaagggagcttatagcagcagggatttcaccagagaagctgttgaaagaaagatcaagggtgtgaagcgacatgaaattgccgatattactgggaagatgctcagaaatccggttggaggagagattgagactctcgagcaagctgagactccacaaatccgagggcagagacgtaatcttgtttccactgagatctaaagtttggagcttactcattttgccaatagtgttgtcggggatcgaaccagacaggtccaacccagaagcggaaatatggagcacattctctccagagtcacagacgaccactcctggccatgaacatgaagaagaaaatgtgtgagcttggggataattgggtaatctcaatgcggagaagaagctggagagataataagcgtcggtgttaggatctaggctcgtcagatgcttgacgaagaaggagaagaacagaagagatccccatagagacaacctcataatttggtgttgtctggagctggagaaaagtggatgggaaagctcagaaagaagacagactgtgtgaaaagaagaaaagacataatggaatcacggggcagagaggtgatgatagtttagaatacattgagatccctttcacgtgcacagcttcaaaaaaaaagaagaagaagataagggttgaaaagtttgggagagttccggagttgagagttgagtttttggttgtatcgtatatggacactggagaaagtgggaggagaagagagtcgttgaaagtcaaaaaaagagatatgtggagattataattaggtaaagtatttgctagtgagttataagaaaatatgaaaatggaatctgtctcagaccttttgtgaatttttcaaatcccaaagttgtcaatggatttggtgagtggaggagtgggtggttgttgtggtttctcatttcagcagtatttccttattaatgtaaaaattcactgtttt

SEQ ID NO: 1825 - DNA, 3290 bp, Eutrema halophilum
acatgattggtttgataaaactataattgagttaagtacagttgtagtttttattgcctaactctcaaagttttttttttttcatcgtctttgcccttttaaagccatgtactatatatccatgacctgcagctcataaagctacacgtctggtatttttttttctgtttattttattaaccttcatcttctttaacgtgtttgttgattgcttccaaacactttattggcatttattggatgttcctgggaactacaggtgtgtctgcctcatccgtctatctaactctggtaaacttgtctggttttgatttgcagccgattcattactctgtttcgccaaaagaaagagaataaagaaacgatatggagaggccaagagcccctccatctcccttgaccgatttggagccattaagtgaacgcagatcccttgaggtcttcaaccccttgagtggaaaagaggtaaacggatcatcatcttcttcttcttcttcttcaaagcctcacgatggaaacggcaaaggcaaaagcagtaagtggatggaatttcaagattccgctaagttagtggagagaactgctgaatggggattatcagctgttaagccggactcaggagaagatggcattagtttcaaggtgtccagtgaagtggaacgaagcaagatgtctaggaggtcatccgaggaatcaacatcttctgattcaggggccttccctagagtatcccaggagctcaaaactgctctctcaacgttgcagcagacctttgttgtgtccgacgccacacagccacactgtcctatagtgtatgccagcagtggattcttcaccatgactggttattcttccaaggagattgttggaagaaactgccggtttctgcaagggccggacacagacaagaaagaggttgccaaaatcagagattgtgtcaagaatggaaaaagttactgtggaaggctcttaaactacaaaaaggatggaacccccttctggaatcttctcacagtcactcctatcaaagacgaccaaggcaacaccatcaagttcattgggatgcaggttgaagtaagcaaatacacagaaggcgtaaacgataaagcattgaggcctaatggactctctaaatccctaatccgatatgatgctcgccagaaggagaaagctttggattccatcacagaggtcgtgcaaacaataaaacatcgcaagtctcaagtgcgagactccgtgagcaatgatgttatggtgaggcttgatagtgctactacacctggtaaacaagttataaaatcagatgaggcttcgaagtcagccagaacacctacacgtgtttctactccaacgaggtcaaagagcaaatcgcttagctcgaataaaaagcatgaagatgttccgagtgtggaacctgaagcattggtgttgagcacagaagtaatagagccgagggatagttttgaccgttcagaaagagaaagggatatacgccaagggattgatctagctaccactcttgagcgcatagagaagaatttcgtcatcagtgatcctcgtcttcccgataatcccattatatttgcatcagacagctttcttgaattgacagagtatacacgcgaggagattttgggtagaaactgtcggtttcttcaggggccagagacagatcaagcgactgtccaaaagattagagacgcaattagagatcaaagggaaataactgtgcagttgataaactacactaagagcggaaagaaattctggaacttattccacttgcaacctatgcgtgatcagaagggagagcttcaatacttcatcggtgtgcagcttgatggaagtgatcatgtggagccgctccaaaatcgtttgtcagagagaacagaattacagagttctaaattggtaaaagctacagcaacaaatgtagatgaagctgtcagagaacttccagatgctaatacgcggcccgaagacttgtgggctgcacactcaaagcctgtctatcctctgcctcacaataaggagagtacgtcctggaaagccatacaaaagattcaagcgagtggcgaaacagtgggactacatcatttcaagccaataaaaccgttgggctctggtgatactggcagtgtccatttggttgaactgaaaggcacaggtgaattgtatgccatgaaggcaatggagaaaacaatgatgttgaatcgtaacaaggctcaccgagcatgcatcgaaagggaaatcatttctcttctggatcatcctttccttcccactctctacacttcctttcagacagccacgcatgtttgtttgattacagacttctgccccggtggagagttgtttgctctgcttgacaaacaacccatgaaatttttgtcagaggaatcagcaaggttctatgcagcagaggtcgttatcggcttagaatatcttcactgcttaggaattgtataccgagatctgaagcctgaaaatatactgctcaagaaggatggacacattgtattagccgactttgatttatcattcatgacgtcctgcacaccacagcttattaatccacctgcacctaacaaacgaaggaagtccaagagtcaaccactaccaacattcgttgcagaaccaattacacagtcaaactcgttcgtagggaccgaagaatacattgcgcctgagataatcacgggtgctggtcatacgagtgctattgattggtgggcgctgggtatcttgttgtatgaaatgctttatggccgcacacctttcaggggtaagaataggcagaagacatttgccaacatcttgcacaaagatctcaccttccccagcagtattcctgtaagtcttgtatgtagacagttgatcaacatgttgctaaatagagatccgagttgccggttaggatccaaaggtggagcaaatgagataaaacagcatgccttcttccgcgggatcaattggcctctcatacgttgcatgagccctccaccattggatgcaccgttgcgtataatagagaaagatccgaatgccaaagatataaagtgggaagatgatggagtgcttgtgaattctatggacattgacattgatctcttctaaaccctccctactcttcccttcttcttctgcttttgagtctcattttaatgcaaaactctcttcttctcaataaagcaaaggtgttgtttgtactgtagttgcttacatatataatacatcagacataaaacagctctttcttgttattaaaggcaccgcacaattttccttct

SEQ ID NO: 1826 - DNA, 6143 bp, Eutrema halophilum
tcagaaacatgattggtttgataaaactataattgagttaagtacagttgtagtttttattgcctaactctcaaagttttttttttttcatcgtctttgcccttttaaagccatgtactatatatccatgacctgcagctcataaagctacacgtctggtatttttttttctgtttattttattaaccttcatcttctttaacgtgtttgttgattgcttccaaacactttattggcatttattggatgttcctgggaactacaggtgtgtctgcctcatccgtctatctaactctggtaaacttgtctggttttgatttgcagccgattcattactctgtttcgccaaaagaaagagaataaagaaacgatatggagaggccaagagcccctccatctcccttgaccgatttggagccattaagtgaacgcagatcccttgaggtcttcaaccccttgagtggaaaagaggtaaacggatcatcatcttcttcttcttcttcttcaaagcctcacgatggaaacggcaaaggcaaaagcagtaagtggatggaatttcaagattccgctaagttagtggagagaactgctgaatggggattatcagctgttaagccggactcaggagaagatggcattagtttcaaggtgtccagtgaagtggaacgaagcaagatgtctaggaggtcatccgaggaatcaacatcttctgattcaggggccttccctagagtatcccaggagctcaaaactgctctctcaacgttgcagcagacctttgttgtgtccgacgccacacagccacactgtcctatagtgtatgccagcagtggattcttcaccatgactggttattcttccaaggagattgttggaagaaactgccggtttctgcaagggccggacacagacaagaaagaggttgccaaaatcagagattgtgtcaagaatggaaaaagttactgtggaaggctcttaaactacaaaaaggatggaacccccttctggaatcttctcacagtcactcctatcaaagacgaccaaggcaacaccatcaagttcattgggatgcaggttgaagtaagcaaatacacagaaggcgtaaacgataaagcattgaggcctaatggactctctaaatccctaatccgatatgatgctcgccagaaggagaaagctttggattccatcacagaggtcgtgcaaacaataaaacatcgcaagtctcaagtgcgagactccgtgagcaatgatgttatggtgaggcttgatagtgctactacacctggtaaacaagttataaaatcagatgaggcttcgaagtcagccagaacacctacacgtgtttctactccaacgaggtcaaagagcaaatcgcttagctcgaataaaaagcatgaagatgttccgagtgtggaacctgaagcattggtgttgagcacagaagtaatagagccgagggatagttttgaccgttcagaaagagaaagggatatacgccaagggattgatctagctaccactcttgagcgcatagagaagaatttcgtcatcagtgatcctcgtcttcccgataatcccattatatttgcatcagacagctttcttgaattgacagagtatacacgcgaggagattttgggtagaaactgtcggtttcttcaggggccagagacagatcaagcgactgtccaaaagattagagacgcaattagagatcaaagggaaataactgtgcagttgataaactacactaagagcggaaagaaattctggaacttattccacttgcaacctatgcgtgatcagaagggagagcttcaatacttcatcggtgtgcagcttgatggaagtgatcatgtggagccgctccaaaatcgtttgtcagagagaacagaattacagagttctaaattggtaaaagctacagcaacaaatgtagatgaagctgtcagagaacttccagatgctaatacgcggcccgaagacttgtgggctgcacactcaaagcctgtctatcctctgcctcacaataaggagagtacgtcctggaaagccatacaaaagattcaagcgagtggcgaaacagtgggactacatcatttcaagccaataaaaccgttgggctctggtgatactggcagtgtccatttggttgaactgaaaggcacaggtgaattgtatgccatgaaggcaatggagaaaacaatgatgttgaatcgtaacaaggctcaccgagcatgcatcgaaagggaaatcatttctcttctggatcatcctttccttcccactctctacacttcctttcagacagccacgcatgtttgtttgattacagacttctgccccggtggagagttgtttgctctgcttgacaaacaacccatgaaatttttgtcagaggaatcagcaaggttctatgcagcagaggtcgttatcggcttagaatatcttcactgcttaggaattgtataccgagatctgaagcctgaaaatatactgctcaagaaggatggacacattgtattagccgactttgatttatcattcatgacgtcctgcacaccacagcttattaatccacctgcacctaacaaacgaaggaagtccaagagtcaaccactaccaacattcgttgcagaaccaattacacagtcaaactcgttcgtagggaccgaagaatacattgcgcctgagataatcacgggtgctggtcatacgagtgctattgattggtgggcgctgggtatcttgttgtatgaaatgctttatggccgcacacctttcaggggtaagaataggcagaagacatttgccaacatcttgcacaaagatctcaccttccccagcagtattcctgtaagtcttgtatgtagacagttgatcaacatgttgctaaatagagatccgagttgccggttaggatccaaaggtggagcaaatgagataaaacagcatgccttcttccgcgggatcaattggcctctcatacgttgcatgagccctccaccattggatgcaccgttgcgtataatagagaaagatccgaatgccaaagatataaagtgggaagatgatggagtgcttgtgaattctatggacattgacattgatctcttctaaaccctccctactcttcccttcttcttctgcttttgagtctcattttaatgcaaaactctcttcttctcaataaagcaaaggtgttgtttgtactgtagttgcttacatatataatacatcagacataaaacagctctttcttgttattaaaggcaccgcacaattttccttctcttctaaatcccgaaatcaaccataaacatacaaacttttgatgaccatgttaatattgttaagtgttattggcccattacgaggcccaataactggcccatcagctgttgggcgaaatgtctttgagaagtccaaccacctgctgcatcgtgggtcgcttccacggcagatcggcggtgcacaagtaccctatcttcaccgcctccgcaatctgctccaccggagctgtctctcgaatcttcggatcgatggcttctgatccttgtccctgcctcaccaaacttctcacccaattcaccaagtccccttccggcttcttcccgctcacgagctcaagcagaacaactccgaagctgtacacatcggattctaccgtcggagagccttgttcctccagctcaggcggtgagtagccgtctaaaactacgggaaatccctcgtccaagagtttcactaaaccaaattctgctaattgcggttcctggctggagtctaagcagattgttgtagccttcacttccccgtggaccaccggaggaatgcatccatgatggaggaaagccaacgccctcgccgtccctagagctatcttatgccggaatctccacgatgcagaatcgactgtggtatagagtaaagtttgcaaattgacattgtctaggtgctcgtaaatcgcgattctttgctctgcggttatgcagtatccagagagcgggacgagatttgggtggttgatccgggcgaggcgttcaaacacaagcaaggcttcgtgattggtcaatgtggttccacttgggacaacttttagagctgctctgaatccatcaggtaagactgcttcgtaagtaggaccagacttgctttcccacaacaatgcgcctctgtcgaagttgaaagtcgcagcctttaggtctgcaaacgtcagcttcatcaacggcttgtcgatcattacgactgagacatcggttgattcattttggtctgacaagttgggttctgtggcttgctttgctgcccatgttctggattttcttctacctctcaaggccacaagtatgagcaacagcgcaacaagtaagaaggccatggagattgctaacgccaaaccaatcttgagccctgtcttcttcttgttgattttctttcccttttgaacaattggctttgcagcaaaggggcagttgttcgtggagccaatgagggatgtctggatcattctttgagagaagttggggttgcaaaaggttagattgttgaaggagaagttaaacctctgcatcatggggagtttctcaagaaccggccttggaatgtctccctctagcttattcagcgagagatcaagtatttcaatgttcttgaggctcaacataggcacatggccagtgagattattggaggagagatctataaccttgagatgacttagccgcgagatttcacctggaatgatacctgctatattggtcctggatagattcagataatatagagctgaaagctttgagatatttgggaattcttgtgtcctgaatcgattgcacgcgaggttaaggtgtctcagcttcggagatgaactcaagccattgagtatatggccgaaaaaacggttattggacaagtcaagatgaaccagactagacgagttgtgtttgacgccgtctattaactgcaagatatgcccaccaaatcggttttcactgagatcaactgtttccaagttttcatgcaagtctcctatcaatgaaccctgaaacagattccgtgaaaggttcaagcttttcagttttgggaaggccgaaccaaaaccaacaggcagtgacccggtgagctggttcgatgagaggtcgatggagactagagaacggcaattgagaagtcctggagggacgacaaactgaaaaccattgttgtcaagcttgagagttgttagattgacaagggagcttatagcggcagggatttctccggagaagctgttgaaagaaagatcaagggtctcaagcgtcatgaaattgccgatgttgctgggaagaggcgcagaaatccggttggaggagagattgagactcttgagggagcccagactccacaaatccgagggcagagacgtaatcttgttgccactaagatccaaagatcggagcattctcaatttcccgatggtgttgtcagggatgggaccggacagttctgaccaagaagctgagaagcggagcacgtactctcttcttgagttacagaccactcctggccatgaacataaagaagaagaagataatgtgtgagcttgggaagaattgggtagtcccattgctgtgaagaagttggagagataagaggcgtctgtgttgggatcttggctggtcagatgcttgacgaagagggagaggaatatgagagttccccatagaggcaagcccatattttggaatctggacttggagaaaggtcggtggaggagctcagaaagaagacagactgtgtgaaaagaagaaaagacataatggaatcacggggtagagatgtgatagtttggaatccattgagatccctttcacgtgcacggcttcaaaatcagagtagaagaaggataaggggttgaaaagttggggagttcagagtgagtttggctgtatcatatgcttggaggaagtggaagagaatagtgagtcgttgaaagtcaaaaaagaggaggagattttataattaggtaaagtttttcgctagtgactaatatgaaaatgggatctgtctcagacttttgtaaatttcaaatcccaaagtgtcaatggatttggttgagtgggagtgggtggctgtggtttctcacttctgcaggattt

SEQ ID NO: 1827 - DNA, 6170 bp, Eutrema parvulum
ttgcgtacagttgtgagtttttattgcctgactctcaaatgtttttttcatcgtctttgccctttttaaagccatgtacaatatatccatgagttgcagctgataaagctacacgtctggtatttattttttgtttatttttattaacttcatcttctttaacgtgtttcttgattgcttccaaacacttttaatggcatttattggctgttcccggaaactacaggtgtgtttgcctcatccacctatctaactcttagtaaacttgtctggttttcatttgcagcctattcattactctgtttcgcgaaagagaataaagaaacaatatggagaggccaagagcccctcaatctcccttgaccgatttggagtcattaagtgttcgcagatccctcgaggtcttcaaccccttgagtggtaaagagttaaacggatcatcatcttcttcttcttcatcaaagcctcaggatggcgacggaaaaggcagcagcagtaagtgggtggaatttcaagattctgcaaagttagcagagagaactgctgaatggggattgtcagccgttaagccggactccggagaagatggcattagtttcaaattgtccggtgaagtggaacgaagtaaaatgtctcggaggtcatctgaagaatcaacgtcttctgaatctggggccttccctagagtatcccaggagctcaaaaccgctctttccacgttgcagcagacctttgttgtctctgacgccactcagccacactgtcccatagtgtatgccagcagtggattcttcaccatgaccggttattcttccaaggaaattgttggaaaaaactgccggtttctacaagggccggacacagaccagaaagaggttgccaaaatcagagattgtgtcaagaatggaaaaagttactgtggaaggctattaaactacaaaaaggacggaacccccttctggaatcttctcacaatcactcctatcaaggacgaccaaggcaacaccatcaagttcattgggatgcaggttgaagtaagcaaatacacagaaggcgtaaatgataaagaattgaggccaaatggactctccaagtccctgatccgatatgatgctcgccagaaggagaaagctttggattccatcacagaggtcgtgcaaacaataagacatcgcaagtcccaagtgcgggaatccgtgagcaatgatattatggtgaggcctgatagtgctactacacctaatagacaagctatacaatcagatgagggttcaaagtcagcgagaacacctggacgtgtttctactccagctagttcaaaaagtaaatcacttagctccaataaaaggcatgaacacggttctagtgtggaacctgaagcattgttgttgagcacagaagtaatagagccgagggacagctgggacagtacagaaagagaaagggatatacgccaagggattgatctagctaccactcttgagcgcatagagaagaattttgtcatcagtgatcctcgccttcctgataatcctattatctttgcatcagatagctttcttgaattgacagagtatacacgcgaggaaattttgggaagaaattgtcgatttcttcaggggccagagacagatcaagcgactgtccagaagataagagacgcaattagagatcaaagggagataactgtacagttgataaactacactaagagcggaaagaaattctggaacttattccacttgcaacctatgcgtgatcagaagggagagcttcaatacttcatcggtgtgcagcttgatggaagtgatcatgtggaacccctccaaaatcgtttgtctgagaaaacagagatgcagagttctaaagtggtgaaagctacagcaacaaatgtagatgaagctgtcagagaacttccagatgctaatatgcggcccgaggacctgtgggctgcacactcaaagcctgtatatcctctgcctcacaaaaaggagagtacgtcctggaaagcgattcataagatccaagccagtggagaaacagtgggacttcatcatttcaagccaataaaaccgttgggctctggtgatactgggagtgtccatttggttgaactgaaaggcacaggggagttgtatgccatgaaggcaatggaaaaagccatgatgttgaatcgtaacaaggcccaccgagcatgcatcgaaagggaaatcatttcccttctggatcatcctttccttcccactctctacgcttcctttcagacatctacgcatgtttgtttgattacagacttctaccctggtggagagttgtttgcactgcttgacagacaacccatgaaatttttgtcagaggaatcagcaaggttctatgcagcagaggtagttatcggcttagaatatcttcactgcttaggaatagtataccgagacctgaagcctgaaaatatactgctcaagaaggatggacacattgtattagccgactttgatttatcattcatgacgtcctgcacaccccagcttataattccacctgcacctaacaaacgaaggagatccaagagtcagcccctacccacatttgttgcagaaccaacggcccagtcaaactcgtttgtagggactgaagaatacattgcgcctgagataattacgggcgctggtcatacgagtgctattgattggtgggcactaggtatcttgttgtatgagatgctttatggtcgcacacctttcaggggtaagaataggcagaagacatttgccaacatcttgcacaaagatctcacctttcccagcagtatccctgtaagtcttgtatgtagacagttgatcaacgcgttgttacatagagatccgagcagccggctaggatccaaaggtggggcgaatgagataaagcagcacgctttcttccgcgggatcaattggcctctcatacggtgcatggaccctccaccattggatgcaccattgcgcataatagagaaagatccgaatgccaaggaaataaagtgggaagatgatggggtacttgtgaattctatggacatggacattgatctcttctaaaccccactcttcctttcttctgcctttaaatctcgttttaatgcaaaaactcttcttctcaataaagcaaaggtgttgtatttttgttgcttacatacataatgcatcagacataaacggctcttttatgtaattagagcaacacacaattttccattcttctaaatctcgaaaccatcaacaataaaacgtacgtactttgtgaccatgttaatactgattggcccattataaggccctagcccattaacaactgattggggaaatgtctttgagaagtccaaccacctgctgcatcgtgggtcgcttccatggcaaatcggcggtgcacaagtaccctatcttcaccgcctccgcaatctgctccaccggacctgtctcttgcatcgtcggatcgatggttctcgatccttgtccttgcctcaccaaccctcttacccaattcaccaagtcccattccggcttcttcccgctcacgagctcaagtagaacaactccaaagctgtacacatcggattctaccgtcggggagccatgttcctccagctccggcggtgcgtaactgtctacatcgccgggaaatccctcgtccaagagtttggctaaaccaaattctgctaattgtggttcctgactggagtctaagcagattgttccagccttcacttccccgtggaccaccggaggaatgcagccatgatggaggaaagccaacgccctcgccgtccccagagctatcttatgcctgagtctccaggatgccaatattctttcggaatcgtatgtggtatggagtagactttgcaaattaacatagtctaggtgctcgtaaatcacaactctttgctctgcggctatgcagtatccagagagcgggacgaggtttgggtgattgatccgcgccaggcgttcgaacgcaatcgaggcttcgtggtcgctcaatgtggtaccatttgggacaactttcagagctgctctgaatccacctggtaggactgcctcgtaagtaggaccagacttgctttcccacaacaatgcgcctctgtcgaagttgagagtggcagccttgaggtctgcaaacgtcatcttcatcaacggcttgtcaatcattaccacagagacgtcggttgagtcactttggtctgacacattaggttctgcggcttgctttgtcgcccatgttctgtattttcttctacctctcaatgccacaagtatgagcaacagcccagtcagtaagaaagccatggagattgcaaaagtcaaaccaatcttaagccctgtcgtcttcttgttgacgttctttcccttttgaacaactggctttgcagcgaaggggcagttgtttgtggaaccaatgagggatgtctggatcattccttgagagaagttggggttacaaaaggttagattgttgaaagagaggttaaacctctccatcattgggagtttctccagaaccggccttggaatgtctccgtctagcttattcagcgagagatcaagtatttcaatgttcttgaggcttaacaaaggtacatggccagtgagattattaaaggagagatcaagaaccttcagatgactcagccgcgagatttcttttgggatgatacctaccagactgatcctggatagatttagataatataaagctgaaagcgttgtgatttgtgggaattcttgtaccctgaatcgattgcacgcgaggttaaggtgtcccagcttctgagatgaactcaatccattgagtatatggccgactaaaagattctccgacaagtccagataaatcagactagacaagttgtgtttgtggccggctattaactgtaagatatgcccatcaaatcggttttcactgagatcaactgtttccacgttttcatgcaagacccctttcagtgaaccctgaaacagattccgtgaaaggttcaggctttttagttgtgggaaggccgagccaaaatcaacaggcagagacccggtgagccgattcgatgagaggtcaatggagactagagatcggcaatggagaagccctggagggacgacaaattgaaaaccattgttgtggagcttgagagttgttagacggacaagggagcttatagcggcagggatttcgccagagaagctgttgaaagaaaggtcgagtgtctcaagggagatgaaattgccgatgttgctggcaagagtctgcgaaatccggttagaggagagattgagactcttgagcgagccccccagactccacaaatccgagggcagagacgtaatcttgttgccactgagatccaaatatcggagcattctcattttaccgatggtgttgtccgggatgggaccagacaagtccgacccataagccgagaagtggacgacgtactctctccgtgagtcacagatcactcctggccacgaacataaagaagaagaagaaaatgtgcgaacttgggaagaattgggtaaaaccattttggaaaaaaactcagagagataaaaagcgtcggtgttgggatcttgactcgtcaggtgcttgacgaagagggagagaaacatgagagttgcccatagacacaagcccatattttggagtctggacctggagaaaggtggatgggggagctcagaaagaagacagactgcgtgaaaagaagaaaagacataatggaatcacggggtggagatgtgatagtttggaatacattgagatccctttcacgtgcacagcttcaaaatcagaggttaatcagaagacatgattccgaagaagaagaagaagataagggtttaaaagtttgggagagttcagagtgagtttggctgtatcctatggactctggaggaactgaaagagaagagagagagagtcgttgaaagtcaaagaaaaaaggggagatgaggagattataattaggtaaagttatactttgctggtgagtaatatgaaatggaatctgcctcagacttttgtgaatttgaaatcccaaggtgtcaaactgtcaatggatttggttgagtgggagagtgggtggttgtggtttctcaattctgcaggatttgggttatagtgtaaaaaatcaccttttt

SEQ ID NO: 1828 - DNA, 3311 bp, Brassica rapa
gaaacattattgtacagttgtgagttttcaactatcaaagctttctcatcgtctttgctctttttaaagccatgtactatatatccatgagttgcagctgataaagctacacgtctggtctttatttattttcgttttttttttaaattcaacttcatctttctttaacgtgtttcttgattgctttcaaacactttaatgccatttattggatgttcccggtaccaggtgtgttagcctctcatctacctatctaactctgtggtgaacttgtctggttttgatttgcagcctctgtttcgccaaaagaaagagaataaagaaacattatggagaggccaagagcccctccgtctatcttcacggaattagagccattaagtgaacgcaaatcacttgaggttttcaacccctcgagtggtaaagaggtaaacggatcagcttcagcttcttcctcctcatcaaagcctcacgatgaaaatggaaaaggaagcagcagtaagtggatggagtttcaagatactgcaaagttagcagagagaactgctgaatggggtttatcagctgttaagccggactcaggggaagatggcattagtttcaaggtgtcaagtgaagtggaccgaagcaagacgtctaggaggtcatctgaagaatcgtcatcttctgaatctggggctttccctagagtgtcacaggagctcaaaaccgcgctttccacgttgcagcagacttttgtagtctctgatgctacacagccacactgtcccatagtgtatgcaagcagtggattcttcaccatgactggttactcttccaaggagattgttggaagaaactgccggtttctgcaagggccggacacagaccagaaagaggttgccaaaatcagagatgctgtcaagaatggaaaaagttactgtggaaggctcttgaattacaagaaggacggaactcccttctggaatcttctcacaatcactcctattaaggatgaccaaggcaacaccatcaagttcattgggatgcaggttgaagtaagcaaatacacagaaggcgtaaacgataaagcattgaggcctaatggactctctaaatccctaatccgatatgatgctcgccagaaggagaaagctttggattccattactgaggtcgtgcaaacagtaagacatcgcaagtctcaagtgcgagattccgtgagcaatgatgtaatggtgacgcctggtagtactactactactacacctgttagacaagctatacaaccagatgaggcttcaaagtcagccagaacacctgggcgtgtttctactccagcgaagtcaaagagcaaatcgcttgatgttccaagtgtggaacctgaagaattgatgttgagcacagaagtaatagagccgagggacagttgggaccgtttagaaagagaaagggatattcgtcaaggcattgatctggctaccactcttgagcgcatagagaagaatttcgtcatcagtgatcctcgtcttcctgatacccccattatatttgcatcagacagctttcttgaactgacagagtatacacgtgaggaaattttggggagaaactgtcggtttcttcaggggccagagacagatcaagcgactgtccagaagataagagacgcaattagagagcaaagggagataactgtacagttgataaactacacgaagagcggaaagaaattctggaacttattccacttgcaacctatgcgtgatcagaagggagagcttcaatacttcatcggtgtgcagcttgatggaagtgatcatgtggaacctctccgaaatcgtttgtctgagagaacagagatgcagagttctaaactggtgaaagccacagcaacaaatgtagatgaagctgtgagagaacttccagatgctaatatgcgaccggaagacctttgggctgcacactcaaagcctgtctacccactccctcacaaaaaggagagtacttcctggaaagcaatacaaaagatccaagcaagtggagaaacagtgggacttcatcatttcaagccaataaaaccgttgggctctggtgatactggcagtgttcatttggttgaactgaaaggcacaggtgagttgtacgccatgaaggcaatggagaaaaccatgatgttaaatcgtaacaaggttcacagagcatgcatcgaaagagaaatcatttcccttctggatcatcctttccttcccactctctacgcttcctttcagacatctacgcatgtttgtttgattacagacttctgccccggtggagagttgtttgcactgcttgacagacaacccatgaaatttttgtcggaggattcagcaaggttctatgcagcagaggtcgttatcggcttggaatatcttcactgcttagggatagtataccgagacttgaagcctgagaatatactgctcatgaaggatggacacattgtattagcagactttgatctatcattcatgacggcctgcacacctcagcttattattccacctgcacctagcaaaagaagaagatccaagagtcaaccattaccgacatttgttgcagaaccaaacgcccagtcaaactcgtttgtagggactgaagaatacattgcgcctgagataatcacgggctctgggcatacgagtgctattgattggtgggcactagggatattgttgtatgagatgctttatggtcgcacacctttcaggggtaagaataggcagaagacatttgccaacatcttgcacaaagatctcaccttccccagcagtatccctgtaagtcttgtaggtagacagttgatcaacatgttgctaaatagagatccaagcagccggttaggatccaaaggtggggctaatgagataaagcagcatgctttcttccgtgggatcaattggcctctcatacggggcatgagccctccaccattggaagcaccgttgcgtataatcgagaaagatccgaaagccaaagatataaactgggaagatgatggggtgcttgtgaattctattgacattgatctcttctaaacaaacaccgactcttcctttcttctgcctttgagactcattttagtgcaaaactcttcttctcaataaagcaaaaggtgttgtattctagttgcttacatgttatatatgtaataatacatcagacataagaggtggtgttgtattctagttgcttacatatcaaacacacaattttccatttcttttaaatcttcaaatcatcaactagttaaccaagttaatatttggtaagatgttgtttggcacctt

SEQ ID NO: 1829 - DNA, 3004 bp, Brassica napus
tctcatctacctatctaactctgtggtgaacttgtctggttttgatttgtagcctctgtttcgccaaaagaaagagaataaagaaacattatggagatgccgagagcccctccgtctatcttcacggatttagagccattaagtgaacgcaaatcacttgaggttttcaacccctcgagtggtaaagaggtaaacggatcagcttcagcttcttcttcatcaaagcctcacgatgaaaatggaaaaggaagcagcagtaagtggatggagtttcaagatactgcaaagttagcagagagaactgctgagtggggtttatcagctgttaagcctgactcgggagaagatgggattagtttcaaggtgtcaagtgaagtggaccgaagcaagacgtctaggaggtcatctgaagaatcatcatcttctgaatctggggcctttcctagagtgtcgcaggagctcaaaaccgctctttccacgttgcagcagacttttgttgtctctgatgctacacagccacactgtcccatagtatatgccagcagtggatttttcaccatgactggttattcttcgaaagagattgttggaagaaactgccggtttctgcaagggcctgacacagaccagaaagaggttgccaaaatcagagatgctgtcaagaatggaaagagttactgtggaaggctcttgaactacaaaaaggacggaactcccttttggaatcttctcacaatcactcctattaaggatgaccaaggcaacaccatcaaattcattgggatgcaggttgaagtaagcaaatacacagaaggcgtgaacgataaagcattgaggcctaatggactctccaaatccctgatccgatatgatgctcgccagaaggagaaagctttggattccattactgaggtcgtgcaaacagtgagacatcgcaagtctcaagtgcgagattcagtgagcaatgatgtaatggtgacgcctggtagtactactaccactacacctgttagacaagctatacaaccagatgaggcttcaaagtcagccagaacacctggacgtgtttctactccagcgaagtcaaagagcaaatcacttgatgctcctagtgtggaacctgaagaattgatgttgagcacagaagtaatagagccgagggacagttgggaccgtttagaaagagaaagggatattcgtcaagggattgatctggctaccactcttgagcgcatagagaagaatttcgtcatcagtgatcctcgtcttcctgatactcctattatatttgcatcagacagctttcttgaactgacagagtatacacgtgaggaaattttggggagaaactgtcggtttcttcaggggccagagacagatcaagcgactgtccagaagataagagacgcaattagagagcaaagggagataactgtacagttgataaactacacgaagagcggaaagaaattctggaacttattccacttgcaacctatgcgtgatcaaaagggagagcttcaatacttcattggtgtgcagcttgatggaagtgatcatgtggaacctctccgaaaccgtttatctgagagaacagagatgcagagttctaaactggtgaaagctacagcaacaaatgtagatgaagctgtcagagaacttccagatgctaatatgcggccggaagacctgtgggctgcacactcaaaacctgtctatcctttgcctcacaagaaggagagtacgtcctggaaagcaatacagaagatccaagcaagtggagaaacagtaggactacaccatttcaagccaataaaaccgttgggctctggtgatactggcagtgtccatttggttgaactgaaaggcacaggtgagttgtatgccatgaaggcaatggagaaaaccatgatgttgaatcgtaacaaggttcacagagcatgcatcgaaagagaaatcatttcccttctggatcatcctttccttcccactctctacgcttcctttcagacatctacgcatgtttgtttgattacagacttctgccccggtggagagttgtttgcactgcttgacagacaaccgatgaaatttttgtcggaggattcagcaaggttctatgcagcagaggtcgttattggcttagaatatcttcactgcttaggaatagtgtaccgagacctgaagcctgaaaatatactgctcatgaaggatggacacattgtattagcagactttgatctatcattcatgacggcctgcacaccccagcttattattccacctgcacctagcaaacgaaggagatccaagagtcaaccattaccgacatttgttgcagaaccaaacgcccagtcgaactcgtttgtagggactgaagaatacattgcgcctgagataatcacgggctctgggcatacgagtgctattgattggtgggcactaggtatcttgttgtatgagatgctttatggtcgcacacctttcaggggtaagaataggcagaaaacatttgccaacatcttgcacaaagatctcaccttccccagcagtatccctgtaagtcttgtaggtagacagttgatcaacatgttgctaaatagagatccaagcagtcggttaggatccaaaggtgggacaaatgagataaaacagcatgctttcttccgcgggatcaattggcctctcatacgaggcatgagccctccaccattggaagcaccgttgcgtataatagagaaagatccgaaagccaaagatataaactgggaagatgatggggtgcttgtgaattctattgacattgatctcttctaaacaaacaccgactctttccgttcttctgcctttgagactcattttagtgcaaacctattcttctcaataaagcaaaatggtgttgtattctagttgcttacatgttatatatgtaataatacatcagacataagaggtggtgttgtattctagttgcttacatattaaacacaattttccattgaac

SEQ ID NO: 1830 - DNA, 3062 bp, Brassica napus
tgctttcaaacactttaatgccatttattggatgttcccggtaccaggtgtgttagcctctcatctacctatctaactctgtggtgaacttgtctggttttgatttgcagcctctgtttcgccaaaagaaagagaataaagaaacattatggagaggccaagagcccctccgtctatcttcacggaattagagccattaagtgaacgcaaatcacttgaggttttcaacccctcgagtggtaaagaggtaaacggatcagcttcagcttcttcctcctcatcaaagcctcacgatgaaaatggaaaaggaagcagcagtaagtggatggagtttcaagatactgcaaagttagcagagagaactgctgaatggggtttatcagctgttaagccggactcaggggaagatggcattagtttcaaggtgtcaagtgaagtggaccgaagcaagacgtctaggaggtcatctgaagaatcgtcatcttctgaatctggggctttccctagagtgtcacaggagctcaaaaccgcgctttccacgttgcagcagacttttgtagtctctgatgctacacagccacactgtcccatagtgtatgcaagcagtggattcttcaccatgactggttactcttccaaggagattgttggaagaaactgccggtttctgcaagggccggacacagaccagaaagaggttgccaaaatcagagatgctgtcaagaatggaaaacgttactgtggaaggctcttgaattacaagaaggacggaactcccttctggaatcttctcacaatcactcctattaaggatgaccaaggcaacaccatcaagttcattgggatgcaggttgaagtaagcaaatacacagaaggcgtaaacgataaagcattgaggcctaatggactctctaaatccctaatccgatatgatgctcgccagaaggagaaagctttggattccattactgaggtcgtgcaaacagtaagacatcgcaagtctcaagtgcgagattccgtgagcaatgatgtaatggtgacgcctggtagtactactactactacacctgttagacaagctatacaaccagatgaggcttcaaagtcagccagaacacctgggcgtgtttctactccagcgaagtcaaagagcaaatcgcttgatgttcctagtgtggaacctgaagaattgatgttgagcacagaagtaatagagccgagggacagttgggaccgtttagaaagagaaagggatattcgtcaaggcattgatctggctaccactcttgagcgcatagagaagaatttcgtcatcagtgatcctcgtcttcctgatacccccattatatttgcatcagacagctttcttgaactgacagagtatacacgtgaggaaattttggggagaaactgtcggtttcttcaggggccagagacagatcaagcgactgtccagaagataagagacgcaattagagagcaaagggagataactgtacagttgataaactacacgaagagcggaaagaaattctggaacttattccacttgcaacctatgcgtgatcagaagggagagcttcaatacttcatcggtgtgcagcttgatggaagtgatcatgtggaacctctccgaaatcgtttgtctgagagaacagagatgcagagttctaaactggtgaaagccacagcaacaaatgtagatgaagctgtgagagaacttccagatgctaatatgcgaccggaagacctttgggctgcacactcaaagcctgtctacccactccctcacaaaaaggagagtacttcctggaaagcaatacaaaagatccaagcaagtggagaaacagtgggacttcatcatttcaagccaataaaaccgttgggctctggtgatactggcagtgttcatttggttgaactgaaaggcacaggtgagttgtacgccatgaaggcaatggagaaaaccatgatgttaaatcgtaacaaggttcacagagcatgcatcgaaagagaaatcatttcccttctggatcatcctttccttcccactctctacgcttcctttcagacatctacgcatgtttgtttgattacagacttctgccccggtggagagttgtttgcactgcttgacagacaacccatgaaatttttgtcggaggattcagcaaggttctatgcagcagaggtcgttatcggcttggaatatcttcactgcttagggatagtataccgagacttgaagcctgagaatatactgctcatgaaggatgggcacattgtattagcagactttgatctatcattcatgacggcctgcacacctcagcttattattccacctgcacctagcaaaagaagaagatccaagagtcaaccattaccgacatttgttgcagaaccaaacgcccagtcaaactcgtttgtagggactgaagaatacattgcgcctgagataatcacgggctctgggcatacgagtgctattgattggtgggcactagggatattgttgtatgagatgctttatggtcgcacacctttcaggggtaagaataggcagaagacatttgccaacatcttgcacaaagatctcaccttccccagcagtatccctgtaagtcttgtaggtagacagttgatcaacatgttgctaaatagagatccaagcagccggttaggatccaaaggtggggctaatgagataaagcagcatgctttcttccgtgggatcaattggcctctcatacggggcatgagccctccaccattggaagcaccgttgcgtataatagagaaagatccgaaagccaaagatataaactgggaagatgatggggtgcttgtgaattctattgacattgatctcttctaaacaaacaccgactcttcctttcttctgcctttgagactcattttagtgcaaaactcttcttctcaataaagcaaaaggtgttgtattctagttgcttacatgttatatatgtaataatacatcagacataagaggtggtgttttattctagttgcttacatatcaaacacacaattttccattt

SEQ ID NO: 1831 - DNA, 3047 bp, Eutrema parvulum
atcgtctttgccctttttaaagccatgtacaatatatccatgagttgcagctgataaagctacacgtctgcctattcattactctgtttcgcgaaagagaataaagaaacaatatggagaggccaagagcccctcaatctcccttgaccgatttggagtcattaagtgttcgcagatccctcgaggtcttcaaccccttgagtggtaaagagttaaacggatcatcatcttcttcttcttcatcaaagcctcaggatggcgacggaaaaggcagcagcagtaagtgggtggaatttcaagattctgcaaagttagcagagagaactgctgaatggggattgtcagccgttaagccggactccggagaagatggcattagtttcaaattgtccggtgaagtggaacgaagtaaaatgtctcggaggtcatctgaagaatcaacgtcttctgaatctggggccttccctagagtatcccaggagctcaaaaccgctctttccacgttgcagcagacctttgttgtctctgacgccactcagccacactgtcccatagtgtatgccagcagtggattcttcaccatgaccggttattcttccaaggaaattgttggaaaaaactgccggtttctacaagggccggacacagaccagaaagaggttgccaaaatcagagattgtgtcaagaatggaaaaagttactgtggaaggctattaaactacaaaaaggacggaacccccttctggaatcttctcacaatcactcctatcaaggacgaccaaggcaacaccatcaagttcattgggatgcaggttgaagtaagcaaatacacagaaggcgtaaatgataaagaattgaggccaaatggactctccaagtccctgatccgatatgatgctcgccagaaggagaaagctttggattccatcacagaggtcgtgcaaacaataaaacatcgcaagtctcaagtgcgagactccgtgagcaatgatgttatggtgaggcttgatagtgctactacacctggtaaacaagttataaaatcagatgaggcttcgaagtcagccagaacacctacacgtgtttctactccaacgaggtcaaagagcaaatcgcttagctcgaataaaaagcatgaagatgttccgagtgtggaacctgaagcattggtgttgagcacagaagtaatagagccgagggatagttttgaccgttcagaaagagaaagggatatacgccaagggattgatctagctaccactcttgagcgcatagagaagaatttcgtcatcagtgatcctcgtcttcccgataatcccattatatttgcatcagacagctttcttgaattgacagagtatacacgcgaggagattttgggtagaaactgtcggtttcttcaggggccagagacagatcaagcgactgtccaaaagattagagacgcaattagagatcaaagggaaataactgtgcagttgataaactacactaagagcggaaagaaattctggaacttattccacttgcaacctatgcgtgatcagaagggagagcttcaatacttcatcggtgtgcagcttgatggaagtgatcatgtggaacccctccaaaatcgtttgtctgagaaaacagagatgcagagttctaaagtggtgaaagctacagcaacaaatgtagatgaagctgtcagagaacttccagatgctaatatgcggcccgaggacttgtgggctgcacactcaaagcctgtctatcctctgcctcacaataaggagagtacgtcctggaaagccatacaaaaggcatgcatcaaaccacattatggcgaaacagtgggactacatcatttcaagccaataaaaccgttgggctctggtgatactggcagtgtccatttggttgaactgaaaggcacaggtgaattgtatgccatgaaggcaatggagaaaacaatgatgttgaatcgtaacaaggctcaccgagcatgcatcgaaagggaaatcatttctcttctggatcatcctttccttcccactctctacacttcctttcagacagccacgcatgtttgtttgattacagacttctgccccggtggagagttgtttgctctgcttgacaaacaacccatgaaatttttgtcagaggaatcagcaaggttctatgcagcagaggtcgttatcggcttagaatatcttcactgcttaggaattgtataccgagatctgaagcctgaaaatatactgctcaagaaggatggacacattgtattagccgactttgatttatcattcatgacgtcctgcacaccccagcttattaatccacctgcacctaacaaacgaaggaagtccaagagtcaaccactaccaacattcgttgcagaaccaattacacagtcaaactcgttcgtagggaccgaagaatacattgcgcctgagataatcacgggtgctggtcatacgagtgctattgattggtgggcgctgggtatcttgttgtatgaaatgctttatggccgcacacctttcaggggtaagaataggcagaagacatttgccaacatcttgcacaaagatctcaccttccccagcagtattcctgtaagtcttgtatgtagacagttgatcaacatgttgctaaatagagatccgagttgccggttaggatccaaaggtggagcaaatgagataaaacagcatgccttcttccgcgggatcaattggcctctcatacgttgcatgagccctccaccattggatgcaccgttgcgtataatagagaaagatccgaatgccaaagatataaagtgggaagatgatggagtgcttgtgaattctatggacattgacattgatctcttctaaaccctccctactcttcccttcttcttctgcttttgagtctcattttaatgcaaaactctcttcttctcaataaagcaaaggtgttgtttgtactgtagttgcttacatatataatacatcagacataaaacagctctttcttgttattaaaggcaccgcacaattttcctttccaaa

SEQ ID NO: 1832 - DNA, 3207 bp, Brassica napus
ctctttaatgtaatttattagctgttacccggaaactacaggtgtaatagcctcaatccttctgtctaactctttggtaaacttgtctggtgtttaatttgcagccagttcattactctgtttcgccaaagaaagtgaataaagaaactacatggagaggccaagagcttctccgtctcccttggctgatttggagccattaagtgaacgcacatcccttgagatattcaacccttcaagtggtaaagaggcatcttcttcttcatcatcaaagcctcaagatggcaaccgcaaaggaagcagcagtaagtggatggagtttcatgattctgcaaagatagtagagagaactgctgagtggggattatcatccgttaaaccggacacaggagaagatggtattagtttcaaggtgtccagtgaagtggaacgaagcaagatgtctaggaggtcatccgaagaatcatcagcttctgaatctggagccttccctagagtatctcaggagctcaaaaccgctctctccacgttgcagcagacctttgttgtctctgacgctacacagccagactgtcccatagtctatgccagcagtgggttcttcaccatgactggttattcctccaaagaaatcgttggaagaaactgccgttttctgcaagggcctgacacagacaagaaagaggttgttaaaatcagagattgtgtcaagaatggaaaaagctactgtggaaggctcttaaactacaaaaaggatggaacacccttttggaatctcctcacagtcactcctatcaaggacgaccaaggcaacaccattaagttcattgggatgcaggttgaagtaagcaaatatacagaaggtgtaaacgataaagaactgaggcctaatggactctccaaatccctgatccgatatgatgctcgccagaaggagttagccttggattctattactgaggtcgtgcaaacaataaaacatcgcaagtctcaagtgcggaactctgtgagtaatgatattctggtgaagcctgatagtactactacacctggtggacaagttgtgcgatcagatgaggcttcaaagtcagccagaacacctggacgtgttgctactccagcgaggccaaagagcaaatcacttagctggaataaaaagcatgaagatgttcctagtgtggaacctgaagaactaatgttgagcacagaagttgtagagcctagggagagttgggagcgtttagaaagagaaagggatatacgtcaagggattgatctagctaccactcttgagcgtatagagaagaacttcgtcatcagtgatcctcgtcttcctgataatcccattatatttgcatcagacagctttcttgaattaactgagtatacacgtgaggaaatattgggaagaaactgtcggtttcttcagggtccagagacagaccaagcgactgtccagaagataagagacgcaattagagatcaaagggagataactgtccagttgataaactacactaagagcggaaagaagttctggaacttattccacttgcaacctatgcgtgatcagaagggagagcttcaatacttcataggtgtgcagcttgatggaagtgatcatgttgagcccctcagaaaccgtttgtctgagagaacagagatgcagagttctaaactggtgaaagctacagcaacaaatgtagatgaagctgtcagagagcttcctgatgctaatatgcggccagaagacttgtgggctgcatactcaaagccagtatatcctctgcctcacaaaaaggagagtacatcctggaaggcaatacaaaagatccaagcgagtggagaaacaataggacttcatcatttcaagccaataaaaccgttaggctctggtgatactggcagtgtccatttggttgaactgaaaggcacaggtgagttgtatgccatgaaggcaatggagaaaaccatgatgttgaatcgtaacaaggctcaccgagcatgcatcgaaagggaaatcatttcccttctggatcatcctttccttcccactctctacacttcctttcagacatctacgcatgtttgtttgatcacagacttctgccccggtggagagttgtttgcactacttgacatccaaccaatgaagtttttgtcagaagaatcagcaaggttctatgcagcagaggtcgttattggcttagaatatcttcactgcttaggaatagtataccgagacctgaagcctgaaaacatactgctcaagaaggatggacacattgtattagccgactttgatctatctttcttgacgtcctgcacaccccagcttattgttccacctgcacctaacaaacggaggagatccaagagccaaccattacccacttttgttgcagaaccagccactcagtcaaactcgtttgtagggactgaagaatacattgctcctgagataatcagtggttctggtcacacgagtgctattgattggtgggcactaggcatcttgttgtatgagatgctttatgggcgcacacctttcaggggtaagaataggcagaagacatttgccaacatcttgcacaaagatctcaccttccccagcagtatccctgtaagtcttgtatgtagacagttgattaacatgttgttaaatagagatccaagcagccggttaggatccaaaggtggggctaatgagataaagcagcatgcattcttctgtgggatcaattggcctctcatacggggcacggagcctccaccattggatgcaccattgcgtataacagagaaagatccgaatgcaaaagatataaagtgggaagatgatggagtgcttgtgaattcgatggacattgacattgatctattctaaacactcactcttttaccttactctgtctgagtctcattttaatgcaaaactcttctcaataaagaaaaaggtggtgtattctagttgacattgttagaccatttgtatatgtagcagagattgcaacatttggtgtggattgatgactgaaatagtaggaatggtcacatgttctctgatgaaccaagtgatagtaagttagcctctaaggcctacacaagaagattttcgaccagttgtagtatataaaccactagggtttggcctgcccgtagggcgggtgaataataataaatatctttatataaatatatgttatg

SEQ ID NO: 1833 - DNA, 5705 bp, Brassica rapa
gtgtgatttccccatccatctatctatctctttgttaaaacttgtctggtttttgattttggcagccaattcattactctaaagaaacgatatggagaggccaagagcccctccttctccctccaccgatttggagccattaagtgaacgcaggtcccttgaggtcttcaacccctcgagtggatcttcttcttcatcaaagccttacgatggaaacagcaaaatcagcagcagcagtaagtggatggagtttcaagactctgcaaagataactgagagaactgctgagtggggattatcagctgttaagccggagccaggagaaaatggcattagcttcaagctgtctactgaagttgaacgaagcaagatgtctaggaggtcatcagaagaatcaacgtcctctgaatctggagccttccctagagtatcccaggagctcaaaaccgctctttccaccttgcagcagacctttgttgtctctgacgctacacagccacactgtcccatagtgtatgccagcagtggattcttcaccatgactggttacacttccaaggaaattgttggaagaaactgcctgtttctgcaagggcctgaaacagaccagaaagaggttgctaaaatcagagattgtgtgaagaacggaaagagttactgtggaaggatcttaaactacaaaaaggacggaactcccttctggaatcttctcacaatcactcctattaaggatgaccaaggcaacaccatcaagttcattgggatgcaggttgaagtaagcaaatacacagaaggcgtgaacgataaagcattgaggcctaatggactctccaagtccctgatccgatatgatgctcgccagaaggagaaagctttggattccatgacagaggtcgtgcaaacaataaaacaccgcaagtctcaagtgagagactccgtgagcaatgatgttatggttaagccaggcagtgctactactacacctggtagacaagctatacaatcagacgaggcttcaaagtcagccaaaacacctgaacgtgtttctactccagcgaggtcaaggagcaaatcgcttagctcgaataaaagacatgaagatgttcctagtgtggaacctgaagaactgatgttgagcacagaagttatagagccgagagacagctgggaccgttcagaaagagagaaggatatacgccaagggattgatcttgccaccactcttgagcgcatagagaagaatttcgtcatcagtgatcctcgtcttcctgataatcccattatatttgcatcagacagctttctcgaactgacagagtatacacgtgaggaaattttgggaaggaactgtcggtttcttcaggggccagagacagatcagtcaactgtccagaagataagagacgcaattagagatcaaagggagataactgtacagttgattaactacactaagagcggaaagaagttttggaacttattccacttgcaacctatgcgtgatcagaagggagagcttcaatacttcataggtgtgcagcttgatggaagtgaccatgtggaacccatccgaaaccgtttgtctgagggaacagagatgcagagttctaaactggtgaaagctacagcaacaaatgtaaatgaagctgtcagagaacttccagatgctaatatgacgccggaagacctatgggctgcacactcaaagcctgtctatcccatgcctcacaaaaaggagagtgcttcctggaaagcaatacaaaagatccaagcgggtggagaaacagtgggactacatcatttcaagccagtaaaacctttggggtctggtgatactggcagtgtccatttggttgaacttaaaggcacaggagagttgtatgccatgaaggcaatggagaaaaccatgatgttgaatcgtaacaaggctcacagagcacgcatcgaaagggaaatcatttcccttctggatcatcctttccttcccactctctacgcatcctttcagacatctacgcatgtttgtttgattacagacttctgccccggtggagagttgtttgcattgcttgatagacaacccatgaagtttttgtcggaggattcagcaaggttctatgcagcagaggtcgttattggcttagaatatcttcattgcttaggaatagtataccgagacctgaagcctgaaaacatactgcttaagaaggatggacacattgtattagcagactttgatctctcattcatgacgtcctgcacaccccagcttattgttccacctgcacctaataaacgaaggagatcatcgtcatccaagagtcggccattaccaacatttgttgcagaaccaatcaccaagtcaaactctttcgttgggactgaagaatacattgctcctgagattatcacgggtgctggtcatacaagtgctatagattggtgggcactaggtatcttgttgtatgagatgctctatggtcgtacacctttcaggggtaagaataggcagaagacatttgccaacatcttgcacaaagatctcaccttccccagcagtatccctgtaagtcttgtaggtagacagttgatcaacatgttactaaatagagatcctagaaaacggttaggtaccaaaggtggagcaaatgagataaagcagcatgctttcttccgcgggatcaattggcctctcatacgggacatggactctccaccattggatgtaccattgcgtataatagagaaagatccaaaagccaaagatataaagtgggaagatgatggggtgcttgttaattctatggacattgacattgatctcttttaaacaaccactcttcctttcttctgcttgcctttgaatctccttttactgcaaaactcttccttctcaataaaacaaaggtgttgtattctctagttgcttacatgtagtatatagtgcactcaaacataaatgactctttcatgttcacactaagatcttcaaatgatcaacaaatagaacatacatactttatgaccatgttagtattgtcaagtgtgacagtatgttaagagagtatcacacaaccttccacttctaatctccaaatcatcaacaatataatacaacctttataaccaagttagtatgtaattgtgacgctatgagggcgaaatgtctttgagcagtccaaccacctgctgcattgtgggtcgcttccatgatagatcagccgtgcacaagtagcctatcttcacagcttctgcaatctgctccaccggacctgtcccttgcagcgtcggatctatggcactagatccttctccttgcctcaccaaccctctcacccaattcaccaagtcccattccgccttcttcccgctcacgagctcaagcagaacaactccaaagctgtacacatctgattctaatgtaggagagccatgttcctccagctctgttggcgtgtagccgtctaaatcactgataagtccctcgttcaagagcttgaccaaaccaaattctgctagttgaggctcctggctagagtctaagaagattgttccagccttcacttccccgtgcaccacaggaggaatgcagccatggtggaggaaagccaacgccctcgccgtccccaatgctatcttatgccggagtatccatgataaagagtcatcatccgcggtgtgaagtaaagtatgcaagttaacatactctaggtgctcgtagatcactattctttgctctgcagctatacagtatccagagagcgggacaagattcgggtgattgatccgagcaaggcgttcaaacgtcaccgaggcttcatgatcactcaacgtggctccacttgagacaactttcaaagctgctctgaatccaccgggtaagactgcttcataagtaggaccagacttgctttcccacaacaatgcgccactgtcaaagttaagagtagcagccttaaggtcagcaagcgtcatcttcatcaacggcttgtcaatcattacaacagggacatcagttgatgaatccccttggtctaacaagttaggttccgcagcttgctttgtcgcccatgttcttgattttcttctacctctcattgccacaagtataaccaacagaccaacaagtaaaaacgccatggagattgctaaagtcaaaccaatcttaagccctgtcttcttcttgctcacgctctcccccttttgaacatttggctttgcagcaaagggacaattgttcgtggagccaatgaaggatgtctgaatcatcccttgtgagaggttagggtcacaaaaggttagattgttgaaagagaagttaaacctctccatcacagggagcttctccagaaccgtcctcggaatgtctccgtctagcttgttgagcgagagatcaagtacttcaatgttcttgagaggtaacaaaggtacattcccattgaggttattgtaggagagatcaagaaccttgagctgactcagctgagtgattccactaggaatggaacctgccagattggttcttgacagattcagataatataaacctgaaagctttaaaatttgtgggaagtcttgtactctgaaacgattagacgcgaggttgaggtgtcccagcttatgagctgaactcaaaccgttaagtatatgccccacaaagccattctcagacaagtcaagataaattaaaccagacaagttgtgtttacgtccagctattaaatgcaatacatgcccatcaaagcgatttttactgagatcaactgtctccatgtttccacgcaagactccattcaccgacccctgtaacagattacgcgaaaggttcagacttttcagctccgggaacgcggaaccgaactcatcagggagagacccggtgaggcgattcgacgagaggtcgatggagactaaagatctgcaattgagaagtcccggagggagaacagactgaaaggcgttgttgttgaggctgagagttgtgaggccgacgagggagcttatggaagcggggatttcgccggagaaggtgttgaaagagagatcgagggtctggagcgagacgaagttgccgatgttgctggggagagggtcggagataaggttggaggagaggttgagatgcttgagggagtctaggctccagaggtctgaggggagagaggtgattttgttgcggctgagatctaaagattgaagctttatcattttgccgatggtgttgtcggggatgggaccggataggtccgacccggaagctgagaagtggaggacgttctgtttttgtctgtcgcagactactcctggcgaagaacataaggaagaaaatgtgtgagctttgggtgaagaagaactcatttggttgaagaagttagagagatgagaggcgtcagtgttgggatcttggctcttgacttgcttgacgaagatggagaggagaatgagagttctccatatacacaagcggcccatgtttttggagtttggagaaaggtggggatgatctcagattctcagagagaagacagactgtgtgaatgacataatggaatcacgaggtggagagatgtgatagtttggaatacattttagataccttttcacgtgaacagcttcaagaaaccagaggttaatcagaaagaagataaggggttgaaaaggtttttgggggagagttcagagtgagtttggctgtatcctcctat

SEQ ID NO: 1834 - DNA, 2699 bp, Brassica napus
agaataaagaaacgatatggagaggcctagagcttctccgtctcccttgactgatttggagccattaagtgaacgcacatcccttgagatcttcaaccccttgagtggtaaagaggcatcttcttcgtcttcttcatcaaagcctcaagatggcaaccgcaaaggaagcagcagtaagtggatagagtttcatgattcagcaaagatagtagagagaactgctgagtggggattatcagccgttaagccggacacaggagaagatggcattagtttcaaggtctccagtgaagtggaccgaagcaagatgtctaggaggtcatccgaagaatcatcagcttctgaatctggagccttccctagagtatcccaggagctcaaaaccgctctttccacgttgcagcagacctttgttgtctctgacgccacacagccagactgtcccatagtctatgccagcagtggattcttcaccatgaccggttactcctccaaagaaatcgttggaagaaactgccggtttctgcaagggcctgatacagacaagaaagaggttgttaagatcagagattgtgtcaagaacggaaaaagttactgtggaaggctcttaaactacaaaaaggatggaacgcccttctggaatcttctcacagtcactcctattaaggacgaccaaggaaacaccataaagttcattgggatgcaggttgaagtaagcaaatacacagaaggcgtaaacgataaagaactgagacctaatggactctccaaatcccttatccgatatgatgctcgccagaaggagttagctttggattccatcacagaggtcgtgcaaacaataaagcatcgcaagtctcaagtgcggaactctgtgagtaatgatattctggtgaaacctgatagtactactacacctggtggacaagttgtacgatcagatgaggcttcaaagtcagctagaacaccgggatgcgtttctactccagcgaggccaaagagcaaatcacttagctggaataaaaagcatgaagatgttcctagtgtggaacctgaagaactaatgttgagcacagaagttgtagagccgagggagagttgggagtgtttagaaagcgaaagggatatacgtcaagggattgatctagctaccactcttgagcgtatagagaagaacttcgtcatcagtgatcctcgtcttcctgataatcccattatatttgcatcagacagctttcttgaattaactgagtatacacgtgaggaaatattgggaagaaactgtcggtttcttcaggggccagagacagaccaagcgactgtccagaagataagagacgcaattagagatcaaagggagataactgtgcagttgataaactacactaagagcggaaagaagttctggaacttattccacttgcaacctatgcgtgatcagaagggagagcttcaatacttcataggtgtgcagcttgatggaagtgatcatgttgagcccctcagaaaccgtttgtctgagagaacagagatgcagagttctaaactggtgaaagctacagcaacaaatgtagatgaagctgtcagagaacttccagatgctaatatgcggccagaagacttgtgggctgcatactcaaagccagtatatcctctgcctcacaaaaaggagagtacatcctggaaggcaatacaaaagatccaagcgagtggagaaacaataggacttcatcatttcaagccaataaaaccgttaggctctggtgatactggcagtgttcatttggttgaactgaaaggcacaggtgagttatacgccatgaaggcaatggagaaaaccatgatgttgaatcgtaacaaggctcaccgagcatgcattgaaagggaaatcatttcccttctggatcatcctttccttcccactctatacacttcctttcagacatctacgcatgtttgtttgatcacagacttctgccctggtggagagttgtttgcactacttgacatccaaccaatgaagtttttgtcagaagaatcagcaaggttctatgcagcagaggtcgttattggcttagaatatcttcactgcttaggaatagtataccgagacctgaagcctgaaaacatactgctcaagaaggatgggcacattgtattagccgactttgatctatctttcttgacgtcctgtgcaccccagcttattgttccacctgcacctaacaaacggaggagatccaagagccaacaattacccacttttgttgcagaaccagccactcagtcaaactcgtttgtagggactgaagaatacattgctcctgagataatcacgggttctggacacgcgagtgctattgattggtgggcactaggtatattgttgtatgagatgctttatggtcgcacacctttcaggggtaagaataggcagaagacgtttgccaacatcttgcacaaggatctcaccttccccagcagtatccctgtaagtcttgtatgtagacagttgattaacatgttgttaaatagagatccaagcagccggttaggatccaaaggtggggctaatgagataaagcagcatgcattcttctgtgggatcaattggcctctcatacggggcacggagcctccaccattggatgcaccgttgcgtataacagagaaagatccgaatgacaaaagatataaag

SEQ ID NO: 1835 - DNA, 3022 bp, Brassica rapa
aggtgtaatagcctcaatccttctgtctaactctttggtaaacttgtctggtgttttaatttgcagccagttcattactctgtttcgccaaaagaaagtgaataaagaaactacatggagaggccaagagcttctccgtctcccttggctgatttggagccattaagtgaacgcacatcccttgagatattcaacccttcaagtggtaaagaggcatcttcttcttcatcatcaaagcctcaagatggcaaccgcaaaggcagcagcagtaagtggatggagtttcatgattcagcaaagatagtagagagaactgctgagtggggattatcatccgttaaaccggacacaggagaagatggtattagtttcaaggtgtccagtgaagtggaacgaagcaagatgtctaggaggtcatctgaagaatcatcagcttctgaatctggagccttccctagagtatctcaggagctcaaaaccgctctctccacgttgcagcagacctttgttgtctctgacgctacacagccagactgtcccatagtctatgccagcagtgggttcttcaccatgactggttattcctccaaagaaatcgttggaagaaactgccgttttctgcaagggcctgacacagacaagaaagaggttgttaaaatcagagattgtgtcaagaatggaaaaagctactgtggaaggctcttaaactacaaaaaggatggaacacccttttggaatctcctcacagtcactcctatcaaggacgaccaaggcaacaccattaagttcattgggatgcaggttgaagtaagcaaatatacagaaggtgtaaacgataaagaactgaggcctaatggactctccaaatccctgatccgatatgatgttcgccagaaggagttagctttggattctattactgaggtcgtgcaaacaataaagcatcgaaagtctcaagtgcggaactctgtgagcaatgatattctggtgaagcctgatagtactactacacctggtggacaagttgtacgatcagatgaggcttcaaaatcagccagaacacctggacgtgttgctactccagcgaggccaaagagcaaatcacttagctggaataaaaggcatgaagatgttcctagtgtggaacctgaagaactaatgttgagcacagaggttgtagagcctagggagagctgggagcgtttagaaagagaaagggatatacgccaagggattgatctagctaccactcttgagcgcatagagaagaacttcgtcatcagtgatcctcgtcttcctgataatcccattatatttgcatcagacagctttcttgaattaactgagtatacacgtgaggaaatattgggaagaaactgtcggtttcttcaggggccagagacagaccaagcgactgtccagaagataagagacgcaattagagaacaaagggagataactgtgcagttgataaactacactaagagcggaaagaagttctggaacttattccacttgcaacctatgcgtgatcagaagggagagcttcaatacttcataggtgtgcagcttgatggaagtgatcatgttgagcccctcagaaaccgtttgtctgagagaacagagatgcagagttctaaactggtgaaagctacagcaacaaatgtagatgaagctgtcagagagcttccagatgctaatatgatccaagcgagtggagaaacaataggacttcatcatttcaagccaataaaaccgctaggctctggtgatactggcagtgtccatttggttgaactgaaaggcacaggtgagttgtatgccatgaaggcaatggagaaaaccatgatgttgaatcgtaacaaggctcaccgagcatgcatcgaaagggaaatcatttctcttttggatcatcctttccttcccactctctacacttcctttcagacatctacgcatgtttgtttgatcacagacttctgccccggtggagagttgtttgcactacttgacatccaaccaatgaagtttttgtcagaagaatcagccaggttctatgcagcagaggtcgttattggcttagaatatcttcactgcttaggaatagtataccgagacctgaagcctgaaaacatactgctcaagaaggatggacacattgtattagccgactttgatctatctttcttgacgtcctgcacaccccagcttattgttccacctgcacctaacaaaagaaggagatccaagagccaaccattacccacttttgttgcagaaccagccactcagtcaaactcatttgtagggactgaagaatacattgctcctgagataatcactggttctggacacacgagtgctattgattggtgggcactaggcatcttgttgtatgagatgctttatgggcgcacacctttcaggggtaagaataggcagaagacatttgccaacatcttgcacaaagatctcaccttccccagcagtatccctgtaagtcttgtatgtagacagttgattaacatgttgttaaatagagatccaagcagccggttaggatccaaaggtggggctaatgagataaagcagcatgcattcttctgtgggatcaattggcctctcatacggggcacggagcctccaccattggatgcgccactgcgtataacagagaaagatccgaatgcaaaagatataaagtgggaagatgatggagtgcttgtgaattcgatggacattgacattgatctattctaaacactcactcttttaccttattctgtctgagtctcattttaatgcaaaactcttctcaataaagaaaaaggtgttgtattccagttgacattgttagaccatttgtaaatgtagcagagattgcaacttttggtgtggattgatgactgaaatagtaggaatggtcacatgttctctgatgaaccaagtgatagtgagttagcctctaaggcctacacaagaagatttttcgaccagttatagtatataaccactagggttt

SEQ ID NO: 1836 - DNA, 1532 bp, Gossypium raimondii
caacaatcttccttcatttcttctccattcctaaaaacctctccacaatgcttttgagaccagtttcatctttgtgtgtgcaagccaagcaaggggataatctaatttgttcccttaagggctcccctgtaacatcatcatcatcatctgctctgagttttcttcccagaaaacatggaagggctttgggtgtttatgcatccataggaaccaacaatcatgcacttacaggggtagtgttccagccttttgaagaggtgaaaaaggaggaacttgatatcccaatcgctcctcatctttcgctggctcgccagaaatatgctgatgcctgtgaagccgccatcaatgagcaaatcaatgtggaatacaacgtttcctatgtgtaccactcgttgtatgcttacttcgacagagacaacgttgcgctcaaaggctttgccaaattcttcaaggaatcaagtgaagaagaaagagagcatgcggagaagctgatggaatatcagaacaaacgaggaggaagagtaaaactacactctattctgatgcccccttcagagtttgatcatgctgagaagggagatgcactatacggtatggaattagcattgtccttggagaagctgacaaacgagaagcttttgtgcctgcacaatgtagcggtgcaaaacaatgatgctcagatggccgatttcatcgaaagcgaatatttagctgagcaggttgaagccattaagaagatatcagaatatgtttctcaattaaggcgggttggaaaaggacatggcgtgtggcacttcgatcaaatgctactccacgaaggggcgtgatgctgcccataatcaccatctaaatgctgcatctttctgttgttttagtgcttcacagatgttctactatatatacatatatgatgagggataggtagtggagaagaataaattgttgtagaatatctatatctatatgtcattgtagtagccccttaacattgccatgtaagagacaataaacagcttggtttttgaaggcgttgagtaaatgtggaagaacaatgtgatttggaaccatttgcatttccccaaagatattgtataatgaatcaaagcattaacatattcacgaaagcatccaagtccaagcattcatttaaaatatagccttgtaagttcactaacattagccaaccgaacaatttaagattgcaagaagaaaatagttctcaaaattttcttcataaccgaaagcaagaaatctagtaactccagaataaactacagcagcaagacatatctagatatcttgtgttaatgttcaagcagcattttgggctgcaagcctcttcctagcttcctcaatgatggacaacttaatacccttgcccttgggaagggatacccatggcttcgttccttttccaattgtgaacacattaccaagacgagttgcaaactcatgcccagcagcatcctgaacgtggattgtctcaaagctacccttgtgcttctccctgttcttaatcactcccacacgac

SEQ ID NO: 1837 - DNA, 1065 bp, Gossypium raimondii
tcttccttcatttcttctccattcctaaaaacctctccacaatgcttttgagaccagtttcatctttgtgtgtgcaagccaagcaaggggataatctaatttgttcccttaagggctcccctgtaacatcatcatcatcatctgctctgagttttcttcccagaaaacatggaagggctttgggtgtttatgcatccataggaaccaacaatcatgcacttacaggggtagtgttccagccttttgaagaggtgaaaaaggaggaacttgatatcccaatcgctcctcatctttcgctggctcgccagaaatatgctgatgcctgtgaagccgccatcaatgagcaaatcaatgtggaatacaacgtttcctatgtgtaccactcgttgtatgcttacttcgacagagacaacgttgcgctcaaaggctttgccaaattcttcaaggaatcaagtgaagaagaaagagagcatgcggagaagctgatggaatatcagaacaaacgaggaggaagagtaaaactacactctattctgatgcccccttcagagtttgatcatgctgagaagggagatgcactatacggtatggaattagcattgtccttggagaagctgacaaacgagaagcttttgtgcctgcacaatgtagcggtgcaaaacaatgatgctcagatggccgatttcatcgaaagcgaatatttagctgagcaggttgaagccattaagaagatatcagaatatgtttctcaattaaggcgggttggaaaaggacatggcgtgtggcacttcgatcaaatgctactcgacgaaggggcgtgatgctgcccataatcaccatctaaatgctgcatctttctgttgttttagtgcttcacagatgttctactatatatacatatatgatgagggacaggtagtggagaagaataaattgttgttgtaaaatatctatatctatatgccattgtagcagccccttaacatttgccatgtaagagacaataaacagcttggtttttgaaggcgttgagtaaatgtggaataacaatgtgatttggaacca

SEQ ID NO: 1838 - DNA, 1226 bp, Theobroma cacao
tcttctgcatttagattgtttcaatttcagttgctgtaatcctctcagaaccaaagcaatgtttttgagatcagtttcatctatctcagtccaaaccaagcatggggataatctaatcagttcccttaggggctcccctgcattatcatcttctagtttcggttctgcctttccttcttcctctgctctgggatttccgcagagaaaacctggaagggcttttggggtttctgcctccttagaaaccaacgatttcgcacttacaggggtagtgtttcagccatttgaagaggtcaagaagaaggaacttgatattccagtcgctcctcaggtttcgcttgctcgccagaaatatacagatgagtgtgaagccgcgatcaatgagcaaatcaatgtggaatacaacgtgtcctatgtgtaccactctttgtatgcctacttcgacagagacaacattgctctcaagggcttagccaaatttttcaaggaatctagtgaagaagaaagagagcatgcggagaagctgatggaatatcagaacatacggggaggaagagtaaaactacactctatcctgatgcccccttcagagtttgaacacgcagagaagggagatgcattatatgctatggaattagcactgtccttggagaagttgacaaacgagaagcttttgagcctgcacaatgtagcagagcgaaaccatgatgctcagatgtcagaattcattgaaagagagtttttatctgagcaggttgaagccattaagaagatatctgaatatgttgctcagttaaggatggttggaaaaggccacggagtgtggcactttgatcaaatgctcctccacgagggtgatgctgcataatgaagatctttcatcctttgcgacttaaattcagtgatgttctactacatgaaccagaattttttggagaagaataaactgttgtgtggaatatttgtttgaagttctaagatatcagtaaccccttagctttgttatgttagagagaaccagagaactttccttttacccccaaaattaagggagctttgtttgtgttcctcaatagctggaggagcaatgtctgtttgatgcatcaatggctcctctcaccagtgtgtctatggattgtgattaggatcattccctagtgaaattgtatcattaaataacagatgtatttgattaagttgcttatgaagcacagtatattctctgc

SEQ ID NO: 1839 - DNA, 1725 bp, Theobroma cacao
acatattatgtttaaatcatactatattcaatagatttattacacgttatgtgcattagagatgttacgtacaagcttaggctagcttctactcgcccaaacattgtacagatacttgattcatgagataaagttgtccgaacaaagagcgagtatagttacatgtaagactcgagcaactgggaaaagtttaggtcacatggggacagctattcgatgacgctcagattgcaatgtggacagaatttgctggctaagattccacaaaagcaagaggattggatagaacacgaggtcgccacacgcctgcctgcgtgtttcaagcaggatcgtccacctaatatgctatcctacggtcgaaaacgaaccccatccgctctggactcttgtaacagtcctacctaccagtgctattctctatatatgccctgacacccagccttcttcagccatcttgtcttcatatcttctgcatttagattgtttcaatttcagttgctgtaatcctctcagaaccaaagcaatgtttttgagatcagtttcatctatctcagtccaaaccaagcatggggataatctaatcagttcccttaggggctcccctgcattatcatcttctagtttcggttctgcctttccttcttcctctgctctgggatttccgcagagaaaacctggaagggcttttggggtttctgcctccttagaaaccaacgatttcgcacttacaggggtagtgtttcagccatttgaagaggtcaagaagaaggaacttgatattccagtcgctcctcaggtttcgcttgctcgccagaaatatacagatgagtgtgaagccgcgatcaatgagcaaatcaatgtggaatacaacgtgtcctatgtgtaccactctttgtatgcctacttcgacagagacaacattgctctcaagggcttagccaaatttttcaaggaatctagtgaagaagaaagagagcatgcggagaagctgatggaatatcagaacatacggggaggaagagtaaaactacactctatcctgatgcccccttcagagtttgaacacgcagagaagggagatgcattatatgctatggaattagcactgtccttggagaagttgacaaacgagaagcttttgagcctgcacaatgtagcagagcgaaaccatgatgctcagatgtcagaattcattgaaagagagtttttatctgagcaggttgaagccattaagaagatatctgaatatgttgctcagttaaggatggttggaaaaggccacggagtgtggcactttgatcaaatgctcctccacgagggtgatgctgcataatgaagatctttcatcctttgcgacttaaattcagtgatgttctactacatgaaccagaattttttggagaagaataaactgttgtgtggaatatttgtttgaagttctaagatatcagtaaccccttagctttgttatgttagagagaaccagagaactttccttttacccccaaaattaagggagctttgtttgtgttcctcaatagctggaggagcaatgtctgtttgatgcatcaatggctcctctcaccagtgtgtctatggattgtgattaggatcattccctagtgaaattgtatcattaaataacagatgtatttgattaagttgcttatgaagcacagtatattctctgctccttctatcatttacatttgattaaggaaagat

SEQ ID NO: 1840 - DNA, 2481 bp, Eutrema parvulum
aacaatggatgatcatgaaactcctcttttgtccaaggtgtcatcatcatcatcatcatcatcaacatcagtggtggcttcttcgttgaaatgggttttgaaagttgtaatgtctgtgattttcgtttcttgggttgttttccttttcatgtaccctggaacattcggcgatgaaattctaaagaattggagaacagtttcttccaacactctctttggcaccacaggaagcatgttcttgattttcagtggtccgattcttgttatctccgtcttagcttcactttatctcatcatttccggagaagagacagtgttcactaagaagaagatatcgaaattcccaaggtttaggctatggacgtttcctgttcttgtggatggaccatttggagttgtttctgcagctgagtttcttggaattatgattttctctgtcttcttcctctgggctatctatgcttatacaatgagggatcttgaccttcttgatctctttcatgtgcttcccaaggatagaagtatgcttctcttggagataacgggtctgcgttttggtatgattggactattgtgtatggtgtttttgtttcttccaatctcgagaggctccattctcctccgtcttatagatatccctttcgagcatgctacaaaatatcatgtttggcttggtcatatcaccatggctttcttctcctttcatggcctctgttatgttgttgcatggaccattcaaggtcgactactagagcttctatttgagtggaaagctattggaatcgctgtattacctggagttatcagtcttgtggctggtttacttatgtgggttacgtcgttacagtacgtgaggaagtattactttgaactcttcttctacacccatcaactgtacattgtctttgttgtcttcttggcactacacgttggtgactacttattcagcatagttgctggaggaattttccttttcattctcgaccgtttcttgaggttctgccaatccagaaggacagtagatataatctctgcaaagagtttaccttgtggaactatcgaactcgtcctatcgaaaccaccaaatatgcgatacaacgcactgagttttgtctttctccaagtgagggaactatcatggctacaatggcatcctttcagtgtttcatcaagtcctctagatggaaagcatcatgttgcggttcttataaaggttcttggtggatggactgcaaagctcagagaccagttgtcaaatctatatgaggcagagaaccaagatcagctcctttctcctcagtcatatcccaaaatcacaacttgtgttgagggtccttatggccatgaatctccataccacttggggtatgagaacctggtcttagtggcaggaggaatcgggatttcgccttttttcgccatcttaagtgatatcttacaccgtaaaagagatggtaaagcttgtctacctaagaaggttttggttatctgggcaattaaaaactcagacgagctttctcttctctcaacgatcgacattccatctatttgcccttctttctctcacaaactaaaccttgagattaacatctatgtcacacgacaatccgagcctctcttggaagacggaatggttcacaagatagtgactccttctgttaagccacggaccaacgggtgtcctatgtcggttctagttggtacaggggacaatatatggtctggactctatctagttgcatccaccattgggtttatttcaatgatcacattgttggacatcttttacataaacaaattcaacataacggcttggtggtacaagggacttctgtttgtggtttgtatggttgcaagtgtgttgatttttggaggtcttgttgttgttttctggcatctttggggtacaaaaactggtgaagtggaagcaaatggccacgacaaggtgaacttgaatggagaagaatctcataatccatcttcggaacttaaaggtcttgacgtagaagaagatattcagagtttcatcactactcgttatggcacgagaccagagtttaaagagatatttgagtcattgaatgggaaatggggaagtgtggacgttggagttatagtatgcggaccgtcgagtcttcagtcgaccgttgccaaagaaatacggtcacatagcatctggcgatccgcgaatcatccgcttttccactttaacagccacagcttcgacctgtaactttactttccagactgaagaaaattgtgtattcaatctgtggaaactcgaagaagaattatgcatatgtaagtaatagcattagtaaggaacacactatggtgaatatgtgtatttgtatctttagattttcatgtataagtaagcaaatgtatgaccttcttctgtggtttatatacttgttggtatctgtttgtactttgtacattgggacattcgtttcatgcaacctgatgagtcttaatatt

SEQ ID NO: 1841 - DNA, 2811 bp, Eutrema parvulum
aaaatcatacaaacatcacattcgtcataataatcatcttatctatatgttcagtagtcactactcatcttgccttaattgtggttgaaatgaaacgtgcctgtctctcccaagtacgttacactcacatgtaaattgccttcttgccctttagtctattttcttttattttttttctaattgtgtactaggattgatgttggaaggaatctttaattaatgcaagtgatgtaaactcgaatggttcacaaaatttcatcatttttgtctcctaattatctatctcctgattttctctaataacgtctctttataatccgatgctgcgtctgtgcccacctctcatcactacactaagaaagctaaaaccaaagtaaaagattcacaagagtcaaaaagagagagagagagtaacaatggatgatcatgaaactcctcttttgtccaaggtgtcatcatcatcatcatcatcatcaacatcagtggtggcttcttcgttgaaatgggttttgaaagttgtaatgtctgtgattttcgtttcttgggttgttttccttttcatgtaccctggaacattcggcgatgaaattctaaagaattggagaacagtttcttccaacactctctttggcaccacaggaagcatgttcttgattttcagtggtccgattcttgttatctccgtcttagcttcactttatctcatcatttccggagaagagacagtgttcactaagaagaagatatcgaaattcccaaggtttaggctatggacgtttcctgttcttgtggatggaccatttggagttgtttctgcagctgagtttcttggaattatgattttctctgtcttcttcctctgggctatctatgcttatacaatgagggatcttgaccttcttgatctctttcatgtgcttcccaaggatagaagtatgcttctcttggagataacgggtctgcgttttggtatgattggactattgtgtatggtgtttttgtttcttccaatctcgagaggctccattctcctccgtcttatagatatccctttcgagcatgctacaaaatatcatgtttggcttggtcatatcaccatggctttcttctcctttcatggcctctgttatgttgttgcatggaccattcaaggtcgactactagagcttctatttgagtggaaagctattggaatcgctgtattacctggagttatcagtcttgtggctggtttacttatgtgggttacgtcgttacagtacgtgaggaagtattactttgaactcttcttctacacccatcaactgtacattgtctttgttgtcttcttggcactacacgttggtgactacttattcagcatagttgctggaggaattttccttttcattctcgaccgtttcttgaggttctgccaatccagaaggacagtagatataatctctgcaaagagtttaccttgtggaactatcgaactcgtcctatcgaaaccaccaaatatgcgatacaacgcactgagttttgtctttctccaagtgagggaactatcatggctacaatggcatcctttcagtgtttcatcaagtcctctagatggaaagcatcatgttgcggttcttataaaggttcttggtggatggactgcaaagctcagagaccagttgtcaaatctatatgaggcagagaaccaagatcagctcctttctcctcagtcatatcccaaaatcacaacttgtgttgagggtccttatggccatgaatctccataccacttggggtatgagaacctggtcttagtggcaggaggaatcgggatttcgccttttttcgccatcttaagtgatatcttacaccgtaaaagagatggtaaagcttgtctacctaagaaggttttggttatctgggcaattaaaaactcagacgagctttctcttctctcaacgatcgacattccatctatttgcccttctttctctcacaaactaaaccttgagattaacatctatgtcacacgacaatccgagcctctcttggaagacggaatggttcacaagatagtgactccttctgttaagccacggaccaacgggtgtcctatgtcggttctagttggtacaggggacaatatatggtctggactctatctagttgcatccaccattgggtttatttcaatgatcacattgttggacatcttttacataaacaaattcaacataacggcttggtggtacaagggacttctgtttgtggtttgtatggttgcaagtgtgttgatttttggaggtcttgttgttgttttctggcatctttggggtacaaaaactggtgaagtggaagcaaatggccacgacaaggtgaacttgaatggagaagaatctcataatccatcttcggaacttaaaggtcttgacgtagaagaagatattcagagtttcatcactactcgttatggcacgagaccagagtttaaagagatatttgagtcattgaatgggaaatggggaagtgtggacgttggagttatagtatgcggaccgtcgagtcttcagtcgaccgttgccaaagaaatacggtcacatagcatctggcgatccgcgaatcatccgcttttccactttaacagccacagcttcgacctgtaactttactttccagactgaagaaaattgtgtattcaatctgtggaaactcgaagaagaattatgcatatgtaagtaatagcattagtaaggaacacactatggtgaatatgtgtatttgtatctttagattttcatgtataagtaagcaaatgtatgaccttcttct

SEQ ID NO: 1842 - DNA, 2854 bp, Eutrema halophilum
tatataatatcaactagtgtaacaccgtgaaattatcatcacactcctcataataatcatcttatctagaactcagagtactcactactcacaatcctttaattgtggttgaaatgaaacgtgtctctctctcccaagtacgttactctcacatgtaaatttgccttcttcccctttactctttttttttatgtattttatttattgttttattttattttaattgtgtacaaggattgatgttggaaggaatctttcattaatgagaatgatgtaacctcgaatggttcagaaaatttttgtctcctaattatctcctcaatttctctaataacgtctccttaaaacccgatgctactacctctaagccacctctcatcactacactgagaaagctaaaaccaaagtagagattcacaaagattttagagtagtaacaatggatgaacatgaaacccctcttttgccaaagccatcatcatcatcatcatcatcatcatcatcatcatcctcgtcgtcaatggtggcttcgtctttgaaatggattcttaaagttgtaatgtctgtgattttcgttgcatgggttgttttccttttgatgtaccctgggaaactcggcgatggatttctgacaaagtggagagaagtctcctccaaaactctctttggaacagcaggaagcatgttcttgattttcagtggtccgattcttgttatctccgtattagcttctctgtatctgatcattgctggggaagagaaagtgttcactaagaagaagatttcaaaattcccaaggtttaggctatggacatttcctgttcttgtggatggaccattcggagttgtttctgcagctgagtttcttggaattatgatcttctctatttttttcctttgggctatctatgcttacactctgaggaatcttaatcttcttgatctctttcatgtgcttccaaaggacagaagtactcttctgttggagataacaggtctacgtttcgggatgattgggttattgtgtatggtatttttgtttcttcccatctcgagaggctccattctcctccgtcttatcgatatacctttcgagcatgctacaaaatatcatgtttggcttggtcatataacaatggctttcttctccttacatggcctctgttatgttgttggatggatgatgcgaggtcaacttctagagatgatatttgagtggaaagctattggaattgctgtgtttcctggagttataagtcttgtggctggtttacttatgtgggtcacgtcgcttcactacgtcagaaagtattactttgagctcttcttctacacccatcaactatacattgtatttgtagtcttcttggcacttcacgttggtgacttcatattcagcatagttgctggaggaatattccttttcattcttgaccgtttcttgagattctgccaatcaagaaggaccgtggatgttatctctgcaaagagtttaccttgtggaactcttgaactcgttctttcgaaaccaccgaatatgcggtacaatgcactgagttttgtctttcttcaagtgagggaactatcatggctacaatggcatcctttcagtgtttcatcaagtcctctagatgggaaccatcatgttgcggtcctcattaaggttcttggttgctggactgcaaagcttagggaccgtttgtcaaagctatatgaggcagagaaccaagatcagctcctttctcctcagtcatatcccaaaatcacaacttgtgtggaaggtccttatggccatgaatctccataccacttgacgtacgagaatctggtcttagtagccggaggaatcgggatttcaccctttttcgccatcttaagtgatatccttcaccgtaaaagagatgggaaagcttgtttaccaaagaaggttttagttatctgggcaataaaaaactcagacgagctctctctgctctcagcaatcgacataccttccatttgtccttccttctctcacaaactaaaacttgagattaacatctatgtcacacgacaatctgagcctctcttggaagatgggttggttcacaagatagtgaatccttctgtgaagccacggaccaacgggtgtcccatgtcagttttagttggtacaggggataatatatggtctggactctatctcattgcatccaccattggatttatttcaatgatcacattgttggacatcttttacataaacaaatataacataacgacatggtggtacaagggacttttgtttgtggtttgtatggttgcaagtgtgttgatttttggaggttctgtagttgttttctggcatctttggggtcataaaaccagtgaagtagaagcaagtggccacaaaaaggtaggttcaaaccaagaagaacctcaaaatgcatctgcggaacttaaaagccttgacacagaagacgacatccagagtttcatcactactcgttatggcacgagaccagactttaaagagacatttgagtctttgaatgtgaaatggggaaacgtggatgttggagttatagtatgcggaccggcgagtcttcagtcaactgttgccaaagaaatacggtcacatagcatctggcgatccgctaatcatccccttttccacttcaatagccacagtttcgatctataacttcaaggccgaagaaaatgtatgaaaattcgaagaaaaatatatgcatatacgaatataccatacttaaagcagtctgtatgtataatgaagcagatgtggtgaatgtgtgtaagtatttcaattttcatgtataagaaatcaaatgtgtgagattcttgtatgatttct

SEQ ID NO: 1843 - DNA, 2591 bp, Eutrema halophilum
atgtaacctcgaatggttcagaaaatttttgtctcctaattatctcctcaatttctctaataacgtctccttaaaacccgatgctactacctctaagccacctctcatcactacactgagaaagctaaaaccaaagtagagattcacaaagattttagagtagtaacaatggatgaacatgaaacccctcttttgccaaagccatcatcatcatcatcatcatcatcatcatcatcatcctcgtcgtcaatggtggcttcgtctttgaaatggattcttaaagttgtaatgtctgtgattttcgttgcatgggttgttttccttttgatgtaccctgggaaactcggcgatggatttctgacaaagtggagagaagtctcctccaaaactctctttggaacagcaggaagcatgttcttgattttcagtggtccgattcttgttatctccgtattagcttctctgtatctgatcattgctggggaagagaaagtgttcactaagaagaagatttcaaaattcccaaggtttaggctatggacatttcctgttcttgtggatggaccattcggagttgtttctgcagctgagtttcttggaattatgatcttctctatttttttcctttgggctatctatgcttacactctgaggaatcttaatcttcttgatctctttcatgtgcttccaaaggacagaagtactcttctgttggagataacaggtctacgtttcgggatgattgggttattgtgtatggtatttttgtttcttcccatctcgagaggctccattctcctccgtcttatcgatatacctttcgagcatgctacaaaatatcatgtttggcttggtcatataacaatggctttcttctccttacatggcctctgttatgttgttggatggatgatgcgaggtcaacttctagagatgatatttgagtggaaagctattggaattgctgtgtttcctggagttataagtcttgtggctggtttacttatgtgggtcacgtcgcttcactacgtcagaaagtattactttgagctcttcttctacacccatcaactatacattgtatttgtagtcttcttggcacttcacgttggtgacttcatattcagcatagttgctggaggaatattccttttcattcttgaccgtttcttgagattctgccaatcaagaaggaccgtggatgttatctctgcaaagagtttaccttgtggaactcttgaactcgttctttcgaaaccaccgaatatgcggtacaatgcactgagttttgtctttcttcaagtgagggaactatcatggctacaatggcatcctttcagtgtttcatcaagtcctctagatgggaaccatcatgttgcggtcctcattaaggttcttggttgctggactgcaaagcttagggaccgtttgtcaaagctatatgaggcagagaaccaagatcagctcctttctcctcagtcatatcccaaaatcacaacttgtgtggaaggtccttatggccatgaatctccataccacttgacgtacgagaatctggtcttagtagccggaggaatcgggatttcaccctttttcgccatcttaagtgatatccttcaccgtaaaagagatgggaaagcttgtttaccaaagaaggttttagttatctgggcaataaaaaactcagacgagctctctctgctctcagcaatcgacataccttccatttgtccttccttctctcacaaactaaaacttgagattaacatctatgtcacacgacaatctgagcctctcttggaagatgggttggttcacaagatagtgaatccttctgtgaagccacggaccaacgggtgtcccatgtcagttttagttggtacaggggataatatatggtctggactctatctcattgcatccaccattggatttatttcaatgatcacattgttggacatcttttacataaacaaatataacataacgacatggtggtacaagggacttttgtttgtggtttgtatggttgcaagtgtgttgatttttggaggttctgtagttgttttctggcatctttggggtcataaaaccagtgaagtagaagcaagtggccacaaaaaggtaggttcaaaccaagaagaacctcaaaatgcatctgcggaacttaaaagccttgacacagaagacgacatccagagtttcatcactactcgttatggcacgagaccagactttaaagagacatttgagtctttgaatgtgaaatggggaaacgtggatgttggagttatagtatgcggaccggcgagtcttcagtcaactgttgccaaagaaatacggtcacatagcatctggcgatccgctaatcatccccttttccacttcaatagccacagtttcgatctataacttcaaggccgaagaaaatgtatgaaaattcgaagaaaaatatatgcatatacgaatataccatacttaaagcagtctgtatgtataatgaagcagatgtggtgaatgtgtgtaagtatttcaattttcatgtataagaaatcaaatgtgtgagattcttgtatgatttctgtactttt

SEQ ID NO: 1844 - DNA, 2553 bp, Arabidopsis thaliana
cttaatttatctctagctagtaacgcctccttaaaagccgatgctgcttctgagccagctctcatcacaacactaagcagtagaagaaattcaaaaaacaacatggatgatcatgaaacccctcttttgtccaaggacttatcatcatcatcatcatcatcatcatcatcatcatctgtggtggtttcatctttgaaatggatattgaaagttgtaatgtctgtgatttttgtgacttgggttgtgttccttatgatgtatcctggatcactcggtgatcaaatcctcacaaactggagagcaatctcctccaacactctctttggcctcacaggaagcatgttcttaattttcagtggtccgattcttgtcatcgccatcttggcttctctctatctgataatctcaggggaagagacggttttcactaagaagaagataacgaaattcccgaggtttaggctatggacatttcctgttcttgtggatggaccatttggagttgtttctgcagctgagtttcttggaattatggtcttctctgtttttttcctttgggctatctatgcttataccttgaggaatctcaacgttcttgactacttccacgtgcttcccaataacagaagtatttttctgttggagttaacgggtctgcgttttgggatgattggattgttgtgtatggtgtttttgtttcttccaatctcgagaggctctattcttctccggcttattgatatccctttcgagcatgctacaagataccatgtttggcttggtcatatcaccatgactttcttctctttacatggcctctgttatgttgttggatggaccattcaaggtcaacttttagagcttttatttgaatggaaagctactggaatcgctgttttacccggagttatcagtctagtggctggtttactcatgtgggtcacatcgcttcacaccgtgagaaagaattactttgagctcttcttctacacacatcaactatacattgtctttgtcgtcttcttggcacttcatgttggtgactacttattcagtatagttgctggaggaatctttctcttcattctagaccgcttcttgaggttctaccaatcaagaaggactgttgatgttatctctgcaaagagtttaccttgtggaactcttgaacttgtcctttcaaaaccaccaaatatgcgatacaacgcgcttagctttatctttcttcaagtgaaggaactgtcttggttacagtggcatcctttcagtgtttcatcaagtcctctagatgggaaccatcatgttgcggttcttataaaagttcttggtggatggactgcaaagcttagggatcaattgtcaactctatatgaggcagaaaatcaagaccagcttatttctcctgagtcatatcccaaaatcacaacttgtgtggagggaccttatggccatgaatctccataccacttagcgtatgagaacctggtattagtagcaggaggaatcgggattacgcctttttttgccatcttaagcgatatcctacaccgtaaaagagatgggaaagattgtttacctggtaaggttttagttgtatgggccattaaaaactcagacgagctctctctgctctcagcaattgacataccttccatttgccatttcttctctaagaaactaaaccttgagattcacatatatgtcactcgacaatccgagccttgcttggaagatgggatggttcacaaggtggtgcatccttctgtcaaaacaccatggaccaacggatgttccatgtcggttttagttggtacaggggataacatatggtctggactctatctaattatctccaccattgggtttattgcaatgatcacattggtggacatcttttacataaacaagtacaacataacaacatggtggtacaagggacttctgtttgttgtttgtatggttgcaagtgtgttgatttttggaggtcttgtggttgttttctggcatcgctgggaacacaaaaccggtgaagtggaagcaaatggcaacgacaaggtagatttgaatggagaagaaacccataatccatctgcagcagagcttaagggcttggcaatagaagaagatgtccagaattacaccactattcgttatggcaccagaccggcctttagagagatatttgagtcattgaatgggaaatgggggagtgtggatgttggagtgatagtatgcggtccagcgactcttcagacgaccgtagccaaagaaatacggtcacatagcatctggcgatcggcgaatcatcctcttttccacttcaacagccacagtttcgatctctaacgatgctctcaaggccaaagaacattatggaaattcgaagatatattatcgatgcatataatttatataatcacagtctgtatgtattatggaaacaactttaactaatttttgagattgatgctacttcatgatagcaatttcttagttcttttgagttaataacttaatatataaatataatggtacaacaaccattacaatcgt

SEQ ID NO: 1845 - DNA, 4864 bp, Arabidopsis thaliana
aaaccccactggtccagaaattttcttccttttactctcctcctaagaatatcttcttcttaatttatctctagctagtaacgcctccttaaaagccgatgctgcttctgagccagctctcatcacaacactaagcagtagaagaaattcaaaaaacaacatggatgatcatgaaacccctcttttgtccaaggacttatcatcatcatcatcatcatcatcatcatcatcatctgtggtggtttcatctttgaaatggatattgaaagttgtaatgtctgtgatttttgtgacttgggttgtgttccttatgatgtatcctggatcactcggtgatcaaatcctcacaaactggagagcaatctcctccaacactctctttggcctcacaggaagcatgttcttaattttcagtggtccgattcttgtcatcgccatcttggcttctctctatctgataatctcaggggaagagacggttttcactaagaagaagataacgaaattcccgaggtttaggctatggacatttcctgttcttgtggatggaccatttggagttgtttctgcagctgagtttcttggaattatggtcttctctgtttttttcctttgggctatctatgcttataccttgaggaatctcaacgttcttgactacttccacgtgcttcccaataacagaagtatttttctgttggagttaacgggtctgcgttttgggatgattggattgttgtgtatggtgtttttgtttcttccaatctcgagaggctctattcttctccggcttattgatatccctttcgagcatgctacaagataccatgtttggcttggtcatatcaccatgactttcttctctttacatggcctctgttatgttgttggatggaccattcaaggtcaacttttagagcttttatttgaatggaaagctactggaatcgctgttttacccggagttatcagtctagtggctggtttactcatgtgggtcacatcgcttcacaccgtgagaaagaattactttgagctcttcttctacacacatcaactatacattgtctttgtcgtcttcttggcacttcatgttggtgactacttattcagtatagttgctggaggaatctttctcttcattctagaccgcttcttgaggttctaccaatcaagaaggactgttgatgttatctctgcaaagagtttaccttgtggaactcttgaacttgtcctttcaaaaccaccaaatatgcgatacaacgcgcttagctttatctttcttcaagtgaaggaactgtcttggttacagtggcatcctttcagtgtttcatcaagtcctctagatgggaaccatcatgttgcggttcttataaaagttcttggtggatggactgcaaagcttagggatcaattgtcaactctatatgaggcagaaaatcaagaccagcttatttctcctgagtcatatcccaaaatcacaacttgtgtggagggaccttatggccatgaatctccataccacttagcgtatgagaacctggtattagtagcaggaggaatcgggattacgcctttttttgccatcttaagcgatatcctacaccgtaaaagagatgggaaagattgtttacctggtaaggttttagttgtatgggccattaaaaactcagacgagctctctctgctctcagcaattgacataccttccatttgccatttcttctctaagaaactaaaccttgagattcacatatatgtcactcgacaatccgagccttgcttggaagatgggatggttcacaaggtggtgcatccttctgtcaaaacaccatggaccaacggatgttccatgtcggttttagttggtacaggggataacatatggtctggactctatctaattatctccaccattgggtttattgcaatgatcacattggtggacatcttttacataaacaagtacaacataacaacatggtggtacaagggacttctgtttgttgtttgtatggttgcaagtgtgttgatttttggaggtcttgtggttgttttctggcatcgctgggaacacaaaaccggtgaagtggaagcaaatggcaacgacaaggtagatttgaatggagaagaaacccataatccatctgcagcagagcttaagggcttggcaatagaagaagatgtccagaattacaccactattcgttatggcaccagaccggcctttagagagatatttgagtcattgaatgggaaatgggggagtgtggatgttggagtgatagtatgcggtccagcgactcttcagacgaccgtagccaaagaaatacggtcacatagcatctggcgatcggcgaatcatcctcttttccacttcaacagccacagtttcgatctctaacgatgctctcaaggccaaagaacattatggaaattcgaagatatattatcgatgcatataatttatataatcacagtctgtatgtattatggaaacaactttaactaatttttgagattgatgctacttcatgatagcaatttcttagttcttttgagttaataacttaatatataaatataatggtacaacaaccattacaatcgtcattataatcatcttatccatactcaatagtcaatactctcaccttccctaaagtgtggttgaaatcaaactttactctctctaggcctgattataattcttttttgtctacacatacaacttcatgagacttaattataatttcttagtgttcttttgttgacatgtaaatcgtagctaagtctaagtggtacttttatttgttattggattttgtttcggttacttaaaagtgtaatgaagaatttttttgactatatacatctaagtttttccttggactgattataacttgtgtgttcgagattgatacaacttcatgatagtcgattattcttgtttaacgtaacacattgttagatagtgtcatttaccagaaacaatctaacagtgaaactttgcaaatttatctctctgctggatcttgaacgcggaaaccgaataatgtttctttcgagctaatccgaatgatgttgaaattctatatgttcagattcaggtaatgtaagcttatccaataaccatcatagtcgtcataataaccatcttatctatactaaagtagtaagtactctcagtctctcaccttacccttaattgtggttgaaatcaacctaacgtgacactctctcccaagtacgttactctcacgtgttaatgacactctcatttttttttatagttttttttattgtgtactaggattgttgtccgaaggaatctttcataaatgagaatgatagaaacctcaatggtccagaaaattttacttgactcttctaagaatatcttattagtttatctctagtaacgccaccttaaaagccgatgctgcttctgagccaacttctcatcacaacactgagaagtggaaattcaaataaagatggatgattatgaaacccctcttttgtccaaggactcatcatcatcatcatctgtgattacttcatctttgaaatggatattgaaagttgtaatgtctatgatttttgtgacttgggttgtttttcttatgatgatgtaccctgaacaactcggtgatgatttcctcacatttgtctcctccaagactttcctaggcaccacaggttacattaacgagcagatgctttgctttctacggaaacatgtccaaaaagtgtaactaatttcatcctttaattgtctaaatttgcaggaaccatgttcttgattttcagttgtccgattcttgtcatctctgtcttagcttctctctatctcattatctccggggaagacaaggtcttcactaagaagaagatatcgaaattcccgaggtttaggctatggacattccctgttcttgtggatggaccatttggagttgtttctgcagctgagtttcttggaattatggtcttctctgtttttttcctttggtctatctatgcttataccttgaggaatcttgaccttcttgaacgcttccacgtccttcccaagaatcgaaggttcttaaaactcttcctttttttttcccatctttgtctttttccttctcattccaatcattagttttgtgtgtgtgtattttcagtattcttctgttggaggtaacgggtctgcgtttaggaatgattggattgttgtgtatggtttttttgtttcttccaatctcgagaggttccattcttctccgtcttatcgatatcccttttgaacatgctacaagatatcatgtttggcttggtcatatcaccatggctttcttctccttacatggcctctgttatgttgttggatggatcattcaaggtcaacttttagagcttatattttcatggaatgctatcggaattgctatcttacccggagttatcagtctagtggcgggtttactgatgtgggtcacatcgcttcacaccgtgagaaagaattactttgagctcttcttctacacacatcaactatacatcgtctttattgtgttcttggcacttcatgttggtgattacatgtttagtatagttgctggaggaatatttcttttcattctagaccgcttcttgaggttctgccaatcaagaaggactgttgatgtaatctctgcaaagagtttaccttgtggaactcttgaactagtcctttcaaaaccaccaagtaacaactctgtttattctctgttttctacctctaatctaaaacatttactgacttttttcttcttcaataccgcaaaaatcagatatgcgatacaatgcgcttagctttatctttcttcaagtgagg

SEQ ID NO: 1846 - DNA, 1951 bp, Brassica juncea
caaacatatcttttctcaaacacacaaacataccttctctcgaacaccaacatttctatcctctctctctctcctcattttctatcaaagagagagtaagaaaactatggaattaacactgaattcctcgagttctctaatcaaacgtaaagatgccaaaagctcaagaacccaagaaaattcctcaaacatgtcctttgccaaaacgaagccaccaacttatcagttccaagcaaagagctctgtcaaggaaatgaagttcactcatgagaagacctacaagccagaaagtgaaaccactgagaggtgggagaagctccacgttctctcctacccacatcccaagagcgactccagcgtaccggttttcgtcatgttgccactggacacggtaacaatgtcagggcatttgaacaaaccaagagccatgaacgctagtttgatggctctgaaaggagccggtgtggaaggtgtaatggttgatgcttggtggggattggttgagaaagatggacctatgaagtataactgggaaggctatgctgagcttatacagatggttcagaagcacggtctcaaactccaagttgttatgtctttccatcaatgcggaggaaacgttggagactcttgcagtattcctttgcccccatgggtgcttgaagagatcagcaagaaccctgatcttgtctacacagacaaatctgggagaaggaatcctgagtacatctccttgggatgtgactctgtgcctgtcctaagaggaagaacacctatccaggtctattcagatttcatgaggagcttccgtgaaagattcgataattacataggaggagttattgcggaaattcaagtgggaatgggaccttgtggagaactgagatacccatcataccctgagagcaatgggacatggaggttcccaggaattggagagttccagtgctatgacaagtatatgaaatcgtcgcttcaagcatatgctgaatcaatagggaaaacaaactggggaacaagtggacctcatgacgccggagagtacaagaacctcccagaagacacagagtttttcaggagagacggcacatggaacagcgagtacggaaagttcttcatggaatggtactccgggaagctactagagcacggagaccagctcctgtcttcagccaaagcaatctttcaaggttccggagctaagctatcaggaaaagtagcagggatccactggcactacaacacaaggtcacacgccgccgagctaaccgcaggttactacaacacaagaaaccacgacgggtatctcccaatagccaagatgttcaacaaacacggcgtcgtgctaaacttcacctgcatggagatgaaagacggcgaacagcccgagcacgcaaactgctctccagaaggtctagtcaagcaagtgcagaacgcgacgaggcaggctggaaccgagctagcgggagagaacgcgttggagagatacgactcgagcgcgttcgggcaagtggttgcgacgaacaggtcggattctgggaacgggttgacggcgttcacgtacctgaggatgaacaagaggctgttcgagggtcagaactggcagcagctggtggagtttgtgaagaacatgaaggaaggtggacatgggaggagactctctgaggaagacacaacagggagtgacctttatgttggtggatttgtgggaagcaagatctctcagacggttgaggaagccgttctagtgtaaagttcccactccacatagggtacatatagtgtggtatataataataaacaatagagatgacagagagaacaaaccagagttattagtgttaaaagctttagaatgtttgcacgattctggatcgatgatgtacacttatatgactgtgtatgctatgaacttttcatcttccaagtctcatctcaaataatatgcatt

SEQ ID NO: 1847 - DNA, 2415 bp, Brassica rapa
tttgtccctaaatcacagccaatcaattttctttataaatacaaacacacaaacatatcttctctcaaacacacaaacataccttctctcgaacaccaacatttctatcctctctctctctcctcattttctatcaaagagagagtaagaaaactatggaattaacactgaattcctcgagttctctaatcaaacgtaaagatgccaaaagctcaagaacccaagaaaattcctcaaacatgtcctttgccaaaacgaagccaccaacttatcagttccaggcaaagagctctgtcaaggaaatgaagttcactcatgagaagacctacaagccagaaagtgaaaccactgagaggtgggagaagctccacgttctctcctacccacaccccaagaacgactccagcgttccggttttcgtcatgctaccgctggacacggtgacaatgtcagggcacttgaacaaacaaagagccatgaacgctagtttgatggctctgaaaggagccggtgtggaaggtgtaatggttgatgcttggtggggattggttgagaaagatggacctatgaagtataactgggaaggctatgctgagcttatacagatggttcagaagcacggtctcaaactccaggttgttatgtctttccatcaatgtggaggaaacgttggagactcttgcagtattcccttgcctccatgggtgcttgaagagatcagcaaaaaccctgatcttgtctacacagacaagtcagggagaaggaatcctgagtacatctccttagggtgtgactctgtgcctgtcctaaggggaagaacacctatccaggtctactcagatttcatgaggagcttccgtgaaagattcgataattacataggaggagttattgcggaaattcaagtgggaatgggaccttgtggagaactgagatacccatcataccctgagagcaatgggacatggaggttcccaggaattggagagttccagtgctatgacaagtatatgaaatcgtcgcttcaagcatatgctgaatcaatagggaaaacaaactggggaacaagtggacctcacgacgccggagaatacaagaacctcccagaagacacagagtttttcaggagagacggaacatggaacagcgaatacggaaagttcttcatggaatggtactccgggaagctactagagcacggagaccagctcctgtcttcagccaaagcaatctttcaaggctccggagctaagctatcaggaaaagtagcagggatccactggcactacaacacaaggtcacacgcagccgagctaaccgcaggttactacaacacaagaaaccacgacgggtatctcccaatagccaagatgttcaacaaacacggcgtcgtgctaaacttcacctgcatggagatgaaagacggcgaacagcccgagcacgcaaactgctctccagaaggtctggtcaagcaagtgcagaacgcgacgaggcaggctggaaccgagctagcgggagagaacgcgttggagagatacgactccagcgcgttcgggcaagtggttgcaacgaacaggtctgattcggggaacgggttgaccgcgtttacgtacctgaggatgaacaagaggctgttcgagggtcagaactggcagcagctggtggagtttgtgaagaacatgaaggaaggtggacatgggaggagactctctgaggaagacacaacagggagtgacctttatgttggtggatttgtgggaagcaagatctctcagacggttgaggaagccgttctagtgtaaagttcccactccacataggtacatatagtgtgtgtggtatatatatatatatataataataataaacaatagagatgactgagagagagagcaaaccagagtagtagtgttaaaaaaagctttagaatgttgcacaattctggatctgggcaaagagaagatgatgtacactttatatgactctgtaatatgcttatgaacttttcatcttcaaactctcatctcaaataatatgcatttttgttttgttacaatcttatcaatatgcatttcttgtgtagacaatgaatactttgataacacatacaataattgctcagaacatgaaagaaactatcatcaaatcaacattctggaaaacgtaaatggagcaatcgaaatcaaaactaagagattctttcttctaatggaagtgtctggtggaattgtgagcagttaactcacgagttgggaggggaagaagaatcgggacctccgcgacggagttcttcgatcaaaccgccgagctcttttctcgccgattctctaccgaacatgaatccatacctatgcgagttaacaaaagacagtatggacactaaatagacggaatggaaaagacgagagctagaga

SEQ ID NO: 1848 - DNA, 1946 bp, Brassica oleracea
gcgtccgctctcaaacccaacatttctatcctctctctctcctcattttctatcaaagagagagtaagaaaactatggaattaacactgaattcctcgagttctctaatcaaacgtaaagatgccaaaagctcaagaatccaagaaaattcctcaaacatgtcctttgccaaaacgaagccaccaacttatcagttccaggcaaagagctctgtcaaggaaatgaagttcactcatgagaagacctacaagccagaaagtgaaaccacagagaggtgggagaagctccacgttctctcatacccacaccccaagaacgactctagcgttcctgttttcgttatgttgccactagacacggtaacaatgtcagggcacttgaacaaaccaagagccatgaacgctagtttgatggctctaaaaggagccggtgtggaaggtgtaatggttgatgcttggtggggattggttgagaaagatggacctatgaagtataactgggaaggctatgctgagcttatacagatggttcagaagcacggtctcaaactccaggttgttatgtctttccatcaatgtggaggaaacgttggagactcttgcagtattcccttgcctccatgggtgcttgaagagatcagcaagaaccctgatcttgtctacacagacaaatctgggagaaggaatcctgagtacatctccttgggatgtgactctgtgcctgtcctaagaggaaggacacctatccaggtctactcagatttcatgaggagcttccgtgaaagattcgataattacataggaggagttattgcggaaattcaagtgggaatgggaccttgtggagaactgagatacccatcataccctgagagcaatgggacatggaggttcccaggaattggagagttccagtgctatgacaagtatatgaaatcgtcgcttcaggcatatgctgaattaatagggaaaacaaactggggaacaagtggacctcacgacgccggagagtacaagaacctcccagaagacactgagtttttcaggagagacggaacatggaacagcgagtacggaaagttcttcatggaatggtactccgggaagctactagagcacggagacaagctcctgtcttcagccaaagcaatctttcaaggctccggagctaagctatcaggaaaagtagcagggatccactggcactacaacacaaggtcacacgccgccgagctaaccgcaggttactacaacacaagaaaccacgacgggtatctcccaatagccaagatgttcaacaaacacggcgtcgtgctaaacttcacctgcatggagatgaaagacggcgaacagcccgagcacgcgaactgctctcctgaaggtctggtcaagcaagtgcagaacgcaacgaggcaggctggaaccgagctagcgggggagaacgcgttggagagatacgactcgagcgcgttcggacaagtggttgcaacgaacaggtcggactcggggaacgggttgacagcgtttacttacctgaggatgaacaagaggctgttcgagggtcagaactggcagcagctggtggagtttgtgaagaacatgaaggaaggtggacatgggaggagactctctgaggaagacacaacggggagtgatctttatgttggatttgtgggaagcaagatctctgagacggttgaggaagctgctctagtgtagatttccactccacataggtacatatagtgtgtgtggtatataattataataaacaatagagatgacaaagagagcaaaccagagtattaatgttaaaaaagctttagaaagttgcacaattctggatctgggcaaagagaagatgatgtacactttctatgactgtgtaatatgcttatgaacttttcatcttcaaactctaatctcaaataatatgcattttttttt

SEQ ID NO: 1849 - DNA, 2048 bp, Eutrema parvulum
tttgtccctaaatcctagccaatcaatttactttataaatgtcaacacaaatagcaccttctctctcaaacacaaacacctcttctacctctctcatcgttttctcaacagagcaaagagagagagaaagctatggagttaacactaaattcctcgagttctcttatcaaacgtaaagataccaaaagttcaagaaaccaagagagttcctcaaacatgtcttttgccaaattgaagccaccaacatatcaattccaagcgaagaactcggttaaggaaatgaagttcactcatgagaagaccttcacgccagaaggtgaaaccactgagagatgggagaagctccacgttctctcatacccacacccaaagagcgacgctagcgttccagtgtttgtcatgttaccactagacacggtaacaatgtcagggcatttgaacaaaccaagagccatgaacgctagtttaatggctctgaaaggagctggtgtggaaggtgtaatggtagatgcttggtggggattggtggagaaagatggacccatgaagtataattgggaaggctatgccgagcttatacagatggtccaaaagcatggtctcaaactccaggtcgttatgtctttccatcaatgcggaggaaacgttggagactcttgcagtattcctttgcccccatgggtgcttgaagaaatcagcaagaaccctgatcttgtctacacagacaaatctgggagaaggaatcctgagtatatctccttgggatgtgattctgtgcctgtcctaagaggaagaacacctatccaggtctactcagattttatgaggagcttccgcgaaagattcgacagttgcataggaggagttattgcggaaattcaagtgggaatgggaccttgtggagaattgagatatccatcataccctgagagcaacgggacatggagattccccggaattggagagttccagtgctatgacaagtatatgagatcatcgcttcaagcatatgctgaatcaatcgggaaaactaactggggaacaagtggaccgcatgacgccggcgagtacaagaacctcccagaagatactgagtttttcaggagagatggaacatggaacagcgagtatggaaagtttttcatggaatggtattccgggaagctactagaacacggagataaacttctatcttcagccaaaggaatcttccaaggaaccggagcaaagctatcaggaaaggtagccggaattcactggcactacaacaccaggtcacacgctgctgagctaaccgctggatattacaacacgaggaaccatgatgggtatctgccaatagctaagatgttcaataaacatggtgttgtgctcaacttcacctgcatggagatgaaagacggggaacaacctgagcacgcaaactgctcacccgaaggtctagttaagcaagtgcagaacgcgacaaggcaggctggaaccgagctagcaggggagaatgcgctagaaagatatgactcaagcgcattcggacaagtggtagcaacaaataggtcagattccggaaacgggttaaccgcatttacttacctaagaatgaacaagaggttatttgagggtcaaaattggcagcagttagtggagtttgttaagaacatgaaggaaggtggtcatggcaggaaactctcagaagaagacacaaccggaagtgacctttatgtgggatttgtcagaagcaggatctctgagaaggttgaagaggcttcgctagtgtaatttcccccacataggtacatatagtgtggtttaattttcttgctgtatgataaaaataaacacagagatgagagagcaaacaaaccagtatagtgttaaagctttagaatgtacacaattctgggtcagagcaaaaaaaacaagatgtgtatcctgtggaattttccttgtacatcttcaaactcaaatctcaaataatatgcatttttttttctcttacaatcttatctcaatcaatcaataagcatttctcgtttatacaacagttgaat

SEQ ID NO: 1850 - DNA, 2058 bp, Eutrema parvulum
tttgtccctaaatcctagccaatcaatttactttataaatgtcaacacaaatagcaccttctctctcaaacacaaacacctcttctacctctctcatcgttttctcaacagagcaaagagagagagaaagctatggagttaacactaaattcctcgagttctcttatcaaacgtaaagataccaaaagttcaagaaaccaagagagttcctcaaacatgtcttttgccaaattgaagccaccaacatatcaattccaagcgaagaactcggttaaggaaatgaagttcactcatgagaagaccttcacgccagaaggtgaaaccactgagagatgggagaagctccacgttctctcatacccacacccaaagagcgacgctagcgttccagtgtttgtcatgttaccactagacacggtaacaatgtcagggcatttgaacaaaccaagagccatgaacgctagtttaatggctctgaaaggagctggtgtggaaggtgtaatggtagatgcttggtggggattggtggagaaagatggacccatgaagtataattgggaaggctatgccgagcttatacagatggtccaaaagcatggtctcaaactccaggtcgttatgtctttccatcaatgcggaggaaacgttggagactcttgcagtattcctttgcccccatgggtgcttgaagaaatcagcaagaaccctgatcttgtctacacagacaaatctgggagaaggaatcctgagtatatctccttgggatgtgattctgtgcctgtcctaagaggaagaacacctatccaggtctactcagattttatgaggagcttccgcgaaagattcgacagttgcataggaggagttattgcggaaattcaagtgggaatgggaccttgtggagaattgagatatccatcataccctgagagcaacgggacatggagattccccggaattggagagttccagtgctatgacaagtatatgagatcatcgcttcaagcatatgctgaatcaatcgggaaaactaactggggaacaagtggaccgcatgacgccggcgagtacaagaacctcccagaagatactgagtttttcaggagagatggaacatggaacagcgagtatggaaagtttttcatggaatggtattccgggaagctactagaacacggagataaacttctatcttcagccaaaggaatcttccaaggaaccggagcaaagctatcaggaaaggtagccggaattcactggcactacaacaccaggtcacacgctgctgagctaaccgctggatattacaacacgaggaaccatgatgggtatctgccaatagctaagatgttcaataaacatggtgttgtgctcaacttcacctgcatggagatgaaagacggggaacaacctgagcacgcaaactgctcacccgaaggtctagttaagcaagtgcagaacgcgacaaggcaggctggaaccgagctagcaggggagaatgcgctagaaagatatgactcaagcgcattcggacaagtggtagcaacaaataggtcagattccggaaacgggttaaccgcatttacttacctaagaatgaacaagaggttatttgagggtcaaaattggcagcagttagtggagtttgttaagaacatgaaggaaggtggtcatggcaggaaactctcagaagaagacacaaccggaagtgacctttatgtgggatttgtcagaagcaggatctctgagaaggttgaagaggcttcgctagtgtaatttcccccacataggtacatatagtgtggtttaattttcttgctgtatgataaaaataaacacagagatgagagagcaaacaaaccagtatagtgttaaagctttagaatgtacacaattctgggtcagagcaaaaaaaacaagatgtgtatcctgtggaattttccttgtacatcttcaaactcaaatctcaaataatatgcatttttttttctcttacaatcttatctcaatcaatcaataagcatttctcgtttatacaacagttgaattgtctggtaa

SEQ ID NO: 1851 - DNA, 2040 bp, Arabidopsis thaliana
ctctcaaacacaaacatatcttctatcaaacaccaacagctctattctctacctcatttctcatcataacaaagagagagaaaaaaactatggaattgacactgaattcctcgagttctcttatcaaacgtaaagatgccaagagttctagaaaccaagaaagttcctccaacaacatgacctttgcgaagatgaagccgccaacatatcaattccaagcaaagaactcggttaaggaaatgaagttcactcacgagaagaccttcacgccagaaggtgaaacccttgagaaatgggagaagctccacgttctctcatacccacactccaagaacgacgctagcgttccggtgttcgtcatgttaccgctcgacacagtaacaatgtcagggcatttgaacaaaccacgagccatgaacgctagtttgatggccctgaaaggagctggtgtggaaggtgtgatggtggatgcttggtggggattggtggagaaagatggacctatgaattataactgggaaggctatgccgagcttatacagatggttcaaaagcacggtctcaaactccaggtcgttatgtcattccatcaatgtggaggaaacgtaggagactcttgcagtatccccttgcctccatgggtgcttgaagagatcagcaagaaccctgatcttgtctacacagacaaatctgggagaaggaaccctgaatatatctccttgggatgtgattctgtgcctgtcctaagaggaagaacacctatccaggtctactcagatttcatgaggagcttccgtgaacgatttgaaggctacataggaggagttattgcggaaattcaagtaggaatgggaccttgtggagaattgagatacccatcataccctgagagcaacgggacctggagattccccggaattggagagttccagtgctacgacaagtatatgaaatcgtcacttcaagcatatgctgagtcaatcgggaaaactaactggggaacaagtggacctcatgatgccggcgagtacaagaacctcccagaagatactgaatttttcaggagagacggaacatggaatagcgagtatggaaagtttttcatggaatggtactccgggaagctgctagaacatggagaccaactcctatcttcagcgaaaggtatctttcaaggaagcggagcaaagctatcaggaaaggtagctggaattcactggcactacaacaccaggtcacacgcagctgagctaaccgctggatactacaacacaagaaaccatgacgggtatctgccaatagctaagatgttcaacaaacatggagttgtgctcaacttcacctgcatggagatgaaagacggggagcaacctgagcacgcgaattgctcaccagaaggtctggtcaagcaagtacagaacgcgacaaggcaggccggaaccgaactagcaggggagaacgcgctagaacgatatgactcaagcgcattcggacaagtggtagcaacaaataggtcagattctggaaatgggttaaccgcatttacttacctaagaatgaacaagcggttatttgagggtcaaaattggcagcagttagtggagtttgttaagaacatgaaggaaggtggtcatgggaggagactctcaaaagaagacacaactggaagtgacctttatgttggatttgtcaaaggcaagatcgctgagaatgtggaggaggctgctttagtgtaatttcccacataggtacatacatatagtgtggtgtttattgtattcctgtctgataaataactagagagatcaaaccagtaagagtgttaaagctatagatttgcacaattctgggtcagagtcagagcaaagagaagcaaaatcaagatgatgtacacttagatgtttcctatgagttttccttgtacatcatcttcatactcttaatctcaaatactatgcatttttctcctacagttttatattatctcaatcaatgtgagtttctcttatcatcaatcaatatgcatctctcgttcaaacg

SEQ ID NO: 1852 - DNA, 2006 bp, Arabidopsis thaliana
aaacacaaacatatcttctatcaaacaccaacagctctattctctacctcatttctcatcataacaaagagagagaaaaaaactatggaattgacactgaattcctcgagttctcttatcaaacgtaaagatgccaagagttctagaaaccaagaaagttcctccaacaacatgacctttgcgaagatgaagccgccaacatatcaattccaagcaaagaactcggttaaggaaatgaagttcactcacgagaagaccttcacgccagaaggtgaaacccttgagaaatgggagaagctccacgttctctcatacccacactccaagaacgacgctagcgttccggtgttcgtcatgttaccgctcgacacagtaacaatgtcagggcatttgaacaaaccacgagccatgaacgctagtttgatggccctgaaaggagctggtgtggaaggtgtgatggtggatgcttggtggggattggtggagaaagatggacctatgaattataactgggaaggctatgccgagcttatacagatggttcaaaagcacggtctcaaactccaggtcgttatgtcattccatcaatgtggaggaaacgtaggagactcttgcagtatccccttgcctccatgggtgcttgaagagatcagcaagaaccctgatcttgtctacacagacaaatctgggagaaggaaccctgaatatatctccttgggatgtgattctgtgcctgtcctaagaggaagaacacctatccaggtctactcagatttcatgaggagcttccgtgaacgatttgaaggctacataggaggagttattgcggaaattcaagtaggaatgggaccttgtggagaattgagatacccatcataccctgagagcaacgggacctggagattccccggaattggagagttccagtgctacgacaagtatatgaaatcgtcacttcaagcatatgctgagtcaatcgggaaaactaactggggaacaagtggacctcatgatgccggcgagtacaagaacctcccagaagatactgaatttttcaggagagacggaacatggaatagcgagtatggaaagtttttcatggaatggtactccgggaagctgctagaacatggagaccaactcctatcttcagcgaaaggtatctttcaaggaagcggagcaaagctatcaggaaaggtagctggaattcactggcactacaacaccaggtcacacgcagctgagctaaccgctggatactacaacacaagaaaccatgacgggtatctgccaatagctaagatgttcaacaaacatggagttgtgctcaacttcacctgcatggagatgaaagacggggagcaacctgagcacgcgaattgctcaccagaaggtctggtcaagcaagtacagaacgcgacaaggcaggccggaaccgaactagcaggggagaacgcgctagaacgatatgactcaagcgcattcggacaagtggtagcaacaaataggtcagattctggaaatgggttaaccgcatttacttacctaagaatgaacaagcggttatttgagggtcaaaattggcagcagttagtggagtttgttaagaacatgaaggaaggtggtcatgggaggagactctcaaaagaagacacaactggaagtgacctttatgttggatttgtcaaaggcaagatcgctgagaatgtggaggaggctgctttagtgtaatttcccacataggtacatacatatagtgtggtgtttattgtattcctgtctgataaataactagagagatcaaaccagtaagagtgttaaagctatagatttgcacaattctgggtcagagtcagagcaaagagaagcaaaatcaagatgatgtacacttagatgtttcctatgagttttccttgtacatcatcttcatactcttaatctcaaatactatgcatttttctcctacagttttatattatctcaatcaatgtgagtttctcttatca

SEQ ID NO: 1853 - DNA, 1847 bp, Arabidopsis lyrata
aaacataaacatatcttctatcaaacaccaatagttctattctctatcctcatttctcaacagaacagagagagaaaaaactatggaattgacactaaattcctcgagttctcttatcaaacgtaaagatgccaagagttctagaaaccaagagagttcctctaacaacatgacctttgcgaagatgaagccgccaacatatcaattccaagcaaagaactcggttaaggaaatgaagttcactcacgagaagaccttcacgccagaaggtgaaacccttgagagatgggagaagctccacgttctctcatacccacactccaagaacgaatctagcgttcctgtgttcgtcatgttaccactcgacactgtaacaatgtcagggcatttgaacaaaccacgagccatgaacgctagtttgatggctctgaaaggagctggtgtggaaggtgtgatggtggatgcttggtggggattggtggagaaagatggacctatgaattataattgggaaggatatgccgagcttatacagatggttcaaaagcacggtctcaaacttcaggtcgttatgtctttccatcaatgtggaggaaacgtcggagactcttgcagtatccccttgcccccatgggtgcttgaagaaatcagcaagaaccccgatcttgtctacacagacaaatctgggagaaggaacgctgagtatatctccttgggatgtgattctgtgcctgtcctaagaggaagaacacctatccaggtctactcagatttcatgaggagcttccgtgaacgatttgaaggctacataggaggagttattgcggaaattcaagtaggaatgggaccttgcggagaattgagatacccatcataccctgagagcaacgggacctggagatttcccggaattggagagttccagtgctacgacaagtatatgaaatcgtcacttcaagcatatgctgaatcaatcgggaaaactaactggggaacaagtggacctcatgatgccggcgagtacaagaacctcccagaagatactgaatttttccggagagacggaacatggaatagcgagtacggaaagtttttcatggaatggtactctgggaagctactagaacatggagaccaactcctatcttcagcaaaaggaatctttcaaggaagcggagcaaagctatcaggaaaggtagctgggattcactggcactacaacaccaggtcacacgcagctgagctaaccgctggatattacaacacaagaaaccatgacgggtatctgccgatagctaagatgttcaacaaacatggagttgtgctcaacttcacctgcatggaaatgaaagatggggagcaaccggagcacgcaaattgctcaccagaaggtctggtgaagcaagtacagaacgcgacaaggcaggctggaacagaattagcaggggagaacgcgctagaacgatacgactctagcgcattcggacaagtggtagcaacaaataggtcagattctggaaatgggttaaccgcatttacttacctaagaatgaacaagcggttatttgagggtcaaaattggcagcagttagtggagtttgttaagaacatgaaggaaggtggtcatggaaggagactttcaaaagaagacacaactggaagtgacctttatgttggatttgtcaaaggcaggatcgctgagaatgtggaggaggctgctttagtgtaagttcccacagaggtacatatagtgtggtgtttattgtattcctgtctgataaataaatagagagatgaaaccagtagagagtgttaaagctatagatttgcacaatactgggtcagag

SEQ ID NO: 1854 - DNA, 1959 bp, Arabidopsis lyrata
aaacataaacatatcttctatcaaacaccaatagttctattctctatcctcatttctcaacagaacagagagagaaaaaactatggaattgacactaaattcctcgagttctcttatcaaacgtaaagatgccaagagttctagaaaccaagagagttcctctaacaacatgacctttgcgaagatgaagccgccaacatatcaattccaagcaaagaactcggttaaggaaatgaagttcactcacgagaagaccttcacgccagaaggtgaaacccttgagagatgggagaagctccacgttctctcatacccacactccaagaacgaatctagcgttcctgtgttcgtcatgttaccactcgacactgtaacaatgtcagggcatttgaacaaaccacgagccatgaacgctagtttgatggctctgaaaggagctggtgtggaaggtgtgatggtggatgcttggtggggattggtggagaaagatggacctatgaattataattgggaaggatatgccgagcttatacagatggttcaaaagcacggtctcaaacttcaggtcgttatgtctttccatcaatgtggaggaaacgtcggagactcttgcagtatccccttgcccccatgggtgcttgaagaaatcagcaagaaccccgatcttgtctacacagacaaatctgggagaaggaacgctgagtatatctccttgggatgtgattctgtgcctgtcctaagaggaagaacacctatccaggtctactcagatttcatgaggagcttccgtgaacgatttgaaggctacataggaggagttattgcggaaattcaagtaggaatgggaccttgcggagaattgagatacccatcataccctgagagcaacgggacctggagatttcccggaattggagagttccagtgctacgacaagtatatgaaatcgtcacttcaagcatatgctgaatcaatcgggaaaactaactggggaacaagtggacctcatgatgccggcgagtacaagaacctcccagaagatactgaatttttccggagagacggaacatggaatagcgagtacggaaagtttttcatggaatggtactctgggaagctactagaacatggagaccaactcctatcttcagcaaaaggaatctttcaaggaagcggagcaaagctatcaggaaaggtagctgggattcactggcactacaacaccaggtcacacgcagctgagctaaccgctggatattacaacacaagaaaccatgacgggtatctgccgatagctaagatgttcaacaaacatggagttgtgctcaacttcacctgcatggaaatgaaagatggggagcaaccggagcacgcaaattgctcaccagaaggtctggtgaagcaagtacagaacgcgacaaggcaggctggaacagaattagcaggggagaacgcgctagaacgatacgactctagcgcattcggacaagtggtagcaacaaataggtcagattctggaaatgggttaaccgcatttacttacctaagaatgaacaagcggttatttgagggtcaaaattggcagcagttagtggagtttgttaagaacatgaaggaaggtggtcatggaaggagactttcaaaagaagacacaactggaagtgacctttatgttggatttgtcaaaggcaggatcgctgagaatgtggaggaggctgctttagtgtaagttcccacagaggtacatatagtgtggtgtttattgtattcctgtctgataaataaatagagagatgaaaccagtagagagtgttaaagctatagatttgcacaatactgggtcagagcaaaaaccaagatgatgtacacttagattgcagttagaactgtgtatcctaaggaatattccttgtacatcttcaaactctatctcatataatatgcaatttttttctctta

SEQ ID NO: 1855 - DNA, 2135 bp, Eutrema halophilum
tttgtccctgaatcacaacagccaatcagttttctttataaaatgcaaacactcaaacagcatcttctctaaaacataaacagcatcttctgctctcaacacaaacacctattctctctctgtcctcatttctcaacagagcaaagagacagagagatatggagttaacactaaattcctcgagctctctcatcaaacgtaaagataccaaaagttcaaggaaccaagacaattcctccaacatgtcctttgcgatgatgaagccaccaacatatcaattccaagcaaagaactcagtcaaggagatgaagttcactcatgagaagacctttactccagaaggtgaaaccactgagagatgggagaagctccacgttctctcatacccacacccgaagagcgacgctagtgttcctgtgtttgtcatgttaccgctcgacacggtcacaatgtcagggcacttgaacaaaccaagagccatgaacgctagtttgatggctctcaaaggagctggtgtggaaggtgtaatggtggatgcttggtggggattggtggagaaagatggacctatgaagtataactgggaaggctatgcagagcttatacagatggttcaaaagcacggtctcaagctccaggtcgttatgtctttccatcaatgtggaggaaacgtaggagactcttgcagtattcccttgcctccatgggtgcttgaagaaatcagcaagaaccctgatcttgtctacacagacaaatctggaagaagaaatcctgagtatatctccttgggatgtgattctgtgcctgtgcttagaggaagaacacctatccaggtctactcagattttatgaggagcttccgtgaaagattcgacagttgcataggaggagttattgcggaaatacaagtgggaatgggaccttgtggagaattgagatacccatcataccctgagagcaacgggacatggagtttccccggaatcggagagttccagtgctacgacaagtatatgagatcgtcgcttcaagcatatgctgaatcaatcggaaaaacaaactggggaacaagtggacctcacgacgccggagagtacaagaacctcccagaagacacagagtttttccggagagacggaacatggaacagcgagtacggaaagttcttcatggaatggtattccgagaagctactagaacatggagacagactcttagcttcagccaaaggaatcttccaaggaaccggagcaaagctatccggtaaagtagcagggattcactggcactacaacaccaggtcacacgctgctgagctaaccgctggatactacaacacaagaaaccacgacgggtacttaccaatagccaagatgttcaacaaacatggcgttgtgcttaacttcacctgcatggagatgaaagacggtgaacaaccagagcacgcgaactgctcaccggaaggtctggttaagcaagtgcagaacgcgacgaggcaggcaggaacagagctagctggtgagaacgcgttagagagatacgactcgagcgcgtttggacaagtggttgcaacgaataggtcagattctggaaacgggttaaccgcatttacttacctgagaatgaacaagaggttatttgagggtcaaaattggcagcagttagtggagtttgttaagaacatgaaggaaggtggtcatggcaagaaactctcggaggaagacacgacaggaagtgatctctatgttggatttgtcagaggcaagaagatcactgagaaagttgaggaagcttcactagtgtaatttttcacaacatctaggtacatataatagtgtgctgtttgatataaataaataaacatagagatttgagagagagaacaaaacctgtgtagtgtttaaagctttagagtttgcacaaattctgagtcgaagcacaaaaacaagatgatgtgtacactacttagtaaacagttagaactgtgtgtattcatattgaattttcattgtacatcttcagagtctaatctcaaataatatgcaattttcttttctattacaaagaatcttatcaaaatcaatgtgggttttctcttatcatcaatcaatatgcatttctctcgtatagacaaa

SEQ ID NO: 1856 - DNA, 2084 bp, Eutrema halophilum
tttgtccctgaatcacaacagccaatcagttttctttataaaatgcaaacactcaaacagcatcttctctaaaacataaacagcatcttctgctctcaacacaaacacctattctctctctgtcctcatttctcaacagagcaaagagacagagagatatggagttaacactaaattcctcgagctctctcatcaaacgtaaagataccaaaagttcaaggaaccaagacaattcctccaacatgtcctttgcgatgatgaagccaccaacatatcaattccaagcaaagaactcagtcaaggagatgaagttcactcatgagaagacctttactccagaaggtgaaaccactgagagatgggagaagctccacgttctctcatacccacacccgaagagcgacgctagtgttcctgtgtttgtcatgttaccgctcgacacggtcacaatgtcagggcacttgaacaaaccaagagccatgaacgctagtttgatggctctcaaaggagctggtgtggaaggtgtaatggtggatgcttggtggggattggtggagaaagatggacctatgaagtataactgggaaggctatgcagagcttatacagatggttcaaaagcacggtctcaagctccaggtcgttatgtctttccatcaatgtggaggaaacgtaggagactcttgcagtattcccttgcctccatgggtgcttgaagaaatcagcaagaaccctgatcttgtctacacagacaaatctggaagaagaaatcctgagtatatctccttgggatgtgattctgtgcctgtgcttagaggaagaacacctatccaggtctactcagattttatgaggagcttccgtgaaagattcgacagttgcataggaggagttattgcggaaatacaagtgggaatgggaccttgtggagaattgagatacccatcataccctgagagcaacgggacatggagtttccccggaatcggagagttccagtgctacgacaagtatatgagatcgtcgcttcaagcatatgctgaatcaatcggaaaaacaaactggggaacaagtggacctcacgacgccggagagtacaagaacctcccagaagacacagagtttttccggagagacggaacatggaacagcgagtacggaaagttcttcatggaatggtattccgagaagctactagaacatggagacagactcttagcttcagccaaaggaatcttccaaggaaccggagcaaagctatccggtaaagtagcagggattcactggcactacaacaccaggtcacacgctgctgagctaaccgctggatactacaacacaagaaaccacgacgggtacttaccaatagccaagatgttcaacaaacatggcgttgtgcttaacttcacctgcatggagatgaaagacggtgaacaaccagagcacgcgaactgctcaccggaaggtctggttaagcaagtgcagaacgcgacgaggcaggcaggaacagagctagctggtgagaacgcgttagagagatacgactcgagcgcgtttggacaagtggttgcaacgaataggtcagattctggaaacgggttaaccgcatttacttacctgagaatgaacaagaggttatttgagggtcaaaattggcagcagttagtggagtttgttaagaacatgaaggaaggtggtcatggcaagaaactctcggaggaagacacgacaggaagtgatctctatgttggatttgtcagaggcaagaagatcactgagaaagttgaggaagcttcactagtgtaatttttcacaacatctaggtacatataatagtgtgctgtttgatataaataaataaacatagagatttgagagagagaacaaaacctgtgtagtgtttaaagctttagagtttgcacaaattctgagtcgaagcacaaaaacaagatgatgtgtacactacttagtaaacagttagaactgtgtgtattcatattgaattttcattgtacatcttcagagtctaatctcaaataatatgcaattttcttttctattacaaagaatcttatcaaaatcaat

SEQ ID NO: 1857 - DNA, 1911 bp, Brassica rapa
ctctcaaacacacaaacatatcttttctctcaaacaccaacatttctattctctctctactcattttttttaactgaacagagagaaagaaaacaatggagttaacactaaattcctcaagttctctaatcaaacgtaaagataccaaaagctcaagaaaccatgaaagctcctccaacatgtcgtttgccaaaatgaagccaccaacttatcaattccaagcaaagagctcggttaaagaaatgaagttcactcatgagaagaccttcaagccagaaggtgaagaagccactgaaagatgggagaagctccacgttctctcctacccacaccccaagaacgactccagcgttcctgttttcgtcatgttaccgctggacacggtgacaatgtcagggcatttgaacaaaccaagagccatgaacgctagtttgatggctctaaaaggagctggtgtggaaggtgtaatggttgacgcttggtggggattggtggagaaagatggacctatgaagtataactgggaaggctatgccgagcttatacagatggttcagaagcatggtctcaagcttcaggttgttatgtctttccatcaatgcggaggaaacgttggagactcttgcagtatacccttgccaccatgggtgctggaagagatcagcaagaaccctgatcttgtctacacagacaaatctggaagaaggaaccctgagtacatctccttgggatgtgattctgtccctgtcttaagaggaagaacacctatccaggtctactcagatttcatgaggagcttccgtgaaagattcgatcattacataggaggagttattgcggagattcaagtgggcatgggaccttgcggagaattgagatacccttcataccctgaaagcaacggaacatggaggttccctggaattggcgagttccagtgctacgacaagtatatgagatcgtcccttcaagcatatgctgaatcagtcgggaagactaactggggaacaagtggaccacatgacgccggagagtacaagaaccttccggaagacactgagtttttcaggagagacggaacatggaacagcgagtacggaaagttcttcatggagtggtactcagggaagctacttgagcacggagacaagctcctagcttcagctaaaggagtcttccaaggaaccggagctaagctatctggaaaagtagccggtatccactggcactacaacaccaggtcacacgccgctgagctaaccgctggatactacaacacaagaaaccacgacgggtatctaccaatagctaagatgttcaacaaacacggcgttgtcctaaacttcacctgcatggagatgaaggacggtgaacaaccggagcacgcgaactgctcgccggaaggtctggttaagcaagtgcagagcgcgacgaggcaggctggaacagacctagcgggggagaatgcgttagagagatacgactcgagcgcgttcggacaggtggttgcaacgaataggtcggatacgggaaacgggttgacagcgtttacgtacctgagaatgaacaagaggttgtttgagggtcaaaattggcagcagttggtggagtttgtgaagaagatgaaggaaggtggtggtgatgggaggaggagacaattatctgaggaagacactacaggaagtgacctttatgttgggtttgtcagaaaaagcaggaaggttgaagaagcttctttagtgtaaaatttccactccacataggtacacatatagtgtgatatgaataataaataacaaagcagcatactgtttaaatcttttagaatgtgcagaaagaaaagatgatgtatacttatgctataaaattttcatcttcaaactctcgtctcattataatatgctatttttc

SEQ ID NO: 1858 - DNA, 1897 bp, Brassica napus
ccaacatttctattctctctctactcattttttgttcaactgaacagagagaaagaaaacaatggagttaacattaaattcctcaagttctctaatcaaacgtaaagatacaaaaagctcaagaaaccatgaaagctcctccaacatgtcatttgccaaaatgaagccaccaacttatcaattccaagcaaaaagctcggttaaggaaatgttcactcatgagaagactttcaagctagaaggtgaagaagccactcaaagatgggagaagctccacgttctctcctacccacaccccaagaatgactccagcgttcctgttttcgtcatgttaccgctggacacggtgacaatgtcagggcacttgaacaaaccaagagccatgaacgccagtttgatggctctaaaaggagctggcgtagaaggtgtaatggttgatgcttggtgggggttggtggagaaagatggacctatgaagtataattgggaaggctatgccgagcttatacatatggttcagaagcatggtctcaagctccaggttgttatgtctttccatcaatgtggtggaaacgttggagactcttgcagtatacccttgcccccatgggtgcttgaagagatcagcaagaaccctgatcttgtctacacagacaaatctggaagaaggaaccctgagtacatctccttgggatgtgactctgtccctgtcctaagaggaagaacacctatccaggtctactcagatttcatgaggagcttccgtgaaagattcgatcattacataggaggagttattgcggagattcaagtgggtatgggaccttgtggagaactgagatatccttcataccctgaaagcaatggaacatggaggttccctggaattggcgagttccagtgctacgacaagtatatgagatcgtcccttcaagcatatgctgaatcagtcgggaagactaactggggaacaagtggaccacatgacgccggagagtacaagaacctcccggaagacactgagtttttcaggagagacggaacatggaacagcgagtacggaaagttcttcatggagtggtactcagggaagctacttgagcacggagacaagctcctagcttcagctaaaggagtcttccaaggaaccggagctaagctatctggaaaagtagccggaatccactggcactacaacaccaggtcacacgccgctgagctaaccgctggatactacaacacaagaaaccacgacgggtatctaccaatagctaagatgttcaacaaacacggcgttgtcctaaacttcacctgcatggagatgagagacggtgaacaaccggagcacgcgaactgctcgccagaaggtctggttaagcaagtgcagagcgcgacgaggcaggctggaacagagctagcgggggagaatgcgttagagagatacgactcgagcgcgttcggacaggtggttgcaacgaataggtcagattcgggaaacgggttgacaacatttacgtacctgagaatgaacaagaggttgtttgagggtcaaaattggcagcagctggtggagtttgtgaagaagatgaaggaaggtcgtggtgatgggaggaggagacaattatctgaagaagacactacaggaagtgacctttatgttgggtttgtcagaagaagcaggaaggttgaggaagcttctctagtgtaaaatttccactccacataggtaacacaatacagtgtggtatgaataataaacaaacaaagcaatatactattaaagcttttagaatgtgcagaaagaaaagatgatgtacacttatgctataaaattttcatcttcaaactctcgtctcattataatatgctattttttctcttacaatcctcctctttt

SEQ ID NO: 1859 - DNA, 1722 bp, Brassica napus
caaggaaatgaagttcactcatgagaagacctacaagccacgaaagcgaaaccacagagaggtgggagaagctccacgttctctcatacccacaccccaagaacgactccagcgtccggttttcgtcatgctaccgctggacacggtgacaatgtcagggcacttgaacaaaccaagagccatgaacgctagtctgatggctctaaaaggagccggtgtggaaggtgtaatggttgatgcttggtggggattggttgagaaagatggacctatgaagtataactgggaaggctatgctgagcttatacagatggttcagaagcacggtctcaaactccaggttgttatgtctttccatcaatgtggaggaaacgttggagactcttgcagtattcccttgcctccatgggtgcttgaagagatcagcaagaaccctgatcttgtctacacagacaaatctgggagaaggaatcctgagtacatctccttagggtgtgactctgtgcctgtcctaagaggtagaacacctatccaggtctactcagatttcatgaggagcttccgtgaaagattcgataattacataggaggagttattgcggaaattcaagtgggaatgggaccttgtggagaattgagatacccatcataccctgagagcaatgggacatggaggttccctggaattggagagttccagtgctatgacaagtatatgaaatcgtcgcttcaggcatatgctgaatcaatagggaaaacaaactggggaacaagtggacctcacgacgccggagagtacaagaacctcccagaagacactgagtttttcaggagagacggaacatggaacagcgagtacggaaagttcttcatggaatggtactccgggaagctactagagcacggagacaagctcctgtcttcagccaaagcaatctttcaaggctccggagctaagctatcaggaaaagtagcagggatccactggcactacaacacaaggtcacacgccgccgagctaaccgcaggttactacaacacaagaaaccacgacgggtatctcccaatagccaagatgttcaacaaacacggcgtcgtgctaaacttcacctgcatggagatgaaagacggcgaacagcccgagcacgcgaactgctctcctgaaggtctggtcaagcaagtgcagaacgcaacgaggcaggctggaaccgagctagcgggggagaacgcgttggagagatacgactcgagcgcgttcggacaagtggttgcaacgaacaggtcggactcggggaacgggttgacagcgtttacttacctgaggatgaacaagaggctgttcgagggtcagaactggcagcagctggtggagtttgtgaagaacatgaaggaaggtggacatgggaggagactctctgaggaagacacaacggggagtgatctttatgttggatttgtgggaagcaagatctctgagacggttgaggaagctgctctagtgtagatttccactccacataggtacatatagtgtgtgtggtatataattataataaacaatagagatgacaaagagagcaaaccagagtattaatgttaaaaaagctttagaaagttgcacaattctggatctgggcaaagagaagatgatgtacactttctatgactgtgtaatatgcttatgaacttttcatcttcaaactctaatctcaaataatatgc

SEQ ID NO: 1860 - DNA, 1473 bp, Brassica napus
tctttcctacccacaccccaagaacgactccagcgttcctgttttcgtcatgctaccgctggacacggtaacaatgtcagggcatttgaacaaaccaagagccatgaacgctagtttgatggctctaaaaggagccggtgtggaaggtgtaatggttgatgcttggtggggattggttgagaaagatggacctatgaagtataactgggaaggctatgctgagcttatacagatggttcagaagcacggtctcaaactccaagttgttatgtctttccatcaatgcggaggaaacgttggagactcttgcagtattcctttgcccccatgggtgcttgaagagatcagcaagaaccctgatcttgtctacacagacaaatctgggagaaggaatcctgagtacatctccttgggatgtgactctgtgcctgtcctcagaggaaggacacctatccaggtctactcagatttcatgaggagtttccgtgaaagattcgataattacataggaggtgttattgcggaaattcaagtgggaatgggaccttgtggagaactgagatacccatcataccctgagagcaatgggacatggaggttcccaggaattggagagttccagtgctatgacaagtatatgaaatcgtcgcttcaagcatatgctgaatcaatagggaaaacaaactggggaacaagtggacctcatgacgccggagagtacaagaacctcccagaagacacagagtttttcaggagagacggaacatggaacagcgaatacggaaagttcttcatggaatggtactccgggaagctactagagcacggagaccagctcctgtcttcagccaaagcaatcttccaaggctccggagctaagctatcaggaaaagtagcaggaatccactggcactacaacacaaggtcacacgccgccgagctaaccgctggttactacaacacgagaaaccacgacgggtatctcccaatagccaagatgttcaacaaacacggcgtcgtgctaaacttcacctgcatggagatgaaagacggcgaacagcccgagcacgcaaactgctctcccgaaggtctggtcaagcaagtgcagaacgcgacgaggcaggctggaaccgagctagcgggagagaacgcgctagagagatacgactcgagcgcgttcgggcaagtggttgcaacaaacaggtcggattcagggaacgggttgaccgcgtttacgtacctgaggatgaacaagaggctgttcgagggtcagaactggcagcagctggtggagtttgtgaagaacatgaaggaaggtggacatgggaggagactctctgaggaagacacaacagggagtgacctttatgttggtggatttgtgggaagcaagatctctcagacggttgaggaagccgttctagtgtaaagttcccactccacataggtacatatagtgtgtgtggtatatat

SEQ ID NO: 1861 - DNA, 1028 bp, Zea mays
caaaagcgaggctgcgagagcggagagagagagtgagggaggcgccgccgcgccgacgccgagtcctttctccatcctgcatctgccgctgtttccgacaggatgtttctcacgaggacggagtacgaccgcggggtgaacaccttctctccggaggggcggctgttccaggtcgagtacgccatcgaggccatcaagttgggatccactgcgatcggtttgaagacaaaggatggtgttgtcctcgccgttgagaaacgtgtgacctcaccactgctggaaccaagcagtgtggaaaaaataatggaaattgatgagcacataggctgtgccatgagtggacttattgctgatgctagaacactagtggaacatgctcgtgttgaaactcagaatcataggttctcatacggagagccaatgactgtagaatcttcgacacaagctatctgtgacttagctctgcgttttggcgaaggtgacgaagagtcaatgtcacggccatttggagtctctctcctaattgctggacatgatgagaatggacctagcctgtactacactgacccatctggtacattttggcaatgcaacgcaaaggcaattggatcaggttctgagggagctgatagttccttgcaggaacagtacaacaaggaattgaccctccaggaggcggagaccatagccctttctatcctgaagcaggttatggaagagaaggtgaccccaaacaacgtcgatattgccaaggttgcccccaagtaccacctctacacccctgccgaggtggaagccgtcatcgcgaggctgtgaaacgcttccgagctcttgctatccacgtcatcaatcggtaatagacgacccttgtacgaagcgtgggcaccatggtccttgattatggcttgattatggcaaggacagtcgatgttagtttgattcacagctcagccgggctcacttgtctttttaaatttttatgaattagcgttgagaactttgtactgccaagaaagttcatttttttt

SEQ ID NO: 1862 - DNA, 998 bp, Sorghum bicolor
cgaggagagagagagggtgagggtaaggggaggcgccgacgccgagttcttgctccatcccgcatccgccgccgtcgccgacacgatgtttctcacgaggacggagtacgaccgcggggtgaacaccttctcgccggaggggcggctgttccaggtcgagtacgccatcgaggccatcaagttgggatccactgcgatcgggttgaagacaaaggatggtgttgtcctcgctgttgagaaacgtgtgacctcgccactgctggaaccaagcagtgtggaaaaaatcatggaaattgatgagcacataggctgtgccatgagtggacttattgctgatgctagaacactagttgagcatgctcgtgttgaaactcagaatcatagattctcgtacggggagccaatgaccgtagaatcttcgacacaagctatctgtgacttagctctgcgctttggtgaaggtgacgaagagtcaatgtcacggccatttggagtctctctcctaattgctggacatgatgagaatggacctagcctgtactacactgacccatctggtaccttttggcaatgcaacgcaaaggcaattggatcaggctctgagggagctgatagctccttgcaggagcagtacaacaaggaattgaccctcgaggaggcagagacgatagccctttctatcctgaagcaggttatggaagagaaggtgaccccaaacaacgtcgatatagccaaggttgcccccaagtaccacctctacacccctgccgaggtcgaagctgttatcgcgaggctgtgaagtgcttccgagctcacgccatcagtcggtaatagacaatccttgtacgaaacgtggacatcttggttcttgattatggctgtcatcgtactctgttgtaactccacaaggacagtcgatggtagtttgattcgcagctcagccggctcagttgtctgtttctagtagcgttgagcgttgagaacattgtattgccaga

SEQ ID NO: 1863 - DNA, 1112 bp, Cenchrus ciliaris
caaaagcgggcgcgaggggagttgagggaggcgccgccgcggagtagagctcgatccagcacccgccgccgccgtcgacgtcgcctacaggacaggatgtttctcacgaggacggagtacgaccgcggggtgaacaccttctcgccggaggggcgactgttccaggtcgagtacgccatcgaggccatcaagttgggatcgactgcgatcgggttgaagacaaaggatggtgttgtccttgctgttgagaaacgtgtcacctcgccactactggaaccaagcagtgtcgagaaaatcatggaaattgatgagcacataggctgtgccatgagtgggcttattgctgatgctagaacgctagtcgagcatgcacgtgttgagacccagaatcataggttctcatatggggagccaatgaccgtagaatcttcaacacaagctatctgtgacttggctctgcgctttggtgaaggtgacgaagagtcaatgtcacgaccatttggagtgtctctcctaattgctggacatgatgagaatggacctagcttgtactacactgacccatctgggacgttttggcaatgcaatgcaaaggcaattggatcaggctctgaaggagctgatagctccttgcaggagcagtacaacaaggacctgaccctccaggaggcagagaccatagccctttctattctgaagcaagttatggaagagaaggtgaccccaaacaatgtcgacattgccaaggtcgcccccaagtaccacctctacacccctgctgaggttgaagccgtcattgcgaggctgtgaaacgcttccagattcttgtcgttcacatcatcaatcagtaatacagctctttctatcttgtcattcacatcatcgatcagtaatagacagctctttctacgaagcgtggacatgtttgatgtgagccgaactgcctagtgtgttgccgatgctgccatcatcatactcgtgtcactagggcagtcgctgatagtctgattgaactgcagccctgtcattctgtctgtttcaactaatgttgagaactccggtactgccagaaagaatgtacacttgtttttacgaattgggcttccgttttt

SEQ ID NO: 1864 - DNA, 1331 bp, Setaria italica
gcaagaagctcaggaagccatcaaaagcgagcgcgaggggagagagagaggcgagaggagaagagggaggcgccgacgcggagttcccgttcgatccagcacccgccgccgctgccgacgccgccgccttcgccttcacgacaggatgtttctcacgaggacggagtacgaccgcggggtgaacaccttctcgccggaggggcggctgttccaggtcgagtacgccatcgaggcaatcaagttgggatcgactgcaatcgggttgaagacaaaggatggtgttgtcctcgctgttgagaaacgtgtcacctcgccactgctggaacccagcagtgtggagaaaataatggaaattgatgagcacataggctgtgccatgagtggacttattgctgatgctagaacgctagtcgagcatgctcgtgttgagacccagaatcataggttctcatatggggagccaatgactgtagaatcttctacacaagctatctgtgacttggctctgcgctttggtgaaggtgacgaagagtcaatgtcacgaccatttggagtgtctcttctaattgctggacatgatgagaatggacctagcttgtactacacggacccgtctgggaccttttggcaatgcaacgcaaaggcaattggatcaggctctgaaggagctgatagctccttgcaggagcagtacaacaaggatctgaccctccaggaggcggagaccatagccctttctatcctgaagcaggttatggaagagaaggtgaccccaaacaatgtggatatcgccaaggtcgcccccaagtaccacctctacacccctgccgaggtcgaagccgtcattgcaaggctgtgaaacgcttccagattcttgctattcgcatcatcgatcagtaatagacagtctttgtacgaagtgtggacatgttgatgcgggccaatctgcctagtgtgttgccatggctgtcatcatcatactcttgtcaactccactagggcagtcgctgatagtctgattcactgcagccctgtcacgctgtttgtttcaagtagcgttgagaacttccgtactgccagaaagaaagtacacttgtttttacgaattcggcttttttttggacaattagctgatgctcttatcctggtgccatacttgctgaaatgttaccagtggaaaggtccagcttttcacgtcctgttatttttggcctgtgttttgtaaaataatcagatcgcgatccaaattagggggctatatgcaaataaaagggggtgttttgtaaatatttgaattttgatcaataattgcgattcaaataagggggtta

SEQ ID NO: 1865 - DNA, 1013 bp, Cenchrus ciliaris
cgccgcggagttcctgctcgatccagcacccgccgccgccgtcgacgtcgcctacaggacaggatgtttctcacgaggacggagtacgaccgcggggtgaacaccttctcgccggaggggcggctgttccaggtcgagtacgccatcgaggccatcaagttgggatcgactgcaatcgggttgaagacaaaggatggtgttgtccttgctgttgagaaacgtgtcacctcgccactactggaaccaagcagtgtcgagaaaatcatggaaattgatgagcacataggctgtgccatgagtgggcttattgctgatgctagaacgctagttgagcatgcacgtgttgagacccagaatcataggttctcatatggggagccaatgaccatagaatcttctacacaagctatctgtgacttggctctgcgctttggcgaaggtgacgaggagtcaatgtcacgaccatttggagtgtctctcctaattgctggacatgatgagaatggacctagcttgtactacactgacccatctgggaccttttggcaatgcaatgcaaaggcaattggatcaggctctgaaggagctgatagctctttgcaggagcagtacaacaaggacctgactctccaggaggcggagaccatagccctttctattctgaagcaagttatggaagagaaggtgaccccaaacaatgttgacattgccaaggtcgcccccaagtaccacctctacacccccgccgaggttgaagccgtcatcgcgaggctgtgaagtgcttccagattcttgtcgttcacaccatcgatcattaatagacagttctctgtacgaagcgtggatatgtttgatgcgggctgaactgcctggtgtgttgccgaggctgccatcatcatactcgtgtcaactccacttgggcagtcgctgatagtccgatttaactgcagccctgtcattctgtttgtttcatctagtgttgagaactcctgtactgccagaaagaaagtaca

SEQ ID NO: 1866 - DNA, 955 bp, Zea mays
aacttcgttcgcaagaagctcagaagtcagatcagaagccgccgaggggaggcgccgacgccgagtttttgctccatcccgcatccaccgccagaatgtttctcacgaggacggagtacgaccgcggggttaacaccttctcgccggaggggcggctgttccaggtcgagtacgccatcgaggccatcaagttgggatccactgcgatcgggttgaaaacaaaggatggtgttgtccttgctgttgagaaacgtgtgacctcgccactgctggaaccaagcagtgtggaaaaaatcatggaaattgatgagcacataggctgtgccatgagtgggcttattgctgatgctagaacactagtcgagcatgctcgtgttgaaactcagaatcataggttctcatacggggagccaatgaccgtagaatcttcaacacaagctatttgtgacttagctctgcgctttggcgaaggtgacgaagagtcaatgtcacggccatttggagtctctcttctaattgctggacatgatgagaatggacctagcctgtactacaccgacccatctggtactttttggcaatgcaacgcgaaggcaattggatctggctctgaaggagctgatagctccttgcaggagcagtacaacaaggagctggcccttgaggaggcggagaccatagccctttctattctgaagcaggttatggaggagaaggtgaccccaaacaacgtcgatattgccaaggttgctcccaagtaccacctctacacccctgccgaggtcgaagccgtgatcgcgaggctgtgaaacgctttcggagctcgtgttattcatgtcatcaatcggtaatagacgatccttgtacgaagcgtggacatcttttgttcttgattatggctgtcatcgtactctgttgttaactccacaaggacagtcgatggtactttgattca

SEQ ID NO: 1867 - DNA, 1109 bp, Oryza sativa
aacaacaccgcgagagtaaaagcaccccccctcttcgtctcggctttcggagctctcgagacttaagccgcgattcggagggaaaccctagctagctcccgctctcgatcccgcgcccgccaccgcactcggcaagatgttcctcacgaggacggagtacgaccgcggggtgaacaccttctccccggaggggcggctgttccaggtcgagtacgccattgaggccatcaagttggggtcaactgcgattggattgaagaccaaggatggtgttgtccttgctgtagagaaacgtgtgacctcgccactgctggaaccaagcagtgtggagaaaatcatggaaattgacgagcacataggctgtgccatgagtggccttattgctgatgctagaacattggttgagcatgctcgtgttgaaacccagaatcataggttctcatatggggagccaatgacagttgaatctactacacaagctatctgtgacttagctctgcgttttggtgaaggtgatgaagaatcaatgtcacgaccatttggagtctctctccttattgctggtcatgatgagaacggacccagcttgtactacactgacccatcaggaaccttttggcaatgcaatgccaaggcaattggatcaggttctgaaggagctgatagctcattacaggaacagtacaataaggaattgaccctccaggaggctgagaccatagccctgtctatcttgaagcaggttatggaggaaaaggttaccccaaacaacgtcgatatcgcaaaggtttctcccaactaccacctctacacccctgctgaggttgaagctgtcattgcacggttatgagaagattgccatcgcgtgttatttttatcagccctaagacagcctctgtatgaacttcctaaatggattatcagtccattgtttgctatggctgtcatgttatgttaacaagatagtggctgctagagtttattactgcctctaatagtctggtgtgcagcccagtcatttgcttgttttcagcagtgttgagaccatgtactatcaaaaagagaacgacaatcctttccaagatttggttgcaacatttcgacagtca

SEQ ID NO: 1868 - DNA, 1090 bp, Brachypodium distachyon
gtctttgctttgctttgttcccaagaagaactccggtcccggagcacgaagccttcgagcgctcgagatacctgggcgacgatttgagtagagaaaaagagtgtgaattccttgcttcggttctgcatccgccgccgctggcaagatgtttctgacgaggacggagtacgaccgcggggtgaacaccttctccccggaggggcgtctgttccaggtcgagtacgccattgaggccatcaagttgggatcaactgcgatcgggttgaagactaaggatggtgttgtcctggcagttgagaaacgtgtgacatcgccactactggaaccaagcagcgtggagaaaatcatggaaattgacgagcatgtaggctgtgccatgagtggccttattgctgatgctagaacactggttgagcatgctcgtgttgagactcagaatcataggttctcatatggggagccaatgacagtagaatctacaacccaagccatctgtgacttggctctgcgctttggtgaaggtgatgaagagtcaatgtcacggccatttggagtctctctccttattgctgggcatgacgaaaatggacccagcttgtactacacggacccatctgggaccttctggcaatgcaacgccaaggcaatcggatctggctctgaaggagctgatagctcgttacaggagcagtacaacaaggagctgactcttgcggaggcggagacaatagccctgtctatcctgaagcaggttatggaagaaaaggtaaccccgaacaacgtcgacattgcaaaggtctcccccagctaccacctatacaccccagcagaggttgaggcagtcatcgcgcggttgtgaagcactgccagtcttgttaattttatatcaacctgtaaggaacagtatgagcttgttgatgtgtctgcctgcccactgttgtgatggctcgtggtactagggcttatcgtgtctggcagcctgattcccagtccagtggtttatttgtttccagtagttcggctgaagagaatatttgacatctatttcaagatttggttgcaacctttggaaagtacacaagttaactgc

SEQ ID NO: 1869 - DNA, 1311 bp, Brachypodium distachyon
atccactggcaggtgggacctacggttccgtgacgtggtactccggcacggtcgcacggcagaggcagaccctctctgcgcttctacttcttcctcaagctcaagcagaacctcccctctctcttctcctctcccagactcccccacaaacccttcttccccgagcccaagcaagccgcgcgcaaccatgttcctcacaaggacggagtacgaccgcggcgtgaacaccttctccccggagggccggcttttccaggtggagtacgccatcgaggccatcaagttgggctctactgcaatagggctgaagacgaaggatggggttgttcttgctgtggagaaacgtgtgacctcgccattgctggagcctagcagtgttgagaaaatcatggaaattgatgagcatgtaggctgtgccatgagtggccttattgccgatgcgagaacattggttgagcatgctcgtgtggagacccaaaatcatagattctcatatggggagccaatgacagttgagtccacgacccaagctatttgtgatctagctcttcgttttggagaaggtgaagaagagtcaatgtcacggccttttggagtttctctcctcattgctggtcatgatgaaaatggtcccagcctgtactacactgacccatctggaaccttttggcagtgcaatgccaaggcaattggctcaggttctgaaggtgccgatagctccttacaggagcagtttaacaaggagttgactcttcaggaggctgaaaccatagctctatctatcttgaagcaggttatggaagaaaaggtgactccaaataatgtcgacatcgccaaggtcgcaccaaactaccacctctacacccctgcagaggtcgaggcagtcatcggacgattgtgaaacacagaaatctttatcttatgtcagcccggatacatatgttctgcttccgtacgttttacaccttgatggaggtccatgcctttcaattagcacaagcacaattgctgtatgatgttgacctctttttcattttgatgtggtgtggacaaggattataagatgatagtgtttgtggacttgtcacctgagatcgacaaccttctgtttgatacgcaggacttgcagcccaacatgcagtatttggccttttctgtttgatacgcaggagcagtaacaacatgctgtatttgcgtaacaatgatcgtttagatatcacaggagcagcaacaacatgcagtatctgcgtaacaatgatcgttttgaaatgcagtcttgaccatatgtttcttttcttccggaactggcct

SEQ ID NO: 1870 - DNA, 990 bp, Brachypodium distachyon
caagcagaacctcccctctctcttctcctctcccagactcccccacaaacccttcttccccgagcccaagcaagccgcgcgcaaccatgttcctcacaaggacggagtacgaccgcggcgtgaacaccttctccccggagggccggcttttccaggtggagtacgccatcgaggccatcaagttgggctctactgcaatagggctgaagacgaaggatggggttgttcttgctgtggagaaacgtgtgacctcgccattgctggagcctagcagtgttgagaaaatcatggaaattgatgagcatgtaggctgtgccatgagtggccttattgccgatgcgagaacattggttgagcatgctcgtgtggagacccaaaatcatagattctcatatggggagccaatgacagttgagtccacgacccaagctatttgtgatctagctcttcgttttggagaaggtgaagaagagtcaatgtcacggccttttggagtttctctcctcattgctggtcatgatgaaaatggtcccagcctgtactacactgacccatctggaaccttttggcagtgcaatgccaaggcaattggctcaggttctgaaggtgccgatagctccttacaggagcagtttaacaaggagttgactcttcaggaggctgaaaccatagctctatctatcttgaagcaggttatggaagaaaaggtgactccaaataatgtcgacatcgccaaggtcgcaccaaactaccacctctacacccctgcagaggtcgaggcagtcatcggacgattgtgaaacacagaaatctttatcttatgtcagcccggatacatatgttctgcttccgtacgttttacaccttgatggaggtccatgcctttcaattagcacaagcacaattgctgtatgatgttgacctctttttcattttgatgtggtgtggacaaggattataagatgatagtgtttgtggacttgtcacctg

SEQ ID NO: 1871 - DNA, 1063 bp, Festuca arundinacea
actctgctctacttcttcctcaagcagaaccttcctctcgtctcccacaaacccttcttccccaagcccaagcaaaccgcgcgccaccatgttcctcacgaggacggagtacgaccgcggcgtgaacaccttctccccggaggggcggctgttccaggtcgagtacgccatagaggcaatcaagttgggctctactgctattgggttgaagaccaaggatggggttgttcttgctgtggagaaacgtgtgacatctccgttgctggaacctagcagtgttgagaaaattatggaaattgatgagcatgttggttgcgccatgagtggccttattgctgatgcgaggacattggttgagcatgctcgtgtggagacccaaaaccatagattctcatatggggaaccaatgacagttgagtccaccacacaagctatttgtgatctagctcttcgctttggagaaggtgaagaagagtcaatgtcacgaccttttggagtttctctccttattgctggtcatgatgaaaatggtcccagtttgtactacaccgacccatctggaaccttttggcagtgcaatgccaaggcaattggatcgggctctgaaggtgctgatagctctttacaggagcagtttaacaaggagctgacccttgaggaggctgaaagcattgctctatctatcctgaagcaggttatggaagaaaaggtaactccgaacaatgttgatatcgccaaggtcgcaccgaactaccacctctacacccctgccgaggtcgaagcagtcatagcacggctgtgaaaacagataaatctttatctatgtcttcatatactcctgcagtactgctgatgtgtgtttgacatccttttaattagcataagcacgactgctcttttgtcttgacactggtgtctacctcttatcgttcaatttaaatctgctatcgacaagaagttatagaggcttacagtatttgttgcctcagccggtgaagatgtcgaacagccttctgtctgacgcgaagggcttgcactcatgcagcaacggattgcagtattt

SEQ ID NO: 1872 - DNA, 1088 bp, Festuca arundinacea
ctacttcgtccccaagaagaacaccattacaccagcaggagcagaaacgccttccacgatttcgagcgaagaaattgccccgttcctgcttcgatcccgcttccaccgccgacgacgagatgtttctcacgaggacggagtacgaccgcggggtgaacaccttctccccggaggggcggctgttccaggtcgagtacgccattgaggccatcaagttgggctcgaccgccatcgggttgaagactaaggagggtgttgtgctggctgttgagaaacgtgtcacctcaccgctgctcgaaccaagcagtgtggagaaaatcatggaaattgatgagcatgtaggctgtgccatgagtggccttattgctgatgctagaacactggttgagcatgctcgtgttgagactcagaatcataggttctcatatggggagccaatgacagtagaatctaccacacaagctatctgcgacttggctttgcgctttggcgaaggtgaagaagagtcgatgtcacgaccgtttggagtctctctccttattgctggtcatgatgaaaatggacccagcttgtactacacagacccatctgggaccttctggcaatgcaacgccaaggcaattggatcaggttctgaaggagctgatagctcactacaagagcagtacaacaaggaactgaccattgctgaggcagagaccattgctctttctatcctgaagcaggttatggaagaaaaggtgaccccaaacaacgttgacatagcaaaggtgtcccccagctaccacctctacacccctgcagaggtcgaagcggtcattgcgcggttgtgaaggatttgccactttgtgaaacagtctcttgctattcccatgaaccctaaagcacaatggactgttgatgtgggttttctgcctattcctgtcagaattatcgttgtttaagaattattagcctgcatccgatttctgatctcccagtccagactttttttttctgtttccagtagcactaagacattgtaccaccaaaacgagttacacatatttttcaaacaggtgcagtctgctgaaaaaaaaaaaaaaaaa

SEQ ID NO: 1873 - DNA, 1126 bp, Gossypium raimondii
gcaagagcaaacagataccagaaccgaaggtattttttttctacgaaaaataccagcatcgctaagctttctcgttgctgaatctctccctttgtcacaagttttggtagatctaataagatcaagtcgatccaaacatgtttctcaccaggactgagtatgaccgtggagtgaacacattttctccggaagggagattgttccaggtggaatatgctattgaggccatcaagctgggttcaactgcaattgggttgaagacaaaagaaggtgtcgttctggctgttgagaagcgtattacttcaccactgttggaacccagcagcgttgagaagattatggaaattgatgagcatataggatgtgctatgagtgggttgattgctgatgcccgtacacttgttgaacatgcacgagttgagactcagaaccacagattctcatatggtgagccaatgacagtagaatccacaacacaagctctttgtgatctggcccttcgatttggtgaaggagatgaagaatcgatgtcccgaccgtttggtgtatcacttctcattgctggtcatgatgagaacgggcctagcttatactatactgatccatctggcacattttggcaatgcaatgcaaaagctataggctctggttctgaaggtgcagatagctctttgcaagagcaatacaacaaggacctaactcttcaagaagctgaaacaattgctctgtccattttaaagcaagtaatggaagaaaaggtgactcccaacaatgttgatattgccaaagtagcaccgacataccatctgtacaccccttcagaggtggaagcagtcatcagtcggctatgagagaaatgctttgttataaactatcatcccatgcagcatgagttaaggggattcaaactgtgaacccttattttttggtgtcgtgcaaaattccagtacgtcttcactcggatattttagttacacctcatcaggaaaaggaacctttgattttggatttagtttgcatgtgggttgcctcctcattgctcgcatttgtgaaataacaagaatgattagtatagactaatatattttctaattatctaaagtttagtcaaatttaaactaggaac

SEQ ID NO: 1874 - DNA, 1133 bp, Lolium multiflorum
tccccaagaagaacaccagcaggagcacaaagcctttccacgatttcgagagagaaagaaggccccgttcctgcttcgatcccgcttccaccgccggcgacgacatgtttctcacgaggacggagtacgaccgcggggtgaacaccttctccccggaggggcgcctgttccaggtcgagtacgccattgaggccatcaagttgggctcgaccgccatcggcttgaagactaaggagggtgttgtcctggctgttgagaaacgtgtcacctcaccgctgctcgaaccaagcagtgtggagaaaatcatggaaattgatgagcatgtaggctgtgccatgagtggccttattgctgatgctagaacactggttgagcatgctcgtgttgagacccagaatcataggttctcatatggggagccaatgacagtagaatctaccacacaagctatctgcgacttggctttgcgctttggcgaaggtgaagaagagtcaatgtcacgaccattcggagtctctctccttattgctggtcatgatgaaaacggacccagcttgtactacacagacccatctgggaccttctggcaatgcaacgccaaggcaattggatcaggttctgaaggagctgatagctcactacaagagcagtacaacaaggaactgaccattgctgaggcagagaccattgctctttctatcctgaagcaggttatggaagaaaaggtgaccccaaacaacgttgacatagcaaaggtgtcccccagctaccacctctacacccctgcagaggttgaagcggtcattgcgcggttgtgaagcatttgccactttgtgaaacagtctcttgctattcccatgaaccctaaagcacaatggactgttgatgtgggttttctgcctattcgtgtcataattatcgttgtttaagaattattagtgcctgcatctgacttctgatctcccagtccagactttttttttctgtttccagtagcactaagacattgtaccaccaaaacgagttacacatatttttcaaacaggtgcagtctgctgaacttatttcatcgtaccattggctggtacgtgcggccactcaaatcgatgtgtgtggtcaaagctaagaccagt

SEQ ID NO: 1875 - DNA, 1062 bp, Lolium multiflorum
ctctacttcgtccccaagaagaaggcaccagcaggagcacaaagcccttccacgatttcgatttcgagcgaagaaacagagagaaagaaggctccgttccggcttcgatcccgcttccaccgccggcgacgagatgtttctcacgaggacggagtacgaccgcggggtgaacaccttctccccggaggggcggctgttccaggtcgagtacgccattgaggccatcaagttgggctcgaccgccatcgggttgaagactaaggagggtgttgtcctggctgtcgagaaacgtgtcacctcaccgctgctcgaaccaagcagtgtggagaaaatcatggaaattgatgagcatgtaggctgtgccatgagtggccttattgctgatgctagaacactggttgagcatgctcgtgttgagacccagaatcataggttctcatatggggagccaatgacagtagaatctaccacgcaagctatctgcgacttggctttgcgctttggcgaaggtgaagaagagtcgatgtcacgacctttcggagtctctctccttattgctggtcatgatgaaaacggacccagcttgtactacacagacccatctgggaccttctggcaatgcaacgccaaggcaattggatcaggttctgaaggagctgatagctcactacaagagcagtacaacaaggaactgaccattgctgaggcagagaccattgctctttctatcctgaagcaggttatggaagaaaaggtgaccccaaacaacgttgacatagcaaaggtgtcccccagctaccacctctacacccctgcagaggtcgaagcggtcattgcgcggttgtgaagcatttgccactttgtgaaacagtctcttgctattcccatgaaccctaaagcacgatggactgttgatgtgggttttctgcctattcctgtcataaagaattattagtgcctgcatctgatttctgatctcccagtccagactagcactaagacattgtaccaccaaaacgagttacacatatttttcaaacaggcgcagtctgaacttatttc

SEQ ID NO: 1876 - DNA, 1170 bp, Festuca arundinacea
ggcacgaggtctctctctctctctctctctctctctctctctcctcgtctctacttcgtccccaagaagaacgcaccagcaggagcagaaaggccttggaagatttcgagcgaagaaatagcgagagagacagagagaaagaaggctccgttcctgcttcgatcccgcgtccaccgccggcgacgagatgtttctcacgaggacggagtacgaccgcggggtgaacaccttctccccggaggggcggctcttccaggtcgagtacgccattgaggccatcaagttgggctcgaccgccatcgggttgaagactaaggagggtgttgtcctggctgtcgagaaacgtgtcacctcaccgctgctcgaaccaagcagtgtggagaaaatcatggaaattgatgagcatgtaggctgtgccatgagtggccttattgctgatgctagaacactggttgagcatgctcgtgttgagacccagaatcataggttctcatatggggagccaatgacagtagaatctaccacacaagctatctgtgacttggctttgcgctttggtgaaggtgaagaagagtcgatgtcacgaccgttcggagtctctctccttattgctggtcatgatgaaaacggacccagcttgtactacacagacccatctgggaccttctggcaatgcaacgcaaaggcaattggatctggctctgaaggagctgatagctcactacaagagcagtacaacaaggaactgaccatcgctgaggcagagaccatcgccctttctatcctgaagcaggttatggaagaaaaggtgacccctaacaatgtcgacatcgcgaaggtgtcccccagctaccacctctacacccctgcagaggtcgaagcggtcatcgcgcggttgtgaattgttgccactttgtgaaacagtctcttgctattcccatgaaccttaggcacaatggactgttgatgtgggttttctgcctattcatgtcatgattatcgttgtttaaggatatagcagtgcctgcatctgatttctgatcttccagtccatgtaattttttttctgtttccagtagcactaagacattgtatcaccaaaacgagttacgcatattttcaaacaaaaaaaaaagaaaaaaaacaaaagtactctgcgttgataccact

SEQ ID NO: 1877 - DNA, 963 bp, Theobroma cacao
ggctgctctttctctctcagacactcattcacaaagttttgttagatctaattctaatcgatccaacatgttcctcaccaggactgagtatgatcgtggggtgaacacattttctcctgagggtagattgttccaggtggagtatgcaattgaggctatcaagctgggttcaactgcaattgggataaagacgaaagacggtgtcgtgctggctgttgagaagcgtattacttcaccactgttggaacccagcagtgttgagaagattatggaaattgatgcgcatataggatgtgccatgagtgggttgattgctgatgcacgtacacttgttgaacatgcacgagttgagactcagaaccacagattctcatatggtgagccaatgactgtggagtccacaacacaagctctttgtgatttggcccttcgatttggtgaaggagatgaagaatccatgtctcgaccatttggggtgtctcttctcattgctggtcatgatgagaatggaccaagcttatactatactgatccctctggcacattttggcaatgcaatgccaaagctataggttcaggttctgaaggcgcagacagctctttgcaagagcaatataacaaggacctaactcttcaagaagctgaaacaattgctctgtccattttaaagcaagtaatggaagaaaaggtaactcccaacaatgttgatattgccaaggtagcaccaacataccatctatacaccccttctgaggtggaagctgtcattacccgtctatgagaatacttggtcataatcaatcttcccatgcaagaactgcctttcctttcataattatgcatgagttggggaagaggcttgtatttgtttctttttggtgtggcattaaactaatctacacttcagttggatgatttagttacacctgatcagaaaagaaccttttaattggatttcattgc

SEQ ID NO: 1878 - DNA, 1259 bp, Echinacea purpurea
cggccggggaataatataaccatcacttcaagagccatatttgggcattaaaggttgtactatttcgacccggactaaaccctaaaacccgacccggttggtgttagcagcaagaacccagggttggcttgcttcgcaagaagggcttcacttcagtcttaaataaataagtataggagaatacatctccaacaatcaggcaacacaaacaagagatctattcatcaatcgaagatgtttctaaccaggaccgagtatgacaggggtgtcaacaccttctctccggaaggcaggttgtttcaggttgaatatgccattgaggccattaagttgggttccacagctattgggttgaagactaaggaaggggttgttcttgctgttgaaaagcgtattacctcgccactcttggagcctagtagtgttgagaaaattatggaaattgatgaacacattggctgtgccatgagtggattaatcgcagatgcccgaacacttgttgaacatgcacgggttgagactcagaatcataggttttcctatggtgagccgatgactgttgagtccactacgcaagccctgtgtgaccttgcactgcgctttggtgaaggagacgaagaatcaatgtctcggccatttggggtatctcttcttattgcaggccacgatgaaaatggtccaagtctatactataccgacccatctggcacattctggcaatgcaatgcaaaagctataggctcaggctctgaaggcgctgacagttctctgcaggagcaatttaacaaggacttgactctaaaagaagctgaaacaattgctctttccatcttgaagcaagtgatggaagaaaaggtaactccaaataatgtggatattgcaaaggtggctcctacttatcacttgtacaccccggctgaggttgaagctgttatcggtcgtctctaaaaccgtcgtctgatatggcttaataaaacatgtattttgtacttaaaactgttgagattttattctgctccctttaggtgtggcatttgaacaccggatcctttttaatcatgtttgagaaaatcatggaattaagtggccacttgtttgtttattgttgactatgttcattgatcctgtcaatcattggggttgtggtgtccatctgttctattttttcttgtgatgcttgtcatttgaccttagcctattggagtttgcgattttgtttatcaagactgctgtgatttcttcagttgtattccaaactc

SEQ ID NO: 1879 - DNA, 1015 bp, Panax ginseng
ccctcaagtcttagctaactttattcaccgatttttaagttctcattagatcgaagatgtttctcaccaggaccgagtacgacagaggtgtgaataccttctctcccgaaggccgattgtttcaggttgaatatgctattgaggctatcaagttaggttcaactgcaattggattgaagactaaggaaggggttgttcttgctgttgaaaagcgtatcacctcaccactcttggagcctagcagtgtggaaaaaattatggaaattgacgagcacattggttgtgcgatgagtggattgattgctgatgcccgtacactagtggaacatgcacgagttgaaactcagaatcataggttctcatatggtgagccaatgactgttgagtccactacacaagcactctgtgatttggcattacgatttggtgaaggggatgaagaatctatgtctcgaccatttggggtatccctactcattgctggtcatgatgagaacggtccgagcttatactatacagatccttcaggtacattttggcaatgtaacgggaaagctattggttcaggctctgaaggtgctgacagctctttacaggagcaatataacaaggacttaaccctcaaagaagctgaaacaatagctctttccatattgaagcaagttatggaagaaaaggtgacacctaataacgtggatattgcgaaggtagctccaacttaccatttgtacacccctgctgaggtggaggctgtcatcagtcgcctataaaaaagatcttccatctaaaagttctggtctttatgtggcttttgattatatttcaatttctgatatactttttgtactgatcttctgggactgtaatatctttctattgcatttggagtttcaaccagattactggttttagtgcccaaaccagccatgttacttgaacagattgaatgattttcattacctaatggaaccgtaaaccttaaagttgaatctattgaggctgctggtgctttctt

SEQ ID NO: 1880 - DNA, 1023 bp, Gossypium raimondii
ttcagaaataagctaaaaaattgtgggtttttttgttctttggggttttgttagatctaacatccaatcgatccaagatgtttctcaccaggactgagtatgaccgtggggtgaacacattttctccggagggaagattgttccaggtagaatatgctattgaggccatcaagctgggttcaactgcaattgggttaaagacgaaagaaggtgttgtgttggctgtcgagaagcgtattacttcgccattgttggagcccagcagtgttgagaagattatggaaattgatgaacatataggatgtgctatgagtggcttgattgctgatgcccgtacacttgttgaacatgcacgagttgagactcagaaccacagattctcatatggcgagccaatgactgtagagtccacaacacaagctctttgtgacctggcccttcgatttggtgaaggagatgaagaatccatgtcccgtccatttggggtgtctcttctcattgctggtcatgatgagaatgggcctagcttatactatactgatccctctggcacattttggcaatgcaatggaaaagctataggctcaggttccgaaggtgcagacagctctttgcaagagcaatacaacaaggacctgactcttcaagaagctgaaactattgctctgtccattttaaagcaagtaatggaagagaaggtgactcccaacaatgttgatattgccaaagtagcaccaacataccatctatacaccccttcagaggtggaagctgtcattactcgcctatgagaatgcgctgccatcataagatcttaccatgcaacaacctgctttactgtcataatgatgcatgacttgagggggagaagcttgtatttgtttcttgggattcaagctgtgaaacgttatttttggtgtggcactaaactcatctactctttcagttggataatttaattacaccagatcagaaaaaagaaccttttttatttggatattatgttctcaaattcatggactc

SEQ ID NO: 1881 - DNA, 1001 bp, Vitis vinifera
acaacacaagaagaacaaacccacagactgagagaaactatacgcagagctttttcaatccgaacagtacaaaatgtttctcacaaggactgagtacgacagaggtgtgaataccttctccccagaaggccgattgtttcaggttgaatatgctatcgaggccatcaagctgggttcaactgcaattgggttgaagacgaaggaaggtgttgtgcttgctgtcgagaaacgcattacttctccattgctggagcccagcagtgtagagaaaattatggaaattgatgagcatataggttgtgctatgagtggattgattgctgatgctcgtacacttgttgaacatgcacgagttgaaactcagaatcataggttttcatatggggagccaatgactgttgagtccactacacaagctctttgtgaccttgccctgcgatttggtgaaggggatgaagaatccatgtctcgaccatttggagtatctcttctcattgctggtcatgatgagaatgggcccagcttatactatacggacccatctggaacattttggcagtgtaatgcaaaagctattgggtcgggttctgaaggtgcagacagttctctgcaggagcaatttaatcaggacctaactcttcaagaggctgaaacaatagctctttccattctgaagcaagttatggaagaaaaggtgacccctaacaacgtggacattgcgaaggtggctccaacctaccatttatacacccctgcagaggtggaggctgtcatcagtcgcctatgaaagaactccctacaaaagaagtcctcagacctcaaatccgttccccatgatatccatacaccaatgctattttattagtttatggggaggatctttatttgtttctgatttgggattttgtcagggaaactcaggaaactttttttgggtgtgtactcaaaccatgctgcttcagttgttggcgtgatcaattctcttgcgctttacgatctac

SEQ ID NO: 1882 - DNA, 1112 bp, Glycine max
tacacggcaagccccttgagcaagaaagcaagcaaattaggcagagtgagtgaggagcaagcaaataaaacccaaacaaacgcttctcattctctctctactcgttttgaagatgtttctcacaaggactgagtatgaccgaggagtcaacaccttttcccccgaaggacgtttgtttcaggttgagtatgcaatcgaagccatcaagctgggatcaactgcgattgggttgaagaccaaagagggtgttgtcctcgcagttgaaaagcgcatcacttcgccgctcctggagcctagtagtgttgagaaaattatggaaattgatgagcacataggttgtgcaatgagtgggttgattgcagatgctcgaacacttgttgagcatgcacgggtggaaactcagaatcataggttctcctatggtgagccgatgactgttgagtccaccacccaagctctttgtgatctagccttgcgttttggtgaaggtgatgaagaatccatgtctcgcccatttggagtttctctcctcattgctggccatgatgagaatggacctagcttatactacactgatccatcgggcacattttggcaatgcaatgcaaaagctattggttcagggtccgaaggcgcagacagttctctacaagaacaattcaacaaggacctaacccttcaagaagccgagacaattgctttatccattttgaagcaagttatggaagagaaggtcactcccaacaacgttgacattgccaaggtggctccaacatatcatctttataccccctctgaggtggaagctgtgataagccgtctatgattttctttttcatgattttctctattcagcatttctttcctattcttcttgcctgtacgtcttattatttagtattatgcgggaacttttttggtggatgatgctgtgttgtgctacacttgtggccaagttgtacactgtatgagattctggtgtcatatttgctgcattcagtctagttgaaattgaggactaaaaaagtttcaatggttgggaaaatcgagaactattatccgaatggggagacaatgaaggaaaaaagaattacactacgatttatatgcat

SEQ ID NO: 1883 - DNA, 1047 bp, Gossypium raimondii
gcttcatttcatttacttatttatttttctttgctcgacggctctcattattcagttttgttagatttaaatataatcgatccaaacatgtttctcacaaggactgagtatgatcgtggggtcaacacattttcaccggaaggaagattgttccaagtggaatatgcaattgaggccatcaagctgggttcaactgcaattgggctaaagacgaaagacggtgtcgttttggctgtggagaagcgtattacttcaccattgttggaacccagtagtgttgagaagattatggaaattgatgagcatataggatgtgctatgagtgggttgattgctgatgcacggacccttgttgaacatgcacgagttgaaactcagaaccatagattctcatatggtgagccaatgaccgtggagtctacaactcaagctctttgtgatctggcccttcgattcggtgaaggagatgaagaatccatgtcccgaccatttggggtatctcttctcattgctggtcatgatgagaatgggactagcttatactataccgatccctctggcacattttggcaatgcaatgcaaaagctataggttcgggttccgaaggtgctgatagctctttgcaagagcaatacaacaaggacttaactcttcaagaagctgaaacaattgccctgtcgattttaaagcaagtaatggaagaaaaggtgactcccaacaatgtcgatatcgctcgagtagcaccgacataccatctatacaccccgtcagaggtcgaagctgtcattactcgtctatgagaacacattgtaccatgttttctgctgtaacgatgctcaagtcgggatcaaggctcgtatttgtttttggggattcaagctgtgaaaccttatgtttggtttggcactacaaactcatccatctcatcatttggattgtttgattacaaaaatagaacctttaattggatttagtatttgcctttctcaatttctagcaagtcttggtttgcctttacttccatgtttttagaattttaccagtag

SEQ ID NO: 1884 - DNA, 2480 bp, Glycine max
gagaaggctcattgaacaagcaaaattaagcacaaaagcccaaccctctctctcgctgctggtctcccccatttggcattcgcagatcgaatacgagtaatttcactgaatcttattgaagatgtttctcacaagaactgagtatgaccgaggagtcaacaccttttctcctgaaggccgtttatttcaggttgaatatgcaatcgaagccatcaagctgggatcaactgcgattggattgaagacgaaagagggtgttgtccttgcagttgaaaagcgcatcacttcaccactgctggagccaagtagtgttgagaaaattatggaaattgatgagcacataggatgtgcaatgagtggattgattgctgatgctcgaacacttgttgagcatgcacgggttgaaactcagaatcataggttctcctatggtgaaccaatgactgttgagtccacaacccaagctctttgtgatctagccttgcgttttggtgaaggtgatgaagaatccatgtctcgaccatttggagtatctcttctcattgctggccatgatgagaatggacctagcttatattacactgatccatctggcacattttggcaatgcaatggaaaagctatcggttcagggtcagaaggtgccgacagttctctgcaagaacaatacaacaaggacctaactcttcaagaagctgagactattgctttatccattttgaagcaagttatggaagagaaggtcactcccaacaatgtcgacattgccaaggtggctccaacatatcatctttataccccctctgaggtggaagctgtgataagtcgtctatgattttcttttcgtgactttctctattcaacatttgtgtttcctatcattcctgcctgacgtctaattattgagtattatgcggaaacttttttggtgggtgatgtttacatgtgctacacttgtggccaagttgtacactgtacgagattctggtgtcatttgctgcattcggtctagttgaaattgagtactataagggtttcaatgtttttgggaaaatcgtaatctattacccgaataccgagctagatttttactgtatgagatattaaggaacggggagacgatggaggaaaaaagaattacacaaagtatctatatgcattatgtgtatactattgaaagaattaggatttattttaaccatcttttattcctcgtagtcaaagcaaattgctcacctcagtcaaatacttaattggatattttcttttataaattatataatttttatcattatttttttaaaatatattgtttttattagaaattttcagattctatttttatatttataatatcgtgctataaattttataacatttttatcatttttattccccatgttttctcctttcctttatctttgttataaaaaaaaggaggtaaaatggatcaatttttattccgtgttcattttttttatctcattattcattgacttggatgggtactatctcacggactaactatattcctaaaaggcatgaattatagtcgactgtattgagttattttaactataatgtaaattgaattatattgttacatgaataagaacatcagtagttgtggaatttgtttaataccgtatagaattccagaagctacctaacatagcttctaagttctcaataaaaaaaatatataggttccaagtttttatacaccggacaaaaggcggagagattatgctacgcacacatatagaatgatgttacactactcattttgctctttgcaccacctgctctctttctttttgtataaaaatatcctttgcagaaactattttccgtcatatatttatatttatgttcatattctaatacattacagaaattaatttatcatttatgcgtaaagatgaaagagaagagtattttaggaatataaagaaaaatgaaagtaatgggtgtgagacaaaaaacgaggtgtaaatagcacgggctacacatgaaatcaccttgagagtgccatagtaaaattcgtcttgagatatgataaattttggtatctcaatgaaaattcaaatttaatttttgaatgtgtaaaaagtataataaattagtcatgttcacaatttaatgacaaattagtttcttaattttgtaacttaatgtgaaatagaatctcgaaaaatataacttattatcaaattattataatttaatgataaaataattttacaaatttaacggcaatactcatttatcgtactttttgcatatttagaaactaaatttgtattttttattttttagggattaatttatcatcgcatcatacttttaaagatgaatttgactatttacccttaaagaaattctgattttagtggttgcacatctcttatttggttaatcataatatactaaacgtagaaacaaaaaattaagggtatatttagaaatcagtttagaag

SEQ ID NO: 1885 - DNA, 1116 bp, Glycine max
ggccccttgaacaagcaaaattaagcacaaaagcccaaccctctctctcgctgttggtctctcctatttggcattcgcagatcgattacgaagtaatttcactgaatcttattgaagatgtttctcacaaggactgagtatgaccgaggagtcaacaccttttctcctgaaggccgtttatttcaggttgaatatgcaatcgaagccatcaagctgggatcaactgcaattgggttgaagacgaaagagggtgttgtccttgcagttgaaaagcgcatcacttcgccgcttctggagccaagtagtgttgagaaaattatggaaattgatgagcatataggttgtgcaatgagtggattgattgctgatgctcgaacacttgttgagcatgcacgggttgaaactcagaatcataggttctcatatggtgaaccaatgactgttgagtccacaacccaagctctttgtgatctagccttgcgttttggtgaaggtgatgaagaatccatgtctcgaccatttggagtatctcttctcattgctggtcatgatgagaatggacctagcttatattacactgatccatctggcacattttggcaatgcaatggaaaagctattggttcagggtcagaaggtgccgacagttctctgcaagaacaatacaataaggacctaactcttcaagaagctgagactattgctttatccattttgaagcaagttatggaagagaaggtcactcccaacaacgtggacattgccaaagtggctccaacatatcatctttataccccatctgaggtggaagctgtgataagtcgtctatgattttctttttgtgactttctgtattcaacatttgtgtttcctatcattcctacccgtacgtctaattattgagtattacgcggaaacttttttggtggatgatgtttgcatgtgctacacttgtggccaagttgtacactgtacgagattctggtgtcatatttgctgcattcagtctagttgaaattgagtactaaaagggtttcaatgattttgaggagacgatgaggaaaaaaaaagaattacacatctatatgcacattatgtgtatactattgaaagaaa

SEQ ID NO: 1886 - DNA, 1152 bp, Panax ginseng
agtcgtctccaatcgccactcaccattgctatttgctggcttgctccacaagaaggacaaacatataaacaaaacatctgttcactgtgaagtgagctttttctcctcatacaaattcaatacagttgcatctccctcaagtcttagctaactttattcaccgatttttaagttctcattagatcgaagatgtttctcaccaggaccgagtacgacagaggtgtgaataccttctctcccgaaggccgattgtttcaggttgaatatgctattgaggctatcaagttaggttcaactgcaattggattgaagactaaggaaggggttgttcttgctgttgaaaagcgtatcacctcaccactcttggagcctagcagtgtggaaaaaattatggaaattgatgagcacattggttgtgcgatgagtggattgattgctgatgcccgtacactagtggaacatgcacgagttgaaactcagaatcataggttctcatatggtgagccaatgactgttgagtccactacacaagcactctgtgatttggcattacgatttggtgaaggggatgaagaatctatgtctcgaccatttggggtatccctactcattgctggtcatgacgagaacggtccgagcttatactatacagatccttcaggcacattttggcaatgtaatgggaaagctattggttcaggctctgaaggtgctgacagctctttacaggagcaatataacaaggacttaaccctcaaagaagctgaaacaatagctctttccatattgaagcaagttatggaagaaaaggtgacacctaataacgtggatattgcaaaggtagctccaacttaccatttgtacacccctgctgaggtggaggctgtcatcagtcgcctataaaaaagaacttccatcgaaaagttctggtcttgatgtggcttttgattatatttcaatttctgatatactttttgtactgatcttctgggattgtaatatctttctattgcatttggagtttcaaccagattactggttttaaaatgcccaaaccagccatgctacttgaacagattgaatgattttcattacctaatggaaccgtagaccttaaacttgaatctattaaggctgctggtgctttcttaa

SEQ ID NO: 1887 - DNA, 970 bp, Centaurea maculosa
ccggggggcttatactcgaataaatatagtcggaagcactttcaatcggaggaaatcgcaaatctcttcgatcggagctaatctatcatcaatcaacagagatctattgagcttttaaactgaatcgaagatgtttctaaccaggactgagtatgatagaggtgttaacaccttctctccagaaggccggctatttcaggttgaatatgccattgaagccatcaagttgggttcgacagccattggtttgaagaccaaggaaggggttgttcttgctgttgagaagcgtattacctcgccacttctggagcctagtagtgttgagaaaattatggaaattgatgagcacattggctgtgcaatgagtggattaattgcagatgcccgaacactcgttgaacatgctcgtgtcgagacccagaatcataggttttcctacggtgaaccaatgactgttgagtccactacccaagccctgtgtgatctggctctgcggtttggtgaaggagatgaagaatctatgtctcggccttttggggtgtctcttcttattgctggccatgatgaaaatggtcctagtctatactatacagatccatcggggacattttggcaatgcaatgggaaagccataggctcaggctctgaaggtgctgacagctctctgcaggagcagtataacaaggacttgacgctaaaagaagctgaaataattgctctttccatcttgaagcaagtcatggaagaaaaggtaaccccaaataacgtggatattgcgaaggttgctcctacttatcacttgtacaccccggctgaagttgaagctgtcatcagtcgcctatgaaatggcaataagttgtagacggtctttgtttggttttcttgaacttgtattttgtactaaattgctgagatgttattctgtttcccatcaactatggtatttgaacacaaggtcttttctatgttt

SEQ ID NO: 1888 - DNA, 1035 bp, Lupinus angustifolius
aagaaaaggaagaaagaaaaagcccacacctcatagcttctttatttcgtattgtcgcagtgagtactgagaacaaaagtttttagcgtgattttatcttctcgaatccaacatgtttctcacaagaactgagtatgaccgtggagtcaacaccttttctcctgaaggacgtttgtttcaggtagaatatgcaatcgaagccattaagctgggatcaactgcaattgggttgaagacgaaagagggtgttgttcttgccgtcgaaaagcgtatcacttcacccttgctggaacctagcagtgtggagaagattatggaaattgatgaccatataggttgtgcaatgagtggattgattgctgatgctcgaacacttgttgaacacgcacgagtggaaactcagaaccacaggttctcctttggtgaaccaatgactgtggagtctacaacccaagctctatgtgacctagccctgcgttttggtgaaggcgatgaagagtccatgtctcgaccatttggagtgtcgctcctcattgctggccatgacgagaacggacctagtttatattacactgacccatctggtacgttttggcaatgcaatgcaaaagccattggatcagggtcggaaggtgcagacagttctctgcaagaacaattcaacaaggaactaactcttcaagaagctgagacaattgctctatccattctgaagcaagttatggaagagaaggtcactcctaataacgttgacattgccaaggtggctccaacatatcatctttacaccccttctgaagtcgaagctgtgataagtcgcctatgatttctcttggcatgatttaatttgtttctatcaatcctggctagctctgtttaattggctttgcccaaaaactgttttggtggatgtgcgtctattaattagtttacatgtactactcgttgtgaccaattgtatactgtacttttattctcttatcaaatttgctgcattgagtttagtagatttgagtctaaatgtttgttttgggt

SEQ ID NO: 1889 - DNA, 1101 bp, Arachis hypogaea
gagcaagcaaagcaaagccaagccaataagcaaaagcccacatcgccgctcttcactcctcagaggcgcaaagatcaagagacagtataagctgagcaagttgaagccatttttgggcaagtgtgatttcatcgaatcaaatcgaagatgttccttacaaggaccgagtatgaccgaggagtcaacaccttttctcctgaaggccgtttgtttcaggttgaatatgcaattgaggccatcaagctgggttcaactgctattgggttgaagacaaaacacggtgttgtccttgcagttgaaaagcgtatcacttcaccgctactggaacctagcagtgtggaaaagattatggaaattgacgaacatataggttgtgcaatgagtggattgattgctgatgctcgaacacttgttgagcatgcacgagtggaaactcagaatcataggttctcctatggtgaaccgatgactgtagagtctaccacccaagcactttgtgatttggccttgcgttttggtgaaggcgatgaagagtccatgtctcgaccatttggagtttctcttcttattgctggacgtgatgagaatggacctagtttatattacactgacccatctggcacattttggcaatgcaatgcaaaagctattggatcagggtcagaaggagcagatagttctctgcaagaacaatacaacaaggaccttactcttgaagaagcagagactattgctttatccattctgaagcaagttatggaagagaaggtaactccaaacaacgttgacatcgctaaggtgtccgaaaaatatcatctttatactccggctgaggtggaagctgtgataagtcgcctatgaattccttttgtctgatttgctatcattgccatatgttcccataccttgaacccctgccttacctacagtctgttttaatagctttgcgctcaaactttttcgatactacacttgtggccaaattgtactctctatctgattctcaggtgttaaatttgctaaattcagtttagttactatatatttattggacaatttggaaacgccacatgaatatgctctcatgagattgtttgccgt

SEQ ID NO: 1890 - DNA, 1114 bp, Glycine max
gcccttcctttgggtaactcgcactctcgcagtatcccctgactcacccaaacaaaaaaacaaacggacgcttctcattctctctctactcgttcagaagatgtttctcacaaggactgagtatgaccgaggagtcaacaccttttctcccgaaggccgtttgtttcaggttgagtatgcaatcgaagccatcaagctgggatcaactgcgattgggttgaagaccaaagaaggagttgtccttgcagttgaaaagcgcatcacatcgccgctcctggagcctagtagtgttgagaaaattatggaaattgatgagcacatcggttgtgcaatgagtgggttgattgcagatgctcgaacacttgttgagcatgcacgggtggaaactcagaatcacaggttctcctatggtgagcctatgactgttgagtccaccacccaagctctttgtgatctagccttgcgttttggtgaaggtgatgaagagtccatgtcccgaccatttggagtatctctcctcattgctggtcatgatgagaatggacctagcttatactacactgatccatctggcacattttggcaatgcaatggcaaagctattggttcagggtcagaaggtgcagacagttctctacaagaacaattcaacaaggacctaacccttcaagaagccgagactattgctttatccattttgaagcaagttatggaagaaaaggtcactcccaacaacgttgacattgccaaggtggctccaacgtatcatctttatacaccgtctgaggtggaagctgtgataagtcgtttatgattatctctattcagcattgtttcctatccttcctgccgtacgtctaattatttagtatcatggggaacttcttgtggatgatgctacacttgtggcaaagttgtatactgtacgagattctggtgttatatttgcatttagtctagttgaaattgaggactaaaaaggcttcaatggttgggaaaatttagaactattacccgattgggggaggcaatgaagggaaaaaagatttacacaacgatctctatgcattatgtatattttattggaagaatgaagatttatttttaccgtttt

SEQ ID NO: 1891 - DNA, 1021 bp, Phaseolus vulgaris
gctgcagtgcggggcagtcacacagcattcgcagatcgaatagaagtaatttcaccaaatcttttcggagatgtttctcacaaggactgagtatgaccgaggagtcaacaccttttctcctgaaggtcgattgtttcaggttgaatatgcaattgaagccatcaagctgggatcaactgcaattgggttgaagactaaagagggtgttgtccttgcagttgaaaagcgcataacttcaccactgctggagccaagtagtgttgagaaaattatggaaattgatgagcacataggctgtgcaatgagtggattgattgctgatgctcgaacacttgttgagcatgcacgggtggaaactcagaatcataggttctcctatggtgagccaatgactgttgagtccacaacccaagctctttgcgatctcgccttgcgttttggtgaaggtgatgaagaatccatgtctcgaccatttggagtatctcttctcattgctggccatgatgagaatgggcctagcttatattacactgatccatctggcacattttggcaatgcaatggaaaagcaattggttcagggtcggaaggtgcagacagttctctgcaagaacaattcaacaaggacctgactcttcaggaagccgagactattgctttatccattttgaagcaagttatggaagagaaggttactcccaacaacgttgacattgccaaggtggctccaacatatcatctttataccccctccgaggtggaagctgtgataagtcgtctatgatttccttttcatgacttcctctgttcaacatttgtgtttcctataactctctgtacgtctaattatttagcattctgcggaatatttctttggtggatgatgctatgtagtgctatacttgtgaccaagttgtccactgtaccagattttacagtcatatttgctgcattcggtctagttgaaattgaggactaaaagggttctaatgtttgggaaaatccataactgttaccagaa

SEQ ID NO: 1892 - DNA, 970 bp, Centaurea maculosa
cactttcaatcggagaatatcgcaaatctcttcgatcggagctaattaatctatcgtcaacagagatctattaagcttttaaactgaatcgaagatgtttctaaccaggaccgagtatgatagaggtgttaacaccttctctccggaaggccggttatttcaggttgaatatgccattgaagccatcaagttgggatcgacagccattggtttgaagaccaaggaaggggttgttcttgctgttgagaagcgtattacctcgccacttctggagcctagtagtgttgagaaaattatggaaattgatgagcacattggctgtgcaatgagtggattaattgcagatgcccgaacactagttgaacatgctcgtgttgagacccagaatcataggttttcctacggtgagccaatgactgttgagtccactacccaagccctgtgtgatctggctctgcggtttggtgaaggagatgaagaatctatgtctcggccttttggggtgtctcttcttattgctggccatgatgaaaatggtcctagtctatactatacagatccatcggggacattttggcaatgcaatgggaaagctataggctcagggtctgaaggtgctgacagctccctccaggagcaatacaacaaggacttgacgctaaaagaagctgaaataattgctctttccatcttgaagcaagtcatggaagaaaaggtaacccccaataatgtggatattgcgaaggttgctcctacttatcacttgtacaccccggctgaagttgaagctgtcatcagtcgcctatgaaatgggaataagttgtagacggtctttgtttggttttcttgaacttgtattttgtactagattgccgagatgttattctgtttcccatcaactatggtatttgaacacaaggtcttttctatgtttgacaaaatcatggattaaggtttaaagattatttag

SEQ ID NO: 1893 - DNA, 1091 bp, Arachis hypogaea
caaagccaagccaataagcaaaagcccacatcgccgctcttcactcctcagaggcgcaaagatcaagacacagtataagctgaggaagttgaagccatttttgggtaagtgtgatttcatcgaatcaaatcgaagatgttcctcacaaggaccgagtatgaccgaggagtcaacaccttttctcctgaaggccgtttgtttcaggttgaatatgcaattgaggccatcaagctgggttcaactgctattgggttgaagacaaaacacggtgttgtccttgcagttgaaaagcgtatcacttcaccgctactggaacctagcagtgtggaaaagataatggaaattgacgaacatataggttgtgcaatgagtggattgattgctgatgctcgaacacttgttgagcatgcacgagtggaaactcagaatcataggttctcctatggtgaaccgatgactgtagagtctaccacccaagcactttgtgatttggccttgcgttttggtgaaggcgatgaagagtccatgtctcgaccatttggagtttctcttcttattgctggacgtgatgagaatggacctagtttatattacactgacccatctggaacattttggcaatgcaatgcaaaagctattggatcagggtcagaaggagcagatagttctctgcaagaacaatacaacaaggaccttactcttgaagaagcagagactattgctttatccattctgaagcaagttatggaagagaaggtaactccaaacaacgtggacatcgctaaggtgtccgaaaaatatcatctttatactccggctgaggtggaagctgtgataagtcgcctatgaattacttttgtgtgatttgctatcattgccatttgttcccataccttgaacccctgccttacctacagtctgttttaatagctttgtgctcaaactttttcgatactacacttgtggccaaattgtactctctatctgattctcaagtgtccaatttgctaaattcagtttagttactatatatttattggacaatttggaaacgccacatgaatatgctctcatgagattgtttgccgtga

SEQ ID NO: 1894 - DNA, 971 bp, Medicago truncatula
atcacactgcgaaaatcgaagcaaaccaaaaacccagcgatagagagagtcttttagtgatctatttcatcgattcaaatcaaatcaaaccaaaccaaaccaaaccaaaccaacatgtttctcacaaggaccgagtatgaccgtggagtcaacactttttctcccgaaggacgtttgtttcaggttgaatatgcaattgaagccattaagcttggatcaactgcgattgggttgaaaaccaaagagggtgtggttcttgcagttgaaaagcgtattacttcgcctctactggagcctagcagtgtggagaaaattatggaaattgatgaccacattggctgtgcaatgagtggattgattgctgatgctcgtacacttgttgagcatgcacgagttgaaactcagaatcacaggttctcttatggtgaaccgatgactgtagagtctacaactcaagctctttgtgacctagccttgcgctttggtgaaggtgatgaagaatccatgtctcgaccatttggagtgtctctcctcattgctggccatgacgagaatggacctagcctatattacactgatccttctggcacattttggcaatgcaatgcaaaggctattggttcaggatcagaaggcgctgacagttctctgcaagaacaattcaacaaggacttaactcttcaagaagctgagactattgctttatcaatcctgaagcaagttatggaagagaaggtcactcccaacaacgttgacattgccagggttgctccagcgtatcatctttataccccgtctgaggtggaagctgtgataagtcgcctatgatttccatctatttaaatgatttgatttgtgctgtacgtctatttaactggtctgctacatgtagtgctgctttatcgccaagttgtatgcaatactagattctcctaccatattttctgatattcagtctagttgaaattgag

SEQ ID NO: 1895 - DNA, 1005 bp, Eutrema halophilum
gagcaaactggtaaaggctacggtttcttcgattcgcagatcaatcgactgacactaaggttttacagatctaagtcgcggaagaagaagatgtttctcactaggactgagtatgacagaggagtcaacactttttctcctgaaggcaggctattccaagtcgagtatgccattgaagctatcaagcttggttctactgcaattggagtaaagacaaaggagggagttgtgcttgctgtcgagaagcgtatcacgtcgcctttactggagccgagcagtgtggagaagattatggaaatcgatgaccatattggttgtgccatgagtggtttaattgctgatgcgcgtacacttgttgagcatgcaagagttgagactcagaaccacagattctcgtatggggagccaatgactgtggagtccacaacacaagcactgtgtgatctggctttacgatttggtgaaggagatgaagaatcaatgtctcggcccttcggagtatctcttctcattgctggtcatgatgaaaacggaccgagcttgtactacacggatccgtcagggacattctggcagtgcaatgcaaaggcaattggttcaggctcagaaggagctgatagttcccttcaagagcaattcaacaaagatctgtcacttcaggaagctgagacgatcgctgtatcgatcctgaagcaagttatggaagaaaaggtgactccaaataatgtggacattgcgaaggtagcaccagcttatcatctctacactccacaagaagtcgaagcagtcattagtcgtctatgaggaagattctgtaatcgggtaatgtatccatccgacgtgtgtctactttggattttgaagccaagagacttttctttcactttgtctgttggattgatggatcatgtcacattttactctgttgtgtaagagaatctttcgtctcccatgtcattcaataacctctcggattttatgactcagaaatttcccttcttacca

SEQ ID NO: 1896 - DNA, 1085 bp, Arabidopsis lyrata
gtctcttcttcgatttccagatcaatcagctggtttgtttctctactctcaaatagttcattgagatgattttcctttgtttctgagtttctggattcatttagatccgtttgtttttctagggttttgattccgttgtgcgaaggacttagaggtttcgcagatcgaaatcgcaaaagaagaagaagatgtttctcactagaactgagtatgacagaggagtcaacactttttctccagaaggaaggctatttcaagtggaatatgccattgaagctatcaagcttggttctactgcaattggagtaaagacaaaagaaggagttgtgcttgctgtcgagaagcgtatcacttcgccattgctggaaccgagcagtgtggagaagattatggaaattgatgaccatattggttgtgctatgagcggtttaattgctgatgcgcgtacacttgttgagcatgctagagttgagactcaaaaccatagattctcgtatggtgaaccaatgactgtagagtccacaacacaagcactgtgtgatctggctttacggtttggtgaaggagaggaagaatcaatgtctcgtccatttggagtatcacttctcattgctggtcatgatgaaaacggaccaagcttgtactacacagatccttcaggaacattctggcagtgcaatgcaaaggcaattggttcaggctcggaaggagctgatagctctctccaagagcaattcaacaaagatttatctctacaagaagctgagacgattgctgtatcgatcctcaagcaagttatggaagaaaaggtgactccaaataatgtggatattgccaaggtagcaccagcttatcatctctacactccacaagaagtcgaagcagtcatcgctcgtctatgatggaaaaatctcaatttgggtaatttacctatccgcttgtgtcacaaaacttgttacttttgtctgtcagattgaggattcatatcagatttttagtctgttgtgtaagagaatcttttgtttgtctcccatgtcattcaataacctctcggatttgtgattagaaaatttcctttcctacca

SEQ ID NO: 1897 - DNA, 1003 bp, Arabidopsis thaliana
gagcaaaagcttctgtttattctccgattcgcagatcaattagctgggttttgattccgttgtgcgaaggactttaagaggttttgcagatcgaaatcggaagagaagaagaagatgtttctcactagaactgagtatgacagaggagtgaacactttttctccagaaggaaggctatttcaagtggaatatgccattgaagctatcaagcttggttctactgcaattggagtaaagacaaaagaaggagttgtgcttgctgtcgagaagcgtatcacgtcgccattgctggaaccgagcagtgtggagaagattatggaaattgatgaccatattggttgtgctatgagcggtttaattgctgacgcgcgcacacttgttgagcatgctagagttgaaactcaaaaccatagattctcgtatggtgagccgatgactgtagagtccacaacacaagcactgtgtgatctggctttacggtttggtgaaggagaggaagaatcaatgtctcggccgtttggagtatctcttctcattgctggccatgatgaaaatggaccaagcttgtactacactgatccttcaggaacattctggcagtgcaatgcaaaggcaattggttcaggttctgaaggagctgatagctctcttcaagagcaattcaacaaagatttgtctctacaagaagctgagactatcgctgtatctatcctaaagcaagttatggaagaaaaggtgactccaaataacgtggatattgccaaggtagcaccagcttatcatctctacactccacaagaagtcgaagcagtcatcgctcgtctttgattgaaaaaactcaatttgggtaatttacctatcagcttgtgtcacaaaacttgttacttttgtctgttagattgaggatcatgtcacattttagtcggttgtgtaagagaatcttttggctcccatgtcattcaataacctttcggatttgtgacttataaaatttcctttccta

SEQ ID NO: 1898 - DNA, 997 bp, Arabidopsis lyrata
gtcttcgggagctaaaaaggaactgggaagagttgtttcttcgatttcgtagatcaattttcagctgacattgaggtttgtgtcagatcgaaatcgagaagaagatgtttctcactaggactgagtatgacagaggagtcaatactttttctcctgaaggtcgtctctttcaggttgagtatgccattgaggctatcaagcttggttctactgctattggcgtaaagacgaaagagggggttgttcttgcagtcgagaagcgtattacttcgcctttgctggaaccgagcagtgttgagaagattatggaaattgatgaccatataggttgtgccatgagtggtctgattgctgatgcgcgaacacttgttgagcatgcacgagtagagacccaaaaccacaggttctcgtatggtgagccaatgactgtagaatctacaacacaagctttgtgtgatcttgctttacggtttggtgaaggagatgaagagtcaatgtctcgtccatttggagtatcccttctcattgccgggcatgatgaaaatggaccgagcctgtactacacagatccatcgggaacattctggcaatgcaacgcaaaggcaattgggtcaggctcagaaggagctgatagttctctccaagagcaattcaacaaggatataactcttcaagaagctgaaacaatcgctgtatctatcctaaagcaagtaatggaagaaaaggtgactccaaacaatgtcgacattgccaaagtagcacccgcatatcacctctacactcctcaggaggttgaagccgtcatcagtcgtctatgaagaaataaaccggcattctcttcatgttatcttacctggtctgtcgggtaatttagcaggcttggtatgcttccggttatctaaaccaaagaccttctttcacaaatggatcctatcgagttgagttttattgagctttctatctacattttttaatggtacacatgtttgttattcaa

SEQ ID NO: 1899 - DNA, 1181 bp, Solanum lycopersicum
aaaagaagaagaagaagaaggaataatcttcagttcaaacaaaatctgaacaaagggtttttggatctgtagcaaaatttcaacaaagatgtttcttacaagaactgagtatgatagaggtgttaacactttctcgcctgaaggacgattgtttcaagttgaatatgctattgaagctatcaagttgggttcaactgcaattggattgaagactaaggaaggagttgttcttgctgtggagaagcgcattacttcaccacttctggagccaagcagtgtggagaaaattatggaaatcgacgagcatattggctgtgcaatgagtggattgatagctgatgcacgaacacttgtggaacatgcacgggttgaaactcagaaccatagattctcttatggcgagcccatgactgttgagtccactacccaagctctctgtgatttggcgttgcgatttggtgagggcgatgaagaatctatgtccaggccttttggtgtgtcccttctcattgctggtcatgatgagaatggtcccagcttgtactatactgatccttctggtacattctggcaatgcaatgctaaagctattgggtcaggttctgaaggtgctgatagctctttgcaggagcagtataacaaggaccttacccttaaagaggctgaaaccatagcactgtccattctcaagcaagtgatggaagagaaggtgactcccaataatgttgatattgcgagggtatctccaacttaccatctatactcaccatcggaggtggaagaggttatcagccgcctataagaaagcatgtgatcacgctcgttatgatatttttcttgtatgacaaaaacactttcttgttgctgcagccctggagcctggaggtcattggattgttttttccttcttccaaggctaggaattgattcagacaagtgttttctgtatgttcattacattatttgcttcaaggatttaagtccatctatatctcttgctgctttatgagttgggatttgttctgaaaataggagttttaaagtgttttgaaagcaagaggcaagtacgatactgtgtaggattatataaataggggtttacattttcttgaatgaaatatttccaatgtatcttagtttaattggatacggaatttaaaaagtaatgaacttgcgatttt

SEQ ID NO: 1900 - DNA, 1289 bp, Phaseolus vulgaris
aaatagaagatcaagactagttttgggaatttaaaaaattatgggggtgtaggaagaaaaacgtaggctacaggaagaaactcccaaaaaaaaaagaattttcaagtcctcttgggaagctaactaggctcagtgaggagcgagtgagagagcaagcaaatcaagtgcccttttggtacctcgtgacccgaacaaaaagcttctcattctcatctcttctattttgcttctccttctgaattctgaagatgtttctcacaaggactgagtatgaccgaggagtcaacaccttttctcccgaaggccgtttgtttcaggttgaatatgcaattgaagcaatcaagcttggatcgactgcgattgggctgaagaccaaagagggtgttgtccttgcagttgaaaaacgcatcacttctcctctgctggagcctagtagtgttgagaaaattatggaaattgatgaccacattggttgtgctatgagtggattgattgcggatgctcgaacactcgttgagcatgcacgggttgaaactcagaatcataggttctcctatggtgaaccaatgaccgttgagtccactacccaagctctttgtgatctagccttgcgttttggtgaaggtgatgaagaatccatgtctagaccatttggagtatctctcctcattgctggacatgacgagaatggaccttgcttatattacactgatccatctggcacgttttggcaatgcaatggaaaagctatcggttctgggtcagaaggcgcagacagttctctacaagagcaattcaacaaggacctaacccttcaagaagccgagaccattgctttatccattttgaagcaagttatggaagagaaggtcactcccaacaacgttgacattgccagggtggctccaacatatcatctttataccccctctgaggtggaagctgtgataagtcgtctatgattttctttcgtgatttttcctaatttttaagtcttatgcgggaactttttttcgtggatgatgctacatgtggtgctacacttgtggccaagttgtacgctgtacgagattatggtgtcttattgaggactagccaaggattacaacttccaatgatcccggatgggggaaaccaaggaaaaacgaattacaaaatatgctattaaaaaaatttaagattttttttttcagccgttttttaatccttgtggaagaaaattgccttgatcgaatgtattatcttaaatacagtttgatgttagatagtttaaaaaattatcctatcgg

SEQ ID NO: 1901 - DNA, 956 bp, Arabidopsis thaliana
aaaggaactgggaagagtttgtttcttcgattcgtagatcaattctcagctgacattgaggtttatctcagatcgaaatcgagaagaagatgtttctcactaggactgagtatgacagaggagtcaatacattttctcctgaaggtcgtctctttcaggttgagtatgccattgaagctatcaagcttggttctactgctattggtgtaaagacgaaagagggagttgttcttgcagtcgagaagcgtattacttcgcctttactggagccgagtagtgttgagaagattatggaaattgatgaccatataggttgtgctatgagtggtctgattgctgacgcgcgaacacttgttgagcatgcacgagtagagacccagaaccacaggttctcgtatggtgagccaatgactgtagaatctacaacacaagctttgtgtgatcttgctttacggtttggtgaaggagaggaagagtcaatgtctcgtccatttggagtatcccttctcattgctgggcatgatgaaaatggaccgagcctgtactacacagatccatcgggaacattctggcaatgcaatgcaaaggcaattgggtctggctcagaaggagctgatagttctctccaagagcaattcaacaaggatataactcttcaagaagctgaaacaatagctgtatctatcctaaagcaagtaatggaagaaaaggtgactccaaacaatgtcgacattgccaaagtcgcaccagcttatcacctctacactcctcaggaggttgaagccgtcatcagtcgtctatgaagaaataaaccgccattctcttcctgttatcttaccttgtctgttcggtaatttatcaggcttctgtctgcttccggttctctaaaccaaaaattagtttcgtttaatcagataatggattttatcgagttgagttttattgagctttctatc

SEQ ID NO: 1902 - DNA, 908 bp, Triphysaria pusilla
agttctcgccagtacatttcgaagctttaatttgctggattaaaatgtttctcacaagaactgagtatgatagaggagtaaacactttctccccggagggccgcttgtttcaagttgaatatgcgattgaggctataaagttgggttcgactgcaattgggattaagaccaaggaaggagtggttcttgctgttgaaaagcgcattacgtcaccacttttggagccaagcagtgtcgagaaaattatggaaattgatgcacatattggttgcgccatgagcggcttaatagctgatgcacgtacgcttgttgaacatgcccgggttgaaactcagaatcataggttttcatatggtgaacccatgactgttgagtccactacacaagctctttgtgatcttgccttgcgttttggtgagggagacgaagaatcaatgtccaggccatttggtgtgtctcttctcattgctggtcatgatgagaatggtcccagtctatactatactgacccgtctggtacattctggcaatgtaatgcaaaagccatcggatcaggttcggaaggcgctgacagctcattgcaagagcagtttaataaggatctaactctgaaagaagctgaaacaactgcactttccatcctcaagcaagttatggaggaaaaggttacgcccaacaacgtcgatattgctaaggtatcaccaacataccatctttactccccttctgaggttgaagcagttatcggacgcctatgagaaaaaaatgtgcccttctatcagtctttttaaccttttctgcctatgatacacatttttatttatgtaatgcttgaaacgagctttgtactactactttaaatgttttgccaagtttcgaataactgtgatttagtctgttaactttct

SEQ ID NO: 1903 - DNA, 956 bp, Triphysaria pusilla
tagtgcatttcgaagctttaatctgcaaaatgttcctcacaaggactgagtatgatagaggagtaaacaccttctccccggagggccgattgtttcaagttgaatatgcgattgaggctatcaagttgggttcaactgctattgggattaagaccaaggaaggagtggttcttgctgttgagaagcgcataacttcgccacttttggagccgagcagtgttgagaaaattatggaaattgatgcacatattggttgtgccatgagtggtttaatagctgatgcacgtacactagttgaacatgcccgagttgaaactcagaatcataggttctcgtatggtgaacccatgactgttgagtccactacacaagctctttgtgatcttgccttgcgatttggtgagggggacgaagaatcaatgtccaggccatttggtgtgtctcttctcattgctggtcatgatgagaatggtcccagcctattctatactgatccatctggcacattctggcaatgtaatgcaaaagctatcggatcaggttccgaaggcgctgacagctctttgcaagagcagtttaataaggatctaactctaaaagaagctgaaacaattgcactatctatccttaagcaagttatggaggaaaaggttacacccaacaacgttgatattgctaaggtgtcaccaacataccatctttactccccttctgaggttgaagcagttatcggacgcctatgataaaagatgagtccgtctatctatttttcagccttttcgcctatgatcctcatttttatttatgtaacgcttgaatgagttttgtactgttttaaatgctttgccaagcgtcgaataactgaggtgtagtctgttttaactttctcaagatttctaatcactctattgtattcgtaaaacttcttatcagacattttctctggcctttctggt

SEQ ID NO: 1904 - DNA, 1028 bp, Triphysaria pusilla
gctctctattcagatccaatttgttgttgtttaattttctcaaatttaactcacaccttatagttctcggcagtgtatctcgaagctttaatttgctggatcaaaatgtttctcacaagaactgagtatgatagaggagtaaacactttctccccggagggccgattgtttcaagttgaatatgcgattgaggctatcaagttgggttcgactgcaattgggattaagaccaaggaaggagtggttcttgctgttgagaagcgcattacgtcaccacttttggagccaagcagtgttgagaagatcatggaaattgatgcacatattggttgtgccatgagcggcttaatagctgatgcacgtacactcgttgaacatgcccgggttgaaactcagaatcataggttctcatatggtgaacccatgactgttgagtccactacacaagctctctgtgaccttgccttgcgttttggtgagggggacgaagaatcaatgtccaggccatttggtgtgtctcttctcattgctggtcatgatgagaatggtcccagcctatactatactgacccgtctggtacattctggcaatgtaatgcaaaagccatcggatcaggttcggaaggcgctgacagctcattgcaagagcagtttaataaggatctaactctgaaagaagctgaaacaactgcactttccatcctcaagcaagttatggaggaaaaggttacgcccaacaacgtcgatattgctaaggtgtcaccaacataccatctttactccccttctgaggttgaagcagttatcggacgcctatgagaaaagattgtgcccgtctatcagtctttttaaccttttctgcctatgatacgcatttttatttatgtaatgcttgaaagagttttgtactgttttaaatgttttgccaatcgttgaataactgcgatttagtctgttaactttctgatttctcatcactcaactgtattcgtaaaacttcttatcagacattttctctggcctttctg

SEQ ID NO: 1905 - DNA, 1177 bp, Solanum lycopersicum
cgggttagaaaatctgacccggaaataccgaagcaagcaacactccaaatacactatttctgcagaaatggcttgtcactcaagttaaaaacaagtagaacaaatcgattctcagtcagttcttagctatcccggactctcaaagctgtgacgaatcagatcgaagatgtttctcactagaaccgagtatgatagaggtgtcaacactttctcgcccgaaggaaggttgtttcaagttgaatatgctattgaagccattaagttgggttcaacggcaattgggataaagaccaaggaaggagttgttcttgctgttgagaagcgaattacctctccacttctggagccaagcagtgtggagaaaattatggaaattgatgagcatattggatgtgcaatgagtggactgatagctgatgcaaggactctggttgaacatgcacgagttgaaactcagaatcacagattctcttacggcgagcccatgactgttgagtccaccacacaagctctgtgtgatttggccctgcgatttggtgagggtgatgaagagtctatgtccagaccttttggagtatcacttctcattgctggtcatgatgagaatggtcctagcttatactatactgatccttctggcactttctggcaatgcaatgcaaaagccattggttcaggttcagaaggtgctgacagctctcttcaggagcaattcaacaaggaccttaccctcaaggaggctgaaaccatagcgctgtcaattctgaagcaagtgatggaagaaaaggtgactcccaataatgttgatattgcgagggtatcaccaacttatcacctctactccccttctgaggtggaagatgttatcagccgcctataagaagaaaacgctcttgttatgcttgtacccaattctctgttatgggcaatgtttgctttcaattgttctagaatttgtgaattgttttgccccttcaagcatgatatattgttagctttgagttccattttccttcaaggacaaagctcaaaccctttatgttgcttgacaaaattcggtacaatgggataagattatttggctacgggcttaagattgcagtaaaattacgttttaatgttattttgtttcgtaaggacatgatggagtcttagtttgaaacatggttgtggtaga

SEQ ID NO: 1906 - DNA, 1034 bp, Triphysaria pusilla
aaagctctctattcagatccaatttgttgttgcttaattttctcaaatttaactcacaccttatagttctcggcagtgtatctcgaagctttaatttgctgggtcaaaatgttcctcacaaggactgagtatgatagaggagtaaacactttctccccggagggccgattgtttcaagttgaatatgcgattgaggctatcaagttgggttcaactgctattgggattaagaccaaagaaggagtggttcttgctgttgagaagcgcataacttcgccacttttggagccgagcagtgttgagaaaattatggaaattgatgcacatattggttgtgccatgagtggtttaatagctgatgcacgtacactagttgaacatgcccgagttgaaactcagaatcataggttttcatatggtgaacccatgactgttgagtccactacacaagctctttgtgatcttgccttgcgatttggtgagggggacgaagaatcaatgtccaggccatttggcgtgtctcttctcattgctggtcatgatgagaatggtcccagcctattctatactgatccgtctggcacattctggcaatgtaatgcaaaagctatcggatcaggttcggaaggtgctgacagctctttgcaagagcagtttaataaggatctaactctaaaagaagctgaaaccactgcactttccatccttaagcaagttatggaggaaaaggttacacccaacaacgttgatattgctaaggtgtcaccaacataccatctttactccccttctgaggttgaagcagttatcggacgcctatgataaaagatgagtccgtctatctgttctttagccttttcgcctatgatcctcatttttatttatgtaatgcttgaacgagttttgtacacttttaaatgttttgccaagcgtggaataactgcggtttagtctgtttaactttctcaagatttctcatcacttgactgtattcgtaaaacttcttatcagacattttttctggtctttctggt

SEQ ID NO: 1907 - DNA, 967 bp, Arachis hypogaea
aagcagtggtatcaacgcagagtacggggggagcaagcaaagcaaagccaagccaataagcaaaagcccacatcgccgctcttcactcctcagaggcgcaaagatcaagagacagtataagctgagcaagttgaagccatttttgggcaagtgtgatttcatcgaatcaaatcgaagatgttcctcacaaggaccgagtatgaccgaggagtcaacaccttttctcctgaaggccgtttgtttcaggttgaatatgcaattgaggccatcaagctgggttcaactgctattgggttgaagacaaaacacggtgttgtccttgcagttgaaaagcgtatcacttcaccgctactggaacctagcagtgtggaaaagattatggaaattgacgaacatataggttgtgcaatgagtggattgattgctgatgctcgaacacttgttgagcatgcacgagtggaaactcagaatcataggttctcctatggtgaaccgatgactgtagagtctaccacccaagcactttgtgatttggccttgcgttttggtgaaggcgatgaagagtccatgtctcgaccatttggagtttctcttcttattgctggacgtgatgagaatggacctagtttatattacactgacccatctggaacattttggcaatgcaatgcaaaagctattggatcagggtcagaaggagcagatagttctctgcaagaacaatacaacaaggaccttactcttgaagaagcagagactattgctttatccattctgaagcaagttatggaagagaatgtaactcccaacaacgtggacatcgctaaggtgtccgaaaaatatcatctttatactccggctgaggtgtaagctgtgataagtcccctaatgaatccctcttgtgggatttgctatcaattgccattgtttccattccttgaaacccatcctggccttgactacagat

SEQ ID NO: 1908 - DNA, 1238 bp, Chenopodium quinoa
cttagtgtttggacatatttttgaagctcaaaattagtagctcaagaacactagagggggattctcactaattcagctctacaattcgcaataagatcggttcgtcctctttaatctttcgtaggacatttgtttttctgctataattgagtaaggatgtttctcaccaggactgagtatgacagaggagtcaacaccttttctcctgaagggagattgtttcaagttgaatatgcaattgaagctatcaagttgggttcaactgcaattgggataaggactaatgaaggtgttgtgcttgctgtcgaaaaacgtatcacctctccattactggagcctagcagtgttgaaaaatcatggaaattgatgagcatattgggtgtgctatgagtggattgattgctgatgctcgcacacttgttgagcatgcaagggtggagacccagaatcacagattctcttatggtgagccaatgaatgttgaatctaccacacaagctttgtgtgatctagcattgcgctttggagaaggagacgaagaatcaatgtcccgtccttttggtgtatctcttctcattgcaggtcatgatgaaaatggacccagcttgtatcatacagatccatctggtacattttggcagtgcagtgctaaggctattggttctggttctgaaggtgcagacagcaatttgcaggagcaatatagaaaggatttgacatttcaagaagctgagaccatagctctttcgaccttgaagcaggttatggaggaaaaggtgacaccaaacaatgttgacattgctaaggtttccccaacctaccacttgtatactcctgctgaagtggaagctgtcattgctcgcctatgagaagcaccctactttcaactgccgttcctatcttgaatacttcctatttgaccggcattgatatactttctagagcttagattggggaaatgatgtttgcttccttctgaattagagaaaacgttgccggggacttattcgaactcttatttaaatgtattcaaagttactgttaaagaacttagtacttcctatttggccggcattgatatgctatctagagcttagttcggggtaatgatgtttgcttccttctgaatcagagacagtatgttgccgggaacttattcgaactcttatttggatgtattcaaagttgctgttaaagaacttgagataggaaattaattgctaatttttttatgctac

SEQ ID NO: 1909 - DNA, 993 bp, Chenopodium quinoa
ggacatttgttttctgctataattgagtaaggatgtttctcaccaggactgagtatgacagaggagtcaacaccttttctcctgaagggagattgtttcaagttgaatatgcaattgaagctatcaagttggttcaactgcaattgggataaggactaatgaaggtgttgtgcttgctgtcgaaaaacgtatcacctctccattactggagccgagcagtgttgaaaaaatcatggaaattgatgagcatattgggtgtgctatgagtggattgattgctgatgctcgcacacttgttgagcatgcaagagtggagacccagaatcacagattctcttatggtgagccaatgaatgttgaatctaccacacaagctttgtgtgatctagcactgcgctttggagaaggagacgaagaatcaatgtcccgtccttttggtgtatctcttctcattgcaggtcatgatgaaaatggacccagcttgtatcatacagatccatctggtacattttggcagtgcagtgctaaggctattggttctggttctgaaggtgcagacagcaatttgcaggagcaatatagaaaggatttgacctttcaagaagctgagaccatagctctttcgaccttgaagcaggttatggaggaaaaggtgacaccaaacaatgttgacattgctaaggtttccccaacctaccacttgtatactcctgctgaagtggaagctgtcattgctcgcctatgagaagcaccctactttcaactggcgttcctatcttgaatacttcctatttgaccggcattgatatactttctagagcttagattggggaaatgatgtttgcttccttctgaattagagaaaacgttaccggggacttattcgaactcgtatttgaatgtattcaaagttactgttaaagaactcagtacttcctatatggccggcattaatatgctatctagagcttagttcggggaaatgatgtttgc

SEQ ID NO: 1910 - DNA, 1002 bp, Chenopodium quinoa
caactgtgtaaaagtgaggtagcatttgttgcttttcccttttcttgcatgacaagatttcaatcttattctaaattccacaattactttgttttagacacatttttgaagctcaaaattagtagctcaagaacactaaaggggattctcacaaatacagctctacaattcgcaataacatcggacatttgtttttctgctataattgaataaggatgtttctcaccaggactgagtatgacagaggagtcaacaccttttctcctgaagggagattgtttcaagttgaatatgcaattgaagctatcaagctaggttcaactgcaattgggataaggaccaatgaaggtgttgtgcttgttgtcgaaaaacgtatcacctctccgttactggagcctagcagtgttgaaaaaatcatggaaattgatgaacatattgggtgtgctatgagtggattgattgctgatgctcgcacacttgttgagcatgcaagagtggagacccagaatcacagattctcttatggtgagccaatgaatgttgaatctaccacacaagctttgtgtgatctagcactgcgttttggagaaggagacgaagaatcaatgtcccgtccttttggtgtatctcttctcattgcaggtcatgatgaaaatggacccagcttgtatcatacagatccatctggtacattttggcagtgcagtgctaaggctattggttctggttctgaaggtgcagacagcaatttgcaggagcaatatagaaaggatttgacctttcaagaagctgagactatagctctttcgaccttgaagcaggttatggaggaaaaggtgacaccaaacaatgttgacattgctaaggtttccccaacctaccacttgtatactcctgctgaagtggaggctgtcattgctcgcctatgagaagcaccctactttcaaatggcattcctatctttagtacttcctatttgaccggcattgatatactttctag

SEQ ID NO: 1911 - DNA, 882 bp, Echinacea purpurea
aggttgtttcaggttgaatatgctatagaggccatcaagttgggttctacggctatcgggttgaagaccaaggaaggggttgttcttgcggttgaaaagcgtatcacctctccacttctggagcctagtagtgttgagaagattatggaaatcgatgagcacattggttgtgccatgagtggattaattgctgatgcccgtacactcgttgaacatgcacgagttgagactcagaatcataggttttcctatggtgagccgatgactgttgagtcaacgacccaagctctgtgtgatctggcactgcgatttggtgaaggagatgaagaatccatgtctcgaccttttggagtatctcttcttattgcaggccatgatgaaaatggtcccagtctttactatacggacccatcaggcacattctggcaatgcaatgcaaaagctatagggtcagggtctgaaggtgctgacagctctctgcaggagcaatataacaaggacttgagtctgaaggaagctgaaacaattgctctttccatcttgaagcaagttatggaagaaaaggtaactcccaataatgtggatattgcaaaggttgcgcctacttatcatttgtacactccggctgaggttgaagctgttatcagtcgcctatagatcttgagtggagtcttatttgatcaattgtagacggtgtctgtttggtttggttttctttgacatgtattttgtactaaacagctaaaattttatcctgcttcccttgttaagtatggtatttgaacacaaggtccatgttatgtttatcgacgaaatcatggtggagttatgtttcaacaaaaccaagttgattctatctgtaggtagcgaatgatgacatgg

SEQ ID NO: 1912 - DNA, 1095 bp, Physcomitrella patens
cacacgcacagagtgcgggctctgatatttcactgttttgctcaactgtgccgatctgcgtcttcctcgcatcgccgaatccgtcaccatgtttcttaccaggagtgagtatgacagaggtgtcaatacgttctcgccggaggggcgtcttttccaagtggagtatgctattgaagctatcaagcttggttcaacggcagtaggattgaagaccaaggagggtgttgtcttggctgttgagaaacgaattacctcagttttactggaacccaccagtgtcgagaagatcatggaaatcgatgagcatattgggtgtgcgatgagcggactaactgcggatgctcgcacgcttgttgagcatgggcgtgtggaaacgcagaatcacagattctcctacaatgagccaatgagtgtagaatctactacacaagctctgtgcgatctggctttgcgctttggagaaggcgatgaagaatcaatgtcacgtcctttcggagtctcactgcttattgctggtcatgatgaaagtggaccatgcttgtatcacacagacccatctggaacattttggcaatgtgatgctaaggcaatcggttcaggatcagaaggtgccgacacttccctccaggagcacttcaacaagaatatgacgctggaggaagctgagactttggcactgtctaccttaaagcaagtcatggaagaaaaggtaacatcttctaatgtggacattgctaaggtggctcccaagtatcatttgtactcacccgaagaagttgaggctgttatacagcgattgtaatcatctgggtagatcaaaactcgaagtttcagaacttgaggatgcggttcttcggcagcacgtacatttcataagctcttattgcagactcttcaatcctaagattatctttcacttagattcaagcttctacgttcgtggaactgttcagagtgcagagctctgttacaggtggccatggctcggactccagtaattggttaaagttgggtattcattttgagtatatgtactaattcaaattgggtaactggagtccatttttgagaagaccgtttccagtgttctttcta

SEQ ID NO: 1913 - DNA, 997 bp, Physcomitrella patens
agctcaaagagagctttgagtgattgtagggttccgaggcacagattgctgcgacatagagagcgagagagagagctttctgcttcttcacttggccccaaaccttgctcatcttcatcagccaagcctccaccatgttcctcaccaggagtgagtatgatagaggtgtcaatacgttttctcccgaggggcgcctctttcaagtggagtacgccattgaagctattaagcttggttccacggcagtgggattgaagaccaaggagggagttgttttggccgtcgagaagcgaataacctcagttttgttggaacccaccagtgtcgagaagatcatggaaatcgatgaacatattgggtgtgccatgagtggtctcactgcggatgctcgcacacttgttgaacatggccgtgtggaaactcagaatcataggttctcgtataatgagcctatgagtgtggagtctactacacaagccctgtgtgatctggctttacgttttggggaaggcgacgaagaatcaatgtcacgtcctttcggagtttctctgctcattgctggccatgatgagagtggaccatgcttgtaccacacagatccatctggaacattttggcaatgtgatgctaaggcaattggttcaggatcagaaggtgccgatacttcccttcaggaacatttcaacaagaacatgacgctggaggaagccgagacattggcgttgtctaccttgaagcaagtcatggaagaaaaggtaacttcctgtaatgtggatattgctaaggtggctcccaagtatcatttgtacacacccgaagaagttgaggttgttatacaacgattgtaattatctgggtagttgaatactcgagaatgccgtttttcgattcatgagctatccattcaaatattggtttaattagtagcgaatgtgttcattttctatggtataacttgaaccttctgcactttttttaattaatttttttatggtct

SEQ ID NO: 1914 - DNA, 859 bp, Festuca arundinacea
aagcaaaccgcgcgccaccatgttcctcacgaggacggagtacgaccgcggcgtgaacaccttctccccggaggggcggctgttccaggtcgagtacgccatcgaggccatcaagttgggctctactgctattgggctgaagacgaaggatggggttgttcttgctgtggagaaacgtgtgacatctccgttgctggaacctagcagtgttgagaaaattatggaaattgatgagcatgttggttgtgccatgagtggccttattgctgacgcgaggacattggttgagcatgctcgtgtggagacccaaaaccatagattctcatatggggaaccaatgacagttgagtccaccacacaagctatttgtgatctagctcttcgctttggagaaggtgaagaagagtcaatgtcacgaccttttggagtttctctccttattgctggtcatgatgaaaatggtcccagtttgtactacaccgacccatctggaaccttttggcagtgcaatgccaaggcaattggatcgggctctgaaggtgctgatagctctttacaggagcagtttaacaaggagctgacccttgaggaggctgaaagcattgctctatctatcctgaagtaggttatggaagaaaaggtaactccaaacaatgttgacatcgccaaggtcgcgccgaactaccacctctacacccctgcagaggtcgaagcagtcatagcacgtctgtgaaaacagataaatctttatctatgccaactcggattcatatactcctgcagtcctgctgatgtgtgtttggcatccgtttaattagcataagcacgattgctcttttgtcttgacactgatgtctac

SEQ ID NO: 1915 - DNA, 712 bp, Nuphar advena
  misc_feature (693)..(693): n is a, c, g, or t
atttcgtagtagcgatctactgcgattttcagggaataacttgggcagcaaggaacatctaccgcctcggagagatatttggtggtttctgaggtttaggtaatcggaaaaatgtttctcaccaggactgagtacgatagaggcgtgaacacgttctcgcctgaagggcgattgtttcaggtcgaatatgcgatcgaggcaatcaagttgggttcaactgcaattggaataaagaccaaggacggcgtagtattggcagttgagaagagaattacttccccattactggagcctagtagtgtggagaagatcatggagattgatgagcatattggatgtgcaatgagtggacttattgccgatgctcgcacactagttgagcatgcacgggttgaaactcagaaccacaggttttcatatggtgaaccaatgactgtggagtccactacccaagcactttgtgatcttgctcttagatttggtgaaggtgatgaagagtccatgtctcgtccatttggggtatctcttttgattgctggccacgatgagaatggacccagcctatactacacagatccatctggcacattttggcagtgcaatgctaaagccattggatctggttctgagggagctgacagttccttgcaagaacaatacaataaggatatatctcttctagaagcagagaanattgctctttccattttga

SEQ ID NO: 1916 - DNA, 669 bp, Acacia harpophylla
gactgctgctcacccgccagccacttccaggattactagattttccatcagcgatctcatttgatcagaacgaagatgtttctaacaaggactgagtatgaccgaggagtaaacacgttttctcctgaaggccggctatttcaggttgaatatgctattgaagccatcaagctgggatcaactgcaattgggttgaagacaaaagaaggtgttgtccttgcagttgaaaagcgtatcacttcaccactgttggagccaagcagtgttgagaaaatcacggaaattgatcagcacatgggttgcgcaatgagtggactaattgctgatgctcgaacacttgttgagcatgcgcgagtcgaaactcagaatcataggttctcctatggggagccaatgactgttgagtcgacaacccaagctttgtgtgatctagccttgcgatttggtgaaggtgatgaagaatcaatgtcacgaccatttggagtgtctctcctcattgctggccatgatgagaatggacctagtttatactatactgatccatcaggaacattttggcaatgcaatgctaaagctattggttcaggctcagaaggagcagacagttctctgcaagaacaatataacaaggaactaactcttcaagaagctgaggctattgctctatcg

SEQ ID NO: 1917 - DNA, 1373 bp, Arabidopsis lyrata
agatcgagagctttcgcaaaactcgtttcttccttccttccatcatcgtcttcgtctctgctgcttccgccatggctgctcttcaatacttggaatctctgaaaaatgcccatccagagctcggtgaatggtacaattcccttgcagatctgtatcagaaaaagctctggcatcaactcacccttaagctcgaacagttcatcgctctcgctgtctttcaggctggtgatgctctaattcagttctatcacaatttcatcactgactttgagacgaagatcaatcttctgaagcttgcgcattttgctgtggtggtctctcgacagtactctgagaaagaagctgcagttagctatcttgaaagtgtgattgagaagcttagagctactaaagagcctcggattactgaaccaatcatttatattgaaacacaaaaagctctgttcaagcttgagcaaggtgatcagaaggagtgcaagaaaatcttggacgatggaaagagctctcttgatagtatgactgacattgatccatcggtctatgccaacttctattgggtgtcttctcagtaccataagtcccgtcaagaattttctgatttctacaaaagtgctctactttatcttgcatacacgtccgtggaggacctctcagaatcgtttaagctggatttggctttcgatttgtcactttcagctctacttggggagaacatctataactttggggaactgttagcccatcccattttgaaaagtctccttggaacaaatgtggaatggctctaccacattctacaggcattcaaccatggtgatttagttcagtatcaagaactatgccgtgtgcacaacgcatccttgattgcccaaccagcactggttgagaacgagaagaagcttttggaaaagatcaacattctctgccttatcgagatcatcttcagccgacccgctgaagatagaaccatccctttgagtatcatcgctgagcgtactaaactttccattgaagatgttgagcaccttctcatgaagagcctttctgtgcatctaattgagggcatcatagaccaagtgaatggaacagtttacgtctcatgggcgcaaccgagagtactagggattccacagatcaaggctttgagggatcaattggacagttgggttgacaaagttcacaccactttgctatctgttgaagccgagacaccagatcttgttgccgcataagaaagaaaaaaccttctacttactgaatgtagtaactcttctctggggagctttttttatttcagtggtagaaatttcaattactacttctgaaccttttagctcccatttcaatatgtccgaaatttaagttctaaattt

SEQ ID NO: 1918 - DNA, 1476 bp, Arabidopsis lyrata
gagaaaagggtttttaggattcttcttttaacgcagagcttgaaatatataagagatcgagagctttcgcaaaactcgtttcttccttccttccatcatcgtcttcgtctctgctgcttccgccatggctgctcttcaatacttggaatctctgaaaaatgcccatccagagctcggtgaatggtacaattcccttgcagatctgtatcagaaaaagctctggcatcaactcacccttaagctcgaacagttcatcgctctcgctgtctttcaggctggtgatgctctaattcagttctatcacaatttcatcactgactttgagacgaagatcaatcttctgaagcttgcgcattttgctgtggtggtctctcgacagtactctgagaaagaagctgcagttagctatcttgaaagtgtgattgagaagcttagagctactaaagagcctcggattactgaaccaatcatttatattgaaacacaaaaagctctgttcaagcttgagcaaggtgatcagaaggagtgcaagaaaatcttggacgatggaaagagctctcttgatagtatgactgacattgatccatcggtctatgccaacttctattgggtgtcttctcagtaccataagtcccgtcaagaattttctgatttctacaaaagtgctctactttatcttgcatacacgtccgtggaggacctctcagaatcgtttaagctggatttggctttcgatttgtcactttcagctctacttggggagaacatctataactttggggaactgttagcccatcccattttgaaaagtctccttggaacaaatgtggaatggctctaccacattctacaggcattcaaccatggtgatttagttcagtatcaagaactatgccgtgtgcacaacgcatccttgattgcccaaccagcactggttgagaacgagaagaagcttttggaaaagatcaacattctctgccttatcgagatcatcttcagccgacccgctgaagatagaaccatccctttgagtatcatcgctgagcgtactaaactttccattgaagatgttgagcaccttctcatgaagagcctttctgtgcatctaattgagggcatcatagaccaagtgaatggaacagtttacgtctcatgggcgcaaccgagagtactagggattccacagatcaaggctttgagggatcaattggacagttgggttgacaaagttcacaccactttgctatctgttgaagccgagacaccagatcttgttgccgcataagaaagaaaaaaccttgttcgtcttcctcttcctccttttgaagctacttactgaatgtagtaactcttctctggggagctttttttatttcagtggtagaaatttcaattactacttctgaaccttttagctcccttaaggatgtccatttcaatatgtccgaaatttaagttctaaatttttgacttttt

SEQ ID NO: 1919 - DNA, 1537 bp, Eutrema halophilum
gagaagggtttttaggattttttacgcccagctttgatataagatcgatttccttcatcttcgttctgcttcgtcgagaaattatccgccatggctgctcttcaatacttggaatctcagaaaaatgcgcatcctgagctcggcgaatggtacaattcccttgcggatctgtatcagaaaaagctctggcatcagctcacccttaagctcgaacagttcatcgctctcgctgtctttcaggctggcgatgctttgatacagttctataacaatttcatcactgactttgagacgaagatcaatctcctgaagcttgcgcattttgctgtggttgtctcccggcagtaccctgagaaagaagctgcagttaactatcttgaaggagtgattgagaaactcagagccactaaagagcctcggataactgaaccgatcatttatatagaaacacaaaaggctttattcaagcttgagcaaggggaccagaaagagtgcaagaaaatcttggacgatgggaagagctctcttgatagtatgactgacatcgatccgtcggtctatgccaacttctattgggtttcttctcagtaccataagttccgtcaagaattttctgatttctacaaaagtgctctactttatcttgcttatacgtctgtggaggcactctcagaatcctttaagctggatttggctttcgatttgtcactttcagctctacttggagaaaacatctacaactttggagaactgttggcccatcccattttgaaaagtctccttggaacaaatgtggaatggctttatcacattctccaggcattcaaccatggtgatttagttcagtaccaagaactgtgccgtgtgcaccacgcgtcattgattgcccaaccagcactggttgagaatgagcagagactactggaaaagatcaacattctctgccttatcgagatcatcttcagccgacctgctgaagataggaccattcctttgagtgtcattgctgagcgtactaaactttccattgaagatgttgagcaccttctcatgaagagcctttctgtgcatttgattgagggcattatagatcaagtgaatggaacagtttacgtctcatgggctcaaccaagagtattggggattccacagatcaagtccttgagagatcaattggacagttgggtcgacaaagttcacaccactttgctatccgttgaagctgagacaccagatcttgttgcagcataagaaaccttcttcttctacttgggtcttttttcttcttcttcattttgaagcgactgattgtaactttctgtgggattaacgcaagtttttatttcagtattagaaattacaattgctctctcttttgttccatttcaagattctctttttaacccgttgtttgcccaccataatgtgcaaattggaatcaaagatactactcctatgttttgtgttatataacgaatcagaagttgtaaagagaagccatataaaattcatggaaatatataattcagtttactcc

SEQ ID NO: 1920 - DNA, 1450 bp, Eutrema parvulum
cttttttttaaagcacagctcagatataagatcgaattcgagactcgtttcttccttcatcttcttcgtctacttctgcgaggcaaaaaaaacaaaaattcgccatggctgcacttcaatacttggaatctctgaaaaatgctaatccagagctcggtgaatggtacaattccatcgcagatctgtatcagaaaaagctatggcatcagctcacccttaagctcgaacagttcatcgctctcgctgtctttcaggctggcgatgctttgatacagttctataacaatttcatcactgactttgagacgaagatcaatctcctgaagcttgcgcattttgctgtggttgtctcccgacagtaccctgagaaagaagctgcagttagctatcttgaaggagtgattgagaaactcagagccactaaagagcctcggataactgaaccgatcatttatatagaaacacaaaaggctttattcaagcttgagcaaggggaccagaaagagtgcaagaaaatcttggacgatgggaagagctctcttgatagtatgactgacatcgatccgtcggtctatgccaacttctattgggtttcttctcagtaccataagttccgtcaagaattttctgatttctacaaaagtgctctactttatcttgcatatacgtctgtggaggcactctcagaatcgtttaagctggatttggctttcgatttgtcactttcagctctacttggagaaaacatctacaactttggggaactgttggcccatcccattttgaaaagtctccttgggacaaatgtggaatggctttaccacattctccaggcattcaaccatggtgatttagttcagtatcaagaactgtgccgtgtacaccatgcatccttgattgcccaaccagcactggttgagaatgagaagaaactattggaaaagatcaacattctctgccttatcgagatcatcttcagccgacccgctgaagataggaccattcctttgagtgtcattgctgagcgcactaaactttcgattgaagatgttgagcaccttctcatgaagagtctttctgtgcatctgattgagggcattattgatcaagtggatggaacagtttatgtgtcatgggcgcaaccaagagtattggggattccacagatcaagtctttgagggatcaattggacaattgggtcgacaaagttcacaccactttgctatccgttgaagctgagacaccagatcttgttgcggcataagagaaacataccttcttccttttggagctactgattgtaactttctctgggattaaatgcgagttcttttttaatttatttcagtggtagaagttacaattgctttggattattgttccaatttcaaaaattctctttttaacccgtttcttgccgctatattgttgcaaatggacttggagata

SEQ ID NO: 1921 - DNA, 1526 bp, Eutrema parvulum
ttttttttaaagcacagctcagatataagatcgaattcgagactcgtttcttccttcatcttcttcgtctacttctgcgaggcaaaaaaaacaaaaattcgccatggctgcacttcaatacttggaatctctgaaaaatgctaatccagagctcggtgaatggtacaattccatcgcagatctgtatcagaaaaagctatggcatcagctcacccttaagctcgagcagttcatcgctctcgctgtctttcaggctggcgatgctttaatacaattctatcacaatttcatcactgactttgagacgaagatcaatcttctgaggcttgcgcattttgctgtggtagtctcccgacagtattccgagaaagaagccgcagttggctatctcgaaggagtgattgagaaacttaaagccactaaagagccccggataactgaaccaatcatttatatagaaacacaaaaggctttgttcaagcttgagcaaggtgatcagaaggaatgcaagaaaatcttggacgatggaaagacctctcttgatagtatgactgatattgatccatctgtctacgccaacttctattgggtgtcttctcagtaccataagttccgtcaagaattctctgatttctacaaaagtgcgctactttatcttgcatatacgtctgtggaggcactctcagaatcgtttaagctggatttggctttcgatttgtcactttcagctctacttggagaaaacatctacaactttggggaactgttggcccatcccattttgaaaagtctccttgggacaaatgtggaatggctttaccacattctccaggcattcaaccatggtgatttagttcagtatcaagaactgtgccgtgtacaccatgcatccttgattgcccaaccagcactggttgagaatgagaagaaactattggaaaagatcaacattctctgccttatcgagatcatcttcagccgacccgctgaagataggaccattcctttgagtgtcattgctgagcgcactaaactttcgattgaagatgttgagcaccttctcatgaagagtctttctgtgcatctgattgagggcattattgatcaagtggatggaacagtttatgtgtcatgggcgcaaccaagagtattggggattccacagatcaagtctttgagggatcaattggacaattgggtcgacaaagttcacaccactttgctatccgttgaagctgagacaccagatcttgttgcggcataagagaaacataccttcttccttttggagctactgattgtaactttctctgggattaaatgcgagttcttttttaatttatttcagtggtagaagttacaattgctttggattattgttccaatttcaaaaattctctttttaacccgtttcttgccgctatattgttgcaaatggacttggagataacaaatgggattagagacgtagaacgaacgagagtgtttcttttgttaatccaatttgctgcttaatcatattttct

SEQ ID NO: 1922 - DNA, 1441 bp, Brassica napus
ggtttgaagattattatttattttcacaaaacccttttctttttctttacgcacagctctgatataagattgaatccaccacaacactacgtcttcatcttcttctgcgaagcgaaatcattttccgtcatggcagctcttcaatacttggaatctctgaaaagctctcacccagagctcaacgaatggtacgattccctatcagatctgtatcagaaaaagctatggcatcagctcaccctcaagctcgagcagttcatcgctctctccgtctttcaggctggagatgcgttgatacagttctaccacaacttcatcaccgacttcgagacgaagatcaacctcctcaagctcgcgcacttcgctgtggtggtctcacgtcagtactctgagaaagaagctgcggttagctatcttgaaggagtgattgagaagcttaaagctactaaggagcctcggatcactgaacctatcgtttacattgagacgcaaaaggctttgttcaagcttgagcaaggtgatcagaaggagtgcaagaaggtcttggacgatgcgaagacctctcttgatagcatgactgatattgatccttcggtgtatgctaacttctactgggtgtcttctcagtaccataagtgccgtcaggagttctctgatttctacaaaagtgctctgctttatctcgcgtatacctctgtggaggcgctctctgaatcgtttaagctggatttggcttttgatttgtcactctcagctctacttggagaaaacatctacaactttggggaactcttggcccatcccattttgaaaagtcttcttggaacaaatgtggaatggctttaccacattctccaagcattcaaccatggtgacttagttcagtatcaagaactgtgccgtgtgcaccatgcatccttgattgcccagccagctctggttgagaatgagaagaaactattggagaagatcaacattctctgtctgatcgagatcatcttcagccgacctgctgaagataggaccattcctttgactgtcattgctgagcgtactaaactttccattgaagatgttgagcaccttctcatgaagagtctttctgtgcatctgattgaggggattatagatcaagtgaatggaacagtttacatctcatgggcgcaaccgagagtgttggggattccacagatcaagtctttgagggatcaattggacagttgggtcgacaaagtccacaccactttgctatctgttgaagctgagacaccagatcttgttgcggcataagaaaaacctacctttttttccttttagagctgctgattataactctatttctgggataagatgcgagaatattagcgattgcagtgtttgaagttacagttgctttggattattgttccattttcaagtttctccttttttttaaccgagt

SEQ ID NO: 1923 - DNA, 1593 bp, Brassica rapa
caaaaccatttgtttgaagattattatttattttcacaaaacccttttctttttctttacgcacagctctgatataagattgaatccaccacaacactacgtcttcatcttcttctgcgaagcgaaatcattttccgtcatggcagctcttcaatacttggaatctctgaaaagctctcacccagagctcaacgaatggtacgattccctatcagatctgtatcagaaaaagctatggcatcagctcaccctcaagctcgagcagttcatcgctctctccgtctttcaggctggagatgcgttgatacagttctaccacaacttcatcaccgacttcgagacgaagatcaacctcctcaagctcgcgcacttcgctgtggtggtctcacgtcagtactctgagaaagaagctgcggttagctatcttgaaggcgtgattgagaagcttaaagctactaaggagcctcggatcactgaacctatcgtttacattgagacgcaaaaggctttgttcaagcttgagcaaggtgatcagaaggagtgcaagaaggtcttggacgatgcgaagacctctcttgatagcatgactgatattgatccttccgtgtatgctaacttctactgggtgtcttctcagtaccataagtgccgtcaggagttctctgatttctacaaaagtgctctgctttatctcgcgtatacctctgtggaggcgctctcagactcgtttaagctggatttggctttcgatttgtcactttcagctctacttggagagaacatctacaactttggagagctcttggcccatcccattttgaaaagtcttcttggaacaaatgtggaatggctttaccacattctccaagcattcaaccatggtgacttagttcagtatcaagaactgtgccgtgtgcaccatgcatccttgattgcccagccagctctggttgagaatgagaagaaactattggagaagatcaacattctctgtctgatcgagatcatcttcagccgacctgctgaagataggaccattcctttgactgtcattgctgagcgtactaaactttccattgaagatgttgagcaccttctcatgaagagtctttctgtgcatctgattgaggggattatagatcaagtgaatggaacagtttacatctcatgggcgcaaccgagagtgttggggattccacagatcaagtctttgagggatcaattggacagttgggtcgacaaagtccacaccactttgctatctgttgaagctgagacaccagatcttgttgcggcataagaaaaacctaccttttttttccttttagagctgctgattataactctatttctgggataagatgcgagaatattagcgattgcagtgtttgaagttacagttgctttggattattgttccattttcaagtttctccttttttttaacccgttttagctataatattacaaaaagacgatcactgttgggggttactgattggtccttatccccttgcttactcaattgcctttcgaaggatagtttgtcccagtgagctcattctgcgacaatgaatgtgataagtacccgaa

SEQ ID NO: 1924 - DNA, 1473 bp, Eutrema parvulum
atacttgtctttgagcacaagaaaaatagtttactaaaaggcagggtttttccggaaatttctactctcaaaccgatacaaagatcgaggctttttcttctttttcttcgtttttttcttcttccgggaaggaaaatctgccatggctgctctacaatacctcgaatcgcagaaaaatgcgcatccggagcttggcgagtggtacaattcgctcgcagatctgtaccagaagaagctctggcaccagctcacccttaagctcgagcagtttatcgctctctctgtctttcaggctggagatgctttgatacagttttacaacaatttcatcaccgactttgagacgaagatcaatcttctgaagcttgcacatttcgcggttgtagtctcccgacagtaccctgagaaagaagctgcggttagttatcttgaaggagtgattgagaagcttagagctactaaagagtcacggataagtgagccgattagctatatagaaacacagatagctttattcaagcttgagcaaggtgaccagaaggagtgcaagaagatattggacgatggaaaaagcgctcttgatagtatgaccgacattgatccatcggtctatgccaacttcttttgggtgtcttctcagtatcataaattccgtcaagagttttctgatttctataagaatgctctcctttacctcgcttatacgtctgtggagtcactctcggaatcgtttaagctggacttggcttttgatctgtcgctgtctgctctactcggagacaatatctataactttggggaactgttagcccatccaattctgaagagtctgcttggaacaaatgtggagtggctttaccacattctacaggcattcaaccacggtgatctagtccagtaccaagaactctgccgtgtgcacaacgcatccttgagtgctcaaccagcactggttgagaatgagaagaaactattagagaagatcaacattctctgccttattgagattattttcagccgaccagctgaagataggaccatacctttgagtgtcattgctgagcgtactaaactttcgatcgaagatgttgagcaccttctcatgaaaagtttatccgtgcacttgatagagggaataatagatcaggtggatggaacggtacatgtctcgtgggcgcaaccgagggtgcttgggattccgcagatcaagtcattgagggatcagctagatagttgggtcgataaggttcacactacgttgttgtctgttgaggccgagacacctgatcttgttgcagcttaaaactcttctttcttttatccttttgagctacagattgtaacattttctggagattaaatgcaagttctttcccttttcttttaccagtttttaggagttacagtaacttttaaaactttgctcttaacaaacacacacgaatgtatcatcttcttcctgcttccattcca

SEQ ID NO: 1925 - DNA, 1464 bp, Eutrema parvulum
atacttgtctttgagcacaagaaaaatagtttactaaaaggcagggtttttccggaaatttctactctcaaaccgatacaaagatcgaggctttttcttctttttcttcgtttttttcttcttccgagaagtgaaatcgccatggctgctttacagtaccttgaatcgcagaaaaatgcgcatccagagcttggcgagtggtacaattcgctcgcagatctgtaccagaagaagctctggcaccagctcaccctcaagctcgagcagttcattgctctctctgtctttcaggctggagatgctttaatacagttttacaacaatttcatcactgactttgagacgaagatcaatcttctgaagcttgcgcatttcgcggttgtcgtctcccgacagtaccctgagaaagaagctgcggttagttatcttgaaggagtgattgagaagcttagagctactaaagagtcacggataagtgagccgattagctatatagaaacacagatagctttattcaagcttgagcaaggtgaccagaaggagtgcaagaagatattggacgatggaaaaagcgctcttgatagtatgaccgacattgatccatcggtctatgccaacttcttttgggtgtcttctcagtatcataaattccgtcaagagttttctgatttctataagaatgctctcctttacctcgcttatacgtctgtggagtcactctcggaatcgtttaagctggacttggcttttgatctgtcgctgtctgctctactcggagacaatatctataactttggggaactgttagcccatccaattctgaagagtctgcttggaacaaatgtggagtggctttaccacattctacaggcattcaaccacggtgatctagtccagtaccaagaactctgccgtgtgcacaacgcatccttgagtgctcaaccagcactggttgagaatgagaagaaactattagagaagatcaacattctctgccttattgagattattttcagccgaccagctgaagataggaccatacctttgagtgtcattgctgagcgtactaaactttcgatcgaagatgttgagcaccttctcatgaaaagtttatccgtgcacttgatagagggaataatagatcaggtggatggaacggtacatgtctcgtgggcgcaaccgagggtgcttgggattccgcagatcaagtcattgagggatcagctagatagttgggtcgataaggttcacactacgttgttgtctgttgaggccgagacacctgatcttgttgcagcttaaaactcttctttcttttatccttttgagctacagattgtaacattttctggagattaaatgcaagttctttcccttttcttttaccagtttttaggagttacagtaacttttaaaactttgctcttaacaaacacacacgaatgtatcatcttcttcctgctt

SEQ ID NO: 1926 - DNA, 1272 bp, Brassica napus
gttttagcacagctctgatataagattgaatccacaactcgttgcttccttcatcttcatcttcttctgcgaagcgaaatcattttccgtcatggcagctcttcaatacttggaatctctgaaaaattctcacccagagctcaatgaatggtacgattccctatcagatctgtatcagaaaaagctatggcatcagctcaccctcaagctcgagcagttcatcgctctctccgtctttcaggctggcgatgctttgatacagttctaccacaacttcatcactgactttgagacgaagatcaatctcctcaagcttgcgcatttcgcggtggtggtctcccgtcagtacgctgagaaagaagctgcggttagctatcttgaaggagttatcgagaagcttaaagctaccaaggagcctcggatcactgaaccgatcgtttacattgagacccaaaaggctttgttcaagcttgagcaaggtgatcagaaggagtgcaagaagatcttggacgatgcgaagacctttcttgatagcatgactgacattgacccttcggtgcacgctaacttctactgggtgtcttctcagtaccataagtttcgtcaggagttttcggatttctacaaaagtgctctgctttatcttgcgtatacgtctgtggaggcgctctcagactcgtttaagctggatttggcttttgatttttcactttcagctctacttggagaaaacatatacaactttggggaactcttggcccatcccattttgaaaagtctccttggaacaaatgtggaatggctttaccacattctccaggcgttcaaccatggtgacttagttcagtatcaagaactgtgccgcgttcaccatgcatccttgattgcccagccagcattggttgagaatgagaagaaacttttggagaagatcaacattctctgcctgatcgagatcatcttcagccgacctgctgaagataggaccattcctttgactgtcattgctgagcgtactaaactttccattgaagatgttgagcaccttctcatgaagagtctttctgtgcatctgattgaggggattatagatcaagtgaatggaacagtttacatctcatgggcgcaaccgagagtgttggggattccacagatcaagtctttgagggatcaattagacagttgggtcgacaaagtccacactactttgctatctgttgaagctgagacaccagatcttgttgcggcataagaaaacctacctaccttttt

SEQ ID NO: 1927 - DNA, 1450 bp, Eutrema halophilum
atacttgtctttgagcacaagaaaaatagtttactaaaaggcaggggttttccggaaatttctactcccaaaccgatacaagatcgaggctttttcttcttccgagaagtgaaatcgccatggctgctttacagtaccttgaatcgcagaaaaatgcgcatccagagcttggcgagtggtacaattcgctcgcagatctgtaccagaagaagctctggcaccagctcaccctcaagctcgagcagttcattgctctctctgtctttcaggctggagatgctttaatacagttttacaacaatttcatcactgactttgagacgaagatcaatcttctgaagcttgcgcatttcgcggttgtcgtctcccgacagtaccctgagaaagaagctgcggttggttatcttgaaggagtgattgaaaagcttagagctactaaagagtcaaggataaatgagccaattagctatatagaaacacagatagctttgttcaagcttgagcaaggtgaccagaaggagtgcaagaagatattggacgatggaaaaagctctcttgatagtatgaccgacattgatccatcagtctatgccaatttctattgggtgtcttctcagtaccataaatttcgtcaagaattttctgatttctacaaaaatgctcttctttacctcgcttacacgtctgtggagtcactctcggaatcgtttaagctggacttggcgtttgatctgtccctgtcagccctactcggagataacatctacaactttggggaactgttagcccatccaattttgaagagtctgcttggaacaaatgtggaatggctttaccacattctccaggcattcaaccacggtgatttagtccagtaccaggaactctgccgtgtgcacaacgcagccttgagcgctcaaccagcactggttgagaatgagaagaaactgttagagaagatcaacattctctgccttattgagatcattttcagccgaccagctgaagacaggaccatacctttgagtgtcattgctgagcgaactaaactttcaatcgaagatgttgagcaccttctcatgaagagcttatccgtgcacttgatagagggtatactagatcaggtggatggaacggtacatgtctcatgggcgcagccgagggtgcttgggattccgcagatcaagtcattgagggatcagctagacagctgggtcgataaggttcacaccactttgttatccgttgaggccgagacaccagatcttgttgcagcttaaaactcttgtttcttctttttccttttgagctacagattgtaacattttctggatattcaatgcaagttctttcccttatgttttcagtttttaggagttgcatttactttttacatttactttttaaatgttgttcttagcaaacacatgatcatctgctccatgctttc

SEQ ID NO: 1928 - DNA, 1456 bp, Eutrema halophilum
atacttgtctttgagcacaagaaaaatagtttactaaaaggcaggggttttccggaaatttctactcccaaaccgatacaagatcgaggctttttcttcttccgagaagtgaaatcgccatggctgctttacagtaccttgaatcgcagaaaaatgcgcatccagagcttggcgagtggtacaattcgctcgcagatctgtaccagaagaagctctggcaccagctcaccctcaagctcgagcagttcattgctctctctgtctttcaggctggagatgctttaatacagttttacaacaatttcatcactgactttgagacgaagatcaatcttctgaagcttgcgcatttcgcggttgtcgtctcccgacagtaccctgagaaagaagctgcggttggttatcttgaaggagtgattgaaaagcttagagctactaaagagtcaaggataaatgagccaattagctatatagaaacacagatagctttgttcaagcttgagcaaggtgaccagaaggagtgcaagaagatattggacgatggaaaaagctctcttgatagtatgaccgacattgatccatcagtctatgccaatttctattgggtgtcttctcagtaccataaatttcgtcaagaattttctgatttctacaaaaatgctcttctttacctcgcttacacgtctgtggagtcactctcggaatcgtttaagctggacttggcgtttgatctgtccctgtcagccctactcggagataacatctacaactttggggaactgttagcccatccaattttgaagagtctgcttggaacaaatgtggaatggctttaccacattctccaggcattcaaccacggtgatttagtccagtaccaggaactctgccgtgtgcacaacgcagccttgagcgctcaaccagcactggttgagaatgagaagaaactgttagagaagatcaacattctctgccttattgagatcattttcagccgaccagctgaagacaggaccatacctttgagtgtcattgctgagcgaactaaactttcaatcgaagatgttgagcaccttctcatgaagagcttatccgtgcacttgatagagggtatactagatcaggtggatggaacggtacatgtctcatgggcgcagccgagggtgcttgggattccgcagatcaagtcattgagggatcagctagacagctgggtcgataaggttcacaccactttgttatccgttgaggccgagacaccagatcttgttgcagcttaaaactcttgtttcttctttttccttttgagctacagattgtaacattttctggatattcaatgcaagttctttcccttatgttttcagtttttaggagttgcatttactttttacatttactttttaaatgttgttcttagcaaacacatgatcatctgctccatgctttcatttca

SEQ ID NO: 1929 - DNA, 1384 bp, Raphanus sativus
  misc_feature (910)..(910): n is a, c, g, or t
  misc_feature (979)..(979): n is a, c, g, or t
  misc_feature (988)..(988): n is a, c, g, or t
  misc_feature (990)..(990): n is a, c, g, or t
  misc_feature (1295)..(1295): n is a, c, g, or t
gccgggggaacgcacagctctgatataaaagaacctttcatcgtctttcgtctacctctgcgaatcaaaacctatttccgccatggctgctcttcaatacttggaatctctgaaaacttcgcacccagagctcaatgaatggtacaattccctcgcagatctgtatcagaaaaagctatggcatcagctcaccctcaagctcgagcagttcatcgctctctccgtttttcaggctggagatgctttggtacagttctaccacaacttcatcaccgacttcgagacgaagatcaacctcctcaagcttgcgcatttcgccgtggtggtctcccgtcagtactctgagaaagaagctgcggtcggctacctcgaaggagtgattgagaagctcaaagccactaaagagcctcgcatcactgaaccgatcgtttacatcgagacgcaaaaggctttgttcaagcttgagcaaggtgatcagaaggagtgcaagaaggttttggacgatgccaagacctctcttgatagcatgactgatattgatccttcggtccacgctaacttctactgggtgtcttctcagtaccacaagttccgtcaggagttctctgatttctacaaaagtgctctgctttttcttgcgtatacctctgtggaggcactctctgaatcctttaagctggatttggctttcgatttgtcactttcagctctacttggagaaaacatctacaactttggggaactcttggctcatcccattttgaaaagtctccttggaacaaatgtggaatggctttaccacattctccaggcgttcaaccatggtgatttagttcagtatcaagaactgtgtcgcgtacaccatgcatccttgattgcccaacccgcactggttgagaatgagaagaanctattggagaagatcaacattctttgccttatcgagatcatcttcagccgacctgctgaagataggacnattcctttnantgtcattgctgagcgtactaaactttccattgaagatgttgagcaccttttcatgaagagtctttctgtgcatctgattgaggggattatagatcaagtgaatggaacagtttacatctcatgggcccaaccgagagtgttggggattccacagatcaagtctttgagggatcaattggacagttgggtcgacaaagtccacaccactttgctatctgttgaagctgagacaccagatcttgtttcggcataagaaaaacctaccttttttttccttttagagctgctgattataactctatttntgggataagatgcaagaatattagctatgcagtgtttgaagttacaatcgctttggattattgctccattttcaagattctcctttttt

SEQ ID NO: 1930 - DNA, 1333 bp, Raphanus sativus
  misc_feature (964)..(964): n is a, c, g, or t
  misc_feature (1165)..(1165): n is a, c, g, or t
  misc_feature (1238)..(1238): n is a, c, g, or t
  misc_feature (1267)..(1267): n is a, c, g, or t
tctacttctgcgaagcaaaacctatttccgccatggctgctcttcaatacttggaatctcttaaaacttcgcatccagagctcaatgaatggtacgattccctcgcagatctgtatcagaaaaagctatggcatcagctcaccctcaagctcgagcagttcatcgctctctccgtttttcaggctggagatgctttggtacagttctaccacaacttcatcaccgacttcgagacgaagatcaacctcctcaagctcgcgcatttcgctgtggtggtctcccgtcagtacgctgagaaagaagctgcggttggctatctcgaaggagtgattgagaagcttaaagccactaaggagcctcgcatcactgaacctatcgtttacatcgagacgcaaaaggctttgttcaagcttgagcaaggtgatcagaaggagtgcaagaaggtcttggacgatgccaagacctctcttgatagcatgactgacattgatccttcggtgtacgcgaacttctactgggtgtcttctcagtaccacaagttccgtcaggagttctctgatttctacaaaagtgctctgctttatcttgcgtatacctctgtggaggcactctctgaatcctttaagctggatttggcttttgatttgtcactttcagctctacttggagaaaacatctacaactttggggaactcttggctcatcccattttgaaaagtctccttggaacaaatgtggaatggctttaccacattctccaggcgttcaaccatggtgacttagttcagtatcaagaactgtgtcgtgtgcaccatgcatccttgattgcccaacccgcactggttgagaatgagaagaagctattggagaagatcaacattctttgccttatcgagatcatctttagccgacctgctgaagataggactattcctttgactgtcattgctgagcgtactaaacnttccattgaagatgttgagcaccttctcatgaagagtctttctgtgcatctgattgaggggattatagatcaagtgaatgggacagtttacatctcatgggcccaaccgagagtgttggggattccacagatcaagtctttgagggatcagttggatagttgggtcgacaaagtccacaccactttactatctgttgaatntgagacaccagatcttgttgcggcataagaaaaacctacctttttccttttagagctactgattataactctntttttgggataaggtgcaagaatattagntattgcagtgttttgaagttacaattgatttggattattgttccattttcaatattctcctttttt

SEQ ID NO: 1931 - DNA, 1586 bp, Raphanus sativus
  misc_feature (872)..(872): n is a, c, g, or t
  misc_feature (875)..(875): n is a, c, g, or t
  misc_feature (878)..(878): n is a, c, g, or t
  misc_feature (1255)..(1255): n is a, c, g, or t
  misc_feature (1266)..(1266): n is a, c, g, or t
  misc_feature (1276)..(1276): n is a, c, g, or t
  misc_feature (1283)..(1283): n is a, c, g, or t
  misc_feature (1308)..(1308): n is a, c, g, or t
  misc_feature (1322)..(1323): n is a, c, g, or t
  misc_feature (1326)..(1331): n is a, c, g, or t
  misc_feature (1334)..(1336): n is a, c, g, or t
  misc_feature (1338)..(1338): n is a, c, g, or t
gcgaagcaaaacctatttccgccatggctgctcttcaatacttggaatctcttaaaacttcgcatccagagctcaatgaatggtacaattccctcgcagatctgtatcagaaaaagctatggcatcagctcacccttaagctcgagcagttcatcgctctctccatctttcaggctggagatgctttgatacagttctatcacaacttcataaccgacttcgagacgaagatcaacctcctcaagctcgcgcatttcgctgtggtggtctcccgtcagtactcggagaaagaagctgcggttggctatctcgaaggagtgattgagaagctcaaagccactaaggagcctcggatcactgaaccgatcgtttacatcgagacgcaaaaggctttgttcaagcttgagcaaggtgatcagaaggagtgcaagaaggtcttggacgatgccaagacctctcttgatagcatgactgacattgatccttcggtgcacgctaacttctactgggtgtcttctcagtaccacaagttccgtcaggagttctctgatttctacaaaagtgctctgctttttcttgcgtatacctctgtggaggcactctctgaatcctttaagctggatttggcttttgatttgtcactttcagctctacttggagaaaacatctacaactttggggaactcttggctcatcccattttgaaaagtctccttggaacaaatgtggaatggctttacacattctccaggcgttcaaccatggtgatttagtcagtatcaagaactgtgtcgcgtacaccatgcatccttgattgcccaacccgcactggtgagaatgagaagaagctattggagaagatcaacattctntgnctnatcgagatcatcttcagccgacctgctgaagataggactattcctttgactgtcattgctgagcgtactaaactttccattgaagatgttgagcaccttctcatgaagagtctttctgtgcatctgattgaggggattatagatcaagtgaatggaacagtttacatctcatgggcccaaccgagagtgttggggattccacagatcaagtctttgagggatcaattggacagttgggtcgacaaagtccacaccactttgctatctgttgaagctgagacaccagatcttgttgcggcataagaaaaacctgcttttttccttttagagctactgattataactctgtttctgggataaggtgcaagaatattagntattgcagtgntttgaagttncaattgntttggattattgttccattttcaanattctccttttttnnaannnnnnacnnntngctataacattacaaaaagacgatcactgttgggggctacacggaccaagagcagctgattggtccttatcccctttgcttactcaaattatctttcgaaggagtttgtcccagtgagctgatactgcgaatgaatgtgttaagcatcgatggtgcatcccgtttccgatattcctaggtctatggttattattgttttgccgacatgatgagattgtctatattgctaatcatgtggttatatttta

SEQ ID NO: 1932 - DNA, 1478 bp, Arabidopsis thaliana
atacttgtctttgagctcaagaaatatagtttactaaaaggctgggtttttctggatttcttactcccaaaccgatacaagatcgaagctttgccttctgtttcttcgaaaatctaccatggctgctctacaataccttgaatcgcagaaaaatgcgcacccagagcttggtgagtggtacaattcgctcgcagatctgtaccagaagaagctctggcatcagctcactcttaagctcgagcagttcatcgctctctctgtctttcaggctggagatgctttaatacagctttacaacaatttcatcactgactttgagacgaggatcaatcttctgaagcttgcgcatttcgctgttgtagtctcccgacagtatcctgagaaagaagctgcagttagttatcttgaaggagtgattgagaagcttaaagctactaaagagtcaaggataaatgaaccaattagctatatagaaacacaaatagctttgttcaagcttgagcaaggtgaccagaaggagtgcaagaaaatcttggacgatggaaaaagcctgcttgatagtatgactgacattgatccatcagtttatgccaacttcttttgggtctcttctcagtaccataaagtccgtcaagagttctctgagttctataaaaatgctcttctttacctcgcttatacgtctgtggactcactctcggaatcatttaagctggatttggcttttgatttgtcgctttcagctctacttggggagaatatctataactttggggaactgttagcccatccaattttgaaaagtctgcttggaacaaatgtggaatggctttaccacattctacaagcattcaaccacggagatttagttcagtaccaagaactctgtcgtgtgcacaatgcatcgttgagtgctcaaccagcactggttgagaatgagaagaaactattagagaagatcaacattctctgccttattgagatcattttcagccgacctgctgaagataggaccatacctttgagtgtcattgccgagcgtactaaactttcaatcgaagatgttgagcaccttctcatgaagagcttatcggtgcacttgatagagggaatactagatcaggtgaatggaacagtttacgtctcatgggcgcaaccgagggtgttaggaataccgcagatcaagtcattgagggatcagctagacagctgggtcgataaggttcacaccacattgttatctgttgaggccgagacacctgatcttgttgcagcttaaactcttctttcctcttttttccttcactgttcgtttaagctacagattgtaacattctctgaggattaaatgcaacttccttttaagtttttaggtattacagttatacttttgaactttgttctccacagacacatgaatctatcctattaagttgagtttcatcgttagtgttgcctttaaggcttaagcctatttg

SEQ ID NO: 1933 - DNA, 1381 bp, Arabidopsis thaliana
actcccaaaccgatacaagatcgaagctttgccttctgtttcttcgaaaatctaccatggctgctctacaataccttgaatcgcagaaaaatgcgcacccagagcttggtgagtggtacaattcgctcgcagatctgtaccagaagaagctctggcatcagctcactcttaagctcgagcagttcatcgctctctctgtctttcaggctggagatgctttaatacagctttacaacaatttcatcactgactttgagacgaggatcaatcttctgaagcttgcgcatttcgctgttgtagtctcccgacagtatcctgagaaagaagctgcagttagttatcttgaaggagtgattgagaagcttaaagctactaaagagtcaaggataaatgaaccaattagctatatagaaacacaaatagctttgttcaagcttgagcaaggtgaccagaaggagtgcaagaaaatcttggacgatggaaaaagcctgcttgatagtatgactgacattgatccatcagtttatgccaacttcttttgggtctcttctcagtaccataaagtccgtcaagagttctctgagttctataaaaatgctcttctttacctcgcttatacgtctgtggactcactctcggaatcatttaagctggatttggcttttgatttgtcgctttcagctctacttggggagaatatctataactttggggaactgttagcccatccaattttgaaaagtctgcttggaacaaatgtggaatggctttaccacattctacaagcattcaaccacggagatttagttcagtaccaagaactctgtcgtgtgcacaatgcatcgttgagtgctcaaccagcactggttgagaatgagaagaaactattagagaagatcaacattctctgccttattgagatcattttcagccgacctgctgaagataggaccatacctttgagtgtcattgccgagcgtactaaactttcaatcgaagatgttgagcaccttctcatgaagagcttatcggtgcacttgatagagggaatactagatcaggtgaatggaacagtttacgtctcatgggcgcaaccgagggtgttaggaataccgcagatcaagtcattgagggatcagctagacagctgggtcgataaggttcacaccacattgttatctgttgaggccgagacacctgatcttgttgcagcttaaactcttctttcctcttttttccttcactgttcgtttaagctacagattgtaacattctctgaggattaaatgcaacttccttttaagtttttaggtattacagttatacttttgaactttgttctccacagacacatgaatctatcctattaagttgagtttca

SEQ ID NO: 1934 - DNA, 1358 bp, Arabidopsis lyrata
atacttgtctttgagctcaagaaatatagtttactaagaggctgggtttttctggattttcttacttcccaaaccgatacaagatcgaagcttttccttctgtttcttcgagaatctgccatgtctgctctacagtaccttgaatcgcagaaaaatgcgcacccagagcttggcgagtggtacaattcgctcgcagatctgtaccagaagaagctctggcatcagctcacccttaagctcgagcagttcattgctctctctgtctttcaggctggagatgctttaatacagctttacaacaatttcatcactgactttgagacgaggatcaatcttctgaagcttgcgcatttcgcggttgtagtctcccgacagtaccctgagaaagaagctgctgttagttatcttgaaggagtgattgaaaagcttaaagctactaaagagtcaaggataaatgagccaattagctatatagaaacacaaatagctttgttcaagcttgagcaaggtgaccagaaggagtgcaagaaaatcttggacgatggaaaaagcttgcttgatagtatgactgacattgatccatcagtctatgctaacttcttttgggtgtcttctcagtaccataaattccgtcaagagttttctgagttctataaaaatgctcttctttacctcgcttatacgtctgtggagtcactctcggaatcatttaagctggatttggcttttgatttgtcactttcagctctacttggagataatatctataactttggggaactgttagcccatccaattttgaaaagtctgcttggaacaaacgtagaatggctttaccacattctacaagcattcaaccacggtgatttagttcagtatcaagaactctgtcgtgtgcacaacgcatcgttgagtgctcaaccagcactggttgagaatgagaagaaactattagagaagatcaacattctctgccttattgagatcattttcagccgacctgctgaagataggaccatacctttgagtgtcattgccgagcgtactaaactttcaatcgaagatgttgagcaccttctcatgaagagcttatctgtgcacttgatagagggaatattagatcaggtgaatggaacagtatacgtctcatgggcgcaaccgcgggtgttagggattccgcagatcaagttattgagggatcagctagacagttgggtcgataaggttcacactacattgttatctgttgaggccgagacacctgatcttgttgcagcttaaacccttgtttcctcttttgtcttcttcattgtccgtttaagctacagattgtaacattctctgaggataaaatgcaa

SEQ ID NO: 1935 - DNA, 1346 bp, Arabidopsis lyrata
ctggattttcttacttcccaaaccgatacaagatcgaagcttttccttctgtttcttcgagaatctgccatgtctgctctacagtaccttgaatcgcagaaaaatgcgcacccagagcttggcgagtggtacaattcgctcgcagatctgtaccagaagaagctctggcatcagctcacccttaagctcgagcagttcattgctctctctgtctttcaggctggagatgctttaatacagctttacaacaatttcatcactgactttgagacgaggatcaatcttctgaagcttgcgcatttcgcggttgtagtctcccgacagtaccctgagaaagaagctgctgttagttatcttgaaggagtgattgaaaagcttaaagctactaaagagtcaaggataaatgagccaattagctatatagaaacacaaatagctttgttcaagcttgagcaaggtgaccagaaggagtgcaagaaaatcttggacgatggaaaaagcttgcttgatagtatgactgacattgatccatcagtctatgctaacttcttttgggtgtcttctcagtaccataaattccgtcaagagttttctgagttctataaaaatgctcttctttacctcgcttatacgtctgtggagtcactctcggaatcatttaagctggatttggcttttgatttgtcactttcagctctacttggagataatatctataactttggggaactgttagcccatccaattttgaaaagtctgcttggaacaaacgtagaatggctttaccacattctacaagcattcaaccacggtgatttagttcagtatcaagaactctgtcgtgtgcacaacgcatcgttgagtgctcaaccagcactggttgagaatgagaagaaactattagagaagatcaacattctctgccttattgagatcattttcagccgacctgctgaagataggaccatacctttgagtgtcattgccgagcgtactaaactttcaatcgaagatgttgagcaccttctcatgaagagcttatctgtgcacttgatagagggaatattagatcaggtgaatggaacagtatacgtctcatgggcgcaaccgcgggtgttagggattccgcagatcaagttattgagggatcagctagacagttgggtcgataaggttcacactacattgttatctgttgaggccgagacacctgatcttgttgcagcttaaacccttgtttcctcttttgtcttcttcattgtccgtttaagctacagattgtaacattctctgaggataaaatgcaagttacttttgaactttgttctcaacagacacatgaaatc

SEQ ID NO: 1936 - DNA, 1424 bp, Raphanus sativus
ccggaaatctccactactcccacaaacccaatacaagatctcgactctctcttctacgaaggaaggagaatctcccccatggctgctctacaatacctcgaatctcagaaaaactcgcacccagacctcaccgagtggtacaattcgctcgcagatctgtaccagaagaagctatggcaccagctcaccctcaagctcgagcagttcatcgctctctccgtctttcaggctggagatgctttgatacagctttacaacaacttcataaccgactttgagacgaagatcaacctcctgaagctagcccacttcgcggtcgttgtctcaaggcagtaccctgagaaagaagctgcggttagttatctccagggagtgattgagaagcttagagcgactaaggagtcgcggatcagtgagccggttagctatgtagaaacgcagatagctttgttcaagcttgagcaaggtgaccagaaggagtgcaagaagatacttgacgatgttaaaagctctctcgatagtatgactgatatcgatccgtcggtgtatgccaacttctactgggtgtcttctcagtaccataagttccgtcaggagttttctgatttctacaagaatgctcttctttatcttgcgtatacttctgtggagtcgctctctgaatcgttcaagctggacttggcttttgatctgtcgctgtcagctctactgggagagaatatttacaactttggggaactgttagcccatccagttctgaagagtctgcttggaacaaatgtggaatggctttaccacattctacaggcgttcaaccacggtgatttggttcagtaccaagaactctgccgtgttcacaatgcagccttgagcgcacagccagcattggttgagaatgagaagaagctgttagagaagatcaacattctctgccttattgagatcattttcagccgaccagctgaagataggaccataccgttgagtgtcattgctgagcgtactaagctctcaatcgaagatgttgagcaccttctcatgaagagcttatctgtccacttgatagaggggataatagaccaggtggatggaacggtgcatgtgtcatgggcgcaaccgagggtgctagggataccgcagatcaagtcattgagggatcagctagatagctgggttgataaggttcacacgaccttgttgtccgttgaggctgagacacctgatcttgttgcagtttaaaactcttgtttcttctttgttttccttttgagctacaagattgtgtatcattttgctggatactcttaatgcaacttctttccctttttcgaataccagtttttaggagttacagtcttttttcttaaaacgtttgctctcaacaaactcatgaatgtatcctcctttctccaatgattcttcca

SEQ ID NO: 1937 - DNA, 1315 bp, Raphanus sativus
tactcccacaaacccaatacaagatctcgactctctcttctgcggaggaaggacaatctcccccatggcagctctacaatacctcgaatctcagaaaaactcgcacccagagctcaccgagtggtacaattctctcgcagatctgtaccagaagaagctatggcaccagctcaccctcaagctcgagcagttcatcgctctctccgtctttcaggctggagatgctttgatacagctttacaacaacttcataaccgacttcgagacgaagatcaacctcctgaagctagcccacttcgcggtcgttgtctccaggcagtaccctgagaaagaagcggcggttagttatctccagggagtgattgagaagcttagagctactaaggagtcacgcatcagtgagcctgtcagctatgtagaaacgcagatagctttgttcaagcttgagcaaggcgaccagaaggagtgcaagaagatactggacgatgtgaaaagctctctcgatagtatgactgatatcgatccgtcggtgtatgccaacttcttctgggtgtcttctcagtaccataagttccgtcaggagttttctgatttctacaagaatgctcttctttatcttgcgtatacttctgtggagtcgctctctgaatcgtttaagctggacttggcttttgatctgtcgctgtcagctctactgggagagaatatttacaactttggggaactgttagcccatccagttctgaagagtctgcttggaacaaatgtggaatggctttaccacattctacaggcgttcaaccacggtgatttggttcagtaccaagaactctgccgtgttcacaatgcagccttgagcgcacaaccagcattggttgagaatgagaagaagctgttagagaagatcaacattttctgtcttattgagatcattttcagccgaccagctgaagataggaccataccgttgagtgtcattgctgagcgtactaagctctcaatcgaagatgttgagcaccttctcatgaagagcttatctgtgcacttgatagaggggataatagaccaggtggatggaacggtgcatgtgtcatgggcgcaaccgagggtgctagggataccgcagatcaagtcattgagggatcagttagatagctgggttgataaggttcacacgaccttgttgtccgttgaggctgagacacctgatcttgttgcagcttaagactcttgtttcttctttgttttccttttgagctacaagattgtatcattttgatggatactctaaatgcaacttctttcccttttccga

SEQ ID NO: 1938 - DNA, 1272 bp, Brassica napus
caagatctcgactttctcttctgcgaggaaggacaatcccccatggctgctctacaatacctcgaatctcagaaaaacgcgcacccagagctcaccgagtggtacaattcgctcgcagatctgtaccagaagaagctctggcaccagctcaccgtcaagctcgagcagttcatcgctctccccgtctttcaggctggagatgctttgattcagctatacaacaacttcataaccgactttgagaccaaaatcaaccttctgaagctcgcgcacttcgcggttgtagtctccaggcagtaccctgagaaagaagctgcggtcagttatctccaaggagtgattgagaagcttagagcgactaaagagtcacgtatcagtgagcctgttagctatgtagagacgcagatagctttgttcaagcttgagcaaggtgaccagaaggaatgcaagaagatactggacgatgtgaaaacctctcttgatagtatgaccgacattgatccttcggtctatgccaacttcttctgggtgtcttctcagtaccataagttccgtcaggagttttctgatttctacaagaatgctcttctttacctcgcgtatacttccgtggagtcactctctgaatcttttaagctggacttggcttttgatctgtcgctgtcagctctactgggagagaatatttacaactttggggaactgttggcccatccagttctgaagagtctgcttggaacaaatgtggagtggctttaccacattctgcaggcgttcaaccacggtgatttggttcagtaccaagaactctgccgtgttcacaatgcagccttgagtgcacagccagcgctggttgagaatgagaagaagctgttggagaagatcaacattctttgccttattgagatcattttcagccgaccagctgaagataggaccataccgttgagtgtcatcgctgagcgtactaagctttcaatcgaagatgttgagcaccttctcatgaagagtttatctgtgcacttgatagaggggataatagatcaggtggatggaactgtgcatgtttcatgggcgcaaccgagggtgctagggatacctcagatcaagtcattgagggatcagcttgatagttgggttgataaggttcacactaccttgttatccgttgaggctgagacacctgatcttgttgcagcttaaggcactcttgtttcttctttgtttttcttttgagctacaagattgtatcattttgctggattttaaatg

SEQ ID NO: 1939 - DNA, 1554 bp, Brassica rapa
atacttgtctttctacacaagaaaaatagtttagtaaaaggcaaaggtttttccggaaatctcttctctactcctcccacaaaaccgatacaagatctcgactttctcttccgcgaggaaggacaatctccaatggctgctcttcaatacctcgaatcccagaaaaacgcgcacccagagctcaccgagtggtacaattcgctcgcagatctgtaccagaagaagctctggcaccagctcaccctcaagctcgagcacttcatcgctctctccgtcttccaggctggagatgctttgatacagctatacaacaacttcataaccgacttcgagacgaagatcaaccttctgaagctcgcgcacttcgcggttgttgtctccaggcagtaccctgagaaagaagctgcggtgagttatctccagggagtgattgagaagcttagagcgactaaagagtcacgtatcagtgagcctgttagctacgtagaaacgcagatagctttgttcaagcttgagcaaggtgaccagaaggaatgcaagaagatactggacgatgtgaaaacctctcttgatagtatgactgacattgatccgtctgtctatgccaacttcttctgggtgtcttctcagttccataagttccgtcaggagttttctgatttctataagaatgctcttctttatcttgcgtatacttctgtggagtcactctctgagtcgtttaagctggacttggcttttgatctgtcgctgtcagctctgctgggagagaatatttacaactttggggaattgttagcccatccagttctgaagagtctacttggaacaaatgtggagtggctttaccacattctgcaggcgttcaaccacggtgacttggttcagtaccaagaactctgccgtgttcacaatgcagccttgagcgcacagccagcgctggttgagaatgagaagaagctgttggagaagatcaacattctctgccttattgagatcattttcagccgaccagctgaagataggaccataccgttgagtgtcattgctgagcgtactaagctttcaatcgaagatgttgagcaccttctcatgaagagtttatctgtgcacttgatagaggggataatagatcaggtggatggaactgtgcatgtgtcatgggcgcaaccgagggtgctagggatacctcagatcaagtcattgagggatcagcttgatagttgggttgataaggttcacactaccttgttgtccgttgaggctgagacacctgatcttgttgcagcttaagacactcttgtttcttctttgttttccttttgagctacaagattgtatcattttgctggatattaaatgcaaacttctttcccttttcaaataccagtttttaggagatagtcgttttaaaaaaaaacgtttgctctcaacaaacacattaatatatcctctcctttctccaatgattcttgaatggatcgacttcactacacccttcactatataagctcctctcatgattgatgtacttgtacctttatacaatctgaa

SEQ ID NO: 1940 - DNA, 1251 bp, Brassica napus
tcccacaaaaccgatacaagatctcgactttctcttccgcgaggaaggacaatctccaatggctgctcttcaatacctcgaatcccagaaaaacgcgcacccggagctcaccgagtggtacaattcgctcgcagatctgtaccagaagaagctctggcaccagctcaccctcaagctcgagcacttcatcgctctctccgtcttccaggctggagatgctttgatacagctatacaacaacttcataaccgacttcgagacgaagatcaaccttctgaagctcgcgcacttcgcggttgtagtctccaagcagtaccctgagaaagaagctgcggtcagttatctccagggagtgattgagaagcttagagctactaaagagtcgcgtatcagtgagcctgttagctacgtagaaacgcagatagctttgttcaagcttgagcaaggtgaccagaaggaatgcaagaagatactggacgatgtgaaaacctctcttgatagtatgactgacattgatccgtctgtctatgccaacttcttctgggtgtcttctcagttccataagttccgtcaggagttttctgatttctataagaatgctcttctttatcttgcgtatacttctgtggagtcactctctgagtcgtttaagctggacttggcttttgatctgtcgctgtcagctctactgggagagaatatttacaactttggggaactgttagcccatccagttctgaagagtctacttggaacaaatgtggagtggctttaccacattctgcaggcgttcaaccacggtgatttggttcagtaccaagaactctgccgtgttcacaatgcagccttgagcgcacagccagcgctggttgagaatgagaagaagctgttggagaagatcaacattctctgccttattgagatcattttcagccgaccagctgaagataggaccataccgttgagtgtcattgctgagcgtactaagctttcaatcgaagatgttgagcaccttctcatgaagagtttatctgtgcacttgatagaggggataatagatcaggtggatggaactgtgcatgtttcatgggcgcaaccgagggtgcttgggataccgcagatcaagtcattgagggatcagcttgatagttgggttgataaggttcacactaccttgttgtccgttgaggctgagacacctgatcttgttgcagcttaagacactcttgtttcttctttgttttccttttg

SEQ ID NO: 1941 - DNA, 1289 bp, Cleome spinosa
caaagatcgaatctttcctcgtcgtcttctcctgcgaggaaaatccgccatggccgctctccaatacttggaatcccagagaaatgcgcatccagagctcggggaatggtacaattccctcgcagatctgtaccagaagaagctctggcaccagctcaccctcaagctcgagcagttcatcgctctcgctgtctttcaggctggggatgctttaatacagctctataacaatttcatcaccgactttgagacgaagatcaatcttctgaagctcgcccattttgcggttgtagtctccagacagtatcctgagaaagaagctgcaattagttatctcgaaggagtgattgaaaaacttaaagctactaaagagcagcgtataaatgagccggttatttatatcaaaatgcaaatggctttgttcaagcttgagcagggtgaccagaaggagtgcaagaaaatcttggaagatggaaagagctccattgatagtatgactgacattgatccatcagtctatgccagctattattgggtgtcttcccaataccacaaatatcgtcaagaattttctgatttctataagaatgctcttctgtacctcgcatacacatcggtggagtcactctcagaatcgtttaagctggatttggcttttgatctgtcactttcagctctactcggagataatatctataactttggagagctgttagcccatcccattataaaaagtctccttggaacaaatgtggaatggctttaccacatgcttcaagccttcaaccatggcgatttagttcagtaccaagaactatgccgtgtgcataatgcatccttgagggctcaacctgcactggttgagaatgaaaagaaacttttggaaaagatcaacattctctgccttattgagatcatcttcagccgacctgctgaagataggaccataccattgaccgtcattgctgagcgcactaaactctctgtggaggacgttgagcatctccttatgaagggcctatctgtccatctgatagagggaatcatagaccaagtggaaggaacagtacatgtctcgtgggcgcaaccgagagttctggggatccagcagatcaaatcgttgagggatcggctggacaattgggcagacaaggttcacaccacattattatccgtcgaagctgagacccctgatcttgttgcagcttgaaactgcctggtctttgtaacattccctgtgatgggatgatttaaatgcaaattctttttcagtggtagaaattatgtgc

SEQ ID NO: 1942 - DNA, 1552 bp, Vigna unguiculata
ggataaagtttctttgtttcggattttgggtttctctcttccgtcaatcgtaatggctgctctgcaatacttggaatcgctgcgcaacgcgcaccctgagctcgccgaatggtacaattcactcgcggatctgtaccagaagaaactctggcatcaactcaccctcaagctcgagcagtttgtcgcactcgctgtttttcaggctggtgatgcgttgattcaattatatcacaatttcatcacagacttcgagactaaaatcaaccttctgaagcttgcacattttgctgttatagtttctcggcagtattctgaaaaggaagctgccgttggttatcttgaaggggttattgagaagttgcaggccactagagagcagcgcatcaaagaacctatcctttacattaagatgcaaatagcaatattcaagcttgagcaaggtgaccagaaggaatgcaagaaactcctggaagatgggaagactacacttgacagcatgacagatattgatccgtctgtatatgctaactattactgggtatcatctcaataccacaagacccgccaagaatttgctgagttctacaaaagtgcccttctctatttggcatacacgtcagtggagtctctgtcagaatcatttaagctggatttagcatttgatttgtccctctctgcccttcttggggacaacatctacaacttcggagagcttcttgcccatcctataatcaagagccttctagggacaaaagtggaatggctttactatattctgcaggcattcaactctggtgatttagtacgatatcaagaattgtgtcgggtacataatgctgctttaagagcccaaccagcactggttcaaaatgaacagaagttgttggaaaagatcaacattctctgtctgatggagattatattcagtcggccttcagaagatcgaactattcccttgagtgtaattgctgagcgtacaaaactttccatagagaatgtggaacatctcctaatgaagagcttatctgttcatctaattgagggtataattgatcaagttgagggcacagtgcacgtttcctgggtgcaaccaagagttctgggtattcaacagatcaaatccttacgggatcgacttgacagttggacagagaaagtacacactgcattgttatccattgaggcagaaacacctgatctaatcggatcgtgaattttctttcatttgttttctgccctttgtaacaatttcttaggttaaagagaacagatcctaaggcgacaaaagatgaggtatgaggagacttccaagtgacatggggccaactttgtatgctttatttgggttttcctgctgatttctgagtgattgctggaagagcaaccccttgtacttggctcacaaattgttggttctatgcttgcaaacttacaaacacggtaactcatttccaccctcccctgtttttacgcattagagtaaattacagactatgtatctggaattttctttgatacggccatttttatggacttttagaaagtattttca

SEQ ID NO: 1943 - DNA, 1682 bp, Prunus mume
cttttgtgttcttttctttgagcacaagttaaataaggtggtttttgggattcgtataaatacaaaccaaacaaagccttaggtctcccaaccctcgcaaattctctccgaatcaggcatggccgcgctgcagtacctggagtcgttgcgcaacgcgcatccggagctctccgattggtacaattcgctcgcagatctgtaccagaagaagctatggcaccagctcactctcaagctcgaacagtttgttgctctcgccgtgttccaggctggcgatgctctgatacagttatatcacaatttcatcactgattttgagactaaaatcaaccttctgaagcttgcacacttcgcagtaattgtttctcggcagtatccagagaaggaagctgctatcaattaccttgaaggggtgattgagaagcttcaagccactagagagcaacggatagaggaaccaatcctttacattaagatgcaaatagcaatattcaaacttgagcaagaagatcagaaagagtgcaaaaaacttctagaagatggaaagagtacacttgacagtatgactgacatcgatccatctgtatatgctagctattattgggtttcatctcaataccataagttccgtcaggaatttgctgagttctacaaaagtgctcttctttatctagcatacacatcagtggagtctctctcagaatcatttaagctggatttggcatttgatttgtccctttctgcgctcctgggagacaacatctacaactttggagagctgcttgcacatcctattattaagagtcttctagggacaaaggtagagtggctttactatattcttcaagcgttcaactctggtgatttagtccgttatcaagaattatgtcgtgtgcataatgctgctcttagagctcaaccggctttagttgaaaatgagaagaagcttctggagaagattaacatcctatgcttgatggaaattatcttcagccggccatctgaagataggactatacctttgagtatcattgcagagcgtacgaaactttctgtcgaggatgtggagcatcttcttgtgaagagtctttctgttcatttgattgagggaataattgatcaagttgaggaaaccgtgcatgtgtcctgggtgcaaccaagagttttgggaattccacagatcaaatcgttgcgtgataggctggatggttggttggacaaagtgcatacagctttgttatctatcgaggcggaaacacctgatttggttgcatcatgagttaggtctcttgctttgttttctgcctttggtgtaacaaatcctaatcgaaaaaaatgtgagtttaaaatgcaagggcggccaagtaaacagtagtctccgttagttgagcacttgggccaacgttttttatgctgcttttcatattgctgatgcttttcttgaatcattttcctggaaggagaagcctcatgtactgcacttgggactaaattccatttcatatataggtggcatgcctagagacatggtgaatcaaattcagagatggctgtgtaaccttaagcgatattaaactatgtatttggaatatttcttagatttttaccgtaatgtgatgatccactttatgcagctgaacattgcatctgccttatatcacttctctctattctctaactaa

SEQ ID NO: 1944 - DNA, 1627 bp, Prunus persica
ttctttgagcacaagctaaataaggtgttttttcggattcgtataaatacaaaccaaacaaggccttaggtctccctaccctcgcaaattctctccgaatcaggcatggccgcgctgcagtacctggagtcgttgcgcaacgcgcatccggagctctccgattggtacaattcgctcgcagatctgtaccagaagaagctatggcaccagctcactctcaagctcgagcagtttgttgctctcgccgtgttccaggctggcgatgctctgatacagttatatcacaatttcatcactgattttgagactaaaatcaaccttctgaagcttgcacacttcgcagtaattgtttctcggcagtatccagagaaggaagctgctatcaattaccttgaaggggtgattgagaagcttcaagccactagagagcaacggatagaggaaccaatcctttacattaagatgcaaatagcaatattcaaacttgagcaagaagaccagaaagagtgcaaaaaacttctagaagatggaaagagtacacttgacagtatgactgacatcgatccatctgtatatgctagctattattgggtttcatctcaataccataagttccgtcaggaatttgctgagttctacaaaagtgctcttctttatctagcatacacatcagtggagtctctctcagaatcatttaagctggatttggcatttgatttgtccctttctgcgctcctgggagacaacatctacaactttggagagctgcttgcacatcctattattaagagtcttctagggacaaaggtagagtggctttactatattcttcaagcgttcaactctggtgatttagttcgttatcaagaattatgtcgtgtgcataatgctgctcttagagctcaaccagctttagttgaaaatgagaagaagcttttggagaagattaacattctgtgcttgatggaaattatcttcagccggccatctgaagataggactatacctttgagtatcattgcagagcgtacgaaactttctgtcgaggatgtggagcatcttcttgtgaagagtctttctgttcatttgattgagggaataattgatcaagttgaggaaaccgtgcatgtgtcctgggtgcaaccaagagttttgggaattccacagatcaaatcgttgcgtgataggctggacggttggttggacaaagtgcatacagctttgttatctatcgaggcggaaacacctgatttggttgcatcatgagttaggtcccttgctttgttttctgcctttggtgtaacaaatcctaatcgaaaaaaatgggagtttaaaatgcaagggcggccaagaaaacagtagtctcagttagttgagaacttgggccaacgttttttatgctgcttttcatattgctgatgcttttcttgaatcattttcctggaaggagaagcctcatgtactgcatttcggactaaattccatttcatatataggtggcatgcctagagacatggtgaatcaaattcagagatggctgtgtaaccttaagcgttattaaactatgtatttggaatatttcttagatttttaccgtaatgcgatgatccactttacgcagctgaac

SEQ ID NO: 1945 - DNA, 1654 bp, Citrus clementina
tattcaaaattacataaaattcttttcttttggttcaagaaaagcgacataaaaaaggcacaacgagaaactgagagagaagggtttttgagattgctctgatattataataaataaagagaaaaaaatcatatttttctctaaatcttgcactgtcgcttcgccatggcagctcttcagtacttggaatctttgcgaaacgaccatccggagctgggcgagtggtacaatgctttggcagatctgtaccagaagaagctgtggcaccagctcaccctcaagctcgaacagttcgtcgctcacgccgtctttcaggctggtgatgctctgattcagttgtaccacaacttcataactgattttgagacaaagatcaatcttctcaagcttgcacattttgctgttatagtttctcggcagtatcctgagaagcaagctgcaattagttatcttgagggtgtgattgaaaaactccgagcaactaatgagcagcgtaaagaagagccaatcctttacattaagatgcaaatagccatgttcaaacttgagcaaggagatagaaaggagtgcaaaaaacttctcgaagatggaaagagtacacttgacagcatgactgacattgatccatctgtgtatgccaactattattgggtgtcatctcagtaccataaatttcaccaggaatttgcagagttctacaaatgtgctcttctttatctggcatacacatctgtggagtctctctcagattcattcaagctggatttggcatttgatctctccctttctgcactgctgggagataacatctacaactttggggaactgctcgcacaccctattataaatagtcttacaggaacaaaggtcgagtggctttactatattctccaggcattcaactctggtgacttagttcgctatcaagaattatgccgtgtacacaatgctgctctgagagctcaaccagcactagttgagaacgagaagaagctattggaaaagattaacattctctgcctgatggaaatcatctttagccggccttctgaggaccgaactattccattaagcatcattgcagagcgcacaaaactttctattgaggatgttgagcatcttctcatgaagtctctctctgttcacctcatagagggtataattgatcaagttgagggcacggtacatgtgtcctgggtgcaaccaagagttttgggaatcccccagatcaaatccttgcgtgatcggctggacagttggttgggcaaagtacatactgctttgttatccatcgaagctgaaacacccgatcttgttgcatcatgatttatttttatttttttttccttctgtgttttcctttctgctccttgtaacaatgtcttttgagaaaacgaaatgaaaacatgacaatggcggcaaagaggaggtagagacggtagtttgaaattactaggtcactcagagccaactttgtatgcaaatcctttaattgttgctttacccctttttcgtgaatcattttttttctgaaaggaacagctcatgtgctttccttcaatttagtgtcattgttatggtagtttcttttttagaccacttgaaaattgataatggcttttcactatttaaaattgaagtgattatcgaacta

SEQ ID NO: 1946 - DNA, 1656 bp, Citrus sinensis
tattcaaaattacataaaattcttttcttttggttcaagaaaagcgacataaaaaaggcacaacgagaaactgagagagaagggtttttgagattgctctgatattataataaataaacagagaaaaaaaatcatatttttctctaaatcttgcactgtcgcttcgccatggcagctcttcagtacttggaatctttgcgaaacgaccatccggagctgggcgagtggtacaatgctttggcagatctgtaccagaagaagctgtggcaccagctcaccctcaagctcgaacagttcgtcgctcacgccgtctttcaggctggtgatgctctgattcagttgtaccacaacttcataactgattttgagacaaagatcaatcttctcaagcttgcacattttgctgttatagtttctcggcagtatcctgagaagcaagctgcaattagttatcttgagggtgtgattgaaaaactccgagcaactaatgagcagcgtaaagaggagccaatcctttacattaagatgcaaatagccatgttcaaacttgagcaaggagatagaaaggagtgcaaaaaacttctcgaagatggaaagagtacacttgacagcatgactgacattgatccatctgtatatgccaactattattgggtgtcatctcagtaccataaatttcaccaggaatttgcagagttctacaaatgtgctcttctttatctggcatacacatctgtggagtctctctcagattcattcaagctggatttggcatttgatctctccctttctgcactgctgggagataacatctacaactttggggaactgctcgcacaccctattataaatagtcttacaggaacaaaggtcgagtggctttactatattctccaggcattcaactctggtgacttagttcgctatcaagaattatgccgtgtacacaatgctgctctgagagctcaaccagcactagttgagaacgagaagaagctattggaaaagattaacattctctgcctgatggaaatcatctttagccggccttctgaggaccgaactattccattaagcatcattgcagagcgcacaaaactttctattgaggatgttgagcatcttctcatgaagtctctctctgttcacctcatagagggtataattgatcaagttgagggcacggtacatgtgtcctgggtgcaaccaagagttttgggaatcccccagatcaaatccttgcgtgatcggctggacagttggttgggcaaagtacatactgctttgttatccatcgaagctgaaacacccgatcttgttgcatcatgatttatttttatttttttttccttctgtgttttcctttctgctccttgtaacaatgtcttttgagaaaacgaaatgaaacatgacaatggcggcaaagaggaggtagagacggtagtttgaaattactaggtcactcagagccaactttgtatgcaaatcctttaattgttgctttacccctttttcgtgaatcattttttttctgaaaggaacagctcatgtgctttccttcaatttagtgtcattgttatggtagtttcttttttagaccacttgaaaattgataatggcttttcactatttaaaattgaagtgattatcgaacta

SEQ ID NO: 1947 - DNA, 1726 bp, Populus trichocarpa
tgagctgaagccagacaaacaatacaaaacccactcttaactcacagagaaaatacaagtgagacgtatcacaaacaaattattaaaaattccttcgaagctcaaaaacacacaaaaagaaactctctctctctctcactctaaatcggcgccatggccgctctacagtacttggagacactgcgcaacgcgcatccagaacttgacgaatggtacaactcactcgcagatctgtaccagaagaagctctggcaccaactcactctcaaactcgaacagtttgtcgctctcgcagtctttcaggctggggatgctcttatacagttgtatcataattttatcaccgactttgagacaaagatcaaccttctcaagcttgcacactttgctgttatagtttctcggcagtatacagagaaagatgctgccattagctatcttgaaggggtgattgaaaagcttcgagcaactagagaacagcgtatagaagaaccagtcctttacattaagatgcaaatagccatattcaagcttgagcagggggatcaaaaggagtgcaaaaggcttttagaagatggaaagagtacccttgacagtatgactgatattgatccgtctgtgtatgccagttattattgggtttcatctcaatactataaacatcgtcaggaattttctgagttctataaaagtgctcttctttatctggcatatacatcagtggagtccctctcagattcatttaagctggatttggcatttgatctctctctttctgcacttttgggtgataacatctacaactttggagagttgcttgcgcatcctataataaagagccttctgggaactcaggttgagtggctctactacattctccaggcatttaactctggtgacttagttcgttatcaagaattgtgccgtgtacacaatgctcccctgaaggcccagccagcattagttcagaatgagccaaagctattagaaaagattaatattctctgcctgatggaaattatctttagccggccttctgaagatcgaactattccattaaaagttattgctgagcgcactaagctttccattgaggacgtggagcatcttctcatgaagagcctttctgtccaccttattgagggtataattgatcaagttgaaggaacagtgcacgtttcgtgggtacagccaagagttctggggattccacagatcaaatccttgcgagatcgactggacaattggttggataaagtgcacactgctttgttatcggttgaggctgaaacacctgatctggttgcatcatgattttttccccatcatctggttcttgatttcctttctgcctactgtaacaatttcgcaaaccaaaaggcgaataatgatgggtggctaagtggagagactagcagcaagtctcatgggcagtcaaggcaaactttgtatgcttccctttcatattccagaatcctttttcgtgaaacgtcaattttattttttattttttttcttaaaggagcagcctgtgtaattcttcacttaggatttgtggcttatataaggtggggtctgccaagagatatggtgaatcagaagaacattctttctttctactcttagaatggttgtcacttaatagactatgttttggtatgtttccattaatattcccaaggtgcgatcctctcgtaagtggattcttctggcaatcattcactaa

SEQ ID NO: 1948 - DNA, 1473 bp, Cucurbita pepo
agaggaagaggcacgaattatataaatcattggagttctctttcttgtctccttccgagaatccatagccggagtagccatggccgctttgcagtacctcgattctcttcgcaactcgcatcctgagctcgctgaatggtacaattcgctagcagatctgtaccagaagaagctttggcatcagctcacacttaagcttgagcagttcgtcgctctcacggtcttccaggctggtgatgcactgattcagttgtatcacaacttcatcactgattttgagaccaaaatcaatcttctcaagcttgcacattttgctgtgattgtttctcggcaatatgcagagaaagaagctgccattagttatcttgaagggataatcgagaaactgaggagtactaaagagcaccgcatagaggagcctatcctttatattaaaatgcaaatagctattttaagctcgagcaaggtgaccgaaaagagtgcaagaaacttttggaagatggaaagagcactcttgacagcatgactgacattgatccatctgtttatgctagctattattgggtttcatctcaattttataagttccgccaagaatttgctgagttctataaaagtgctcttctttatctcgcatatacttcagtggaatcactctcagactcatttaaattggatttgacctttgatttgtctctttctgcacttttgggagataacatctacaactttggagagcttcttgcacatcctattatcaaaagtctgttgggcacaaaggtcgagtggctttactacattcttcaggcattcaattctggtgatttagttcgctatcaagaattatgccaagtccataatgcagctttaagggctcaaccggctttagttgaaaatgaaaagaaactattggagaaaatcaatattctctgcctcatggaaattatcttcagccggccatctgaagatcgaacgatcccattgaaggttatagcagaacgaacaaaactctctattgaggatgtggagcatctactaatgaagagcctgtctgtccaccttatagagggtatcatcgatcaagtcgagggaacggtccatgtttcctgggtgcaaccaagggtactaggcattccacagatcaaatccctgcgagaccgactggacagttgggtggataaagttcattcaactttgctttcagtcgaggccgagacgcctgatctagttgcatcgtaatcctcttcattgcatctctaaacaacttagcagagggaggaagcaaaaagccagaagaaactactgatccttcataagattctcatgtgctggcttggctagctagctagctatcttgcctccatctttcttgaactattttctaggaatcagaagcctctacgtcttagttttgaaagtgagcatggattggaggagttgagaaacggacttaaagagtggttattggactct

SEQ ID NO: 1949 - DNA, 1628 bp, Malus domestica
ttctttgagcacaagctaaataaggtgttttttgggattcacatagatagaaaccaaacaaggccttgggtctccaaccctcgcaaactctctctgaaccagccatggccgcgctgcagtacctggagtcgctgcgcaacgcgcatccggagctcgccgaatggtacaattcactggcagatctgtaccagaggaagctatggcaccagctcactctcaagctcgagcagttcgttgctctcgccgtctttcaggctggtgatgctttaatacagttataccacaatttcatcaccgattttgagactaaaatcaaccttctcaagcttgcacactttgcggtcatcgtttctcgacagtacccagagaaggaagctgctatcagttacctagaaggagtgattgagaagcttcaagccactagagagcaacgcatagaggaaccaatcctttacattaagatgcaaatagcaatattcaaacttgagcaacaagaccaaaaagaatgcaaaaggcttctagaagatggaaagactacacttgacagcatgactgacattgatccatctgtatatgctagctattattgggtatcatctcaatatcataagttccgtcaagaatttgctgagttctacaaaagtgctcttctttatctagcatacacatcagtggagtcgctctcagaatcattcaagctggatctggcatttgatttgtccctttctgcgctcctgggagataatatctacaactttggagagctgcttgcgcatcctattattaagagccttctagggacaaaggtagagtggctttactatattcttcaagcgttcaactctggtgatttagttcggtatcaagaattatgtcgtgtgcacaatgctgctctgagagcacaaccagcattagttgaaaatgagaagaagcttttggagaagattaacattctgtgcttgatggaaattatcttcagccggccatctgaagatcggactataccattgagtatcattgcagagcgcaccaaactttctgttgaggatgtggagcatcttcttgtgaagagcctttccgttcatctgattgagggaataatcgatcaggttgaggagacggtgcatgtgtcctgggtgcagccaagagtattggggattccacagatccaatctttgcgtgataggctggacggttggttggacaaagtccatactgctttgttatcgatcgaggcggaaacacctgatttggttgcgtcttgagtcgccttttgctttattttctgcccagtgtaacaaacccttatcggagaaatggggggttcaaaatgcaagggggccaggaaacactagttttcggttgattgagcactttgggccaactttgtttatgctgcttttcttattggtgaagctttttggttgaatcattttcctggaaggagcggccttgtgtactgtacttgggagtaatactccattgtttagtggcatggcatgcctagagacatggtgaatcgattaaaatgcgctgtcgttatacctttgtattttgaattttcctttccctagataacctaactttatgctttttcattagttttaatgattttctccttctcgcaa

SEQ ID NO: 1950 - DNA, 1747 bp, Cajanus cajan
aaaaaagtggtgtatataaatagagaagaaagagggttagtaatagagagtttcgttctgtttctttttcgtgtgcgtattgcgtgtgtctggggtttgaatcgccatggccgctctgcaatacttggaatcgctccgcaacgcgcaccccgagctcgccgattggtacaattcgcttgcggatctgtaccagaagaagctctggcaccagctcactctcaagctcgagcagttcgtagctctcgccgttttccaggctggtgatgctttaatacaattatatcacaacttcatcacagactttgagaccaaaattaaccttctcaagcttgcacattttgctgttatagtttctcggcaatattctgagaaagaagctgctgttggttatcttggaggggtcattgagaaactgcaagccacaagagagcagcgcatagaagaacctattctttacattaagatgcaaatagcaatattcaagcttgagcaaggtgatcaaaaggaatgcaagaaacttctagaagatggaaagagtacacttgacagcatgacagatatcgatccatctgtatatgctagctattactgggtatcatctcagtatcataaaacacgtcaagaatttgctgagttctacaaaagtgcccttctctacttggcatacacatcagtggagtccctatcagaatcattcaagctggatttggcattcgatttgtccctctctgcccttcttggggataacatctacaactttggagagctacttgcccatcctataattaagagccttctggggacaaaggtggaatggctttactatattctccaggcattcaattctggtgatctagcacgatatcaagagttatgtcgggtgcataatgcttctttaagagcccaaccagcactagttcaaaatgaacagaagttgttggaaaagatcaacattctctgtctgatggagattatattcagtcggccttccgaagatcgaactattcccttgagtgtaattgcagagcgaaccaaactttctatagagaatgtggagcatctccttatgaagagcctatctgtccatctaattgagggtataattgatcaagttgaagggacagtgcacgtttcatgggtgcagccaagagttctgggtattcaacagatcaaatccttacgggatcgactggacagttggacaggaaaagtacacactgcattgttgtccatcgaggcggaaacacctgatctaattgggtcgtgattttcttttatttgttttctgccatctgtaacaatttcttaagttaaagggaacacttcctaaggcgacaaaagatgaggagacttccaagtgacatgggcaatatagccaactttatatgcttcatttgggttttgcctgctgcattttgaatgattgctggaaagaacagccccttgtacttggcttagaaattgttggttctatgctttaatgcctagggacatggttcgaaacaggctgtttttacgctttagagtgatcacaaactatgtatctcgaatttttcttagatacggccatttttattcacttcagaagtttcttttaattgaattgtgcccaagcattcaccatcatttgcctaatttgtcatgtactttaatttggtactgcttgccatgagatgaatcttctgtttgttatataattaatattagttagaccttgcacttctctcatatctgcgataaaaaaaaa

SEQ ID NO: 1951 - DNA, 1614 bp, Castanea mollissima
tctttttctttattttctcttctctctctctctctctaagttcgaagttccagacatggccgcgccgctgcaatacctggagacactgcgcagcgctcacccagagctgggcgagtggtacgcttctcttgcagatctgtaccagaggaagctctggcaccagctcactgccaagctcgagcagttcgtcgctctcaccgtcttccaggctggtgatgctctgatacagttatatcacaatttcatcaccgactttgagaccaaaatcaatcttctcaagcttgcacattttgctgtcatagtttctaggcaatattcagagaaagaagctgctattaattatctagaaggagtgattgagaaacttcaagcaactagagagcagcgaatcgaagaaccaatcctttacattaagatgcaaatagccatatttaaacttgagcaaggtgaccaaaaagagtgcaagaagcttctagaagatgggaagagtacccttgacagcatgacggatattgatccaactgtctatgctaactattactgggtttcatctcagtactacaaatttcgtcaagaatttgctgagttctataaaagcgctcttctttatctggcatacacatcagtggagtctctctcagattcatttaagctggatttggcatttgatttgtccctttctgcattactgggagataacatctacaactttggagagctgcttgcccatcccattattaagagtcttctagggacaaaggttgagtggctctactatatccttcaggcattcaactctggggatttggttcgttatcaggaactatgccatgtgcacaatgctgctctgagggctcaaccagcattagttgagaatgagaagaagcttttggaaaagataaacattctctgcttgatggaaattatattcagccggccgtctgaagatcgaaccatacctttgagtatcattgcggagcgcacaaaactttctatagaggatgtggagcatcttcttatgaagagcctttctgttcatctgattgaaggtataattgatcaagttgagggcacagtgcatgtatcctgggtgcagccaagagttctgggtgttccacagatcaaatccttgcgtgaccgtctggacaactggttggataaagtgcacactgccttgttatccgttgaggctgaaacacctgatcttgttgcatcatgattcgtgtttattgatttgctttctgcccattgtaacgattccttaaccaaaaaaaagggataaaattgctaaggcgacaaacagagatacacagactaaagtgtaagttgcttgggcagtagggccagctttgtatgcttcctttcttattgcctgtttcatcattttcctggaaggagcaacctcttgtacttcacttcggagtcattggtactatagtggcatgcctacagacatggtgcatcaaaatgaaaaacggctgtttttagactttagagtgattattaaactatgtattttgaaattttcttggatacggtcacatgcgatctctttctgcttattaagtgcatttcctttaatggttatcatttaatttgttgcacacgtaattg

SEQ ID NO: 1952 - DNA, 1704 bp, Quercus alba
atggggacactattcttttctttacgccaaagaaatcttttattctttttatatatataaaaataaatatataacaaaaaccaacacacacagaccgagcttctccgattgctttttaatattttcactctctctctctctctctctctcagttcagagttccagacatggctgcgccgctgcaatacctggagacactgcgcagcgctcacccagagctaggcgagtggtacgcttctcttgcagatctgtaccagaggaagctctggcaccagctcactgccaagctcgagcagtttgtcgctctcaccgtcttccaggctggtgatgctctgattcagttgtatcacaatttcatcactgactttgagaccaaaatcaatcttctcaagcttgcacattttgctgtcatagtttctaggcaatattcagagaaagaagctgctattaaatatctagaaggagtgattgagaaacttcatgcaactagagagcagcgaattgaagaaccaatcctttacattaagatgcaaatagctatatttaaacttgagcaaggtgaccaaaaagagtgcaagaagcttctagaagatgggaagagtacccttgacagcatgacggatattgatccatctgtctacgctagctattactgggtttcatctcagtactacaaatttcgtcaagaatttgctgagttctataaaagtgctcttctttatctggcatacacatcagtggagtctctctcagattcatttaagctggatttggcatttgatttgtccctttctgcattactgggagataacatctacaactttggagagctgcttgcccatcccattattaagagtcttctagggacaaaggttgagtggctctactatatccttcaggcattcaactctggtgatttggttcgttatcaggaactatgccatgtgcacaatgctgctctaagggctcaaccagcattagtagagaatgagaagaagcttttggaaaagataaacattctctgcttgatggaaattatattcagccggccatctgaagatcgaaccatacctttgagtatcattgcggagcgcacaaaactttctatagaggatgtggagcatcttcttatgaagagcctttctgttcatctgattgagggtataattgatcaagttgagggcacagtgcatgtatcctgggtgcagccaagagtattgggtgttccacagatcaaatccttgcgtgaccgtctggacaactggttggataaagtgcacacggccttgttatccgttgaggctgaaacacctgatcttgttgcatcatgattcgtgtttattgatttgctttctgcccattgtaacgattccttaacaaaaaaaaaggggataaaattgcaaaggcaacaaaaagagatactcagactaagtgtaagttgcttgggcagtagggccagctttgtatgcttcctttcttattgcctgtttcatcattttcctggaaggagcatcctcttgtacttcacttcggagtcattggtactatagtggcatgcctagagacatggtggatcaaaatgaaaaacggctgttttagactttagagtgattattaaactatttattttgaaattttcttggatacaattacaagtgatctctttctgcttattaagtgcatttcctttaatggttatcattt

SEQ ID NO: 1953 - DNA, 1587 bp, Gossypium hirsutum
aaaaaaaaaaaaaccctactttacgcttcagcttctcttcgactgtgtagtggaatcgggatccatggcggccttgcaatacctggaatctcttcgaaatgagcatccagagctagccgactggtatagttctctagcagatctgtatcagaagaagctttggcatcagctcactctcaagcttgaacagttcgttgctctcaccgtctttcaggctggagatgcactgatacagttgtatcataattttatcactgactttgagaccaagattaatcttctcaagcttgcacattttgctgttatagtttctcggcagtattctgacaaagaagcttctactagttatcttgaaggtgtgatcgaaaagcttcaggctactaaagagcagcgcatagaagagccaattatttatattaagatgcaaattgccaaatttaagcttgagcagggtgaccaaaaggagtgcaagaaacttcttgatgatggaaagagtactcttgacagtatgactgacatagatccttctgtatatgctagctattattgggtttcatctcaataccataaatttcgtcaagaatttgctgacttctacagaagtgctctcctttatcttgcatacacatctgtggcgtccctgtcagaatcctttaagctggatttggcatttgatctgtccctttctgctcttctgggtgataacatctacaactttggagaactgcttgcacatcccattataacaagtcttcttgggactagggttgagtggctttaccatatcctccaggccttcaactcaggtgatctagctcgctatcaagaattgtgtcatgtgcacaatgctgcattgagggctcaaccagccttggttgagaatgagaagaagctgtctgaaaaaatcaatattctatgcttaatggagattatcttcagccgcccatccgaagaccgaaccataccgttaaaagttattgctgagcgaacaaaactgtccattgaggatgttgagcatcttctcatgaagagcttgtctgttcatctgattgagggcacaattgatcaagttgagggtacagttcatgtctcctgggtgcagccgagagttctgggaattccacagatcaaatccttacgtgacaggttggataattgggtaggcaaagtacaaactgcttggttatcaatcgaggctgaaacacctgatcttgttgcagcatgaattttttctcccctcaagttcctttctgcccattgtaacaatttcgttattggaaaaaaaaaaaaaaaaagagagaagttaatggtgagcaatgaggatagagacaagtgtaagtgatgtggggatattagttgatagttgatcctggaattcttctattcttgtggaaggagtgtcccctcctttgtactttctttttcacgtttggtcatttgttggatatttacagtggcatatatgcctaaggatacttgttaaacttgagaatagctagtttccttctcttttttaactttgtattgggagttctaatttacatacaatcagatatatgaaccactttcatgtggatcatatgataa

SEQ ID NO: 1954 - DNA, 1520 bp, Cucurbita pepo
aatcggagctctcgttttttcccttccagaatccatagccggaatagcagccatggccgctttgcagtacctcgattcgcttcgtatctcgcatcctgaactcgcggaatggtacaattcgctcgcagatctgtaccagaagaagctttggcatcaactcacactcaagcttgagcaatttgtcgccctgaccgtcttccaggctggtgatgcactgattcagttgtatcacaacttcatcactgattttgagaccaaaatcaatcttctcaagcttgcacatttcgcagtgattgtttctcggcaatatgcagagaaagaagctgctattagttatcttgaagggataattgagaagctaaggagcactaaagagcagcgcatagaggagcccatcctctatattaagatgcaaatagctgtttttaagctcgagcaaggtgaccgaaaagagtgcaagaaacttttggaggatggaaagagcactcttgacagcatgaccgacattgatccatctgtctatgctagctattactgggtttcatctcagttttataagtttcgccaagagtttgctgagttctataaaagtgctcttctttatctggcatatacttcagtggagtcactgtcagactcttttaaattggatttggcctttgatttgtctctttctgcacttctgggagataacatctacaactttggggagcttcttgcacatcctattattaaaagtctgttgggcacaaaggtcgagtggctgtactacatacttcaggcattcaatgcgggtgatttagttcgctatcaagaattgtgtcaagtgcataatgcagctttaagggctcaaccagctttagttgagaatgagaagaaactattggagaaaatcaacattctctgccttatggaaattatcttcagccggccatccgaagatcggactattccattgaaggttatagcagaaaggacaaaactttctatagaggatgtggagcatctactaatgaagagcctctctgtccaccttatagaaggtataatcgatcaagtcgaggggacagtgcatgtttcctgggtgcaacccagagttcttggcattcaacagatcaaatccctgcgagaccggctagacaactgggtggataaagtacattcgactttgctttcagttgaggccgagacccccgatctagtcgcatcataatcctcttcatttcatatcgaaacaacttagcaaaggagaaggaaggggagagggacaaaacaaaagccagggaccaactgatcctttctataatgttcatgtgctggttggttttcaagctgtcttttcatcttacctactgctttcttgaactattttttaggaagcagaagcctctacttcagtctagttagttttaaaagtgagcatgaattggaggagtagagaacagacttaagattggatattatacttctgtatttgttacttttattgcatacaattgagttttactgagctgaatgct

SEQ ID NO: 1955 - DNA, 2013 bp, Gossypium raimondii
tttaacagaaggatcgacttactttttggtctaatgtacatagactaatttgttttttttaagtatgagaatcaatttttaacaatgaaaataaataaaatttttatcagaaaaattaagttatttttaatataacatagaaacattaatttatttaaatttttaattagagagacaaaatacaataacttctaatattaaaaaaagtagcactatgaaccaaattcgttgcgtaacccgacccactttactttttagtacaacacaacatgcccggcccgatatcttttgcctttctcgggttccgttattcttttctttgggcacaagacacacaaaacatcatttttttcagagttcaataaataatagaaaaaaccaaaattgaaaaaagaaattgaaaaaaaaaaccctactttacgcttcagcttctcttcgactgtgtagtggaatcgggatccatggcggccttgcagtacctggaatctcttcgaaatgagcatccagagctagccgactggtatagttctctagcagatctgtatcagaagaagctttggcatcagctcactctcaagcttgaacagttcgttgctctcaccgtctttcaggctggagatgcactgatacagttgtatcataattttatcactgactttgagaccaagattaatcttctcaagcttgcacattttgctgttatagtttctcggcagtattctgacaaagaagcttctactagttatcttgaaggtgtgatcgaaaagcttcaggctactaaagagcagcgcatagaagagccaattatttatattaagatgcaaattgccaaatttaagcttgagcagggtgaccaaaaggagtgcaagaaacttcttgatgatggaaagagtactcttgacagtatgactgacatagatccttctgtatatgctagctattattgggtttcatctcaataccataaatttcgccaagaatttgctgatttctacagaagtgctctcctttatcttgcatacacatctgtggcgtccctgtcagaatcctttaagctggatttggcatttgatctgtccctttctgctcttctgggtgataacatctacaactttggagaactgcttgcacatcccattataacaagtcttcttgggactagggttgagtggctttaccatatcctccaggccttcaactcaggtgatctagctcgctatcaagaattgtgtcatgtgcacaatgctgcattgagggctcaaccagccttggttgagaatgagaagaagctgtctgaaaaaatcaatattctatgcttaatggagattatcttcagccgcccatccgaagaccgaaccatacctttaaaagttattgctgagcgaacaaaactgtccattgaggatgttgagcatcttcttatgaagagcttgtctgttcatctgattgagggcacaattgatcaagttgagggtacagttcatgtctcctgggtgcagccgagagttctgggaattccacagatcaaatccttacgtgacaggttggataattgggtaggcaaagtacaaactgcttggttatcaatcgaggctgaaacacctgatcttgttgcagcatgaattttttctcccctcaagttcctttctgcccattgtaacaatttcgttattggaaaaaaaaaaaaagagaagttaatggtgagcaatgaggatagagacaagtgtaagtgatgtggggatattagttgatagttgatcctggaattcttctattcttgtggaaggagtgtcccctcctttgtactttctttttcacgtttggtcatttgttggatatttacagtggcatatatgcctaaggatacttgttaaacttgagaatagctagtttccttctcttttttaactttgtattgggagttctaatttacatacaatcagatatatgatccacttttatgtggatcatatgatatgaaagtgcattttcattttagaatgttctttttta

SEQ ID NO: 1956 - DNA, 3712 bp, Gossypium raimondii
ctctactgattttcatgtttctagttaaatattatttattacactaacaaaagcaaatggtaagaaaaaaaagaaagaaaacgagaatctaatcttatcagacacaaaaaacacccattacgcaaagcaagcttaaactaaagccaaccctaacctaaagttgccccactcttatcatcttctctgtccttttatgcttgtctcttcacagaacctgtaacgtcatcaccatttgttattgcagcatataactctggttcccagttgactttttttatttttggctttcaacggatctaagatctgaggacccttttgtctgaaatagagtttcccatagctgggaaatagacaacaacatggttggtctttttcctagattttctgttggcaaagctggtcatcgacgatcccagagtgctcttgtggaaggggaagtggtgcctccaattccggatgttgcaacagtagcagcggccactgctgcccctactactgctcatggaatcgaagtagcggtggagtttaaaccggtagaacatccaattgaacctttggacaacgaccagccgattcaatgcccattgcctgagccttcaattctaaatgacggaagaatatggaaggagcgtgtatcagctagcgtacggaggagagccgacttgccggttatgcaagatggaggcacccttcaatctcaatccgaatccgaagctactgtcggaaccaaacctcggccgacctcaaatcgtatgatcttaccgtctctaagtgctccggaacataatttactaaagctccttgaagaatgtactgcatctaggatctaaaagcatgctgctacaatgctacttcaacttcattggaataatttgcatgtcatctataaacatcaaaccatatatatacatcatggaaacgttacccactgtatatctaataaatcacgtctaaatttaaatccttcttttcatttctacttaaatttaattttaactattttatgtctataaaaaaattaaattataattttttttagaataaaatgtaattgtccaaccaaatgacatgcataaagcataacgatgaaaattttgcatatcattaattattttgattggctcgtaatcattaattatttttataaaaataaaaataaacattttcatggtagtgaaagaaaaacttgcaatacattatcatgctgaatgaaattttagtgcaattaaaatgtttaatgtatattcttttatggtgtatataaaacaaaacaaattattaatattaatataataaataactttttttttaaaaattcgcttctacttggtccgacctgttcaaatgactcatttgaaaaataataaaaatataattttacttgccaaaaaaataaaaataaaaactatattatatgtatttataattagaattaaatacaaatattttgtctaattacaaaagataaaagtaccatgaaagttgttatactacatgttaaattgcattgtgtcctctttactcaaaaaatgagtaaaataattcttatacattagataaaaagtaaattagtcttttttattaaaagtttcatcaatttatactattaaaaattgacctaattagcgggataaccaaatattaatacatgacatgccacatttaccatatgttgtataggaatcggttttaaaataaaaatagataaaaattttaacagaaggatcgacttactttttggtctaatgtacatagactaatttgttttttttaagtatgagaatcaatttttaacaatgaaaataaataaaatttttatcagaaaaattaagttatttttaatataacatagaaacattaatttatttaaatttttaattagagagacaaaatacaataacttctaatattaaaaaaagtagcactatgaaccaaattcgttgcgtaacccgacccactttactttttagtacaacacaacatgcccggcccgatatcttttgcctttctcgggttccgttattcttttctttgggcacaagacacacaaaacatcatttttttcagagttcaataaataatagaaaaaaccaaaattgaaaaaagaaattgaaaaaaaaaaccctctttacgcttcagcttctcttcgactgtgtagtggaatcgggatccatggcggccttgcagtacctggaatctcttcgaaatgagcatccagagctagccgactggtatagttctctagcagatctgtatcagaagaagctttggcatcagctcactctcaagcttgaacagttcgttgctctcaccgtctttcaggctggagatgcactgatacagttgtatcataattttatcactgactttgagaccaagattaatcttctcaagcttgcacattttgctgttatagtttctcggcagtattctgacaaagaagcttctactagttatcttgaaggtgtgatcgaaaagcttcaggctactaaagagcagcgcatagaagagccaattatttatattaagatgcaaattgccaaatttaagcttgagcagggtgaccaaaaggagtgcaagaaacttcttgatgatggaaagagtactcttgacagtatgactgacatagatccttctgtatatgctagctattattgggtttcatctcaataccataaatttcgccaagaatttgctgatttctacagaagtgctctcctttatcttgcatacacatctgtggcgtccctgtcagaatcctttaagctggatttggcatttgatctgtccctttctgctcttctgggtgatgacatatacaactttggagaactgcttgcacatcccattataacaagtcttcttgggactagggttgagtggctttaccatatcctccaggccttcaactcaggtgatctagctcgctatcaagaattgtgtcatgtgcacaatgctgcattgagggctcaaccagccttggttgagaatgagaagaagctgtctgaaaaaatcaatattctatgcttaatggagattatcttcagccgcccatccgaagaccgaaccatacctttaaaagttattgctgagcgaacaaaactgtccattgaggatgttgagcatcttcttatgaagagcttgtctgttcatctgattgagggcacaattgatcaagttgagggtacagttcatgtctcctgggtgcagccgagagttctgggaattccacagatcaaatccttacgtgacaggttggataattgggtaggcaaagtacaaactgcttggttatcaatcgaggctgaaacacctgatcttgttgcagcatgaattttttctcccctcaagttcctttctgcccattgtaacaatttcgttattggaaaaaaaaaaaaagagaagttaatggtgagcaatgaggatagagacaagtgtaagtgatgtggggatattagttgatagttgatcctggaattcttctattcttgtggaaggagtgtcccctcctttgtactttctttttcacgtttggtcatttgttggatatttacagtggcatatatgcctaaggatacttgttaaacttgagaatagctagcttccttctcttttttaactttgtattgggagttctaatttacaatcaatcagatatatgatccacttttatgtggatcatatgatatgaaagtgcattttcattttagaa

SEQ ID NO: 1957 - DNA, 2032 bp, Ricinus communis
aacaaacaaaattagtattcttttctttacggtcaagccagaaaaggagtatagagagagtgagaggggcctttgctttgatagttcacatatacagataaatctttttctaaaaaagaaagaggcaaaaacccaaattacatttatcatctctgtgaaatctctctctgtcagagtgatggccgctctacagtatctggagtcattgcgcaacgcgcatcccgaactagctgaatggtacaattcgcttgcagatctgtatcaaaagaagctatggcaccagctcactctcaagctcgagcagttcgttgctctcgccgtctttcaggctggtgacgctctgatacagttgtatcacaattttatctccgattttgagaccaaaattaatcttctcaagcttgcccactttgcggttatagtttctcggcagtataaagagaaagaagctgccatcagttatcttcaaggtgtaattgaaaagcttatagcaactagagaactacgcattgatgagccaattctttacattaagatgcaattagctatcttgaagctcgagcaaggggatcaaaaagagtgcaagaaacttctagaagatggaaagagtacactagacagcatgactgatattgatccatctgtttatgccagttactattgggtttcatctcagtaccataagtaccgccaagagtttgctgagttctacaaaagttctcttctttatctggcatatacatcagtggaatccctctcagattcattcaagctggatttggcatttgatctttccctctctgcgcttctgggagataacatctacaacttcggagaattgcttgctcatccaattatcaagagccttctgggaacacaagttgagtggctctactatatccttcaagcattcaattctggggatctagttcgctaccaagaattatgccgtgtgcataacgcatctctgagggcccagccagcattagttgagaatgaacagaagctattggaaaaaattaacattctttgcctgatggagattatctttagccgtccttctgaagatcgaactattccattaactatcattgctgagcgcactaagctctccgttgaggatgtggagcatcttctcatgaagagtctttccgtccatcttattgagggtataattgatcaagtcgagggaacagtacatgtgtcctgggtgcagccaagagttctggggattccacagatcaaatccttgcgagaccgactggataactggttggagaaagttcacactgctttagtatccatcgaatctgaaacaccggatctagttgcattgtgattgtctatcttttggttgttttccttgtgtttcttaattacctccccgcccactgtaacaatttcttaattgaaaagggaaaaactcgtaggcagcaaaaagtggagagacaatagtaagtcacttgggcttttcatattgtagaatcctttttactgaatcatttttctaaaaggagcagctatgtactttctttcactttgaatttgtctgtcagctagtaagatgggatgcctactcgagatacagtattctattgagcaagaaaaaggttcagcgtggttacttaaactaagtaatttgattatttagaatttccatttgactagttaggaatttattgcatttatttctgttgctatttgcataactttttttagtcttgtgcatggatttaactttgtatactgttgcagtgatgtttttcttgtgacaagagaataatgggcttgtccgtccagtctcatggatttattttgcaatattgatttgtgaatttggactgggctttcattctggttccaaatttccattctcataagaattccaactaaattatatatatatttactttcttgatttctgaaaataaaaatgtaaaaaaagttcaataaaaaaagaaaaagaaaagaaaagaaaagaaaagaaagtcatctaaattatgatttccctctcacagtctctgaacgccaa

SEQ ID NO: 1958 - DNA, 1503 bp, Euonymus alatus
ggagtcagaaataaacaaaagcattcttctcctcttccgctctgagtcggtctatttggttctggtgatagttgttgaacacacagccatggcagctctgcaatacctcgagacgttgcgtgacgcgcatccggagctgtcggaatggtacaattcgctggcggatctgtacgagaagaagctctggcatcagctcgctctcaagctcgagcagtttgtcgctctctccgtcttccaggctggcgatgctctgatacaattatatcacaatttcatcaccgacttcgagacaaagatcaaccttctcaagcttgcacattttgctgttatcgtttctcgtcagtatccggagaaagaggctgccattagttatcttgaaggggtgatagaaaagctacgagctactaaagagagtcgcatagaggaacctatcatttacataaaaatgcaaattgctctcctcaaactagagcaaggggatcagaaagagtgcaagaaactccttgaagaggggaagagtgctctggatagtatgacagacattgatccatctgtgtatgccagtttctactgggtttcatctcaatatcataaatatcgtcaggaatttgctgagttctacaaaagcgcccttctttatctggcatacacttcggtggagtctctgtcagattcattcaagctggatttggcatttgatctttccctatctgcactgctgggagataatatctacaactttggagaattgcttgctcatcctattattaagtgcctcctaggaacaaaggttgaatggctttaccatattcttcttgcattcaactctggggatctgtttcgctatcaagaattatgtcgtgtgcacaatgctgccctaagtgctcaaccagcattggttgagaatgagaagaagctgctggaaaaaatcaacattctttgcctcatggaaattatcttcagccgcccatctgaagatcgaactattccgttaactgctattgctgagcgcacgaaactctctattgaggatgtggaacatcttttaatgaagagtctctctgtacatcttattgagggtataattgatcaagttgagggaacggttcatgtatcctgggttcagccaagagttctgggggttcaacagatcacatctttaagagactggcttgacaactggttggataaagtacatactgctttgttatccatcgaagcagaaacaccagatttagttgcatcatgatttgctttttggcttgattttcattccgccctttgtatcaaatttttaatcttaattagaagcaaaaatgcgaagacaggaaacagagagagactagtaaggcccgtggattgtctgtactcttccttttaatattgcaccatccattttatttagccgtttcctgaaagcagcggcttgtttcctcgacttttgttgtgttgggtcttaaatggcatgcctagtgacatggtgaaaaaacatccttctgatta

SEQ ID NO: 1959 - DNA, 1318 bp, Flaveria ramosissima
aaagaaacctcattcgaaatcaatcaccctatacacaaatcccccaaatctccctccggcaacacttccgatatcaccgtcggagatccgccggcgatggcagctcttcagtacctcgattctctccgtaacactcaccctgagctctccgattggtacaatacgcttgcagatctgtaccagaggaagctatggcaccaactcactctaaagctcgaacaattcgtcgcactcgctgtgtttcaggctggcgatgctctcatacagctatatcataatttcataactgacttcgaaactaagatcaatcttctcaagcttgcacattttgctgttatagtgtctcgccagtattctgagaaagaagctgccatcagttatcttgaaggagtgattgagaagcttagagctacaaaagagatgcgtatagaggaaccaatcgtttatattaagatgcagatagctctttttaatcttgaaaaaggagatcaaaaggagtgcaagaatcttctagaagatgggaagagtacacttgatagcatgactgacattgacccatctgtatatgctaattactattgggtgtcatctcagtaccataaatctcgccaagagtttgctgaattctacaagaattctctactttatttggcctacacctcagtggagtctctctccgattcatttaagctggatcttgcatttgatctatctttatctgctttactgggagataacatttacaactttggggaactacttgcacatccaataattaaaagtctaatagggacaaaggttgagtggctctattatattcttgaagcattcaatgctggagatcttgttcgctatcaagaattatgtcgtgttcatgcagcttcactcaacgcccaacctgctttggtggagaatgagaagaagcttctagaaaagattaacattctctgcttgatggaaattatcttcagtcggccatcagaggacagaaccattccattaaacatcattgcagagcgaacaaaacttacagttgaagatgttgaatatcttctcatgaagagtttatcggtgcatcttattgaggggataattgatcaagttgaaggaacagtttacgtgtcgtgggtgcaacctcgagttttgggaataagtcagatcaaatctttgcgtgatcggttggacaactgggtagggaaagtacacactgctttggtatctgttgaagcagaaacaccagatttagttgcatcttaagtttgtattcgacaatattgtttcttgttttgtaatactcacaaaagccccgaggatagtt

SEQ ID NO: 1960 - DNA, 1485 bp, Flaveria ramosissima
tttcttcaaggaaaagaaatcacatacgaaatcaaacaagggtttatatattataatacacaaatcctctcaatcatccctacggcaacagttttcgtgaatccatcagcgatgtcagctcttcagtacctcgattctcttcgtaacactcaccctgagctctccgattggtacaacacgcttgcagatctgtaccaaaggaagctatggcaccaactcactctaaagctcgaacaattcgtcgcactcgctgtttttcaggcgggtgatgctctcatacagctatatcataatttcatcactgactttgagactaagattaatcttctcaagcttgcacattttgctgtcatagtctctcgccagtatgcagagaaagaagctgccattagctatcttgaaggagtaattgaaaaactccgagctacaaaagagatgcgtatagaggaaccaatcgtttatatcaagatgcaaatagccatttttaatcttgagaaaggagatcaaaaggagtgcaagaatattctagacgatggaaagagtacccttgatagcatgacagacattgatccgtctgtgtatgctaattattattgggtaacatcccagtaccataaagctcgccaggagtttgctgaattctacaagaattctctactctatttggcctacacttcggttgagtctctctcagattcatttaaattggatcttgcatttgatctatctctatctgctttactgggagacaacatttacaactttggagaactacttgcacatccaataataaaaagtctgctagggacacaggttgaatggctgtactatattctagaagcattcaacaatggggatctagttcgctatcaagaactatgtcgggttcatgcagcttctcttaacgctcagccggctttagtggagaacgagaagaagcttctagaaaagattaacatcctttgtttgatggaaattatcttcagtcgaccatcggaagacagaaccattccattgagcatcattgcagaacggacaaaacttacagttgaagatgttgaatatcttctcatgaagagtttatctgtgcatcttatcgagggaataattgatcaagttgaaggaaccgtttatgtgtcatgggtgcagcctagagttttgggaataagtcaaataaagtctctacgtgatcgcttggacaactgggtcgggaaagtgcacactgctttggtgtcggttgaagccgaaacaccggatttagttgcatcttaaatcaacaatctcgtttcttgttttgttttgtaacacactcttggatggcttgttgtccaagttatccaggtgaacttgatgtaagatacctattcgttttcgacttcttaagactgttgagcctcatatgtaccttactttccgtttttgatctgtggttggatagaaacttgttgaatgcaacaatctattagcaagattgcaattacaatc

SEQ ID NO: 1961 - DNA, 1235 bp, Flaveria ramosissima
aatcaatcactcttatatacaaatctcccaaatctccctccggcgacaacttccggtatcaccgtcggagatccgccggcgatggcagctcttcagtacctcgattctctccgtacgactcaccctgagctctccgattggtacaatacgcttgcagatctgtaccagaggaagctgtggcaccaactcactctaaagctcgaacaattcgtcgcactcgctgtttttcaggctggcgatgctctcatacagctatatcataatttcatcactgacttcgaaactaagatcaatcttctcaagcttgcacattttgctgtaatagtgtctcgccagtattcagagaaagaagctgccataagttatcttgaaggagtgattgagaagctcagagctacaaaagagatgcgtatagaggaaccaatagtttatattaagatgcagatagccctttttaatcttgaaaaaggagatcaaaaggagtgcaagaatcttctagaagatgggaagagtacacttgatagcatgactgacattgacccatctgtatatgctaattactattgggtgtcatctcagtaccataaatctcgccaagagtttgctgaattctacaagaattctctactttatttggcctacacctcagtggagtctctatccgattcatttaagctggatcttgcatttgatctatctttatctgctttactgggagataacatttacaactttggagaactacttgcacatccaataattaaaagtctactagggacaaaggttgaatggctctattatattcttgaagcgttcaatgctggagatcttgttcgctatcaagaattatgccgtgttcatgcagcttcactcaacgcccaacctgctttggtggagaatgagaagaagcttctagaaaagattaacattctctgcttgatggaaattatcttcagtcggccatcagaagacagaaccattccattgagcatcattgcagagcggacaaaacttacagttgaagatgttgaatatcttctcatgaagagtttatcggtgcatcttattgaggggataattgatcaagttgaaggaacagtttacgtgtcgtgggtgcaacctcgagttttgggaataagtcagatcaaatctttgcgtgatcggttggacaactgggtagggaaagtacacactgctttggtatctgttgaagcagaaacaccagatttagttgc

SEQ ID NO: 1962 - DNA, 1471 bp, Flaveria ramosissima
caagggtttatatatcatcatatatacacaaatcctctcgatcatccctacggcaacagtttcgtgaatccattagcgatgtcagctcttcagtacctcgattctcttcgtaacactcaccctgagctctccgattggtacaatacgcttgcagatctgtaccaaaggaagctatggcaccaactcactctcaagctcgaacaattcgtcgcactcgctgtttttcaggcgggtgatgctctcatacagctatatcataatttcatcactgactttgagactaagattaatcttctcaagcttgcacattttgctgtcatagtctctcgccagtatgcagagaaagaagctgctatcagctatcttgaaggagtaattgaaaaactccgagctacaaaagagatgcgtatagaggaaccaatcgtttatatcaagatgcaaatagccatttttaatcttgagaaaggagatcaaaaggagtgcaagaatattctagacgatggaaagagtacccttgatagcatgacagacattgatccatctgtgtatgctaattattattgggtaacatcccagtaccataaagctcgccaggagtttgctgaattctacaagaattctctactttatttggcgtacacttcggttgagtctctctcagattcatttaaattggatcttgcatttgatctatctctatctgctttactgggagacaacatttacaactttggggaactacttgcacatccaataataaaaagtctgctagggacacaggtggaatggctgtactatattctagaagcattcaacaacggggatctagttcgctatcaagaactatgtcgggttcatgcagcttctcttaacgctcagccggctttggtggagaacgagaaaaagcttctagaaaagattaacatcctctgtttgatggaaattatcttcagtcgaccatcggaagacagaaccattccattgagcatcattgcagaacggacaaaacttacagttgaagatgttgaatatcttctcatgaagagtttatctgtgcatcttattgagggaataattgatcaagttgaagggacagtttatgtgtcatgggtgcaacctagagttttgggaataagtcaaataaagtctctgcgtgatcgcttggacaactgggtcgggaaagtgcacactgctttggtgtctgttgaagcagaaacaccggatttagttgcatcttaaagtcaacaatctcgtttcttgttttgtaacacactcttggatggcttgttgtccaagtcttccaggcgaaattgatgtaagatacctattcgttttcgtactttttaagacttttgagtcctcaaatgtaccttactttccgttttgattctgtggttggatagaaacttgtcgaatgcaacaatctattagcaagattgcaattacaatcaacctctttattcgttgacta

SEQ ID NO: 1963 - DNA, 1544 bp, Tripterygium wilfordii
ctgtttggttctggtgatagttgttgaactcagccatggcagctttgcagtatctcgagacgcttcgtagcgcgcatccggagctatcggaatggtacaattcgctggcggatctgtacgagaagaagctctggcaccagctcactctcaagctcgagcagtttgtcgctctctccgtctttcaggctggcgatgctctgatacaattatatcacaatttcatcaccgactttgagacaaagatcaaccttctcaagcttgcacattttgctgtcatcgtctctcgtcagtatccggagaaagaggctgccattagttatcttgaaggggtgatagaaaagctacgagctactaaagagagtcgcatagaggagcctatcctttacatcaaaatgcagattgctctcctcaaacttgagcaaggcgatcagaaagagtgcaagaaactccttgatgaggggaagagtgctctggataccatgacagatattgatccgtctgtgtatgccagtttctattgggtttcatctcaatatcataaatatcgtcaggaatttactgagttctacaaaagcgcccttctttatctagcatacacttcagtggagtctctgtcagattcattcaagttggatttggcatttgatctttccctatctgcgctgctgggagataacatctacaactttggagaattactcgctcatcctattattaagagtctcctaggaacaaaggttgaatggctttaccatattctcctggcattcaactctggtgatctggttcgctatcaagaattatgccgtgtgcacaatgctgccctaagtgctcaaccagcgttggttgagaatgagaagaagctactggaaaaaatcaacattctctgcctcatggaaattatcttcagccgcccatctgaagatcgaactattccgttaactgttattgctgaccgcacgaaactttctattgaggatgtggagcagcttctgatgaagagtctatctgtacatcttattgagggtataattgatcaagttgtgggaacagttcatgtatcctgggtacagccaagagttttgggggttcaacagatcacatctttaagagaccggcttgacaactggttggataaagtacacactgctttgttatccatcgaagcagaaacaccagatttagttgcatcatgatttgcattttggcttgattttctttctgccctttgtatcaaatttttaatcttaattagaagcagaaatgcgaagacaggacagagagagagagagactagtaaggccctggattgtcatggcatccctgtactcttgtttttcatattgcaccatccattttatttagccgtttcctgaaagcagcggcttgtttcctcgacttttggttgtgttggttcttaaaaggcatgcctagagacatggtgaaaaaacatccttcggattataaccatttttggagtggttactgtattatgtgtttatgtatttgagaaatttcatctgatggagtatggtgtgataaac

SEQ ID NO: 1964 - DNA, 1555 bp, Theobroma cacao
cggtgaaatcgggatcgatggcggccttggaatacctagagactcttcgaaatgagcacccagagctagccgactggtacaattctctagcagatctgtatcagaagaagctctggcaccagctcactctcaagcttgagcagttcgtcgctctcaccgtctttcaggctggagatgcactgatacagttgtatcataattttatcactgactttgagaccaagattaatcttctcaagcttgcacattttgctgtcatagtttctcggcagtacgcagagaaagaagctgctatttgttatcttgaaggggtgatcgaaaagcttcaggctactagagagcagcgcatagaagagccaattctctatattaagatgcaaattgccaaattcaagctcgagcagggtgaccaaaaggagtgcaagaaacttcttgaagatggaaagagtactctcgacagtatgaccgacattgatccatctgtatatgctagctattattgggtttcatctcaatattataaatttcgccaagaatttgccgaattctacaaaagcgctctcctttatcttgcttacacatcagtggagtctctctcagaatcttttaagctggatctggcatttgatctgtcgctttctgctcttttgggagataaaatctacaactttggagaactgcttgctcatcctattataaagagtcttctgggtaccaaagttgagtggctttactatatcctccaggccttcaactcaggggatttagttcgctatcaagaattgtgtcgtgtgcacaatgctgcattgagggctcaaccagccttggttgagaatgagaagaagctattggaaaaaataaatattctatgcttaatggagattatcttcagccgcccatccgaagatcgaactattccattaaaagttattgctgagcgaacaaaactgtcgattgaggatgttgagcatcttatcatgaagagcctatctgttcatctgattgagggcataattgatcaagttgagggaactgttcatgtctcctgggtgcagccgagagttttgggaataccacagatcaaatccttgcgagaccggttggataattgggtgggcaaagtacacactgcttggttatcgattgaggctgaaacgcctgatcttgttgcatcatgatttttttccctagttccttttgtgcccattgtaacaatttcgtaatttgaagaaagaacaaaaaaggaaaggcaatggtgagcaatgaggatggagtctagtgtaagtcgtgtggggagtggagccaactttgtatgcttcctttaaagatactacttgatccttttcttaaatcattcttctcaaaggagcggctcttgtacttttcagttttcagcatttgttggatctacaatggcactgacatgcctaaggatacggtcagatttgaaaacagcatccttttcttttttaaggtggttcttccaacttttgtattgggatttttccttagatacaatcagatatgatccacttttatgtggatttttagttca

SEQ ID NO: 1965 - DNA, 1391 bp, Centaurea maculosa
ctctttctctttctctccgacgtcaatctatcatcggaattcagccggcggcgatggcagctcttcagtacctggattctcttcgtactactcatccggagctctccgattggtataacacccttgccgatctctaccaaaggaagctatggcaccaactcactctcaagctcgaacaattcgttgccctagctgttttccaggctggtgatgctctgatacagctatatcataatttcatcaccgactttgagactaagatcaaccttctcaagctggcacattttgccgttacagtctctcggcaatattcagagaaagaagctgccatcagctatcttgaaggtgtgattgaaaagctccgagctacaaaagagatgcgcatagaggagccaatcctttacattaagatgcagatagccgtctttaatcttgagaaaggagatcagaaggagtgcaagaatcttctagacgatggaaagagtacgcttgatagtatgactgacattgatccatccgtatatgccaactactattgggtatcatctcagtaccataaatctcgccaggagtttgctgagttctacaagagttctcttctatatttggcatacacctccgtagagtctctgtcagatgcatttaagctggatcttgcatttgatctatcgttatctgcattgctgggagataacatttacaacttcggagaactacttgcacatccaataataaaaagtctgttagggacaaaggttgaatggctctactatattcttgaagcattcaactctggagatctagttcgctatcaagaactatgtcgtgttcatgcagcttctcttaatgctcaacctgctttagtggagaacgagaagaagcttttggaaaagattaacattctctgtttgatggaaattatcttcagtcgaccatcagaagagagaaccatcccattgagtatcattgcagagcggacaaaacttactgttgaagatgtagagtatcttctcatgaagagtttatctgtgcatcttatcgagggaattatcgatcaagttgatggaacggtttacatatcgtgggtgcaacctagagttttggggatagctcaaatcaaatctttgcgtgatcggctggacaactgggtcgggaaggtacacaccgctttgatatccgtggaagcagaaacacccgatttagttgcatcttaagtttttcgtttctacatgttgtctcttcttgttttgtaacaattcttgaaagcccaaatgacagctcggaagacggtatgttaaagatgtttagtgttgaggcaatttcagcaaactttatgtacgatactactacttgttcattttcatcttttcaacgactgttttaactttgaa

SEQ ID NO: 1966 - DNA, 1570 bp, Phaseolus vulgaris
ataaaactttctttatttcgtattttgggtttctctctttcgtcaatcttaatggctgctctgcaatacctggaatcgctgcgcaacgcgcatcctgaactcgccgaatggtacaattcgctcgcggatctgtaccagaagaagctctggcatcaactcaccctcaagctcgagcagtttgttgcactcgctgtttttcaggctggtgatgcgttgattcaattatatcacaatttcatcacagacttcgagactaaaatcaaccttctgaagcttgcgcattttgctgttatagtttctcggcagtattctgaaaaggaagctgctgttgcttatcttggaggagtcattgagaagttggaggccactagagagcagcgcatagaagaacctatcctctacattaagatgcaaatagcaatattcaagcttgagcaaggtgaccagaaggaaagcaagaaactcctagaagatgggaagactacacttgacagcatgacagatattgatccatctgtatatgctaactatttctgggtatcgtctcaatttcacaagacgcgccaagaatttgcagagttctacaaaagtgcccttctctatctggcatacacatcggtggagtctctatcagaatcattcaagctggatttagcatttgatttgtccctctctgcccttcttggggacaacatctacaactttggagagctacttgcccatcctataatcaagagccttctagggacaaaagtggaatggctttactatattctgcaggcgttcaattctggtgatttagaacgatatcaagaattgtgtcgggtgcataatgctgctttaagagcccaaccagcactggttcaaaatgaaaagaagttgttggaaaagatcaacattctctgtctgatggagattatattcagtcggccttcagaagaccgaactattcccttgagtgtaattgctgagcggacaaaactttctatagagaatgtggaacatctcctaatgaagagcttatctgttcatctaattgagggtataattgatgaagttgagggcacagtgcatgtttcctgggtgcaaccaagagttctgggtattcaacagatcaaatccttacgggatcgacttgacagttggacagggaaagtacacactgcattgttgtccatcgaggctgaaacacctgatctaatcggatcgtgaattttcttttatttgttttctgtcctttgtaacaatttcttaggttaaagagaacacatcctaaggcgacaaaagatgaggagacttccaagtgacatggggccaactttgtatgcttcatttgggtttgcctgctgctttctgagtgattgctggaaagagctgccccttgtacttcacttagaaattgttggttctatgcttgcaaacttacagacatggtagctcatttcaaccctggctgtttttactcattagagttattgcagactatgtatctggaattttctgtgatacggccatttttatcgactgttagaagtaattttcattgaacagtcccaagcattccaccttc

SEQ ID NO: 1967 - DNA, 1707 bp, Phaseolus vulgaris
aaagaagaagggtataaatagagaagaaataagagggcacagtataaaactttctttatttcgtattttgggtttctctctttcgtcaatcttaatggctgctctgcaatacctggaatcgctgcgcaacgcgcatcctgaactcgccgaatggtacaattcgctcgcggatctgtaccagaagaagctctggcatcaactcaccctcaagctcgagcagtttgttgcactcgctgtttttcaggctggtgatgcgttgattcaattatatcacaatttcatcacagacttcgagactaaaatcaaccttctgaagcttgcgcattttgctgttatagtttctcggcagtattctgaaaaggaagctgctgttgcttatcttggaggagtcattgagaagttggaggccactagagagcagcgcatagaagaacctatcctctacattaagatgcaaatagcaatattcaagcttgagcaaggtgaccagaaggaaagcaagaaactcctagaagatgggaagactacacttgacagcatgacagatattgatccatctgtatatgctaactatttctgggtatcgtctcaatttcacaagacgcgccaagaatttgcagagttctacaaaagtgcccttctctatctggcatacacatcggtggagtctctatcagaatcattcaagctggatttagcatttgatttgtccctctctgcccttcttggggacaacatctacaactttggagagctacttgcccatcctataatcaagagccttctagggacaaaagtggaatggctttactatattctgcaggcgttcaattctggtgatttagaacgatatcaagaattgtgtcgggtgcataatgctgctttaagagcccaaccagcactggttcaaaatgaaaagaagttgttggaaaagatcaacattctctgtctgatggagattatattcagtcggccttcagaagaccgaactattcccttgagtgtaattgctgagcggacaaaactttctatagagaatgtggaacatctcctaatgaagagcttatctgttcatctaattgagggtataattgatgaagttgagggcacagtgcatgtttcctgggtgcaaccaagagttctgggtattcaacagatcaaatccttacgggatcgacttgacagttggacagggaaagtacacactgcattgttgtccatcgaggctgaaacacctgatctaatcggatcgtgaattttcttttatttgttttctgtcctttgtaacaatttcttaggttaaagagaacacatcctaaggcgacaaaagatgaggagacttccaagtgacatggggccaactttgtatgcttcatttgggtttgcctgctgctttctgagtgattgctggaaagagctgccccttgtacttcacttagaaattgttggttctatgcttgcaaacttacagacatggtagctcatttcaaccctggctgtttttactcattagagttattgcagactatgtatctggaattttctgtgatacggccatttttatcgactgttagaagtaattttcattgaacagtcccaagcattccaccttcgaggctgttttcttgtaacagcaataaattgatcaaatgacacgaatggtgacagaaatactaaatgttttaacactctgttgaacaaagaatt

SEQ ID NO: 1968 - DNA, 2099 bp, Theobroma cacao
gttggacctttttgggctttatcaagagaggcccaaataaaaaaatcattagtttggacaaaatcgtgggcctcaaataaagaaatttattttaagggtaggcaagagacgtgcaactacaaggtaacccgaaaaggccattacgaaccggcccatttgatgtttaaaagcgctacataccacaacacaacattacaacccgacccggacaataagtcctctttttctcgggtttcgttattcttttctttcagctcaagacacagagagaacaaaagcttcttttttttttttttcatttccataattcaaatatatataaatagagagaaactacgaacgcttcaccttctatttcgttgtgttcgactccgtggcggtgaaatcgggatcgatggcggccttggaatacctagagactcttcgaaatgagcacccagagctagccgactggtacaattctctagcagatctgtatcagaagaagctctggcaccagctcactctcaagcttgagcagttcgtcgctctcaccgtctttcaggctggagatgcactgatacagttgtatcataattttatcactgactttgagaccaagattaatcttctcaagcttgcacattttgctgtcatagtttctcggcagtacgcagagaaagaagctgctatttgttatcttgaaggggtgatcgaaaagcttcaggctactagagagcagcgcatagaagagccaattctctatattaagatgcaaattgccaaattcaagctcgagcagggtgaccaaaaggagtgcaagaaacttcttgaagatggaaagagtactctcgacagtatgaccgacattgatccatctgtatatgctagctattattgggtttcatctcaatattataaatttcgccaagaatttgccgaattctacaaaagcgctctcctttatcttgcttacacatcagtggagtctctctcagaatcttttaagctggatctggcatttgatctgtcgctttctgctcttttgggagataaaatctacaactttggagaactgcttgctcatcctattataaagagtcttctgggtaccaaagttgagtggctttactatatcctccaggccttcaactcaggggatttagttcgctatcaagaattgtgtcgtgtgcacaatgctgcattgagggctcaaccagccttggttgagaatgagaagaagctattggaaaaaataaatattctatgcttaatggagattatcttcagccgcccatccgaagatcgaactattccattaaaagttattgctgagcgaacaaaactgtcgattgaggatgttgagcatcttatcatgaagagcctatctgttcatctgattgagggcataattgatcaagttgagggaactgttcatgtctcctgggtgcagccgagagttttgggaataccacagatcaaatccttgcgagaccggttggataattgggtgggcaaagtacacactgcttggttatcgattgaggctgaaacgcctgatcttgttgcatcatgatttttttccctagttccttttgtgcccattgtaacaatttcgtaatttgaagaaagaacaaaaaaggaaaggcaatggtgagcaatgaggatggagtctagtgtaagtcgtgtggggagtggagccaactttgtatgcttcctttaaagatactacttgatccttttcttaaatcattcttctcaaaggagcggctcttgtacttttcagttttcagcatttgttggatctacaatggcactgacatgcctaaggatacggtcagatttgaaaacagcatccttttcttttttaaggtggttcttccaacttttgtattgggatttttccttagatacaatcagatatgatccacttttatgtggatttttagttcagtttcatttcagaaatttcattttattcataaattaggttgtttggcttgcatgtgcactgtcaaatttgcattgagctcaagttgttccccttcggactcatcagcttctgtaaagaatggccttagagcgcccgttccatctgctaataacataacgcaggtgct

SEQ ID NO: 1969 - DNA, 1790 bp, Manihot esculenta
gagctcacgacagaaagtagcagtgggagaggtttttcaaatttctcatctatacattggaattcccaagcaatcaacgcaccctcaaaaaaatatccgccatggctgctctgcagtacctggagtctctgcgcaacgcgcatccagaacacgccgagtggtacaattcacttgcagatctgtaccagaagaagctctggcaccaacttactctcaagcttgaacagttcgttgctttcgctgtcgttcaggctggtgatacattgatacagctgtatcataattttatctccgactttgagaccaaaattaatcttctcaagcttgcgcattttgcggttatagtctctaagcagtataaagagaaagatgctgccgttagctatcttgaaggggtgattgaaaagcttcgaacaactaaagaacaacacattgaagagccaattctttacattaagatgcaattagctatcttcaagcttgagcaaggggatcaaaaggagtgtaagaagcttttggaagatggaaagagcacactggacagtatgactgatattgatccaactgtatatgccaattattattgggtttcatctcagtaccataaataccgtcaagaatttgctgagttctacaagagtgctcttctttatctagcatacacatccgtggaatccctctcagaaccttttaaactggatttggcatttgatctctctctttctgcacttctgggagataacatctacaacttcggagaactgcttgctcatcctgttataaatagccttctgggaacacaagtggagtggctttactatattcttcaggcatttaactctggtgatctagttcgctaccaagaattgtgtcgtgtgcataatgcatccctgagatcccagccagcattagttgagaatgagcagaagttattggaaaagattaacattctttgcctgatggaaattatctttagccgtccttctgaagatagaactattccactaagtgtaattgctgagcgcacaaaactttccattgaggatgtggagcatcttctcatgaagagtctttctgtgcatcttattgagggtataattgaccaagtggagggaacagtacatgtgtcttgggtgcagccaagagttctggggattccacagatcaaatccttgcgagatagattggataattggctggataaagtgcacactgccttattatccattgaagctgaaacacctgatctagtagcgtcatgattttcttttgctcttttatttggctcttttcctttttgttatttatttactcgctgcccattgtaacaatttcttaatcgaaaagggcaaaaaagaattcataggcggctaagtgaagggactagagtaagtcacgctagggcagtcagagccaactttgtttgattccatatcatattgcagaatcctttttcccgaatcaaatttcttataaggcgcagctgattacgttttcacttggagtttgccatctccaaggggcatgcttaagagatgcactgaattgattgaagaaaacaaaaaattcctaattcagtgtggctggttaaactgatttgtattgggaaatttggtctgatccatctgtgtgttgttgctatcaaatggttgctttatgttccttgtaacatttcatttcacttcatttcatttctgattgctattctcatagcaaatgttagttgatagtggaacaaagagattcatatactatgactttggctttattttattatgttctttgagtgc

SEQ ID NO: 1970 - DNA, 1490 bp, Centaurea maculosa
taatccctcacacaaaggttaggttcccccaatcttcttctctccgacgacgtcaatctatcatcggaattcattcagccggcggcgatggcagctcttcagtacctagattctcttcgtactactcatccggagctctccgattggtataacaccctcgccgatctctaccaaaggaagctatggcaccaactcactctcaagctcgaacaattcgttgcactcgctgttttccaggctggtgatgctctgatacagctatatcataatttcatcaccgactttgagactaagatcaaccttctcaagctggcacattttgccgttacagtctctcggcaatattcagagaaagaagctgccatcagctatcttgaaggtgtgattgaaaagctccgagctacaaaagagatgcgcatagaggagccaatcctttacattaagatgcaaatagccgtctttaatcttgagaaaggagatcagaaggagtgcaagaatcttctagatgatggaaagagtacgcttgatagtatgactgacattgatccgtccgtatatgccaactattattgggtatcatctcagtaccataaatctcgccaggagtttgctgagttctacaagagttctcttctatatttggcatacacctccgtagagtctctgtcagatgcatttaagctggatcttgcatttgatctatcgttatctgcattgctgggagataacatttacaacttcggagaactacttgcacatccaataataaaaagtcttttagggacaaaggttgaatggctctactatattcttgaagcatttaactccggagatctagttcgctatcaagaactatgtcgtgttcatgcagcttctcttaatgctcagcctgctttagtggagaacgagaagaagcttttggaaaagattaacattctctgtttgatggaaattatcttcagtcgaccatcagaagagagaaccatcccattgagtatcattgcagagcggacaaaacttactgttgaagatgtagagtatcttctcatgaagagtttatctgtgcatcttatcgagggaattattgatcaagttgatggaacggtttacatctcgtgggtgcaacctagagttttggggatagctcaaatcaaatctttgcgtgatcggctggacaactgggtcgggaaggtacacaccgctttgatatccgtggaagcagaaacacccgatttagttgcatcttaagtttttcattttctacatgttgtctcttcttctcttgtaacaattcttgaatgcccaaacggcagctcggaagacggtatgttaaagatgtttagtgttgaggcaatttcagcaaactttatgtacgatacttactacttgttcattttcatctttcccacgactgtcttaactctgaatcgagtctcctctgtatcttacttttggtttatgaatcgggtttatattttgcatctttaagt

SEQ ID NO: 1971 - DNA, 1473 bp, Centaurea maculosa
  misc_feature (29)..(29): n is a, c, g, or t
  misc_feature (61)..(61): n is a, c, g, or t
  misc_feature (65)..(65): n is a, c, g, or t
  misc_feature (191)..(191): n is a, c, g, or t
  misc_feature (248)..(248): n is a, c, g, or t
  misc_feature (377)..(377): n is a, c, g, or t
  misc_feature (1070)..(1070): n is a, c, g, or t
  misc_feature (1288)..(1288): n is a, c, g, or t
  misc_feature (1388)..(1388): n is a, c, g, or t
  misc_feature (1406)..(1406): n is a, c, g, or t
  misc_feature (1419)..(1419): n is a, c, g, or t
aggttaggttccccaatcttcttctctcngacgacgtcaatctatcatcggaattcattcngccngcggcgatggcagctcttcagtacctagattctcttcgtactactcatccggagctctccgattggtataacaccctcgccgatctctaccaaaggaagctatggcaccaactcactctcaagctngaacaattcgttgcactcgctgttttccaggctggtgatgctctgatacagctatancataatttcatcaccgactttgagactaagatcaaccttctcaagctggcacattttgccgttacagtctctcggcaatattcagagaaagaagctgccatcagctatcttgaaggtgtgattgaaaanctccgagctacaaaagagatgcgcatagaggagccaatcctttacattaagatgcaaatagccgtctttaatcttgagaaaggagatcagaaggagtgcaagaatcttctagatgatggaaagagtacgcttgatagtatgactgacattgatccgtccgtatatgccaactattattgggtatcatctcagtaccataaatctcgccaggagtttgctgagttctacaagagttctcttctatatttggcatacacctccgtagagtctctgtcagatgcatttaagctggatcttgcatttgatctatcgttatctgcattgctgggagataacatttacaacttcggagaactacttgcacatccaataataaaaagtcttttagggacaaaggttgaatggctctactatattcttgaagcatttaactccggagatctagttcgctatcaagaactatgtcgtgttcatgcagcttctcttaatgctcagcctgctttagtggagaacgagaagaagcttttggaaaagattaacattctctgtttgatggaaattatcttcagtcgaccatcagaagagagaaccatcccattgagtatcattgcagagcggacaaaacttactgttgaagatgtagagtatcttctcatgaagagtttatctgtgcatcttatcgagggaattatngatcaagttgatggaacggtttacatctcgtgggtgcaacctagagttttggggatagctcaaatcaaatctttgcgtgatcggctggacaactgggtcgggaaggtacacaccgctttgatatccgtggaagcagaaacacccgatttagttgcatcttaagtttttcattttctacatgttgtctcttcttctcttgtaacaattcttgaatgccnaaacggcagctcggaagacggtatgttaaagatgtttagtgttgaggcaatttcagcaaactttatgtacgatactactacttgttcattttcatctttncaacgactgttttaactntgaatcgagtctnctctgtatcttacttttggtttatgaatcgggtttatattttgcatctttaagt

SEQ ID NO: 1972 - DNA, 1444 bp, Cirsium arvense
tacatatacatatatactaatcccccacgcaaaggttaggttcccccaatcttcttctctccgacgacgtcaatctatcatcggaattcattcagccggcggcgatggcagctcttcagtacctagattctcttcgtactactcatccggagctctccgattggtataacaccctcgccgatctctaccaaaggaagctatggcaccaactcactctcaagctcgaacaattcgttgcactcgctgttttccaggctggtgatgctctgatacagctatatcataatttcatcaccgactttgagactaagatcaaccttctcaagctggcacattttgccgttacagtctctcggcaatattcagagaaagaagctgccatcagctatcttgaaggtgtgattgaaaagctccgagctacaaaagagatgcgcatagaggagccaatcctttacattaagatgcagatagccgtctttaatcttgagaaaggagatcagaaggaatgcaagaatcttctagatgatggaaagagtacgcttgatagtatgactgacattgatccgtccgtatatgccaactattattgggtatcatctcagtaccataaatctcgccaggagtttgctgagttctacaagagttctcttctatatttggcatacacctccgtagagtctctgtcagatgcatttaagctggatcttgcatttgatctatcgttatctgcattgctgggagataacatttacaacttcggagaactacttgcacatccaataataaaaagtcttttagggacaaaggttgaatggctctactatattcttgaagcattcaactccggagatctagttcgctatcaagaactatgtcgtgttcatgcagcttctcttaatgctcagcctgctttagtggagaacgagaagaagcttttggaaaagattaacattctctgtttgatggaaattatcttcagtcgaccatcagaagagagaaccatcccattgagtatcattgcagagcggacaaaacttactgttgaagatgtagagtatcttctcatgaagagtttatctgtgcatcttatcgagggaattatcgatcaagttgatggaacggtttacatctcgtgggtgcaacctagagttttggggatagctcaaatcaaatctttgcgtgatcggctggacaactgggtcgggaaggtacacaccgctttgatatccgtggaagcagaaacacccgatttagttgcatcttaagtttttcattttctacatgttgtctcttcttctcttgtaacaattcttgaatgcccaaacggcagctcggaagacggtatgttaaagatgtttagtgttgaggcaatttcagcaaactttatgtacgatactacttgttcattttcatctttccaacgactgtttaactttgaatcgag

SEQ ID NO: 1973 - DNA, 1858 bp, Cucumis melo
attcttttctttgagaacaagaaaaagaaacagaggaagaggcagaaattatataaattggatttctcttttttctttcttttccctcttcgaaaatccatagccggagcagccatggccgctttacagtacctcgattcccttcgtaactcgcatcctgagcttgctgaatggtacaacaccctcgcagatctgtaccagaagaagctttggcatcagctcacgctcaagcttgagcaattcgtcgctctgaccgtcttccaggctggtgatgcactgattcagttgtatcataacttcatcactgattttgagaccaaaatcaatcttctcaagcttgcacattttgctgtgattgtctcacgtcaatatgcggagaaggaagccgccattagttatcttgaagggataattgagaaactaaggagtactaaagagcagcgcatagaggagcctatcctctatattaagatgcaaatagctatttttaaacttgagcaaggtgaccgaaaagagtgcaagaaactattggaagatggaaagagcactcttgacagcatgacggacattgatccatctgtttatgctagctattattgggtttcatctcaattttacaagttccgccaagaatttgctgagttctataaaagtgctcttctttatctagcatacacctcagtggaatcactgtcagactcatttaaattggatttggcatttgatttatctctttctgcacttctgggagacaacatctacaactttggagagcttcttggacatcctattatcaaaagcttgctgggcacaaaggtcgagtggctttactacattcttcaggcattcaattctggtgatttagttcgctatcaagaactatgccaagtccataacgcagctttaagggcccaaccagctctagttgagaatgagaagaaactattagagaaaatcaacatcctctgcctcatggaaattatcttcagccggccgtctgaagaccgaaccattccattgaaggttatagcagagcggacaaaactttctatagaggatgtggagcatctactaatgaagagtctctctgtccaccttatagagggtataattgatcaagtcgaggaaacggtacacgtttcctgggtgcaacctagggttctgggcattcaacagatcaagtccctgcgagaccggctggacaattgggtggataaagtgcattcgactttgctctcagtcgaggccgagacccctgatctagttgcatcataatcctcttcatttcatctctaaacaatttagccgagggacaaaacaaaagccaggagaaactactgccgatcctctatatgatgattttcatttgctggctggctggctggttttgaagctgtcttttcatcttgcctactgctttcttgaactattttctaggaagcagaagcctctacttcagtctagttagttttaaaagtgagcatggattggaggagttggaatggacttaagtgggtattagacttccttctgtatttgttttacttttgttgcatacaattgagttttgatgtgctccatggaaatcgatttcatgattaagtttaaatcttataaaccagacttcttacaacgcatataatctcatttcttcatgcctaatatgggaagcctaatgagctatacaaaattacaagacatccttctacaacataaatccaacatttcacttccttttgaacatgaatatggagaacatttggatttaggcttgctaatgcccaagtacaaatcaaaactctcaaaaaaattgcaagaatcaccttattcaaggaggagagtagatgtaagggaagca

SEQ ID NO: 1974 - DNA, 1615 bp, Fragaria vesca
aaatagagaaaccaaacagagcctaatacactcctcttctgattcacagccatggccgctctgcaataccttgaatcctctcgcaacgcgcacccggagctggccgaatggtacaattcccttgcagatctgtaccagaagaagctatggcaccagctcactctcaagctcgagcagttcgtcgccctcgccgtctttcaggctggggatgctctgatacagttatatcacaatttcatcacagacttcgagacaaaaatcaaccttctgaagcttgctcactttgcagttattgtgtctcgtcagtatccagagaaagaagctgctatcaattaccttgaaggggtaattgagaagcttcacaccactagagagcaacggatcgaggaaccaatcctttacatcaagatgcaaatagcaattttcaaacttgagcaacaagaccagaaggagtgcaaaaagcttctagaagatggaaagagcacactggacaatatgactgacattgatccatccgtttatgccagttattattgggtttcatctcaatactataagttccgccaggaatttgctgagttctacaaaagtgctcttctttatctggcatacacatcagtggagtctctttcagattcatttaagctggatttggcatttgatctgtctctttctgcactcctgggagataacatctacaactttggagagctacttgcccatcctattatcaagagtcttctagggacaaaggtagagtggctttactatattcttcaagcattcaactctggtgatttaggttgttatcaagaattatgccgtgtgcacaatgctgccctcagtgctcaaccggcattagttgagaacgagaagaagcttctggaaaagatcaacattttgtgcttgatggaaattatcttcagccggccatctgaagatcgaactatacctttgagtatcattgcagagcgtacaaagctttcgattgaggacgtagagcatcttcttgtgaagagcctttctgttcatctgattgagggaataattgatcaagttgaggggacggtgcatgtttcgtgggtgcaaccaagggttttgggagttccacaaatcaagtctgtgcgtgatcggctggacggttggttggataaggtccatactgctttattatccattgaagccgaaacaccagatttggttgcatcgtgagtgatatttgttgctatattctgcctagtgtaacatttccatagcgaaaaagtggggggtcaaaatctgcaaggcagttagatgaaaacattagtctcatttgcttgagcacctggacctacttttgtatgttgcgttttcttgaaatcattttcctcctcgtgtacttcacttgggactaattccattctacagtagcatgcctagagacatggtgatcaaattgaaaaacggctatttaccttttagcatggctatgaaactctatgttctgaaattttcttagataccgtaatgtgtgttcaaattgaaagacggctgtttaccttctattgaactgtgtatgttcggcagttttctttaaattagaagatgattgttcacccttaagcatttctattct

SEQ ID NO: 1975 - DNA, 1381 bp, Tripterygium wilfordii
ttcttccgctttgagtcggtctctctggttctggtgataatagtcgttgaactcagccatggcagctctgcagtatctcgagtcattgcgcaacacgcatccggagctatcggaatggtacaattcgctggcggatctgtacgagaagaagctctggcaccagctcactctcaagctcgagcagtttgtcgctctcgccgtcttccaggctggcgatgctctgatacaattatataacaatttcatcacctactttgagacaaagatcaaccttctcaagcttgcacattttgctgttgtcgtatctcgtcaatatccggataaagatgctgccattagttatcttgaaggggtaatagaaaagttacgagttactaaagaaaatcgcatagaggagcctatcctttacatcaaaatgcaaatcgctcttttcaaacttgagcaaggggatcaaaaagagtgcaagagactccttgaagaggggaagagtgctctagacagtatgacggatattgatccttctgtgtatgccagtttttattgggtttcatgtcaatatcataaatatcgtcaggaatttgctgagttctacagaagcgctcttctttatctggcatacacttcagtggagtctctgtcagattcattcaagctggatttggcatttgatctttccctatctgctctgctgggagataacatctacaactttggagaattgctcgctcatcctattattaagagcctcctaggaacaaaggttgaatggctttaccataatcttctggcattcaactctggggatctggttcgctatcaagaattatgtcgtgtgcacaatgctgccctaagtgctcaaccagcattggttgagaatgagaagaagctactggaaaaaatcaacattctctgcctcatggaaattatcttcagccgcccatctgaagatcgaactattccgttaactgctattgctgaacgcacgaaactctctattgaggatgttgagcatcttctgatgaaaagtctctctgtacatcttattgagggtataattgatcaagttgagggtacagttcatgtgtcctgggttcagccaagagttttgggggttcaacagatcacatctctaagagaccggcttgacaactggttggataaagtacatactgctctgttatccatcgaagcagaaacaccagatttagttgcatcatgatttgctttttgtcttgatttccctccgacccttgtatcaaaattttaactttgattagaagcaaaaatgcgaagacagaaaaaatatagagagagagaatgagactagtaaggccttggattgtcatgcgatcgctgtactcttcctttccatattgcacca

SEQ ID NO: 1976 - DNA, 1720 bp, Phaseolus vulgaris
aataagagagagtacaaaggttctcaatttcgtagtttgggggttttctctggtttcaatcgctatggctgctctgcaatacttggaatcgctgcgcaattcgcaacctgagttggctgaatggtacaattcgcttgcggatctgtatcagaagaagctatggcatcagctcaccctcaaactcgagcagtttgtcgcactcgctgtttttcaggctggtgatgcgttgattcaattatatcacaatttcatcacagactttgagactaaaatcaaccttctgaagcttgcgcattttgctgttatagtttctcggcagtattctgaaaaagaagcggcaattggttatcttggagcagtcattgagaaactgcaagccaccagagaacagcgcatagaagaacctatcctttacattaagatgcaaatagcaatattcaagcttgagcaaggtgaccagaaggaaagcaagaaactcctagaagatggtaagactacacttgacagcatgacggatattgatccatctgtatatgccaattattactgggtatcatctcaatttcacaagacccgccaagaatttgcagagttctacaaaagtgcccttctctatttggcatacacatcagtggagtctctctcagaatcatttaagctggatttagcatttgatttgtccctctctgcccttcttggggacaacatctacaactttggagagctacttgcccatcctataatcaagagccttctagggacaaaagtggaatggctttactacattctgcaggcattcaattctggtgatttagtacgatatcaagaattgtgccgggtgcataatgctgctttaagagcccaaccagcactggttcaaaatgaacagaagttgttggaaaaaatcaacattctctgcctgatggagattatattcagtcggccttcagaagatcgaactattcccttgaatgtaattgctgagcgtaccaaactttctatagaaaatgtggaacatctcctgatgaagagcttatctgttcatctaattgagggtataattgatcaagttgagggcacagtgcacgtctcctgggtgcaaccaagagttttgggtattcaacagatcaaatccttaagggatagacttgacagttggacagggaaagtacacactgcattgttatccatcgaggcagaaacacctgatctaatcggatcgtgatttttctttatttgttttctgccattgtaacaatttcttaggttaaagagaacacatcctaaggcgacaaaagatgaggagacttccaagttacatggagcctggtttgcctgctgctttctgagtcactgctggcaagagcagccccttgtacttggcttagaaactgttggttctgtgcttgcaaacttacagacatggtaactcgtttccacccaggctgtttttacgaattagtgtgatgacagactatgtatctggaattttctttgatacgaccatttttattgacttttagaagtaattttcattgaacagtcccaagcattcacgttcttttgccatttttcatccactctgaatcttttctgttatttgtgtgaggctgttttcttgtaacagcaataaaatgatgaattgacacgactggtgatagagatgctaaatgttttaacacattcttgaacatactttttttcttataggataaagttt

SEQ ID NO: 1977 - DNA, 1933 bp, Cannabis sativa
gatcctttcccggcatcacggcatcacttatcaaaattaccaatttacccattaccaaaattacgtatttatgtgtatatacttttctttaagcacaagttaaaatggaaagaaacgtttttttccagattcatataaattaaaaaacaaacgaggtcttgcctcagaaatctctcccattgcagagacctttctctctttatatctactctctctctctctctctctctctctctctcaaacatggccgcgctgcaatacctagagtctctgcgcagcgcacatccggagctgggtgattggtacaattcgcttgcagatctgtaccagaagaagctctggcaccaactcactctcaagctcgaggagttcgtagccctcgctgtcttccaggctggggatgctctaatacagttatataataatttcatcactgactttgagactaaaatcaatcttctcaagcttgcacattttgcagtcattgtttctcggcaatatcctgaaaaagaaacagccattgggtatcttgaaggggtgatagagaagcttagagccactcgggagcagcgtatagaggagccagtcctttacattaaaatgcaaattgccatattcaaacttgagcaagaccaaaaggagtgcaaaaacctcctagaagatggaaagagtacacttgacagcatgactgacattgatccgtctgtgtatgccatttattattgggtttcttctcaataccataaatttcgtcaagagtttgctgagttctacaaaagtgctcttctttacttagcatatacctcagtggaatctctgtcagaatcatttaagctggacttggcatttgatttgtcgctttctgcacttcttggggataatatctacaactttggcgagctgctggcacatcctattattaaaagtcttctagggacaaaggttgagtggctgtactatattcttcaagcattcaacactggtgatttagttcgctatcaggaattatgtcgtgtgcacaattctgctttgagtgctcagccagcgctggttgagaatgagaagaagctagtggaaaagattaacattctatgtttgatggaaatcatcttcagccggtcatctgacgacaggactatacctttgagtataattgctgagcgcactaaactttccattgaggatgtggagcatctccttatgaagagtctttctgttcatctgattgaaggcataatcgatcaagttgatggaaccgtgcatgtttcctgggtgcaaccaagagttttggggattccacagatcaaatcgttgcgagaccggctggacaactggttggataaagtgcacaccgcattggtatccatcgaggcagaaacacctgacttggttgcatcatgagttgacttcttttcttaacaagaaaggcagtaaaaaaaaagtacatgggatgggtggcctcaaaagagatttagcctcgtttgcttgggcagacgaggcttctttgtatgcctgctttttctttttcatattgcctctcctgcgtttcttgaatcatttttctgaaaggagttgcttcttatacttcacttcggagtagtaaattttatagtggcatgcctagagacatgatccatttgatgatcaattaaaagacggctgttgtttactttcttagctatgatattaaaccaatgtattttgaatttttcttagttacagttacttgatccatttgattcagatcagctgctttgctttagattgtttaaaattaaaattgtcatggttcgtatgagagagagtggattgggttttcagtttacactatgataaatagctatcttttagaaacacttcggtgaactaattttcacaaagaatcctgctgtttcgaaaagaagctagataacttagatactatttagataaa

SEQ ID NO: 1978 - DNA, 1348 bp, Cirsium arvense
aagggtttataaactaatccccaagcaagccctttccggttcttaatcctccctccgacgacagtttcgacatcatcatcgggagacagtcggccatggcagctcttcagtatctagattctcttcgtagtactcatccggagctctccgattggtataatacgcttgccgatctgtatcaaaggaagctatggcaccaactcactctcaagcttgaacaattcgttgcactcgctgtttttcaggctggtgatgctctcatacagctatatcataatttcatcacagacttcgagactaagatcaaccttctcaagctggcacattttgccgttacagtctctcggcaatatgcagagaaagaagctgccattagctatcttgaaggagtgattgaaaagctacgagctacaaaagagatgcgcatagaggagccaatcctttatattaagatgcagatagccgtctttaatcttgagaaaggagatcagaaggagtgcaagaatcttctagatgatggaaagagtacgcttgatagtatgactgacattgatccgtccgtatatgccaactattattgggtgtcatctcagtatcataaatctcgacaggagtttgctgagttctacaagagttctctactttatttggcatacacctccgtagaatctctgtcggattcatttaagctggatcttgcatttgatctatcgttatctgcattgctgggagataacatttacaactttggagaactacttgcgcatccaattataaaaagtctgataggaacaaaggttgaatggctttactatattcttgaagcattcaactctggagatctagttcgctatcaagaactatgtcgtgttcattctgcttctcttaatgctcagcctgctttagtggagaacgagaagaagcttttggaaaagattaacatcctctgtttgatggaaattatcttcagtcgaccatcagaagagagaaccattccgttgagtatcattgcagagcggacaaaacttactgttgaagatgtagaatatcttctcatgaagagtttatctgtgcatcttatcgaggggataattgatcaagtagatggaacagtttacatatcgtgggtgcaaccaagagtgttggggataactcaaataaaatcgttgcgtgatcggttggacaactgggtcggaaaggtacacactgctttgatatctgtggaagctgaaacacccgatttagttgcatcttaaaactccttttttttcacttctactactactactacatgttttgtaacaattaattcttgaaagatgctagtgttgaggtaatttcagcaaaa

SEQ ID NO: 1979 - DNA, 1753 bp, Humulus lupulus
accaacactctctttgtgactcagccatggccgcgctgcaatacctagagtctctgcgcagcacacatccagagctgggtgattggtacaattcgcttgcagatctgtaccagaagaagctctggcaccaactcactctcaagctcgaggagttcgtagcccttgctgtcttccaggctggagatgctctgatacaattgtatcataatttcatcaccgactttgagaccaaaatcaatcttctcaagcttgcacattttgcagttattgtttctcgacagtatcctgaaaaagaagcggccattgggtatcttgaaggggtgatagagaagcttagagccactcaggagcagcgtatagaggagccagttctttacattaagatgcaaattgccatattcaaacttgagcaagatcaaaaggagtgcaaaatccttctagaagatggaaagactacaattgatagcatgactgacattgatccgtctgtgtatgccatttattattgggtttcttctcaataccataaatttcgtcaagaatttgctgagttctacaaaagtgctcttctttacttagcgtatacctcagtggaatctctgtcagaatcatttaagctggacttggcatttgatttatcactttctgcactgcttggggataatatctacaactttggcgagctgctggcacatcctattattaagagtcttcttgggacaaaggttgagtggctctactatattcttcaagcattcaacgctggtgacttagttcgctatcaggaactatgtcgtgtgcacaatgctgctttgagggctcaaccagccttggttgagaatgagaagaagcttctggaaaagattaacattctttgtttgatggaaatcatcttcagccggtcatctgacgacaggactataactttgagtataattgctgaccgcactaaactttcaattgagaatgtggagcatcttctcatgaagagtctttctgttcatctgattgagggcataattgatcaagttgatggaaccgtgcatgtttcctgggtgcaaccaagagttttggggattccacagatcaaatctttgcgagaccgactggacaactggttggataaagtgcacaccgcattggtatccattgaggcagaaacacctgacttggttgcatcgtgagtttgatttcttgataagttttcaggccattgtaacattttcttaacaagaaaggcagtaaacatgggtggcctcaaaagatttagcctagtttgcttgggcagatgggccttctttgtacgcccctgctttttctttttcatattgcctctcctgcgtttcttgaatcatttttctgaaaggagttgcttctgatacatcacttcggagtagtaaattctatagtggcatgcctagagacatggtgatccatttgctgatcaattaaaagacggctgttatttactttcttagctttgatattgaaccaatgtatttggaatttttcttagttacagttatgtgatccatttgattcagatcgcttcttttgctttagatagtccgatgaaaagctaagtttgtcatgttcgtttgaaagtggattgggtttacactatttttgaaaaggagttaggaagcagtctaattttcacaaaagaaagaggacaactctttgtcagatgtttagtcaaacatttttatgataactgaaatactttaacattataaactaattaaattattct

SEQ ID NO: 1980 - DNA, 1602 bp, Populus trichocarpa
tttttccttttccttttgttttctttgagctcaagccaaacaaactaaacccacaacgaacaaagaaattagagagacgcatcacaaacaaatattattaaccctccaaagctcaaaacacagaaaaaagatctctcaatcggcgccatggctgctctacagtacttggagacacagcgcaacgcgcatccggaactggacgagtggtacaactcacttgcagatctgtaccagaagaagctttggcaccaactcactctcaaacttgaacagtttgtcgctctcgccgtctttcaggctggtgatgctctaatacagttttatcataattttatcaccgactttgagacaaagatcaaccttctcaagcttgcacactttgccgttatagtttctcggcgttatgcagagaaagaagctgccattagctatcttgagggggtgattgaaaagcttcgagcaactagagaacagcgtatagaagaaccagtcctttacattaagatgcaaatagccatattcaagcttgagcagggggatcagaaagagtgcaagaagcttttagaagatggaaagagtacccttgacagtatgactgatatagatccatccgtgtatgccagttattattgggtttcgtctcagaactataaacatcgtcaggaatttgctgagttctataaaagcgctcttctttatctggcatatacagcagtggagtccctctcagactcatttaagctggatttggcatttgatctttctctttctgcgcttttgggggataacatctacaactttggagagttgctggctcatcctataataaagagcctactgggcactcaggttgagtggctctactacattctccaggcatttaactctggtgacttagttcgctatcaagaattgtgccgtgtgcacaacactgccctgagggcccagccagcattagttcagaatgagcagaagctattagaaaagattaacattctctgcctaatggaaattatctttagccgtccttctgaaaatagaactattccattaaatgttattgctgagcgcacaaagctttccattgaggatgtggagcatcttctcataaagagtctctctgtccaccttattgagggtataattgatcaagtcgaaggaacagtgcacgtttcctgggtacagccaagagttctggggattccacagatcaaatccttgcgagatcgactggacaattggttggataaagtacacactgctttgttatcagtggaggcagaaacacctgatctagttgcatcataatccccccccccccccatttcttcttcttgatttcctttcagcctactgtaacactttcttaatacaaaaggcggatattgatgggtagcaaaatggagagacaagctgtaagtcacatgggcagttgagtcaaatttgcatgcttcctttcacattgcagaatcctttttcctgaatcatcaattttttcttaaaggagctgcatgtgtacttttttcacttgggatttgttggctatataatgtggtctgcctggaggtaaggtgaatttgaatgcaaagaaaagcttttcta

SEQ ID NO: 1981 - DNA, 1386 bp, Tragopogon dubius
atcgtgttcgtttctttggggaaaagaaaacaacaacgacatcaaacaagggttttatatacaaatccccaagcaacccctttctccttccgatcttctctccgacaacattttgggcgtcattcggccatggcagctcttcagtacctggattctcttcgtactactcatccggagctctccgattggtataatacgcttgccgatctgtaccaaaggaagctatggcaccaactcactctcaaacttgaacaattcgttgcactcgctgttttccaggctggtgatgcactcatacaactataccataacttcataaccgactttgagaccaagatcaaccttctgaagcttgcacattttgcggttatcgtctctcgccagtactcagagaaagaagctgccataagctacttggaaggaataattgaaaagcttcgagctacaaaagagatgcgtatagaggagccaatcctttacataaagatgcaaattgccatctttaatcttgagaaaggtgatcaaaaggagtgcaagaatcttctagaagatgggaagagtacacttgatagcatgactgatatcgatccatctgtgtatgccaattattattgggtgtcatctcagtaccataaatcccgccaagagtttgctgagttttacaagaattctctgctttatttggcgtacacctcggttgaatctctttcagattcgtttaaactggatcttgcatttgatctatctttatctgcgttgttgggagacaacatttacaactttggagaactacttgcacatccaattataaaaagtctgctagggacaaaggtggaatggctctaccatattctagaagcattcaactcgggagatcttgtacgctatcaagaactatgtcgtgtacattcagcttcacttaatgctcaacctgccctagtggaaaacgagaagaagcttctagaaaaaatcaacattctctgtttaatggaaatcatcttcagtcgaccatctgaagacaggacaattccattgagtattgttgcagagcggactaaacttacggttgaagatgtggaataccttctcatgaaaagtttatctgtgcatttgatcgaggggataattgatcaagttgaaggaacggtttacgtgtcgtgggtgcaaccgcgagttttgggggtggctcagatcaaatcgttgcgcgatcggcttgacaattgggttgggaaggtacacacggctttgatatcagtggaagcagaaacaccggatttagtcgcatcttaaggttttttttttttaaacatctaaatgttgtctattttgttttgtaacaatttctggaaagcacaaagaactctcatgtaagatacctattcattt

SEQ ID NO: 1982 - DNA, 1552 bp, Tragopogon dubius
gattggaaatccccaaagtgtcaaaattatctccaacttgacatgttcgtttctttgagcaaaagaaaacaccgacgagacacaagaagggtttatatttaaatctctaccggaggcctcctctcgcaactcattgtcgtcggaatcagtcaaagatggcggctctccagtacctagattctcttcgtagtactcatccggagctatccgattggtacaatacgcttgccgatctgtaccaaaggaagctatggcatcaactcactctgaagctcgaacagttcgttgctctagccgtttttcaggctggtgatgctctcatacagctatatcataatttcataactgactttgagactaagatcaaccttctgaaactggcacactttgctgtcatagtctctcggcaatattcagagaaagaagctgccatcagttatcttgatggggtgattgaaaagcttcgagctacaaaagagacccgtatagaggaaccagttttatatatcaagatgcagatagccatctttaatcttgaaaaaggagatcaaaaggagtgtaagaatcttctagaagatgggaagagcacacttgatagcatgactgacattgatccgtctgtatacgccaattattattgggtttcatctcaataccataaatcacgccaagagtttgctgagttttacaagagcgctcttctttatttggcatacacctcagtagaatctctatcagactcattcaagctggatcttgcatttgatctatccctatctgcattgctgggagagaatgtgtacaactttggagagctacttgcacatccaattgtaaagagtctactagggacaaaggtagaatggctgtactacattcttgaagcttttaactcaggagatttagtgaaatatcaagaattatgtcgtgtccatggggcttctcttagtgctcagcctgctttgttggagaatgaaaagaagcttctggaaaagattaacattctatgcttaatggaaattatcttcagtcgaccgtcagaagacagaaccattccgctaagcatcattgcagaacagacaaaacttagggttgaagatgtggaatatcttgtcatgaagagtctatctgttcatctgattgagggtataattgatcaagttgatgggacggtgtatgtgtcgtgggtgcaaccaagagttttgggaatttctcaaataaaatcgttgcgtgatcggctcgatagttgggtggggaaagtacacactgcgttgatatctgtagaagccgagacccctgatttagttgcatcttaagttttttaatttctgtaacaatttcttgaaaacctaaaagaagggattaagagagactaatgttgagttaatttgcatcttaagcttcctttcataatttgccatatgttttggcattgaaaggagggtcttgtacttacttttttagagtttttgttttatggttggagttgcatatacacggctatttgtcgttcttttagagaattatgtatcctattttggtttgatattag

SEQ ID NO: 1983 - DNA, 1451 bp, Lippia dulcis
ctctctcccgcatataaatctccactcctgtgttttctctctctagaatttcgtactgtgcagcaccactctcgttcttgttgattgagcggccgggagaatcgatggcggcgctgcagtatttggagagcctgcggaatgctcacccggagctttccgagtggtacaacacgctttcagatctgtaccagagaaagctgtggcaccagctgacgctcaagctcgagcaattcgtcgcccacgctgtatttcaggctggggatgcccttatccagctgtacaataatttcattaccgattttgagacgaagatcaatcttctgaagcttgcacattttgctgttatagtatctcgacagtattctgagaaagaggctgcgattaactatctcgaaggagtcattgaaaagcttcgtaatacaaaagaaacacgcattgaggagccaatactttatatcaaaatgcagattggtatatttaagcttgagcagggagatcaaaaagagtgcaagaatcttttagatgagggaaaaagtacacttgacagcatgactgacatcgatccatctgtttatgccaactactattgggtttcatctcaatatcataaatcccgtcaagaatttgcggagttttacagaagtgcgttgctttatttggcttacacttcagtggagtcgctctcagattcattcaagctggatttggcatttgatctatcactttcggccttgttggggagaacatctacaactttggtgaactgcttgctcatccaattataaaaagtcttctggggactaaagttgagtggctttactatattcttgaagcattcaatgctggtgatttagtgcgttatcaagaactatgccgtgtacatggagctgctttgaatagccaacctgcgcttgttcagaatgagaaaaagcttctagagaagatcaacattctctgcttgatggagattatattcagccggccatcagaagacagaactatcccactaaacatcattgctgaacgaacaagacttactgtagaagatgtagagtatcttcttatgaagagcctctcagttcatcttattgagggaatcattgaccaagttgaaggaactgtgtatgtgtcctgggtgcaacccagagtgttggggattccacaaatcaaatctttgcgcgaccggcttgatggttgggtagacaaagtacacactgctctgttatctgttgaggcggaaacacctgatctagttgcagcataattttagttcttatgcttttgtaacttttttgttttgttgtttttcttctttaagcaagtagtaacagatttctttacatacgactctggctacatctgtcttaaggccataatactatacttggaatacccattctcttttttgcaaattattcattgaactgagttggaacttttctgaaaaagaa

SEQ ID NO: 1984 - DNA, 1490 bp, Centaurea maculosa
tatatatatctccaccggagttctcttctgctaatcatcgtcgtcggaatcagtaggaggatatggcggctctagagtacctagattctcttcgaactactcatccggagctatccgattggtacaatacgcttgccgatctgtaccaaaggaagctatggcatcaactcactctcaagctcgaacagttcgttgctcttaccgttttccaggctggtgatgctctcatacagctatatcataattttattaccgacttcgagactaagatcaaccttctcaagctggcacactttgctgtgatcgtctctcggcaatattcagagaaagaagctgccatcagttatctcgagggggtgattgaaaagctccgggctacaaaagaggcccgtatagaagagccagttctttatattaagatgcagatagccatctttaatcttgagaaaggagatcaaaaggagtgcaaaaatcttttagaagacgggaagagtacactcgatagcatgactgacattgatccgtcagtatattccaactactattgggtttcatctcagtaccacaaagcccgccaagagtttgctgagttctacaagagtgctcttctttatttggcatacacctccgtggagtcgctgtcagattcatttaagctggatcttgcatttgatctatccctgtctgcattgctgggagagaatgtctacaactttggggagctacttgcacatccaattataaagagtctgctagggacaaaggttgaatggctctactacattcttgaagcatttaactctggagatctaattcgctatcaagaactatgtcgtgttcatggagcttctcttagtgctcagcctgctttggtggataatgagaagaagcttttggagaagattaacattctctgcttgatggaaattatcttcagtcgaccatcggaagaacgaactattccactgagcatcattgcagagcgaacaaatcttacggttgaagatgtggaacatcttctcatgaagagtctatcggttcatcttattgagggtataattgaccaagttgatgggacggtttacgtttcatgggtgcaacccagagttttgggaattcctcaaatcaaatcattgcgtgatcggttggacggttgggtgggaaaagtgcacaccgccttgttatctgtggaagcagaaacgcctgatttggttgcatcgtaggtctttgtttgtttgtttccatccatccctgtaacaaactacttttggaagccgaaagaagagagagctcctaagcaaaacgaactaagagactgatgaccgttgaccttggtcaactctttgtgtaagtgtttttctttgatattttcgccatcgggaagggggctcttgtgtaccttacattttagagtttttgattcatggttggagagttgcatataaacaactgttgtccctttcagataaagatattttcactttttatta

SEQ ID NO: 1985 - DNA, 1710 bp, Echinacea purpurea
ccaaatcgatcattcgtttctttgggaacaagaaatcacaggcgaaatcaaacaagggtttatacttcattcatacacaaatcccccaatcctccttccggcaaccgttttgtgaatcggtcaacgatgtcagcacttcaatacctagattctcttcgtaacactcacccggagctatccgattggtacaatacgcttgcagatctgtaccaaaggaagctatggcaccaactcactctaaaactcgaacaatttgtcgcactcgctgtttttcaggccggcgatgctctcatacaactatatcataatttcatcaccgactttgaaaccaagatcaatcttctcaagcttgcacattttgctgttatagtctctcgtcagtattcagagaaagaagcagccatcaactatcttgaaggagtgattgaaaaactcagagctacaaaagaatcgcgtatcgaggaaccaatcgtttatatcaagatgcaaatagccatttttaaacttgaaaaaggagatcaaaaggagtgcaagactcttctagaagatggaaaaagtacacttgatagcatgactgacatcgatccgtctgtgtatgctaattattattgggtgacatcccagtatcataaagctcgccaggaatttgctgaattctacaagagttctctactttatttggcctacacttcagttgaatctctctcagattcttttaagttggatcttgcttttgatctatctttatctgctttactgggagacaacatttacaattttggagaactacttgcacatccaataataaaaagtctgctggggacacaggttgaatggctgtactatattctagaagcattcaacaatggagatctagttcgctatcaagaactatgccgtgttcatgcagattctcttaatgctcagccagctttggtggagaatgagaagaagcttctagaaaagattaacattctctgcttgatggaaatcatcttcagtcggccatcaggagacagaaccattccattgagcatcattgctgagcggacaaaacttacagttgaagatgttgagtatcttctaatgaagagtttatcggtgcatcttatcgaggggataattgatcaagttgaaggaacagtttacgtgtcttgggtgcaacctcgagttttgggaattagtcaaatcaaatctttgcgcgatcggttggacaactgggttgagaaagtacacacggctttggtatctgttgaagcagaaacaccagatttagttgtatcttaagttttgtatttcggcatattgtttcttgttttgtaacactcatgaggatagtttgttactgtgtcttgaagatgaagtaatttgtgttgtgggttagctctgtgtaaggcacttgttcgttttgtcttttttcaaagactgtttcgatgctggctgcaaaacaaaaagttgtggaacttttgatggaccttaaatcttgacagttcatttgcagcgcgctcagtttgattttcactttgtatgccttattgttgtgttatgacagtatgctatccggtataatcttagtgattagggtgcaaatgtactgaacgtttagcaaatagttcgttaactgtttaacgggaagtccttttgtgttcgtttgttaataaatgaacgagcacgaacaagaaattttgttgtttagttaaatgaacgaat

SEQ ID NO: 1986 - DNA, 1705 bp, Panax ginseng
aagcagtggtatcaacgcagagtacatggggatatttatcttgctctattgtcacatatttcaaatacactctctccccttcgtcgttgtagtcagccatggctgctctgcaatacctggattcacttcgtaattcccatccggagctctccgattggtacaataccctagcagatctgtaccagaggaagctatggcaccagctcactctcaagctcgaacaatttgttgccctcgccgtattccaggctggtgatgcactaatacagctatatcataatttcatcaccgattttgagactaaaatcaatcttctcaagcttgctcattttgcggtcatagtctcccggaaatattctgagaaagaggctgccattagttatcttgaaggggtgattgagaagcttcgggctactagagaaatgcgcatagaggagcctgtcctttatattaagatgcaaattgctatgttcaaccttgagaaaggagaccaaaaggaatgcaagaaactactagaagatgggaaaactacacttgacagcatgactgacattgatccgtctgtctatgccagctattattggaattcatcccaataccacaaatctcgtcaggagtttgcagagttctacaaaagcgctcttctatatttagcatacacctcagtagagtccctgtcagaatcatttaagctggatttggcttttgatttatcactatctgcattgctgggagaaaacatttacaactttggcgaactgcttgcgcatccaattataaagagtcttctggggaccaaggttgagtggctctactacattcttgaagcattcaactctggtgatttggtccgctatcaagaattatgccatgttcatagtgcttctctgagcgcgcaaccagcattagtagaaaatgagagaaaacttctggaaaagatcaacattctctgcttaatggaaatcatcttcagtcgaccatcagaggatagaaccattcccttaagtatcattgccgagcgcacaaaacttactgtagaggatgtggagtatcttcttatgaagagcctatcagttcatctgattgaaggtataattgatcaagttgaagggacagttcatgtttcatgggtgcaacccagagttttggggatttcccagatcaaatctttgcgtgatcgactggacaactggatggataaagtacacaccgctttattatcagttgaggctgaaacacctgatttagttgcttcataatttcgttcttggctttctattttcttgtaacaatctcttaacttcctcaaaagagctggttaacttcactaaggagaggagatatagcaattaatcatttgggcggactttgtaggcttccttcatcttggtcatatctagtgttattttcctgaaggagagatgcctcttcatgtacttttgcttttccatttttgatttatggtgtctgcatgcttaagactcaaggagtcgaatcttaaaacggctgctttacgtgaagaatattaattcagaccatgtaggtggattttttattctttgcatcacaatcagatatgatccatccgttcggtggatgcagcgtcttctttttttgtacccaaatatcagacttttatattatggaactttgttgttccgatgttctattttaaatcccagatctggcatcaaatttgtatggc

SEQ ID NO: 1987 - DNA, 1536 bp, Artemisia annua
aacaacaacaacaaaacaaaaggttttcatattcacagatcaaatcactactactactcaccggaaacctaaaccaaccatggcagcacttgaataccttgagtcgctccgcactagtcaccctgagttatccgaatggtacactacgcttgctgatttgtaccaaaggaagctttggcatcagctcactttgaagcttgaacagtttgttgctcttgctgtttttcaggcgggtgatgctctcattcagttatatcacaatttcataactgatttcgagactaagatcaaccttcttaagctagcacacttcgctgttattgtctctcggcaatattcagagaaagaagctgccataagttatcttgaaggggtcattgaaaagcttagggctacaaaagagtcgcgaattgaggagccaattctatatatcaagatgcagatagcagtatttaatcttgagaaaggagatcaaaaagggtgtaagaatcttttagaagatgggaagactactcttgatagcatgactgacatcgatccgtcagtttatgccaattattattgggtgtcgtctcagtaccataaatcccgccaagagtttgctgagttctacaagagtgctcttctttatttggcatacacctcagttgagtcgttatcagattcatttaagctggatcttgcttttgatctatctttatctgcgttgctgggagagaacgtctacaactttggggagctacttgcacatccaattgtaaagagtctgctagggacaaaggttgaatggctttactacattcttgaagcgtttaacgctggagatctagttcgctatcaagaattatgtcgtgtccatggagcttctcttagtgctcagcctgctttggtggctaacgagcagaagcttttggaaaagatcaacattctctgcttgatggaaattatcttcagtcgaccatcagaagaaagaactatcccactaagcatcattgcagagcggacaaaacttaaagttgaagatgttgaataccttctcatgaagagtctttctgttcatcttatcgagggaataattgatcaggttgatggaacagtctatgtttcatgggtgcaaccaagagttctgggaattcctcaaataaaatccctgcgtgataggcttgatggttgggtgggaaaagtacacaccgcattgacatctgtggaagcagagacacctgatttggttgcatcttaagttcttgttcccatctgtaacaatctctttaaatcccatagaagagctcgtaatagagcaacgaaaagagatcaaaagactaatgtcaagttcatttggttaagctctgtgtaagcttcattgtggatttaacttacggtttatccgatgaaaggagcttcttttgtaccttactttctagaattttttatttaaggttggagttgcatataaacaactgttgtcctttcagggaatgatacttttactttgtactagtgttattttatgatattaagccttcatattgctttaaa

SEQ ID NO: 1988 - DNA, 1766 bp, Manihot esculenta
agcagcgggggaggctttgttttccagatttcacatatataaatagaaaattcaagcaaccaaacgccctgaaatctccaccgctatggctgctttacagtatctggagtctcttcgcaacgcgcatcccgaacacgccgagtggtacaattcccttgcagatctgtatcagaagaagctgtggcaccaactcactctcaagctcgagcagttcgttgcttttgctgtcgttcaggctggtgacacattgattcagctgtatcataattttatctctgattttgagaccaaaattaatcttctcaagcttgcacattttgcggttatagtctctaagcagtataaagagaaagatgcagccattagctatcttgaaggggtgattgaaaaacttagagagactagagaacagcgcaatgaagagccaattctgtatattaagatgcaattagctatcttcaagcttgagcaaggggatcaaaaagagtgcaagaagcttctagaagatggaaagagtacactggatagtatgactgatattgatccatctgtatatgctaattattattgggtttcatctcagtaccataaatttcgtcaagaatttgcagagttctacaaaaatgcccttctttaccttgcatacacatcagtggaatccctctcagaaccatttaagttggatttggcatttgatctctctctttctgcacttttgggagataacatctacaactttggagaattgcttgctcatcctattataaatagtcttctgggaacacaagtggagtggctttatcatattcttcaggcatttaacactggcgatctagttcgcttccaggaattgtgtcgcgtgtataatgcgtccctgagagcccagccagcgttagttgagaatgagcagaagctattggagaagattaacatcctttgcctgatggaaatcatctttagccgtccttctgaagatcgaactattccactaagtgtcattgctgagcgtacaaagctttccattgaggatgtggagcaccttctcatgaagagtctttctgtccatcttattgagggtataattgaccaagttgaaggaacagtacatgtgtcttgggtgcagccaagagttctggggattccacagatcaaatccttgcgagatcgactggataattggctggagaaagtacacactgccttattatctattgaagccgaaacacctgatctagtagcattgtgatttaatctttttttaatctattttttggcattttccctttctgttattgatttcctctctgcccattgtaacaaattctaaatccaaaagggaaaaatttgtaggcagctaagtggagagactagattaagtcacactagggcagttaagccaactgggtttgcttccttgtcatattgcagaatccttttcctgaatcaattttctgaaagaagcagcgctgtaccttttcacttggaatttgtgagttctaagtggcatgcctagagatacatttgaattcatttagaaaaagaaagggcgtatctacttcagtgtggtttattaaactaatttgtattgagaaatttactttgatccatctgtgatctatctgcctgtctggttgctattcaaacagtagttttatgcatcttgtatgtggacgtagtagaacatcatttctgatggctattctcatatttctatcgaagtctgattaatccttaatgtgaatgattatacactactttattccatc

SEQ ID NO: 1989 - DNA, 1651 bp, Centaurea maculosa
gcgggggaagaatctcaccgatagatacagggtttatatataaaatctccaccggcaggcccttctgctaaccatcgtcgtcgtcgtcgttgccggaatctgtagaacggagatggcggctttagagtacctagattctcttcgaactactcatccggagctatccgaatggtacaatacgcttgccgatctgtaccaaaggaagctatggcatcaactcactctcaagctcgaacagttcgttgctcttaccgttttccaggccggtgatgctctcatacagctatatcataatttcataaccgactttgagactaagatcaaccttctcaagctggcacactttgctgtgattgtctctcggcaatattcagagaaagaaactgccatcagttatcttgatggggtgattgaaaagctacgtgctacaaaagagacgcgtatagaggagccaattctttatattaagatgcagatagccatctttaatcttgagaaaggagatcaaaaggagtgcaagaatcttctagaagacgggaagagtacacttgatagcatgactgacattgatccgtcagtgtattccaactactattgggtgtcatctcagtaccacaaagcccgccaagagtttgctgagttctacaagagtgctcttctttatttagcatacacgtcggtagagtctctatcagattcatttaagctggatcttgcatttgatctatccctgtctgcattgctgggagagaatgtctacaactttggggagctacttgcacatccaattataaagagtctgctagggacaaaggtcgaatggctctactacattcttgaagcatttaactctggagatctaattcgctatcaagaactatgccgtgttcatggagcttctcttagtgctcaacctgctttggtggctaacgagaagaagcttttggagaagattaacattctctgcttgatggaaattatcttcagtcgaccatcggaagaacgaactattccgctgagcatcatcgcagagcgaacaaaccttacggttgaagatgtggaacatcttctcatgaagagtctatcggttcatcttatcgagggtataattgaccaagttgatggaacggtttacgtttcatgggtgcaacctagagttttgggaattcctcaaatcaaatcattgcgtgatcggttggacggttgggtgggtaaagtgcacaccgccttgttatctgtggaagcagaaacgcctgatttggttgcatcgtaagtctttgtttgtttgtttccatccatccctgtaacaaactacttttggaagcccaaagaagagagaggtcctcctaagcaaaacgaactaagagactgatgaccgttgaccttggtcaacactttgtgtaagcgtttttctttgatattttcgccatcaggaagggggctcttgtgtaccttacattttagagtttttgattcatggttggagagttgcatataaacaactgttgtccctttcagagaaagatattttcactttttattactagtgttcttttatgaatgcattatgatgttttaatttccaatttactctgtttgggttgtaattgtgtggatttaagatatggcatccctcatttcccaaaaaaaa

SEQ ID NO: 1990 - DNA, 1647 bp, Centaurea maculosa
  misc_feature (59)..(59): n is a, c, g, or t
  misc_feature (121)..(121): n is a, c, g, or t
  misc_feature (127)..(127): n is a, c, g, or t
  misc_feature (675)..(675): n is a, c, g, or t
  misc_feature (960)..(960): n is a, c, g, or t
  misc_feature (963)..(963): n is a, c, g, or t
  misc_feature (1014)..(1014): n is a, c, g, or t
  misc_feature (1272)..(1272): n is a, c, g, or t
  misc_feature (1350)..(1350): n is a, c, g, or t
  misc_feature (1356)..(1356): n is a, c, g, or t
  misc_feature (1361)..(1361): n is a, c, g, or t
  misc_feature (1381)..(1381): n is a, c, g, or t
  misc_feature (1388)..(1388): n is a, c, g, or t
  misc_feature (1396)..(1396): n is a, c, g, or t
  misc_feature (1401)..(1401): n is a, c, g, or t
  misc_feature (1404)..(1404): n is a, c, g, or t
  misc_feature (1406)..(1406): n is a, c, g, or t
  misc_feature (1415)..(1415): n is a, c, g, or t
  misc_feature (1428)..(1428): n is a, c, g, or t
  misc_feature (1446)..(1446): n is a, c, g, or t
  misc_feature (1454)..(1454): n is a, c, g, or t
  misc_feature (1471)..(1471): n is a, c, g, or t
  misc_feature (1474)..(1474): n is a, c, g, or t
  misc_feature (1478)..(1478): n is a, c, g, or t
  misc_feature (1497)..(1497): n is a, c, g, or t
  misc_feature (1505)..(1505): n is a, c, g, or t
  misc_feature (1525)..(1525): n is a, c, g, or t
  misc_feature (1546)..(1546): n is a, c, g, or t
  misc_feature (1562)..(1562): n is a, c, g, or t
  misc_feature (1564)..(1564): n is a, c, g, or t
  misc_feature (1571)..(1571): n is a, c, g, or t
  misc_feature (1576)..(1576): n is a, c, g, or t
  misc_feature (1579)..(1579): n is a, c, g, or t
gcgggggaagaatctcaccgatagatacagggtttatatataaaatctccaccggcagncccttctgctaccatcgtcgtcgtcgtcgttgccggaatctgtagaacggagatggcggctntagagnacctagattctcttcgaactactcatccggagctatccgaatggtacaatacgcttgccgatctgtaccaaaggaagctatggcatcaactcactctcaagctcgaacagttcgttgctcttaccgttttccaggccggtgatgctctcatacagctatatcataatttcataaccgactttgagaccaagatcaaccttctcaagctggcacactttgctgtgattgtctctcggcaatattcagagaaagaagctgccatcagttatcttgatggggtgattgaaaagctacgtgctacaaaagagacgcgtatagaggagccaattctttatattaagatgcagatagccatctttaatcttgagaaaggagatcaaaaggagtgcaagaatcttctagaagacgggaagagtacacttgatagcatgactgacattgatccgtcagtatattccaactactattgggtgtcatctcagtaccacaaagcccgccaagagtttgctgagttctacaagagtgctcttctttatttagcatacacntcggtagagtctctatcagattcatttaagctggatcttgcatttgatctatccctgtctgcattgctgggagagaatgtctacaactttggggagctacttgcacatccaattataaagagtctgctagggacgaaggttgaatggctctactacattcttgaagcatttaactctggagatctaattcgctatcaagaactttgccgtgttcatggagcttctcttagtgctcagcctgctttggtggataacgagaagaagcttttggagaagattaacatnctntgcttgatggaaattatcttcagtcgaccatcggaagaacgaactattccnctgagcatcatcgcagagcgaacgaaccttacggtcgaagatgtggaacatcttctcatgaagagtctatcggttcatcttatcgagggtataattgaccaagttgatggaacggtttacgtttcatgggtgcaacctagagttttgggaattcctcaaatcaaatcattgcgtgatcggttggacggttgggtgggaaaagtgcacaccgctttgttatctgtggaagcagaaacgcctgatttggttgcgtcgtangtctttgtttgtttgtttccatccatccctgtaacaaactacttttggaagccgaaagaagagagagctcctaagcanaacganctaanagactgatgaccgttgaccntggtcancactttgngtaancgntnttctttganattttcgccatcnggaagggggctcttgtgnaccttacnttttagagtttttgatncanggtnggagagttgcatataaacnactgttgnccctttcagagaaagatatnttcactttttattactagtgntcctttatgaatgcantntgatgtnttaanttncaatttactctgtttgggttgtaattgtgtggatttaagatatggcatccctcatttcccaaaaaaaa

SEQ ID NO: 1991 - DNA, 1320 bp, Cirsium arvense
tcgtcgtcgtcgtcgttgccggaatctgtagaacggagatggcggctctagagtacctagattctcttcgaactactcatccggagctatccgattggtacaatacgcttgccgatctgtaccaaaggaagctatggcatcaactcactctcaagctcgaacagttcgttgctcttaccgttttccaggccggtgatgctctcatacagctatatcataatttcataaccgactttgagactaagatcaaccttctcaagctggcacactttgctgtgattgtctctcggcaatattcagagaaagaagctgccatcagttatcttgatggggtgattgaaaagctacgtgctacaaaagagacgcgtatagaggagccaattctttatattaagatgcagatagccatctttaatcttgagaaaggagatcaaaaggagtgcaagaatcttctagaagacgggaagagtacacttgatagcatgactgacattgatccgtcagtgtattccaactactattgggtgtcatctcagtaccacaaagcccgccaagagtttgctgagttctacaagagtgctcttctttatttagcatacacgtcggtagagtctctatcagattcatttaagctggatcttgcatttgatctatccctgtctgcattgctgggagagaatgtctacaactttggggagctacttgcacatccaattataaagagtctgctagggacaaaggtcgaatggctctactacattcttgaagcatttaactctggagatctaattcgctatcaagaactatgccgtgttcatggagcttctcttagtgctcaacctgctttggtggctaacgagaagaagcttttggagaagattaacattctctgcttgatggaaattatcttcagtcgaccatcggaagaacgaactattccactgagcatcatcgcagagcgaacaaaccttacggttgaagatgtggaacatcttctcatgaagagtctatcggttcatcttatcgagggtataattgaccaagttgatggaacggtttacgtttcatgggtgcaacctagagttttgggaattcctcaaatcaaatcattgcgtgatcggttggacggttgggtgggtaaagtgcacaccgccttgttatctgtggaagcagaaacgcctgatttggttgcatcgtaagtctttgtttgtttgtttccatccatccctgtaacaaactacttttggaagcccaaagaagagagagctcctaagcaaaacgaactaagagactgatgaccgttgaccttggtcaacactt

SEQ ID NO: 1992 - DNA, 1685 bp, Mimulus guttatus
tctctctctctctcttctccctctctctctctagaattcctcaccggtgagcaccgtttgtcgtgtttgttggacggcggagggaataatcgatggcggcgcttcagtatttggagaccctgcggaatgcgcacccggagctttccgagtggtacactacgctttcagatctgtaccagaggaagctatggcaccagctcacgctcaagctcgaacaattcgctgccctagctgtatttcaggctggggatgctctaatccagctctaccacaatttcataactgattttgagacaaaaatcaatcttctcaagcttgcacattttgctgtcatagtttctaggcagtattcggagaaagtggctgccatagcttatcttgaagaagtgatagaaaagcttcgtaacaccagagaagcacgcatagaggagccgatactttatatcaaaatgcagattggtgtatttaagcttgagcagggagatcaaaaggaatgcaagaaacttctagatgagggaaagagtaccctcgacagtatgactgacattgatccatctgtgtatgccaactactactgggtttcatctcaatatcataaaacccgtcaagaattcgcagatttctatagaagtgctctcctttatctagcttacacttcagtagagtctctatcagactcgtttaagctggatttggcatttgatttatctctctcagccttgttgggggagaacatctacaactttggcgaacttcttgcccatccgattattaaaagtcttctggggactaaagttgagtggctttactacattcttgaagcatttaattctggagatttagttcgttatcaagaactatgccgtgtacacggagctgctctgagcactcaaccggctctagtccagaatgagaaaaggcttctggagaagataaacattctctgcttgatggagattatattcagccgaccatcagatgaaagaactataccattgagtatcatttctgaacgaacaaaacttactgtagaagacgtggagtaccttcttatgaagagcctttcagtacatctgatagagggaatcattgaccaagtggagggaactgtttacgtgtcgtgggtgcaacctagggttttaggaattcctcagatcaagtcgttgcgtgacaggctggacaattgggttgataaagtacacactgctttgttatccgtcgaggctgaaacacctgatctagttgcagcttaattttagctcttatccaattccaatttcttcttcatataacgttttgaggacaaaatgtgttactctatgtagtaagagagaaaactaaaatccatgtttcttggaccactgtgtatggggggttctctcttgttatattttcaattcccgtacaccatacttgtaatacccatttcttttttcgcgtattatttcattgagccgagtattttggatattcttgttaactgtgatttgtgcttcaatattgatcaaaggattccagtaagaaaagctgctgtgaaaatgaattaccttacatttaaattacatgcttcgcatggagttgagcagcaactgacaggagaggatagttggtcttgtcagtttggtcgtgtaaaacgatcttggttacgtaattttatggatccgactggtaacaagtgaatagtt

SEQ ID NO: 1993 - DNA, 1273 bp, Carthamus tinctorius
  misc_feature (866)..(866): n is a, c, g, or t
  misc_feature (1192)..(1192): n is a, c, g, or t
ggggcaaagaacgatagatacagcgcaagggtttatattcaaatctccatcggaggtctcttctgctaatcaccatcgtcgtcggaatcactaggaggagatggcggctctacagtacctagattctcttcgaagcactcatccggagctatccgattggtacaatacgcttgccgatctgtaccaaaggaagctatggcatcaactcactctcaagctcgaacagttcgtcgctcttaccgttttccaggctggtgatgctctcatacagctatatcataattttattactgactttgagactaagatcaaccttctcaagctggcacacttcgctgttatagtttctcggcaatattcagagaaagaagctgccatcagttatctcgagggggtgattgaaaagctccgggctacaaaagagatgcgtatagaggagccagttctttatattaagatgcagattgccatctttaatcttgagaaaggagatcaaaaggagtgcaagaatcttctagaagatgggaagagtacacttgatagcatgactgacattgatccgtcagtatattccaactactattgggtgtcatctcagtaccacaaagcccgccaagaatttgctgagttctacaagagtgctcttctttatttggcatacacctcagtagagtctctatcagattcatttaagctggatcttgcatttgatctatccctgtctgcattgctgggagagaatgtctacaactttggggaactacttgcacatccaattataaagagtctgctagggacaaaggttgaatggctctactacattcttgaagcatttaactccggagatctaattcgctatcaagaantatgccgtgttcatggagcttctcttagtgctcagcctgctttggtggataatgagaagaagcttttggagaagattaacattctctgcttgatggaaattatcttcagtcgaccatcggaagaacgaacaattcctctgagcatcatcgctgagcgaacaaaccttgcggtagaagatgtggaacatcttctcatgaagagtctatcggttcatcttattgagggtataattgatcaagttgatggaacggtttacgtttcatgggtgcaacctagagttttgggaattcctcaaatcaaatcattgcgtgatcggttggacggntgggttggaaaagtacacaccgccttgatatccgtggaagcagaaacgcctgatttggttgcatcgtaagtctttgtttgt

SEQ ID NO: 1994 - DNA, 1778 bp, Glycine max
ttgagaggaagcaaacaaaacccaaaaaactataagaaaaaacaaataaaaagaaggacgattattccgaaattaattcaaaaaagaaaaaagaaaaaaggagttagggtataaaaaacagaagaaagaaggcacaccagtggtattgcgtgttggtgtgaatcaagaaccgctctgctatggctgctctgcaatacttggaatcgctgcgcaattcgcaccctgagctctccgattggtacaattcgctggcggatctgtaccagaagaagctctggcaccagctcactctcaagctcgagcagtttgtggctctcgccgtcttccaggctggtgatgctttaatacaattatatcacaatttcatcacagactttgagacgaaaatcaaccttctcaagcttgcacattttgctgttatagtttctcggcagtattctgaaaaagaagctgctgttggttatcttggaggggtcattcagaaacttcaagacactagagagcagcgcatagaagaacctattctttacattaagatgcaaatagcaatattcaagcttgagcaaggtgatcaaaaggaatgcaagaaacttctagaagatgggaagagtacactcgacagcatgacagatattgatccatctgtatatgctagctattactgggtatcatctcagtttcataagacatgccaagaatttgctgagttctacaaaagtgcccttctctatttggcatacacatcagtggaatctctctcagattcattcaagctggatctggcatttgatttgtccctctctgcccttcttggggataacatctacaactttggagagctacttgcccatcctataattaagagccttctggggacaaaggtggaatggctttactatattctgcaggcattcaattctggtgatctggtacgatatcaagaattatgtcgggtgcataatgctgctttaagagcccaaccagcactagttcaaaatgagcaaaagttgttggaaaagatcaacattctgtgtctgatggagattatattcagtcggccttcggaagatcgaactattcccttgagtgtaattgcagagcgcacaaaactttctatagagaatgtggagcatctccttatgaaaagcctatctgttcatctaattgagggtataattgatcaagttgagggcacagtgcatgtttcctgggtgcagccaagagttctgggtattcaacagatcaaatccttacgggatcgactggacagttggactggaaaagttcacactgcattgctgtccattgaggctgaaacacctgatctaattggatcgtgatttttctttaatttggtttctgctctttgtaacaatttcttaagttgaagggaatacatcctaaggcgacaaaagatgaagagacttccaagtgacatgggcaatgaatgtagctaactttatatgcttcatttgctttttgaatgattgctggaaagagcagtcccttgtacttggcttagaaattgttagttctatgcctgcatacctagagacatggtaacttggttggaaacaggctgtttttacgctttagagtgatgacaaactatgtatctggaattttcttagatacggccatttttattcacttcagaaatttcttttttattgaattgtgccaagcattcaccttagtttgtctaatttctcatgtacttcaatatgggtgctacttaacttgccatgagatgaatcttgtcataccaattctgttag

SEQ ID NO: 1995 - DNA, 1655 bp, Glycine max
aagaaagaaggcacaccagtggtattgcgtgttggtgtgaatcaagaaccgctctgctatggctgctctgcaatacttggaatcgctgcgtaattcgcaccctgagctctccgattggtacaattcgctggcggatctgtaccagaagaagctctggcaccagctcactctcaagctcgagcagtttgtggctctcgccgtcttccaggctggtgatgctttaatacaattatatcacaatttcatcacagactttgagacgaaaatcaaccttctcaagcttgcacattttgctgttatagtttctcggcagtattctgaaaaagaagctgctgttggttatcttggaggggtcattcagaaacttcaagacactagggagcagcgcatagaagaacctattctttacattaagatgcaaatagcaatattcaagcttgagcaaggtgatcaaaaggaatgcaagaaacttctagaagatgggaagagtacactcgacagcatgacagatattgatccatctgtatatgctagctattactgggtatcatctcagtttcataagacatgccaagaatttgctgagttctacaaaagtgcccttctctatttggcatacacatcagtggaatctctctcagattcattcaagctggatctggcatttgatttgtccctctctgcccttcttggggataacatctacaactttggagagctacttgcccatcctataattaagagccttctggggacaaaggtggaatggctttactatattctgcaggcattcaattctggtgatctggtacgatatcaagaattatgtcgggtgcataatgctgctttaagagcccaaccagcactagttcaaaatgagcaaaagttgttggaaaagatcaacattctgtgtctgatggagattatattcagtcggccttcggaagatcgaactattcccttgagtgtaattgcagagcgcacaaaactttctatagagaatgtggagcatctccttatgaaaagcctatctgttcatctaattgagggtataattgatcaagttgagggcacagtgcatgtttcctgggtgcagccaagagttctgggtattcaacagatcaaatccttacgggatcgactggacagttggactggaaaagttcacactgcattgctgtccattgaggctgaaacacctgatctaattggatcgtgatttttctttaatttggtttctgttctttgtaacaatttcttaagttgaagggaatacatcctaaggcgacaaaagatgaagagacttccaagtgacatgggcaatgaatgtagctaactttatatgcttcatttgctttttgaatgattgctggaaagagcagtcccttgtacttggcttagaaattgttagttctatgcctgcatacctagagacatggtaacttggttggaaacaggctgtttttacgctttagagtgatgacaaactatgtatctggaattttcttagatacggccatttttattcacttcagaaatttcttttttattgaattgtgccaagcattcaccttagtttgtctaatttctcatgtacttcaatatgggtgctacttaacttgccatgagatgaatcttgtcataccaattctgtt

SEQ ID NO: 1996 - DNA, 1543 bp, Helianthus annuus
tcaacgatacagaacacaaactagggtttatattcaaatcttcaacaggagatcacctctgcaactcatcgtcaccggagtcagtcaaagatggcggctcttcagtacctcgattctcttcgtaccactcaccctgagctatccgattggtacaatacgctggccgatttgtaccaaaggaagctatggcatcaactcactttgaagctcgaacagttcgttgctcttgccgtttttcaggctggcgatgctctcatacaactatataacaatttcataaccgacttcgagactaagatcaaccttctaaagctagcacactttgctgttatagtctctcgccaatactcagaaaaagacgctgcaatcagttatctcaatggggtgattgaaaagctcagagctacaaaagaaacccgtatagaggaaccagtcctttacattaagatgcaaatagcgatgtataatcttgagaaaggagatcaaaaggagtgcaagaagcttctagatgacgggaagagtacacttgatagcatgaccgacattgatccatcagtgtatgctaattactattgggtgtcatctcagtaccataaatcttgtcaagagtttgctgaattctacaaaagtgctcttctttatttagcatacacctccgtcgagtctttatcagattcgtttaagctggatcttgcttttgatctatcgctatctgcattgctgggagagaatgtctacaactttggagagctacttgcacatccaattgtaaagagtttgctcgggacaaaggttgaatggctctactacattcttgaagcgtttaactctggagatttagttcgttatcaagaactatgtcgtgttcataatgcttcacttactgctcaacctgctttggtggaaaacgagaagaaacttctggaaaaaattaacattctctgtttaatggaaattatcttcagtcgaccgtcagaggacaggactattccgctgggcgtcattgcagagcggacaaaacttacggttgaagatgttgagtatcttctcatgaagagtctatctgttcatcttattgaagggataatcgatcaagttgatgggaccgtttatgtttcatgggtgcaaccaagagttttggggatttctcaaatcaaatcactacgtgaccggctcgatggttgggtgggaaaagtgcacactgcgttggtgtctgttgaagcggaaacacctgatttggttgcgacttaagttcttgtttccatctctgtaacaatctcttgaaagcccaaagtagagctttgaaaagagattaggagactaacgttgactggagttgggtcaactctttgtaacttcctttcatgtttcacctttggttttcacaaaggagcctcttgtgtaccttaacccttatagttttttatttattgtttgtgttgcttacaaacaaagttttatgagctacttaattaagagctactggataacatagatgcaatgcagctaggggtgcttattctaatcgaattttggtttattc

SEQ ID NO: 1997 - DNA, 2004 bp, Panax ginseng
atatacatatatagatatatttatcttggtctattttcacatatttcaaacacactctctctccccttcgtcgttgtagtcagccatggctgctctgcaatacctggattcacttcgtaattcccatccggagctctccgattggtacaataccctcgcagatctgtaccagaggaagctatggcaccagctcactctcaagctcgaacaatttgttgccctcgctgtattccaggctggtgatgcactaatacagctatatcataatttcatcaccgactttgagactaaaatcaatcttctcaagcttgcacattttgcggtcatagtctcccggcaatattctgagaaagaggctgccaatagttatcttgaaggggtgattgagaagcttcgggctactagagaaatgcgcatagaggagcctgtcctttatattaagatgcaaattgctatgttcaaccttgagaaaggagaccaaaaggaatgcaagaaactactagaagatgggaaaactacacttgacagcatgactgacattgatccgtctgtctatgccagctattattggaattcatcccaataccacaaatctcgtcaggagtttgcagagttctacaaaagtgctcttctatatttagcatacacctcagtagagtccctgtcagaatcatttaagctggatttggcttttgatttatccctatctgcattgctgggagaaaacatttacaactttggcgaactgcttgcgcatccaattataaagagtcttctgggaaccaaggttgagtggctctactacattcttgaagcattcaactctggtgatttggtccgctatcaagaattatgccatgttcatagtgctgctctgagcgcgcaaccagcattagtagaaaatgagagaaagcttctggaaaagatcaacattctctgcttaatggaaatcatcttcagtcgaccatcagaggatagaaccattcccttaagtatcattgccgagcgcacaaaacttactgtagaggacgtggagtatcttcttatgaagagcctatcagttcatctgattgaaggtataattgatcaagttgaagggacagttcatgtttcatgggtgcaaccaagagttttggggatttcccagatcaaatctttgcgtgatcgactggacaactggatggataaagtaaacaccgctttattatcagttgaggctgaaacacctgatttagttgcttcataatttcgttctgggctttctattttcttgtaacaatctcttaacttcctcaaaagagctggttaactgcactaaggagaggagatatatcaattaatcatttgggcggactttgtagaattccttcatcttggtcatatctagtgttattttccggaaggagagatgcctcttcatgtacttttgcttttccatttttgatttatggtgtctgcatgcttaagacttagggagtcgaatcttaaaacgactgctttacgtaaagaatattaattcaaaccgtgtaggtggattttttattctttgcatcacaatcagatatgatccatccattcggtggatgcagcgtcttctttttttgtacccaaatatcagacttttataatacgaaattttgttgttctgatgttccattttaaatcccagatctggcatcaaatttgtatggcagttattatattttttggtaatgataatgaagtatggcaggttgattttcaggatagccttgtgtttccgttgcgtgaactggagattcatggcaaaaagtatcaagttttatcaatgtcagtttttattcctgaagtaaatttattacagaatagacatgtagaagtgcaacatatcaagaaaataagcaagtctttttttggttataaccctacagtctcctgagaaatagcacaaggaccaagccactcatggctcaatatggtaagaaattattcataagttttgggtgcatggatccaggcaagaat

SEQ ID NO: 1998 - DNA, 1679 bp, Gossypium raimondii
ttcctagtcctctgtgtcagtgtctttgctcgaagacagggaaaatcaaagctttcggtatttataatagagagaaaactaagttgacaagaaaggaaattttctctcattcgacattgttgagggaaattgaggtgaatggcggccttgcaatacctagactctcttcgaaatgaacatccagagctatccgattggtatagttctcttgcagatctgtatcagaagaagctttggcatcaacttaccctcaagcttgatcaattcgttgctcttaccttcttccaggctggagatgcactgatcaagttgtatcataattttatcactgactttgagaccaagattaatcttctcaagctcgcacattttgctgttatagtttctcggcaatactcagagaaagaagctgctattagttatctcgaaggggttattgaaaagcttcgagctactaaagagaagcgcatagaagaacctattctttatatcgagatgcaagtcgccaaattcaagcttgagctgggcgaccaaaaggagtgcaagaaacttcttgaagatggaaagagtacccttgacagtatggatggcgtagatccatctgtgtatgctagctattattgggtttcatctcaataccataaatttcgtcaagaatttgctgagttctataaaagtgctctcctttatcttgggtacacatcggtggattctctctcagaatcttttaagttggatttggcatttgatctatccctttctgctcttttgggagataatatctacaactttggggaactgcttgctcatcctattgtaaagagccttttggggaccagtgtagagtggctttactatatcctcctagccttcaactcaggggatttagttcactatcaagaattgtgtcgcatacacaatgctgcattgaggacacaaccagccttggttgagaatgagaagaggctcttggaaaaaattaatgttctttgcttaatggagattatcttcagccgcccggctgaagatcgaaccattcctttaaaagttatagctgagcgaacaaaactgtcgattgaggatgttgagcatcttctcatgaagagcctgtctgtgcatctgatagagggtataatagatcaagttaaaggaactgcctacatctcctgggtgcagccgagagttctgggaatcccacagatcaaatccttgcgggatcggttggatagttgggtgggcaaagtacacactgcttgcttatcaatcgaagctgaaacacccgaccttgtcgcaccatgatcttttttccctttctgtccagtatacgaaaaggaaacaaaaggaaaaggcaatggcaagcaatgaggatattgcttgatctttaaatcgttcttttgaaaggagagcggctcagaccttttggcatttgttggatctcaatggcaatggcaatggcaatatgcctaaggatacagtgttaaaaattgaaaagagcgtcttttctgtttcttaaactttgtattaggaattttcattagaaacaataagatgatccactttcatatgggatgatgaaaatgcattttcatttgttttctttcctcgtgtattatactagaaattgagtgggaggaattggagcatataaaaaattgaaaattatgattcgtaacattata

SEQ ID NO: 1999 - DNA, 1524 bp, Euphorbia peplus
aggagttataaataaagtccggacgactgaaatcgggtgtggtaaatcgcttcgatggctgctctagaatatctagatactcttcgcaacgaacatccggagctgggagaatggtacaattcacttgcagatctgtaccagcggaagctatggcatcagctcactctcaagctcgagcagtttgttgctctcgctgttttccaggctggtgatgccttgatacagttgtatcataattttatctgtgattttgagactaaaatcaatcttctcaagcttgcgcattttgcggtaatagtctctcggcaatacaaagagaaagaggcagcaattcaatatcttgaaggggtgattgataagcttcgagcaactcgagaacaacgcatagaggagcctgttctttatattaagatgcaattagctattctaaagcttgagcacggtgatcagaaggaatgcaagacgcttctggaagatgggaaaagtacattggacagtatgactgatatagacccatccgtttatgctagtttttattgggtttcatctcagttccataaatatcgccaagaatttgctgagttctacaaaagtgctcttctttacctagcatacacttctgtggaatccctctcagattcatttaaactggatttggcatttgatctgtccctgtctgcccttcttggggataacatctacaactttggagaactgcttgctcatcctattttaaagagtctcctgggaacaccagttgagtggctgtactatatccttcaggcgtttaatgttggtgatctcgttcggtaccaagaattgtgccgtgtgcataacacatctttgagggcccagccagcattagttgagaacgaacagaagctattggaaaagattaacatcctttgcctgatggaaatcatcttcagccgcccttctgaagatcgaactattccattaagtgtcattgctgagcgcactaagctctctgtcgaggatgtggagcatcttcttatgaagagcctttctgttcaccttatcgaaggcataatcgatcaagtggagggaacagttcatgtgtcttgggtgcaaccaagagttttggggattccacaaatcacatcgttgagagatagactggacaactggttgggtaaagttcatggcgcattgttgtccattgaagccgaaacacccgacctagtggctgtgtgattttcttgtgtctcgattgcttcgccttgtgttctcaatttggcggcttcccattgtagccgaatgaaaaacttgtaggctgctaagcgaaatgggatgtcgagctaagcttttttactttctgaagctgcacgatccttttttctgattaattttctttaaggaacgcccatgtacttttatttttcaatttggtgaatgaattgttagttatagagacttgagaaaagcaattcagcagacgatagcaatgtcaattagaaacagaaatgtttatcgaacaatgcattttaaatttcattcactagt

SEQ ID NO: 2000 - DNA, 1805 bp, Lactuca sativa
ttttaagaaaagcataacaatggttataagttgtaacattagcaactccaaaatgagttgggaaagataacctaacaacccatgtgatattcggttcgggtcaaagatccagattggaaaatcaccaaattctcaaatttatctccaatcccacatgttcgtttctttgagcaaaagaaaacaccgacgatacagcggaagggttttgtattaaaatcttctacccggaggctccatctcgcaactcattgtcgtcggattcagtcgaagatggcggctcttcagtatcttgattctcttcgtagtagtcatccggagctatcggattggtacaatacgcttgccgatctgtaccaaaggaagctatggcatcaactcactctgaagcttgaacagttcgttgctcttgccgttttccaggctggtgatgctcttatacaactatataacaatttcataaccgactttgagaccaaaatcaacctcctcaagctagcacactttgcagtcatagtctcaaggcaatactcagaaaaagaagctgccatcagttaccttgatggggtcattgagaagctcagagccacaaaagagacacgtatagaggagccagttctttacatcaaaatgcaaatagccgtttttaatcttgaaaaaggtgatcaaaaggagtgcaagaaccttctagaagatggaaagagcactcttgatagcatgactgacattgatccatcagtatacgccaattattactgggtgtcatctcagtaccataaaacccgccaagagtttgctgagttttacaaaagcgcccttctttatttagcatacacctcagtagagtctctttcagactcttttaagctggatcttgcatttgatctgtcgctatctgcattgctgggagagaatgtgtacaattttggggagctgcttgcacatccaattataaagagtctgatagggacaaaggttgaatggctgtactacattctagaagcatttaactccggagatttagtgaaatatcaagaattatgtcgtgttcatacagctgctcttaatggtcagcctgctttggtggagaacgaaaagaaacttctggaaaagatcaacatcctctgcttgatggaaattatcttcagtcgaccatcggaagagagaactattccactgagcatcattgctgaacggacaaaacttacggttgaagatgtggaatatcttctgatgaagagtctatctgttcatctgattgagggtataatcgaccaagttgatgggacagtttacgtatcatgggtgcagccaagggttctgggaattgctcagattaagtcgttgcgtgatcgtctggatggctgggtggggaaagtacacaccgcattgctatctgtggaagctgagactcccgatctagttgcctcttaacttcttcttcatgtctgtaacaatctcttgaaaaaaactaaagaagagcagtgtcaagagattaatgttgagctgactggttttgcaccactgtgtaatttggcatctgttttcaggcgtctcttctcttctcatgtgtaccttacttttttttttttttcgtagagttcttgattgatttatgggtggattggagttctttttggagattttaatatacacaactgttgcttttctttcagagaatcatattttcacttctgacttgtgttcctcttatgattagttattacagaattaaattccattgaattctaaagaatgtaacatacaatccaagtcaatttccttgaataaaatcatgaatataattc

SEQ ID NO: 2001 - DNA, 1579 bp, Momordica charantia
ggcgttttctattcttttctttgagaacaagaaaaagaacagaggaggaaggcacaaattatataaatcggagtctctttcccttcgagcatccatagccggagtagccatggccgctttacagtacctcgattctcttcgtaactcgcatccggagcttgctgattggtacaatacgcttgcagatctgtaccagaagaagctttggcatcagctcacactcaagcttgagcaatttgtcgctctgactgttttccaggctggtgatgcactgatacagttgtaccacaacttcatcacttactttgagaccaaaatcaatcttctcaagcttgcacattttgctgtgattgtttctcggcaatatgtggagaaagaagctgccattggttatcttgaagggataattgagaaattaaggattactaaagagcagcgcttagaggagcctatcctttatattaagatgcaaatagctatctttaagcttgagcaaggtgatcgaaaagagtgcaagaaactattggaagatggaaagagcactcttgacagcatgactgacattgatccatctgtttacgctagctattattgggtttcatctcagttttataagttccgcaaagaatttgccgaattctataaaagtgctcttctttatctggcatatacttcagtagaatcactgtcagactcttttaaattggatttagcctttgatttgtcgctttctgcactcctgggagataacatctacaacttcggagagcttcttgcacatcctattatcaaaagtctgttaggaacaaaggtcgagtggctttactacatacttcaggcattcaattctggtgatctagttcgctatcaagaattgtgtcaagtgcataatgaagctttaagggcacaaccagctttagttgaaaatgagaagaagctattagagaaaatcaacattctctgcctcatggaaatcatcttcagccgaccgtctgaagatcgaaccattccattgaatgttatagcagaacggacaaaactttcaatagaggatgtggagcatctactaatgaagagcctctctgtccaccttatagagggtataatcgatcaagtcgaggggacggtacatgtttcttgggtgcaacctagggttctgggcattcaacagatcaaatccctgcgagaccggctggacaattgggtggataaggtgcattcgactttgctttcagtcgaggccgagactcccgacctagttgcatcatgatcctcttcatttcatccctgaacaactttagcaagagagaaaaaggggaggagagagaaaacaaaggccatagaacaactgattttcaagctgtcttttattgaagcattttcttggaagcagaagcctccacttcagtctagttagttttcaaagtgagcatggattggagaagttgttgagaacagatttggagtggttattggactaattctgtatttgttactttagttgcatacaattgagttttaatgagctccatgccaatcaatttcatagaaaaaattttaaatcttatgaattagactt

SEQ ID NO: 2002 - DNA, 1399 bp, Helianthus annuus
ggggagcaaagaatccagacgaaatcaacaagggtttatacttctttacacacaaatccccaaatcgttcattcagcaaccgtttcggaaatcaatcagcgatgtcagctcttcaatacctagattctcttcgtaatactcacccagaactctccgattggtacaatacgcttgcagatctgtaccaaaggaagctatggcatcaactcactctaaaactcgaacaattcgtcgcactcactgtttttcaggcgggtgatgctctcatccaactgtatcagaacttcatcaccgactttgagactaagataaatcttctcaagctcgcacattttgctgttatagtctctcgtcaatattcagagaaagaagcagccatcagctatctcgaaggagtgattgaaaaactccgagctacgaaagaatcacgtatagaggaaccaatcgcttacattaagatgcaaatagccattttcaaccttgaaaaaggagatcaaaaggagtgcaagaatcttctagacgacggaaagagcacacttgatagcatgactgacatcgatccgtccgtgtatgctaattattattgggtgacgtcccagtaccataaatctcgccaggagtttgctgaattctacaagagttctctactttatttggcatacacgtcggttgaatctctttcggattcatttaagttggatcttgcatttgatttatctctatctgctttacttggagacaacatttacaactttggagaactacttgcacatccaataataaaaagtctgctagggacacaggttgaatggctctactatattctagaagcattcaacaacggagatctagttcgctatcaagaactgtgccgtgttcatgcagcttctcttaacgctcagccagctttggtggagaatgagaagaagcttctagaaaagatcaacatcctctgtttgatggaaattatcttcagtcgaccatccgatgagagaaccattccattaagcatcatagcagaccggacaaaacttacagttgaagacgttgaatatcttctcatgaagagtttatcagtgcatcttattgaggggataattgatcaagttgaaggaaccgttcatgtgtcttgggtgcaaccgagagttttgggaataagtcaaataaagtcattgcgtgatcgattggacaactgggtcgggaaagtacacactgctttggtatcggttgaagctgaaacaccggatttagttgcatcctaagtcgtttcttggttttatttatctcttggatagcttgttgcccaagttatttgggtgaactcaatgtatgatacctattcgtttttctccttttcgaaggctgttgagcctcatatgtatcttactttccgtttttg

SEQ ID NO: 2003 - DNA, 1560 bp, Helianthus annuus
aaactcaaccaagggcttatacacaaacacacacaaatcccccaatcttttctccggcaacacttccgatatcaccgtcggaaaatcagccggcgatggcagctcttcagtacctagattctcttcgcaatactcatccggagctctccgattggtacaatacgcttgcagatctgtaccagaggaagctatggcatcaactcacgttaaagcttgaacaattcgtcgcactcgctgtttttcaggctggcgatgctctcatacaactatacaacaatttcatcaccgacttcgagactaagatcaatcttctcaagcttgcacattttgctgttatagtatctcgccagtattcttcgaaagaagatgccatcagctatcttgaaggagtgatcgagaagctcagagctacaaaggagacgcgtatagaggaaccaatcctctatattaagttgcaaatagcttcttttaatcttgaaaaaggagatcaaaaggagtgcaagaatcttctagaagatgggaagagtacacttgatagcatgactgacattgacccatctgtatatgctaattactattgggtgtcgtctcagtaccataaatcccgtcaagagtttgctgaattctacaagaattctctgctttatttggcttacacctccgtggagtctctttcagattcatttaagctggatcttgcatttgatctatctttatctgctttactgggagataacatttataactttggagaactgcttgcgcatccaataattaaaagtctactagggacaaaggtggaatggctctactacatccttgaagcattcaacgctggagatcttgtccgctatcaagaactatgtcgtgttcatgctgcttcactgaacgctcagcctgctttggtggagaatgagaagaagcttctagaaaagatcaacattctctgcctgatggaaattatcttcagtcgtccatcaggagacagaaccattccattgagcatcattgcagaacagacaaaacttacagttgaagatgttgaatatcttctcatgaagagtttatcggtgcatcttatcgagggaataattgatcaagttgaaggaacagtttacgtgtcatgggtgcaaccgagagtcttggggataagtcaaataaaatctttgcgtgatcggttggacaactgggttgggaaggtgcacactgctttggtatctgttgaagcagaaacacctgatttaattgcatcttaagttttgtatttcgaaaatattgtttcttgttttgtaacactcatgaggatagttggttactgtgacgttgaagatgaagtaatttgtgttgtgggataactctgtgtaagatatttgttttcgtcttttcaaagactgtttttatgctgactgcaagcacaaaaggtagttgctgaactttcattgaacgttaatctttgacagtccatttgcgtgtttgatactttgatgtgttgttgaacttggtatgtctatgtatggttgggttatgatatagaggtgaatagtgataaagtttacaaca

SEQ ID NO: 2004 - DNA, 1449 bp, Helianthus annuus
attcgtttcttgaagcaaaagaaatcacagacgaaatcaaacaagggtttatacttctttacacacaaatccccaaatcgttcattcagcaaccgtttcggaaatcaatcagcgatgtcagctcttcaatacctagattctcttcgtaatactcacccagaactctccgattggtacaatacgcttgcagatctgtaccagaggaagctatggcaccaactcactctaaaactcgaacaattcgtcgcacttactgtttttcaggcgggtgatgctctcatccaactatatcagaacttcatcaccgactttgagactaagataaatcttctcaagctcgcacattttgctgttatagtctctcgtcaatattcagagaaagaagcagccatcagctatctcgaaggagtgattgaaaaactccgagctacgaaagaatcacgtatagaggaaccaatcgcttacattaagatgcaaatagccatcttcaaccttgaaaaaggagatcaaaaggagtgcaagaatcttctagacgacggaaagagcacacttgatagcatgactgacatcgatccgtccgtgtatgctaattattattgggtgacgtcccagtaccataaatctcgccaggagtttgctgaattctacaagagttctctactttatttggcatacacgtcggttgaatctctttcggattcatttaagttggatcttgcgtttgatttatctttatctgctttacttggagacaacatttacaactttggagaactacttgcacatccaataataaaaagtctgctagggacacaggttgaatggctctactatattctagaagcattcaacaacggagatctagttcgctatcaagaactgtgccgtgttcatgcagcttctcttaacgctcagccagctttggtggagaatgagaagaagcttctagaaaagatcaacatcctctgtttgatggaaatcatcttcagtcgaccatccgatgagagaaccattcccttaagcatcatagcagaccggacaaaacttacagttgaagacgttgaatatcttctcatgaagagtttatctgtgcatcttattgaggggataattgatcaagttgaaggaacagttcatgtgtcttgggtgcaaccgagagttttgggaataagtcaaataaagtctttgcgtgatcgattggacaactgggtcgggaaagtacacactgctttggtatcggttgaagctgaaacaccggatttagttgcatcttaagtcttttcttggttttatttatctcttggatagcttgttgcccaagttatttgggtgaactcaatgtatgatacctattcgtttttctccttttcgtaaggctgttgagcctcatatgtatcttactttccggtttgtatctgttgttggatagaaacttgttgaatgcaactt

SEQ ID NO: 2005 - DNA, 2475 bp, Citrullus lanatus
gcttttctattcttttctttgagaacaagaaaaagaacggaggaagaggcacaaattatataaatcggacttctctttttcttttccccttcgagcatcatccttagccggagcagccatggccgctttacagtacctcgattcccttcgtaactcgcatcctgagctcgctgaatggtacaatacgctcgcagatctgtaccagaagaagctttggcatcagctcacactcaagcttgagcaattcgtcgctctgacggtcttccaggctggtgatgcactgattcagttgtatcacaacttcatcactgattttgagactaaaatcaatcttctcaagcttgcacattttgctgtgattgtttctcggcaatatgcagagaaagaagctgccattagttatctcgaagggataattgagaaactaaggagtactaaagagcagcgcatagaggagcctatcctctatattaagatgcaaatagccatttttaagctagaaattggccatttttatgcttgagcatggtgacctgaaagagtgcaagaaacttttggaagatggaaagagcacacttgacagcatgactgacattgatccatctgtatatgctagctattattgggtttcatctcaattttacaagttccgccaagaatttgctgagttctacaaaagtgcccttctttatctggcctacacttcagtggaatcactgtcagactcatttaaattggatttggcctttgatttgtctctttctgcgcttctgggagataatatctacaactttggggagcttcttgcacatcctattatcaaaagtctgttgggcacaaaggtcgagtggctttactacattctacaggcattcaattctggtgatttagttcgctatcaagaattatgccaagtccataatgcagctttaagggctcaaccagctttagtagagaatgagaagaaactattagagaaaatcaacattctctgcctcatggaaattatcttcagccggccatctgaagatcgaaccattccattgaaggttatagcagaacggacaaaactttctatagaagatgtggagcatctactaatgaagagcctctctgtccaccttatagagggtataatcgatcaagttgagggaacggtacatgtttcctgggtgcaacctagggttctgggcattcaacagatcaaatccctgcgagaccggctggacaattgggtggataaagtgcattctactttgctttcggtcgaggccgagacccctgatctcgttgcatcatgatcctcttcctttcatctctaaacaatttagcggagggacaaaggccaggagaaactactgatcctttatatgattttctgtgctggctggctgcctggttttcaagctgtcttttcaacttgcctactgctttcttgaactatcttctaggaagcagaagcctctacttcagtctagttagttttaaaaatgagcatggattggaggagttgagaaatggacttagagagtggttattagacttccttctgtatttgttcacttttgttgcatacaattgatacaattgagttttaatgagctccatgcgaatcgatttcatgataaagtttaaatcttataaactagacttcatataacacagataatctcatttgtccatgcctcaaatatgagaagcaatgaaatgctactacgagctatacaaagttataagacattcttctacaacatcaatccaacatttcacttccttttgaacatgaatatgaagaacactgggctgcaggcttgctattgcctaaatagaaatcaaaacttgaaaaaaaaaatggaagaatcaccttattcaaggagaagagtaaagtgaaccacatgtttttttctttcttttttaggcttcctttagacattatctatgaaactagtacaagaatcattgttgtctaacaaatggagatgagctcacatctgtgctatagaaggaatcctcaggtccaccatagtagttctcctctttctcctcatcccacttgacaacttctcttatatacttgaatgcctcgtcaatagtcactcggtcccttgctctagcttgccaaacaaaaagcttacgacccgtgatggattgataaaggtctttgaatttcatagctacatagtagtaagcttgatgagatagtgactggttgctatgcagtggtctcaccgggctaaaatcgttaaaccattcgcaaacattcaatgacccccgatttactttctcttcaaagagatcatacttgttgagtatcaacacgaatggggtatttctgaagcaagggtgtcggaccatcgtctcaaagagctccttgctctgcatcatcttgttttgtaataggtttccgctgccactaccttctggggcgagagacatctgatcaaaatcactaagagcaacgcaaaagacgacgac

SEQ ID NO: 2006 - DNA, 1544 bp, Panax ginseng
acttataatccagctctcaaaactttctctctcatctgtttcagaaaaccctctctccttccatcatcgttgtagtcagcaatggctgctatgcaatacctggattctctccgtaattcccatccggagctctccgattggtacaataccctagcagatctgtaccagaggaagctatggcaccagctgactctcaagctcgaacagtttgttgccctcgcagtctttcaggcaggtgatgctttgatacagctatatcataatttcatcaccgactttgagactaaaatcaatcttctcaagcttgcacattttgcggtcatagtctctcggcaatattctgagaaagaggctgccattagttatcttgaaggggtgattgagaagcttcgggctactagagaaatgcgcatagaggagcctgtcctttatatcaagatgcagattgctatgttcaaccttgagaaaggagaccaaaaggaatgcaagaaactactagaagatgggaaaagtacactcgacagcatgactgacattgatccgtctgtacatgccagctattattggatttcatctcaataccacaaatctcgtcaggaatttgcagagttctacaaaagtgctcttctatatttggcatacacctcagtagagtctctatcagaatcatttaagctggatttggcttttgatttatccctatctgcattgctgggcgaaaacatttacaactttggcgaactgcttgcgcatccaattataaagagtcttctgggaaccaaggttgagtggctctactacattcttgaagcattcaactctggtgatttggtccgctatcaagaattatgccatgttcatagtgctgctctgagcgcgcaaccagcattagtagaaaatgagagaaagcttctggaaaagatcaacattctctgcttaatggaaatcatcttcagtcgaccatcagaggatagaaccattcccttaagtatcattgctgagcgcacaaaacttactgtagaggacgtggagtatcttcttatgaagagcctatcagttcatctgattgaaggtataattgatcaagttgaagggacagttcatgtttcatgggtgcaaccaagagttttggggatttcccagatcaaatctttgcgtgatcgactggacaactggatggataaagtaaacgccgctttattatcagttgaggctgaaacacctgatttagttgcttcataatttcgttctgggctttctattttcttgtaacaatctcttaacttcctcaaaagagctggttaactgcactaaggagaggagatatatcaattaatcatttgggcggactttgtaggcttccttcatcttggtcatatctagtgttattttccggaaggagagatgcctcttcatgtacttttgcttttccatttttgatttatggtgtctgcatgcttaagactcaaggagtcgaatcttaaaacggctgctttacgtgaagaatattaattcagaccatgtaggtggattttttattcttt

SEQ ID NO: 2007 - DNA, 1434 bp, Panax ginseng
gtcagcaatggctgctctgcaatacctggattctctccgtaattcccatccggagctctccgattggtacaataccctagcagatctgtaccagaggaagctatggcaccagctgactctcaagctcgaacagtttgttgccctcgccgtctttcaggcaggtgatgctttgatacagctatatcataatttcatcaccgactttgagactaaaatcaatcttctcaagcttgcacattttgcggtcatagtctctcggcaatattctgagaaagaggctgccattagttatcttgaaggggtgattgagaagcttcgggctactagaaaaatgcgcatagaggagcctgtcctttatatcaagatgcagattgctatgttcaaccttgagaaaggagaccaaaaggaatgcaagaaactactagaagatgggaaaagtacactcgacagcatgactgacattgatccgtctgtacatgccagctattattggatttcatctcaataccacaaatttcgtcaggaatttgcagagttctacaaaagtgctcttctatatttggcatacacctcagtagagtctctatcagaatcatttaagctggatttggcttttgatttatccctatctgcattgctgggcgaaaacatttacaactttggcgaattgcttgcgcacccaattataaagagtcttctgggcaccaaggtggagtggctctactacattcttgaagcattcaactctggtgatttagtccgctatcaagaattatgccgtgttcatagtactgccctgagcgcacaaccagcattagttcagaatgagagaaatcttcttgaaaagatcaacattctctgcttaatggaaatcatcttcagtcgaccatcagaagatagaaccattcccttaagtattattgcggagcgcacaaaacttacagtagaggatgtggagtatcttctaatgaaaagcctatcggttcatcttatcgagggaataattgatcaagttgaagggaccattcatgtttcctgggtgcaaccaagagttttggggatttctcaaatcaaatctttgcgtgatcggctggataactggatggagaaagtacacactgctttattatcagtcgaggctgaaacacctgatttagttgcatcttaattttgtttctggacttccttcctttctgatttcttgtagcaatctctcaagagctggctaaccgcaccaaaggagaggagatgtaggatttaatcaccactatgtaggcttcctttcatttctaccattatttaccggaaggaactgcctcttaatgtactgcttttcccatttctgatttatgctgtcagcttgcttaagatatatataggggagtcgatcaaatcgtgcaatgaatttttgttttagcattacaatctgatatt

SEQ ID NO: 2008 - DNA, 1720 bp, Panax ginseng
ctcaaaactttctctctcatctgtttcagaaaaccctctctccttccatcatcgttgtagtcagcaatggctgctctgcaatacctggattcacttcgtaattcccatccggagctctccgattggtacaataccctagcagatctgtaccagaggaagctatggcaccagctcactctcaagctcgaacaatttgttgccctcgccgtattccaggctggtgatgcactaatacagctatatcataatttcatcaccgattttgagactaaaatcaatcttctcaagcttgctcattttgcggtcatagtctcccggaaatattctgagaaagaggctgccattagttatcttgaaggggtgattgagaagcttcgggctactagagaaatgcgcatagaggagcctgtcctttatattaagatgcaaattgctatgttcaaccttgagaaaggagaccaaaaggaatgcaagaaactactagaagatgggaaaactacacttgacagcatgactgacattgatccgtctgtctatgccagctattattggaattcatcccaataccacaaatctcgtcaggagtttgcagagttctacaaaagtgctcttctatatttagcatacacctcagtagagtccctgtcagaatcatttaagctggatttggcttttgatttatccctatctgcattgctgggagaaaacatttacaactttggcgaactgcttgcgcatccaattataaagagtcttctgggaaccaaggttgagtggctctactacattcttgaagcattcaactctggtgatttggtccgctatcaagaattatgccatgttcatagtgctgctctgagcgcgcaaccagcattagtagaaaatgagagaaagcttctggaaaagatcaacattctctgcttaatggaaatcatcttcagtcgaccatcagaggatagaaccattcccttaagtatcattgctgagcgcacaaaacttactgtagaggacgtggagtatcttcttatgaagagcctatcagttcatctgattgaaggtataattgatcaagttgaagggacagttcatgtttcatgggtgcaaccaagagttttggggatttcccagatcaaatctttgcgtgatcgactggacaactggatggataaagtaaacgccgctttattatcagttgaggctgaaacacctgatttagttgcttcataatttcgttctgggctttctattttcttgtaacaatctcttaacttcctcaaaagagctggttaactgcactaaggagaggagatatatcaattaatcatttgggcggactttgtaggcttccttcatcttggtcatatctagtgttattttccggaaggagagatgcctcttcatgtacttttgcttttccatttttgatttatggtgtctgcatgcttaagacttagggagtcgaatcttaaaacgactgctttacgtaaagaatattaattcaaaccgtgtaggtggattttttattctttgcatcacaatcagatatgatccatccgttctgtggatgcagcgtcttctttttttgtacccaaatatcagacttttatattacgaaattttgttgttctgatgttccattttaaatcccagatctggcatcaaatttgtatggcagttattatatttttggtaatgataatgaagtatggcaggttgattt

SEQ ID NO: 2009 - DNA, 1416 bp, Ambrosia trifida
ctccttcaacacttccaaatagtaataataatattatcatcaccacaaaaccagtcggtgatggcagctcttgagtacctagactctctccgtactgctcatccagagctctccgattggtacaatacgcttgcagatctgtaccaaaggaagctatggcaccagctcacgttaaaactcgaacagttcgtcgcactcgctgtttttcaggccggcgatgctctcatacaactatataacaatttcatcaccgactttgagactaagatcaatcttctcaagctcgcacactttgctgttatagtgtctcgccagtattcaaagaaagaagatgccatcaagtatcttgaaggagtgattgagaagctcagagctacaaaggagatgcgtatagaagaaccaatcctttatattaagatgcaaatagccgctttcaatcttgaaaaaggagatcaaaaggagtgcaagaatcttctagatgatgggaagagtacacttgatagcatgactgatattgacccatctgtgtatgctaactattattgggtgtcatctcagtaccataaagctcgccaagagtttgctgaattctacaagaattctctactttatttggcttacacctcggtggagtctctttcagattcatttaagctggatcttgcatttgatctatcattatctgcattactgggagataacatttacaactttggagaactacttgcgcatcccataattaaaagtctactagggacaaaggttgaatggctctactatattcttgaagcatttaacgctggagatcttgttcgctatcaagaattatgccgtgttcacgcagcttcactgaacgctcaacccgctttggtggaaaatgagaagaagcttctagaaaagattaacattctctgcctgatggaaattatcttcagtcggccatcaggagatagaaccattccattgaacatcattgcagagcgaacaaaactttcagttgaagatgttgaatatcttctcatgaagagtttatcggtgcatcttatcgaggggataattgatcaagttgaaggaacagtttacgtgtcgtgggtgcaacctagagtcttgggaattagtcaaataaaatctttgcgtgatcggttggacaactgggttgagaaggtgcacactgctttggtatctgttgaagcagaaacaccagatttagttgcatcttaagttttgtatttcgaggatattgcttctttgtttgtaacagtctcatgaggatagtttgttactgtgtcgttgaagatgaagtaatttgtgttgtgggtttaactctgtaagatacctatttgttttagtcttttcaaagactatttttattctgactgcaaaaaagaaaaataaccgactgcgactctgcgttga

SEQ ID NO: 2010 - DNA, 1385 bp, Arnica chamissonis
cagtcggcgatggcagctcttcagtacctagattctcttcgtagtactcacccggagctctccgattggtataacacgcttgcagatctgtaccaaaggaagctatggcaccaactcactctaaagcttgaacaattcgtcgcactcgctgttttccaggccggcgatgctctcatacaattgtatcataatttcatcaccgacttcgagactaagatcaatcttctcaagcttgctcattttgctgttatagtgtctcggcagtattcagagaaagaagctgccatcggctatcttgaaggagtgattgaaaagctcagagctacaaaagagacgcgtatagaggaaccaattctttatattaagatgcaaatagccatttttaatcttgaaaaaggagatccaaaggagtgtaagaatcttctagaagatgggaagagtacacttgatagcatgactgacattgacccatctgtatatgcaaattattattgggtgtcttctcagtaccacaaatcttgccaagagtttgctgaattctacaagaattctttactttatttggcctacacctcggtggagtctctttcagattcatttaagctggatcttgcatttgatctatctttatctgctttgttgggagataacatttacaactttggagaactacttgcgcatccaataattaaaactcttctagggacaaaggttgaatggctttattatattctggaagcgtttaatgctggagatcttgttcgctatcaagaattatgtcgtgttcatgcagcttcactgaacacccagccggctttggtggagaatgagaagaagcttctagaaaagattaacattctttgcttgatggaaattatcttcagtcggccatcggaagacagaaccattccattgagtatcattgcagagcggacaaaacttacagttgaagatgttgaatatcttctcatgaagagtttatcggtgcatcttatcgaggggataattgatcaagttgaaggaactgtatacgtgtcgtgggtgcaacctcgagttttgggaataagtcaaataaaatctttgcgtgatcggttggacaactgggttggaaaggtacacaccgctttggtatctgttgaagcagaaacaccggatttaattgcatcttaagttttgtatttcgacaaccttgtttcttgttctgtaatggaagcccagaggatagtttgttactgtgtcgttgaagatgaggtaattcgtgttgtgggttaactctgtgtaaggtacctattcgccttcgtcttttcatagactgttttaataccgactgcaagcacaagaagtagttgtgtggaacttttgttggaccccaaatctttgatgac

SEQ ID NO: 2011 - DNA, 1862 bp, Cicer arietinum
ctccattattgttattattatgcatttctttgagccgaagcaaaacaagttaaaaaaataaaataaaacatttattatttatataaaaagtaaaaagtaaaataaaataaataaaactagaaagacctcaaaacacaagagaatagagtttcatttcctattttcgtgtttctttctttgtttcagagttttctcgctttgaatcgccatggctgctcttcaatacttggaatctcttcgaagttcgcatcctgagctctccgattggtacaattctcttgaagatctgtaccagaagaagctatggcatcagctcactctcaagctcgaacagttcctcgctcttgctgtttttcaggctggcgatgctctgatacaattatataacaatttcatcactgacttcgagaccaaaatcaaccttctcaagcttgcacattttgctgtgatggtttctcgacagtattctgagaaagaagctgccattggttatctagaaggggtcattgagaaactgcaagccactagagagcagcgcattgaagagcccatcctatatattaagatgcaaattgccttatttaagcttgagcaaggggaccaaaaggaatgcaagagtcttctagaaaatggaaagagtacactagacagcatgacagatattgatccaactgtgtatgcaagctatttctgggtatcttctcaatatcacaaatctcgtcaggaatttgctgagttctacaaaagtgctcttctctacttggcatacacatcagtggagtctctctctgactcattcaagctggatttggcatttgacttatccctttctgccctgctgggggataacatctacaactttggagagctactagcccatcctattattaagagcctcctggggacaaaggtggaatggctctactatattctgcaggcatttaattctggtgatttggttagatatcaagaattatgtcaggtgcataatgctgctttaagggctcaaccagcactagttcaaaatgaacagaagctgttggaaaagatcaacattctctgtctgatggaaattatattcagtcggccttcggaagatcgaactattcccttgagtgtaattgcggagcgtacaaaactttctatagaggatgtggagcatctccttatgaagagtctttctgttcatctgattgagggtataattgatcaagttgatggcaccgtacatgtttcgtgggtgcaaccaagagttttgggtattcaacagataaaatccttgcgggatcgactggacagttggacaggaaaagtacacaacgcgttgttgtccatcgaggcagaaacgcctgatttaattggatcttaaattttctgtttgttgtctgtcaattgtaacaattttattagttaaaagggaacagatcctgaggcaacaaaagatgaagagacttccgagggcatatagccaacttatgtgcttcatttggttttgcctgctgcttttgaatgattgctggaaatagcagcctcttgtactggcttagaaattattggttctatatggttgcatgcctagagacaacatgttgcatcagtttaaaacaggccgtttttatgctttagagtgatgacaaaactatgtacctggaatttttttcttagatacgaccatttttattcactttggaagttcttttcatttaattgagctaagcgattactttcttttgccaatttcacgaatgtcagtttggttgctattattcttactgtgttataaatcatcttttgtttcttaacaatgataaaatggcgttccaattactaatgcagacaacaatgcattgcttgttcgaatt

SEQ ID NO: 2012 - DNA, 1427 bp, Cirsium arvense
aaaagaaaacaccgacgatacagcacaaaagggtttatatttaaatctccacccggaggtctgtattgctgataatcgtcgtcggaattagtaggaggagatggcggctctacagtacctagattctcttcgcagtactcatccggagctatccgattggtacaatacgcttgccgatctgtacgaaaggaagctatggcatcaactcactctgaagctcgaacagttcgttgctcttaccgttttccaggctggtgatgctctcatacagctatatcataatttcataaccgactttgagacgaagatcaaccttctcaagctggcacactttgctgtgatagtctctcgtcaatattcagagaaagaagctgccatcagttatcttgatggggtgattgaaaagctcagggctacaaaagaaacacgtatagaggagccagttctttatattaagatgcagatagccatctttaatcttgagaaaggagatcaaaaggagtgcaagaatcttctagaagacgggaagagtacacttgatagcatgaccgacattgatccgtcggtatattccaactattattgggtgtcatctcagtaccacaaatcccgccaagagtttgctgagttttacaagagtgcccttctttatttggcatacacctcagtggagtctctatcagattcattcaagctggatcttgcatttgatctatccctgtctgcattgctgggagagaatgtctacaacttcggggagctacttgcccatccaattataaagagtcttctagggacaaaggttgaatggctctactacattcttgaagcatttaactctggagatctaatccgctatcaagaactatgtcgtgttcatggagcttctcttagtgctcagcctgctttggtggataatgagaagaaacttttggaaaagattaacattctctgcttgatggaaattatcttcagtcgaccatcagaagaacgaactattccactgagcatcattgcagagcgaacaaaccttaccgttgaagatgtggaacatcttctcatgaagagtctatcggttcatcttattgagggtataattgatcaagttgatggaacggtttacgtatcgtgggtgcagccgagagttctgggaatttctcaaatcaaatcattgcgtgatcggttggatggttgggtgggaaaagtacacactgcgttgatatctgtggaagcggaaacacctgatttagttgcatcgtaagtctttgtttgtttccatctctgtaacaaactactttggaaagcccaaagaaaagagctcgtaagaaaccagcgaaaggaattaagagactaattaagagccaactctgtgtaagtcgtttttctttgatattttcgccatcgggaaggaggctcttgtgtacctt

SEQ ID NO: 2013 - DNA, 1251 bp, Flaveria ramosissima
gtacctcgattctctccgtaccactcaccctgagctctccgattggtacaatacgcttgcagatctgtaccagaggaagctgtggcaccaactcactctaaagctcgaacaattcgtcgcactcgctgtttttcaggctggcgatgctctcatacagctatatcataatttcatcaccgacttcgaaactaagatcaatcttctcaagcttgcacattttgctgtaatagtgtctcgccagtattcagagaaagaagctgccataagttaccttgaaggagtgattgagaagctcagaggtacaaaagagatgcatatagaggaaccaatcgtttatattaagatgcagatagccctttttaatcttgaaaaaggagatcaaaaggagtgcaagaatcttctagaagatgggaagagtacacttgatagcatgactgacattgacccatctgtatatgctaattactattgggtgtcatctcagtaccataaatctcgccaagagtttgctgaattctacaagaattctctactttatttggcctacacctcagtggagtctctctccgattcatttaagctggatcttgcatttgatctatctttatctgctttactgggagataacatttacaactttggagaactacttgcacatccaataattaaaagtctactagggacaaaggttgagtggctctattatattcttgaagcattcaacgccggagatcttgttcgctatcaagaattatgtcgtgttcatgcagcttcactcaacgcccaacctgctttggtggagaatgagaagaagcttctagaaaagattaacattctctgcttgatggaaatcatcttcagtcggccctcagaagacagaaccattccattgagcatcattgcagagcggacaaaacttacagttgaagatgttgaatatcttctcatgaagagtttatcggtgcatcttattgaggggataattgatcaagttgaaggaacagtttacgtgtcgtgggtgcaacctcgagttttgggaataagtcagatcaaatctttgcgtgatcggttggacaactgggtagggaaagtacacactgctttggtatctgttgaagcagaaacaccagatttagttgcatcttaagtttgtattcgacaatatcgtttcttgttttgtaatactcacaaaagccctgaggatagtttgttactgtgtgattgacgatagagtaattgtttggtgatatt

SEQ ID NO: 2014 - DNA, 1833 bp, Gossypium raimondii
tgatccgacccacaccacaagccgacccgacatataattttcccttttttgggtatgttttttttctattccttcggtcgattgagctgacggcttttctttgttttccccttcagaattcatatagagacagagaaccaaagttgaaaaaaaagaacatacacatctaaatctttaaggcctcagcttctctttctctgtttcgactctgtggagtaaatttgggatcgatggcggccttgcagtacctagactctcttcgaaatgagcatccagagctaggcgactggtataattctcttgcagatctgtatcaaaagaagctctggcaccagctcactctcaagcttgagcagttcgttgctctcaccgttttccaggctggagatgcgttgataaagttgtatcataactttatcactgactttgagacgaagattaatcctctcaagcttgcacatttcgctgttatagtttctcagcagtactcagagaaagaggctgctattagtttccttgaaggggtgattgaaaagcttcaggctactaaggagcagcgcatagaagagccaattctttatattaagatgcaaatttccaaattcaagcttgagcaaggtgatcaaaaggagtgcaagaaacttcttgaagatgggaagagtacccttgacagtatgactgacatagatccatctgtatatgctacctattactgggtttcatctcaataccataaatttcgccaagaatttgctgagttctacagaagtgctctcctttatcttgcatacacatcagtggagtctctctcagaatcttttaagctggatttggcatttgatctgtccctttctgctcttttgggagataacatctacaactttggagaactccttgctcatccaattataaagagtcttctggggaccaaggtggagtggctttattatatcctccaatccttcaactctgggaatttggttcgctatgaagaattgtgtcgcgtgcacaatgctgcactgagtgctcaaccagccttggttgagaatgagaagaagctcttggaaaaaattaatattctatgcttaatggagattatcttcagccgcccttctgatgatcgaactattcctttaaaagttattgctgagagaacaaaattgtcaattgaggatgttgagtatcttctcatgaagagcctgtctgttcgtctgattgagggcataattgatcaagttgagggaacaattcatgtctcttgggtgcagccaagagttttggggattccacagatcaaatccttgcgtgaccggttggataattggatgggcaaagtacataacgcttggttatcaattgaggctgaaacacctgatctcgttgcatcatgaatttttttctccagttcctttctgccattgtaacaatttcgttatttgaaaagggcaagaaaaagggaaagtgaaatgatgagcaatgaggatagagataagcgttagtcatttgcgggtagagccatctttgtatgattcctttagtaggtattgcttgatccttaaatctttgttctgaaaggagcggctcatgtactaaacttttcactttttggcatttgttggatctacaatggcactggaatgcctgaggatacggttaaaaccgcaaacatcatccttatctttcattttgtattgggatttttcattagatacaatcagatatgatccacttttatgtggatgaaagtgcattttcatttcagattagatgtttttctgcatgatctatatattgtttggcttcagtgcgttactagacgagttgctgctactt

SEQ ID NO: 2015 - DNA, 1797 bp, Gossypium raimondii
gtattttaattttttgttagcgaaacccgacccgaaatataattgtcaaaattctcgggtttcctagtcctctgtgtcagtgtctttgctcgaagacagggaaaatcaaagctttcggtatttataatagagagaaaactaagttgacaagaaaggaaattttctctcattcgacattgttgagggaaattgaggtgaatggcggccttgcaatacctagactctcttcgaaatgaacatccagagctatccgattggtatagttctcttgcagatctgtatcagaagaagctttggcatcaacttaccctcaagcttgatcaattcgttgctcttaccttcttccaggctggagatgcactgatcaagttgtatcataattttatcactgactttgagaccaagattaatcttctcaagctcgcacattttgctgttatagtttctcggcaatactcagagaaagaagctgctattagttatctcgaaggggttattgaaaagcttcgagctactaaagagaagcgcatagaagaacctattctttatatcgagatgcaagtcgccaaattcaagcttgagctgggcgaccaaaaggagtgcaagaaacttcttgaagatggaaagagtacccttgacagtatggatggcgtagatccatctgtgtatgctagctattattgggtttcatctcaataccataaatttcgtcaagaatttgctgagttctataaaagtgctctcctttatcttgggtacacatcggtggattctctctcagaatcttttaagttggatttggcatttgatctatccctttctgctcttttgggagataatatctacaactttggggaactgcttgctcatcctattgtaaagagtcttttggggaccagtgtagagtggctttactatatcctcctagccttcaactcaggggatttagttcactatcaagaattgtgtcgcatacacaatgctgcattgaggacacaaccagccttggttgagaatgagaagaggctcttggaaaaaattaatgttctttgcttaatggagattatcttcagccgcccggctgaagatcgaaccattcctttaaaagttatagctgagcgaacaaaactgtcgattgaggatgttgagcatcttctcatgaagagcctgtctgtgcatctgatagagggcataatagatcaagttaaaggaactgcctacatctcctgggtgcagccgagagttctgggaatcccacagatcaaatccttgcgggatcggttggataattgggtgggcaaagtacacactgcttgcttatcaatcgaagctgaaacacccgaccttgtcgcaccatgatcttttttccctttctgtccagtatacgaaaaggaaacaaaaggaaaaggcaatggcaagcaatgaggatattgcttgatctttaaatcgttcttttgaaaggagagcggctcagaccttttggcatttgttggatctcaatggcaatggcaatggcaatatgcctaaggatacagtgttaaaaattgaaaagagcgtcttttctgtttcttaaactttgtattaggaattttcattagaaacaataagatgatccactttcatatgggatgatgaaaatgcattttcatttgttttctttcctcgtgtattatactagaaattgagtgggaggaattggagcatataaaaaattgaaaattatgattcgtaacattatatatatataaaaaaaaaaggaaattatgattcttaacattatacagaggaggcgattag

SEQ ID NO: 2016 - DNA, 1667 bp, Lotus japonicus
gagattttccaatttcttcttcttctcctccgtggttgaatcgccatggctgctctgcaatacttggattcgcttcgcagcgcgcacccggagcttgacgattggtacaattctcttgcggatctgtaccagaagaagctctggcatcagctcactctcaagctcgagcagtttctcgctcatgctgttttccaggctggcgatgctttgattcagctgtaccacaatttcatcacagactttgagactaaaatcaaccttctcaagcttgcacattttgctgtgatggtttctcggcagtattctgagaaagaagctgccgttggttatcttgatgggatcattgagaaactgcaagccactaaagaacagcgcatagaagaacctattctatacattaagatgcaaatagccatatttaagcttgagcaaggtgatcaaaaggaatgcaagaagcttctggaagatggaaagagtacactagacagcatgacagatatcgatccaactgtgtatgctagctattactgggtatcttctcagtttcataaatcccgccaggaatttgctgagttctacaaaagtgctcttctctatttggcatacacagcagtggaatctctctccgattcattcaagctggatttggcttttgatttgtccctttctgctctgctgggggataacatctacaactttggagagctacttgcccatccaataattaagagccttctggggacaaaggtggagtggctgtactatattttgcaggcattcaattctggtgatttggttcgatatcaagaactatgtcgggttcataatgctgctttaagggctcaaccagcactagttcaaaatgaacagaggttattggaaaagatcaacattctctgcctgatggagattatattcagtcggccttcggaagatcgaactattcccctggctgtaattgcagagcgtacaaaactttctatagaggatgtggagcatcttcttatgaagagcctatctgttcatctaattgagggtataattgatcaagttgaaggcacagtgcatgtttcctgggtgcagccaagagttttgggcattcaacagatcaaatccttacgtgatcgactggacagttggacaggaaaagtacacaccgcattgttgtccatcgaggcggaaacacctgatctaattggatcatgacttttcctggtttgttttgttcactgcccattgtaacaatttctcatgttaaagggaaaacatcctaaggcgacaaaagatgaagagacttccaagtcacatgggcaatatgccaactttatgtgcttcatttggttttgccagctgcttttgaatgattgattgctggaaagagcagcctcttgtacttcacttagaaattgttggttctatggcctggagacatggtgaatcggttagaaacatgctgtttttacgctttagagtgatgataaaaactatgtacctttaagtttttcttagatacggccattttcattcacttcagaatttcttttatttaattgagccaatcagttattttctttcacttgatgtgcttcaattccgacgctattgatcctgccatggattaaatctttagtttcactgggttcttatctaatgactgataaaatggc

SEQ ID NO: 2017 - DNA, 1596 bp, Arachis hypogaea
gaagttcggtggtgcgtgttgttgggcttgggaatcggttgtgaatcgcgatggctgcacttcaatacttggaatcgctgaggaacgcgcatcctgagctctctgattggtacaattccctcgcagatctgtatcagaagaagctctggcaccagcttactcttaagctcgagcagttcgttgccctcgccgctttccaggctggtgatgctcttatacagttgtataacaatttcatcacagactttgagaccaaaatcaaccttctcaagctagcacattttgctgtgatagtttcccggcagtattctgagaaagaagctgctgttggttatcttgatggagtcattgagaagcttcaagctactagagagcaacgcattgaagaacctattctttacattaagatgcgaattgccataattaagcttgagcaaggtgaccaaaaggaatgcaagaaacttctggaagatggaaagagtacacttgatagcatgacagacattgatccatctgtatatgctagctattactgggtgtcatcccagtaccacaaatcgcgtcaggagtttgctgagttctacaaaagtgctcttctctatttggcatacacatcagttgaatctctctcagattcattcaagctggacttggcgtttgatttgtccctctctgctctgcttggggataacatatacaactttggagaattgcttgctcatcctattattaagagccttcttgggacaaaggtagaatggctttattatattctgcaggcattcaattctggtgatttagttcgatatcaagaattatgccgggtgcatagtgctgctctaagggctcaaccggcactagttcaaaatgagcagaaattgttggaaaagattaacattctctgcttgatggagatcattttcagtcggccttcagaagatcgaactatacccttgagtgtcattgcagatcgtactagactttctatagagaatgtggagcatctcctaatgaagagcctatctgttcatctaattgagggtataattgatcaagttgatggcacagttcatgtttcctgggtgcaaccaagggttctgggtattcaacagatcaaatccttacgtgatcgactggacagttggacggggaaagtacacactgcattgttgtccatcgaggcagaaacacctgacttaattggatcgtgatttttctttgcttgttttctgccaattgtaagaatttcttaagttaaagggaagacatgctgaggggacaaaacgagagacttccaactcacatgggaattatagccgagtatatgtgcttcatttggttttatctgctgcttttgaatgaatgctggagagaacagacccttgtactccacttagaaattgttggttctatggtttcatgcatagacacatcggattcagttggaagcaggctatttttatgctttagagtgatgatactactatgtacctggaatttttattagatacagccattttaattcactttcacaagttcctttttctgccgagcattccttctattgccaaaaacaatcatctattgctttaataa

SEQ ID NO: 2018 - DNA, 1546 bp, Arachis hypogaea
ggtgcgtgttgttgggcttgggaatcggttgtgaatcgcgatggctgcacttcaatacttggaatcgctgaggaacgcgcatcctgagctctctgattggtacaattccctcgcagatctgtatcagaagaagctctggcaccagcttactcttaagctcgagcagttcgttgccctcgccgctttccaggctggtgatgctcttatacagttgtataacaatttcatcacagactttgagaccaaaatcaaccttctcaagctagcacattttgctgtgatagtttcccggcagtattctgagaaagaagctgctgttggttatcttgatggagtcattgagaagcttcaagctactagagagcaacgcattgaagaacctattctttacattaagatgcgaattgccataattaagcttgagcaaggtgaccaaaaggaatgcaagaaacttctggaagatggaaagagtacacttgatagcatgacagacattgatccatctgtatatgctagctattactgggtgtcatcccagtaccacaaatcgcgtcaggagtttgctgagttctacaaaagtgctcttctctatttggcatacacatcagttgaatctctctcagattcattcaagctggacttggcgtttgatttgtccctctctgctctgcttggggataacatatacaactttggagaattgcttgctcatcctattattaagagccttcttgggacaaaggtagaatggctttattatattctgcaggcattcaattctggtgatttagttcgatatcaagaattatgccgggtgcatagtgctgctctaagggctcaaccggcactagttcaaaatgagcagaaattgttggaaaagattaacattctctgcttgatggagatcattttcagtcggccttcagaagatcgaactatacccttgagtgtcattgcagatcgtactagactttctatagagaatgtggagcatctcctaatgaagagcctatctgttcatctaattgagggtataattgatcaagttgatggcacagttcatgtttcctgggtgcaaccaagggttctgggtattcaacagatcaaatccttacgtgatcgactggacagttggacggggaaagtacacactgcattgttgtccatcgaggcagaaacacctgacttaattggatcgtgatttttctttgcttgttttctgccaattgtaagaatttcttaagttaaagggaagacatgctgaggggacaaaacgagagacttccaactcacatgggaattatagccgagtatatgtgcttcatttggttttatctgctgcttttgaatgaatgctggagagaacagacccttgtactccacttagaaattgttggttctatggtttcatgcatagacacatcggattcagttggaagcaggctatttttatgctttagagtgatgatactactatgtacctggaatttttattagatacagccattttaattcactttcacaagttcctttttctgccgagcat

SEQ ID NO: 2019 - DNA, 1723 bp, Gossypium raimondii
tctattccttcggtcgattgagctgacggcttttctttgttttccccttcagaattcatatagatacagagaaccaaagttgaaaaaaaagaacatacacatctaaatctttaaggcttcagcttctctttctctgtttcgactctgtggagtaaatttgggatcgatggcggccttgcagtacctagactctcttcgaaatgagcatccagagctaggcgactggtataattctcttgcagatctgtatcaaaagaagctctggcatcagctcactctcaagcttgagcagttcgttgctctcaccgtcttccaggctggagatgcattgataaagttgtatcgtaactttatcactgactttgagacgaagattaatcctctcaagcttgcacatttcgctgttatagtttctcagcagtactcagagaaagaggctgctattagtttccttgaaggggtgattgaaaagcttcaggctactaaggagcagcgcatagaagagccaattctttatattaagatgcaaatttccaaattcaagcttgagcaaggtgatcaaaaggagtgcaagaaacttcttgaagatgggaagagtacccttgacagtatgactgacatagatccatctgtatatgctacctattactgggtttcatctcaataccataaatttcgccaagaatttgctgagttctacagaagtgctctcctttatcttgcatacacatcagtggagtctctctcagaatcttttaagctggatttggcatttgatctgtccctttctgctcttttgggagataacatctacaactttggagaactccttgctcatccaattataaagagtcttctggggaccaaggtggagtggctttattatatcctccaatccttcaactctgggaatttggttcgctatgaagaattgtgtcgcgtgcataatgctgcactgagtgctcaaccagccttggttgagaatgagaagaagctcttggaaaaaatcaatattctatgcttaatggagattatcttcagccgcccttctgatgatcgaactattcctttaaaagttattgctgagagaacaaaattgtcaattgaggatgttgagtatcttctcatgaagagcctgtctgttcgtctgattgagggcataattgatcaagttgagggaacaattcatgtctcttgggtgcagccaagagttttggggattccacagatcaaatccttgcgtgaccggttggataattggatgggcaaagtacataacgcttggttatcaattgaggctgaaacacctgatcttgttgcatcatgaatttttttctccagttcctttctgccattgtaacaatttcgttatttgaaaagggcaagaaaaagggaaagtgaaatgatgagcaatgaggatagagataagcgttagtcatttgcgggtagagccatctttgtatgattcctttagtaggtattgcttgatccttaaatctttgttctgaaaggagcggctcatgtactaaacttttcactttttggcatttgttggatctacaatggcactggaatgcctgaggatacggttaaaactgcaaacatcatccttatctttcattttgtattgggatttttcattagatacaatcagatatgatccacttttatgtggatgaaagtgcattttcatttcagattagatatttttctgcatgatcta

SEQ ID NO: 2020 - DNA, 1570 bp, Chenopodium quinoa
aaaaaatcgtttaggttaggccttgaagttttctttctctctcctcccggtgttcggtggtttccttattttctgcgcatttttacttgttcattcatctttctctttcacttacttcccagaaaatttttcacagcagagagaaactagagagagaaacctcaactatgtcggcgcttcagtacttggatactctcagaagcgcgcatcctgagctcgctgaatggtacaatactctcgcagatctataccagaagaagttatggcatcagcttactctcgagctcgagaagttcgtcgcactcgctgttttccaggctggtgatgccctgatacagttatatcacaatttcatcacagactttgagacaaagataaatctccttaagcttgctcattttgctgtcatagtatcccgacagtatgcggagaaagaagcagctattggttatcttgaaggagtgattgaaaagcttcatgctacccgggaatctcgtatagaggagcctgtcctctatataaagatgcagatggctttgtttaagcttgagcaaggggaacaaaaagaatgcaagaagatattggaagatggaaaaaccacacttgacagtatgactgatattgatccatcagtttatgctagtttttattgggtatcatctcagtaccataaagcacgccaggagtttgccgagttctacaagaatgctctcctttaccttgcttacacatcagtggagtctctttctgaatcattcaagctggacttggcttttgatctttcattgtctgcactgttgggagagaatatctacaactttggggagctccttgcccatccaattttaaagtctcttcttgggacaaaggtcgagtggctctactatattctgcaagcatttaacactggcgacctgattcggtatcaagaactatgcaatgtgcacaaagatgctttgaatgcacaaccagctttggttgctaatgaaaggaaacttttggagaagattaatattctctgcttgatggaaatcatcttcaaccgaccagcagaagataggacaattcccttgaaggtcattgcggagcgcactaggttgtctattgaagatgttgagtatctgctcatgaagagcctctctgttcatcttattgagggaatcattgatcaagttgaggggacagttcatgtatcctgggtgcaaccgagagttttagggattccacaaatcacatccttgcgtgaccggctggatagttggttgggcaaagtacacactgccttattatccgttgaggctgaaacaccagatctagttgcttcataatttgtaggttctcatatttgtctcatgtaacggatacttagtgcgtggacaaaagggaaaggatgcctattatcagagagtgacaggttatccgggctttaacttttgtatgcatcttttcaagtattttgttcgttggtcttagattcatttttcctggagcaaatctttccccttgtacttcctctatttgaggtgtttgatctgcttaatgagactaagagaggggggctgaatcattt

SEQ ID NO: 2021 - DNA, 1304 bp, Ambrosia trifida
tttcttctcccaaaagaaaactcaaacaagggcttataaataaaatccccaatcaatcaatccattctccttcaacacttccaaataataataataatattatcatcaccacaaaaccaagtcggtgatggcagctcttgagtacctagactctctccgtactgctcatccagagctttccgattggtacaatacgcttgcagatctgtaccaaaggaagctatggcaccagctcacgttaaaactcgaacagttcgtcgcactcgctgtttttcaggccggggatgctctcatacagctatataacaatttcatcactgactttgagactaagatcaatcttctcaagcttgcacactttgccgttatagtgtctcgccagtattcaaagaaagaagatgccatcaagtatcttgaaggagtgattgagaagctcagagctacaaaggagatgcgtatagaggaaccaatcctttatattaagatgcaaatagccgctttcaatcttgaaaaaggagatcaaaaggagtgtaagaatcttctagatgatgggaagagtacgcttgatagcatgaccgacattgacccatctgtgtatgctaactactattgggtgtcgtctcagtaccataaagctcgccaagagtttgctgaattctacaagaattctctactttatttggcttacacctcggtggagtctctttcagattcatttaagctggatcttgcatttgatctatctttatctgcattactgggagataacatttacaactttggagaactgcttgcacatcccataattaaaagtctactagggacaaaggttgaatggctctactatattcttgaagcattcaacgctggagatcttgttcgctatcaagaattatgccgtgttcacgcagcttcactgaacgctcaacccgctttggtggaaaatgagaagaagcttctagaaaagatcaacattctctgcctgatggaaattatcttcagtcggccatcaggagatagaaccattccattgaacatcattgcagagcgaacaaaacttacagttgaagatgttgaatatcttctcatgaagagtttatcggtgcatcttatcgaggggataattgatcaagttgaaggaacagtttacgtgtcgtgggtgcaacctagagtcttgggaataagtcaaataaaatctttgcgcgatcggttggacaactgggttgagaaggtgcacactgctttggtatctgttgaagcagaaacaccagatttagttgcatcttaagttttgtatttcgagg

SEQ ID NO: 2022 - DNA, 1314 bp, Cichorium intybus
ggggttctttggggaaagaaactccggcgacatcaaacaagggttttatatacaaatcctcaagcaacctcattctccttcgcaatcctctctcggacaacaatttgaacatcattcagcgatggcagctcttcagtacctagattctcttcgtactactcacccagagctctccgattggtacaatacgcttgccgatctgtaccaaaggaagctatggcaccaactcactctcaagcttgaacaatttgttgcactcgctgttttccaggctggtgatgctctcatacaactatacaataatttcatcaccgactttgagacaaagatcaatcttctgaagcttgcacattttgctgtgatagtctctcgccagtattcagagaaagaagctgccataagctatctggaaggagtgattgaaaagcttcgggttacaaaagagacgcgtatagaggagccaatcctttatattaagatgcagatagccatttttaatcttgagaaaggtgatcaaaaggagtgcaagaatcttctagaagatgggaagagcacacttgatagcatgactgatattgacccttctgtgtatgcaaactattattgggtgtcatctcagtaccataaatctcgccaggagtttgctgagttttacaagaactctctactttatttggcctacacatcagtggagtctttgtctgattcatttaagctggatcttgcatttgatctatccctatctgcattgcttggagacaacatttacaactttggagaactacttgcccatccaattataaaaagtctgctagggacaaaagtggaatggctgtaccatattctagaagcattcaattcaggagatttaattcgctatcaagaactatgtcgtgttcattcagcttcacttaatgctcaacctgctttagtggaaaacgagaagaagcttctagaaaaaattaacattctctgtttaatggaaattatcttcagtcgagcatctgaagacagaaccattccattgagtgtaatcgcagaaaggacaaaactcactgttgaagatgtggaataccttctcatgaaaagtttatctgtgcatttgatcgaagggataattgatcaagttgatgggacagtccacgtgtcatgggtgcagccacgtgtcttgggggtggctcagattaaatctttgcgtgatcggttggacaactgggttgggaaagtacacactgctttgatatctgtggaagcagaaacaccggatttagctgcatcttaacttttgttttttgtttttttgtttttgttttt

SEQ ID NO: 2023 - DNA, 1522 bp, Olea europaea
ggtagtcctccataactctctgtagcatacaacggattcagagcacaaaatcgtagtagaaggagcgatggcggcactacagtatcttgacaccctgaggaatactcacccggagctttctgagtggtacaacacgcttgcagatctgtaccagcgcaaactctggcaccagctcaccctcaagctcgaacagtttgtcgccctcgctgtctttcaggctggtgatgctctaatacagctgtaccacaatttcataaccgagtttgagacaaagatcaatctcctcaagcttgctcattttgctgtcatagtttcccggcagtattcggagaaagaggctgccataaattatcttgaaggagtgattgaaaagcttcgtaatacaaaagagatgcgcattgaggagcctattctttatataaagatgcagattgctacttttaagcttgagcaagaagatcataaagagtgcaagaaactcttagaggatgggaagagtacacttgatagcatgactgacattgacccatctgtgtatgccagctactattgggtttcatctcaacttcataaatcttgtcaagaatttgcagatttctataaaagcgctcttctttatttagcttacacttctgtggagtctctgtcagaatcatttaaactggatttggcatttgatttgtccctatcagcattgttgggggaaaacatttacaactttggagaactccttgctcatccaattgtaaaaagtctcatagggactaaggtagaatggctatactatattctggaagcattcaactctggcaacttggttcgttatcaagaattgtgccaggttcatatggctgctcttagtgcccaaccagcattggtgcagaatgagaaaaaccttctggagaaaattaacattctctgcttgatggagactatttttagtcgaccatcagaagatagaactattccattatgtgtcatagctgaacgaacaaagcttactgtggaagacgtggagtatcttcttatgaagagcctttcagtgcatctgattgagggaattattgatcaagttgaggaaacagtttatgtttcctgggttcaaccaagagttttggggattcctcaaatcaaatcattgcgtgatcgactggacaattggatggagaaagtacacactgcattgttatctgttgaggcagaaacccctgatttagtcgcagcataactttagatccgaaccttgtcatattcatctgccactctctttctggccagaacatagtcttatgtcggaagagggcaaatttaagtttctttgtcgacccgtgtgcttaatcacataattgctcgcattttcaatttttgttttagggaagcagcaacatatttctcataatttcaagttgtgccttggtactccctacataacagacaactgtttctactgcctcaattatctcatggaaccgtgtagaactaattgttttatgcgcaatttttgcttgtcgatgtttcttag

SEQ ID NO: 2024 - DNA, 1674 bp, Glycine max
aataaagaaaaaaagaaactagggtataaaaaaaaatagaagaggggacgcagtgctatcgagtttttttttcttaatgccatggctgctctgcaatacttggaatcgctgcgcaacgcgcatcctgagctctccgattggtacaattcgctggcggatctataccagaacaagctctggcaccagcttaccctcaagcttgagcagttcgtggctctcgccgtcttccaggccggtgatgcattaatacaattatatcacaatttcatcacagactttgagaccaaaatcaaccttctcaagcttgcgcatttcgctgttatagtttctcggcagtatgctgagaaagaagctgcggttggttatcttggaggggttattcagaaacttcaagatactagagagcagcgcatagaagaacctattctttacattaagatgcaaatagcaatattaaagcttgagcaaggtgatcaaaaggaatgcaagaaacttctagaagatggaaagagtacactagacagcatgacagatattgatccatctgtatatgctagctattactgggtatcatctcagtttcataagacacgtcaagaatttgctgagttctacaaaagtgcccttctctatttggcatacacatcagtggaatctctctctgattcattcaagctggatctggcatttgatttgtccctctctgcccttcttggggataacatctacaacttcggagagctacttgcccatcctataattaagagccttatggggacaaaggtggaatggctttactacattctgcaggcattcaatgctggtgatttattacaatatcaagaattatgtcgggtgcataatgctgctttaagagcccaaccagcactagttcaaaatgagcaaaagttgtcggaaaagatcaacattctgtgtttgatggagattatattcagtcggccttcggaagatcgaactattcccttgagtgtaattgcagagcgtacaaagctttctatagagaatgtggagcatctcctcatgaagagcctatctgttcatctaattgagggtataattgatcaagttgagggcacagtccacgtttcttgggtgcagccaagagttctgggtattcaacagatcaaatccttacgggatcgactagacagttggaccggaaaagttcacactgcattgttgtccattgaggcagaaacacctgatctaattggatcgtgatctttctttaattttttttctgccctatgtaacaatttctcaagtcaaagggaacacatcctaaggcttcaaaagatgaagagaaattccaagtgacatgggcaatgtagccaacttgtcttggcttcatttttatttacatgcttcatttgctttttgaatgatgactggaaagagcagccccttggcttaggaatggttgtttctatgcttttgcatacctagagacatggtaactcggttgggaacaggctgtttttacgctttagagtgatacaaactatttatctggaattttcttagatacggccattttattcacttaagaagtcttttttttttcattgaattgtgccaagcattcaccttcgtttgtctaatttctcatgtacttcaatatgggtgctactttacttgccatgagatgaatct

SEQ ID NO: 2025 - DNA, 1651 bp, Glycine max
taaaaaaaaatagaagagcggccgcgagggctatcgagtttttttttcttaatgccatggctgctctgcaatacttggaatcgctgcgcaacgcgcatcctgagctctccgattggtacaattcgctggcggatctataccagaacaagctctggcaccagcttaccctcaagcttgagcagttcgtggctctcgccgtcttccaggccggtgatgcattaatacaattatatcacaatttcatcacagactttgagaccaaaatcaaccttctcaagcttgcgcatttcgctgttatagtttctcggcagtatgctgagaaagaagctgcggttggttatcttggaggggttattcagaaacttcaagatactagagagcagcgcatagaagaacctattctttacattaagatgcaaatagcaatattaaagcttgagcaaggtgatcaaaaggaatgcaagaaacttctagaagatggaaagagtacactagacagcatgacagatattgatccatctgtatatgctagctattactgggtatcatctcagtttcataagacacgtcaagaatttgctgagttctacaaaagtgcccttctctatttggcatacacatcagtggaatctctctctgattcattcaagctggatctggcatttgatttgtccctctctgcccttcttggggataacatctacaacttcggagagctacttgcccatcctataattaagagccttatggggacaaaggtggaatggctttactacattctgcaggcattcaatgctggtgatttattacaatatcaagaattatgtcgggtgcataatgctgctttaagagcccaaccagcactagttcaaaatgagcaaaagttgtcggaaaagatcaacattctgtgtttgatggagattatattcagtcggccttcggaagatcgaactattcccttgagtgtaattgcagagcgtacaaagctttctatagagaatgtggagcatctcctcatgaagagcctatctgttcatctaattgagggtataattgatcaagttgagggcacagtccacgtttcttgggtgcagccaagagttctgggtattcaacagatcaaatccttacgggatcgactagacagttggaccggaaaagttcacactgcattgttgtccattgaggcagaaacacctgatctaattggatcgtgatctttctttaattttttttctgccctatgtaacaatttctcaagtcaaagggaacacatcctaaggcttcaaaagatgaagagaaattccaagtgacatgggcaatgtagccaacttgtcttggcttcatttttatttacatgcttcatttgctttttgaatgatgactggaaagagcagccccttggcttaggaatggttgtttctatgcttttgcatacctagagacatggtaactcggttgggaacaggctgtttttacgctttagagtgatacaaactatttatctggaattttcttagatacggccattttattcacttaagaagtcttttttttttcattgaattgtgccaagcattcaccttcgtttgtctaatttctcatgtacttcaatatgggtgctactttacttgccatgagatgaatcttc

SEQ ID NO: 2026 - DNA, 1434 bp, Panax ginseng
aagcagtggtatcaacgcagagtacatggggctctctcatctgtttcagaaaaccctccctccttccatcatcgttgtagtcagcaatggctgctctgcaatacctggattctctccgtaattcccatccggagctctccgattggtacaataccctagcagatctgtaccagaggaagctatggcaccagctgactctcaagctcgaacagtttgttgccctcgccgtctttcaggcaggtgatgctttgatacagctatatcataatttcatcaccgactttgagactaaaatcaatcttctcaagcttgcacattttgcggtcatagtctctcggcaatattctgagaaagaggctgccattagttatcttgaagggtgattgagaagcttcgggctactagagaaatgcgcatagaggagcctgtcctttatatcaagatgcagattgctatgttcaaccttgagaaaggagaccaaaaggaatgcaagaaactactagaagatgggaaaagtacactcgacagcatgactgacattgatctgtctgtacatgccagttattattggatttcatctcaataccacaaatctcgtcaggaatttgcagagttctacaaaagtgctcttctatatttggcatacacctcagtagagtctctatcagaatcatttaagctggatttggcttttgatttatccctatctgcattgctgggcgaaaacatttacaactttggcgaactgcttgcacacccaattataaagagtcttctgggcaccaaggtggagtggctctactacattcttgaagcattcaactctggtgatttagtccgctatcaagaattatgccgtgttcatagtactgccctgagcgcacaaccagcattatttcagaatgagagaaatcttcttgaaaagatcaacattctctgcttaatggaaatcatcttcagtcgaccatcagaagatagaaccattcccttaagtattattgcggagcgcacaaaacttacagtagaggatgtggagtatcttctaatgaaaagcctatcggttcatcttattgagggaataattgatcaagttgaagggaccattcatgtttcctgggtgcaaccaagagttttggggatttctcaaatcaaatctttgcgtgatcggctggataactggatggagaaagtacacactgctttattatcagtagaggctgaaacacctgatttagttgcatcttaattttgtttctggacttcctttctgttttcttgttgcaatctctcaatgcccctaaaagagctggctaacctcaccaaaggagaggagatgtaggatttaatcatttgggtggactatgtaggcttcctttcatttctagcattatttactggaaggaactgcctcttaatgtactgctttttccattt

SEQ ID NO: 2027 - DNA, 1426 bp, Panax ginseng
aagcagtggtatcaacgcagagtacgcggggctctacttataatccagctctctctctctctcatcttgtttcagaaaaccctccctccttccatcatcgttgtagtcagcaatggctgctctgcaatacctggattctctccgtaattcccatcccggagctctccgattggtacaataccctagcagatctgtaccagaggaagctatggcaccagctgactctcaagctcgaacagtttgttgccctcgccgtctttcaggcaggtgatgctttgatacagctatatcataatttcatcaccgatttgagactaaaatcaatcttctcaagcttgcacatttttgcggtcatagtctcttcggcaatatctgagaaaagaggctgccattagttatcttgaagggttgattgagaagcttcgggctactagagaaatgcgcatagaggagcctgtccttatatcaagatgcagattgctatgttcaaccttgagaaaggagaccaaaaggaatgcaagaaactactagaagatgggaaaactacacttgacagcatgactgacattgatccgtctgtctatgccagctattattggaattcatcccaataccacaaatctcgtcaggagtttgcagagttctacaaaagcgctcttctatatttagcatacacctcagtagagtccctgtcagaatcatttaagctggatttggcttttgatttatcactatctgcattgctgggagaaaacatttacaactttggcgaactgcttgcgcatccaattataaagagtcttctggggaccaaggttgagtggctctactacattcttgaagcattcaactctggtgatttggtccgctatcaagaattatgccatgttcatagtgcttctctgagcgcgcaaccagcattagtagaaaatgagagaaaacttctggaaaagatcaacattctctgcttaatggaaatcatcttcagtcgaccatcagaggatagaaccattcccttaagtatcattgccgagcgcacaaaacttactgtagaggatgtggagtatcttcttatgaagagcctatcagttcatctgattgaaggtataattgatcaagttgaagggacagttcatgtttcatgggtgcaaccaagagttttggggatttcccagatcaaatctttgcgtgatcgactggacaactggatggataaagtaaacaccgctttattatcagttgaggctgaaacacctgatttagttgcttcataatttcgttctgggctttctattttcttgtaacaatctcttaacttcctcaaaagagctggttaactgcactaaggagaggagatatatcaattaatcatttgggcggactttgtagaattccttcatcttggtcatatctagtgttattttcc

SEQ ID NO: 2028 - DNA, 1282 bp, Ambrosia trifida
cgttataaatccccaatcatccattgtccatcacattccaataataatattattattcatcaccgcaaaaccatcggtgatggcagctcttgagtaccttagactctctccgtactgctcatccagagctttccgattggtacaatacgcttgcagatctgtaccaaagaaagctatggcaccagctcacgttaaagctcgaacagttcgtcgcactcgctgtttttcaggccggcgatgctctcatacaactatataacaatttcatcactgactttgagactaagatcaatcttctcaagcttgcacactttgctgttatagtgtctcgccagtattcaaagaaagaagatgccatcaagtatcttgaaggagtgattgagaagcttagagctacaaaggagatgcgtatagaggaaccaatcctttatattaagatgcaaatagccgctttcaatcttgaaaaaggagatcaaaaggagtgcaagaatcttctagatgatgggaagagtacgcttgatagcatgaccgacattgacccatctgtgtatgctaactactattgggtgtcatctcagtaccataaagctcgccaagagtttgctgaattctacaagaattctctactttatttggcttacacctcggtggagtctctttcagattcatttaagctggatcttgcatttgatttatctttatctgctttactgggagataacatttacaacttcggagaactacttgcacatcccataattaaaagtctactagggacaaaggttgaatggctctactatattcttgaagcatttaacgctggagatcttgttcgctatcaagaattatgccgtgttcatgcagcttcactgaacgctcaacctgctttggtggagaatgagaagaagctcctagaaaagattaacattctctgcctgatggaaattatcttcagtcggccatcaggagatagaaccattccattgaacatcattgcagagcgaacaaaacttacagttgaagatgttgaatatcttctcatgaagagtttatcggtgcatcttatcgagggaataattgatcaagttgagggaacagtttacgtgtcatgggtgcaacctagagtcttgggaataagtcaaataaaatctttacgtgatcggctggacaactgggttgagaaggtgcacactgctttggtatctgttgaagccgaaacaccagatttagttgcatcttaagttttgatttcgaggtttattgtttctttgtttgtaacact

SEQ ID NO: 2029 - DNA, 1837 bp, Gossypium hirsutum
tgatccgatccacacaactaagcctaacccgtaaattataattttctcttttttgggttatgttttttttctatttcttcggtcgattgagctgacggcttttcttgttttcctcttcagaattcatatagagacagagaaccaaagttgaaaaaaagaacatacacatctaaatctttaaggcctcagcttctctttctctgtttcgactctgtggagtaaatttggaatcgatggcggccttgcagtacctagactctcttcgaaatgagcatccagagctaggcgactggtataattctcttgcagatctgtatcaaaagaagctctggcaccagctcactctcaagcttgagcagttcgttgctctcaccgttttccaggctggagatgcgttgataaagttgtatcataactttatcactgactttgagatgaagattaatcctctcaagcttgcacatttcgctgttatagtttctcagcagtactcagagaaagaggctgctattagtttccttgaaggggtgattgaaaagcttcaggctactaaagagcagcgcatagaagagccaattctttatattaagatgcagatttccaaattcaagcttgagcaaggtgatcaaaaggagtgcaagaaacttcttgaagatgggaagagtacccttgacagtatgaccgacatagatccatctgtatatgctacctattactgggtttcatctcaataccataaatttcgccaagaatttgctgagttctacagaagtgctctcctttatcttgcgtacacatcagtggagtctctctcagaatcttttaagctggatttggcatttgatctgtccctttctgctcttttgggagataacatctacaactttggagaactccttgctcatccaattataaagagtcttctggggaccaaggtggagtggctttattatatcctccaatcctttaactctgggaatttggttcgctatgaagaattgtgtcgcgtgcacaatgctgcactgagtgctcaaccagccttggttgagaatgagaagaagctcttgggaaaaaattaatattctgtgcttaatggagattatcttcagccgcccatctgatgatcgaactattcctttaaaagttattgctgagagaacaaaattgtcaattgaggatgttgagtatcttcttatgaagagcctgtctgttcgtctgattgagggtataatcgatcaagttgagggaacaattcatgtctcttgggtgcagccaagagttctggggattccacagatcaaatccttgcgtgaccggttggataattggatgggcaaagtacataacgcttggttatcaattgaggctgaaacacctgatctcgttgcatcatgactttttttctccagttcctttctgccattgtaacaatttcgttatttgaaaagggcaagaaaaagggaaagtgaaacgatgagcaatgaggatagagataagcgttagtcatttgcgggtagggccatctttgtatgattcctttagtaggtattgctcgatccttaaatctttgttctgaaaggagcggctcatgtattaaacttttcactttttggcatttgttggatctacaatggtactggagtgcctgaggatacggttaaaactgcaaacatcatccttatctttcattttgtattgggatttttcattagatacaatcagatatgatccatttttatgtggatgaaagtgcattttcatttcagattagatatttttctgcatgatgtatatattgtttggcttcaatgcgatactagatgagctgctacttctt

SEQ ID NO: 2030 - DNA, 1526 bp, Salvia sclarea
ctaatagaccctggctgtcactcaaaaatctccaccccctcgattttccattttccctttctctctctagagtttttgacaccggcgagcaccactgtttcgtgtagattgagcggcggcgcaaggaaatcgatggcggctctgcagtatttggaatccctgcgcaatgcgcacccggagctgtccgagtggtacaacacgctttcagatctgtaccagcggaagctctggcaccagctcacgctcaagctcgagcaattcgtcacgctcgccgtgtttcaggctggggattccctaatccaactgtaccaaaacttcataactgattttgagacaaagatcaatctactcaagcttgcccattttgctgtcatagtctctaggcagtatccagagaaagaggctgccatatcgtatcttgaaggagtgatcgagaagctccgtaatgccagtaaagtgcggatagaggagccaatactttatatcaatatgcagattgcttttgtttaagcttgagcagggagatcaaaaagaatgcaagaaacttttagaagagggaaagagtacacttgacagcatgactgacattgatccatctgtgtatgctagctactattggatttcatcacaatatcataaagcccgtcaagaatttgctgagttctacagaagtgctcttctttatttagcatacacttcagtagagactttgtcagactcatttaagctggatttggcatttgacctatctctatcagccttgttgggggataacatctacaactttggtgaacttcttgctcatccaattataaaaagccttatggggactaaagttgagtggctttactatattcttgaagcatttaactctggtgatttagtgcgttatcaagaactgtgtcgtgtacatggagctgctctgagtagccaaccagcattagtccagaatgagaaaaagcttctcgagaagatcaacattctttgcttgatggagatcatattcagccgaccatcagaagatagaactatcccgttgagtgctattgctgaacgaacaaaacttacagttgaagatgtggagtatcttcttatgaagagcctttcagtgcatctgatcgaaggaattatcgaccaagtagagggaacagtttatgtgtcgtgggtgcaacccagagtcttagggatccctcaaatcaggtcgttgcgtgaccggctggacaattgggtggacaaagtacacactgctttgttatccgttgaggctgagacacctgatctagttgcagcatgatcttcttaactcttattccttggatttcttctgacaatgcttttagtaggtcaaatctgttgcttccaccggaaacaaatcagttgttggccgctgtgtacggttgtcttgcaatgcctgtatttcttttcccttttaaggcagatctcttccttgatgcgactgaatatctgtttccatgccagaacaccatacttgtaatactcattttactttttgctaaatccttcta

SEQ ID NO: 2031 - DNA, 1541 bp, Trigonella foenum-graecum
ttgaatcgctaccatggctgcactgcaatacctagaatcgcttcgaagctctcaccctgaactcggtgaatggtacaattcccttgcggatctgtaccagaagaagctatggcatcaactcactctcaagctcgaacagttcctcgctcttaaagtctttcagaaattgcaggctggtgatgctctgatacagttatataacaacttcatcacagactttgagaccaaaatcaaccttctcaagcttgcacattttgctgtgatggtttctcgacagtattctgagaaagaagctgccattggttatcttgaaggggtcattgagaaactacaagccaccagagagcagcgcatagaagagcctatcctatacattaagatgcaaattgccttatttaagcttgagcaaggcgaccaaaaggaatgcaagaatcttctagagaatggaaagagtacacttgacagcatgacagatattgatccaactgtgtatgcaagctattactgggtatcgtctcaatatcacaaatcccgtcaggaatttgctgagttctacaaaagtgctcttctctatttggcatacacatcagtggagtctctctctgactcattcaagctggatttggcatttgacttgtccctttctgctctgctgggggataacatctacaactttggagagctacttgcccatcctattattaagagcctcctagggacaaaggtggaatggctctactatattctggaggcatttaattctggtgatttggttcgatatcaagaattatgtcaggtgcataatgactctttgttggctcaaccggcactagttcagaatgaacagaagctgttggaaaagatcaacattctctgtctgatggaaattatattcagtcggccttcggaagatcgaactattcccttgaaagtaattgcagagcgaacaaaactttctatagagaatgtggagcatctccttatgaagagcttatctgttcatctgattgagggcataattgatcaagtggatggcacagtacatgtttcctgggtgcaaccaagagttctgggtattgaacagataaaatccttacgggatcgattggacagttggactggaaaagtacacacggcgttgttgtccatcgaggcagaaactcctgatttaattggatcgtgaattttctgttcttgttttctgccaattgtaacaatttcatatgttaaaagggaacacatcttgaggcaacaaaagacgaagagacttccgagttgcatgggcttatagccaacttatgtgcttcatttcgttttgtctgctgcttttgaatgattgctggaaatagcaaccccttgtactccgcttagaaattattgtttctatatggttgcatgcttagagacatgttgcatcagttccaaacagcctgtttttatgcattagagtgatgacacaactatgtacctggaatttttcttagatacggccatttttattccctttagaagttcttttaatttaattaagctaagcgact

SEQ ID NO: 2032 - DNA, 1619 bp, Panax ginseng
aagcagtggtatcaacgcagagtacgcggggggagagagagggttctataagatgatttttaaatatacaagtctctctctctacttataatccagctctcaaaactttctctctcatctgtttcagaaaaccctctctccttccatcatcgttgtagtcagcaatggctgctatgcaatacctggattctctccgtaattcccatccggagctctccgattggtacaataacctagcagatctgtaccagaggaagctatggcaccagctgactctcaagctcgaacagtttgttgccctcgcagtctttcaggcaggtgatgctttgatacagctatatcataatttcatcaccgactttgagactaaaatcaatcttctcaagcttgcacattttgcggtcatagtctctcggcaatattctgagaaagaggctgccattagttatcttgaaggggtgattgagaagcttcgggctactagagaaatgcgcatagaggagcctgtcctttatatcaagatgcagattgctatgttcaaccttgagaaaggagaccaaaaggaatgcaagaaactactagaagatgggaaaagtacactcgacagcatgactgacattgatctgtctgtacatgccagttattattggatttcatctcaataccacaaatctcgtcaggaatttgcagagttctacaaaagtgctcttctatatttggcatacacctcagtagagtctctatcagaatcatttaagctggatttggcttttgatttatccctatctgcattgctgggcgaaaacatttacaactttggcgaactgcttgcacacccaattataaagagtcttctgggcaccaaggtggagtggctctactacattcttgaagcattcaactctggtgatttagtccgctatcaagaattatgccgtgttcatagtactgccctgagcgcacaaccagcattatttcagaatgagagaaatcttcttgaaaagatcaacattctctgcttaatggaaatcatcttcagtcgaccatcagaagatagaaccattcccttaagtattattgcggagcgcacaaaacttacagtagaggatgtggagtatcttctaatgaaaagcctatcggttcatcttattgagggaataattgatcaagttgaagggaccattcatgtttcctgggtgcaaccaagagttttggggatttctcaaatcaaatctttgcgtgatcggctggataactggatggagaaagtacacactgctttattatcagtagaggctgaaacacctgatttagttgcatcttaattttgtttctggacttcctttctgttttcttgttgcaatctctcaatgcccctaaaagagctggctaacctcaccaaaggagaggagatgtaggatttaatcatttgggtggactatgtaggcttcctttcatttctagcattatttactggaaggaactgcctcttaatgtactgctttttccatttctgatttatgctgtcagcttgcttaagatatataggggagtcgatcttaaacctactttttatgctaagatgtcgatcaatcaaatcgtgcaatgaatttttgttt

SEQ ID NO: 2033 - DNA, 1414 bp, Chenopodium quinoa
gggggccctatccccctcgtcgtgcccttgcctccccacgacccctccccacgtgctcgagagaaactagagagagaaacctcaactatgtcggcgcttcagtacttggatactctcagaagcgcgcatcctgagctcgctgaatggtacaatactctcgcagatctgtaccagaagaagttatggcatcagcttactctcgagcttgagaagttcgtcgcactcgcggttttccaggccggtgatgccctgatacagttatatcacaatttcatcacagactttgagacaaagataaatctccttaagcttgctcattttgctgtcatagtatctcgacagtatgcggagaaagaagcagctattggttatcttgaaggagtgattgaaaagcttcaggctacacgagaatcacgtatagaggagcctgtcctctatataaagatgcagatggctttgtttaagcttgagcaaggggaacaaaaagaatgcaagaagatattggaagatggaaaaaccacacttgacagtatgaccgatattgatccatcagtttatgctagtttttattgggtctcatctcagtaccataaagcacgccaggagtttgctgagttctacaagaatgctctcctttatcttgcttacacatcagtggagtctctatctgaatcattcaagctggacttggcttttgatctttcattgtctgctctgttgggagagaatatctacaactttggggagcttcttgcccatccaattttaaagtctcttcttgggacaaaggtcgagtggctctactatattctgcaagcatttaacactggcgacctgattcggtatcaagaattatgcaatgtgcacaaagatgctttgaatgcacaaccagctttggttgctaatgaaaggaaacttttggagaagattaatattctctgcttgatggaaatcatcttcaaccgaccagcagaagataggacaattcccttgaaggtcattgcagagcgcactaggttgtctattgaagatgttgagtatctgctcatgaagagcctctctgttcatcttattgagggaatcattgatcaagttgaggggacagttcatgtatcctgggtgcatccgagagttttagggattccacaaatcacatccttgcgtgaccggctggatagttggttgggcaaagtacacactgccttattatccgttgaggctgaaacaccagatctagttgcttcgtaatttttaggttctcatatttgtctcctgtaacggatacttagtgctcgaacagaagggaaaggatgcctattattagagtgacagagattatctgggcttcaacttttgtatgcatcttttcaagtgttttgttcgtcggtcttgattcatttttcctggagcaaat

SEQ ID NO: 2034 - DNA, 1474 bp, Ambrosia trifida
ttggatggtttcttcgagaaaaagaaaacaatcagaggcgaaattaatcaaacaagggtttatagtttattatttacacaacaaatccctcaatcgagcaacggtttctgtaatcagtgaacgatgtcagctctagagtacctagattctcttcgtaatagtcacccagagctctccgattggtacaatacgcttgcagatctctaccaacgaaagttatggcatcaactcactctaaaactcgaacaattcgtcgccctcactgtttttctaggcgggtgatgctctcatccaactatatcagaatttcatcactgactttgagactaagataaatcttctcaagcttgcacattttgctgttatagtctctcgccagtattcagagaaagaaaaagccgtagattatcttgaaggagtgattgaaaaactccgagctacaaaagagtcacgcatagaggaaccaatcgtttatattaagatgcaaatagccatttttaatcttgaaaaaggagatcaaaaggagtgcaagaatcttctagaagatggaaagagtacacttgatagcatgactgacatcgatccgtctgtgtatgctaattattattgggtgacatcccagtaccataaatctcgtcaggagtttgctgaattctacaagagctctctactttatttggcctacacctcggttgaatctctctcagattcatttaagttggatcttgcatttgatttatctctatctgctttactgggagataacatttacaactttggagaactacttgcacatcccataattaaaagtctactaggggacaaaggttgagtggctctactatattcttgaagcatttaacgctggagatcttgttcgctatcaagaattatgccgtgttcatgcagcttcactgaacgctcaacctgctttggtggagaatgagaagaagcttctagaaaagatttaacattctctgcctgatggaaattatcttcagtcggccatcaggagatagaaccattccattgaacatcattgcagagcgaacaaaacttacagttgaagatgttgaatatcttctcatgaagagtttatcggtgcatcttatcgaggggataattgatcaagttgagggaacagtttacgtgtcatgggtgcaacctagagtcttgggaataagtcaaataaaatctttacgcgatcggttggacaactgggttgagaaggtgcacactgctttggtatctgttgaagcggaaacaccagatttagttgcatcttaagttttgatttcgaggatattgtttcttgttttgtaacactctcatgaggatagtttgtactgtgtcgttgacgatggagtaatttgtgttgtgggtttaaactctgtaagatacctatttgttttagtcttttcaaagtactatttttattctgactgacaaaaaaagaaaaagtaaccgactagcg

SEQ ID NO: 2035 - DNA, 1487 bp, Vaccinium corymbosum
gtcaagaagccatggcagctattcagtacctcgattctctgcgcaacacccatccagagctagccgaatggtacaacaccctctcagatctgtaccacaagaagctctggcatcagctaactctcaagctcgaacagttcgtcgctctcgccgtgtttcaggctggtgatgctctcatacagttgtatcataacttcatcactgatttcgagaccaagatcaatcttctcaagcttgcgcattttgctgttatagtttctcggcagtattcagagaaagaagctgccattagttacctggaagatgttattgaaaagcttcgtgctactagagagatgcgcattgaggaaccaattctttatataaagatgcaaattgctgtcttcaatattgagaaaggcagccaaaaagagtgcaagaaacttcttgaagacgggaagagtacacttgacactatgactgacattgatccatctgtgtatgccagctattattgggtttcatctcagtaccataaatctcgacaggagtttgctgagttttacaaaagtgctcttctttatctagcatatacctcagtggagtctctatcggactcatttaagctggacttggcctttgatttatctctagctgcattgctcggagagaacatatataattttggggaactgctcgcacatccaatcattaagagtcttctgggcacgaaggttgaatggctcttctatattcttgaagcattcaattctggtgacttagttcgctaccaagaattatgccaggtgcatagagctgcgttgagtgctcaaccagccctagtggagaatgagaaaaagctactagaaaagatcaacattctctgtttgatggaaatcatcttcagccggccatcagaagatagaactattccactacatatcattgccgaatgcacgaaacttaatgtggaggatgtggagtatcttctcatgaaaagcctttcagttcatctaattgaggggataattgaccaagttgagggaaatgttcacatctcttgggtgcaaccaagagtgttaggttttccgcagatcaaatctttgcgtgatcgactggacaattgggtggacaaagtacacacggctttgttgtcggtagaggcagaaacacctgatctagttgcatcttaagctttatttctctgacctcctttcagcattctgtaacagtctcttaaaaagaatccgtaactgcagcaaagaaaaagattgttagttgctcgtgtcatctttgtatgcttcaatttcatattgattcatcagatcttgcaatatttgttttgaaaggagcagcttctcatgctttcgtttccagatttattgcatgcgtagagacacagcaagtcgatgggaaaattggctattttacttccttcatggtttattgaacaatttaactgaaatattcttgagtcacttcaaaatttggtcaatggagttcatcct

SEQ ID NO: 2036 - DNA, 1682 bp, Gossypium hirsutum
tttcctagtcctctgtgtcagtgtctttgctcgaagacagggaaaatcaaagcttttggtatttataatagagagaaaactaagtagacaagaaaggaaattttctctcattcgacattgttgagggaaattgaggtgaatggcggccttgcaatacctagactctcttcgaaatgaacatccagagctatccgattggtatagttctcttgcagatctgtatcagaagaagctttggcatcaacttaccctcaagcttgatcaattcgttgctcttaccttcttccaggctggagatgcactgatcaagttgtatcataattttatcactgactttgagaccaagattaatcttctcaagctcgcacattttgctgttatagtttctcggcaatactcagagaaagaaggtgctattagttatctcgaaggggttattgaaaagcttcgagctactaaagagaagcgcatagaagaacctattctttatatcgagatgcaagtcgccaaattcaagcttgagctgggcgaccaaaaggagtgcaagaaacttcttgaagatggaaagagtacccttgacagtatggatggcgtagatccatctgtgtatgctagctattattgggtttcatctcaataccataaatttcgtcaagaatttgctgagttctataaaagtgctctcctttatcttgggtacacatcggtggattctctctcagaatcttttaagttggatttggcatttgatctatccctttctgctcttttgggagataatatctacaactttggggaactgcttgctcatcctattgtaaagaatcttttggggaccagtgtagagtggctttactatatcctcctagccttcaactcaggggatttagttcactatcaagaattgtgtcgcatacacaatgctgcattgaggacacaaccagccttggttgagaatgagaagaggctcttggaaaaaattaatgttctttgcttaatggagattatcttcagccgcccggctgaagatcgaaccattcctttaaaagttatagctgagcgaacaaaactgtcgattgaggatgttgagcatcttctcatgaagagcctgtctgtgcatctgatagagggcataatagatcaagttaaaggaactgcctacatctcctgggtgcagccgagagttctgggaatcccacagatcaaatccttgcgggatcggttggataattgggtgggcaaagtacacactgcttgcttatcaatcgaggctgaaacacccgaccttgtcgcaccatgatcttttttccctttctgtccagtatacgaaaaggaaacaaaaggaaaaggcaatggcaagcaatgaggatattgcttgatccttaaatcgttcttttgaaaggagaacggctcagaccttttggcatttgttggatctcaatggcaatggcaatggtaatatgcctaaggatacagtgttaaaaattgaaaagagcgtcttttctctttaactttgtattaggaattttcattagaaacaataagatgatccactttcatatgggatgatgaaaatgcattttcatttgttttcttcctgtgtattatactagaaattgagtgggaggaattggagcatataaaaaattgaaaattatgattcgtaacattataaaaaagaa

SEQ ID NO: 2037 - DNA, 1393 bp, Eschscholzia californica
gaaactcattctctctctcatcggaaatctccaatcaaacatcaatggcagctcttcagtatctagagtctcaacgtaacgcgcagccggaacttgccgattggtacaacactttggcagatttgtatgagaagaaactatggcatcagcttactcttaagcttgatcagttcgtcgctcttgccgtctttcaggcgggtgatacattgattcaattgtatcacaattttatcacagaatttgagacgaaaattaatctcctcaagcttgcccattttgctgttatagtatctcgacagtatccagaaaaagaagctgccattgcttatcttgaaggggttattgagaagcttcgagcaactagggagttgcggatagaagaacctgtcctttatgcgaagatgcagatagctgccttcagactcgagcagggagaacaaaaagagtgcaagaaacttttagatgatgggaagactacactcgacagcatgactgatatagatccatcagtttatgcgagctaccactgggtttcatcccagtaccacaaatctcgtcaggaattcgcagaattctataaaagtgcacttctgtatttggcatacacctctgtggaatctctctctgaaacattcaagctggatttggcatttgatttatcactttctgcattgcttggagataacatctacaattttggggagctgcttgcacatccaataataaagagtcttttggggactaaagtggagtggttatactatatccttcaggccttcaactccggcgatctagttcgttatcaagaactctgtgttgtccacggagcttctttaagtgcgcaacctgcgcttgtccagaatgagaagaagctactggaaaagattaacatactctgtctaatggaaataattttcagccgcccctcggaggatcgaactatcccgttaagtatcattgctgaacgcactaaactttctgtagaagacgtggagcacctactcatgaagagtctttctgtgcatcttatcgaaggtataatcgatcaagttgaggcaaccgttcatgtatcgtgggtgcaaccaagagttttgggtattcctcaaatcaaatcattgagagatcgattggacaattggttaggcaaagtacacactgctttattatctgtggaggcagaaacacctgatcttgtggcttcgtaattctatcttccattttcgttactctctttcttctccatgacctcctctgtaacaatttaagatacctgaaaagttgaaggaacaaaatcttccccaatgatgaagtggtaatatgactctatcctcatttctgcacactttcatacttatcggggcaattttatccgtactaggagaggcaggctttg

SEQ ID NO: 2038 - DNA, 1464 bp, Fagopyrum esculentum
gaagccaagtatatttcctagtagagactctaaacccgatttcttcttctctctgcgattgaatcgagagagaaaactcgatttcgaaatccaattcggaaacaccatgtctgctcttcaatacttggaatcccagcgaaacgcgcacccggaactctcagaatggtacagtacactcgcagatctgtaccagaagaagctttggcaccagctcacccagaagcttgagcagttcgtcgctctcgccgttttccaggctggagatgctctgatacaattttatcacaatttcataaccgactttgagacaaagatcaaccttctgaagcttgcacattttgctgtcattgtttctcgacaatatgcagagaaaaatgctgctattagctatcttgaaggggttattgaaaagcttcgtgaaacacgagaaatacgtatagaggagcctatcctttacataaagatgcagattgcttcatttaagcttgaacacggggaaccaaaagaatgcaagaagcttctggatgatgggaaaacgacccttgatagcatgactgatattgatccatctgtgtatgcaagctattattgggtctcctctcagtattacaagtcacaccaagagtttgctgatttctataaaaatgctcttctttatcttgcctacacctcagtggattctctgtctgactcattcaagctggatttggcgtttgatctgtcattgtctgctctgctgggagaaaatatttacaattttggggagcttcttgcacatccaattgttaagagtcttcttggcaccaaggtggaatggctgtactatattctgcaagcattcaactctggggacttagttcggtatcaggaactttgtcgtgtccatggagaggctttaaatgctcaaccagcattggtagccaacgaaaagaagcttctggagaagataaacatcctttgcttgatggaaatcatattcagccgcccctcagaggatcggacaattcccttgagtgtcatcgctgagcgtaccaaactttcggtggaggatgttgagtatcttctcatgaagagcctttctgttcatctcatagagggaatcatcgatcaagttgaaggaacagttcatgtgtcttgggtgcagccgagagtcttggggattccgcagattaaatcactacgtgatcggctggataactggatgggcagagtgcataccgcattgttgtccgttgaggctgaaactccggatctagttgcttcataagcttcttctttttttctttttcgtggggttgaattccttcgtttcttgtaacggttgtagcaattacttaaccaacggggtttgtgaaatcgtaacgaaactcatgttatgtttatggatgttttatttgagatttgatcaaatctcaatcgtctgctttttcctagttgaatgttaattggatttcagaaaatact

SEQ ID NO: 2039 - DNA, 1252 bp, Flaveria ramosissima
tcttcgtaacactcaccctgagctctccgattggtacaatacgcttgcagatctgtaccaaaggaagctatggcaccaactcactctcaagctcgaacaattcgtcgcactcgctgtttttcaggcgggtgatgctctcatacagctatatcataatttcatcactgactttgagactaagattaatcttctcaagcttgcacattttgctgtcatagtctctcgccagtatgcagagaaagaagctgctatcagctatcttgaaggagtaattgaaaaactccgagctacaaaagagatgcgtatagaagaaccaaacgtttatatcaagatgcaaatagccatttttaatcttgagaaaggagatcaaaaggagtgcaagaatattctagacgatggaaagagtacccttgatagcatgacagacattgatccatctgtgtatgctaattattattgggtaacatcccagtaccataaagctcgccaggagtttgctgaattctacaagaattctctactttatttggcgtacacttcggttgagtctctctcagattcatttaaattggatcttgcatttgatctatctctatctgctttactgggagacaacatttacaactttggagaactacttgcacatccaataataaaaagtctgctagggacacaggttgaatggttgtactatattctagaagcattcaacaacggggatctagttcgctatcaagaactatgtcgggttcatgcagcttctcttaacgctcagccggctttagtggagaacgagaagaagcttctagaaaagattaacatcctctgtttgatggaaattatcttcagtcgaccatcggaagacagaaccattccgttgagcatcattgcagaacggacaaaacttacagttgaagatgttgaatatcttctcatgaagagtttatctgtgcatcttattgagggaataattgatcaagttgaaggaaccgtttatgtgtcatgggtgcaacctagagttttgggaataagtcaaataaagtctctacgtgatcgcttggacaactgggtcgggaaagtgcacactgctttggtgtctgttgaagcagaaacaccggatttagttgcatcttaagtcgacaatctcgtttcttgttttgtaacacactcttggatggcttgttgtccaagttatccaggtgaacttgatgtaagatacctattcgttttcgtactttttaagactgttgag

SEQ ID NO: 2040 - DNA, 1697 bp, Medicago truncatula
aagaatagaatttcgcatttgtttctttctttctttgttttcagagttttcttcttcttcttctctcgcttgaatcgctgccatggctgcactgcaataccttgaatcgcttcgaagttctcaccctgaactcggtgaatggtacaattctcttgcggatctgtaccagaagaagttatggcatcagctcactctcaagctggaacagtttctcgctcttaccgtctttcaggctggtgatgctataatacagttatataacaatttcatcacagactttgagaccaaaatcaaccttctcaagcttgcacattttgctgtgatggtttctcgacggtatgctgagaaagaagctgccattggttatcttgaaggggtcattgagaaactgcaagccactagagagcagcgcatagaagagcctatcctatacattaagatgcaaattgccttattcaagcttgagcaaggtgaccaaaaggaatgcaagaatcttctggaaaatgggaagagtacactcgacagtatgacagatattgatccaactgtctatgcgagctactactgggtatcctctcaatatcacaaatcccgtcaggaatttgctgagttctacaaaagtgctcttctctatttggcatacacatcagtggagtctctctctgactcattcaagctggatttggcatttgacttgtccctttctgctctgctgggggataacatctacaactttggagagctacttgcccatcctattatcaagagccttcttgggtcaaaggtggaatggctctactatattctgcaggcatttaattctggtgatttagttcgttatcaagaattatgtcaggtgcataatgctgctttgagtgctcaaccagcactagttcaaaacgaacagaagctgttggaaaagatcaacattctgtgtctgatggaaattatattcagccggccttcggaagatagaacgattcccttgagtgttattgcagagcgaacaaaactttctatagagaatgtggagcatctccttatgaagagcctatctgttcatctgattgagggtataattgatcaagtggagggcacagtacatgtttcctgggtgcaaccaagagttctgggtattgaacagataaaatccttacgggatcgtttggacggttggaccggaaaagtacacaccgcgttgttatccatcgaggcagaaacacctgatttaattggatcgtgaattttctgttctcgtttcttgccaattgtaacaatttgttatgttataacgaacacattctgaggcaacaaaagacgaagagacttccgagttacatgggcatatatagccaacttatgcgcttcatttcgttttgtcagctgcttttgaatgattgctggaaatagcaacctcttgtacttcgcttcgaaattattggttctatatggttgcatgcctagagacatgttgcatcagtttgaaacaggctgtttttatgcattagagtgatgacaaaactatgtacctggaatttttcttagatacgaccatttttattccctttaggagttcttctaatttaattattaagctaagcgactattttcttttgcaaaatcttttgtgcgtcatttggttgctgctattaatattactgtgttataaaaattctgttctcataactgataaaatt

SEQ ID NO: 2041 - DNA, 1584 bp, Medicago truncatula
gtttctttctttctttgttttcagagttttcttcttcttcttctctcgcttgaatcgctgccatggctgcactgcaataccttgaatcgcttcgaagttctcaccctgaactcggtgaatggtacaattctcttgcggatctgtaccagaagaagttatggcatcagctcactctcaagctggaacagtttctcgctcttaccgtctttcaggctggtgatgctataatacagttatataacaatttcatcacagactttgagaccaaaatcaaccttctcaagcttgcacattttgctgtgatggtttctcgacggtatgctgagaaagaagctgccattggttatcttgaaggggtcattgagaaactgcaagccactagagagcagcgcatagaagagcctatcctatacattaagatgcaaattgccttattcaagcttgagcaaggtgaccaaaaggaatgcaagaatcttctggaaaatgggaagagtacactcgacagtatgacagatattgatccaactgtctatgcgagctactactgggtatcctctcaatatcacaaatcccgtcaggaatttgctgagttctacaaaagtgctcttctctatttggcatacacatcagtggagtctctctctgactcattcaagctggatttggcatttgacttgtccctttctgctctgctgggggataacatctacaactttggagagctacttgcccatcctattatcaagagccttcttgggtcaaaggtggaatggctctactatattctgcaggcatttaattctggtgatttagttcgttatcaagaattatgtcaggtgcataatgctgctttgagtgctcaaccagcactagttcaaaacgaacagaagctgttggaaaagatcaacattctgtgtctgatggaaattatattcagccggccttcggaagatagaacgattcccttgagtgttattgcagagcgaacaaaactttctatagagaatgtggagcatctccttatgaagagcctatctgttcatctgattgagggtataattgatcaagtggagggcacagtacatgtttcctgggtgcaaccaagagttctgggtattgaacagataaaatccttacgggatcgtttggacggttggaccggaaaagtacacaccgcgttgttatccatcgaggcagaaacacctgatttaattggatcgtgaattttctgttctcgtttcttgccaattgtaacaatttgttatgttataacgaacacattctgaggcaacaaaagacgaagagacttccgagttacatgggcatatatagccaacttatgcgcttcatttcgttttgtcagctgcttttgaatgattgctggaaatagcaacctcttgtacttcgcttcgaaattattggttctatatggttgcatgcctagagacatgttgcatcagtttgaaacaggctgtttttatgcattagagtgatgacaaaactatgtacctggaatttttcttagatacgaccatttttattccctttaggagttcttctaatttaattattaagctaagcgac

SEQ ID NO: 2042 - DNA, 1547 bp, Orobanche aegyptiaca
tataaatcctctccagtttcactttctctctctagtatttcgtactgttgagcaccaccgtttcggtcatagattgaacggcggaaggaaaactcgatggcggccctacagtatttggataccctgcggaatgcgcacccggagctctccgagtggtacaacacgctttcagatctgtaccagagaaagctatggcaccagctcacgctcaagctagaacagttcgtcgctctcgccgtgtttcaggctggggatgctctaatccagctgtacaacaatttcataagtgagtttgagacaaagatcaatcttctcaagcttgctcattttgctgtcatagtttctcgccagtattcggagaaggaagctgcgataaattacctcgaaggagtgatcgaaaagcttcttaataccagagaaccacgtatagaggagccgattctttatatcaaaatgcagattagtctgtgtaagcttgagcagggagatcagaaagaatgcaagaaacttttagaagagggaaagatcacacttgacagcatgacagacattgatccatctgtgtatgccagctactattgggtttcatctcaatatcataaatctcatcaagaatttgcagatttctacagaagtgctctcctgtatctagcttacacttcagtagagtctctttcagaatcttttaagctggatttggcatttgacttgtctctttcagccttgttgggggagaacatctacaacttcggtgaacttcttgctcatccaattgtaaaaagccttatggggactagagctgagtggctttactatcttcttgaagctttcaattctggtgatttagtgcgttatcaagaactatgtcgtgtacatggagctgctctgagtacccaaccagcattagtccagaatgagaaaaaacttttggaaaagatcaacatactctgcttgacggagattatattcagccgaccatcagaagacagaaccatcccattaagtatcattgctgaacgaacaaagcttacagtagaagatgtggagtatctacttatgaagagcctttcagtgcatctgatagagggaatcattgaccaagttgaagggaccgtctacgtgtcgtgggtgcaacctagagttttgggaattcctcagatcaagtccttgcgtgaccggctcgacaattgggtggacaaagtgcatagtgctttgttgtccgtcgaggctgaaacacctgatctagttgcggcgtaatttttagctcatgtccctttgatttctgacgatgtgaagagccgaaaattatcaatctagcaaaagagaaacctgattacgagttttcttgggccacgcgtatggttctcttgcaatgcttgttttgttctttttacttttgaatgacttcctcaccttatgagttaagcggcaagattggatgtttggatatttcgttatatgcgatcgtctcctatctgttttggtgctagcatatgattcttgtaatagtaatactcattatttgctttgggggtttatttgaccgg

SEQ ID NO: 2043 - DNA, 1574 bp, Solanum phureja
tttctttcttcatcatcttcatcgagagagaggatttttcgaacactgaatcagctatggcggctctacagtacttggaatcgttacgcaatgatcatccagagctttctgattggtacaccacgcttgcagatctgtaccaacgcaagctctggcatcagctctctctcaagctcgaacagttcgttgctctcgctgtttttcaggctggtgacacgttgatacagctatatcacaatttcatcactgattttgagacaaagatcaatcttctgaagcttgcacatttcgctgtaatcgtctctcggcaatattcggagaaagatgctgcaataggttatctggaaggagtggcagagaaactccaaaatactaaagagacacggatagaggagccaatactttatattaagttgcagattgccctatttaagcttgaacaaggggatcaaaaagagtgcaagaagcttttagaacaggggaatgctacacttgacagcatgaccgatgttgacccctctgtgtatgccagttactattgggtttcatctcagtatcataaaacacggcaggagtttgcagagttttacaaaagtgccctcctctatcttgcatacatttcagtggattctctttcggagtcattcaagctggatttggcatttgatttgtccttgtcagcattactgggagacaacgtatacaattttggggagctgcttgctcatcctataataaagagtttggtagggacacaagtcgaatggctatatcatatccttgaagcattcaacactggtgatttagttcgttatcaggaattgtgccgtgtccatcaagctgctttaagtgctcaaccagcattgttgcagaacgagaaaaagcttcttgagaagatcaacattctatgcttgatggaaatcatcttcagtcgcccagcagaggatagaactattccattgagtgccattgcagagcgcactaaacttagcgtggaagatgtagagcatctcttaatgaagagtctctctgtacatctgatagagggaataatcgatcaagtggaagggactgttcacgtgtcctgggttcaaccaagagttttgggtattcctcagatcaagtcattgcgggatcggctagataattgggtggataaagtacacactgcattgttatccgtggaagctgaaactcctgatttggtttcatcgtaatctttagtttcccagtttgcacttcctggtccctgcaacactccgatttcttcgtcctctcttttttgctgtccttattagagcttgtaacacaacagaggaagtagggagacatttgtttagtttctcatgcctacactctatgctgtggcttttatcccaaatcattgatctgtcactgttttctggatttaggtgcttgttctcgaatgtcatcactttctacaatagcgatgacatcgccttagacgtttttatgcagagtacacttgattgggaatatggaagtaacatatattatttgacactctaaattacgtcattgctgcataaattgagatagaggaagtaacaaat

SEQ ID NO: 2044 - DNA, 1488 bp, Ambrosia trifida
cgttggatggtttctttgagaaaaagaaaacaatcagagacgaaatcaatcaatcaaacaagggtttatagtttattatttacacaacaaatcgagcaacggtttctgtaatcagtgaacgatgtcagctctagagtacctggattctcttcgtaatactcacccagagctctctgattggtacaatacgcttgcagatctctaccaacggaagttatggcatcaactcactctaaaactcgaacaattcgtcgccctcactgtttttcaggcgggtgatgctctcatccaactatatcagaatttcatcactgactttgagactaagataaatcttctcaagcttgcacattttgctgttatagtctctcggcagtattcagagaaagaaaaagccatagagtatcttgaaggagtgattgaaaaactcagagctacaaaagagtcacgcatagaggaaccaatcgtttatattaagatgcaaatagccattttaatcttgaaaaaggagatcaaaaggagtgcaagaatcttctagaagatggaaagagtacgcttgatagcatgacagacatcgatccctctgtgtatgctaattattattgggtgacatcccagtaccataaatctcgtcaggagtttgctgaattctacaagagctctctactttatttggcttacacgtcggttgaatctctctcagattcatttaagctggatcttgcatttgatctatctctatctgctttattgggagataacatttacaactttggcgaactacttgcacatccaataattaaaagtctgctagggacacaagttgaatggctttactatattctagaagcattcaacaacggagatctagttcgctatcaagaactttgccgtgttcatgcagcttctcttaacgctcagccagctttggtggagaatgagaagaagcttctagaaaagattaacattctctgtctgatggaaattatcttcagtcgaccatctgacgagagaaccattccattgagcatcatagcagatcggacaaaacttacagttgaagatgttgaatatcttctcatgaagagtttatccgtgcatcttatcgaggggattattgatcaagttgaaggaacagttcatgtgtcatgggtgcaaccgagggttttgggaataagtcaaataaagtctttgcgtgatcggttggacaactgggtcgggaaagtacacactgctttggtatcggttgaagccgaaacacctgatttagttgcatcttaagtttcttgtttttattattttcttggatagcttgtcgcccaaagttacctgggtgaactctatgtatgatacctatttgttttcttctttcaaaggctgtgccatttgtaccttgcctttttgatctgtggttggatagaaacttgttgaatacaacattctgttggtaagattgcaatgacaagcaacctctttattaaaaaagaa

SEQ ID NO: 2045 - DNA, 1454 bp, Tropaeolum majus
aagcccacggaaatagaaagagtggttcttcagattccattttttcccaacaaaaaccaaagcaaagaccgcaacaactcctacttcgtacttcctctcgtcccttttctccaattatggcggccctgcaatacttggagactatgcggaacgctcaccccgagctcgcggagtggtacaattcgtttgcagatctgtacgagaagaagctatggcatcagcttactctcaaactggagcaattcgttgctctcgccgtctttcaggctggtgatgccttgatacagctgtatcataatttcattgcagactttgagactaagatcaatctcctgaagctcgcacattttgctgttatagtttctaggcagtactccgagaaagaagctgctgtgagctatcttgaaggggtgattgagaagcttcgggatactaaaaggcataagatagaggagccaattgtttatattaagatgcaaataactttaatcaagcttgagcaaggggaccaaaaggagtgcaagaaccttttggaatctggaaggagcactcttgatggtattaccgacattgatccatccgtgtatgccagcttttattgggtgtcctctcaatatcataaatttcgtcaagaatttgcggagttctataaaaatgctcttctttatcttgcctacgtctctgtggagtccctatcagaatcctttaaactggatttggcattcgatctttcactttctgcgcttatgggagataacatctacaacttcggtgaactgcttgcccatcccattataaagtctcttttggggtcaaaagttgaatggctttactatctccttgaggcattcaataccggcgatttagttcggtatcaagaattatgtcgtgtgcacaatactgcccttggggctcaaccagcgttagttgaaaatgagaaaaaacttttggaaaagatcaatattctctgcctcatggaaatcatctttagccggccatctgaagatagaactatccccttaaatataatcgctgagcggacaaaactttcgattgaggatgttgagcaccttctcatgaagagtctttcagttcatcttattgagggcattatcgatcaagttgatggaacagtacatgtctcctgggtgcaaccaagagttctaggaattccacagatcaagtcattgcgtgatcgactcgataattggttgggcaaagtacacggtgctttgttatcaatcgaagctgaaacaccagaccttgttgcatcataattttgtcccctttttttttggttcttgtttcttatggtagcccgatgatgtaacaactgtttttagaagaaaaaacagagaggggagagagatacgtgtaaggcccaaccaaacatttatattttgtttggggatcatgtttctatagcagctctactattatttaactttcttttt

SEQ ID NO: 2046 - DNA, 1628 bp, Tropaeolum majus
atttaaaacaaaatcgaaactccataacgcaaactcttcctctcctactcctccagtcatggccgctctgcaatacttggagaatatgcgcaacgcgcagcctgagctcgccgagtggtacaattctcttgcagatctatacgagaaaaagctatggcaccagctaactctcaagctggagcaattcgtagccctaaccgtatttcaggctggtgatgccctgatacagctgtatcataatttcatcacagactttgagacaaagatcaatcttttgaagcttgcacattttgctgtcatagtttctcgacagtattctgaaaaagatgctgcagttagttatcttgaaggggtgattgaaaagcttcgagatgctagagagcaacacacagaacagccaattgtttatattaagatgcaaatagctttattcaagcttgagcaaggtgatcagaaggagtgcaagaaacttttggaatctggaaagagcactcttgatagtaggaccgacattgatccatccgtgtatgcgagcttctattggatctcttctcaatactataaatttcgtcaagaatttgctgagttttataaaaatgctcttctttatcttgcatacacatcagtggagtctctctcagaatcatttaggctggatttggcttttgatctttcactatctgcgctcttgggagataacatctacaactttggtgaactgcttgctcatcctgttataaagagcctcatagggaccaaggtcgaatggctgtactatatcctccaggcattcaatgctggtgatttagttcgctatcaagaattatgccaggtgcataatgctgctctcagtgctcaaccggctttagtcgcaaatgagaagaaacttctggaaaagattaacattctctgcctaatggaaattatctttagccgaccatctgaagatagaactattccgctaaatatcatcgctgaacgtacaaaactttcaatcgaggatgttgaacgccttctcatgaagagtctttctgttcatctcattgagggtattatcgatcaagttgagggaacagtacatgtatcctgggtgcaaccaagagttttaggaattccacaggtcaaatccttacgtgataggctggacaattggttggacaaggtacacactgctttgatttccatcgaagccgaaacaccagatcttgtagcttcgtgattttccttttggcccgttgtaacaatttctttagagaaaaaagtttcaaaaaaagaaaggcattggttgcaaagaggagaaagagacttagtttaaaagcctgtgtgatctgaccagttgggccaactttgtattctgttacttttttcaatattttgcatttattgtttttttggatcatatttttttatccaccactgtagtcttgtcgaatctactgtttagtcttatggtgtcttggtgcaagtatatgataatggtaactgtattcgagagttttgcatctgagatgaatactgtgttggttattatatttgtttcatcttcatggagtatttggttgaatactactgtggtattagtgtaacttagttttaaatggttaaacagaatatatgtttgagagact

SEQ ID NO: 2047 - DNA, 1587 bp, Triphysaria pusilla
tataaatcttcagcgtctctccaatttctacttcctctttctagaatttcttactgtcgaacaccactgttccgagaggcggaaggaaaaactaatggcggccctgcagtatttggagaccctgcagaattcgcatccggagctgtccgagtggtacagctcgctttcagatctgtaccaaagaaagctatggcaccagctgacgctgaagcttgaacagttcgtcgccctcgccgtttttcaggctggggatgctctaatccagctgtacaacaatttcataagtgattttgagacgaagatcaatcttctcaagcttgctcaattttctgtcatagtttctcggcagtattcggagaaagcggctgcgataagctatcttgaaggagtgattgaaaagcttcgtgataccagagaatcacgcatagaggagccgatactttatatcaaaatgcagattgctacttgtaagcttgagcagggagataaaaaagaatgcaagaaccttctagaagagggaaagagtgcacttgatagcatgacagacattgatccatctgtgtatgccagctactattgggtttcgtctcagtatcataaatcccatcaagaatttgcagaattctacagaagtgctctcctttatttagcttacacttcagtagagtctctatcagaatcctttaagctggatttggcatttgatttgtccctatcggccttgttaggggagaacatctacaactttggcgaacttcttgctcatccaattataaaaagccttctggggactaaagttgagtggctttactatgttcttgaagccttcaattctggtaatttagtgcgttatcaggaactatgtcgtgtacatggagctgctctgagctcccaaccagcattagtccagaatgagaaaaatcttctggaaaagatcaacattctctgcttgatggagataatattcagtcggccttcagaagaaagaaccatcccactaagtatcatcgctgaacgaactaaacttactgtagaagatgtggagtatcttcttatgaagagtctttcagtgcatctgatagaaggaatcattgaccaagtcgaagggaccgtttatgtgtcgtgggtgcaacctagagtattgggaattcctcagatcaagtccttgcgtgaccggctagacaactgggtggacaaagtccatactgctttgctgtccgttgaggccgaaacacccgatcttgttgcagcttaatcttagtccttgcgcttttgatttcagacaatggttaaaggccaaatccgttcctctagcaaaggagaaacctaattacgaatttcatgggctacatttatggttctcttgcgatgcttattttgtcttttttccttcgagtaaatcagcaatggatttccttatatgcgatttgactcgtctctgttcgatgcagattcttagcatacagtacttgtaatactcattattatttacttctttttgcaaattattcctttttgacagaattagtgaaactttttcttagtggtatgatggtatctatgatttcgtggaaaaaaaaaaaaaaa

SEQ ID NO: 2048 - DNA, 1590 bp, Triphysaria pusilla
atatataaatcttcagcgtctctccaatttctacttcctctttctagaatttcttactgccgaacaccactgttccgagaggcggaaggaaaaactaatggcggccctgcagtatttggagaccctgcagaattcgcatccggagctgtccgagtggtacagctcgctttcagatctgtaccaaagaaagctatggcaccagctgacgctgaagcttgaacagttcgtcgccctcgccgtttttcaggctggggatgctctaatccagctgtacaacaatttcataagtgattttgagacgaagatcaatcttctcaagcttgctcaattttctgtcatagtttctcggcagtattcggagaaagcggctgcgataagctatcttgaaggagtgattgaaaagcttcgtgataccagagaatcacgcatagaggagccgatactttatatcaaaatgcagattgctacttgtaagcttgagcagggagataaaaaagaatgcaagaaccttctagaagagggaaagagtgcacttgatagcatgacagacattgatccatctgtgtatgccagctactattgggtttcgtctcagtatcataaatcccatcaagaatttgcagaattctacagaagtgctctcctttatttagcttacacttcagtagagtctctatcagaatcctttaagctggatttggcatttgatttgtccctatcggccttgttaggggagaacatctacaactttggcgaacttcttgctcatccaattataaaaagccttctggggactaaagttgagtggctttactatgttcttgaagccttcaattctggtaatttagtgcgttatcaggaactatgtcgtgtacatggagctgctctgagctcccaaccagcattagtccagaatgagaaaaatcttctggaaaagatcaacattctctgcttgatggagataatattcagtcggccttcagaagaaagaaccatcccactaagtatcatcgctgaacgaactaaacttactgtagaagatgtggagtatcttcttatgaagagtctttcagtgcatctgatagaaggaatcattgaccaagtcgaagggaccgtttatgtgtcgtgggtgcaacctagagtattgggaattcctcagatcaagtccttgcgtgaccggctagacaactgggtggacaaagtccatactgctttgctgtccgttgaggccgaaacacccgatcttgttgcagcttaatcttagtccttgcgcttttgatttcagacaatggttaaaggccaaatccgttcctctagcaaaggagaaacctaattacgaatttcatgggctacatttatggttctcttgcgatgcttattttgtcttttttccttcgagtaaatcagcaatggatttccttatatgcgatttgactcgtctctgttcgatgcagattcttagcatacagtacttgtaatactcattattatttacttctttttgcaaattattcctttttgacagaattagtgaaactttttcttagtggtatgatggtatctatgatttcgtggaaaaaaaaaaaaaaa

SEQ ID NO: 2049 - DNA, 1349 bp, Cynara scolymus
  misc_feature (700)..(700): n is a, c, g, or t
  misc_feature (708)..(708): n is a, c, g, or t
  misc_feature (715)..(715): n is a, c, g, or t
  misc_feature (717)..(717): n is a, c, g, or t
  misc_feature (719)..(719): n is a, c, g, or t
  misc_feature (757)..(758): n is a, c, g, or t
  misc_feature (803)..(803): n is a, c, g, or t
  misc_feature (1159)..(1159): n is a, c, g, or t
  misc_feature (1214)..(1214): n is a, c, g, or t
  misc_feature (1315)..(1315): n is a, c, g, or t
agaacccgaaacagggtttatatactaatccccacgctccggttcttaatcctccctccgacgacagttgtgacatcatcatcgggagtcagtcggcgatggcagctcttcagtatctagattctcttcgtagtactcatccggagctctccgattggtataatacgcttgccgatctgtaccagaggaagctatggcaccaactcactctcaagcttgaacaatttgttgcactcgctgtattccaggctggtgatgctctcatacagctatatcataatttcatcaccgacttcgagactaagatcaaccttctcaagctggcacattttgctgttactgtctctaggcaatattcagagaaagaagctgccattagctatcttgaaggagtgatcgaaaagctccgagccacaaaagagatgcgcatagaggagccaatcctttacattaagatgcagatagctgtctttaatcttgaaaagggagatcagaaggagtgcaagaatcttctagatgatggaaagagtacgcttgatagtatgactgacattgatccgtccgtatatgccaactattattgggtgtcatctcagtatcataaatctcgacaggagtttgctgagttctacaagagttctctactttatttggcttacacctccgtagaatctctgtcagattcatttaagctggatcntgcatttnatactancntnatctgcattgctgggagataacatctacaacttcggannactacttgcgcatccaataataaaaagtctgctagggacaaaggntgaatggctctactatattcttgaagcatcactccggagatctagttcgctatcaagaactatgtcgtgttcatgcagcttctcttaatgctcagcctgctttagtggagaacgagaagaagcttttggaaaagattaacattctctgtttgatggaaattattttcagtcgaccatcagaagagagaaccattccattgagtatcattgcagagcggacaaaactgactgttgaagatgtagaatatcttctcatgaagagtttatctgtgcatcttatcgaggggataatcgatcaagtagatggaacagtttacatatcatgggtgcaacctagagttttggggataactcanataaaatctttgcgtgatcggctggacaactgggtcgggaaggtacacaccgctntgatatctgtggaagcagaaacacccgatttagttgcatcttaagtcctttttcatttgtgtctctggttttgtaacaataattcttgaaagatgttagtncttatgtatgatacttgtttcatttacatccttc

SEQ ID NO: 2050 - DNA, 1490 bp, Ambrosia trifida
ggatggtttctttgagaaaaagaaaacaatcagagacgaaatcaatcaatcaaacaagggtttatagtttattatttacacaacaaatcgagcaacagtttctgtaatcagtgaacgatgtcagctctagagtacctggattctcttcgtaatactcacccagagctctctgattggtacaatacgcttgcagatctctaccaacggaagttatggcatcaactcactctcaaactcgagcaattcgtcgccctcaccgtttttcaggccggtgatgctctcatccaactatatcagaatttcatcactgactttgagactaagataaatcttctcaagcttgcactatttgctgttatagtctctcgtcagtattcagagaaagaaaagccatagagtatcttgaaggagtgattgaaaaactcagagctaacaaaagagtcacgcatagaggaaccaatcatttatattaagatgacaaatagccatttttaatcttgaaaaaggagatcaaaaggagtgcaagaatcttctagaagatggaaagagtacacttgatagcatgacggacatcgatccgtctgtgtatgctaattattattgggtgacatcccagtaccataagtctcgtcaggagtttgctgaattctacaagagctctctactttatttggcttacacttcggttgaatctctctcagattcatttaagttggatcttgcatttgatctatctctatctgctttattgggagataacatttacaactttggagaactacttgcacatccaataattaaaagtctgctagggacacaagttgaatggctttactatattctagaagcattcaacaacggagatctagttcgctatcaagaactttgccgtgttcatgcagcttctcttaacgctcagccagctttggtggagaatgagaagaagcttctagaaaagattaacattctctgtctgatggaaattatcttcagtcgaccatctgatgagagaaccattccattgagcatcatagcagatcggacaaaacttacagttgaagatgttgaatatcttctcatgaagagtttatccgtgcatcttattgagggtattattgatcaagttgaaggaacagttcatgtgtcatgggtgcaaccgagggttttgggaataagtcaaataaagtctttgcgtgatcggttggacaactgggtcggaaagtacacactgctttggtgtcggttgagccgaaacacctgatgtagttgcatcttaagttgtttcttgtttttattattttcttggatagcttgtcgcccaaagttacctgggtgaactccatgtatgatacctatttgtttttcttcttttcaaaggctgtgccatttgtaccttgcctttttgatctgtggttggatagaaacttgttgaatgcaacattctgttggtaagattgcaatgacaagcaacctctttattaaaaaagaaa

SEQ ID NO: 2051 - DNA, 1504 bp, Nuphar advena
  misc_feature (551)..(551): n is a, c, g, or t
  misc_feature (575)..(575): n is a, c, g, or t
  misc_feature (617)..(617): n is a, c, g, or t
  misc_feature (620)..(620): n is a, c, g, or t
  misc_feature (660)..(660): n is a, c, g, or t
  misc_feature (672)..(672): n is a, c, g, or t
  misc_feature (713)..(713): n is a, c, g, or t
  misc_feature (989)..(989): n is a, c, g, or t
  misc_feature (995)..(995): n is a, c, g, or t
  misc_feature (997)..(997): n is a, c, g, or t
  misc_feature (1000)..(1000): n is a, c, g, or t
  misc_feature (1042)..(1042): n is a, c, g, or t
  misc_feature (1093)..(1093): n is a, c, g, or t
  misc_feature (1099)..(1100): n is a, c, g, or t
  misc_feature (1124)..(1124): n is a, c, g, or t
  misc_feature (1129)..(1129): n is a, c, g, or t
  misc_feature (1135)..(1135): n is a, c, g, or t
  misc_feature (1183)..(1183): n is a, c, g, or t
  misc_feature (1201)..(1201): n is a, c, g, or t
  misc_feature (1241)..(1241): n is a, c, g, or t
  misc_feature (1258)..(1258): n is a, c, g, or t
  misc_feature (1260)..(1260): n is a, c, g, or t
  misc_feature (1262)..(1262): n is a, c, g, or t
  misc_feature (1264)..(1265): n is a, c, g, or t
  misc_feature (1267)..(1268): n is a, c, g, or t
  misc_feature (1270)..(1270): n is a, c, g, or t
  misc_feature (1274)..(1274): n is a, c, g, or t
  misc_feature (1277)..(1278): n is a, c, g, or t
  misc_feature (1422)..(1422): n is a, c, g, or t
ccctctctcccagaaaaccataacgggggaaggtaaccctagggtcggcgtcgtcgccgtttcccggcggaaaccccatggcggcactgaagtacctcgaatcgcagagttccgctcagccggagctggcggaatggtacaattccctcgccgatttgtaccagaggaagctctggcaccaactcaccctcaagctcgagcaattcgtcgctcttgccgtcttccaggctggtgatcgactcattcaattgtatcacaatttcatcaccgactttgagacaaaaattaatctgctcaaacttgcacactttgctgtaatagtttcacgtcagtatacagaaagagaagctgcaattagctatcttgaaggagtaattgaaaagctccgtgccaccagggaaatgaggatagaggaaccaattctatatgtaaggatgcagatagctgcattcaagcttgaacaaggggatcagaaagagtgcaagaagcttcttgatgaagggaaaaatgctttggacagcatgactgatattgatccttcagtttatgcnagctatcattggatttcatctcantatcacaaatctcgccaggagtttgcagagttttataaaagngcncttctttatttagcatacaccactgtagaaactctgtcanaaccattcaagntggacttggcttttgatctctcccttgctgcattgttgggngacacatctataacttcggagagcttcttgcacatccaattataaaaagtcttcttgggacaaatgtggagtggctttactacatcttacaggcattcaacactggtgatttggctcgttaccaagaactttgtcgtgtccatgcagctgctcttaatgcacagcctgcactggtagcaaatgaaaaaaagttgcttgagaaaattaacattctttgtctaatggagatcatcttcagtcgtccttcagaagatagaaccatccccttaagtgttnttgctnancgnactaggctttccatagaagacgtggagtacctacttatgaanagtctatctgttcatctaattgaaggcatcatagaccaagttgaaggaacngttcanntttcttgggtacaaccgcgagttntaggnataccncagatcaaagcacttcgggatcgtctggatggttggttggacaaggtncacactgctttgttatcngtagaagccgaaacacctgacctagtggcatcatgaaccnaggcatctgcctttttntntntnntnntntgtnacnntctagatctaaaattaggaaaggagttacttggttaggatcgaggttttgtttgcttcctttttgttttccatctcggtttcccttgcttaaattttttgagtggaaggggaggcacacacctttcctatttcctgctacttgncagatctgtattttttaattcttatgaatgcttatgctcccatgaattacaatcatcaatgaccaggtgagatattgacact

SEQ ID NO: 2052 - DNA, 1659 bp, Vaccinium corymbosum
aaaaactatacacgcctctgcggcttggggcttcaccgctttgaagtcagccatggccgctctgcagtacctcgagaaccttcgcaatgcccatccagggctcgacgactggttcaataccctatcagatctgtaccagaagaagctttggcatcagctcactctcaagctcgaacagttcgtctctctccccgcctttcagggtggtgattctctcatacagttatatcataatttcattgcggactttgaaaccaagatcaatcttctcaagcttgcacattttgccgtcatagtctctcggcaatatccagagaaagaggctgccattagtttccttgaaggcgtgattgaaaagcttcgtgctaccagggagatgcgcattgaggaaccaattctttacattaagatgcaaatagctatcttcaacattgagaaaggcgaccaaaaggagtgcaaaaagcttttagatgatgggaagactacgcttgacagcatgactgacattgatccctctgtgtatgctagctattattgggtttcatcacaatattacaagtctcgccaggaatttgctgaattttacaaaagtgctcttctttacttggcatacacttcagtggagtctatatccgaatcatttaagctggatttggcttttgatttgtccctagctgcgttgctcggagaaaacatatacaactttggggagttgcttgctcatcctattataaagagtcttctggggacaaaggttgaatggctttaccacattcttgaagcattcaactctggtgatttagttcgttaccaagaattgtgccatgtgcatagcgcctctttaaatgcccaaccagcactggtggagaatggaaaaaagctattggaaaagattaacattctctgcttgatggaaatcatcttcagccgaccgtcagaagataggactattccactaagtgtcattgctgagcggacaaaactaactgtcgaggatgtggagtatcttctgatgaaaagcctttcggttcatcttattgaagggataattgatcaagtccagggaaccgtccatgtttcctgggtgcaaccaagagttttaggtatttctcaaatcaaatctttacgcgaccgtctggacaactgggttgacaaagtacacactgctttgctatctgtggaggcggaaactcctgatctagtggcggcttaattctcgattttggactaaagttcctttatgtgctccgtaaccatcttttcaacgccccaaaagaaccactgcgaagaaggaagactgatactcgtattggccacctttgtatgcttcatttgacttgctttttaatgatttcttgcattgattttttgggagaagcagcttgtatttttgtcggttatgttttcccagttcaggggcattttagagacagtgtcagtcgatcgacaaaactggtgtttgactctcttaatggtaatcggtccctgtgttaggaaatcttatgagttattgagatattagccctgatgtggtggatgaatttcattttcatttctctgttgtgatataactgcatcataatgaagcagccaaaaatttgaagagatgttatcaatttgtgctctgttgctactagctcctcgtggctggtgtacaac

SEQ ID NO: 2053 - DNA, 1552 bp, Euonymus alatus
aagaaaaacagaacagaaataaagcaattttgtttttccttcttccgctacgagtctgtctctctgtctggttctggtgatagtcgttgaactcagccatggcagctctgcagtatctcgagacgttgaggaacgtgcatccggagctttcggaatggtacaattctctggcggatctgtacgagaagaagctctggcaccagctcactctcaagctcgagcagtttgtcgctctcgccgtcttccaggccggcgatgctctgatacaattatataacaatttcatcacctactttgagacaaagatcaaccttctcaagcttgcacattttgctgctatcgtttctcgtcagtatctggataaagatgctgccattagttatcttgaaggggtgatagaaaagctccaagtttctagagaatatcgcatagaggagcctatcctttacatcaaaatgcaaatcgctctcttcaaacttgagcaaggggatcagaaagagtgcaagagactccttgaagaggagaagagtgctctagacagtatgacagatattgatccatccgtgtatgccagtttttattgggtttcatctcaatatcataaatatcttcaggaatttgctgagttctacaaaaacactcttctttatctggcatacacttcggtggagtctctgtcagattcattcaagctggatttggcatttgatctttccctctctgcgctcctgggagataacatctacaactttggagaattgctcgctcatcctattattaagagccttctgggaacaaaggttgaatggctataccatattcttcgggcattcaactctggggatctggttcactatcaagaattatgtcgtgtgcacaatgcagccctaagtgctcaaccagcgttggttgagaatgagaagaagctactggaaaaaatcaacattctctgcctcatggaaattatcttcagccgcccatctgaagatcgaactattccgttaactgctattgctgaacgcacgaaactctctattgaggatgtggagcatcttctgatgaagagtctctctgtacatcttattgagggtatcattgatcaagttgagggaacagttcatgtgtcctgggttcagccaagagttttgggggttcaacagatcacatctttaagagaccggcttgacaactggtcggataaagtacgtactgctttgttatccatcgaagcagaaacaccagatttagttgtatcatgatttttttgtgtcttgattttccttcttccctttgtatcaaaatttttaactttaattagaagcaaaaatgcaaagacacagagagacagagagagagactagtaaggcccttggatagtcatgcgatccctgtactcttccttttcacattgcaccatcattctatttagccatttcctaaaagcagctacttgtttcctagagacatggtgaaaaaaccattactgcattcatcgtgtgtttatgaatttgggaaatttcatttgatggaatatgatgcgataacaagtcga

SEQ ID NO: 2054 - DNA, 1568 bp, Sarracenia psittacina
acgggggaagaagaaagagtgcaggagagaggtttataagattatatattatacatacaggaaagaaaaatacatacagaagcctcaccccaactctggtctcatcaatttctctccctctcgtcctttgcagcttgggcttcaccgcttgagtcagccatggccgctctgcagtacctggagacgctgcgcagcgcccatccggagctttccgattggtacaacaccctctcagatctgtaccagaagaagctgtggcaccagctcactctcaagctcgagcagttcgtcgctctcgccgtctttcaggccggtgatgccctgatacagttatatcacaatttcatcactgactttgagaccaagatcaatcttctcaagcttgcacattttgctgtcatagtctcccggcagtattcagagaaagaagctgccatcagttatctagaaggtgtgattgaaaaacttcgtgcgactagagagacacgtattgaggaaccaatcctttatattaagatgcaaatagctatcgtcaatgttgagaaaggtgaccaaaaggagtgcaagaaacttctagaagacgggaagagtacacttgatagcatgactgacattgacccatccgtgtacgcttgctattactgggtttcatctcaataccataaagctcgtcaggaatttgctgaattttacaaaagtgctcttctttatcttgcatacacatccgtggagtctctgtcggaatcatttaagttggatctggcatttgatttgtccctagctgcattgcttggagaaaacatatacaactttggggagttgcttgctcatccgattgtaaagagtcttctggggacaaaggttgaatggctttattatattcttgaagcattcaactccggaaatttagttcgttatcaagaactgtgcaatgtgcatagagctgctctaagtgcccaaccggcactggtggagaatgagaaaaagctactagaaaagattaacatactctgtttgatggaaatcatcttcagtcgaccttcagaagatagaactattccaattagtatcattgcggagcgcacaaaacttaccgtagaagatgtggagtatcttctcatgaagagtcttctgttcatctcattgaggggagtaattgatcaagttgaaggaactgttcatgtttcctgggtacaaccaagagttttaggtatcccacagatcaagtctttgcgcgatcggctggacaactgggtgggcaaagtacacactgctttgctatctgtagaggcggaaactcccgatctagttgcatcttaattatcatttctgcttccttctcttttatctactctccataacagtcttttcaacgcccgaaagaattgatgactgccgccaagaggagaaaaggagaaaagatagatagtcgctttggctatctttgtatgcttcctctcatgtgactttaatcgatacctgcattattttcgaaaaggagcagcctcttgtacctgtcgcattttaagttgtctcatttttgagggaatgtctagagacactcagta

SEQ ID NO: 2055 - DNA, 1585 bp, Plantago ovata
ggcagacaaaccaccattgttgaattcttccccaagcaaacacctgttctccacaaatttcactcaaaccgaacattcgaaatccgcatcaatggcagcagctcccctgcagtatctggagtccctgcgtaatgcccatccagagctttccgagtggtacaccacgctctccgatctgtaccagcgcaagctatggcatcagctttctctcaagctcgaacaattcgtcgccctcactgtttttcaggctggggatgctcttattcagctttatcacaatttcataacggacttcgagacaaagatcaatcttctcaagcttgctcattttgctgtcataatttcacggcagtattctgagaaggaagctgctataagttatcttgaaggattgatagaaaagcttcgtaataccaaggagatgcgcattgaggagccgatactgtatatcaaaatgcaaattgctacatttaggctggagcaaggggatccaaaggaatgcaagaagcttttagatgaagggaagagttcacttgatagcatgactgacattgatccatctgtgtatgccagctactattgggtttcatctcaataccataaatctatcccagatttcgctgagttctacaaaagtgctcttctttacttggcttacacgtccgttgagtctttatcagattcgttcaagcaggacttggcgtttgacctatctctgtcagccctcctgggggagaatatctacaactttggtgagctgcttgcacatccaattctaaaaagtctcctgggcacaagggttgagtggctatattatatcctcgaagcattcaattctggtgatttagctcgctatcaagaactatgccgtgtccataaagctgctctccttgaccaaccagcgttagtcaagaatgagaaaaatcttgtggagaagatcaacattctctgcttgatggagaccatctttagtcgcccagcggaagataggacgattccattaagtatcattgctgaacgaacaagactcactgtagaagatgttgagcatctccttatgaagagcctttcagtgcatttgattgagggaattatagaccaagttgatggaacagtgtatgtttcctgggtgcaacccagagttctaggtatttcccagatcaagtctttgcgtggccgtcttgacaattgggttgataaagtcaacgagactctaaattccgttgaggcagagacacctgatttagttgctgcatgatctaaaagagctctttagcctgttcgactttgttttaacagttagcagtggtaaattttgctgaggtgaaagacagatcaaaatttgatggaccacttgaatgaactgcaaccttttgcagcagctttctgtttatttatatttttcatttcagacagagactagcaagtgtttaatgtgacattactttgtgctgtatctttagtctactcggacaaattattcgatttggttattagattttttttagttctgagtctaggccttccttcttgcctgtatagcaagctatacaggcaagaaggaaggcctagactacaagaaact

SEQ ID NO: 2056 - DNA, 1509 bp, Cynara scolymus
  misc_feature (4)..(4): n is a, c, g, or t
ctcncgggggggcaaagaaacccgacgatacagcagaaagggtttatatttaaatctcctgccggtggtctgttttgctaattgacgtcggagtcagtaggagatggcggctttacagtacctagattctcttcgcagtactcatccggagctgtccgattggtacaatactcttgccgatctgtaccaaaggaagctatggcatcaactcactctgaagctcgaacagttcgttgctcttaccgttttcaaggctggtgatgctctcatacaactatatcataatttcataaccgactttgagactaagatcaaccttctcaagctggcacactttgctgtgatagtctctcggcaatattcagagaaagaagctgccatcagttatcttgatggggtgattgagaagctccaggctacgaaagaaacacgtatagaggagccagttctttatattaagatgcagatagccatctttaatcttgagaaaggagatcaaaaggagtgcaagaatcttctagaagatgggaagagtacacttgatagcatgactgacattgatccgtcggtatattccaactattattgggtatcatctcagtaccacaaatcccgccaagagtttgctgagttctacaagagtgctcttctttatttggcatacacctcagtggagtctctatcagattcattcaagctggatcttgcatttgatctatccctgtctgcattattgggagagaatgtctacaacttcggggagctacttgcccatccaattataaagagtctgctagggacgaaggttgaatggctctactacattctcgaagcatttaactctggagatctaattcgctatcagactatgtcgtgtcatggagcttctcttagtgctcagcctgctttggtggataacgagaagaagcttttggagaagattaacattctctgcttaatggaaattatcttcagtcgaccatcagaagaacgaactattccattgagcatcattgcagaacgaacaaaccttaccgttgaagatgtggaacatcttctcatgaagagtctatcggttcatcttattgagggtataattgatcaagttgatggaacagtttatgtttcatgggtgcaaccgagagttctgggaatttctcaaatcaaatcattgcgtgatcggttggatggttgggtgggaaaagtacacactgcgttgatatctgtggaagcagaaacgccggatctagttgcatcgtaagtctttgtttgtttccatccctgtaacagaatactttcgaaagcccaaagaaaagagctcataagagaccagcaaaaggaattaagagactaatggcagttgatttgggccgacttagtgtaagcgttttttctttgatattccgccatcgggaaggaggctcttgtgtaccttacattttagaatttttgatttatggagagttgcatataaacaactgttgtcctttcagagaatgatattttcac

SEQ ID NO: 2057 - DNA, 1369 bp, Nicotiana benthamiana
gtattcatcactgagagtaatcaccgatggccgctttagagtacttagattcacttcgaaatgcacatccagagctgtccgattggtacaatacgctatcagatctgtaccagcgcaagctctggcaccagctctctcttaagcttgaacaattcgttgccctcgccgtttttcaggcaggcgatgcactgatacagctgtatcacaatttcatctctgattttgagacaaagatcaatcttctcaagcttgcacattttgcagtcattgtttcccggcagtatgcagagagagaagctgctataggttaccttgaaggtgtgatcgagaaacttcaaaatacaaaggagacacgcatagaggagccaattctatacattaagttgcagattgctctatttaagcttgaacaaggggatcaaaaagattgcaagattcttttagaagaggggaaaactacacttgacagcatgactgacattgatccctctgtttatgctagctattattgggtttcgtctcaattccataaagctcgcctggagttcgctgagttttacagaagtgctcttctttatcttgcatacacttctgtggaatctctttctgaatcgtttaagctggatttggcgtttgatttatccctgtcagctttgctaggagacaacatatacaactttggtgaactgcttgctcatccaattgtaaatagcctcttggggaccaaggttgagtggctctatcatattcttgaagcattcaacaccggtgatttgatttgttatcaagaattgtgccgtgtccatcaagctgcattgaatgctcaaccggcattagtgcagaacgagaaaaagcttctggagaagatcaacattctctgcttgatagaaataatcttcagtcgcgcggcagaagatagaactatcccaatgaacgtcatcgcagagcgcacaaagttgggtgtggaagatgttgaatatctcctcatgaagagcctttctgtgcatctgattgagggaataattgatcaagtggaggggacaattcatgtctcctgggtgcaaccaagagttcttggaattccccaaatcaagtcattgcgtgatcggctagacaattgggtggagaaagttcacactactttgctatcagtagaggctgaaactcctgatttagttgcatcataaatcataatcaagcagaggcgctagcgaaactaaatctagtaattcaatgatctcaatgtgtttttaagggaaataggtgcttgttattgtatttcatttcgtcaggttcataatgacattcctagggaaaacagggagccaagttgtgaaatggctgtactttactgctttagatacttgga

SEQ ID NO: 2058 - DNA, 1538 bp, Solanum tuberosum
gcaaaacacaacttacaagtcaggaatctctctctttcacatacacacacagtagctgcttcgtcttcatcggtgttactgagagagctttttcagccatggcggcacttcagtacttggaatcgttttgcaatgctcattcacagctttccgattggtacactactttggcagatctgtaccagaggaagctctggcatcagcttactcttaagcttgaacagttcgttgctcttcccgtttttcaggctggtgacggactaatacaattgtatcacaacttcatcactgattttgagacaaagatcaatcttctcaagcttgcacattttgcggtcattgtttctcggcaataccccgagaaagaagccgctataggcttccttgaaggagtgacagagaaacttcataatactaaagagatacggatagaggagccaattctttatattaagatgcagattgccctatttaagcttgagcaagaagatccaaaagagtgccagaaacttttagatgaggggaaaacaacacttgatagcatgactgacattgatccatctgtctatgcaagctattattgggtttcatctcagtaccataaaactcgccaggagtttgccgagttctacaaaagtgctcttctttatctcgcgtacacttcagtggaatctctttctgaatcatttaagctggatttggcttttgatctgtccctgtcggcattgctgggagacaacatatacaactttggagaactgcttgctcatccgatcataaagagtttgatagggactaaggttgagtggctctattatattcttgaagcatttaacactggtgatttggttcactatcaaaaattgtgccatgtccatcaagctgctttaactgctcaaccagcattggtgcagaatgagaaaaagcttctcgagaagatcaacattctctgcttgatggaaattatcttcagtcgcccagcagatgatagaactatccccctgagtgtgattgcagagcgcacaaagttaactgtggaggatgtcgaatatctactcatgaagagcctttctgtgcatctgattgagggaataattgaccaagtcgaagggacagttcatgtgtcctgggtgcaaccaagagttctgggaattcctcaaatcaagtcactgagggatcggctagacaattgggttgacaaagtacacactgctttgttatccgtggaggctgaaactcctgatctagttgcagcataatctttaactttttttccagtgtcctttatccgtaatagccacctgcacgtacctgtcttctaaaatttacttctcgcagagagctgagaagctagggactgtggtctagttttcataggcctttgtttgtatgtcccggtttatgttgcgaaactattgatctcattggttttatttcttccggatagtttcttgttcttgtatttgattacttcttattcagatttcagactgatgacatccagtgctagacatgaagccaagttgtgaaatgactat

SEQ ID NO: 2059 - DNA, 1625 bp, Tabernaemontana elegans
agaacccctttctcctcctccgaagctctctctttctcgaagcattatcagcagccatggcggcactgcagtatctagattctcttcggaatacccatccagagctctccgattggtacaataccctcgcagatctgtaccagcgcaagctctggcatcagctcactcagaagctcgagcagttcgtcgctcttgctgtctttcaggttggcgatgctttaatccagttctatcataatttcattgccgattttgagacaaaaatcaaccttctcaagcttgcacactttgccgtcatagtatctcggcagtatgcagagaaagaagctgcaattagctatcttgaaggggtgattgaaaagcttcgtaataccagggagttgcgcatagaggagccaattctctatattaagatgcagatggcttatctcaagcttcagcaaggggatcaaaaagagtgcaaaaaacttttagaagagggaaagagtacccttgatagcatgactgatattgatccttctgtgtatgccagttattattgggtttcatctcaatgccataaatcccgacaggagtttgcagagttctacaaaagcgcacttcttttcctggcctacacttcagtcgagtctttatctgaatcattcaaactggacttggcatttgatttatccctttcagccttgcttggagaaaacatttacaattttggggaattacttgcacatccaattataaaaagtcttctaggggcaaaggttgaatggctgtactatattcttgaagcatttaacactggtgatttagttcgctatcaagaattatgcaatgttcaccgagcagctctgagttctcaaccagctctggtggagaatgagagcaagcttctggaaaaaatcaatattctctgcttgatggaaatcatctttagtcgaccatcagaggacagaaccattccattgagtgttatttccgagcgcaccaaactgtctgtggaagatgtggaatatctcctcatgaagagcctttcagtccatttgattgaggggataattgatcaagttgaaggaactgttcatgtttcgtgggttcaaccaagagtcttgggaatatctcagatcaagtcattgcgtgaccgcttgaatagctgggtggataaagtacagactgctttggtatctgtcgagtctgaggcacctgatctagttgcttcgtgatggatgtagacacggatgtaatctgtcgcatgtaacatagtgcccaaattgagctagtgtttgtgctgaaaatgagagaagaagatttcttaagttgcctgggcctgtttccgatgcacgtctcacattgtttcattattactctctgttctttccgctttgcttttgagcaagtagtctgttttccggtactcactgcttttttcattcttagtcgtatggctaggtgcaattagctgatatacagacggcttttaccattctgaggatgctctattggatgatatactccaatttacaccattccaatcaaatttgatccactttcagtggatcttatatgtattgcagtatttactctcatctcactttgttttgtttacgtggcttcaaagccagcttgattgg

SEQ ID NO: 2060 - DNA, 1593 bp, Solanum lycopersicum
agaacttcttgtttctttcttcatcgtcttcatcaagagagagattttttcgaacactgaatcagccatggcggctctacagtatttggaatcgctacgcaatgatcatccagagctttctgattggtacacgacgcttgcagatctgtaccaacgcaagctctggcaccagctctctctcaagctcgaacagtttgtcgctctcgctgtttttcaggctggtgacacgttgatacagctgtatcacaatttcatcactgattttgagacaaagatcaatcttctgaagcttgcacatttcgctgtaatcgtctctcggcaatattcggagaaagatgctggaataggttatctggaaggagtagcagagaagctccaaaatactaaagagacacggatagaggaaccaatactttatattaagttgcagattgccctatttaagctagaacaaggggatcaaaaagagtgcaagaggcttttagaacaggggaatgctacaattgacagcatgaccgatgttgacccctctgtttatgccagttactattgggtttcatctcagtatcataaaacgcggcaggaatttgcagagttttacaaaagcgctctcctctatcttgcatacgtttcagtggattctctttcggagtcattcaagctggatttggcgtttgatttgtccttgtctgctttactgggagacaacgtatacaattttggggagttgcttgctcatcctataataaagagtttggtagggacacaagttgaatggctatatcatatccttgaagcattcaacactggtgatttagttcgttatcaagaattgtgccgtgtccataaagctgctttaagtgctcaaccagcattattgcagaacgagaaaaagcttctcgagaagatcaacattctgtgcttgatggaaatcatcttcagtcgcccagcagaggatagaactattccattgagtgccattgcagagcgcactaaacttagcgtggaagatgtagagtatctcttaatgaagagtctctctgtacatctgatagagggaataatcgatcaagtggaagggactgttcacgtgtcctgggttcaaccaagagttttgggtattcctcagatcaagtcattgcgagatcggctagacaattgggtggataaagtacacactgccttgttatctgtggaagctgaaactcctgatttggtttcatcataatcttagtttcccagtttgcacttcctggtccctgcagcactccgatttcttcgtcctctcttttttgctgtgcttacgagagcttgtaacacaacagaggaattttgtgagacatttgtttagttttctcaggcctacactctgtactgtggcttatatcccaaatcattgatctgtcactgttttctggatttaggtgcttgttcagtcatcactttgtagtctatagactactatagcgacgacatcgtcttaacggttttattcagagtacacttgatttggattaagcaagtaagatatattatttgacactcggaagttacgttactgtcacataaattgagatagaggaagtaacaaat

SEQ ID NO: 2061 - DNA, 1623 bp, Solanum lycopersicum
tataaaaattattttctatttttttagaacttcttgtttctttcttcatcgtcttcatcaagagagagattttttcgaacactgaatcagctatggcggctctacagtatttggaatcgctacgcaatgatcatccagagctttctgattggtacacgacgcttgcagatctgtaccaacgcaagctctggcaccagctctctctcaagctcgaacagtttgtcgctctcgctgtttttcaggctggtgacacgttgatacagctgtatcacaatttcatcactgattttgagacaaagatcaatcttctgaagcttgcacatttcgctgtaatcgtctctcggcaatattcggagaaagatgctggaataggttatctggaaggagtagcagagaagctccaaaatactaaagagacacggatagaggaaccaatactttatattaagttgcagattgccctatttaagcttgaacaaggggatcaaaaagagtgcaagaggcttttagaacaggggaatgctacaattgacagcatgaccgatgttgacccctctgtttatgccagttactattgggtttcatctcagtatcataaaacgcggcaggagtttgcagagttttacaaaagcgctctcctctatcttgcatacgtttcagtggattctctttcggagtcattcaagctggatttggcgtttgatttgtccttgtctgctttactgggagacaacgtatacaattttggggagttgcttgctcatcctataataaagagtttggtagggacacaagttgaatggctatatcatatccttgaagcattcaacactggtgatttagttcgttatcaagaattgtgccgtgtccatcaagctgctttaagtgctcaaccagcattattgcagaacgagaaaaagcttctcgagaagatcaacattctgtgcttgatggaaatcatcttcagtcgcccagcagaggatagaactattccattgagtgccattgcagagcgcactaaacttagcgtggaagatgtagagtatctcttaatgaagagtctctctgtacatctgatagagggaataatcgatcaagtggaagggactgttcacgtgtcctgggttcaaccaagagttttgggtattcctcagatcaagtcattgcgagatcggctagacaattgggtggataaagtacacactgcattgttatctgtggaagctgaaactcctgatttggtttcatcataatcttagtttcccagtttgcacttcctggtccctgcagcactccgatttcttcgtcctctcttttttgctgtccttacgagagcttgtaacacaacagaggaattagtgagacatttgtttagttttctcaggcctacactctgtactgtggcttatatcccaaatcattgatctgtcactgttttctggatttaggtgcttgttcagtcatcactttgtagtctatagactactatagcgacgacatcgtcttaacggttttattcagagtacacttgatttggattaagcaagtaagatatattatttgacactcggaagttacgttactgtcacataaattgagatagaggaagtaacaaatattgtc

SEQ ID NO: 2062 - DNA, 1443 bp, Valeriana officinalis
tgagtccatcgtcagactcagctatggccgctctgcaatacctcgattccctgcgaaattctcaccctgaactctccgattggtacaatactctatcagatctttaccagagaaagttatggcaccagcttacactcaagctcgaacagttcctcgctcttaccgtctttcaggctggcgatgctctgatacagctgtacaacaatttcataaccgactttgagacaaagataaatcttctgaagctcgcacattttgctgtgatagtgtctcgtcagtactcagataaagatgctgcaattggatatcttgaaggggttattgaaaagcttagagctactagagaacttcgaattgaggagccggttctttacattaagatgcaaagagctttgtttgagcttgaaagaggtaaccagaaggaatgcaaaaagcttttagaggacggcaagagtacattggatagcatgactgacgttgatccatcggtttatgcgagttattattgggtttcgtcacagtactataaatctcgtcaggagtttgccgatttttacaaaagtgcccttctttatctggcttacacctcggatgattctttgtcagagtcgtttaagctggatttggcatttgacttatcgctatctgcattgcttggagaaagcatttacaattttggggagcttcttgcacatccaattgtaaagagtcttaccgggactaaagtagagtggctctactatatactggaagcattcaacacaggtgacttagttcgttatcaagagttatgccaggttcacagagcttctcttagtgctcaaccagctcttgtccagaatgagaagaagcttctagagaagattaacattctctgcttaatggagattatctttagtcgaccgtcagaagatagaacaattccgttgagtataattgctgagcgaactaaacttactgttgaggatgttgagtatcttctcatgaagagtctatctgttcatctgatagaggggattatagatcaagtggagggaacggtgcacgtatcgtgggtacaaccgagagtgttggggattccgcagatcaaatcgttgcgcgacaggctcgacaactggatggagaaagttcacaccgctttgatatccgttgaggctgaaactcctgatttagttgcttcataactcaatcttctactttttcttcttcatgtaacaattgctttaaacagtaagaaattctagtaaactcggccacaggagacgctatcaaatcaaacccttttgttttgtttctaagtttctttttgtatgcacaaaccaattattgtagttcttcaatttcatttgtcgcacatttcatttttttttcttaagattctctctgctgtttccttgcaactttgacgaaaatgtatctgattatttaacttttgcattgttt

SEQ ID NO: 2063 - DNA, 1599 bp, Vaccinium corymbosum
aaaactatacacgcctctgcggcttggggcttcaccgctttgaagtcagccatggccgctctgcagtacctcgagaaccttcgcaatgcccatccagggctcgacgactggttcaataccctatcagatctgtaccagaagaagctttggcatcagctcactctcaagctcgaacagttcgtctctctccccgcctttcagggtggtgattctctcatacagttatatcataatttcattgcggactttgaaaccaagatcaatcttctcaagcttgcacattttgccgtcatagtatctcggcaatatccagagaaagaggctgccattagtttccttgaaggcgtgattgaaaagcttcgtgctacccgggagatgcgcattgaggaaccaattctttacattaagatgcaaatagctatcttcaacattgagaaaggcgaccaaaaggagtgcaaaaagcttttagatgatgggaagactacgcttgacagcatgactgacattgatccctctgtgtatgctagctattattgggtttcatcacaatattacaagtctcgccaggaatttgctgaattttacaaaaagcgctcttctttacttggcatacacttcagtggagtctatatccgaatcatttaagctggatttggcttttgatttgtccctagctgcgttgcttggagaaaacatatacaactttggggagttgctcgctcatcctattataaagagtcttctggggacaaaggttgaatggctttaccacattcttgaagcattcaactctggtgatttacttcgttaccaagaattgtgccatgtgcatagcgcctctttaaatgcccaaccagcactggtggagaatgaaaaaaagctattggaaaagatcaacattctctgcttgatggaaatcatcttcagccgaccgtcagaagataggactattccactacgtgtcattgctgagcggacaaaactaactgtcgaggatgtggagtatcttctgatgaaaagcctttcggttcatcttattgaagggataattgatcaagttgagggaaccgtccatgtttcctgggtgcaaccaagagttttaggtatttctcaaatcaaatctttacgcgaccgtctggacaactgggttgacaaagtacacactgctttgctatctgtggaggcagaaactcctgatctagtggcggcttaattgtcgattttggactaaagttcctttatgtaccccgtaacaatcttttcaacgtccaaaagaaccactgcgaaggaggaagactgatactcgttttggccacctttgtatgcttcatttgacttgctttttaatgatttcttgcattgattttttgggagaagcagcttcttgtatttttgcggttatgttttcccagttcaggggcattttagagacggtgttagtcgatcgacaaaactggtgtttggctctcttaatggtaatcggtccctgtattaggaaatcttatgagttattgagatattagccccgatatggtggatgaatttcattttccatttctatgtctgtgatataacttcatcataatgaagcagccaaaa

SEQ ID NO: 2064 - DNA, 1685 bp, Cucumis sativus
attcttttctttgagaacaagaaaaagaacagaggaagaggcagaaattatataaattggatttctcttttttctttcttttccctcttcgtgaatccatagccggagcagccatggccgctttacagtacctcgatacccttcgtaactcgcaccctgagctcgctgaatggtacaatacccttgcagatctgtaccagaagaagctttggcatcagctcacactcaagcttgagcaattcgtcgctctgaccgtcttccaggctggtgatgcactgattcagttgtatcataacttcatcactgattttgagaccaaaatcaatcttctcaagcttgctcattttgctgtgattgtctctcgtcaatatgcggagaaagaagccgccattagttatcttgaagggataattgagaaactaaggagtactaaagagctgcgcatagaggagcctatcctctatattaagatgcaaatagctatttttaaacttgagcaaggtgaccaaaaagagtgcaagaaactattggaagatggaaagagcactcttgacagcatgacggacattgatccatctgtttatgctagctattattgggtttcatctcaattttacaagtcccgcaaagaatttgctgagttctataaaagtgctcttctttatctagcatacacttcagtggaatcactgtcagactcatttaaattggatttggcatttgatttatctctttctgcacttctgggagacaacatctacaactttggagagcttctagggcatcctattatcaaaagtctgtcgggcacaaaggtcgagtggctttactacattcttcaggcattcaattctggtgatttagttcgctatcaagagctatgccaagtccataacgcagctttaagggcccaaccagctttagttgataatgagaagaaactattagagaaaatcaacattctttgcctcatggaaattatcttcaggcatgcaggcttagctcctttccggccgtctgaagaccgaaccattccattgaaagttatagaagagcggacaaaactttctacagaggatgtggagcatctactaatgaagagtctctctgtccaccttatagaaggtataatcgatcaagtcgagggaacggtacatgtttcctgggtgcaacctagggttctgggcattcaacagatcaaatccctgcgagaccggctggacaattgggtggaaaaagtgcacacggctttactttcggtcgaggccgagacccctgatctagttgcatcataatcctcttcatttcatctctaaacaatttagccaagggacgaaacaaaagccaggagaaactactgccgatcctttatatgatgattttcatgtgctggctggctggctgttttccaagctgtcttttcatcttgcctactgctatcttgaactattttctaggaagcagaagcctctacttcagtctagttagttttaaaagtgagcatggattggaggagttgaaatggacttaatttgacttctgtatttgttttacttttgttgcatacaattgagttttgatgtgctccatggaaatccattttatgatatgtttaaatcttataaaccagacttcatataacacacataatctcatttcttcatgcctaatatgggaagcctaat

SEQ ID NO: 2065 - DNA, 1389 bp, Capsicum annuum
gcacgaggggcattacagtacttggaatcgcagcggagtgaacatccagagctatcagaatggtacagtacgcttgcagatctgtaccaacgtaagctctggcatcagctctctcttaagctcgaacagttcgtcgctctagctgtttttcaggccggtgacacactgattcaattgtatcacaatttcatcactgattttgagacaaagatcaatcttctgaagcttgcacatttcgctgtaatcgtttctcggcaatactcggagaaagaagctgcaattggttacctggaaggagtagctgagaaactccaaaatactaaagagacaaggattgaggagccaatactttatattaaattgcagattgccctatttaagcttgaacagggggatcagaaagagtgcaagaagcttctagaacaggggaatgctacacttgacagcatgactgatgttgatccctctgtttatgccagctactattgggtttcatctcagtatcataagactcggcaggagtttgcagagttttacaaaagtgctctcctctatcttgcatacatttcagtggattctctttcggagtcattcaagctggatttggcgtttgatttgtccttgtcagcattactgggagacaacatatacaattttggggagctgcttgctcatccaattataaagagtttggtagggacacaggttgaatggctatattatattcttgaagcattcaacactggtgatttagttcgttatcaagaattgtgccgtgtacatcaagctgctttaagtgctcaaccagcattgttgcagaacgagaaaaagcttctcgagaagatcaacattctgtgcttgatggaaatcatcttcagtcgtccagcagaggatagaactattccattgagtgccattgcagagcgcactaagcttagcgtggaagatgtagagtatctcttaatgaagagcctctctgtgcatctgattgagggaataatcgatcaagtggaagggactgttcacgtgtcctgggttcaaccaagagttttgggtatttctcaggtgaagtcattgcgggatcggctagacaattgggtggataaagtacacactgcattgttatccgtggaagctgaaactcctgatttggttgcatcgtaatccttagtttcccagtttgcactttctggtccctctataacactccgatctcctctttaactcattttttggctgtccctatgagagctggtatctcagcggagttagtatggggagacatcgttatactttctcgggcctatactgttagtatggggagacatcattatactttctcgggcctatactgttcatttagttgcttgttcttgtacttccatcact

SEQ ID NO: 2066 - DNA, 1613 bp, Nicotiana tabacum
  misc_feature (116)..(117): n is a, c, g, or t
  misc_feature (152)..(152): n is a, c, g, or t
  misc_feature (191)..(191): n is a, c, g, or t
  misc_feature (239)..(239): n is a, c, g, or t
  misc_feature (356)..(356): n is a, c, g, or t
  misc_feature (529)..(529): n is a, c, g, or t
  misc_feature (541)..(541): n is a, c, g, or t
  misc_feature (548)..(548): n is a, c, g, or t
  misc_feature (692)..(692): n is a, c, g, or t
  misc_feature (725)..(725): n is a, c, g, or t
  misc_feature (734)..(734): n is a, c, g, or t
  misc_feature (737)..(738): n is a, c, g, or t
  misc_feature (780)..(780): n is a, c, g, or t
  misc_feature (810)..(810): n is a, c, g, or t
  misc_feature (985)..(985): n is a, c, g, or t
  misc_feature (1000)..(1000): n is a, c, g, or t
ggccattacggccgggggtgcagaagaagaaatccaaagttttaagaggttttataaaaggatttacagttccactttttcttcttcttctttgtgttcatcattgagagtaatcnncgatggccgctttagagtacttagattcacttcgnaatgcacatccagagctatccgattggtacaatacgctntcagatctgtaccagcgcaagctctggcaccagctttctcttaagctngaacaattcgttgccctcgccgtttttcaggcaggcgatgcactgatacagctgtatcacaatttcatcactgattttgagacaaagatcaatcttctcaagcttgcacattttgcngtcattgtttcccggcggtatgcagagaaagaagctgctataggttaccttgaaggagtgatcgagaaacttcaaaatactaaggagacacgcatagaggagccaattctatacattaagttgcagattgccctatttaagcttgaacaaggggatcaaaaagattgcaagantcttttagaagnggggaanactacacttgacagcatgactgacattgatccctctgtttatgctagctattattgggtttcgtctcaataccataaagctcgccaggagttcgccgagttttacagaagtgctcttctttatcttgcatacacttctgtggantctctttctgaatcgtttaagctggatttggcntttgatttntcnntgtcagctttgctgggagacaacatatacaactttggtgaantgcttgctcatccaattgtaaatagcctcntggggaccaaggttgagtggctctatcatattcttgaagcattcaacaccggcgatttgattcattaccaagaattgtgccatgtccatcaagctgcattgaatgctcaaccagcattagtgcagaacgagaaaaagcttctggagaagatcaacattctctgcttgatggaatnatcttcagtcgcgcngcagaagatagaactatcccattgagtgtcatcgcagaacgcacaaagttgggtgtggaagatgttgaatatctcctcatgaagagcctttctgtgcatctgattgagggaataattgatcaagtggaggggacaattcatgtctcttgggtgcaaccaagagttcttggaattccccaaatcaagtcattgcgtgatcggctagacaattgggtggagaaagttcacactactttgctatcagtagaggctgaaactcctgatttaattgcatcataaatcataatcaagcagagaacgtagcgatactaaatctagtaaatcaatgatctcaatgtgttttttgagggaagcaggtgcttgttattgtatttcatttcttcaggtccatagtgacattcctaggacacagggagccaagttgtgaaatggctgtattttactgcctttagatacttcgaccttttctgcaccagcatttaaaagaatccagtttctgatggatgctttgcgtcctttactttctggtttttgaactattcttttatttgctacgttccctgaacagttaaagaagtggacaagaacaagcctgctggaaaaaaaaaaattc

SEQ ID NO: 2067 - DNA, 2153 bp, Aristolochia fimbriata
aaggcaaaacctcagcgcggcccttttcttcgtcagcagcagcagtagcccttgagagagaagaaaaagggggcaaaaaaatcactgcgaccgggcggcagtcgaaccaggggagactaacccgagggttttgtgtttggcttgttttcgtcgaacggagaagacacctcccgatcgtctttcttctcgccggcgtctttttttttgttttccctggggtgtcagccatgtcggccctacagtacctcgaggcgcagcgcaacaagcagccggagctagcggattggtacaattcgctcgcggatttgtaccagcggaagctgtggcaccagctcactctcaaacttgagcaattcgttgccctagccgtttttcaggcgggtgatgctctcatacaattatatcataatttcatcaccgactttgaaacaaaaatcaatctccttaagcttgcacactttgctgttatagtttctcgtcagtattcagaaaaggatgctgctatcagctatcttgaagggttgattgaaaagcttcgtgcaactaaggagatgcggatagaggaaccggttctctatgtgaagatgcaaatagcggctttcaacattgagaagggagagcagaaagagtgtaagaaacttctagaagagggcaagatcatactggatagtatgacagatattgatccctctgtttatgcaaattatcactgggtttcgtcgcagtatcataagtctcatcaagaatttgctgagttctataaaagtgctcttctctatttagcatacacaactgttgaatctctatcagactctttcaagctggatctggcatttgatttgtccctttctgcattgcttggcgataacatctacaactttggtgaattactggcacacccaattataaaaagccttttggggacaccagtagagtggctttattacatacttcaagcattcaattctggtgatcttgttcgttaccaagaactatgtcgtgttcatcaagctgcactgactgcacagccggcattggtgcaaaacgagaaaaaattgcttgagaaaatcaatatcctttgtttgatggagatcattttcagtcgtccctccgaagatcgaaccattccattgagtgtcattgcggagcgtactaaactttctatagaggatgtggaatatcttctcatgaaaagcttatctgtccatctcattgagggcatcattgatcaagtagaaggtacggtccacgtatcatgggtccaaccaagagttctgggaattcctcaaatcaaatccttgagaagtcgcctggataattggcttgagaaggtgcacacagctttgttgtccgtggagtctgagatcccagatcttgtagcctcgtgattcaccattgtgggcatgcggtcaccagtctctgtaacaatgttaaggtgccagacaaagcagcggggaaagaagaacatgtatgccttcctgggtctcgtccttatggttttcctttatgttccttgaaaattttggaaggggcagcgtttcgttagctttgaggcctgtattttttaattcatcagttgtcagaacccggaggatacgctcagcagacactgtccggtagggcatttagaacggctgtttcttttatttgtcatggaagagtcagcttttataatacttccaggttataattgctgcgaacgtttgtgagacatcattcacactagaaaaaccaaagtcctttgaaaaggatcgaagtgctttctctcccgcgtggttggcgtcatttgttgactagttttatgtttccataattcatttacagtagtttttgtttcattttagaggtagtatcaatgcgtttatgtaatgtcaaaacagtagcaacattctatattattgctttgctacgagataggtaattgtatttacgtataaagattgttaaagtctaatgtagtgtcctcgcctttcttcatgtttgtcttcggtgagagggttcgttaaacggtgggttgtgatcgcatggtaaggttgttgcgcccacccagttattaatattcaagaatcatatgatcattaagaatttgttcgcaaaaatatcaggcaacattacaaaccaacatttatacgagaggaagaagcctaagattc

SEQ ID NO: 2068 - DNA, 1696 bp, Nicotiana benthamiana
aaatcccacacttgcccattaatcatatccaaattacgagaaaccccactgtaagacatttctcacagagtctattcctttcttcgtgcagaagaagaaatcctaaatttttaagaggttttataaaaggatttacagtttcacttcttcttcttcgtattcatcattgagagtaatcagcgatggccgctttagagtacttagattcacttcgaaatgcacatccagagctatccgattggcacaatacgctatcagatctgtaccagcgcaagctctggcaccagctttctcttaagcttgaacaattcgttgccctcgccgtttttcaggcaggcgatgcactgatacagctgtatcacaatttcatcactgattttgagacaaagatcaatcttctcaagcttgcacattttgcagtcattgtttcccggcgatatgcagagaaagaagctgctataggttaccttgaaggagtgatcgagaaacttcaaaataccaaggagacacgcatagaggagccaattctatacattaagttgcagattgccctatttaagctcgaacaaggggatcaaaaagattgcaagtttcttttagaagaggggaaaactacacttgacagcatgactgacattgatccctctgtttatgctagctattattgggtttcgtctcaataccataaagctcgccaggaattcgccgagttttacagaagtgctcttctttatcttgcatacacttctgtggaatctctttctgaatcgtttaagctggatttggcgtttgatttatccctgtcagctttgctgggagacaacatatacaactttggtgaactgcttgctcatccaattgtaaatagcctcttgggaaccaaggttgagtggctctatcatattcttgaagcattcaacaccggtgatttgattcgttatcaagaattgtgccgtgtccatcaagctgcattgaatgctcaaccagcattagtgcagaacaagaaaaagcttctggagaagatcaacattctctgcttgatggaaataatcttcagtcgcgcggcagaagatagaactatcccaatgaacgtcatcgcagagcgcacaaagttgggtgtggaagatgttgaatatctcctcatgaagagcctttctgtgcatctgattgagggaataattgatcaagtggaggggacaattcatgtctcctgggtgcaaccaagagttcttggaattccccaaatcaagtcattgcgtgatcggctagacaattgggtggagaaagttcacactactttgctagcagtagaggctgaaactcctgatttagttgcatcataatcataatcaagcagagactctagcgaaactaaatctagtttcttgggttgtcattgtcccgatttacgtaacaaattcaatgatctcgatgtgtttttaagggaagcaggtgcttgttattgtatttcatttcgtcaggttcataatgacattcctagggaaaacagggagccatgttgtgaaatggctgtactttactgctttagatacttagatcttttatgcactagaatctaaaagaatccagtttctgatggatgttttgcgtcctttgctttctggtttttgaactattcttttgtttgctacgttcctgaacagttaatgaagtggacacgaacaagcttggtgga

SEQ ID NO: 2069 - DNA, 1543 bp, Olea europaea
cctttcacccacgtatataaatcccctccgccttctgtctttccttttatctttccacacttctgtaggtagtcctccataactctctgtagcatatatcggattctgagcacaaaatcgtagtggaagaagcgatggcggctctacagtatctggacatcctgcggagtactcaccctgagctctctgagtggtacaacacgcttgcagatctctaccagcgcaaactctggcaccagctcaccctcaagctggaaaagtttgtcgccctcgccgtctttcaggccggtgatgctctgatacagttgtaccacaatttcataactgacttcgagacgaagatcaatctcctcaagcttgctcattttgctgtcatagtttctcggcagtattcggagaaagaggctgccataaattatcttgaaggagtgattgaaaagctttgtaatactaaagagatgcgcgtagaggagcctattctttatatcaagatgcagattgctagttttaagcttgagcaaggatatcagaaagagtgcaagaaactcttagagaatgggaagactacacttgatagcatgactgacattgacccttctgtgtatgctagctactattgggtttcatctcaatttcataaatctcgtcaagaatttgcagagttctataaaagctctcttctttatttggcttacacttccgtgaagtctctatcagaatcatttaagctggatttggcatttaatttgtccctatctgcattgttgggggaaaacatttacaactttggagaactccttgcacatccaattgtaaaaagcctcatagggactaaggtagaatggctatactatattctggaagcattcaactctggcgacttggttcgttatcaagaattgtgccaggttcatagagctgctctgagctcccaaccagcattagtgcagaatgagaaaaacctactggagaaaattaacattctctgcttgatggagactatcttcagtcgtccatcagaagatagaactattgcattaagtgtcatagctgaagggacaaaacttactgtagaagacgtggagcatcttcttatgaagagcctttcagtgcatctaatcgaaggaattattgatcaggttgagggaacggtttacgtttcctgggttcaacccagagttttggggattcctcagatcaagtcattacgtggccgtctggacaattggatggataaagttcacaccgccttactatctgttgaggcagaaacccctgatttagtcgcagcataattttagttccgctcctggccagaacatcacgtgttctatcaaaaaggagagatgggaaaatttaagattctttggtgcttaattacatatatgcttgcattatcaatttttattttgggaaagtagcaacacatttctcttgtaacattcaaattgtgccatacttgtcttttctactcacagaactgtttttacaaattattgagtagaaaagacaagtatggcacaatttgaatgttacaagagaa

SEQ ID NO: 2070 - DNA, 1396 bp, Capsicum annuum
gcacgaggaccatttctctctctcacacacatacacacagcagtagcagctgctgcttcgtcttcttcatcggagctctttttgttcagctatggcggcactgcaatacttggaatcattttgcaatgcaaatccgcagcttaatgagtggtacactacgctatcagatctgtacaacagaaaactatggcatcaacttactcttaagctcgaacaatttgttcttcttcccctttttcaggcgggtgatggactaatacagttgtatcacaacttcattactgatttcgagacaaagatcaatcttctcaagcttgcacattttgcggttgttgtttctcggcaataccccgagaaagaagccgccatagctttccttgaaggggtgacagagaaacttcataatactaaagagacccggatagaggagccgattctttatattaagatgcagattgccctatttaagcttgagaaaggagatccaaaagagtgccagaaacttttagataaggggaagactacacttgatagcatgactgacattgatccatctgtctatgcaagctattattgggtttcatctcagtaccataaagctcgacaggagtttgccgacttttacaaaagtgctcttctttatctcgcgtacacttcagtggaatctctttctgaatcatttaagctggatttggcttttgatttgtccctgtcagcattgctgggagacaacatatacaacttcggagaactgcttgctcatccgattataaagagtctgatagggactaaggttgagtggctctattatattctagaagcattcaacaccggtgatttggttcactatcaaaaattgtgcaatgtccatcaagctgctttaaatgctcaaccagcattggtgcagaacgagaaaaagcttcttgagaagatcaacattctctgtttgatggaaattatcttcagtcgtccagcagacgatagaactatccccctaagtgtgattgcacagcgcacaaggttaagtgtggaggatgttgaatatctactcatgaagagcctttctgtgcatttgattgagggaataattgatcaagttgaagggacagttcatgtctcgtgggtgcaaccaagagttctgggaattcctcaaatcaagtcattgagggatcggctagacagttgggtggataaagtacacaccgctttgttatccgtggaggctgaaactcctgatctagttgcagcataatcttttacgttcaatagatcccatctctatttcaattttacttcttgccagagagctgagtaacttgggactggtctagttttcatagacctttatttgtatgttctgaaattattgatgatctcaattgaattttttttccct

SEQ ID NO: 2071 - DNA, 1640 bp, Solanum phureja
tagaggtccaatgtaatacaatagagactaaactgaactaacccaaactccattattcatttctttatgaacaagcaaaacacaatttacaagtcaggaatctctctctttcacatacacacacagtagctgcttcgtcttcatcggtgttactgagagagctttttcagccatggcggcacttcagtacttggaatcgttttgcaatgctcattcacagctttccgattggtacactactttggcagatctgtaccagaggaagctctggcatcagcttactcttaagcttgaacagtttgttgctcttcccgtttttcaggctggtgacggactaatacaattgtatcacaacttcatcactgattttgagacaaagatgaatcttctcaagcttgcacattttgcggtcattgtttctcggcaataccccgagaaagaagccgctataggcttccttgaaggagtgacagagaaacttcataatactaaagagatacggatagaggagccaattctttatattaagatgcagattgccctatttaagcttgagcaagaagatccaaaagagtgccagaaacttttagatgaggggaaaacaacacttgatagcatgactgacattgatccatctgtctatgcaagctattattgggtttcatctcagtaccataaaactcgccaggagtttgccgagttctacaaaagtgctcttctttatctcgcgtacacttcagtggaatctctttctgaatcatttaagctggatttggcttttgatctgtccctgtcggcattgctgggagacaacatatacaacttcggagaactgcttgctcatccgatcataaagagtttgatagggactaaggttgagtggctctattatattcttgaagcatttaacactggtgatttggttcactatcaaaaattgtgccatgtccatcaagctgctttaactgctcaaccagcattagtgcagaatgagaaaaagcttctcgagaagatcaacattctctgcttgatggaaattatcttcagtcgcccagcagatgatagaactatccccctgagtgtgattgcagagcgcacaaagttaactgtggaggatgtcgaatatctactcatgaagagcctttctgtgcatctgattgagggaataattgaccaagtcgaagggacagttcatgtgtcctgggtgcaaccaagggttctgggaattcctcaaatcaagtcgctgagggatcggctagacaattgggttgacaaagtacacactgctttgttatccgtggaggctgaaactcctgatctagttgcagcataatctttaactttttttccagtgtcctttatccgtaatagccacctgcacgtacctgtcttctaaaatttacttctcgcagagagctgagaagctagggactgtggtctagttttcataggcctttgtttgtatgtcccggtttatgttgcgaaattattgatctcattggttttatttccccggatagtttcttgttcttgtatttgattacttcttattcagatttcagagttcagactgatgacatccagtgctagacatgaagccaagttgtgaaatgactatatttacaactgttatgtttttg

SEQ ID NO: 2072 - DNA, 1680 bp, Solanum lycopersicum
gtaaactttaggggtccaatgcataatagaatagagactaaactggactaacccaaactccattattgatttctttatgaacaagtaaaacgcaatttacaagtcaggtatctttctctctcacatacacaccacagtatctgcttcgtcttcatcggtgttactgagagagctttttcagctatggcggcacttcagtacttggaatcgttttgcaatgctccttcacagctttccgattggtacactactttggcagatctgtaccagaggaagctatggcatcagcttactcttaagcttgaacagtttgttgctcttcccgtttttaaggctggcgatggactaatacaattgtatcacaacttcatcactgattttgagacaaagatcaatcttctcaaacttgcacaatttgcggtcattgtttctcggcaataccctgagaaagaagccgctataggcttccttgaaggagtgacggagaaacttcataatactaaggagatacggatagaggagccaattctttatattaagatgcagattgccctatttaagcttgagcaaggagatccaaaagagtgccagaaacttttagatgaggggaaaactacacttgatagcatgactgacattgatccatctgtctatgcaagctattattgggtttcatctcagtaccataaaactcgccaggagtttgccgagttctacaaaagtgctcttctttatctcgcgtacacttcggtggaatctctttctgaatcatttaagctggatttggcttttgatttgtccctgtcagcattgctgggagacaacatatacaacttcggagaactgctagctcatccgattataaagagtttgatagggactaaggttgagtggctctattatattcttgaagcatttaacaccggtgatttggttcactatcaaaaattgtgccatgtccatcaagctgctttaactgctcaaccagcattggtgcagaatgagaaaaaacttctcgagaagatcaacattctctgcttgatggaaattatcttcagtcgcccagcatatgatagaactatcccactgagtgtgattgcagagcggacaaagttaagtgtggaggatgtcgaatatctactcatgaagagtctttctgtgcatctgattgagggaataattgaccaagtcgaagggacagtacatgtgtcctgggtgcaaccaagagtcctgggaattcctcaaatcaagtcactgagggatcggctagacaattgggtcgacaaagtacacactgctttgttatccgtggaggctgaaactcctgatctagttgcagcataatcttttacttttttctagtgtcctttatccgtaatagccacctgctcgcacctctcgtctaaaatttacttgttgcagagagctgagaagctagggacttgttggtctagttttcataggcctttgtttgtatgtcccgatttatgttgcgaaattattgatctcattgtttttttttcttccagatagtttcttgtttcttgtatttgattacttcttatttaatttcacagttcagactgatgacacccagtgctagacacaaatattaagttcagggttgttttcaatttattgcgtatattagcttatgaatattttttaattatgacctgt

SEQ ID NO: 2073 - DNA, 1635 bp, Solanum lycopersicum
caatgcataatagaatagagactaaactggactaacccaaactccattattgatttctttatgaacaagtaaaacgcaatttacaagtcaggtatctttctctctcacatacacaccacagtatctgcttcgtcttcatcggtgttactgagagagctttttcagctatggcggcacttcagtacttggaatcgttttgcaatgctccttcacagctttccgattggtacactactttggcagatctgtaccagaggaagctatggcatcagcttactcttaagcttgaacagtttgttgctcttcccgtttttaaggctggcgatggactaatacaattgtatcacaacttcatcactgattttgagacaaagatcaatcttctcaaacttgcacaatttgcggtcattgtttctcggcaataccctgagaaagaagccgctataggcttccttgaaggagtgacggagaaacttcataatactaaggagatacggatagaggagccaattctttatattaagatgcagattgccctatttaagcttgagcaaggagatccaaaagagtgccagaaacttttagatgaggggaaaactacacttgatagcatgactgacattgatccatctgtctatgcaagctattattgggtttcatctcagtaccataaaactcgccaggagtttgccgagttctacaaaagtgctcttctttatctcgcgtacacttcggtggaatctctttctgaatcatttaagctggatttggcttttgatttgtccctgtcagcattgctgggagacaacatatacaacttcggagaactgctagctcatccgattataaagagtttgatagggactaaggttgagtggctctattatattcttgaagcatttaacaccggtgatttggttcactatcaaaaattgtgccatgtccatcaagctgctttaactgctcaaccagcattggtgcagaatgagaaaaaacttctcgagaagatcaacattctctgcttgatggaaattatcttcagtcgcccagcatatgatagaactatcccactgagtgtgattgcagagcgcacaaagttaagtgtggaggatgtcgaatatctactcatgaagagtctttctgtgcatctgattgagggaataattgaccaagtcgaagggacagtacatgtgtcctgggtgcaaccaagagtcctgggaattcctcaaatcaagtcactgagggatcggctagacaattgggtcgacaaagtacacactgctttgttatccgtggaggctgaaactcctgatctagttgcagcataatcttttactttttttctagtgtcctttatccgtaatagccacctgctcgcacctctcgtctaaaatttacttcttgcagagagctgagaagctagggacttgtggtctagttttcataggcctttgtttgtatgtcccgatttatgttgcgaaattattgatctcattgtttttttttcttccagatagtttcttgtttcttgtatttgattacttcttatttaatttcacagttcagactgatgacacccagtgctagacacaaatattaagttcagggttgttttcaatttcttgcgtatattag

SEQ ID NO: 2074 - DNA, 1802 bp, Elaeis guineensis
ggcgaaagaaagaggcgagaaaaacataagaagcggagttagggtttcaaagatttcgtcccggaacgtatcgatctcctctagggtcgggcggaggtcgatccagccatggcgggggctctccagtacttggaatcgcagcggaacgcccagccggaactcgcggactggtacaatgccctggccgacttgtaccagcggaagctctggcaccagctcaccctcaagcttgagcagttcgtggccctagccgtcgttcaggcgggtgatgctctcatacagctatatcataacttcattacggactttgagacaaaaatcaatctcctgaaacttgcacattttgctgtagtagtttcacgtcagtattcagaaaaagaagctgcaattagctatcttgagggtgtaattgagaagctgcatgctacaaaggacttacgaattgaagagcctattttatatgtgaagatgcaaatagctgcatttaatcttgagaaagggaataaaaaggagtgtaagaaacttctagaagaggggaaggccacactagatagcatgactgatgttgatccttcggttcatgctagctattactggatatcttctcaatatcataaatcttgccaggaatttgctgagttttataagagtgcacttctttatatggcatacactacagttgattcactttcagaagcattcaagctggatttggcatttgacctttccctttctgctttgctgggtgataacatatataacttcggggaattgcttgcccatcccattatcaatagtcttcttggaaccaaagtggagtggctttaccatatactccaggcatttaacactggcaatctgattcgctatcaagaactctgccatgttcataatgctgctttgagtgcacagcctgcgttagtagagaatgagaagaagctacttgaaaaaataaatattctttgtttgatggaaatcatctttagccggccatctgaagatcgaaccattccattaagtattattgccgaacgaactagactttctatcgaagatgtggaatatcttctaatgaaaagcctctccgttcatcttatcgaaggcataatagatcaagttgagggcacaattcatgtctcatgggtgcagcctagggttttgggaatcttgcagatcaaatccttgcgcgatcggctggatgcatggataggcaaggtgcatacaactttgttgtcagttgaagcagagacgcctgatctagtggcatcatgatgtgcgaccccgtagcctctcctttacaagctctttgtaacagcttacagcacggaaggaagcagaggaaacattgctgcagcccttgtccgagtcctctctcttttgccttgaatattttttgtgcacgaggggcggcagctgagagctgacctgaggcctgtattttttaaatctttcagaaaactgttagaatttgagatatgcttgcagagacggaggaccatatgtttcaggccagtgaacactttcaagtcagatcatctatttcttttgtgattcagcaatgatgcatgctggacattaatgcaacaaatgctgctcacttattcacactgtttggtcttcataattatttgaatcatttaatttgttgtttacgcatgtgctgcatgatgagaactgaatttggatgtcagctgccatttagtagaaatatggtttatcaggtttttagggattatgaaaatggaatctggtactggataaggcattgttaataaatcggaagaaaacatccctgccatgtt

SEQ ID NO: 2075 - DNA, 1566 bp, Amsonia hubrichtii
aagagaggttttataatagagattttcccaaagacgaaacgacattaacaagaacccccttcccctccatcaaagctcgctttctctctctctctcagcgttagcagtagccatggcggcactacagtatctagattctctccggaatgcccatccagagctctccgattggtacaataccctcgcagatctgtaccagcgcaagctctggcatcagctcactcagaagctcgagcaattcgtcgctctcgccgtctttcaggctggtgatgctctaatccagttctatcataatttcattgctgattttgagacaaaaatcaaccttctcaagcttgcacacttcgctgtcatagtatctcggcagtatgcagagaaagaagctgcaattagctaccttgaaggggtgattgaaaagcttcgtaataccagggagttgcgtatagaggagccaatcctttatattaagatgcagatggcttatcttaagcttcagcaaggggatcaaaaagagtgcaaaaagcttttagaagagggaaagagtacccttgatagcatgactgatattgatccttctgtgtatgccagttattattgggtttcatctcaataccataaagctcgtcaggagtttgcggagttctacaaaagtgcacttctttttctggcctacacttcagttgagtctttatctgactcattcaagctggacttggcctttgacctgtccctttcagcgctgcttggggagaacatctacaattttggggaattacttgcacacccaattataaaaagccttctagggactaaggttgaatggctctactacattcttgaagcatttaatagtggtgatttagttcgctatcaagaattatgcaatgttcaccgagcagctctgagttctcaaccagcactagtgcagaatgagaacaagcttctggagaaaatcaatattctctgcttgatggaaatcatcttcagtcggccatcagaggacagaaccattccattaagagttatttctgagcgcaccaaactctctgtggaaaatgtggagtatctcctcatgaagagcctttctgtccatttgattgagggaataattgatcaagtcgaaggaacagtccatgtctcatgggtacaacctagagtcttggggatatctcagatcaagtcattgcgcgaccgcttggataactgggtggataaagtacagactgctttggtatctgttgagtccgaggcacctgatctagttgcttcatgatggatgtagtcactgatgtaaactgtcgcatgtaacatacactgcccaatttgagctgaaaatgagagagagatgatttctttagttgcttgggcctgtttccgttgcacatcacattgattcggtagtacaatgttttttttttttacgtttcttggaagtaggccgttttctggtactctttactactatttaattcttagtgacatggctaggtgcaattagccttatatatggacggcttttaccattctgagaatgtttcattggacaacatatactccaacccttta

SEQ ID NO: 2076 - DNA, 1492 bp, Catharanthus roseus
gcaaccatggcggcactacagtatctagattctctccggaatacccatccagagctcgccgattggtacaataccctcgcagatctgtaccagcgcaagctctggcatcagcttactcagaagctcgagcaatttgtcgctcttgccgtctttcaggctggcgatgctcttatccagttctatcataacttcattgctgactttgagacaaaaatcaatcttctcaagcttgcacattttgctgtcatagtgtctcggcggtatgcagagaaagaagctgcaattagctaccttgaaggtgtgattgaaaagctccgtaatacaagggagttgcgaattgaggagccaatcctttacattaagttgcagatggcttatcttaagcttcagcaaggggatgaaaaagagtgcaaaaaacttttggaggagggaaagagtacccttgatagcatgactgatattgatccttctgtgtatgccagttattattgggtttcatcacaataccataaatctcgacaggagtttgcggagttctacaaaagtgcacttcttttcctggcctacacttcagtcgagtcgttatctgaatcattcaagctggacttggcctttgatttgtccctttcggcactgcttggagagaacatctacaattttggggaattactttcacatccaattataaaaagtcttttagggagtaaggttgaatggctctactacattcttgaagcttttaacgctggtgatttagttcgctatcaagaattatgcaatgttcaccaagcagctctgagttctcaaccagcactggtgcagaatgagagcaagcttctcgagaaaatcaatattctatgcttgatggaaatcatcttcagtcgaccttcagaggacagaaccattccattgagtgttatttctgagcgtaccaaactttctgttgaaaatgtggagtatctcctcatgaagagcctttcggtccatttaattgagggaataattgatcaagttgaaggaaccgtccatgtctcgtgggtgcaaccaagagtgttgggaatatctcagatcaagtctttgcgtgaccgtttggacagctgggtggataaagtacagactgctttggtatcagttgagtctgaggctcctgatctggttgcttcgtaagggatttgtagattcactgatgtaaaactagtggcatgtaacaatagtgcccaaatttctagtgtttgagctgaaaatagagagaaagatgatttccttaattagctgggcctgtttttggttagtcgtctttcattgttacattactactgtctctctctctctctctctcgctctgccttgacctgtttttgattctcctgaagtagtctgttttgggcactttttagtacttttttttatcgttagttatgtggttaggtttacctatgtggacgaaaacatttttaagattatgggaattccttactgaacattatacttc

SEQ ID NO: 2077 - DNA, 1485 bp, Aquilegia formosa
aacaaagttgttgaattgaatctacacttctctgtaacttgtggtggaagtggagatggcaggtttacagtacttggaatctcagcgtaacgcacaaccagaactagcagaatggtacaacagtttggctgatttgtatcaaagaaagctttggcatcaactcactctcaagcttgatcagttcgttgctcttgctgtcttccaggctggtgatgctttaatacaattgtacaacaatttcatcactgaattcgagactaagatcaatcttcttaagcttgcgcattttgctgttatagtttctcgacagtatgcagaaagagaatcagcatttagctatcttgaaggtgtgattgaaaagcttcaagctacgaaggaattgcgtatagaggagccaatcctttatgtcaagttgcagatagctgcattcaaacttgagaaaggggaccaaaaagagtgcaaaaagatcttggatgatggcaagactacacttgacagcatgaccgatgttgatccatcagtttatgcaagcttccactgggtttcatctcaataccataaatttcatcgagaattctcagagttttatagaagttctcttctttatctggcctacacatcagtggagtctctttctgatacatttaaattggatttggcatttgatctttctctgtctgctttgctgggggataatatttacaacttcggagaattgctttcacatccaattattaaaagccttcttggaactaaggtggagtggatctattatatcctccaggcattcaatgccggtgatttagttcgctataaagaactctgttctgttcacaaagctgcacttgtatctcagccagcattggtagaaaatgagaagaagctgttggaaaagattaacattctgtgtctgatggagatcatctttagccgtccttcggaggaccgaaccattccgttaaatgtcattgcagagcgaactaaactttctgtagaggacgtggaatatcttctcatgaagagcctttctgttcatcttattgaggggataattgatcaagttgagggaacagttcatgtttcctgggtgcaaccaagggttctgggcataccccaggtcaaatccctgcgtgatagactggacaactggctggacaaagtacacactgctttgttatctgttgaggcagagacacctgatctagttgcatcatgattttattatccattgctctcttttcttgccctgtaacgattcaagtagcttaaaatccaaaggataactgaaggaaaagaattttgaattctttgacattgggaccaggcttgcaaaattggtcgtctgacccttagttcgtgtagcccagaattgaatagtttcaccgcagtttgtttttgtttttgtgtgttgtcttttattttattttatcttttctatgataaagatggttaattatcttatatgtagcccagaattgaataggt

SEQ ID NO: 2078 - DNA, 1375 bp, Olea europaea
acactatacgtatatctctctgtctatacaaaatcagattcatacgcagtagtggaaggaacaggaaaaatggcggcttttgagtacctagagtcccttcgtaatgcgcatccggagctttcggagtggtacaacacgcttgcagatctgtaccagcggaagctctggcaccagctcacgctcaagcttgaacagttcgttgcccttcctgtctttcaggctggcgatgctctcatacaattgtacaataatttcataactgattttgagacaaagatcaatcttctgaagcttgcacattttgcggtcgtagtatctcggcagtacacagagaaagatgctgctattaattatcttcaaggaataattgaaaagctacgcaatacaaaggagatgcgcattgaggaaccgattctttatatcaagatgcagattgctgtatataagcttgagcaagaagataaaaaagagtgccaaaatcttttagaagatggaaagagtacacttgacagcatgactgacatcgatccatctgtgtatgcttgctattattggatttcctctcaataccataaatctcgtcaagaatttgcagagttctacaaaaatgctctcctctatctagcttacacctcagtacagtcgctatcggaatcatttaagctggatttggcatttgatttagccctgtcagcactgttaggggaaaacatttacaattttggagaacttcttgcgcatcccattataaaaagtcttctaggaaccaaggttgagtggctgtactacattctcgaagcattcaactctggtgatttagttcgttatcaagaactatgccgtgtccatggagctgctttgagtgctcaaccagcattagtacagaatgataaaaagcttctggaaaagatcaacatcctttgcctgatggaaatcatcttcagtcggccatcagaagacagaactattccgttaagtgtgattgccaagcgaacaaaacttactgtagaagatgtggagtatctgcttatgaagagcctttcagttcatctgatcgaggggattatcgatcaagtcgaggaaacagttcatgtgtcgtgggttcaacctagagttttggggattcctcaaatcaagtcattgcgtgaccggttggttaattggatggataaagtacacactgctttgctatctgttgaggcagaaacaccagatcttgttgctgcataattttagacacaaaatttgctgatttatatgagcatttctcaaaagcgatgctacgttaaagtaagacagcttgtagaagacattcaagaatttgtctatcctttccacattttctcgacttgtcttattaggagcatgtttgagt

SEQ ID NO: 2079 - DNA, 1818 bp, Picea glauca
acgcgaatggtaaaggtgaagattaaaagcctaaggggacgaaagcttttagcttttgtacaaggcttacgccagtcttcgaaggcaggtataaacagtagttagttaatgctcagaggaacgaacaggaagggtttcagagaatccatatcccagcattttgcgtttgtttggggtttttctttgcggatctgcctttgttaaatggctgctcttaagtatctggaaacgcagagggcggctcagcccgagttagccgaatggtacaattcattggcggatctctacgagcgcaagctatggcaccaactcactctcaagctcgagcagttcgtcgccctcgcagtttttcaggctggtgatgcgcttatccaattatatcataattttataacagattttgagacaaagatcaatctgctcaagcttgcacattttgctgtgatagtttctcgtcagtacacagaaagggaagctgctatcagctacttagagggagtaatcgagaagcttcgtgccacaagggatatacgacttgaggaaccgatactatatgttagaatgcaaatagctgcattgaaacttgaacaaagtgaacaaaaagaatgtaaaaagctactggatgatggtaaaaatacattggacagtatgactgatatagatccttctgtttatgcaagctaccattgggtctcatctcagtatcacaagtcgagacaagaatttgctgagttttataaaagtgcacttctctttctggcttatactactgtagagtctctttccgaaccatttaagctggatttagcgtttgacttgtctcttgctgcattactcggagataacatatacaactttggagaactgttggcacatccaattgtgaagagtcttctgggtacgagtgtagagtggttgtattatattttacaagcatttaatgctggtgacctagcccgatatcaagaactttgtcatgttcatagggctgccctcaatgcacaaccagcactcgtagagaatgagaaaaagttgctggaaaagattaatatcttatgcttgatggagatcatatttagccgtccttcagaagataggacagtcccactgagtatcattgcagaccgaactaaattatcaattgaagatgtagagtatctgctcatgaaaagcctttctgttcatttaattgaaggggttattgaccaagttgatggtactgtgcatgtatcttgggtacagcctagagtgctgggaataccccagatcaaatccttaagggacaagcttgacaactggctgcagaaagtccacacaactctgttggctgttgaagctgaaaccccagatttagtggcatcatgactgaaaagtaagcatagactcgaaggcatcaaatgaaaagcatggccattttaaattgacaattggcagttagtcatcttccatggagatgctataattcaacctcatcatttcagcagtctggattattgttgttagattttcaaggatagtaacttgtacctttctttgaggccaaagaattcatgcagcaatgtgtcccaacagagcatatgttttcagcactgtcaagaaagaagactcagtttgctgatttttgtagggatagaatctattactttactggccactaatatttaaccaagatgggtaaagtccctcgtttgtgtgttgaatttcaatttgataacagatgtaatatttgggaacaaatattattctgtagctgttaaataatttgaggatatttaatgctactcctaattagctctatatttttggaagcaaaagatc

SEQ ID NO: 2080 - DNA, 1610 bp, Amorphophallus konjac
cagttctggtttcgccggcggctctccggcgacaaagtgcgaagcagcctcgctccttctctccttcctccgcggtggatccaacagacggggtcgtcgatggcgggggcgctacagtacttggagtcgcagaggaacgcgcagccggagctggccgagtggtacagcacgcttgcggacctctaccagaggaagctatggcaccagctgaccttgaagctggagaagttcgtcgccctcgcggtcgtccaggctggggatgaactcattcaattatatcataacttcatcaccgacttcgagatgaagataaatcttctgaagcttgcacactttgctgtgattgtctctcgccaatactcagaaaaagatgctgcaattagctaccttgaaggagtgattgaaaaacttcgtgccactagggagctgcggatagaggagcctattctctatgtgaagatgcaaatagctacgtttaatctcgagaaaggtgaccaaaaggagtgcaaaaaactcctagaagatggaaagtccacattggatagcatgactgatattgacccttctgtacatgctagctattactgggtatcttctcagtatcacaagtcccgccaagaatttgcagagttctataaaaatgctcttctttacttggcatacactaccgtggaatctctttctgagacatttaaactggacttggcatttgacctgtctctgtctgctctcttgggtgataatatatataactttggagaacttttggcgcatccaattattaacagtctgcttggaaccaatgttgagtggctatactatatactccaggcatttaacaccggcaacttagttcgctatcaggaactctgccgtgttcataatgctgctctgagtgcccaaccttcattggtacaaaatgagaagaagctattggagaaaattaacattctttgcttgatggagatcatcttcagtcgcccctctgaagaccgaaccataccactgagtgccattgctgaacgtactagcctttccattgaagatgtggaatatcttcttatgaaaagtctttctgttcatcttattgaaggtgtaattaatcaagttgaaggaacggtccatgtctcatgggttcagccaagagttttgggtatcccacagataaaagccttacgtgatcggcttgatgactggttaaacaaggtgcacactgctttgcgatctgttgaagcagagacacctgatctagcagaatcgtagatctgtgttcctgggcttgctcttacatgtcctctgtaacaatctagcgcttggagacgagggaaaatttgctgtggcactagggttgggctttatttgttttggcatattttccttgataattttgtgcacaaagcggctgcttattgctggctaagccctgtatttgttaattcttcatatagtgctggtccttgagaccgagaggtgattagtttccgggatggctgctttcagtgtagtctacagttaaaaagaacttgtcagtgcttgtaagccggcactttgtgtttgacaaattcatcgggaggagaccagcctgttatctgctagaacatttttttgat

SEQ ID NO: 2081 - DNA, 1775 bp, Pseudotsuga menziesii
gccaagaggacgaaagcttctatcttttgtatgaagcctgtgccaacttacaaggcagggataaacagtagttcgttattactcagaggaacgaacaggaagggtttcagagaatccacatcccagcattttgcgtttgtttgagggttttcttggcggatctacctttgtgaaatggctgctctcaagtatctggaaacgcagagggcgtctcagcccgagctgtccgaatggtacaattcattggctgatctctacgagcgcaagctgtggcatcaactcactctcaagctcgagcagttcgttgccctcgcagtttttcaggctggtgatgcgcttatccaactatatcataattttataacagattttgagacaaagatcaatcttcttaagcttgcacattttgctgttatagtttctcgtcagtacacagaaagggaagctgctatcagctacttagagggagtaattgagaagcttcgtgccacaagggatatgcgaattgaggaaccaatactatatgttagaatgcaaatagctgcattgaagcttgaacaaactgaacagaaagaatgtaaaaagctactagatgatggcaaacttacactggacagtatgactgatatcgatccttctgtttatgcaagataccattgggtctcttctcagtatcataagtcgagacaagaatttgctgagttttataaaagtgcacttctctttttggcttatactactgtagagtctctttcggaaccatttaagctggatttagcatttgacttgtcccttgctgcattacttggagataacatatacaactttggagaactgttggcacatccaatcgtgaagagtcttctgggaacaagtgtagagtggctatattatattttacaagcatttaatgctggtgatctagcccgatatcaagaactatgtcatgttcacagggatgcactcaatgcacagcctgcacttgtagagaatgagaaaaagttgcttgaaaagattaatatcttatgcttgatggagatcatatttagccgtccttcagaagacaggacagtcccactgagtatcattgcagaccgaactaaattatcaattgaagatgtagagtatctcctcatgaaaagcctttctgttcatttaattgaaggggttattgatcaagttgatagtactgtgcatgtatcttgggtgcagcctagagtgctgggaataccacagataaaatccctaagggacaagcttgacaattggctgcagaaagtccatacgactctgttggctgttgaagctgaaaccccagatttagtggcatcatgattggaaagtatagactcgggcaccgaatgaaagcatgtccattacaaattgcctattgtcaatgagttatcttccatggagatgctataatttaaagtcatcatttcagcagtctggataattgttgttagcttttcgaggataggaacttgtaccttgctttgaggccagagaattcatgcggcagtgtgtctcaacagagcatatgttttcagcatattgtcaagaaagaagacccagttagctgatttatgtagggatagaatctgttactttgctggccactaatctttcattgagatgggtaaagtccctcttttgtgttgaatttcaatttgataagagatgtaatatttgaaagcaaacattattctgtagctgttaaataattaaagaatttaaatgttagtcttacttagttttataattttgaaagcaaa

SEQ ID NO: 2082 - DNA, 1447 bp, Silene vulgaris
agaaagagaaagagtgcaaaggaagaagacgaagatgtcggccatggaatacttggagacacagaggaactcgcatcctgaacttgctgaatggtacaatgttatttcagatctgtatcagaaaaagctatggcatcagcttactcttaagcttgataacttcctttctctctcccttttccagtccggagattccctcatacagctatatcacaacttcatcactgactttgagacaaagataaaccctcttaagcttgcacattttgcggtcatagtatcccgacaatatggggagaaagaggcagctgttggttatcttgaagggataatcgaaaagcttcgtgctacaaaagagactcgcattgaagagccaatcctttacataaaaatgcaaatatctttatttaagcttgagcaaggggaacacaaagaatgcaagaaacttttggaagatggaaaaaccacactcgatagcatgactgatattgatccatctgtttatgctacctttttttgggtttcttctcagtatcataagtcacgccaagaatttgctgaattctacaagaatgctcttctttatcttgcttacacttcagtggaatctctttctgactcattcaagctggatctggcttttgatttatcattatctgcactactgggagaaaacatctacaactttggggagctacttgcgcatccgattttaaggtctcttcttgggacaaaggtcgagtggctttactatatccttcaagcgtttaacagtggtgatttggttcggtatcaagagttatgcaatgtccacaaggatgctctgaatgcccaaccagcacttgttgctaacgagaggaagcttttggagaagataaatattctatgcttgatggagatcatctttagccgtcctgctgaagaccgaacaattccattgagcgtgatagctgagcgcactaagctatctactgaagatgtggaataccttctcatgaagagcctctctgttcacttgatcgagggaatcattgatcaagtagaggggacggttcatgtgtcatgggtgcaaccaagagtattgggagtttctcaaatcaagtccctccgtgatcgattggacagttgggtcggtaaagtgcatacggcattgttgtcagttgaagcggagacacctgacctagtcgcatcatgagtctagttcttaggtgtgtcgtatgttgcttttgtacttgatttcgtccttctcgttagcgttccccaacttttattgaacaaattttctgctagtaaatcatcttcttactagtttccggctgcttttgcttgctttgccatttagatttacaagtgccgatgagtacttttaaaaattttgaagttatggatacgaatctgtatttctatgaatttacagtcactgcttttcatgttaattttcccccgg

SEQ ID NO: 2083 - DNA, 1778 bp, Abies balsamea
agtggacgaaagcgtttagcttttgtatgaagcttagaccgaattcacaggcatatataacagtagttatacacggaggaacgaacaggaagggtttcagagaatccatatcccagcattttgcgtttgtttgagggctttctttgcggatctgcgtttaagagacagtaagatggctgccctcaagtatctggaaacacagagggcggctcagcccgagctggccgaatggtacaattcattggctgatctctacgagcgcaaactgtggcaccaactcactctcaagctcgagcagttcgttgccctcgcagtttttcaggctggtgacgcacttatccaactatatcataattttattacagattttgagacaaagatcaatctgcttaagcttggacactttgctgttatagtttctcgtcagtacacagaaagggaagctgctatcagctacttagagggagtaatagagaagcttcgtgccacaagggatatgcgaattgaggaaccaatactgtatgttagaatgcaaatagctgcattgaaacttgaacaaggtgaacagaaagaatgtaaaaggctactagatgacggcaaaactacactggacagtatgactgatatagatccttctgtttatgcaagctaccattgggtctcatgtcagtaccataaatcaaggcaagaatttgctgagttttataaaagtgcacttctctttctggcttatactactgtggagtctctttcggaaccatttaaactggatttagcgtttgacttgtctcttgctgcactacttggtgataacatatacaactttggagaactgttggcacatccaattgtgaaaagtcttttgggaacgagtgtagaatggctatattatattttacaagcatttaatgctggtgacctagcccgatatcaagaactttgtcatgttcatatggctgccctcaatgcacaaccagcccttgtagagaatgagaaaaagttgctggaaaagattaatatcttatgcttgatggagatcatatttagccgtccttcagaagataggacagtcccactgagtatcattgcagaccgaactaaattatcaattgaagatgtagagtatctcctcatgaaaagcctttctgttcatttaattgaaggggttattgaccaagttgatggtaccgtgcatgtatcttgggtacagcctagagtgctgggaataccccagatcaaatccttgagggataagcttgacaactggctgcacaaagtacacagtactctgttggctgttgaagctgaaaccccagatttagtggcatcatgagtggaaagtgagcattagactcgggcatcgaatgaaagcatggcccttttaaattgataattgtcaatttgtcatcttccatggagatgctataattcaacctcaacatttcagcagtctggataattgttgttaacttttcaaggatagtaacttgtacctttctttgaggtcagagaattcatgcagcaatgtgtgacccaatagagcatatgttttcagcactgtcaagaaagaagactcagttagctgatttttgtagggatagaatctgttactttgctggccactaatctttcactgagatgggtaaagtctctcttttgtgtgttgaatttcaatttgataagagatgtaatattagggaacaaatatcattctgtagctgttaaataatgtaagtactaaggacatttaatgttagtcttaattagctctatatttt

SEQ ID NO: 2084 - DNA, 1589 bp, Nicotiana benthamiana
gaaagaggttttagttttctctctcgtacacacacacatcgctgctgcttcgtcttgcctcgagtttttcagccatggcggctttacagtatttagaatcagtttgcaatgccaatccagagctctccgattggtacactacgctatcagatctgtaccaaagaaagctctggcaccagcttacgctcaagcttgaccagttcgtttcacttcccctttttcaggctggtgacccactaatacagttgtatgacaacttcatcactgattttgagacaaagatcaatcttctcaagcttgcacattttgcggtcattgtttctcggcaataccccgagaaagaggctgctataggttaccttgaaggagtgactgagaaacttcgtaatactaaagagacacggatagaggagccgattctttatattaagatgcagattgccctgtttaagcttgagcaaggggatcaaaaagagtgccagaaacttttagatgaagggaagactgcacttgacagtatgactgacattgatccatctgtttatgcgagctattattgggtttcatctcagtatcataaagctcgccaggacttcgctgagttctacaagagttctcttctttatcttgcttacacttcagtggaatctctttctgaatcatttaagctggatttggctttcgatttgtccctgtcagcattgctgggagacaacatatacaactttggagaactacttgctcatccaattatacagagtctggtagggactaaggttgagtggctctattatattcttgaagcctttaacaccggtgatttggttcgctaccaacaattatgccatgtccatcaagctgctttgagtgctcaaccagcattggtgcagaacgagaaaaggcttctcgagaaggtcaacattctctgcttgatggaaattatcttcagtcgcccagcagacgatagaactatccctctgagtgtgattgcagagcgcacaaagttaagcgtggaggatgtagagtatctactcatgaagagcctttctgttcatctcattgagggaataattgatcaagtcgaaggtacagttcatgtctcctgggtgcaaccaagagttttgggaattccccaaatcaagtcattgagggatcggctagacaattgggtggacaaagtacacacagctttgttatctgtggaggctgaaactcctgatttagttgctacataatccttgggtttcccatttttctttcagatctctgtaatagccccgcctcatctttatatttgttttgcttccgaaaagagctggttatacagttgagaaactagggacactgttctagtactcttaggcgtttccttttatgtcccgattttagcttgagatattattgatctcattgaatttttcccccagatagctggttgttcttgtattcgattaccagagttcatagcgatgaaattcaacggggataactggagccaagttgtgaaatggcttgtttttacgattgttagaattttttatttcctggacattcttttgcactaccactaacagagccaatagtatgtg

SEQ ID NO: 2085 - DNA, 1430 bp, Vinca minor
tcccaagccccttctcctttttcaaccctctctcagaatcagcagaggagctctcccatggcggcactacagtatctagattctctccggaattcccatccagagctctccgaatggtacaattccctcgcagatctataccaacgcaagctctggcatcaacttactcagaagctcgaccaattcgttgctctcgccgtctttcaggccggcgatgccctaatccagttttaccataatttcattgcggattttgagacaaaaatcaacctcctcaagcttgcacactttgctgtcatagtatctcgacagtatgcagagaaagaagctgcaattagctaccttgaagccgtgattgagaagcttcgtaatacgagggagttgcgcatagaggagccaatcctttacatcaagatgcagatggcttaccttaaacttcagcaaggggatccaaaagagtccaaaaagctcttagaagagggaaagagtacccttgatagcatgactgatattgatccttctgtgtatgctagttattattgggtttcatctcaatactataaatctcgtcaggagtttgcagagttctacaaaagtgcgcttctttttctggcctacacttcagtggaatctttatctgaatcattcaagatggacttggcctttgatttgtccctttcggcactgcttggagaaaacatctacaattttggggaattacttgcacatccaattataaagagtcttacagggagtaaagttgaatggctctactatattcttgaagctttttaatgctggtgatttaattcgttatcaagaattatgcaatgttcatcgagcagctttgacctctcaaccagcactagtgcaaaatgagaataagcttctggaaaaaatcaacattctctgcttgatggaaatcattttcagtcgaccatcggaagacagaactattccattgagtgtaatctctgagcgcaccaaacttgctgtggaagatgttgagtatctcctcatgaagagcctttctgtccatctaattgagggaattatagatcaagttgaaggaaccgtccatgtctcgtgggtgcaaccaagagtcctggggatatctcagatcaagtcattgcgtgaccgcttggataactgggtggacaaggtgcagacagctttggtatctgtcgagtctgaggctcctgatctggttgcttcatgagggatgtagtcacccatgtgtaaactgtcaactgtcgcatgtaacacacatttgttttttttccttctgattttggttctctagaggtagtctgtttctggtactctttaatacttttttatttttttaaatttttattattagtgatatggctaggtgcaattagccagtatgcgacggcttttactgtcctgagaataccttactagac

SEQ ID NO: 2086 - DNA, 1847 bp, Pinus pinaster
tctttacaagaagatggtcgaaatggttgttgctgccacgcgaatgctaaaaggtaaaggttaaagccgaggggacgaaagcttttagttttggtgtaaggcttatggcgagatcgaaggcaggtactaacagttagttaattttcagaggaacgggccgcgaaggggttagagaattcacatcccggcattctgcgtttgttcaaggcttttctttgcggatctacgtttgtaaaatggccgctctcaagtatctggaaacgcagagggcagcccagcccgaactggccgaatggtacaatgcattggctgatctctacgagcgcaagttgtggcaccaactcactctcaagctcgaacagttcgtagccctcgcagtttttcaggctggtgatgcgcttatccaactatatcacaattttataacagattttgagacgaagatcaatctgcttaagcttgcacattttgctgttattgtttctcgtcagtacacagaaagggaagctgctatcagctacttagagggagtaatcgagaagcttcgtgccacaagggatacacgaattgaggaaccaatactatatgttagaatgcaaatagctgcattaaaacttgaacaaagtgaacagaaagaatgtaaaaagctactagatgagggcaaacatacactggacagtatgactgatatagatccttctgtttatgcaagctaccattgggtctcatctcagtatcataagtcgagacaagaatttgctgagttttataaaagtgctcttctgtttctggcttatactactgtagagtctctttcagaaccgttcaagctggatttagcatttgacttgtctcttgctgcattacttggagataacatatacaactttggagaactgttggcacatccaattgtgaagagtcttctgggtacgagtgtagagtggctatattatattttacaagcatttaatgctggtgacttagctcggtatcaagaactatgtcatgttcatagggatgctctcaatgcacaaccggcgcttgtagagaatgagaaaaagttgctggaaaagattaatatcctatgcttgatggagatcatatttagccgtccttcagaagatagaacagtcccactgagtatcattgcagaccgaaccaaattatcaattgaagatgttgagtatctcctcatgaaaagcctttctgttcatttaattgaaggggttattgaccaagttgatgcgactgtgcatgtatcttgggtacagcctagagtgctgggaataccccagatcaaatccttaagggataagcttgacaattggctgcaaaaagtccacacaactctgttggctgttgaagctgaaaccccagatttagtggcatcatgattgaaaagtaaagcgtagacgaaggcatcaaatgaaagcatggccattttaagttgttgacaattgtcaatgagtcttccatggagatgcgataatttaaccccatcttttcagccgtctgcattattgttgttagcttttcaaagatagtaatttgtgcctttctttgaggtcagagaattcatgcagcaatttgtcctaacagagcatttgttttcagcactgtcaaagaaagactcagtttgctgatttttgtagggatcgaatctgtaactttgctggccatgaatatttcactgagatcagtatagtccatcttttgtgtgtttgaatttcaatttgataagagatgtaatatttgggaacgaatattattctgtagctgctaataattccaggatatttaatgctactccttattagttttatattttaggaattaaaaatctt

SEQ ID NO: 2087 - DNA, 1827 bp, Papaver somniferum
attcgaggtttcctctccttaaaagtaaagtcacaatcatcataactcacccaaaacctttcaatctcctcctccgataagcaacagcagccatggcagctctgcaatacctagaatctcaacgtagttctcagccagaacttgctgaatggtataccagtttgattgatttgtatcagaagaagttatggcatcaacttactcttaagcttgatcagttcgtcgctcttgccgtctttcaggcgggtgatactttgatacagttgtatcacaatttcatcactgagttcgagactaagatcaatcttctcaagcttgcccattttgctgttatagtgtctcggcagtatgcagaaaaagaagcttccattggttatcttgagggaattattgagaagctgcgcgcaaccagagaaacacgtatagaggagcctattctctacataaagatgcagattgctgccttcagacttgagaaaggagagcaaaaggagtgcaagaatcttttggatgacgggaaaactacactcgatagcatgactgatatagacccctctgtttatgcaagctactactgggtttcatctcagtatcataagtcacgtcaggaatttgctgagttttataacagtggtcttctttatttagcgtacactcccgtggagtccctctctgaaacattcaagctggacctggcattcgacttatcccttgctgccttgcttggtgataacatatataattttggggagctgcttgcacaccccataataaaaagccttttgggtactaaggtggaatggctatactatctccttcaagccttcaactctggtgatttagttcgatatcaagaactgtgtgctgtccacaaggctgctttgaacgctcaacctgcattggtacaaaacgagaagaagctactggaaaagattaacattctttgcttgatggaaatcattttcagccgccccgcagaggatcgaacaattccattgagcattattgctgagcgcactaaactttctgtggaggatgtggagcttcttctcatgaagagcttatctgttcatctcattgaaggaataatcgatcaagtggaggcaacggttcatgtctcatgggtgcagccgagagtactgggtatcacccagatcgaatccttgagggctaggttggacagttgggtaggcaaagtgcatgaagctttaaaatcagtggaggccgaaacacctgatcttgttgcatcttgaattgatttttttttgttaaaatttctctctttccaatgacctgtgtaacaatcttaagatatatcttgaaagtgaaggaaagagtcctcccctgagtcctgactatggagtctgaaggatgacttcctcttttggcctcttttggttctttcttgttctggaaggtggtagccattgttttttaattagaatctcaacaacagcatttggatatattgtgagctaagcatcaaacagcgtcatgttgtagtgcagttagttttccttgatatatcttcagaaagtgtgctttgtgttacaatgagaaattgattcagtgtgcggacccaatgccttagtatctaaaggggtgttcccatgctgggtagataagggcaagggggaaaaaatgctccagtgccgttttttagctgtctgtggctgggagttggaggctgtatgtcttgtgtgcgttgttgtttaggtttactttaggccttaaatcttttcctttttgatgcacttgttcggtgtttttccctatgtagctctcttttttccttgaacaatatctgaactttcatatatacattcc

SEQ ID NO: 2088 - DNA, 1460 bp, Papaver somniferum
caatctcctcctccgataagcaatagcagccatggcagctctgcaatacctagaatctcaacgtagtgctcaaccagaacttgctgaatggtataccagtttgattgatttgtatcagaagaagttatggcatcaacttactcttaagcttgatcagttcgtcgctcttgccgtctttcaggcgggtgatactttaatacagttgtatcacaatttcatcaccgagttcgagactaagatcaatcttctcaagcttgcccattttgctgttatagtgtctcggcaatatgcagagaaagaagctgccattggttatcttgagggaattattgagaagctgcgtgcaaccagagaaacacgtatagaggaacccgttctctatataaagatgcagattgctgccttcagacttgagaaaggagagcaaaaagagtgcaagaatcttttagatgacgggaagactacactcgatagcatgactgatatagatccctctgtttatgcaagctactactgggtttcgtctcagtatcataagtcacgtcaggaatttgctgagttttacaacagcggccttctttatttagcatacactcccgtggagtccctctctgaaacattcaagctggacctggcattcgacttatcccttgctgccttgcttggtgataacatatataactttggggagctgctcgcacaccccataataaaaagccttttggggactaaggtggaatggctatactatctcctccaggccttcaactccggtgatttagttcgatatcaagaactctgtgctgtccacaaggctgctttgaatgctcaacctgcattggtacaaaacgagaagaagctactggaaaagatcaacattctttgcttgatggaaatcattttcagccgccccgcggaggatcgaacaattccattgcgcattattgctgagcgcacaaaactttctgtggaggatgtggaacttcttctcatgaagagcttatctgttcatctcattgaaggaataatcgatcaggtggaggcaacggtacatgtctcatgggtgcagccaagagtactgggtatctcccagatcgaatccttgagggctaggttggacagttgggtaggcaaagtgcacactgctttacaatcagtggaggctgaaacacctgatcttgttgcatcttgagttgatttttgtttgttaaaatttctctttccaatgaccttgtgtaacaatttaagatatatcttgaaaagtgaaggaaagagtcctcccctgacgatggatgacttcctcttttggcctcttttggttctttcttgttctggaaggtgttggccattgtttttttaattagaatcttaacaacagcatttggatatattgtgagctaagcatcgaacggcgtcattttgtagtgtagttaattttctttattatatcttcagaaagt

SEQ ID NO: 2089 - DNA, 2144 bp, Pinus taeda
cggccggggacgcgaatgctaaaaggtaaaggttaaagccgaggggacgaaagcttttagttttggtataaggcctatggcgagatcgaaggcaggtactaacagttagttaattttcagaggaacgggtcgcgaaggggtcagagaattcacatcccggcagtctgcgtttgtttaaggcttttctttgcggatctacgtttgtaaaatggccgcgctcaagtatctggaaacgcagagggcagcccagcccgaactggccgaatggtacaatgcattggctgatctctacgagcgcaagctgtggcaccaactcactctcaagctcgaacagttcgtagccctcgcagtttttcaggctggtgatgcacttatccaactatatcacaattttataacagattttgagacgaagatcagtctgcttaagcttgcacattttgctgttattgtttctcgtcagtacacagaaagggaagctgctatcagctacttagagggagtaatcgagaagcttcgagccacaagggatacacgaattgaggaaccaatactatatgttagaatgcaaatagctgcattaaaacttgaacaaagtgaacagaaagaatgcaaaaagctactagatgagggcaaacatacactggatagtatgactgatatagatccttctgtttatgcaagctaccattgggtctcatctcagtatcataagtcgagacaagaatttgctgagttttataaaagtgctcttctgtttctggcttatactactgtagagtctctttcggaaccgttcaagctggatttagcatttgacttgtctcttgctgcattgcttggagataacatatacaactttggagaactgttggcacatccaattgtgaagagtcttctgggtacgagtgtagagtggctatattatattttacaagcatttaatgctggtgacttagctcggtatcaagaactatgtcatgttcatagggatgctctcaatgcacaaccggcgcttgtagagaatgagaaaaagttgctggaaaagattaatatcctatgcttgatggagatcatatttagccgtccttcagaagatagaacagtcccactgagtatcattgcagaccgaaccaaattatcaattgaagatgttgagtatctcctcatgaaaagcctttctgttcatttaattgaaggggttattgaccaagttgatgcgactgtgcatgtatcttgggtacagcctagagtgctgggaataccccagatcaaatccttaagggataagcttgacaactggctgcaaaaagtccacacaactctgttggctgttgaagctgaaaccccagatttagtggcatcatgattgaaaagtaaagcgtagacgaaggcatcaaatgaaagcatggccattttaagttgttgacaattgtcaatgagtcttccatggagatgcgataatttaaccccatcttttcagccgtctgtgttattgttgttagcttttcaaagatagtaacttgtgcctttctttgaggtcagagaattcatgcagcaatttgtcctaacagagcatttgttttcagcactgtcaaagaaagactcagtttgctgatttttgtagggatcgaatctgtaactttgctggccatgaatatttcactgagatcggtatagtccctcttttgtgtgttgaatttcaatttgataagagatgtaatatttgggaacaaagattattctgtagctgctaataattccaggatatttaatgctactcctaattagttctatatttttggaattaaaaaatcttggtctttgattccttcttgtttactcatgatcaaattctattaccaattgaaaattctattacctagatttttcatttttctggtaaggacaaatcattttggtccactgcactgcaatgtatcgtcttgggaaaccgtcttgagattgcggccttgatttatgagaagaatgaaatgagcccatgttaagcatggccaatcagaaattacatgtgataaaacagaacgagaacttaacagtctttaggactgaatggttgctacattgtataggatgaggtatttggatagttatttctgcatccatctatagtggaaaattat

SEQ ID NO: 2090 - DNA, 1249 bp, Ambrosia trifida
tactcacccagagctctctgattggtacaatacgcttgcagatctctaccaacggaagttatggcatcaactcactctcaaactcgagcaattcgtccgccctctaccgtttttcaggccggtgatgctctcatccaactatatcagaatttcatcactgactttgagactaagataaatcttctcaagcttgcacattttgctgttatagtctctcgtcagtattcagagaaagaaaaagccatagagtatcttgaaggagtgattgaaaaactcagagctacaaaagagtcacgcatagaggaaccaatcgtttatattaagatgcaaatagccaattttaatcttgaaaaaggagatcaaaaggagtgcaagaatcttctcgaagatgggaagagtacacttgatagcatgacggacatcgatccgtctgtgtatgctaattattattgggtgacatcccagtaccataaatctcgtcaggagtttgctgaattctacaagagctctctactttatttggcctacacttcggttgaatctctctcagattcatttaagttggatcttgcatttgatctatctctatctgctttactgggagacaacatttacaactttggagaactacttgcacatccaataattaaaagtctgatagggacacaagttgaatggctttactatattctagaagcattcaacaacggagatctagttcgctatcaagaactatgccgtgttcatgcagcttctcttaacgctcagccagctttggtggagaatgagaagaagcttctagaaaagattaacattctctgtctgatggaaattatcttcagtcgaccatccgacgagagaaccattccattgagcatcatagcagatcggacaaaacttacagtggaagacgttgaatatcttctcatgaagagtttatccgtgcatcttattgaggggattattgatcaagttgaaggaacagttcatgtgtcatgggtgcaaccgagggttttgggaataagtcaaataaagtctttgcgtgatcggttggacaactgggccgggaaagtacacactgctttggtatcggttgaagccgaaacacctgatttagttgcatcttaagtcgattcttgtttttattattttcttgggtagcttgtcgcccaaagttatctgggtgaactctatgtatgatacctatttgtttttcttttgtcaaaggctgtgagccatttgtaccttg

SEQ ID NO: 2091 - DNA, 1169 bp, Raphanus sativus
gggtggcccagttatatcctttgtggtttgcccagtgctcaagaaacgatctattctcctcttcgtttgtcactttagagcttcttcatcttcttcttctcgcttcaatttgataacttttcttcagcaagggttttaacaatgaagcttgatacgagtgggttcgagacttccatgcctacgattggcttcggctctagcaacgacatgcttgatgggttttctactgtgccctcctttgatcttccccggaccacagattttgatgggtttcagaaagaagcagtacagatggtgaagccagcgaaaggaacaaccacacttgcttttatcttcaaagaaggtgtcatggtcgctgcagattctcgtgctagcatgggtggatatatctcctcacaatccgtgaagaagattattgaaatcaatccttatatgcttggtacaatggctggaggagctgctgactgccaattctggcacaggaatcttggaattaagtgccgtctgcatgagctggcaaacaagaggagaatttctgtttccggagcttcaaaacttctcgcaaacatgctctactcataccgtggaatgggactttccgtcggcaccatgatcgctggatgggacgaaactggtcctggactatactatgtggacaacgaaggaggaaggctcaagggagacaggttctcagtcggttccggttcaccatacgcttacggtgtactagacagcgggtacaagttcgatatgtcagttgaagaagcttccgagttagcaaggagatcaatctaccatgctacattccgtgatggagccagtggtggtgttgctagcgtgtaccacgtgggtcctaatggatggacgaaactgtcgggagatgatgtcggggagctacactatcactactaccccgtgccaccagccattgcggaacaagtcatggaggaagcagctgccgagtaaaactaagattctctttttgcttccaaatcatttcactccatttctctagcttaagctgtggtattcactctattaagattctcctttttttcttctttaaacattgctctcttcgatcagcttgttaaactcttcaccctgtgtttccaacccatgaaattaagaacacaagttgaatattattaaaagaatgtttggtaaga

SEQ ID NO: 2092 - DNA, 1255 bp, Brassica oleracea
  misc_feature (18)..(18): n is a, c, g, or t
  misc_feature (336)..(336): n is a, c, g, or t
  misc_feature (933)..(933): n is a, c, g, or t
  misc_feature (1201)..(1202): n is a, c, g, or t
  misc_feature (1210)..(1210): n is a, c, g, or t
  misc_feature (1219)..(1219): n is a, c, g, or t
cggagctcaagaaacganctgctactttgagctacttcttcgtcttcttcgtctctctctcgaaaccctttggctcgacttgattacctctcttcagtaagatctgattcgagttttcgagaggaaaagatcgttgcttggcatctggggtttaaaaagatgaagcttgatacaagtgggttcgagacctccatgcccacgattggattcgagtcgagcaacgatatgcttgatgggttttctactgtgccctcctttgaccttccccgcactactgatttcgatgggtttcagaaagaagcagtacagatggtgaagccagcgaaaggaacaacnacactcgcttttatcttcaaagaaggtgtcatggtcgctgctgattctcgtgctagcatgggtggatatatctcgtcacaatctgtgaagaagattattgaaatcaatccttatatgcttggtacaatggctggaggagctgctgactgccaattctggcacaggaatcttggaattaagtgccgtctacatgagctggcaaacaagaggagaatctctgtttccggagcttcaaaacttctagcaaacatgctctactcataccgtggaatgggactttccgtcggcacgatgatcgctggatgggacgaaactggtccaggactttactatgtcgacaacgaaggaggaaggctcaagggagacaggttttcagtcggttccggttcaccatacgcttatggtgtactagacagcgggtacaaattcgatatgtcagttgaagaagcttccgagttagcaaggagatcaatctaccatgcgacattccgtgatggagccagtggtggagttgctagcgtgtaccacgtgggtcctaatggatggaagaaactgtcaggagatgatgttggggagctacactatcactactacccngtgccaccagccattgcggaacaggtcatggaggaagcagccgctgagtaaggagatccgttttacttccaaatcagtcactctcttttatgtgtgtttgctttagtagatactgagttttctctagcttaagctttggtgttcactatgtaagattctccttttttatctgcaactacatgttatctttactttgttcaagcagttctttttcactcttcaccctgtgttttaaagtatgaaaataatcacagattattgtgcacannttggtacnttagctgtnaaaacatgtaattaaatttttataacaagtttatag

SEQ ID NO: 2093 - DNA, 1073 bp, Brassica napus
aagaaacgatctaattccttattattctcgtcatccccttttcacttttagagctacttcttctctctctctcttttctacggcaagggtttaaaagatgaagcttgatacaagtgggttcgagacctcaatgcctacgattggttttggctcgagcaacgatatgcttgatgggttctctactgtgccctcctttgatctcccccgcaccacagattttgatggcttccagaaagaagcagtgcagatggtgaagccagcgagaggaacaaccacactcgcttttatcttcaaagaaggtgtcatggtcgctgctgattctcgtgctagcatgggtggatatatctcatcacaatctgtgaagaagattattgaaatcaatccgtatatgcttggtacaatggctggaggagctgctgactgccaattctggcacagaaatcttggaattaagtgccgtctacatgagctggcaaacaagaggagaatctccgtttcaggagcttcaaaacttctcgctaacatgctctattcataccgtggaatgggtctttctgtcggcacgatgattgctggatgggacgaaactggtcctggactatactatgtcgacaacgaaggaggaaggctcaagggagacaggttttcagtcggttctggttcaccatacgcttacggtgtactagacagcgggtacaaattcgatatgtcagttgaagaagcttccgagttagcaaggagatcaatctaccatgcgacattccgtgatggagccagtggtggagttgctagcgtgtaccacgtgggtcctaatggatggaagaaactgtcaggagatgatgttggggagctacactatcactactacccagtgccaccagccattgcggaacaagtcatggaggaagcagccgctgagtgaaggagatccgttttacttccaaatcatttcactctcttttatgtgtgttttgctttagttaaatactgagtttctctagcttaagcttcggtattcactatataagattctccttttttatctgcaaatacatgttatctttactttgttc

SEQ ID NO: 2094 - DNA, 832 bp, Brassica napus
ttaaaggatgaagcttgatacaagtgggttcgagacctcaatgcctacgattggctttggctctagcaacgatatgcttgatgggttttctactgtgccctcctttgatctcccccgcaccacagattttgatgggtttcagaaagaggcagtacagatggtgaagccagcgaaaggaacaacaacactcgcttttattttcaaagaaggtgtcatggtcgctgctgattctcgtgctagcatgggtggatatatctcatcacaatctgtgaagaagattattgaaatcaatccttatatgcttggtacaatggctggaggagctgctgactgccaattctggcacagaaatcttggaattaagtgccgtctacatgagctggcaaacaagaggagaatctccgtttctggagcttcaaaacttctggcaaacatgctctattcataccgtggaatgggtctttctgtcggcacgatgattgctggatgggacgaaactggtcctggactatactatgttgacaacgaaggaggaaggctcaagggagacaggttttcagtcggttctggttcaccatacgcttacggtgtactagacagcgggtacaaattcgatatgacagttgaagaagcttccgagttagcaaggagatcaatctaccatgcgacattccgtgatggagccagtggtggagttgctagtgtgtaccacgtgggtcctaatggatggaagaaactgtcaggagatgatgttggggagctacactatcactactacccagtgccaccagccattgcggaacaggtcatggaggaagcagccgctgagtaa

SEQ ID NO: 2095 - DNA, 1215 bp, Brassica napus
gtttcttatttctcgtcttcgttggtcactttaaagctccttcttctctcttttcgtcagcaagggttaaaagatgaagcttgatacaagtgggttcgagacctccatgcctacggttggctttggctctagcaacgatatgcttgatgggttctctactgtgccctcttttgatcttccccgcaccacagattttgatgggttccagaaagaagcagtgcagatggtgaagccagcgaaaggaacgaccacactcgcttttatcttcaaagaaggtgtcatggtcgctgccgattctcgtgctagcatgggtggatatatatcatcacaatctgtaaagaagattattgaaatcaatccttatatgcttggtacaatggctggaggagctgctgactgccaattctggcacagaaatcttggaattaagtgccgtctacatgagctggcaaacaagaggagaatctctgtttcaggagcttcaaaacttctcgcaaacatgctctattcataccgcggaatgggtctttctgtcggcacgatgattgctggatgggacgaaactggtcctggactatactatgtcgacaacgaaggaggaaggctcaagggagacaggttttcagtcggttctggttcaccatacgcttacggtgtactagacagcgggtacaaattcgatatgtcagttgaagaagcttccgagttagcaaggagatcaatctaccatgcgacattccgtgatggagccagtggtggagttgctagcgtgtaccacgtgggtcctaatggatggaagaaactgtcaggagatgatgttggggagctacactatcactactaccctgtgccaccagccattgcggaacaagtcatggaggaagcagccgctgagtaaggagatccgttttacttccaaatcagtcactctcttttatgtgtgtttgctttagtagatactgagttttctctagcttaagctttggtattcactatataagattgagactccttttctgcaaatacattttctcttaactttgttcaagcagctcttttttaactcttcaccctgtgttttaaagtatgaaataatctgtgattattttgtatgtagttaaaattttataacaagtagtgtatatattaacttagctccccaaacaagacaaaactggagtcattaattacatttttgttgatatagtagttgga

SEQ ID NO: 2096 - DNA, 1155 bp, Brassica rapa
aagaaacgatctattcttatttctcgtcttcgttggtcactttagagctccttcttctctcttttctacagcaagggttaaaagatgaagcttgatacaagtgggttcgagacctcaatgcctacgattggttttggctctagcaacgatatgcttgatgggttctctactgtgccctcttttgatcttccccgcaccacagattttgatggatttcagaaagaggcagtgcagatggtgaagccagcgaaaggaacaacaacactcgcttttatcttcaaagaaggtgtcatggtcgctgctgattctcgtgctagcatgggtggatatatatcctcacaatctgtgaagaagattattgaaatcaatccttatatgcttggtacaatggctggaggagctgctgactgccaattctggcacagaaatcttggaattaagtgccgtctacatgagctggcaaacaagaggagaatctccgtttcaggagcttcaaaacttctcgcaaacatgctctattcataccgcggaatgggcctttctgtcggcacgatgattgctggatgggacgaaactggtcctggactatactatgtcgacaacgaaggaggaaggctcaagggagacaggctttcagtcggttctggttcaccatacgcttacggtgtactagacagcgggtacaaattcgatatgacagttgaagaagcttccgagttagcaaggagatcaatctaccatgcgacattccgtgatggagccagtggtggagttgctagcgtgtaccacgtgggtcctaatggatggaagaaactgtcgggagatgatgttggggagctacactatcactactacccagtgccaccagccattgcggaacaggtcatggaggaagcagccgctgagtaaggagatccgttttacttccaaatcagtccctctcttttatgtgtgtttgctttagtagatactgagttttctctagcttaagctttggtattcactatataagattgagactccttttctgcaaatacattttctcttaactttgttcaagcagctcttttttaactcttcaccctgtgttttaaagtatgaaataatctgtgattattttgcatgtagttaaaattttataacaagtagtgtata

SEQ ID NO: 2097 - DNA, 1236 bp, Brassica rapa
aattagatggcccatcacggcccagttagctcctctgtggtttgcccggtgctcaagaaacgatctattcctttttctcgtcttcgttcgtcagttcgagcttcttcatcttcttcttcttctcgcttcaatttgattacttttcttcgtcaagggttttaacaatgaagcttgacactagtggattcgagacatccatgcctacgattggattcggctcaagcaacgatatgcttgatgggttttctaccgtgccctcgtttgatcttccccggactacagattttgatgggtttcagaaagaagcagtgcagatggtgaagcctgcgaaaggaacaaccacacttgcttttatcttcatagaaggtgccatggtcgctgctgcttctcgtgctagcatgggtggatatatctcctcacaatctgtgaagaagattattgagatcaatccttatatgcttggtacaatggctggaggagctgctgactgccaattctggcacagaaatcttggtattaagtgccgtctacatgaactggcaaacaagaggagaatctctgtttccggagcttcaaaacttctcgcaaacatgctctactcataccgtggaatgggactttccgtcggcaccatgattgctggatgggacgaaactggtcctggactatactatgtcgacaacgaaggaggaaggctcaagggagacaggttttcagttggttctggttcgccatacgcttacggtgtactagacagcggatacaagttcgatatgtcagttgaagaagcttccgagttggcaaggagatcaatctatcatgcgacattccgtgatggagccagtggtggtgttgctagcgtgtaccacgtgggtcctaatggatggacgaaactgtcaggagatgatgttggggagctacactatcactactaccccgtgccaccagccattgcggaacaggtcatggaggaagcagctgccgagtaaaactaagactttcttttacttcctaatcaattcactccctttctttagcttaagctctggtgttcactctattaagattctcctttttattttctgcaaacacatactccctttactttgttcaaacagctttttcaactcttcagtctttgtttcaaccgtaaaattaggaacataagttgaataattatagtttgacaaaaaaaaaagttgaataattataaagaaaatgtttggttgaaaaata

SEQ ID NO: 2098 - DNA, 1117 bp, Raphanus sativus
  misc_feature (988)..(988): n is a, c, g, or t
  misc_feature (1071)..(1071): n is a, c, g, or t
tcttcgtttcacttagaacaacttcttcctcttcttctctctcggaaccctttggctcgatttgattacttctcttcagtaagggtttaaaaaaaaagatgaagcttgatacaagtgggttcgagacctccatgcctacgattggattcggctccagcgacgatacgcttgatgggttttctactgtgccctcctttgatcttccccgcactactgatttcgatgggtttcagaaagaggctgtacagatggtgaagccagcgaaaggaacaaccacactcgcttttatcttcaaggaaggtgtcatggtcgctgctgattctcgtgctagcatgggtggatatatctcgtcacaatctgtgaagaagattattgagatcaatccttatatgcttggtacaatggctggaggagctgctgactgtcaattctggcaccgaaaccttggtattaagtgccgtctacatgagctggcgaacaagaggagaatctctgtttccggagcttcaaagcttctcgcaaacatgctctactcataccgtggaatgggactttccgtcggcacgatgattgctggatgggatgaaaccggccctggactatactatgtggacaacgaaggaggaagactcaagggagacaggttttcagtcggttccggttcaccatacgcttatggtgtacttgacagcgggtacaaattcgatatgtcagttgaagaagcgtctgagttagcaaggagatcaatctaccatgcgacattccgtgatggagctagtggtggagttgctagcgtgtaccacgtgggaccaaatgggtggacgaaactgtcaggagatgatgttggggagctgcattatcactactaccccgtgccgccagccactgcggaacaggtcatggaggaagcagccgccgagtaatgagcccccttttagttcacaagtcattcactctctagcttgataaactttggtttttaactatnagattctcctttttatctgcaaatgcactactctttgtttgttgagatcaagcagctctgtttcaaccatatgaaattagggnaacctgtgattggtgcacaatttgattagttaagcttttatgtgca

SEQ ID NO: 2099 - DNA, 970 bp, Eutrema parvulum
tttatatttttttcaattggggatttgtcatgattctgtagggtttaaagatgaagcttgatactagtgggttcgagacttccatgcctacgattggcttcggctcgagcaacgatatgcttgatgggttttcttctgtgccctcgtttgatcttccccgcacaacagattttgatgggtttcagaaagaagctgtacagatggtgaagcctgcgaaaggaacaaccacactcgcttttattttcaaagaaggtgtcatggtcgctgctgattctcgggctagcatgggaggatatatctcctcacaatctgtgaagaagattattgaaatcaatccgtacatgcttggtacaatggctggaggagctgctgactgccaattctggcacagaaatcttggaattaagtgccgtcttcatgagctagcaaacaagaggagaatctctgtttctggagcttcaaaacttctcgcaaacatgctctattcataccgtggaatgggactttctgtcggcacgatgattgctggatgggacgaaactggtcctggactatactatgttgacaatgaaggaggaaggctcaagggagaccggttttcagtcggttctggttcaccatatgcttatggtgtattagacagcgggtacaaattcgatatgtcagttgaagaagcttctgagttagcaaggagatcaatctaccatgcgacattccgtgatggagccagtggtggagtcgctagcgtgtaccacgtcggtcctaatggatggaagaaactgtcaggagatgatgttggggagctacactatcactactaccccgtggcaccagccactgcggaacaagttatggaggaagcagccgccgagtaaggagaagaaccttttgctttcaaattattcaccatcttttatgttttttttgctttagtaaatactgagttttctctagcttaaactttggtatt

SEQ ID NO: 2100 - DNA, 1220 bp, Brassica rapa
cggagctcaagaaacgatctactactttgagctacttcttcgtcttcttcttctctatctctcggaaccctttggctcgatttgattacctctcttcactaaggtttaaaggatgaagcttgatactagtgggttcgagacatccatgcctacgattggattcgggtcgagcaacgatatgcttgatgggtttactactgtgccctcctttgaccttccccgcactactgatttcgatgggtttcagaaagaagcagtacagatggtgaagccagcgaaaggaacaaccacgctggctttcatcttcaaagaaggtgttatggtcgctgctgactctcgtgctagcatgggtggatatatctcgtcacaatctgtgaagaagattattgaaatcaatccttatatgcttggtacaatggctggaggagctgctgattgtcaattctggcaccgtaatcttggaattaagtgccgtctacatgagctggcaaacaagaggagaatatctgtttccggagcttcaaaacttctagcaaacatgctctactcataccgtggaatgggactttccgtcggcacaatgattgctggatgggacgaaactggtcctggactatactatgtggacaacgaaggaggaaggctcaagggagacaggttttcagtcggttctggttcaccatacgcttatggtgtacttgacagcgggtacaaattcgatatgtcagttgaagaagcatctgagttagcaaggagatcaatctaccatgcgacattccgtgatggagctagtggtggagttgctagcgtgtaccacgtgggtcctaatggatggaagaaactgtcgggagatgatgttggggagctacactatcactactaccctgtgccaccatccactgccgaacaagtcatggaggaagcggccgccgagtaataacattcactctctagcttaaactttgtttctcactataagattctccttttattctgcaaatgcacactctttattttgttcaagcagctctgtttccaccatgaaattaggaatctgtgattggttttgacaatttgattaggtaagctttcatgtgcaatctgaatattaaaaaccgatcaaatcgaaccgaactttttcaaatagtcgactgtgacagccctagacttttgtctgaaatcatttatcgaacgcagcccctattagcaagacaagccct

SEQ ID NO: 2101 - DNA, 2448 bp, Brassica napus
agtaaataagaacaaagtcatagcttaacttgaattgtgacaactttctttatccaacagagtttgtgaatatcatcaaaaagaagaagtataactacttgatggtagccttggggatggtggaagtgcagggtccagctgacgtcatgaacggtatgcctttgtaagtggctacaccactttcatcagtgtacaaatgcggcgttatcttctcaagttgcttcttttttgggttcagtacctcttccgccttcccttccacccctgagaatgaaacacgctctcccggtttagctccagcaggtggtagcaacggctccacaaccgagtgatcttcatttgaagcacaaagaaccagtccttctgacattacatctcttagctttccaggtttgacatttgtgatgagcgcaacaagacggttcgttagatcatcaggactgcagaatttagctaagccactaacgacttgcctcactttaccctctccaacatctatttcttccaccagcaaactgtctgctgacgggtgtttccatgctttgcgaatcagaccgacctgaatatttagcaaactgacactaagctccgtctctttgctagctgctgctggtgctgcttcagcaggcttcttcttttctttcttggcatccttctcctttgcagcctttttctttggctcctcaggctcagttttctttgtgcttggctgagcttctgatttatcaagaggctttggactctctgcagtctttttggaatccaccttgacgacactttttgatacctcgaagtcaaactgtggtaacttcacagagattggtccaaacaatgttgtcaactcttctttaatctggatgtagttcatccaccttatgacatgtgggatcttctccttgtctgaatccgagagaccaatcactgaagcatgcaaagctgcaaagacagcaacatcagctgcagatggcgtcaatccatctcccaacaccactgacttgactgctaactccacattcagcttctcaagagctgcaaagcaatcctttgagagaccttccgcatattccatccactttaagacctcatcgttgttttgtgaagacacttcttttccagatgctttcactacattagagtacagcgtcttgacatcactctcaccagacccttcaagaccagcagggtctacggagaagtgtttacagagagctgataggatcatctgcttcgtctttgaatccatcttcttcttctcttttatcgttttcggggctctttgctcgatttgattacctctcttcactaaggtttaaaggatgaagcttgatactagtgggttcgagacatccatgcctacgattggattcgagtcgagcaacgatatgcttgatgggttttctactgtgccctcctttgaccttccccgcactactgatttcgatgggtttcagaaagaagcagtacagatggtgaagccagcgaaaggaacaacaacacttgctttcatcttcaaagaaggtgtcatggtcgctgctgattctcgtgctagcatgggtggatatatctcgtcacaatctgtgaagaagattattgaaatcaatccttatatgcttggtacaatggctggaggagcggctgattgtcaattctggcacagaaaccttggaatcaagtgccgtctacatgagctggcaaacaagaggagaatctctgtttccggagcttcaaaacttctagcaaacatgctctactcgtaccgtggaatgggactttccgtcggcacgatgatcgctggatgggacgaaactggtcctggactatactatgtggacaacgaaggaggaaggctcaagggagacaggttttcagtcggttctggttcaccatacgcttatggtgtacttgacagcgggtacaaattcgatatgtcagttgaagaagcatctgagttagcaaggagatcaatctaccatgcgacattccgtgatggagctagtggtggagttgctagcgtgtaccacgtgggtcctaatggatggaagaaactgtcgggagatgatgttggggagctacactatcactactaccctgtgccaccatccactgccgaacaagtcatggaggaagcggctgccgagtaataacattcactctctagcttaaactttgtttctcactataagattctccttttattctgcaactgcacactctttattttgttcaagcagctctgtttcaaccatgaaattaggaccgatcaaatagaaccgatctatttcaaatagtcgactgtgacagccgtagacttttgtctgaaatcatttatcgaacgcagcccctattagcaagacaagccctgtggctaagatagtgactgcatgtgacgttatgaccacatgcttttgtcacgtttactattcagaaatttagtattttctgttacaa

SEQ ID NO: 2102 - DNA, 1132 bp, Eutrema parvulum
aatttagggcctagtctggcccatgtctgctcttctgttgtttgcccggagctcaagaaacgatcgcttcctttttctcgtcctcgtttgtcacttagagctacttcttcgtcttcttctcgcttaacacttcgtcgcgatttgattgcttttcttcagcaagggtttaaagatgaagcttgatactagtgggttcgagacttccatgcctacgattggcttcggctcgagcaacgatatgcttgatgggttttcttctgtgccctcgtttgatcttccccgcacaacagattttgatgggtttcagaaagaagctgtacagatggtgaagcctgcgaaaggaacaaccacactcgcttttattttcaaagaaggtgtcatggtcgctgctgattctcgggctagcatgggaggatatatctcctcacaatctgtgaagaagattattgaaatcaatccgtacatgcttggtacaatggctggaggagctgctgactgccaattctggcacagaaatcttggaattaagtgccgtcttcatgagctagcaaacaagaggagaatctctgtttctggagcttcaaaacttctcgcaaacatgctctattcataccgtggaatgggactttctgtcggcacgatgattgctggatgggacgaaactggtcctggactatactatgttgacaatgaaggaggaaggctcaagggagaccggttttcagtcggttctggttcaccatatgcttatggtgtattagacagcgggtacaaattcgatatgtcagttgaagaagcttctgagttagcaaggagatcaatctaccatgcgacattccgtgatggagccagtggtggagtcgctagcgtgtaccacgtcggtcctaatggatggaagaaactgtcaggagatgatgttggggagctacactatcactactaccccgtggcaccagccactgcggaacaagttatggaggaagcagccgccgagtaaggagaagaaccttttgctttcaaattattcaccatcttttatgttttttttgctttagtaaatactgagttttctctagcttaaactttggtattatcaaacacttgactcttttttcttcgatgtttatcgaac

SEQ ID NO: 2103 - DNA, 1004 bp, Brassica juncea
ttgatactagtgggttcgagacctccatgcctacgattggattcggctcgagcaacgatatgcttgatgggttttctactgtgccctcctttgatcttccccgcacgactgatttcgatgggtttcagaaagaagcagtacagatggtgaagccagcgaaaggaacaaccacgctggcttttatcttcaaagaaggtgtcatggtcgctgctgattctcgtgctagcatgggtggatatatctcatcacaatctgtgaagaagatcattgaaatcaatccgtatatgcttggtacaatggctggaggagctgctgactgccaattctggcacagaaatcttggaattaagtgccgtctacatgagctggcaaacaagagaagaatctccgtttcaggagcttcaaaacttctggcaaacatgctctattcataccgtggaatgggtctttctgtcggcactatgattgctggatgggacgaaactggtccaggactatactatgttgacaacgaaggaggaaggctcaagggagacaggttttcagtcggttctggttcaccatacgcttacggtgtactagacagcgggtacaaattcgatatgacagttgaagaagcttccgagttagcaaggagatcaatctaccatgcgacattccgtgatggagccagtggtggagttgctagcgtgtaccacgtgggtcctaatggatggaagaaactgtcaggagatgatgttggggagttacactatcactactacccagtgccaccagccattgcggaacaggtcatggaggaagcagctgccgagtaaaactaagactttcttttacttcctaatcaattcactccctttctttagcttaagctctggtgttcactctattaagattctcctttttattttctgcaaacacatactccctttactttgttcaaacagctttttcaactcttcagtctttgtttcaaccgtaaaattaggaacataagttgaata

SEQ ID NO: 2104 - DNA, 903 bp, Brassica napus
atacaagtgggttcgagaccaccatgcctacgattggttttggctcgagcaacgatatgcttgatgggttttctactgtgccctcctttgatctcccccggaccacagattttgatgggttccagaaagaagcagtgcagatggtgaagccagcgaaaggaacaacaacactcgcttttatcttcaaagaaggtgtcatggtcgctgctgattctcgtgctagcatgggtggatatatctcatcacaatctgtgaagaagattattgaaattaatccgtatatgcttggtacaatggctggaggtgctgctgactgccaattctggcacagaaatcttggtattaagtgccgtctacatgagctggcaaacaagaggagaatctccgtttcaggagcttcaaaacttctcgcaaacatgctctattcataccgtggaatgggtctttctgttggcacgatgattgctggatgggatgaaactggtcctggactatactatgttgacaacgaaggaggaaggctcaagggagacaggttttcagtcggttctggttcaccatacgcttatggtgtactagacagcgggtacaaattcgatatgacagttgaagaagcttccgagttagcaaggagatcaatctaccatgcgacattccgtgatggagccagtggtggagttgctagcgtgtaccacgtgggtcctaatggatggaagaaactgtcaggagatgatgttggggagctacactatcactactacccagtgccaccagccattgcggaacaggtcatggaggaagcagccgctgagtaaggagatccgttttacttccaaatcagtcactctcttttatgtgtgtttgctttagtagatactgagttttctctagcttaagctttgg

SEQ ID NO: 2105 - DNA, 1253 bp, Eutrema halophilum
attacgatggcccatcttggcccatatattgctcccctgtggtttgcccggagctcaagaaaagaaacgatctattcattcgttctcgtcttcgtttgtcacttgagctacctcttcttcttcttcttcttattaacctttagctctatttgattacttttcttcagtaagggatttaaaaaatgaagcttgatactagtgggttcgagacctccatgcctctgattggctttggctcgagcaacgatatgcttgatgggttttcttctgtgccctcgtttgatctaccccgcacaacagattttgatggattccagaaagaagctgtacagatggtaaagcctgcgaaaggaacaaccacactcgcttttatcttcaaaggtggtgtcatggtcgctgctgattctcgagctagcatgggaggatatatctcctcacaatctgtgaagaagattattgaaatcaatccgtacatgcttggtacaatggctggaggagctgctgactgccaattctggcacagaaatcttggaattaagtgccgtctacatgagctggcaaacaagaggagaatctctgtttctggagcttcaaagcttctcgcaaacatgctttattcataccgtggaatgggactttccgtcggcacgatgattgctggatgggacgaaactggtcctggactatactatgttgacaacgaaggagggaggctcaagggagacaggttttcagttggttctggttcaccatacgcttatggtgtactagacagcgggtacaaatacgatatgtcagttgaagaagcttctgagttagcgaggagatcaatctaccatgcgacattccgtgatggagccagtggtggagttgctagcgtgtaccatgtcggtcctaatggatggaagaagctgtcaggagatgatgttggggagctacactatcactactaccctgtcgcaccagccactgctgagcaagtcatggaggaagcagccactgaataaggagacacttctttactttcaattcattcactctttattctgtttggctttaagtgaatactgaaaataagattctgctcccattttctgcgaatacatattctcctttactttgttcaattagctctttttagcttttcaccctgtgtttcaaccatgaaaattagggatctgtgattgttacacaaccatgaaattaggaatttgtgattgttacacaaccatgaagttaggaatctgtgattg

SEQ ID NO: 2106 - DNA, 1156 bp, Eutrema halophilum
gtcacttgagctacctcttcttcttcttcttcttattaacctttagctctatttgattacttttcttcagtaagggatttaaaaaatgaagcttgatactagtgggttcgagacctccatgcctctgattggctttggctcgagcaacgatatgcttgatgggttttcttctgtgccctcgtttgatctaccccgcacaacagattttgatggattccagaaagaagctgtacagatggtaaagcctgcgaaaggaacaaccacactcgcttttatcttcaaaggtggtgtcatggtcgctgctgattctcgagctagcatgggaggatatatctcctcacaatctgtgaagaagattattgaaatcaatccgtacatgcttggtacaatggctggaggagctgctgactgccaattctggcacagaaatcttggaattaagtgccgtctacatgagctggcaaacaagaggagaatctctgtttctggagcttcaaagcttctcgcaaacatgctttattcataccgtggaatgggactttccgtcggcacgatgattgctggatgggacgaaactggtcctggactatactatgttgacaacgaaggagggaggctcaagggagacaggttttcagttggttctggttcaccatacgcttatggtgtactagacagcgggtacaaatacgatatgtcagttgaagaagcttctgagttagcgaggagatcaatctaccatgcgacattccgtgatggagccagtggtggagttgctagcgtgtaccatgtcggtcctaatggatggaagaagctgtcaggagatgatgttggggagctacactatcactactaccctgtcgcaccagccactgctgagcaagtcatggaggaagcagccactgaataaggagacacttctttactttcaattcattcactctttattctgtttggctttaagtgaatactgaaaataagattctgctcccattttctgcgaatacatattctcctttactttgttcaattagctctttttagcttttcaccctgtgtttcaaccatgaaaattagggatctgtgattgttacacaaccatgaaattaggaatttgtgattgttacacaaccatgaagttaggaatctgtgattg

SEQ ID NO: 2107 - DNA, 1124 bp, Eutrema halophilum
aaaattgatttccttttagtttcttcgtcattcgtcagcttcacacttcctccgcttcgtttattttgcgtctcgatatcgttgcttttccttagcaagggtttttgaagatgaagcttgatactagtggatttgagacaactatgccaatgattgggtttggatcaagcagcgagatgcttgatggattttcttctgtaccttcattcgatcttcctcgtacaactgattttgatgggtttcagaaagaagctgtacagatggtgaagcctgcaaagggtacaacgacactcgcgtttatctttaaagaaggtgttatggtagctgctgattctcgagcaagcatgggaggatatatctcttcgcagtctgtgaagaagattattgaaattaatccttatatgcttggtacaatggctggtggagctgctgattgccaattctggcaccggaatctgggaatcaagtgccgtctacatgagctggcaaacaaaaggagaatctctgtttcaggagcttcaaagctgcttgccaacatgctctattcataccgtggaatgggactatctgtcggcacaatgattgctggatgggatgaaacaggccctgggttgtactatgttgacaatgaaggaggacggcttaagggagacagattctctgtcggttcgggttcaccatacgcttatggtgttcttgacagcggatacaaattcgatatgtcggttgaagaagcctcagaattagcaaggagatctatctaccatgctacattccgtgatggagctagtggtggagttgctagcgtgtaccacgttgggcctaatgggtggaagaaactctctggagatgacgtcggcgagctacattaccactattatccagtggttccagccaccgcggaacaggagatggaagaggcgaccgagtaaatacttttgattatctattattagcttttaagagttttatcacaagtcttctgttgagaacagaatcatggttacatgtttcttttgtattgcgaatgttgtagttaggtatattagagtctcctgggattgcttgcggatatcgaatgttattgatatttaattatctttcgaatcagattggataatctc

SEQ ID NO: 2108 - DNA, 1065 bp, Eutrema parvulum
tttattttgcgtctcgatatcgttgcttttccttagcaagggtttttgaagatgaagcttgatactagtggatttgagacaactatgccaatgattgggtttggatcaagcagcgagatgcttgatggattttcttctgtaccttcattcgatcttcctcgtacaactgattttgatgggtttcagaaagaagctgtacagatggtgaagcctgcaaagggtacaacgacactcgcgtttatctttaaagaaggtgtcatggtagctgccgattctcgagcaagcatgggaggatatatctcgtcacaatctgtgaagaagattattgaaattaatccgtatatgcttggtacaatggctggcggagctgctgactgccagttctggcaccggaatctgggaattaagtgccgtctacatgagctggcaaacaaaaggagaatctctgtttcaggagcttcaaagcttcttgccaacatgctctattcataccgtggaatgggactttctgttggcacaatgattgctggatgggatgaaacaggccctggattgtactatgttgacaatgaaggaggacgacttaagggagatagattctctgtcggttcaggttcaccatacgcttatggtgttcttgacagcggatacaaattcgatatgtcggttgaagaagcctcagagttagcaaggagatctatctaccatgctacattccgtgatggagctagtggtggagttgctagcgtataccacgttgggcctaaaggatggaagaaactctctggagatgacgtaggcgagctacattaccactatcaccctgtggttccagccaccgcggaacaggtgatggaagaggcagccgagtaaatactttgattatctcttagtagcttttaagagttttatgacaactcttctgctatgaacagaatcatagattcatgttcatttgtatcacgaatgatgtagttaggtctggtatttgaagattatggcctccggagattgcattctgataacgaatattttattatctttcggatcatgttggataatatc

SEQ ID NO: 2109 - DNA, 1025 bp, Eutrema parvulum
ggtctttgacaatgaagcttgatactagtggattggagacaactatgccaatgattgggtttggatcaaacaacgagatgcttgatgggttttcttctgtaccgtcgttcgatcttcctcgtacaactgattttgatgggtttcagaaagaagctgtacagatggtgaagcctgcaaagggtacaacgacactcgcgtttatctttaaagaaggtgtcatggtagctgccgattctcgagcaagcatgggaggatatatctcgtcacaatctgtgaagaagattattgaaattaatccgtatatgcttggtacaatggctggcggagctgctgactgccagttctggcaccggaatctgggaattaagtgccgtctacatgagctggcaaacaaaaggagaatctctgtttcaggagcttcaaagcttcttgccaacatgctctattcataccgtggaatgggactttctgttggcacaatgattgctggatgggatgaaacaggccctggattgtactatgttgacaatgaaggaggacgacttaagggagatagattctctgtcggttcaggttcaccatacgcttatggtgttcttgacagcggatacaaattcgatatgtcggttgaagaagcctcagagttagcaaggagatctatctaccatgctacattccgtgatggagctagtggtggagttgctagcgtataccacgttgggcctaaaggatggaagaaactctctggagatgacgtaggcgagctacattaccactatcaccctgtggttccagccaccgcggaacaggtgatggaagaggcagccgagtaaatactttgattatctcttagtagcttttaagagttttatgacaactcttctgctatgaacagaatcatagattcatgttcatttgtatcacgaatgatgtagttaggtctggtatttgaagattatggcctccggagattgcattctgataacgaatattttattatctttcggatcatgttggataatatc

SEQ ID NO: 2110 - DNA, 1101 bp, Arabidopsis lyrata
cttctgcttctcgtcgtcgtttgtcactttagagctacttcttcttcttctcttctctgctaaacctttctctcgatttgattgcttttcttcagtaagggtttgcaaagatgaagcttgatactagtgggttcgagacttccatgcctatgattggatttggctcgagcagtgatatgcttgatgagctttcttctgtgccctcgtttgatctacctcgtacaaaagagtttgatggatttcagaaagaagctaaagacatgttgaagcatgcaaaaggaacaaccactctcgcttttatcttcaaaggtggtgttatggtcgctgctgattctcgggctagcatgggaggatatatttcctcacaatctgtgaagaagattattgaaatcaatccgtatatgctcggtacgatggctggaggagctgctgactgccaattctggcacagaaatcttggaattaagtgccgtctacatgagctggcaaacaagaggagaatctctgtgtccggagcatcaaaactacttgcgaacatgctctattcataccgtggaatgggactttctgttggcacaatgattgctggatgggacgaaactggtcctggactatactatgtcgacaacgaaggaggacggctcaagggagacaggttttcagtcggttctggttcaccatacgcttacggtgtactggacagcgggtacaaatacgatatgtcagttgaagaagcttcggagttagcaaggagatcgatctaccatgcgacattccgtgatggagccagtggtggagttgctagcgtgtaccacgttggtcccgaaggatggacgaaactatcaggagatgatgttggggagctacactaccactactaccccgtggcaccagctatcgcagaacaagtgatggaggaagcaacagccgagtaataaacatgtttagttttctaatcgttcactcccttttctgttgttgcattttgtggtagtacatactgagttgtctctagctgaagctttggtattctattttactgatctgaaatgttgctcgcaactcattctctatgagattctcttttttctgcaatcacat

SEQ ID NO: 2111 - DNA, 1139 bp, Arabidopsis lyrata
ctctatacttctgcttctcgtcgtcgtttgtcactttagagctacttcttcttcttctcttctctgctaaacctttctctcgatttgattgcttttcttcagtaagggtttgcaaagatgaagcttgatactagtgggttcgagacttccatgcctatgattggatttggctcgagcagtgatatgcttgatgagctttcttctgtgccctcgtttgatctacctcgtacaaaagagtttgatggatttcagaaagaagctaaagacatgttgaagcatgcaaaaggaacaaccactctcgcttttatcttcaaaggtggtgttatggtcgctgctgattctcgggctagcatgggaggatatatttcctcacaatctgtgaagaagattattgaaatcaatccgtatatgctcggtacgatggctggaggagctgctgactgccaattctggcacagaaatcttggaattaagtgccgtctacatgagctggcaaacaagaggagaatctctgtgtccggagcatcaaaactacttgcgaacatgctctattcataccgtggaatgggactttctgttggcacaatgattgctggatgggacgaaactggtcctggactatactatgtcgacaacgaaggaggacggctcaagggagacaggttttcagtcggttctggttcaccatacgcttacggtgtactggacagcgggtacaaatacgatatgtcagttgaagaagcttcggagttagcaaggagatcgatctaccatgcgacattccgtgatggagccagtggtggagttgctagcgtgtaccacgttggtcccgaaggatggacgaaactatcaggagatgatgttggggagctacactaccactactaccccgtggcaccagctatcgcagaacaagtgatggaggaagcaacagccgagtaataaacatgtttagttttctaatcgttcactcccttttctgttgttgcattttgtggtagtacatactgagttgtctctagctgaagctttggtattctattttactgatctgaaatgttgctcgcaactcattctctatgagattctcttttttctgcaatcacatggtttcaaacatcaatttagggaattgtgat

SEQ ID NO: 2112 - DNA, 1083 bp, Arabidopsis lyrata
gagctcaagaaacatccctccataatttgcttctccattctccacttctctctcacatttcttcttcttcgttaatttgcttctcgatttcgttctttaggaatttgacaatgaagcttgatactagtggattggagacaactatgcctgtgattggttttggatcaaacagcgagatgcttgatgggttttcgtctgtaccttcgtttgatcttcctcgtaccaccgactttgatgggtttcagaaaaaagctgtggagatggtgaagcctgcaaagggtacaactacacttgcgtttatctttaaagaaggtgttatggttgctgctgattctcgagcaagcatgggaggatatatctcttcgcaatctgtgaagaagattattgaaattaatccttatatgcttggtacaatggctggtggagctgctgattgccaattctggcacagaaatctgggaattaagtgccgtctacatgagctggcaaacaaaaggagaatctctgtttcaggagcttcaaagcttcttgctaacatgctctattcctaccgtggaatgggactttctgttggtacaatgattgctggatgggatgaaacaggccctggattgtactatgttgacaacgaaggaggacgacttaagggagacagattctctgtcggttccggttcaccatatgcttatggtgttctggacagcggatacaaattcgatatgtcagttgaagaagcctcagagttagcaaggagatccatataccatgctacattccgtgatggagctagtggtggagttgctagcgtgtaccacgttgggcctcaaggatggaagaaactctctggagacgacgttggcgagctacattaccattattaccccgtgactccagtcaccgcggaacatgtgatggaagaggctgctgaataaatactgtgattcgtctctatcgttcgaagagttctattacatcacttatgttttgttcatctatgaacagaatcaaagattcatcatgtttcatttgtattgcgaatgatgtagacgttagtctggccacaatgatcaggttgataataga

SEQ ID NO: 2113 - DNA, 1083 bp, Arabidopsis lyrata
gagctcaagaaacatccctccataatttgcttctccattctccacttctctctcacatttcttcttcttcgttaatttgcttctcgatttcgttcttcaggaatttgacaatgaagcttgatactagtggattggagacaactatgcctgtgattggttttggatcaaacagcgagatgcttgatgggttttcgtctgtaccttcgtttgatcttcctcgtaccaccgactttgatgggtttcagaaaaaagctgtggagatggtgaagcctgcaaagggtacaactacacttgcgtttatctttaaagaaggtgttatggttgctgctgattctcgagcaagcatgggaggatatatctcttcgcaatctgtgaagaagattattgaaattaatccttatatgcttggtacaatggctggtggagctgctgattgccaattctggcacagaaatctgggaattaagtgccgtctacatgagctggcaaacaaaaggagaatctctgtttcaggagcttcaaagcttcttgctaacatgctctattcctaccgtggaatgggactttctgttggtacaatgattgctggatgggatgaaacaggccctggattgtactatgttgacaacgaaggaggacgacttaagggagacagattctctgtcggttccggttcaccatatgcttatggtgttctggacagcggatacaaattcgatatgtcagttgaagaagcctcagagttagcaaggagatccatataccatgctacattccgtgatggagctagtggtggagttgctagcgtgtaccacgttgggcctcaaggatggaagaaactctctggagacgacgttggcgagctacattaccattattaccccgtgactccagtcaccgcggaacatgtgatggaagaggctgctgaataaatactgtgattcgtctctatcgttcgaagagttctattacatcacttatgttttgttcatctatgaacagaatcaaagattcatcatgtttcatttgtattgcgaatgatgtagacgttagtctggccacaatgatcaggttgataataga

SEQ ID NO: 2114 - DNA, 1113 bp, Arabidopsis thaliana
agagctcaagaaacatccctccataatttgcttctcttttctccaattctcacacattcttctgcttcgttaattttctactcgatttcgctcttcagaaatttgacaatgaagcttgacactagtggattggagacaactatgcctgtgattggctttggatcaaacagtgagatgcttgatgggttttcgtctgcaccttcgtttgatcttcctcgtaccaccgattttgatgggtttcagaaaaaagctgtggagatggtgaagcctgcaaagggtacaactacacttgcgtttatctttaaggaaggtgttatggtagctgctgattctcgagctagcatgggaggatatatctcgtcgcaatctgtgaagaagattattgaaattaatccttatatgcttggtacaatggctggtggtgctgctgattgtcaattctggcacagaaatctgggaattaagtgccgtctacatgagctggcaaacaaaaggagaatctctgtttcaggagcttcaaagcttcttgctaacatgctctattcatatcgtggaatgggactttctgttggcacaatgattgctggatgggatgaaacaggccctggattgtactatgttgacaacgaaggaggacggcttaagggagacagattctctgtcggttcaggttcaccatacgcttatggtgttctggacagcggatacaaattcgatatgtcggttgaagaagcctcagagttagcaaggagatccatctaccatgctacattccgtgatggagctagtggtggagttgctagcgtgtaccacgttgggccgcaaggatggacgaaactctctggagacgacgttggcgagctacattaccattattaccccgtggctccaatcaccgcggaacatgtgatggaagaggctgccgaataagtactgtgattcttgtctatcttactaagagttttattacatcacttatgttttgttcatcaatgaacagaatcatagattcaagtttcttttgtattgcgaatgatgtagacgttagtttggccacaatgatcacgttgcataatagataacataatagataacctgtttctttcttcttct

SEQ ID NO: 2115 - DNA, 1089 bp, Arabidopsis thaliana
gagctcaagaaacatccctccataatttgcttctcttttctccaattctcacacattcttctgcttcgttaattttctactcgatttcgctcttcagaaatttgacaatgaagcttgacactagtggattggagacaactatgcctgtgattggctttggatcaaacagtgagatgcttgatgggttttcgtctgcaccttcgtttgatcttcctcgtaccactgattttgatgggtttcagaaaaaagctgtggagatggtgaagcctgcaaagggtacaactacacttgcgtttatctttaaggaaggtgttatggtagctgctgattctcgagctagcatgggaggatatatctcgtcgcaatctgtgaagaagattattgaaattaatccttatatgcttggtacaatggctggtggtgctgctgattgtcaattctggcacagaaatctgggaattaagtgccgtctacatgagctggcaaacaaaaggagaatctctgtttcaggagcttcaaagcttcttgctaacatgctctattcatatcgtggaatgggactttctgttggcacaatgattgctggatgggatgaaacaggccctggattgtactatgttgacaacgaaggaggacggcttaagggagacagattctctgtcggttcaggttcaccatacgcttatggtgttctggacagcggatacaaattcgatatgtcggttgaagaagcctcagagttagcaaggagatccatctaccatgctacattccgtgatggagctagtggtggagttgctagcgtgtaccacgttgggccgcaaggatggacgaaactctctggagacgacgttggcgagctacattaccattattaccccgtggctccaatcaccgcggaacatgtgatggaagaggctgccgaataagtactgtgattcttgtctatcttactaagagttttattacatcacttatgttttgttcatcaatgaacagaatcatagattcaagtttcttttgtattgcgaatgatgtagacgttagtttggccacaatgatcacgttgcataatagataacataatag

SEQ ID NO: 2116 - DNA, 1147 bp, Arabidopsis thaliana
ctctttcttcttcttctcgtcgtcgtttgtcactttagagctacttcttcttcttctctgctaagcctttcctctcgacttgatacttttctccagtaagggtttgcaaagatgaagcttgatactagtgggttcgagacttccatgcctatgattggatttggctcgagcagtgatatgcttgatgagctttcttctgtaccctcgtttgatctaccccgtactaaagagtttgatggatttcagaaaaaagctaaagacatgttgaagcatgcaaaaggaacaaccactctcgcttttatcttcaaaggtggtgttatggtcgctgctgattctcgggctagcatgggaggatatatctcctcacaatctgtgaagaagattattgaaatcaatccttatatgctcggtacaatggctggaggagctgctgattgccaattctggcacagaaatcttggaattaagtgccgtctacatgagctggcaaacaagaggagaatctctgtttccggagcttcgaaacttcttgccaacatgctctattcataccgtggaatgggactttctgttggtacaatgattgctggatgggacgaaactggtcccggactatactatgtcgacaacgaaggaggacggctcaagggagacaggttttcagtcggttctggttcaccatatgcttacggtgtgctggacagcgggtacaaatatgatatgtcagttgaagaagcttccgagttagcaaggagatcaatctaccatgcgacattccgtgatggagccagtggtggagttgctagcgtgtaccacgttggtcccgaaggatggacgaaactatcaggagatgatgttggggagctacactaccattactaccccgtggcaccagctaccgcagaacaagtcatggaggaagcaacagccgaataaaaatcctgtttagttttctaatcgttcactccctttcttgttgttgcattttgtggtagtatatactgagttgtctctagctgaagctttggtattctattttactgatctgaaatgttgctcgcggattattctctataagattctctttttctgcaatcacattcttctcttactcggtgttttaaattccaatatagggaattgtgat

SEQ ID NO: 2117 - DNA, 1070 bp, Arabidopsis thaliana
tttgtcactttagagctacttcttcttcttctctgctaagcctttcctctcgacttgatacttttctccagtaagggtttgcaaagatgaagcttgatactagtgggttcgagacttccatgcctatgattggatttggctcgagcagtgatatgcttgatgagctttcttctgtaccctcgtttgatctaccccgtactaaagagtttgatggatttcagaaaaaagctaaagacatgttgaagcatgcaaaaggaacaaccactctcgcttttatcttcaaaggtggtgttatggtcgctgctgattctcgggctagcatgggaggatatatctcctcacaatctgtgaagaagattattgaaatcaatccttatatgctcggtacaatggctggaggagctgctgattgccaattctggcacagaaatcttggaattaagtgccgtctacatgagctggcaaacaagaggagaatctctgtttccggagcttcgaaacttcttgccaacatgctctattcataccgtggaatgggactttctgttggtacaatgattgctggatgggacgaaactggtcccggactatactatgtcgacaacgaaggaggacggctcaagggagacaggttttcagtcggttctggttcaccatatgcttacggtgtgctggacagcgggtacaaatatgatatgtcagttgaagaagcttccgagttagcaaggagatcaatctaccatgcgacattccgtgatggagccagtggtggagttgctagcgtgtaccacgttggtcccgaaggatggacgaaactatcaggagatgatgttggggagctacactaccattactaccccgtggcaccagctaccgcagaacaagtcatggaggaagcaacagccgaataaaaatcctgtttagttttctaatcgttcactccctttcttgttgttgcattttgtggtagtatatactgagttgtctctagctgaagctttggtattctattttactgatctgaaatgttgctcgcggattattctctataagattctctttttctgcaa

SEQ ID NO: 2118 - DNA, 1083 bp, Cleome gynandra
cttctatttgcttgctggattattcttctctcttacggtctgtatcaaattttcctattgattctgttccatcaaggatttgaaaatgaagcttgatacaagtgggtttgagtcagctgtgcctatgtttggcggaagcagtgagaacgagatgctggatgggttatccgctgtcccctcctttgatcttcctctcacaaccgattttgatgggtttcaaaaggaagctgtacagatggtgaagcctgcaaagggtacaaccacactcgcctttatctttaaggagggtgtcatggttgccgctgattctcgagcaagcatgggaggatacatctcatcgcagtctgtgaagaagattattgaaattaatccttatatgcttggaacaatggctggaggagctgctgactgccagttctggcacagaaatctgggtattaagtgccgtcttcatgaactagcaaacaagaggagaatctctgtttccggagcatctaagcttcttgccaatatgctctactcataccgtgggatgggactttccgttgggacaatgattgccggatgggatgaaactggtcccggtctatactatgttgacaacgaaggaggccggatcaaaggcgacaggttctcagtgggatctggttcaccatatgcctacggtgtcctcgacagtgggtacaaattcgatatgacagttgaggaagccgcggagctagcgaggagatccatctaccatgccacattccgtgatggggcgagtggtggagttgctagcgtgtaccacgttggaccgaatggatggaagaaactgtcgggagacgacgtgggtgagctacattacaagtactatcctgtgacgccgatcaccacggaacaggtaatggccgaagcatgaggagatggtgtggtataatatcaggcttcatgcccatttgcattgttgatctcagtttatgacagaacttatgttttcttctgtactatcccatgaacatgttctgaaagaatgctgctccgtttttaacggcaagttgcaagtgtactctgaatttagagtttgaaggatgatattacagg

SEQ ID NO: 2119 - DNA, 820 bp, Brassica juncea
atctattcttcttatttctcgtcttcgttggtcacttttgagctccttcttctctcttttcgacagcaagggtttaaaaagatgaagcttgatacaagtgggttcgagacctcaatgcctacgattggctttggctctagcaacgatatgcttgatgggttctctactgtgccctcttttgatcttccccgcaccacagattttgatggatttcagaaagaggcagtgcagatggtgaagccagcgaaaggaacgaccacactcgcttttatcttcaaagaaggtgtcatggtcgctgctgattctcgtgctagcatgggtggatatatctcctcacaatctgtgaagaagattattgaaatcaattcgtatatgcttggtacaatggctggaggagctgctgactgccaattctggcacagaaatcttggaattaagtgccgtctacatgagctggcaaacaagaggagaatctccgtttcaggagcttcaaaacttctcgcaaacatgctctattcataccgcggaatgggcctttctgtcggcacgatgattgctggatgggacgaaactggtccaggactttactatgtcgacaacgaaggaggaaggcttaaaggagacaggttttcagtcggctccggttcaccatacgcttacggtgtactagacagcgggtacaaattcgatatgtcagttgaagaagcatctgagttagcaaggagatcaatctaccatgcgacattccgtgatggagctagtggtggagttgctagcgtgtaccacgtgggtcctaatggatggaagaaactgtcgggag

SEQ ID NO: 2120 - DNA, 1280 bp, Manihot esculenta
atggagtggaatggaaaaggtggggcaaaattgaatgcttcataccacctgcttggttcttggcttcttgccctcggcacaagaaacccccctgctctctacttcgatatctattgcttctccgagcaatttccttcgttactgtcaaatcttcggcctctgagctttcagtctctgctcattctcttcttttctgatcactatctaaggatcatgaagcttgacactagtggtcttgaatcggctgcaccgctctttggagtgactagcgagctggttgatgggttttctaccgtgccttcatttgagcttcccgttactactgattttgatgggttccagaaggaagctatacaaatggtgaagcctgccaaggggacaaccacactcgctttcatttttaaggagggtgtcatggttgctgctgattctcgagctagcatgggaggctatatttcatcacagtctgttaaaaaaatcattgaaatcaatccttatatgcttggtacaatggctggaggagctgcagactgccagttttggcacagaaatctgggcattaagtgtcggctacatgaattggcaaacaagcgtagaatttcagttacgggggcatccaagcttctagcaaacatactgtactcctaccgtggaatgggtctttctgttgggaccatgattgctggatgggatgaaacgggacctggattatattatgtggacagtgaaggagggaggctgaaaggaacaagattctccgttggatctggttccccatatgcttatggtgtactagatagtgggtatcgatatgatttgtcaattgaagaagctgcagagttggctagaagggctatttatcatgctacattccgagatggagccagtggtggagttgctagcgtttatcatgtgggaccaaatggatggaagaagctgtctggtgatgatgttggtgaactccactacaaatactatccagttatgcccagtacagtggaacaggagatggttgaagtagcaggggcatgagaatacttgctcaggttggacacttgccccctcagccccccgcccttacatgatgtctgattcagatggcctgcagtccatcttatgtatctgaaactgctaactattggtgttctttagttgattcctgtggaacaattcatgggttgatgtggcttgttgtcaatgccttgagagtattatttgctattatcttcccattatacaattccgtttctcttgaccattttaaggaaaaaaaggaaaag

SEQ ID NO: 2121 - DNA, 1327 bp, Lactuca sativa
agagtcggattttaagttatagtgttgttcaagaaatcactccttcaaatactctgatttgagttttctctctgctgaatcaacgtattaacaatctggtctattctttccgatttaaaggtggaaatcatgaagctcgactttagtggactagaatcaagtgcaccactctatggaggaagtgatgacttgctttctgatgggttctcagatgccccttcatttgaccttccagttacatcagattttgatggatttcagaagaattctatccaaatggtaaaaccagcaaagggaacaacaactttggcttttatttttaaggaaggtgtgatggttgctgcagattcccgagctagcatgggaggctatatatcatctcaatctgtgaaaaaaatcattgaaattaatccgtatatgcttggtactatggctggaggagctgcagattgtcagttttggcacagaaatttaggcattaagtgtcgtctgcatgaattggcaaacaagagaaggatttcagtgacaggcgcatcaaagatgctggccaacattctctattcttaccgtggcatgggtttgtctgttgggacaatgattgcaggatgggatgaaaagggccctggtctgtattacgtagacagcgaaggtggacgcctcaagggaacaaaattctccgttgggtctggctcaccgtatgcttacggtgtacttgatagcgggtatcaatatgatatgtcaattgaggaagctgctgagctggcgagaagatccatttatcatgctacgttccgcgatggagctagtggtggtgttgccagcgtgtatcatgtggggccgactggatggacaaagctatcgggtgatgatgttggggagcttcactactcttactatccggttgaacccgcaattgttgaacaggaaatgactgaagctgtagctgcttgagttggtaatttgttattaaaaaaatgttaagttgaatgtattttcttatgatttcacaagtttaagatgacattaagtctttttttatttcttgtttactagatttgagacttttttcttgtttctttatatcaaatatttggtctctgtttttgctataaagttataaacttttagcatcgggtgtggatgccgaatgcgaaatggcaaaattttcgaccattttgcatcggttgtcagcaaagtgatacttttcatatgtgaaatggtcattaaacatttcaattaagctttaattgaggcagtaaaatactttgagatgtatagattttagttattaaactaaaatgaaataaaatttgtacacatgttaata

SEQ ID NO: 2122 - DNA, 937 bp, Theobroma cacao
tgcatctcacttgatctctctctctctttttatccgtttcacgatcgcctgcagtctgataggaaagatttttttaaaaaccgaacatgaagcttgacaccagcggtttagaatcggctgcgcctgtctgggctgcttttaatgagcttgctgatgggttctctgctgctccgtcattcgagctcccaaatactactgattttgatgggtttcagaaggaagcaattcagatggtgaaacctgctaagggtaccaccacgcttgccttcatttttaaggaaggcgtcatggttgctgctgattctagagctagcatgggaggctatatctcatcacagtcagtgaagaaaattattgaaatcaacccttacatgcttggcacaatggctggtggagctgcggactgccagttttggcacagaaatttaggcattaagtgccggctacatgaattggcaaacaagcgtagaatttctgttacaggggcatcaaaattgttggcaaacattctttattcttaccgaggaatgggactgtcggttggaaccatgattgctggatgggatgaaacgggtcctggactatactatgtggacagtgaaggggggaggttaaagggcatgcgtttctctgttggatccggttcaccatatgcctatggtgtgctggatagtgggtaccggtatgatatgtcagttgaagaagctgcagagttggcaagaagagctatttatcatgccacattccgagatggtgccagtggtggtgttgccagcgtttaccacgtgggaccaaatggctggaagaagctatctggtgatgatgttggagagcttcactacaaatactatccggtgatgccaagcacggtagaacaggaaatggttgaagtagctggggcctaagtggcttgtactcagcttggactcagttgaag

SEQ ID NO: 2123 - DNA, 1617 bp, Theobroma cacao
atcaaaaaacacacttctttcttttcctcattgtaggtctcttgctgcatctcacttgatctctctctctctctttatccgtttcacgatcgcctgcagtctgataggaaagatttttttaaaaaccgaacatgaagcttgataccagcggtttagaatcggctgagccggtctgggctacttttaatgagcttgctgatgggttctctgctgctccgtcattcgagctcccaaatactactgattttgatgggtttcagaaggaagcaattcagatggtgaaacctgctaagggtaccaccacgcttgccttcatttttaaggaaggcgtcatggttgctgctgattctagagctagcatgggaggctatatctcatcacagtcagtgaagaaaattattgaaatcaacccttacatgcttggcacaatggctggtggagctgcggactgccagttttggcacagaaatttaggcattaagtgccggctacatgaattggcaaacaagcgtagaatttctgttacaggggcatcaaaattgttggcaaacattctttattcttaccgaggaatgggactgtcggttggaaccatgattgctggatgggatgaaacgggtcctggactatactatgtggacagtgaaggggggaggttaaagggcatgcgtttctctgttggatccggttcaccatatgcctatggtgtgctggatagtgggtaccggtatgatatgtcagttgaagaagctgcagagttggcaagaagagctatttatcatgccacattccgagatggtgccagtggtggtgttgccagcgtttaccacgtgggaccaaatggctggaagaagctatctggtgatgatgttggagagcttcactacaaatactatccggtgatgccaagcacggtagaacaggaaatggttgaagtagctggggcctaagtggcttgtactcagcttggactcagttgaaggtgtttgcattcgatgactgcttaatgggatagattctgagactatgtacgcagtttcctctatgtacttgaaatttagccttaagataattcactgatagacgtgggtgcaagttcttgttttaaggatccttcttattgcggttatcgcatcatgtcaaatccagatatcttgatcagtttggtattgttgttgaaaaattttaaggaatctctacttttagctaccccaacatacgaattactatgtgttcatctagggttcggcattttgttaactgccaattttgctgtaacaatctgagtagacaagtcatttggcagggaaatgggtaggtgcagtttccacttgggtttgatttactgcaaaatgtcgaaaaaaactgaaaaaggaagtgtcatgtgcagtaccatgtcttcggcttggcaggcgctgaagcaagctgcaaaagccctgaccacgtggagggctagccatggtgatgaaggaggactctggcaggtgatcccctattatgtagcccattgggagctgacattttgtgtgtgttggaaaaactgaccataatgggcgtccttccaggtggtcggttcaacgtttctgatctgtagttaaatcaacaatccatttggac

SEQ ID NO: 2124 - DNA, 1182 bp, Glycyrrhiza uralensis
ggaaaaacaccatcgtttcagttggcagagcccggagtcctcactcctcagtcactcgctgccaccacactgccacagatccagagcggttcgtcgcgtttatttaccaggtcacgaacctgcaatcatgaagcttgataccagtggtctcgaatcgtttcctacactgattgcacctggaaacgacgtcgttggggacttctctgcccctccatcattcgagcttccaaattccaaagatttcgatggcttccttaaagaagctattcagatggtgaagcctgcaaagggtactacaactcttgcttttatattcaaggagggtgtcatggtagctgccgattctcgagctagcatgggaggatatatatcatcacagtctgttaagaaaattattgaaatcaatccgtatatgctcgggacaatggctggaggtgctgctgattgccaattttggcacagaaatcttgggatcaagtgtcgcttgcatgagttggcaaataaaaggagaatctcagtaacaggagcctctaagttacttgcaaatattttatactcctatcgtggaatggggttatctgttggtaccatgattgctggatgggatgagacgggtcctggtctatattatgttgatagtgaaggaggaagacttaaaggcactagattctctgttggatctggttcaccatatgcttatggtgtattggacagcgggtacaaatatgacatgtcagttgaggaagccgctgaactggcccggcgagcaatttatcatgcaacatttcgtgatggagctagtggtggagttgctagcgtttaccatgtgggaccaaatggatggaagaaattgtctggtgatgatgttggggaacttcattaccattactacccagttaccccaagcaccgtggagcaagaaatggttgaggcaactggagcttgatggagtaactcgtggatatcttttctagtttccaatacttgcctgcttattttgaatcaattgcatgaaactgatcattttatattctaaaccgacattaatttactgtatacacaagtgctgtcctatgttgatgttgtgttgagttttggatcatgtcaaatttaccatcggaagggacagatccatgtgtaatatggatagtttaaatttgaaaagcacgtttgacgcttatt

SEQ ID NO: 2125 - DNA, 1093 bp, Ambrosia trifida
aacggtacgggcggggtagtttctttttttttcttgtttaaatcaacatattaacgatctgggtcgatcaaaaggtggaaatcatgaagctcgactttagcggactagaatcaagtgcaccactctacgggggaagtaatgagttgctttgtgatgggttctcagctgccccttcatttgaccttccagttacatcagattttgatggattccagaagaattctatccaaatggtaaaaccggcaaagggaacaacgaccttggcttttatctttaaggagggtgtgatggttgctgctgattcccgagcaagcatgggggctatatctcatctcaatccgtgaagaaaattattgaaattaatccgtatatgctcggtactatggcaggaggagctgctgattgccaattctggcacagaaatcttggcattaagtgtcgtttgcatgaattggcaaacaagagaagaatttcagtgaccggtgcttcaaagttgttggcaaatattttatattcttaccgtggaatgggtttgtctgtcgggacaatgattgcaggatgggatgaaaagggcccgggtctgtattacgtagacagcgaaggaggacgcctgaagggaacaaagttctcagttgggtctggctcaccatatgcttatggtgtactagatagcgggtacaaatatgatctgacagtcgatgaagctgctgaattggctagaagagccatctatcatgcaacattccgtgatggagctagtggcggtgttgctagcgtttatcatgtggggccaaacggatggacaaaactatcgggtgatgatgttggtgaacttcactactcatactatcctgttgaacccgccatcgttgaacaggaaatgacagaagctgtagctgcctgagtccaccaggttgtttgtaatttcttaaaaacaaacatgatgtgcttttgttatgattttacattccaaatgacatttaactggctttttcttgtttattactagagtgacattcatattatttgcgtttattagtgtcatgaagggtgaatggtatataataatattgtacttaagagcaaaaaagaa

SEQ ID NO: 2126 - DNA, 1105 bp, Vitis vinifera
ccgatctttatttactcagaaagtattcaatcagttcttctccaaacgctgcgtttcgatcgatctgtgagttctaggctataagcatgaagcttgacactagtggtcttgagtcaactgtaccgctcttcggggctaatagcgagcttcttggtgggttttcagctgctccttcatttgagcttccaaacactactgattttgatgggtttcagaaagatgctattcaaatggtgaagccagcaaagggaacaacgactcttgccttcatttttaaggagggtgtaatggttgctgctgattctcgtgctagcatgggaggatatatctcatcacaatctgtgaagaaaattattgaaattaatccctacatgcttggcacaatggctggaggagctgctgattgccagttttggcacagaaatttgggcattaagtgccgactgcatgaacttgcaaacaagcgaaggatttcagttacaggggcttcaaaactgctggcaaacattctatattcttaccgtggaatgggtctatctgttgggaccatgattgctgggtgggatgaaacgggtcctggactgtattatgtggacagtgaagggggcaggctgaaaggaacacgattctctgttggatctggttcgccttatgcttatggtgtactggataatggataccgttatgatatgtctgttgaggaagctgctgaattggctagacgatctatttatcatgcaacattccgtgatggagctagtggtggagttgcaagcgtttattatgtggggccaaatgggtggaagaagctgtctggtgatgatgtcggagaactccactacaaatactacccggttatgccaagcacagtggaacaggaaatggttgaagtagcaggagcttgagagaaagatgccttggaacaacttagaccaggtttgagatgttctcgctcttaatacatgacatgaagggatggattcgcctatgttctgatgaacccaaaaatccttgaatacatgtactttggtttgatcccaaacaactcattaacagacccgggtttcagttattgtcataagaacctttactattatgatccttt

SEQ ID NO: 2127 - DNA, 842 bp, Ambrosia trifida
ggtggaaatcatgaagctcgactttagcggactagaatcaagtgcaccactctacgggggaagtaatgagttgctttgtgacgggttctcagctgccccttcatttgaccttccagttacatcagattttgatggattccagaagaattctatccaaatggtaaagccggcaaagggaacaacgaccttggcttttatctttaaggagggtgtgatggtcgctgctgattcccgagcaagcatgggaggctatatctcatctcaatccgtgaagaaaatcattgaaattaatccctatatgttgggtacaatggcaggaggagctgctgattgccaattctggcacagaaatcttggcattaagtgtcgtttgcatgaattggcaaacaagagaagaatttcagtgactggtgcttcaaagttgttggcaaatattttatattcttaccgtggaatgggtttgtctgtcgggacaatgattgcaggatgggatgaaaagggcccgggtctgtattacgtagacagcgaaggaggacgcctgaagggaacgaagttctcagttgggtctggctcaccgtatgcttatggtgtactagatagcgggtacaagtatgatctgacaatcgatgaagctgctgaattggctagaagagccatctatcatgcaacattccgtgatggagctagtggtggtgttgctagcgtttatcatgtgggaccaaacggttggacaaaactatcgggtgatgatgttggtgaacttcactactcatactatcctgtcgaacccgccatcgttgaacaggaaatgacagaagctgtagctgcctgagtccaccagg

SEQ ID NO: 2128 - DNA, 1257 bp, Fagus grandifolia
tctactccgaccaaatccattcctccattttaatcctctgacactctcgcactcgatctctccgacctcgtctttatttccttattttccacaaaaagtttataaacaaagcatgaagcttgatactagtggtcttgaatcaactgtgccgccctttgcgtcgagcagtgggcttctcgatgggttttcagctgccccgtcatttgagcttcctactactatcgattttgatggatttcaaaaagacgcgatacagatggtgaagccggcgaagggaacaaccacgcttgcattcatattcaaagagggtgtcatggttgctgctgattctcgagctagcatgggaggctatatctcatcacagtctgtaaagaaaatcattgaaatcaatccatacatgcttggcactatggctggaggagctgctgactgtcagttttggcacagaaatctgggcattaagtgccgactgcatgaattggcaaacaagcgcagaatttctgttacaggggcatcaaagctgttggcaaacattctgtactcataccgtggaatgggtctgtctgttgggaccatgattgctggatgggatgagacgggccctggactatactatgtggacagtgaaggaggaaggctcaaaggaacacgattttcagttggatctggttcaccctatgcttatggtgtcctggataatggctaccggtatgatatgtcaattgaagaagctgcagagttggctagaaggtctatctatcatgcaacattccgtgatggagccagtggtggagttgctagcgtttattatgtgggacctgagggatggaagaaactctctggtgatgatgttggagaacttcattaccattactatccagttacgccaagtacagtggaacaggaaatgattgaagtagctgggacataaggctcttgctgaacttggaccatgctatagatgttctcaccttaagggatggattccaaaacatgcttactaggcagaaaatccttaaaagtacatgtatttctggttggtctttgaaacaattcatagatagacttgtctttaaggtattcagagccttatgattcatggcaatgtagttttattgggcagttttttgttgctgatttttacctatattttaatttcttctcgtggtgtattttagttattccactgtgttttattttttctaatatcacccaacccccgccccctcccctgctagggagtcgacgcggccacgt

SEQ ID NO: 2129 - DNA, 1105 bp, Flaveria ramosissima
actctcgttcgagctttttctccgtttgaaacaaagaatttacgatctgtttgatacaaaggtggaaatcatgaagcttgactttagtggactagaatcaagtgcaccactctacggggaaaataatgagttgctttgtgatgggttttcagctgccccttcatttgaccttccagttacatcagattttgatggattccaaaagaattctatccaaatggtaaagccagcaaaaggaacaacaaccttggcttttatttttaaggagggtgtgatggttgctgctgattcccgagcaagcatgggaggctatatctcatctcaatccgtgaagaaaatcatcgaaataaatccctatatgctgggtaccatggcaggtggagcggctgattgccaattctggcacagaaatctaggcattaagtgtcgtttgcatgaattggcaaacaagagaaggatttctgtgactggtgcttcaaagttgttggcaaatattttatattcctatcgtggaatgggtttgtctgttgggacaatgattgcaggatgggatgaaaagggcccgggtctgtattatgtagacagtgaaggaggacgcctgaagggaacaaagttctcagttgggtctggttcaccatatgcttatggtgtgctagacagcgggtataaatatgatctgtcaattgatgaagctgctgaattggctagaagagccatctatcatgcaacattccgtgatggagctagtggtggcgttgctagcgtttatcatgtgggccccaatggatggacaaagctatcgggtgatgatgtcggtgaactgcactactcatactatccagttgaaccagccattgtcgagcaggaaatgaccgaagctgtagctgcctgagtccgccaggttgtttgtaatttccgacaagaaaaagaacataatctcatgattttacattttcagctgtctttttcttgtttatcactggagtcacattcttgttgttccctcatctagagattgttatgcatttatagtagcatcttatcaattgtatcaggttggaaaaagttggaaagttgaattgttgagctcataaaaaaaaatatt

SEQ ID NO: 2130 - DNA, 1496 bp, Gossypium raimondii
gtttatatagatattatctgaatccaagccatgaatgtaaggtccaattcgtctaaatctgggcttacaaagtataatcaatggtggtttcggatcatatctcgggcctattcgctacgcccgaagacccaagcaagcacactgcccctttgctcaagaaaactcccacttaaatttatcaacccccccccccccccaaacccaattttctatattttttttttgctggatctcatttgatttctctttttcttcccgccgatcatctgcaatctgattgaaaagaattgtttaaagaagaaaaaaacgaacatgaagcttgacaccaccggtatggaatcggcggcgccggtttggggttctcataatgaacttgttgatgggttttcggctgctccgtcattcgagctcccaaatactactgattttgatgggtttcaaaaagaagctattcaaatggtgaaacctgctaaaggaaccaccacacttgcctttattttcaaggaaggtgtaatggttgctgctgattctagagctagcatgggaggctatatatcatcacagtcagtgaagaaaattattgaaatcaatccatacatgcttggaacaatggctggtggagctgctgactgccagttttggcacagaaatctgggaatcaagtgccggctgcatgaattggcaaacaaacgtagaatttctgttacaggtgcatcaaaactgttggcaaacattctctattcttaccgtggaatgggactatcagttggaaccatgattgctggatgggatgaaacgggtcccggactatactacgtggacaatgaagggggaaggttaaaaggaatgcgtttctctgttgggtcgggttcaccatatgcttacggtgtgctggataatggctatcggtatgacatgtcagttgaagaggcagcagagttggctcgaagagctatttatcatgccacattccgagacggagccagtggtggtgtcgccagcgtttattacgtgggaccgaatggctggaagaagctatcaggcgatgacgttggagaacttcactatagatactatccggtgatgccgagcacggtagaacaggagatggccgaagtaactggagcctaagaggatcgtccttgacctagacctaattgaagatgtttgccttcacagatcggccgacgggattccatcggattctacaaggacagttcactgatagacttagtttgtcattgttgatgttgaaatttcttaaaagaatcaaattagtttaaacgggaatttgtttggaagttattcagtttcgtttcgaatcgagctcgggtttatttgatttgagctatcaaatgagtcgaatttgaagtaatttaatccctgaattgagtcgttgacaagcttaatcgagtttttctttgtagttagaattgaaaattttctatacaaactcgaaatcaagtataaataattgagtatgagcatgatagttg

SEQ ID NO: 2131 - DNA, 1329 bp, Vitis vinifera
atgcatcgcctttaaggtttgcttgcagcacaagaagacccgatctttatttactcagaaagtattcaatcagttcttctccaaacgctgcgtttcgatcgatctttgagttctaggctataagcatgaagcttgacactagtggtcttgagtcaactgtaccgctcttcggggctaatagcgagcttcttggtgggttttcagctgctccttcatttgagcttccaaacactactgattttgatgggtttcagaaagatgctattcaaatggtgaagccagcaaagggaacaacaactcttgccttcatttttaaggagggtgtaatggttgctgctgattctcgtgctagcatgggaggatatatctcatcacaatctgtgaagaaaattattgaaattaatccctacatgcttggcacaatggctggaggagctgctgattgccagttttggcacagaaatttgggcattaagtgccgactgcatgaacttgcaaacaagcgaaggatttcagttacaggggcttcaaaactgctggcaaacattctatattcttaccgtggaatgggtctatctgttgggaccatgattgctgggtgggatgaaacgggtcctggactgtattatgtggacagtgaagggggcaggctgaaaggaacacgattctctgttggatctggttcgccttatgcttatggtgtactggataatggataccgttatgatatgtctgttgaggaagctgctgaattggctagacgatctatttatcatgcaacattccgtgatggagctagtggtggagttgcaagcgtttattatgtggggccaaatgggtggaagaagctgtctggtgatgatgtcggagaactccactacaaatactacccggttatgccaagcacagtggaacaggaaatggttgaagtagcaggagcttgagagaaagatgccttggaacaacttagaccaggtttgagatgttctcgctcttaatacatgacatgaagggatggattcgcctatgttctgatgaacccaaaaatccttgaatacatgtactttggtttgatcccaaacaactcattaacagacccgggtttcagttattgtcataagaacctttactattatgatccttttgtcctggcaatttagttttattctcagttctttgctgcatgtgtcatgaactttaatttcaatctctttgcagtatcctgatgtgccactgaaaaattcaatgcctctaacaggaccttatccaccaacaatcactccatttttgtgaaagaaccaatggacaatgaatatatctaatctgcaa

SEQ ID NO: 2132 - DNA, 1190 bp, Carica papaya
gaggagatttcaaactcggcccatttgcaaactttgcccgctgcacaagaaaagcgcatatcgctctctttctcttccgttctttctgaacttcttactccctctctcaaataaccactgtacgacgatcgatctctgcgtacactctgaaatcatcgttttcgttttctttaccattctctttaaagatgaagctggacactagtggtcttgaatcagcgacaccactattttgtgcaagaagtgagaatgttgatggcttttccaccaatccatcatttgatcttccacaaactactgattttgatggctttcagaaagaagctattcaaatggtgaagcctgcaaagggaacaaccacacttgctttcatttttaaggaaggtgttatggttgctgctgattctcgagctagcatgggaggatatatttcatcacagtccgtgaagaagattattgaaataaatccttacatgcttggtacaatggccggaggagctgctgactgccagttttggcacagaaatctgggcattaagtgccgactgcatgaattggcaaacaagcgcagaatttcagttaccggggcatcgaagcttttagcaaatattctctactcatatcgtggaatggggctgtctgttgggaccatgattgctggatgggatgaaacgggtcctgggctatattatgtggataatgagggaggaagattgaaaggaacacgtttctctgttggatctggttcaccatatgcttatggtgttcttgataatggataccgatatgatatgtcaattgaagaagctgcagagttggccagaagagctatttatcatgccactttccgagatggagccagtggtggtgttgcaagcgtttactacgtgggacctgatggatggaaaaaactctccggtgatgatgttggagagctgcactataaatactatccagttatgccaagtacagtagagcaggaaatggttgaggtggctggggcataagtgatacggctttagacgaggtctcttatgttctacctctacatagataaggtgggataaattgttttgtactcctgtgcttccccttgtggggccaaatccatttctattttgaagaacattgctgttaattgtttcagttattctgtctttgccaatttcatataacaaacctaattgagc

SEQ ID NO: 2133 - DNA, 954 bp, Ambrosia trifida
aggtggaaatcatgaagctcgactttagcggactagaatcaagtgcaccactctacgggggaagtaatgagttgctttgtgacgggttctcagctgccccttcatttgaccttccagttacatcagatttcgatggattccagaagaattctatccaaatggtgaagccggcaaagggaacaacgaccttagcttttatctttaaggagggtgtgatggtcgctgctgattcccgagcaagcatgggaggctatatctcatctcaatccgtgaagaaaatcattgaaattaatccctatatgttgggtacaatggcaggaggagctgcggattgccaattctggcacagaaatcttggcattaagtgtcgtttgcatgaattggcaaacaagagaagaatttcagtgactggtgcttcaaagttgttggcaaatattttatattcttaccgtggaatgggtttgtctgtcgggacaatgattgcaggatgggatgaaaagggcccgggtctgtattacgtagacagcgaaggaggacgcctgaagggaacaaagttttcagttgggtctggctcaccatatgcttatggtgtactagatagcgggtacaaatatgatctgacaatcgatgaagctgctgaattggctagaagagccatctatcatgcaacattccgtgatggagctagtggtggtgttgctagcgtttatcatgtggggccaaacggatggacaaaactatcgggtgatgatgttggtgaacttcactactcatactatcctgttgaacccgctgtcgttgaacaggaaatgacagaagctgtagctgcctgagtccaccaggttgtttgtaatttcttaaaaacaaaacatgatgtgcttttgttatgattttacatttcaaatgacatttaactgtctttttcttgtttattattagagtgacattaatatt

SEQ ID NO: 2134 - DNA, 1078 bp, Tragopogon dubius
tattctcattctagttttctcactactgaaacaacgtattaacgatctggtctatcctattcgattcaaaggtggaaatcatgaagcttgactttagtggactagactcgagtgcacccctctatgggggaagtaacgatttgctttctgatgggttctcagctgccccatcatttgaccttccagttacatcagattttgatggatttcagaagagttctatccaaatggtaaagccagcaaagggaacaacaaccttggcttttatttttaaggatggtgtgatggttgctgctgattccagagctagcatgggaggctatatatcatcacaatctgtgaagaaaatcattgaaattaatccgtatatgttgggtacaatggctggaggagctgccgattgccagttctggcacagaaatctaggcattaagtgtcgtttgcatgaattggcaaacaagagaagaatttcagtgactggtgcttcaaagttgctggccaacattctgtattcttaccgtggtatgggtttgtctgttgggacaatgattgcaggatgggatgaaaagggcccaggtctgtattacgtagacagtgaaggaggacgtctgaaaggaacaaaattctccgttgggtctggttcaccgtatgcttatggtgtactagatagcgggtaccgctatgatatgacaatagatgaagctgctgagctggcgagaagatccatctatcatgctacattccgtgatggagctagtggcggtgttgccagcgtgtatcatgtgggaccaactggatggacaaagctatcgggtgatgatgttggtgaacttcactactcttactatccagttgaacctgcgattgttgaacaagaaatgaccgaagctgtagctgcttgagtggtaatttgtttaaaaaatatgtactttgttatgatgatttaacgagttcaaatgacatttagtgccctttttttactagatttgggacttttaattgttgcttcatcttaaatattatgcacttattgctactttgaatctgctaatggtggtgttattgtgatttattggat

SEQ ID NO: 2135 - DNA, 1174 bp, Gossypium raimondii
tatatttcagtttgctttgctttgctgcatcttattctcacttcacctttttttttttattgtctggatcatcggaaagaaattaaagaaccaatcatgaagcttgacaccagcggactagaatcggctgcgcctgtctggggtgctcccagtgaacttgttgacgggttttcggctgctccgtcgttcgatctcccaaacactactgattttgatgggtttcaaaaagaagctatccagatggtaaaacctgctaagggtaccaccacgctagctttcatctttaaggaaggggtcatggttgccgctgattctagagctagcatgggaggctatatctcttcacagtcagtgaagaaaattattgaaatcaatccttacatgcttggaacaatggctggaggagctgctgactgccagttttggcacagaaatttaggcatcaagtgccggctgcatgaattagcaaacaagcgtagaatttcagttacaggggcatcaaaactgttggcaaacattctctattcttaccgaggaatgggactttcggttggaaccatgattgctggatgggatgaaacgggccctggactatactatgtggacagtgaagggggaaggttaaaaggaatgcgtttctctgttggatctggttcaccatatgcttatggtgtgctggataatggctatcggtatgatatgtctgttgaagaggctgcagagttggccagaagagctatttatcatgccacattccgagatggagccagtggtggtgttgccagcgtttactacgtgggaccaaatgggtggaagaagctatctggtgatgatgttggagaacttcactataaatactatccagtgatgccaagcacagtggaacaggaaatggttgaagtaggtggggcataaatgggatctactcaacctaggccaagttgataagatggatgaatgggatatattcttatatacagtgaatacttggccttaaaagacaatgtgatgatgttgagtttgttatttgatgttgaaaattttaaggaatctcgggttttagtaaccccaacatttgaaatattcagtgttcatgtgtagggtcatttggcttgggaaatttggtaagtggtgtttccagtttcaattaaagcttggttgtttcctgcaaaat

SEQ ID NO: 2136 - DNA, 1201 bp, Gossypium raimondii
ttattttttgctggatctcatttgatttctctttttcttcccgccgatcatctgcaatctgattgaaaagttttgtttaaagaagaaaaaaacgaacatgaagcttgacaccaccggtatggaatcggcggcgccggtttggggttctcataatgaacttgttgatgggttttcggctgctccgtcattcgagctcccaaatactactgattttgatgggtttcaaaaagaagctattcaaatggtgaaacctgctaaaggaaccaccacacttgcctttattttcaaggaaggtgtaatggttgctgctgattctagagctagcatgggaggctatatatcatcacagtcagtgaagaaaattattgaaatcaatccatacatgcttggaacaatggctggtggagctgctgactgccagttttggcacagaaatctgggaaccaagtgccggctgcatgaattggcaaacaaacgtagaatttctgttacaggtgcatcgaaactgttggcaaacattctctattcttaccgtggaatgggactatcagttggaaccatgattgctggatgggatgaaacgggtcccggactatactacgtggacaatgaagggggaaggttaaaaggaatgcgtttctctgttgggtcgggttcaccatatgcttacggtgtgctggataatggctatcggtatgacatgtcagttgaagaggcagcagagttggctcgaagagctatttatcatgccacattccgagacggagccagtggtggtgtcgccagcgtttattacgtgggaccgaatggctggaagaagctatcaggcgatgacgttggagaacttcactatagatactatccggtgatgccgagcacggtagaacaggagatggtcgaagtaactggagcctaagaggatcgtccttgacctagacctaattgaagatgtttgccttcacagatcggccgacgggattccatcggattctacaaggacagttcactgatagacttagtttgtcattgttgatgttgaaatttcttaaaagaatcaaattagtttaaacgggaacttgtttggaagttattcagttctgttacgtttcgaatcgagctcgggtttatttgatttgagctatcaaatgagtcgaatttgaagtaatttaatccctgaattgagtcgttgacaagcttaatc

SEQ ID NO: 2137 - DNA, 1122 bp, Fagus grandifolia
cctcacgttatagtaatataccagtctactccgaccaaatccattcctccattttaatcctctgacactctcgcactcgatctctccgacctcgtctttatttccttattttccacaaaaagtttataaacaaagcatgaagcttgatactagtggtcttgaatcaactgtgccgccctttgcgtcgagcagtgggcttctcgatgggttttcagctgccccgtcgtttgagcttcctactactatcgattttgatggatttcaaaaagacgcgatacagatggtgaagccggcgaagggaacaaccacgcttgcattcatattcaaagagggtgtcatggttgctgctgattctcgagctagcatgggaggctatatctcatcacagtctagtaaagaaaatcattgaaatcaatccatacatgcttggcactatggctggaggagctgctgactgtcaattttggcacagaaatctgggtattaagtgccgactgcatgaattggcaaacaagcgcagaatttcagttacaggggcgtcaaagcttttggcaaacattctgtactcttaccgtggaatgggtctgtctgttgggaccatgattgctggatgggatgagacgggtcctggactatactatgtggacagtgaaggaggaaggctcaaaggaacacggttttcagttggatctggttcaccctatgcttatggtgtcctggataatggctatcggtatgatatgtcaattgaagaagctgcagagttggctagaaggtctatttatcatgcaacattccgtgatggagccagtggtggagttgctagtgtttattatgtgggacctgatggatggaagaagctctccggtgatgatgttggagaacttcattaccattactatccagttatgccgagtacagtggaacacgaaatggttgaagtagctggggcataaagctgttgccgaacttggaccatgctatagatgttctcacctcaagggatggattccaagacatgatcacaaggcagaaacttcttcaagtgcatgtatttccggttggcctttgaaacaattcatagattgacaaagacttgtctttaaggttatgagagcccta

SEQ ID NO: 2138 - DNA, 982 bp, Fagus grandifolia
agggtttgctctctcagctctcggaattcgtttctcgtttctcgcttctcgatcatctcttctctgatctctaagttcataaaagcatgaagcttgatactagtggtcttgaatcaactgcgccgcttttcgggacgagaagtgagcttcttgatgggttttcagccaccccatcatttgagcttccgaatactatcaattttgatggatttcagaaagaggctatacagatggtgaagccagcaaaaggaacaaccacgcttgcattcatattcaaagagggtgtcatggttgccgctgattctcgagctagcatggggggctatatctcgtcacagtctagtaaagaaaatcattgaaatcaatccttacatgcttggcactatggctggaggtgctgctgactgtcagttttggcacagaaatctgggcattaagtgccgactgcatgaattggcaaacaagcgcagaatttctgttacaggggcatcaaagctgttggcaaacattctgtactcataccgtggaatgggtctgtctgttgggaccatgattgctggatgggatgagacgggccctggactatactatgtggacagtgaaggaggaaggctcaaaggaacacgattttcagttggatctggttcaccctatgcttatggtgtcctggataatggctaccggtatgatatgtcaattgaagaagctgcagagttggctagaaggtctatctatcatgcaacattccgtgatggagccagtggtggagttgctagcgtttattatgtgggacctgagggatggaagaaactctctggtgatgatgttggagaacttcattaccattactatccagttacgccaagtacagtggaacaggaaatgattgaagtagctgggacataaggctcttgctgaacttggaccatgctatagatgttctcaccttaagggatggattccaaaacatgcttactaggca

SEQ ID NO: 2139 - DNA, 1342 bp, Gossypium hirsutum
ctgcatcttattctcacttcaccttttttttttttattgtctggatcatcggaaagaaattaaagaaccaatcatgaagcttgacaccagcggactagaatcggctgctcctgtctggggtgctcccagtgaacttgttgacgggttttcggctgctccgtcgttcgatctcccaaacactactgattttgatgggtttcaaaaagaagctatccagatggtaaaacctgctaagggtaccaccacgctagctttcatctttaaggaaggggtcatggttgccgctgattctagagctagcatgggaggctatatctcttcacaatcagtgaagaaaattattgaaatcaatccttacatgcttggaacaatggctggaggagctgctgactgccagttttggcacagaaatttaggcatcaagtgccggctgcatgaattagcaaacaagcgtagaatttcagttacaggggcatcaaaactgttggcaaacattctctattcttaccgaggaatgggactttcggttggaaccatgattgctggatgggatgaaacgggccctggactatactatgtggacagtgaagggggaaggttaaaaggaatgcgtttctctgttggatctggttcaccatatgcttatggtgtgctggataatggctatcggtatgatatgtctgttgaagaggctgcagagttggccagaagagctatttatcatgccacattccgagatggagccagtggtggtgttgccagcgtttactacgtgggaccaaatgggtggaagaagctatctggtgatgatgttggagaacttcactataaatactatccagtgatgccaagcacagtggaacaggaaatggttgaagtaggtggggcataaatgggatctactcaacctaggccaagttgataagatggatgaatgggatatattcttatatacaatgaatacttggccttaaaagacaatgtgatgatgttgagtttgttctttgatgttgaaaattttaaggaatctcgggttttagtaatcccaacatttgaaatattcagtgttcatgtgtagggtcatttggcttgggaaatttggtaagtggtgtttccagtttcaattaaagcttggttgtttcctgcaaaatgtctgaaaaaggtgagaatgaaaacacttgattatggagttgggtttcagtagtgagacatgaattgcctcctacatcccaacagcattggggtgttcacgtatgtccccaaatgctcatgagagaagttgaataagcaaagctgatgaggaaataatttaatcaataatcaaatactctacgaatacctt

SEQ ID NO: 2140 - DNA, 1242 bp, Gossypium hirsutum
tggatctcatttgatttctctttttcttcccgccgatcatctgcaatctgattgaaaagaattgtttaaagaagaaaaaaacgaacatgaagcttgacaccaccggtatggaatcggcggcgccggtttggggttctcataatgaacttgttgatgggttttcggctgctccgtcattcgagctcccaaatactactgattttgatgggtttcaaaaagaagctattcaaatggtgaaacctgctaaaggaaccaccacacttgcctttattttcaaggaaggtgtaatggttgctgctgattctagagctagcatgggaggctatatatcatcacagtcagtgaagaaaattattgaaatcaatccatacatgcttggaacaatggctggtggagctgctgactgccagttttggcacagaaatctgggaatcaagtgccggctgcatgaattggcaaacaaacgtagaatttctgttacaggtgcatcaaaactgttggcaaacattctctattcttaccgtggaatgggactatcagttggaaccatgattgctggatgggacgaaatgggtcccggactatactacgtggacaatgaagggggaaggttaaaaggaatgcgtttctctgttgggtcgggttcaccatatgcttacggtgtgctggataatggctatcggtatgacatgtcagttgaagaggcagcagagttggctcgaagagctatttatcatgccacattccgagacggagccagtggtggtgtcgccagcgtttattacgtgggaccgaatggctggaagaagctatcaggcgatgacgttggagaacttcactatagatactatccggtgatgccgagcacggtagaacaggagatggccgaagtaactggagcctaagaggatcgtccttgacctagacctaattgaagatgtttgccttcacagatcggccgacgggattccatcggattctacaaggacagttcactgatagacttggtttgtcattgttgatgttgaaatttcttaaaagaatcaaattagtttaaacgggaatttgtttggaagttattcagtttcgtttcgaatcgagctcgggtttatttgatttgagctatcaaatgagtcgaatttgaagtaatttaatccctgaattgagtcgttgacaagcttaatcgagtttttctttgtagttagaattgaaaattttctatacaaactcgaaatcaagtat

SEQ ID NO: 2141 - DNA, 1593 bp, Gossypium raimondii
cataaaactagctctttggcccatagatcttgttaactgtaagagattctgtggactgggataattgtgtggtttacaaagtcgatactcccatctccgttttggatcaaagcttgggccaatctgagacaacccaaacaagcagattttcccagtttcccgtagcacaagaaaactgaggaagaaaaagtagaaatcaaccctttttcctccttatatttcagtttgctttgctttgctgcatcttattctcacttcacctctttttttttattgtctggatcatcggaaagaaattaaagaaccaatcatgaagcttgacaccagcggactagaatcggctgcgcctgtctcgggtgctcccagtgaacttgttgatgggttttcggctgctccgtcgttcgatctcccaaacactactgattttgatgggtttcaaaaagaagctatccagatggtaaaacctgctaagggtaccaccacgctagctttcatctttaaggaaggggtcatggttgccgctgattctagagctagcatgggaggctatatctcttcacagtcagtgaagaaaattattgaaatcaatccttacatgcttggaacaatggctggaggagctgctgactgccagttttggcacagaaatttaggcatcaagtgccggctgcatgaattagcaaacaagcgtagaatttcagttacaggggcatcaaaactgttggcaaacattctctattcttaccgaggaatgggactttcggttggaaccatgattgctggatgggatgaaacgggccctggactatactatgtggacagtgaagggggaaggttaaaaggaatgcgtttctctgttggatctggttcaccatatgcttatggtgtgctggataatggctatcggtatgatatgtctgttgaagaggctgcagagttggccagaagagctatttatcatgccacattccgagatggagccagtggtggtgttgccagcgtttactacgtgggaccaaatgggtggaagaagctatctggtgatgatgttggagaacttcactataaatactatccagtgatgccaagcacagtggaacaggaaatggttgaagtaggtggggcataaatgggatctactcaacctaggccaagttgataagatggatgaatgggatatattcttatatacagtgaatacttggccttaaaagacaatgtgatgatgttgagtttgttatttgatgttgaaaattttaaggaatctcgggttttagtaaccccaacatttgaaatattcagtgttcatgtgtagggtcatttggcttgggaaatttggtaagtggtgtttccagtttcaattaaagcttggttgtttcctgcaaaatgtctgaaaaaggtgagaatgaaaacacttgattatggagttgggtttcagtagtgagacatgaattgcctcctacatcccaacagcattggggtgttcacgtatgtccccaaatgctcatgagagaagttgaataagcaaagctgatgaggaaataatttaatcaataatcaaataccctacgaatccctttctcactagccaaa

SEQ ID NO: 2142 - DNA, 1405 bp, Prunus mume
gcgcaagttatttcctttaccaaatacaaaagcccaatttattttcagttttcccaccaacttgggcctaccatctcggcccaaaaataaaatgaaagtcgacaaagcagtctcctagccatcactattaacactttcctcgagcacaagaaacccactctgtctaaataagcattccttccattaattttctctgctcgatcttcgtctctgttcttcgtcttcctcttcctttgcgtgattatcaatcgtccagaaatttaagagaaatgaagcttgatactagcggtcttgaatcagccgcgccgctggttggcgcgagcagtgggtttctcgatgggtttgcagatgctccatcgttcgaggttcctactaccaatgattttgatggctttcagaaagaagctattcaaatggtgaagcctgccaaggggacaaccacacttgcttttatcttcaaggaaggcgtcatggttgccgctgattctcgagctagcatgggaggatatatatcctcacaatctgtgaagaaaattattgaaatcaatccttacatgcttggtacaatggctggaggagccgctgactgccagttttggcatagaaatctagggataaagtgccgattgcatgaattggcaaacaagcgcagaatttcagttacaggggcatcaaagctgttggcaaacattctgtactcttaccgtggcatgggtctctctgttgggaccatgatagctggatgggatgaaacgggtcctggactctattatgtggacagtgagggaggaagattgaaaggcatgcggttttcagttggatctggttcaccatatgcttatggtgttctcgataatgggtaccggtacgatatgtctgttgaagaagctgctgaattggctagaagggctatatatcatgcaacattccgtgatggagccagtggtggagttgcgagcgtttatcacgtgggaccaaatggatggaagaagctttctggcgacgatgttggggagcttcactatcactattatcctgtagtccaaggtgcagttgaacaggaaatggttgaagtagctggggcctaagaatcttacacaacctggaccaggtttgaagtgttgttccccccctcatgtatctgatggcagatggaaacgcaagactataggatttcatgtcctattttggttgatatgttgttagaatcgggatttgaagtttgatgtcatacaattttctgataatcatcatctttccattgtggattacattttatctattgttggtgatgcccttccattttagttaaaccctggtcaaactgggttatattttttatcggtgctcatacccctggcatgttcgtattttataatactaatctaaatccaatgggagaaaa

SEQ ID NO: 2143 - DNA, 1220 bp, Prunus persica
atcactattaacactttcctcgagcacaagaaacccactctgtctaaataagcattccttccattaattttctctgctcgatcttcgtctccgttcttcgtcttcctcttcctctgcgtgattatcagtcgtccagaaatttaagagatatgaagcttgatactagcggtcttgaatcagctgcgccactggttggcgcgagcagtgggtttcttgatgggtttgcagatgctccatcgttcgaggttcctactaccaatgattttgatggctttcagaaagaagctattcaaatggtgaagcctgcgaaggggacaaccacacttgcgtttatcttcaaggatggcgtcatggttgccgctgattctcgagctagcatgggaggatatatatcctcacaatctgtgaagaaaattattgaaatcaatccttacatgcttggtacaatggctggaggagccgctgactgccagttttggcatagaaatctggggattaagtgccggttgcatgaattggcaaacaagcgcagaatttcagttacaggggcatcaaagctgttggcaaacattctgtactcttaccgtggcatgggtctctctgttgggaccatgatagctggatgggatgaaacgggtcctggactttattatgtggacagtgagggaggaagattgaaaggcatgcggttttcagttggatctggttcaccatatgcttatggtgttctcgatgatgggtaccggtacgatatgtctgttgaagaagctgctgagttggctagaagggctatatatcatgcaacattccgtgatggagccagtggtggagttgcaagcgtttatcacgtgggaccaaatggatggaagaagctttctggcgacgatgttggggagcttcactatcactattatcctgtagtcgaaggtgcagttgaacaggaaatggttgaagtagctgcggcctaagaatcttgcgcaacctggaccgggtttgaagtgttgttcccccccttcatgtatctgatggcagatggaaatgcaagactagaggatttcatgacctatttcggttgatatgttgttagaatcgggattttaagtttgatgtcatagaactttctgaaaatcatcatcatctttccattgtggatttcattttatctattgttggtgatgcccttccattttagttaaaccctggtcaaactgggttatatt

SEQ ID NO: 2144 - DNA, 960 bp, Arnica chamissonis
catacttctcgattaaaaggtggaaatcatgaagcttgactttagtggactagaatcgagtgcaccactctacggcggaaataatgagttgctgtctgatgggttctcagctgccccttcatttgatcttccagtgacatcagattttgatgatttccagaagaattctatccaaatggtaaaaccagcaaaggggactacaaccttggcttttatttttaaggagggtgtaatggttgctgctgattcccgagctagcatgggaggctatatctcatctcaatctgtgaagaaaatcattgaaattaatccctatatgctgggtacaatggctggaggagctgcagattgccagttctggcacagaaatctaggcattaagtgccgtttgcatgaattggcaaacaagagaaggatttcagtgactggtgcttcaaaattgctggcaaatatattatattcttatcgtggaatgggtttgtctgttgggacaatgattgcaggatgggatgaaaagggtccgggtctgtattatgtggacagtgaaggaggacgcctgaagggaacaaagttctcagttgggtctggttcaccatatgcttatggtgtactagatagcgggtataaatatgatatgtcaattgatgaagctgctgaattggctagaagagccatttatcatgcaacattccgtgacggagctagtggcggtgttgcgagcgtttatcatgtgggcccaaccggatggacaaagctatcgggtgatgatgttggtgaacttcactactcgtactatcctgtcgaacccgccattgttgaacatgaaatgaccgaggctgtagctgtctgagtcgaacgggttgctggtaatttgttaaaaaaaacatgggagcatgatgtacttttgttatgattttacattttcaaatgacattaacttgtctttttcttgtttattac

SEQ ID NO: 2145 - DNA, 1110 bp, Cichorium intybus
atagaatcggatctctatttctgctttgttctgagatatctcctgtaaatactctcattcgagttttctccctgctgaatcaacgtattaacaacaatctggtctattctttgcgatttacaggtggaaatcatgaagcttgactttagtggactggaatctcatgcaccactctatggaggaagtaatgatttgctttctgatggactctcggatgccccttcatttgaccttccagttacatcagattttgatggattccagaagaattctatccaaatggtaaagccagcaaagggaaccacaactttggcttttatattcaaggaaggtgtgatggttgctgcagattcacgagctagcatgggaggctatatatcatctcagtctgtgaagaaaatcattgaaattaatccatatatgctcggtacaatggctggaggagctgcagattgtcagttctggcacagaaatctaggcattaaatgtcgtttgcatgaattggcaaacaagagaaggatttcagtaactggcgcttcaaagttgcttgctaatattctctattcttatcgtggaatgggtttgtctgtgggcacaatgattgcgggatgggatgaaaagggccctggtttgtattatgtagacagcgaaggaggacgcctcaagggaacaaaattctccgtcgggtccggttcaccgtatgcttacggtgtactagacagcgggtaccgctatgatatgacaatcgatgaagctgctgagctggcgagaagatccatttaccatgcaacattccgtgatggagctagtggtggtgttgctagcgtttatcatgtgggacccactggatggacaaagctatcgggtgatgatgttggtgagcttcattactcttactatcctgttgcacctgccattgttgaacaggaaatgactgaagctgtagttgcctgagttggtgaagtttggtaatttgttaaaaaaatgtgttttgtttgttatatgatttaacaagttcgaattgacattatgtgccttttcttgtttactagatttgagacttttaattgttctttcatcttaaatattataagtgcttgttggtgtaaa

SEQ ID NO: 2146 - DNA, 927 bp, Cichorium intybus
atcacgtattaacacaatctggtctattctttgcgatttacaggtggaaatcatgaagctcgactttagtggactggaatctcatgctccactctatggaggaagtaacgatttgctttctgatggactctcagatgccccttcctttgaccttccagttacatcagatttcgatggattccagaagaattctatccaaatggtaaaaccagcaaagggaaccacaactttggcttttatattcaaggaaggtgtaatggttgctgcagattcacgagctagcatgggtggctatatatcatctcagtctgtgaaaaaaatcatcgaaattaatccatatatgctcggtacaatggctggaggagctgcagattgtcagttctggcacagaaatttaggcattaagtgtcgtttacatgaattggcaaacaaaagaaggatttcagtaactggtgcttcaaagttgcttgctaatattctctattcttatcgtggaatgggtttgtctgtgggcacaatgattgcaggatgggatgaaaagggccctggtttgtattatgtagacagcgaaggaggacgtcttaaaggaacaaaattctccgtcgggtccggttcaccgtatgcttacggtgtactagacagcgggtaccgctatgatatgacaattgatgaagctgctgagctggcgagaagatcgatttatcatgcaacattccgtgatggagctagtggtggtgttgctagtgtttatcatgtgggacccactggatggacaaagctatcgggtgatgatgttggtgagcttcattactcttactatcctgttgcacctgccattgttgaacaggaaatgagtgaagctgtagttgcatgagtcgggtgaagtttggtattttgttaaaaaaatgtgttttgtttgttatatga

SEQ ID NO: 2147 - DNA, 1021 bp, Cirsium arvense
attaacgatctggtttatccttctcgatttaaaaggttgaaatcatgaagcttgactttggtggactagaatcgagtgcaccactctatgggggaaatgacgacttgctatctgatgggttctcaactgccccttcatttgaccttccggttacatcagattttgatggattccagaagaattctatccaaatggtaaagccagcaaagggaactacaaccttggcttttatctttaaggagggtgtgatggttgctgcagattcccgagctagcatgggaggctatatctcatctcaatctgtgaagaagatcattgaaattaatccttatatgttgggtacaatggctggaggagctgccgattgccagttctggcacagaaatctaggcattaagtgccgtttgcatgaattggctaacaagagaaggatttcagtgacgggtgcctcaaagttgctggcaaacattctttactcttatcgtggaatgggtttgtctgtcgggacaatgattgcaggatgggacgagaagggccctggtctgtattacgtcgacagcgaaggaggacgtctgaagggaacaaaattctccgttgggtctggttcaccatatgcttatggtgtattggatagcgggtaccactatgatatgacgatcgatgaagctgctgaattggctagaagatccatctatcatgccacattccgtgatggagctagtggtggtgttgctagcgtttatcacgtgggaccaactggatggacgaagctatcgggtgatgatgttggtgaacttcactactcatactaccctgttgaaccagccattgttgaacaagaaatgactgaagctgtagttgcttgagtgctggtaatttgttaaaaaacatgtattttgttatgattttatgaagttcataatgacatttaagtggcctttttttgcttactagatttgaccttattgttcccaaatattatgcactttttagtactctgagtttgctaatggtaattgtt

SEQ ID NO: 2148 - DNA, 1137 bp, Euphorbia peplus
gtctatgatcatgaagcttgatactagccgtttcgagtcggttactccatttggagcacctagtgagcttgttgatggctttgggttttctactgcgccgtctttcgagcttcccgttactactgattttgatggcttccagaaggaagctgtgcaaatggtgaagcctgctaagggtactactacacttgctttcatatttaaggatggcattatggtcgctgctgattctcgagctagcatgggaggatatatctcttcacagtcggtgaaaaagatcattgaaatcaatccttacatgcttggtaccatggctggaggagctgctgactgccaattttggcacagaaacttgggcattaagtgccggctgcatgaattggcaaacaagcgcagaatttcagttacaggagcgtcaaagcttttggcgaacatattgtactcctaccgcggaatggggctttcggttggcaccatgattgctggttgggatgaaacgggtcctggattatactatgttgacagtgaaggaggaagactgaaaggaatgagattctctgttggctctggttccccatatgcttatggtgttctagatagcgggtataagtttgatatgtccatcgatgaagctgcagagttggctagaagatctatttatcatgctacattccgagatggggccagtggtggagttgctagcgtttattatgttggaccggatggatggaagaagctatctggtgacgatgttggagaacttcactacaaatactatccagttacgcccagtaccgtcgaacaggaaatggttgaagtaacaggggcttgagaaactcaggtacatcagttggacagttctacccttgtgacggtatttgaatagaatcagaaactactaaaatctgaagttggtacctagaacatgtcatggattgatatgggttttgtcatgaggacacttttgtcattattgtcgtatcatgtaattctgtttgtttctttgtttaacagtcatagtggaattcaacagttcatttctttgttggttcttcaaaaactccttataatcctagtttttggatgtgaaaaatcgttggcaagctatttttttgagtagcagaaccaatcgttgga

SEQ ID NO: 2149 - DNA, 1056 bp, Flaveria ramosissima
cttttttctccgttgaaacaaagaatttacgatctgtttgatacaaaggtggaaatcatgaagcttgactttagtggacttgaatcaagtgcaccactctacggagaaaataatgagttgctttgtgatgggttttctgctgccccttcatttgaccttccagttacatcagattttgatggattccaaaagaattctatccaaatggtaaagccagcaaaaggaacaacaaccttggcttttatttttaaggagggtgtgatggttgctgctgattcccgagcaagcatgggaggctatatctcatctcagtccgtgaagaagatcatcgaaattaatccctatatgctgggtaccatggcaggtggagctgctgattgccaattctggcacagaaatctaggcattaagtgtcgtttgcatgaattggcaaacaagagaaggatttctgtgactggtgcttcaaagttgttggcaaatattttatattcctatcgtggaatgggtttgtctgtggggacaatgattgcaggatgggatgaaaagggcccgggtctgtattatgtagacagcgaaggaggacgcctgaagggaacaaagttctcagttgggtctggttcaccatatgcttatggtgtactagatagtgggtataaatatgatctgacaattgatgaagctgctgaattggctagaagagctatctatcatgcaacatttcgtgatggagctagtggtggcgttgctagcgtttatcacgtgggccccaatggatggacaaagctatcgggtgatgatgtcggtgaactgcactactcatactatccggttgaaccagccattgttgagcaggaaatgaccgaagctgtagttgcctgagtcggccaggtagtttgtaatttctgacgaaaaaaagaacataatctcatgattttacattttcagctgtctttttcttgtttattactggagtcacattcttgttgttccttcatctaaagattgttatgcatttatagttgcatctaatcaattgtatcttgttggtgggatatt

SEQ ID NO: 2150 - DNA, 1011 bp, Flaveria ramosissima
aaatactctcgttcgagctctttctctgttgaaacaaggaatttacgatctgtttgatacaaaggtggaaatcatgaagcttgactttagtggactggaatcaagtgcgccactctatggagaaaataatgagttgctttgtgatgggttttcagaagccccttcatttgaccttccagttacatcagattttgatggattccaaaagaattctattcaaatggtaaagccagcaaaaggaacaacaaccttggcttttatttttaaggagggtgtgatggttgctgctgattcccgagcaagcatgggaggctatatctcatctcaatccgtgaagaaaatcatcgaaattaatccctatatgctgggtaccatggcaggtggagctgctgattgccaattctggcacagaaatctaggcattaagtgtcgtctgcatgaattggcaaacaagagaaggatttctgtgactggtgcttcaaagttgttggcaaatattttatattcctatcgtggaatgggtttgtctgttgggacaatgattgcaggatgggatgaaaagggcccgggtctgtattatgtagacagtgaaggaggacgcctgaagggaacaaagttctcagttggatctggttcaccatatgcttatggtgtactagacagtgggtataaatatgatctgacaattgatgaagctgctgaattggctagaagagccatctatcatgcaacattccgtgatggagctagtggtggcgttgctagcgtttatcatgtgggccccaacggatggacaaagctatcgggtgatgatgtcggtgaactgcactactcatactatccggttgaaccagccattgttgagcaggaaatgaccgaagctgtagttgcctgagttggctatgtctgtaatttctgaacgaaaaaagacataatctcatgattttacattttcagtccgttctttttctttagtttatttacgtggggttctacgtttcgtttgtttcg

SEQ ID NO: 2151 - DNA, 1016 bp, Guizotia abyssinica
actctcgttcaaccttttgtctgttgaatcaacctgctaacgatctcttttatcttttctcgatttgaaggttgtgatcatgaagcttgactttagtggactagaatcgagtgcaccactctacgggggaagtaatgagttgctgtctgatgggttctcagctgccccttcgtttgatcttcctgtcacatcagattttgatgacttccagaagaattctatccaaatggtaaagcctgcaaaggggacaacaaccttggcttttatttttaaggagggtgtgatggttgctgctgattctcgtgctagcatgggaggctatatctcatctcaatctgtgaagaaaatcattgaaattaatccttatatgctgggtacaatggctggaggagctgcagattgccagttttggcacagaaatttaggcattaagtgtcgtttgcatgaattggcaaacaagagaaggatttcagtgactggtgcttcaaagttgctggcaaatttattgtattcttatcgtggaatgggtttgtctgttgggacaatgattgcaggatgggatgaaaagggcccgggtctgtattatgtagacagtgaaggaggtcgcctgaagggaaaaaagttctcagttgggtctggttcaccatatgcttatggtgtgctagatagcgggtacaaatatgatatgacaattgatgaagctgctgaattggctagaagagccatttatcatgcacattccgtgatggagctagtggcggtgttgctagtgtttaccatgtgggcccaactggatggacaaagttatcgggtgacgatgttggtgaacttcactaccattactaccctgttgaacccgccattgttgaacaagaaatgaccgaagctgtggttgcctgagtcggaacggttctttggtaatttgttaaaaatgtgatggagcataatgtacttttgttacgattttacattatcaaatgacatttaacttgtttattactagagtttgacgttct

SEQ ID NO: 2152 - DNA, 1150 bp, Malus domestica
tttcttttcctccagcacaagaaaacactcggcattccttcttcagctcgatctcactctccgttcttcatctcgacttcttgttcttcgtctgtgcgcaatcatcaatctccaagaggtggactttaagagctagctatgaagcttgacactagcggtctcgaatcacacgcgccgcatctcttcggcgagagcagtgggtttctcgacggagtttccggtcctccgtctttcgaggttcccactaccaatgattttgatggatttcagaaggaagctatccagatggtgaagcctgcaaaggggacaaccacgcttgcattcatcttcaaggatggagtcatggttgctgccgattctcgagcttcaatgggaggctatatctcgtcacaatctgtgaagaagattattgaaatcaatccgtacatgctcggtacaatggctggaggagctgctgactgccagttttggcacagaaatttggggattaagtgtcggcttcatgagttagcaaataagcgcagaatttctgttactggagcatcgaagctgttggcaaatattttgtactcttaccgcggaatgggtctctctgttgggaccatgattgctggctgggacgaaacaggtcctggactgtattatgttgacagtgagggaggccgtttgaaaggaatgaggttttctgttggttcgggctcgccttacgcttatggtgttctggataatgggtaccggtatgacatgtcagtcgaagaagctgctgagttggctagaagagctatctatcatgcaacattccgtgatggggccagcgggggagtggcaagcgtctatcacgtggggccaaacggatggaagaagctgtccggagacgatgttggcgaacttcactaccactattaccctgtagtggcaggttctgttgagcaagaaatggttgaagtctgatggaaaatgggaataccaacggtaggatttcatggccgattctgggtttatatgtgaaactgtttgttgtattaggatttctaagttgacgtcacaaccttctgatcattattacattcaattgcggatttcatataatttgttggtgatgttatttcatttgaattagacagctgatcacattcgtgtccggtttttt

SEQ ID NO: 2153 - DNA, 1194 bp, Gossypium hirsutum
atttatttttgctggatctcatttgatttctctttttcttcccgccgatcatctgcaatctgattgaaagttttgtttaaagaagaaaaaaacgaacatgaagcttgacaccaccggtatggaatcggcggcgccggtttggggttctcataatgaatttgttgatgagttttcggctgctccgtcattcgagctcccaaatactactgattttgatgggtttcaaaaagaagctattcaaatggtgaaacctgctaaaggaaccaccacacttgcctttattttcaaggaaggtgtaatggttgctgctgattctagagctagcatgggaggctatatatcatcacagtcagtgaagaaaattattgaaatcaatccatacatgcttggaacaatggctggtggagctgctgactgccagttttggcacagaaatctgggaaccaagtgccggctgcatgaattggcaaacaaacgcagaatttctgttacaggtgcatcgaaactgttggcaaacattctctattcttaccgtggaatgggactatcagttggaaccatgattgctggatgggatgaaacgggtcccggactatactacgtggacaatgaagggggaaggttaaaaggaatgcgtttctctgttgggtcgggttcaccatatgcttacggtgtgctggataatggctatcggtatgacatgtcagttgaagaggcagcagagttggctcgaagagctatttatcatgccacattccgagacggagccagtggtggtgtcgccagcgtttattacgtgggaccgaatggctggaagaagctatcaggcgatgacgttggagaacttcactatagatactatccggtgatgccgagcacggtagaacaggagatggtcgaagtaactggagcctaagaggaccgtccttcacctagacctaattgaagatgtttgccttcacagatcggccgacgggattccatcggattctacaaagacagttcactgatagacttagtttgtcattgttgatgttgaaatttcttaaaagaatcaaattagtttaaacgggaacttgtttggaagttattcagttctgttacgtttcgaatcgagcttgagtttatttgatttgagctatcaaatgagtcaaatttgaagtaatttaatgcctgagctgagtagttgacgag

SEQ ID NO: 2154 - DNA, 1199 bp, Flaveria ramosissima
tgggataaatgaacccgggaatcatccgatccatactaaccgggtcaaatatcggatctgatgttatattgttgttcaagaaaccacttcttcaaacactctcagactctcgttcgagcttttcagttttccctattgaatcaacgtatcaacgatctcttttgttcttctcgatcacaaggtggaaatcatgaagcttgactttagtggactagaatcgggtgcaccgctctgtgggggaaataatgagttgctatgtgatgggttctcagctgccccttcatttgaccttccagttacatcagactttgatgaattccagaagaattctatccaaatggtaaagccagcaaaggggacaacaaccttggcttttatttttaaggagggtgtgatggttgctgctgattcccgagctagcatgggaggatatatctcatctcaatctgtgaagaaaatcattgaaattaatccatatatgctgggtacaatggctggaggagctgcagattgccagttctggcacagaaatctaggcattaagtgtcgtttgcatgaattggcaaacaagagaaggatttcagtgaccggggcttcaaaattgctggcaaatatattatattcatatcgtggaatgggtttgtccgttgggacaatgattgcaggatgggatgaaaagggtccaggtctttattatgtagacagcgaaggaggacgcctgaagggaacaaagttctcagttgggtctggttcaccgtatgcttatggtgtactagatagcgggtataaatatgacatgaccatcgatgaagctgctgaattggctagaagagcgatttatcatgcaacattccgtgatggagctagtggtggtgttgctagcgtttatcatgtgggcccaaccggatggacaaagctatcgggcgatgatgttggtgaacttcactactcatactatcctgttgagcccgccattgttgaacaggaaatgacggaagctgcagctgcctgagtccaacgggttgctggtagtttgatataaaaacatcggagcttaatgtgcttttgttatcatctgttttttcttgtttattactggagttttagtcaccttgttgttcattcatctaaaaatttcatgcatgtattagtactttaaagggctaatgtcttaaattagtggcgtacttaaggatatt

SEQ ID NO: 2155 - DNA, 1194 bp, Heritiera littoralis
tagttggtcctatttacggccggggatctctctcgatctccctgtctctttggtttcacgatcatctgcaatccgatagtgaaggaaaaaaaaccaacatgaagcttgacaccagcggtctagaatctgttgcgcctgtctggggtgctcctaatgagcttgttgatgggttatcgattgttccgacgttcgagctcccaaatactaccgattttgatgggtttcagaaagaagctattcagatggtgaaacctgctaagggtaccaccacgcttgcatttatttttaaggaaggcgttacggtagctgctgattctagagctagcatgggaggctatatctcatcacagtcagtgaagaaaattattgaaatcaatccttacatgcttggcacaatggctggtggagctgctgactgccagttttggcacagaaatttaggcatcaagtgccggctgcatgaattggcaaacaagcgtagaatttctgttacaggggcatcaaaactgttggccaacattctctattcttaccgagggatgggactatcagttggaaccatgatagccggatgggatgaaacaggtcctggactatactatgtggacagtgaagggggaaggttaaagggaatgcgtttctctgttggatctggttcaccttatgcttatggcgtgctggataatggctatcggtatgatatgtcagttgaagaagcagcagagttggcccgaagagctatttatcatgccacattccgagatggagccagcggtggtgttgccagcgtttactacgtgggaccaaatggctggaagaagctatctggagatgatgttggagaactccactacaaatactatccagtgatgccaagcacagtagaacaagaaatggttgaagtagctggagcctaagagggttctactcaacctagaccaaggtgcttgcattcgtagaccgattactgggatagattctgattctatgaagcacaatttcctctatttacttcagaacaaaccctaaaaagacaatgcactgatagacctgggtgcaagttaatgttgaattatcttgatcagtttgccattgttgttgaaaaattttaatgaatttctacttttagttagcccaacgttcgaattattgtcttgtctggtatttttgttaaattactacaattaccataac

SEQ ID NO: 2156 - DNA, 1014 bp, Juglans hindsii x Juglans regia
  misc_feature (52)..(52): n is a, c, g, or t
  misc_feature (62)..(63): n is a, c, g, or t
  misc_feature (118)..(118): n is a, c, g, or t
  misc_feature (120)..(120): n is a, c, g, or t
  misc_feature (142)..(142): n is a, c, g, or t
  misc_feature (648)..(648): n is a, c, g, or t
  misc_feature (711)..(711): n is a, c, g, or t
  misc_feature (828)..(828): n is a, c, g, or t
  misc_feature (834)..(834): n is a, c, g, or t
  misc_feature (864)..(864): n is a, c, g, or t
  misc_feature (868)..(868): n is a, c, g, or t
  misc_feature (885)..(885): n is a, c, g, or t
  misc_feature (888)..(888): n is a, c, g, or t
  misc_feature (891)..(891): n is a, c, g, or t
  misc_feature (909)..(909): n is a, c, g, or t
  misc_feature (931)..(931): n is a, c, g, or t
  misc_feature (936)..(936): n is a, c, g, or t
  misc_feature (938)..(938): n is a, c, g, or t
  misc_feature (966)..(967): n is a, c, g, or t
  misc_feature (971)..(971): n is a, c, g, or t
  misc_feature (975)..(975): n is a, c, g, or t
  misc_feature (981)..(981): n is a, c, g, or t
  misc_feature (984)..(984): n is a, c, g, or t
  misc_feature (986)..(988): n is a, c, g, or t
  misc_feature (990)..(990): n is a, c, g, or t
  misc_feature (995)..(995): n is a, c, g, or t
  misc_feature (999)..(999): n is a, c, g, or t
  misc_feature (1004)..(1005): n is a, c, g, or t
  misc_feature (1009)..(1009): n is a, c, g, or t
gccattacggccggggacggacaaaacctagtcatcacacttaacctgaagngcaagaaacnnacgtcatcttctgcagtcttgcattcgatctctcagcctgttattcgtcttcgtntncgttttttcgttgcctgtctancacaaagtttataaaaaagaatgaagctcgatactagtggtcttgaaccaactgcaccctttgggtcaagcaatgaacttaatgatgggttttcagctgccccatcctttgagattcctgatacgattgactttgatggctttcagaaagaggctgtacagatggtgaagccagcaaagggaaccaccacgcttgctttcatattcaaggagggtgtcatggttgctgctgattctcgagctagcatgggaggctatatctcatctcagtctgtgaagaaaattattgaaattaatccttacatgcttggcactatggctggaggagctgctgactgtcaattttggcacagaaatcttggcattaagtgccgactgcatgaattagcaaacaagcgcagaatttcagttacaggggcatcaaagttgctggcaaacattctgttctcttaccgtggaatgggtttgtctgttgggaccatgattgctggatgggatgaaacgggncctgggctatattatgtcgacagtgaaggaggaaggcttaaaggaacacgattttcagttggntctggttcaccctatgcttatggtgtgctggataatggttaccggtatgatatgtcaattgaagaagctgcagagttggctagaagggctatttatcatgcaacattccgtgatgcngccagnggtggagttgctagcgtttattatgtgggncccnatgggtggaagaagctntcnggngatgatgttggggaactncattacgaatactatccagttntgccnantacagtggaacaggaaatggttgaagtnnctgnggcntaaggntcntnnngnacttncacnatgcnngagntttct

SEQ ID NO: 2157 - DNA, 899 bp, Centaurea maculosa
ttgaatcaacgatctgttttatccttctcgatttattaaaaggttgtaatcatgaagcttgactttggtggactagaatcgagtgcaccactttatggtggaaatgatgatgttctttctgatgggttctcagctgccccttcatttgacctcccagttacatcagactttgatggattccagaagaattctatccaaatggtaaagccagcaaagggaactacaaccttggcttttatctttaaggagggtgtgatggttgccgcagattcccgagctagcatgggaggctatatctcgtctcaatctgtgaagaagatcattgaaattaatccctatatgttgggtacaatggctggaggagctgccgattgccagttctggcacagaaatctaggcattaagtgccgtctgcatgaattggctaacaagagaaggatttcagtgacgggcgcttcaaagttgttggcaaacattctttactcttaccgaggaatgggtttgtctgttgggacaatgattgcaggatgggacgagaagggcccggggctgtattatgttgacagcgaaggaggacgactgaagggtacaaaattctctgttgggtctggttcaccatatgcttatggtgtattagatagcgggtaccactatgatatgacgatcgatgaagctgctgaattggcgagaagatccatctatcatgctacattccgtgatggagctagtggtggtgtggctagcgtttatcacgtgggaccgactggatggacgaagctatcgggtgatgatgttggtgagcttcactactcgtactatcccgttgaaccagccattgttgaacaggaaatgactgaagctgtagttgcttgagggtactactggtaatttgttaaaaa

SEQ ID NO: 2158 - DNA, 903 bp, Centaurea maculosa
tataatctgtttttatccttctcgatttattaaaaggttgtaatcatgaagcttgactttggtggactagaatcaagtgcaccactttatgggggaaatgatgatgttcttgctgatgggttctcagctgccccttcatttgaccttccagttacatcagattttgatggattccagaagaattctatccaaatggtaaagccagcaaagggaactacaaccttggcttttatctttaaggagggcgtcatggttgctgcagattcccgagctagcatgggaggctatatctcatctcaatctgtgaagaagatcattgaaattaatccctacatgttgggtacaatggctggaggagctgccgattgccagttctggcacagaaatctaggcattaagtgccgtctgcatgaattggctaacaagagaaggatttcagtgacgggcgcttcaaagttgttggcaaacattctttactcttatcgtggaatgggtttgtctgtcgggacaatgattgcaggatgggacgagaagggcccgggtctgtattatgttgacagcgaaggtggacgactgaagggtacaaaattctctgttgggtctggttcaccatatgcttatggtgtattagatagcgggtaccactatgatatgacgatcgatgaagctgctgaattggcgagaagatccatctatcatgctacattccgtgatggagctagtggtggtgttgctagcgtttatcacgtgggaccgactggatggacgaagctatcgggtgatgatgttggtgagcttcactactcgtactatcctgttgaaccagccattgttgaacaggaaatgactgaagccatagttgcttgagagtactactggtaatttgttaaaaagatgtacttt

SEQ ID NO: 2159 - DNA, 1217 bp, Glycine max
cctctttctacttttccctcattgcttctaactcaacaattgagatctcacactgcaattccttcttctcccagaatcggtcactaaatccgcaatcatgaagctcgataccaccggtctcgaatcgtttcccacactgcttgcgcctcaaaacgacgtcgttggagaactctccgccgctccatccttcgaccttccgaattccaacgatttcgatgggtttgtgaaagaagctattcagatggtgaagcccgcgaagggtactacgactcttgcttttatatttaaggagggtgttatggtagctgctgattctcgagctagcatgggaggatatatatcatcgcagtctgtgaagaagattattgaaattaatccgtatatgcttgggacaatggctggaggtgctgctgattgtcagttttggcacaggaatcttgggatcaagtgtcgtttgcacgagttggcaaataaaaggagaatttcagtgacaggagcctcaaagctacttgccaatattttatactcttatcgtggaatggggttatctgttggtaccatgattgctggatgggatgagacgggtcctggtctatattatgttgatagtgaaggaggaagacttaaaggcactagattctctgttggatctggttcaccatatgcttatggtgtattggacagcgggtaccgatatgacctgtcagttgaggaagctgctgaacttgctcgacgagcaatttatcacgcaacatttcgtgatggggccagtggtggagttgctagcgtttactatgtgggtccaaatggatggaagaaattgtccggtgatgatgttggggaacttcattaccattactacccagttaccccaagcaccgtggaacaagaaatggttgaggcaactggagcttgatgaagcaactcgtggatattttcagtttcctttgcttgctagcttattttgaaccgatgaaactgattactttataattgaaaattgacattagtttgataaatacaagtgctgtcctatcctgttgtgttttttatcaagccatatttatcattaaaaatgatagattagagctcatgtataatgtgcagtgatttaaatgggtaaagcaggtcagaagcgtgttgctaatgtaattcatcttgcgattaatggttttcgtggcaacttctgaaagttgtacaagaaacttaccaaggag

SEQ ID NO: 2160 - DNA, 1115 bp, Malus domestica
aaataggcagcattcctaccagtatctttttagctcgatctcactatcccttcttcctctttggtcttcgtctgcacgatcatcaacctctcaagaggattttaagagctatgaggcttgacactagcggtcttgagtcacgcgcgccgctgttcggcgagagcagtgggtttcttgacggcgtttcggctcctccgtcgttcgaggttccgacgacgaatgattttgatggatttcagaaggaagctattcagatggtgaagccggcgaaggggacaaccacacttgcgttcatcttcaaggatggagtcatggttgctgctgattctcgggccagcatgggcggatatatctcatcacaatctgtgaagaagattattgaaatcaatccttacatgcttggtacaatggctggaggagctgctgactgccagttttggcataggaatctggggattaagtgtcggttgcatgagttggcaaataagcggaggatttcagttacaggagcatcaaagctgctggcaaacattctttactcttatcgtggtatgggtctctcagttgggaccatgatcgcaggctgggacgaaacgggtcctggattgtattatgtcgacagtgagggaggccgtttgaaaggaatgaggttttctgttggttcgggctcgccttatgcttatggtgttctggatgatgggtaccgatatgatatgtctgtagaagaagctgctgagttggctagaagagcaatatatcatgcaacattccgtgatggagccagcggcggtgttgcgagtgtatatcatgtgggagcaaatggatggaagaagctttcgggagatgacgtaggggagcttcactactcgtactaccctgtggtcgcaggggctgtggagcaggagatggtcgaagtagctgcacattgatgaaactttgtgatatatttccttccattttcattttatctgctgttactgatgcttaaagtttcggattcaagtaaaccctgacccggtgatacggtatcactctataatttctcccgcatcaacgagaacaaattttatttgcggggattgggccctcaccattctcgtgaacatgttgaacaa

SEQ ID NO: 2161 - DNA, 1040 bp, Artemisia annua
tactccaacggggaaactgaattaaattaactcaacaactgtgttttccgttttagtatcacaaacaaaggttgaaatcatgaaacttgacttcagtggactcgaatcaagtgccccactctatgggggaagtaatgacttgctttttgatgggttctcagctgcccctgcatttgatcttcccgttacatcaaactttgatgaatatcagaagaaatctgttcaaatggtaaagccagcaaagggaacaacgactctggcttttatctttaaggatggtgtgatggtagctgctgattcacgagctagcatgggaggctatatctcttctcaatctgtgaagaaaattattgaaattaatccttatatgctgggtactatggctgggggagctgctgattgccagttctggcacagaaatcttggtatcaagtgccggttgcatgaacttgcaaacaagagaagaatatcagttaccggggcttcaaagctgttggcaaacattctctattcttatcgtggaatgggtttgtctgttggtacaatgattgcaggatgggatgaaaagggccctggcttatactacgtggacagtgaaggaggacggctaaagggtaccaagttttctgttggatctggttcaccatatgcatatggtgtattagatagcgggtaccgatacgatatgacagtcgatgaagccgctgagctggctagaagatccatctatcatgcaacattccgtgatggtgcaagtggtggtgttgctagcgtgtatcacgtgggcccaaacggatggaccaagctatcaggcgatgatgttggggaacttcactactcttactacccggttgaacccgccactgttgaacaagaaatgaccgaggctgtcgttgcatgagtgctgtaatttctcacaaatgcttttgcacaatttgtcaatttgcttggttattgatgctttgtattaaacatgactccaaattggccctttagaggcattggtattgtttgaacaatgaaaaaacaacccttgtgct

SEQ ID NO: 2162 - DNA, 1036 bp, Centaurea maculosa
tatccttctcgatttattaaaaggttgaaatcatgaagcttgactttggtggactagaatcgagtgcaccactctatggtggaaatgatgacgttctttctgatgggttctctgctgccccttcatttgacctaccagttacatcagactttgatggattccagaagaattctatccaaatggtaaagccagcaaagggaactacaaccttggcttttatctttaaggagggtgtgatggttgctgcagattcccgagctagcatgggaggctatatctcatctcaatctgtgaagaaaatcattgaaattaatccctacatgttgggtacaatggctggaggagctgccgattgccagttctggcacagaaatctaggcattaagtgccgtctgcatgaattggctaacaagagaaggatttcagtgacgggcgcttcaaagttgctggcaaacattctttactcttatcgtggaatgggtttgtctgtcgggacaatgattgcaggatgggacgagaagggcccgggtctgtattatgttgacagcgaaggtggacgattgaagggtacaaaattctccgttgggtctggttcaccatatgcttatggtgtattagatagcgggtaccactatgatatgacgatcgatgaagctgctgaattggcgagaagatccatctatcatgctacattccgtgatggagctagtggtggtgttgctagcgtttatcacgtgggaccgactggatggactaagctatcgggtgatgatgttggtgagcttcactactcgtactatcccgttgaaccagccattgttgaacaggaaatgactgaagctgtagttgcttgagggtactactggtaatttgttaaaaagatgtactttgttatgacttttcaaattgataatgacatttgagtggcctttttaagttttctagatttgactttgttgttgttttcccaaatatcatgcacttatttactactttcgatttgctaatggtaatgttatgtccatccgctaaagaa

SEQ ID NO: 2163 - DNA, 1001 bp, Centaurea maculosa
  misc_feature (957)..(957): n is a, c, g, or t
  misc_feature (979)..(979): n is a, c, g, or t
acgatctgttttatccttctcgatttattaaaaggttgaaatcatgaagcttgactttggtggactagaatcgagtgcaccactttatggtggaaatgatgatgttcttgctgatgggttctcagctgccccttcatttgaccttccagttacatcagattttgatggattccagaagaattctatccaaatggtaaagccagcaaagggaactacaaccttggcttttatctttaaggagggtgtcatggttgctgcagattcccgagctagcatgggaggctatatctcatcgcaatctgtgaaaaagattattgaaattaatccctacatgttgggtacaatggctggaggagctgccgattgccagttctggcacagaaatctaggcattaagtgccgtctgcatgaattggctaacaagagaaggatatcagtgacgggtgcttcaaagttgttggcaaacattctttactcttatcgtggaatgggtttgtctgtcgggacaatgattgcaggatgggacgagaagggcccgggtctgtattatgttgacagcgaaggtggacgactgaagggtacaaaattctccgttgggtctggttcaccatatgcttacggtgtattagatagcgggtaccactatgatatgacgatcgatgaagctgctgaattggcgagaagatccatctatcatgctacattccgtgatggagctagtggtggtgttgctagcgtttatcacgtgggaccgactggatggaccaagctatcgggtgatgatgttggtgagcttcactactcgtactatcccgttgaaccagccattgttgaacaggaaatgactgaagctgtagttgcttgagtactactggtaatttgttaaaaagatgtactttgttatgacttttcaaattgataatgacatttgagtggcctatttatgttttctagatntgactttgttgttgtttttccnaatatcatgcacttatttactg

SEQ ID NO: 2164 - DNA, 906 bp, Centaurea maculosa
  misc_feature (465)..(465): n is a, c, g, or t
  misc_feature (533)..(533): n is a, c, g, or t
  misc_feature (572)..(572): n is a, c, g, or t
  misc_feature (579)..(579): n is a, c, g, or t
  misc_feature (599)..(599): n is a, c, g, or t
  misc_feature (614)..(614): n is a, c, g, or t
  misc_feature (773)..(773): n is a, c, g, or t
ggattaatcacgatctgtgtttccttctcgatttataaaaggttgaaatcatgaagcttgactttggtggactagaatcgagtgcaccactctatggtggaaatgatgacgttctttctgatgggttctctgctgccccttcatttgacctaccagttacatcagactttgatggattccagaagaattctatccaaatggtaaagccagcaaagggaactacaaccttggcttttatctttaaggagggtgtgatggttgccgcagattcccgagctagcatgggaggctatatctcatctcaatctgtgaagaaaatcattgaaattaatccctacatgttgggtacaatggctggaggagctgccgattgccagttctggcacagaaatctaggcattaagtgccgtctgcatgaattggctaacaagagaaggatttcagtgacgggcgcttcaaagttgntggcaaacattctttactcttatcgtggaatgggtttgtctgtcgggacaatgattgcaggatgggangagaagggcccgggtctgtattatgttgacagcgaaggnggacgantgaagggtacaaaattctcngttgggtctggttcnccatatgcttatggtgtattagatagcgggtaccactatgatatgacaatcgatgaagctgctgaattggcgagaagatccatctatcatgctacattccgtgatggagctagtggtggtgtggctagcgtttatcacgtgggaccgactggatggacnaagctatcgggtgatgatgttggtgagcttcactactcgtactatccggttgaaccagccattgttgaacaggagatgactgaagctgtagttgcttgaaggtactactggtaatttgttaaaaagatgtact

SEQ ID NO: 2165 - DNA, 993 bp, Taraxacum officinale
cttcggcgggggatcatcgtatttacaatctggtctgtcctttccaatttaaagttggaatcatgaagcttgactttagtggactagaatcgagtgcaccattgtatgggggaagtgacgacttgcattctgatgctctatcagatgccccttcattcgaccttccagttacatcagattttgatggatttcagaagagttcaatccaaatggtaaagccagcaaagggaacaacaacactggcttttatttttaaggaaggtgtgatggttgctgcagattcaagagctagcatgggaggatatatatcatctcaatctgtgaagaaaatcattgaaattaatccgtatatgctcggaacaatggctggaggtgctgctgactgccagttctggcacagaaatctaggcatcaagtgtcgtttacatgaactggcaaacaagagaaggatctcagtgactggtgcttcaaaaatgcttgccaacattctctattcttaccgtggaatgggtttgtctgttggcaccatgattgcaggatgggatgaaaagggcccgggtctttattatgtagacagtgagggaggccgattgaagggaaataagttctctgttggctctggttcaccatatgcttacggtgtactagacagcgggtatcgttatgatatgagcatcgatgaagctgctgagctggcaagaaggtccatttaccatgcaactttccgtgatggagctagtggcggtgttgccagcgtgtatcatgtggggccaaatggatggacaaagctgtcgggtgatgatgttggagagcttcattattcttactaccctgttcagcctgcagttgttgagcaagaaatggctgaagctgtagctgcctgataagctttgttaaaaaaaaaaatgaaaaatatgttattttgttgtcaagatcatacattaagtggtgccttttttccttgatgtgttgttagatttgacatctacttac

SEQ ID NO: 2166 - DNA, 1084 bp, Flaveria ramosissima
actgtcgttcgagctttcccttattgaatcaacgcatcaacgatctgttttgttcttctcgatcacaaggtggaaatcatgaagcttgactttagtggactagaatcgggtgcaccgctctgcgggggaaataatgagttgctatgtgatgagttctcagctgccccttcatttgaccttccagttacatcagattttgatgaattccagaagaattctatccaaatggtaaagccagcaaagggtacaacaaccttggcttttatctttaaggagggtgtgatggttgccgctgattcccgagctagcatggggggctatatttcatctcaatctgtgaaaaaaattattgaaatcaatccatatatgctgggtacaatggctggaggagctgcagattgccagttctggcacagaaatctaggcattaagtgtcgtttgcatgaattggcaaacaagagaaggatttcagtgactggtgcttcaaaattgctggcaaatatcttatattcttatcgtggaatgggtttgtctgttgggacaatgattgcaggatgggatgaaaagggtccaggtctttattatgtagacagcgaaggaggacgcctgaagggaacaaagttctctgttgggtctggttcaccgtatgcttatggtgtactagatagtgggtataaatatgacatgacaatcaatgaagctgctgaattggctagaagagcaatttatcatgcaacattccgtgatggagctagtggtggtgttgctagcgtttatcatgtgggcccaaccggatggacaaagctatcaggcgatgatgttggtgaacttcactactcatactatcctgttgagcccgccatcattgaacaggaaatgacggaagctgcagctgcctgagtccaatgggttgctggtagtttgatataaagaaatcagagcataatgtacttttgttatcatctgtttttttttttgttaactactggagtttgactaccttattgttcattcatctaaaaattttatgcatgtattagttactttgtctttaaagggctaatgtcataaattagtggcgtac

SEQ ID NO: 2167 - DNA, 1422 bp, Cajanus cajan
acagtgcctctttcaacttttcctcattgcttgagactgaaccattgagatctaacactgcaattgcttcttctcccagaatcggtcactaattcgcaaccatgaagctcgataccactggtctcgaatcgtttcccacactgcttgctcctcaaaacgacgtcgttggagacctctccgccgccccctcgttcgaccttcctaattccaatgactttgatggcttcttgaaagaggcaattcagatggttaagcccgcgaagggtactacaactcttgcttttatatttaaggagggtgtcatggtggcagctgattctcgagctagcatgggaggatatatatcatcgcagtctgtgaagaaaattattgaaatcaatccgtatatgctcgggacgatggctggaggtgctgctgattgtcagttttggcacaggaaccttgggatcaagtgtcgtttgcatgagttggcaaataaaaggagaatttcagtaaccggagcctcaaagctacttgcgaatattttatactcttatcgtggaatggggttatctgttggtactatgatcgctggatgggatgagacgggtcctggactatattatgttgatagtgaaggaggaagacttaaaggcactagattctctgttggatctggttcaccatatgcatatggtgtattggacagcgggtaccggtatgacctatcagttgaggaagctgctgaacttgcccgacgagcaatttatcatgctacatttcgtgatggggccagtggtggagttgctagcgtttactatgtcggaccaaatggatggaagaaattgtcgggtgatgatgttggggaacttcattaccattactacccagttaccccaagcaccgtggaacaagaaatggtggaggcaactggagcttgatgaagtaactcatggatatcttttaaagtctccgttgcttgccagcttatgttgaatcaattgcatgaaactgattactttataattgaaaattgacattagtttgatagatccaagtgttgtcctatcctgatttgttctagatcaagtcatattttaccatcgaaaatgaaagatagagccatatacaatgtggattggtttaaatgcgtaaagcacgatagacacgtatggctatctatagctaatgtaatcaatcttgcgattaatagttttcatgacaacttccgaaagttgtacgagaaacttaccaaggagaattgtggttcaatgttttccgattggttgttgtagtttataagcatacttttggtacatcctggttgtattagttcatctttgtcaaagtgatacttaaattaattgttggacttgataacataatcgaaaaaaacacttaaatcacataggcgattaggatgaatccatagagttcttatat

SEQ ID NO: 2168 - DNA, 1390 bp, Glycine max
gtcctgcctttttctccaagccgacgcattctgaaattaaaaaaaaaaaaaaacagtgcctctttctacttttccctcattgcttctaactcaacaattgagatctcacactgcaattccttcttctcccagaatcggtcactaaatccgcaatcatgaagctcgataccaccggtctcgaatcgtttcccacactgcttgcgcctcaaaacgacgtcgttggagaactctccgccgctccatccttcgaccttccgaattccaacgatttcgatgggtttgtgaaagaagctattcagatggtgaagcccgcgaagggtactacgactcttgcttttatatttaaggagggtgttatggtagctgctgattctcgagctagcatgggaggatatatatcatcgcagtctgtgaagaagattattgaaattaatccgtatatgcttgggacaatggctggaggtgctgctgattgtcagttttggcacaggaatcttgggatcaagtgtcgtttgcacgagttggcaaataaaaggagaatttcagtgacaggagcctcaaagctacttgccaatattttatactcttatcgtggaatggggttatctgttggtaccatgattgctggatgggatgagacgggtcctggtctatattatgttgatagtgaaggaggaagacttaaaggcactagattctctgttggatctggttcaccatatgcttatggtgtattggacagcgggtaccgatatgacctgtcagttgaggaagctgctgaacttgctcgacgagcaatttatcacgcaacatttcgtgatggggccagtggtggagttgctagcgtttactatgtgggtccaaatggatggaagaaattgtccggtgatgatgttggggaacttcattaccattactacccagttaccccaagcaccgtggaacaagaaatggttgaggcaactggagcttgatgaagcaactcgtggatattttcagtttcctttgcttgctagcttattttgaaccgatgaaactgattactttataattgaaaattgacattagtttgataaatacaagtgctgtcctatcctgttgtgttttttatcaagccatatttatcattaaaaatgatagattagagctcatgtataatgtgcagtgatttaaatgggtaaagcaggtcagaagcgtgttgctaatgtaattcatcttgcgattaatggttttcgtggcaacttctgaaagttgtacaagaaacttaccaaggagaattgtggttcaatgtcttcgattaattgtagtagttaataagcatagtttacgtcatggttttattagtttatctttcgacaaaatgaaacttaaactaatcgttgaacttgat

SEQ ID NO: 2169 - DNA, 1331 bp, Helianthus annuus
tatcaactcagattacgctggaagaaaccacttcttcaaatactctcattcaagctttttctccgttaaatcaatctattaacaatctgttctacacttctcgattgattaaaaggtggaaatcatgaagcttgactttagtggactagaatcaagtgcaccactctacgggggaccaaatgagttgctttgtgacgggttctcagctgccccgtcgtttgaccttccagttacatcagattttgatggattccagaagaattctatccaaatggtaaagccagcaaagggaacaacaaccttggcttttatttttaaggagggtgtgatggttgctgctgattcccgagctagcatggggggctatatctcatctcaatccgtgaagaagatcattgaaatcaatccctatatgctgggtacaatggcaggaggagctgctgattgccaattctggcacagaaatctaggcattaagtgtcgtttgcatgaattggcaaacaagagaaggatttccgtcactggtgcttcaaagttgttggcaaatatcttatattcttaccgtggaatgggtttgtctgtcgggacaatgattgcaggatgggatgaaaagggcccgggtctgtattacgtagacagcgaaggaggacgcttgaagggaacaaagttctcagtcgggtctggttcaccatatgcttatggtgtactagatagcgggtacaaatatgatctgacaattgatgaagctgctgaattggctagaagagccatctatcatgccacattccgtgacggagctagtggcggtgttgctagcgtttatcatgtggggccaaccggatggacaaaactatcgggtgatgatgttggtgaacttcactactcatactatcctgttgaaccagccgttgttgaacaagaaatgaccgaagctgtagctgcctgagtctaccaggttgtttgtaatctcttgaaaaaacatgatgtgcttttgttatgattttacatttctaatgacattagctgtctttttcttgtttattactagagtgacattcctatcattccttatttcaaaaaacattatggatttatgatattgtaagcgtccaagatggtaatggttaaaaacgtctgaaaaccagtcagcggaaggaagcaccatgtgctcaaaaacgaccttaaaatgggttatggcgctcttagattttcgcgagaaagccatatggatgctggtagtcggaggattcccttctaatacgagactttcgacacatctctcttttagaggcaaaatacttgtatctttttatttatctaagagcacatca

SEQ ID NO: 2170 - DNA, 1197 bp, Liriodendron tulipifera
  misc_feature (874)..(874): n is a, c, g, or t
aagcacaccccttttcttttcctccatctcacgtgacttttcctccttctcacgtgagagctcttttgataaaaactcggggtttcttcattcccaagcagttgttggattttctcttgcagcagagcagaggcgaaactaatcaaattcacaaactcgcaccgctgaaagaaggtttataagcatgaaactcgatacaagtggtcttgaatcattcaccccttttcatgggggaggtaatgatctttgtggaggcttctcatcagtcccatctttcgaacttcccagtagcactaattttgatgattttcagaaaaaggcaatgcagatggtaaagccagcaaaagggacaacaacacttgccttcatttttaaggaaggagttatggttgctgctgattctcgggctagcatgggaggatatatttcatcccagtccgtgaagaaaatcattgaaatcaatccttacatgcttggcacaatggctggaggtgccgctgactgccaattttggcataggaatttgggcatcaagtgccgtctgcatgagctggcaaacaagcggaggatttcagtaactggcgcttcaaagctattggcaaatattctgtattcgtaccgtggaatgggtctatcagttggaaccatgattgctggatgggatgaaacgggtcctggtttgtattatgtagacagcgaaggagggagactcaagggaacacgattctctgttggatctggttctccatatgcttatggtgtgctggacaatgggtaccgctatgacatgtcgattgaagaagctgctgaactggctcgccgttctatttatcatgcaacctttcgagatggagctagcggtggcgttgctagncgtttatcacgttggacctgatggctggaaaaagctctctggggatgatgtcggtgaactccactacaagtactacccagttgttccgagctctgttgaacaggaaatgaccgaggttgctgtgagctgagaggaggttccatcactgttgaaatgtctgaggttgctgtaacctgagagagagaagctccattgttgaattcaccgattctgaccttttaaagtttacctatttggaatttttagtctgacctttttatgttctcccatttggaatttctaaatgctcgagtggggaaattgggaaatggatgtccttcatg

SEQ ID NO: 2171 - DNA, 951 bp, Centaurea maculosa
acgatctgttttatccttctcgatttattaaaaggttgaaatcatgaagcttgactttggtggactagaatcgggtgcaccactttatggtggaaatgatgacgttctttctgatgggttctcagctgccccttcattcgacctcccagttacatcagattttgatggattccagaagaattctatccaaatggtaaagccagcaaagggaactacaaccttggcttttatctttaaggagggtgtgatggttgctgcagattcccgagctagcatgggaggctatatctcatctcaatctgtgaagaagatcattgaaattaatccctatatgttgggtacaatggctggaggagctgccgattgccagttctggcacagaaatctaggcattaagtgccgtctgcatgaattggctaacaagagaaggatttcagtgacgggcgcttcaaagttgttggcaaacattctttactcttatcgtggaatgggtttgtctgtcgggacaatgattgccggatgggacgagaagggcccgggtctgtattatgttgacagcgaaggtggacgactgaagggtacaaaattctctgttgggtctggttcaccatatgcttacggtgtattagatagcgggtaccactatgatatgacgatcgatgaagctgctgaattggcgagaagatccatctatcatgctacattccgtgatggagctagtggtggtgttgctagcgtttatcacgtgggaccgactggatggaccaagctatcgggtgatgatgttggtgagcttcactactcgtactatcctgttgaaccagccattgttgaacaggaaatgactgaagccgtagttgcttgagtactactggtaatttgttaaaaagatgtactttgttatgacttttcaagttgataatgacatttgagtggccttttttgtttttt

SEQ ID NO: 2172 - DNA, 924 bp, Arnica chamissonis
ttaacgatctggttgatacttctcgattaaaaggtggaaatcatgaagctcgactttagtggactagaatcaagtgcaccactctatggaggaaataatgggttgctttgtgatgggttctcggatgccccttcatttgaccttccagttacatcagattttgatgggttccagaagaattctatccaaatggtaaagccagctaagggaacaaccaccctggcttttatttttaaggagggtgtgatggttgctgctgattcccgagcaagcatgggaggctatatatcatctcaatctgtgaagaaaataattgaaattaatccctatatgctgggtacaatggcaggaggagccgctgattgccaattctggcacagaaatctaggcattaagtgtcgtttgcatgaactggcaaacaagagaaggatttcagtgaccggtgcttcaaagttgttggcaaatattttatattcttatcgtggaatgggcttgtctgttgggacaatgattgcaggatgggatgaaaagggcccaggtctgtattatgttgacagtgaaggaggacgcctgaagggaacaaagttctcagttgggtctggttcaccatatgcttatggtgtactagatagcgggtacaaatatgatatgacaatcgatgaagctgctgaattggctagaagagccatctatcatgcaacattccgtgatggagctagtggcggtgttgctagcgtttatcatgtggggccaactggttggacaaagatatcgggtgacgatgttggtgaacttcactactcgtactatcctgttgaacccgccattgtcgaacatgaaatgaccgaagccgtagttgcctgagtcgaccaggctgtttgtaatttgttgtgattttacattttcaactgtgtgttttttgtt

SEQ ID NO: 2173 - DNA, 1128 bp, Castanea mollissima
ctcttcagtctctctcgctctctacttcgtcttcgttgtcttcttcatcaagaaaaaaaaaaatttacaaaatcatgaagcttgatactagtggtcttgaatcaactgccccgctctttgggtcattgagcagtgggattcatgatgagatttctgccgccccatcttttgcacttcctaatactatcaattttgatggattccagaaagaggctatacagatggtgaagccagcaaagggaaccaccacacttgcgttcatattcaaagagggtgtcatggttgctgctgattctcgagctagcatgggaggctatatctcatcacagtctgtaaagaaaatcattgaaatcaatccttacatgcttggcactatggctggaggagctgctgactgtcagttttggcacagaaatctgggcattaagtgccgattgcacgaattggcaaacaagcgcagaatttcagttacaggagcatcaaagctgttggcaaacattctgtactcttaccgtggaatgggtctgtctgttgggaccatgattgctggatgggatgagacgggtcctggactatattatgtggacagtgaaggaggaaggctcaaaggaacacgattttcagttggatctggttcaccctatgcttatggtgtcctggacaatggttaccggtatgatatgtcaattgaagaagctgcagagttggctagaaggtctatttatcatgcaacattccgtgatggtgccagtggtggagttgctagcgtttattatgtgggacctgatggatggaaaaagctctctggtgatgatgttggagaacttcattaccactactatccagttatgccgagcacagtggaacaggaaatggttgaagtaactggggcataaagctcttgctgaacttggactctgctatagatgttttctccgtaggagatgggggcctaaaatcctttaagcacatgcatttccagttggtctttgaaacaatttatagatagacttgtctctaaggttatatcacttatcagagccctatgattcatggctgtgtagtgttgttggacagactattgttgctgattgttcaaaagttttataaattctatttggttttaac

SEQ ID NO: 2174 - DNA, 1077 bp, Cirsium arvense
gatctcaagctataatctgtttttatccttctcgatttattaaaaggttgaaatcatgaagcttgactttggtggactagaatcgggtgcaccactttatggtggaaatgatgacgttctttctgatgggttctcagctgccccttcattcgacctcccagttacatcagattttgatggattccagaagaattctatccaaatggtaaagccagcaaagggaactacaaccttggcttttatctttaaggagggtgtgatggttgctgcagattcccgagctagcatgggaggctatatctcatctcaatctgtgaagaagatcattgaaattaatccctatatgttgggtacaatggctggaggagctgccgattgccagttctggcacagaaatctaggcattaagtgccgtctgcatgaattggctaacaagagaaggatttcagtgacgggcgcttcaaagttgttggcaaacattctttactcttatcgtggaatgggtttgtctgtcgggacaatgattgccggatgggacgagaagggcccgggtctgtattatgttgacagcgaaggtggacgactgaagggtacaaaattctctgttgggtctggttcaccatatgcttacggtgtattagatagcgggtaccactatgatatgacgatcgatgaagctgctgaattggcgagaagatccatctatcatgctacattccgtgatggagctagtggtggtgttgctagcgtttatcacgtgggaccgactggatggaccaagctatcgggtgatgatgttggtgagcttcactactcgtactatcctgttgaaccagccattgttgaacaggaaatgactgaagctgtagttgcttgagtactactggtaatttgttaaaaagatgtactttgttatgatttttcaagttgataatgacatttgagtggcctttttttgttttctagatttgactttgttgttgttttcccaaatatcatgcacttatttactactttgaatttgctaatggtaatgttatgtccatccgctgaaaaaagaaaaaagtaccgactgcg

SEQ ID NO: 2175 - DNA, 1152 bp, Quercus alba
attttattttaatcctcttcagtctctctctctctctctgcttcgtcttcgttgtcttcttcatcaagaaaaaaaaagtttacaaaatcatgaagcttgatactagtggtcttgaatcaactgccccgctctttgggtctctgagcagtgggattcatgatgagatttctgccgccccatcttttgcgcttcctaatactatcaattttgatggattccagaaagaggctatacagatggtgaagccagcaaagggaaccaccacgcttgcgttcatattcaaagagggtgtcatggttgctgctgattctcgagctagcatgggaggctatatctcatcacagtctgtaaagaaaatcattgaaatcaatccttacatgcttggcactatggctggaggagctgctgactgtcagttttggcacagaaatctgggcattaagtgccgattgcacgaattggcaaacaagcgcagaatttcagttacaggagcatcaaagctgttggcaaacattctgtactcttaccgtggaatgggtctgtctgttgggaccatgattgctggatgggatgagacgggtcctggactatattatgtggacagtgaaggaggaaggctcaaaggaacacgattttcagttggatctggttcaccctatgcttatggtgtcctggacaatggttaccggtatgatatgtcaatcgaagaagctgcagagttggctagaaggtctatttatcatgcaacattccgtgatggtgccagtggtggagttgctagcgtttattatgtgggacctgatggatggaaaaagctctctggtgatgatgttggagaacttcattaccactactatccagttatgccgagcacagtggaacaggaaatggttgaagtaactgggcaataaagctcttgctgaacttggactctgctatagatgttctctccgtaagagatggattccaagatatgcttacaaggcctaaaatcctttaagcacatgcatttccagttggtctttgaaacaatttatagatagacttgtctttaaggttatcacttatctgagcccaatgattcatggctgtgtagttttgttgggcagactattgttgctgattgttccaaagttttaattaattctattt

SEQ ID NO: 2176 - DNA, 921 bp, Lupinus angustifolius
aaatcagcaacagttttctttctcttcaagatttcacaacacagatctcacactgcaacatttctctcacaatcggtttacaatcatgaagcttgataccagtggtcttgaatcattctccacacaacttggaattcaaagcaatatcattggagaaatttcgtcttcaacatcattcgatcttccaaattcaaacgattttgatgggtttgtgaaagaagctattcaaatggtgaagcctgcaaagggtactacaactctggcttttatatttaaagatggtgttatggtagctgctgattctcgtgctagtatgggtggatatatatcatctcagtccgtgaagaaaattattgaaatcaatccatatatgcttggaacgatggccggaggagctgctgattgccaattttggcacaggaatcttgggattaagtgtcggttgcatgagttagcaaacaagaggagaatttcagtgacaggagcctcaaagctacttgcaaatattttatactcttatcgtggaatgggattatctgttggtaccatgattgctggatgggatgagacgggtcctggtctgtattatgttgatagtgaaggaggaagactgaaaggcactcgattctctgttggatctggttcaccatatgcttatggtgtattagacagcggatacaagtatgacatgtcaattgaggaagcttctgaactggctcgacgagcaatttatcatgcaacctttcgtgatggagctagtggtggagttgctagtgtgtactatgttggaccaaatggttggaagaaattgtctggtgatgatgttggggaactccattaccattactacccagttatcccaagcactgtggaacaagaaatgaccgaggctcccggagtttgatgaaatttagccatgga

SEQ ID NO: 2177 - DNA, 1077 bp, Artemisia annua
gagttaacaataaaaacttttgttgtgtaaaataaaccaacatcgatctaataatttcatacttgaaaaacaaggtgaaaatcatgaagcttgactttagtggactagaatcgagtgcaccactctatgggggaaatgacaatttgttgtctgatgggttctcagatgcaccttcatttgaccttccagtcacatcggattttgatggattccagaagaattctatccaaatggtaaagccagcaaaaggaacaacaaccttggcttttattttcaaggatggtgtgatggttgcggctgattcccgagctagcatgggaggctatatatcatctcagtctgtgaagaaaatcattgaaattaatccgtatatgctgggtacaatggctggaggagctgccgactgtcagttctggcacagaaatctaggcattaagtgtcgtttgcatgaattagcaaacaagagaagaatttcagtgactggtgcttcaaagttgctggcaaacattctttattcttaccgtggaatgggtttgtcagtcggaacaatgattgcaggatgggatgagaagggcccaggtctgtactatgtagacagcgaaggaggaagactaaagggaacaaagttttcagttgggtctggttcaccatatgcttatggtgtattagatagcgggtacaactatgatatgtcaattgatgaagctgctgaattggctagaagagccatttatcatgctacatttcgtgatggtgctagtggtggtgttgctagcgtgtatcatgtggggccaactggatggacgaaactatctggtgatgatgttggtgaactccactactcatactaccccgttgaaccagccgttgttgagcatgaaatgaccgaagctgtaactgcctgattgggaaatgttactggtaatttgttaagaatgtgttgagaggagattgtacttttgttatgatattacatgttcaaatgatagtaagtcacttttccttgtttactagtgtttgacattcttattgttccttcatctcagatgttatgcattaaatagtactttgaacctg

SEQ ID NO: 2178 - DNA, 1191 bp, Vaccinium corymbosum
ttgaacaagaaaaccccttctacaaaaattctctaggctctctctttccgatctcctgcgattcgattctttctcttcctcactccgatcagtcgttgaaggtattaagcatgaagttcgatacaagtggtctcgagtcccacgtgctgcatagtggagtgagcgatgaccttctcagtgggttcccgactgctccatcttttgagattcctagtgcaaccgatttcgatgggtttcagaaagaagctatccaaatggtgaaaccagcaaaaggcacaactacactggccttcatcttcaaggaaggtgtaatggttgctgccgactcccgtgctagcatgggaggctacatatcctcacaatctgttaagaaaatcattgaaattaatccctacatgctcggcacaatggctggtggtgcagctgattgccaattctggcataggaatctgggcattaagtgccgactccatgaacttgcaaataagcgaagaatttcagttacaggggcttcgaagctattagcaaacattctgtacagttaccgtggaatgggtttgtctgttggaaccatgattgctggttgggacgaaacgggtcctgggctgtactatgtggacagtgagggaggacgtctgaagggaatgagattttctgttggatctggttcaccttatgcttatggagtactggatagtgggtatcgttatgatatgtcagtggaagaagctgcagagttggctagacgttccatatatcatgctacattccgagatggagcaagtggcggtgttgctagtgtatatcacgtgggacccgatggatggaagaaactatctggggatgatgttgctgaacttcactacaattactatccagttgaagcaacagtggtagaacatgagatggctgagacttcggcagcatgagggaaaatgctgatttaatctctctttctgcaactcctttccagtagtgttttcgaagttctccagaattttcaaaacagccttgttgtacaccaaagcaatttatttccgccgacaattatttttggctgtgaacttaaaattaagctttactttgcgctcgtggtttgtgctcatgtattttacttcgttgtttgaatatcgttatccctactaccttcgaaaatgtactggacagtggaagggaagtaatgtttatttt

SEQ ID NO: 2179 - DNA, 1539 bp, Cicer arietinum
accaagccaacacacagtgaaaccagttcctttattcagcctttctctcaattgcttcaaaactcaacaattgagatctcacactacaactccttcttctgccacagcaatcggtcacacacactaatctgcaatcatgaagcttgatacaagtggtctcgaatcgtttccatcactgatatcacatggaaacgacgtcgttggagagttcgaagcacctccgtcattcgagcttcctaattccaatgacttcgatggcttccttaaagaagctattcagatggtgaagcctgcgaagggtactacgactcttgcttttatctttaaggagggtgttatggtagctgctgattctcgagctagtatgggaggatatatatcatcacagtctgttaagaaaattattgaaatcaatccatacatgcttgggacaatggctggaggtgctgctgattgccaattttggcatagaaatcttgggatcaagtgtcgcttgcatgagttggcaaataaaagaagaatttcagtaacaggagcctctaagttacttgcaaatattttatactcttatcgtggaatggggttatctgttggtacgatgattgctggatgggatgagacgggtcctggtctatattatgttgatagtgaaggaggaagacttaaaggcactagattctctgttggatctggttctccatatgcttatggtgtcttggacagcgggtacaaatatgacatgtcaattgaggaagcttctgaactggctcggcgagcaatttatcatgcaacatttcgtgatggagctagtggtggagttgctagcgtgtactacgttggaccaactggatggaagaaattgtctggtgatgatgttggggaacttcactaccattacaacccagtaaccccaagcaccgtggagcaagaaatggttgaggcaactggaccttgatgcaataactcatggatatcttcgagttacctatacttgcctgcttattttgaatcaattgcatgtacctgattattttatattctaaactgtcatcagtttaatatgtacacaagtgctaccctatgctctgatgatgatgtgtcgagtttctagatcaagtcaaatttaccataggaatggacagagccatgtgtaatgtggaatagtttcaatgggagaagcacgataaacatatattgccatgcatgtttgatgtagaattgtgtccaaatttaggttttagtagtagtgataaaaaaaataacttcaaagtttaatctaattcagatccaacttatttaaacacaactagctgaactttgctctgtttgttttagattttaggggggcccaattgcattacaaacatgtccaatgtgttttccttcaaaatgaatatttatttttgcttctgcgataatctgttggtgacttgtgttgagctatacagacaaatgcagaatttaacctgaaactaacgagtgagaattatggtatattgtcattctaaactgcagtgatagatcaatgattggttgggc

SEQ ID NO: 2180 - DNA, 1193 bp, Humulus lupulus
ttttctcgatctctctccctccctctccgataatcttcgtcgttcctcgtctacgccacctttcatcgccaagggttttaatcatgaagctggacactagcggtctggagtcaagtgcaccgctctttggtgtaagcaatgagttggttgatgggttatctactgccccatcgttcgatcttcctagcaatgttgatcttgatggattcttgaaagacacaatccaaatggtgaagccagctaagggaacaacaacgctggctttcattttcaaggagggtgtcatggttgctgctgattctcgagctagcatgggagggtatatatcatcacagtctgtaaaaaagatcattgaaataaatccttacatgcttggcactatggctggaggagcagctgattgccaattttggcaccgaaatctggggattaagtgccggctgcatgaattggcaaacaagcggagaatatcagttacaggagcatctaagctgctagccaacattctctactcctaccgtgggatgggtctgtctgttggaaccatgattgccggatgggatgaaacgggtcctggactatactatgtggacagtgaaggaggaaggctaaaagggacacgattttcagttggatctggttcaccatatgcttatggtgtacttgatgatgggtaccgatatgatatgtcaattgaagaagcttcggaattggctagaagagcaatttatcatgcaacattccgtgatggagccagtggtggagttgctagcgtttattacgttggaccaagtgggtggaagaagctgtctggtgatgatgttggggaacttcactatcattactatccagtaaccgcaggggctgtagaacaagaaatggtcgaagtaagtggcgcgtagaggtgttcaacatctggagggaatccaaaacatgctaatgaagctaccaaatttctttgcatgtgttatgcgcatgggcatttacccctttcatctgaatacataagatctttgaagttgtttttacacacactcgactaagatctttccatttacaattaattgctagtggcgccttgtgttgatgttcctcaaacttttaaaacttaaagcttatatatggtatctcacttaaaacctagatctcttttttctaccgtaaaaaaaaaaaaacctaccaggccgcctcgc

SEQ ID NO: 2181 - DNA, 1110 bp, Lotus japonicus
ggactgcttcaaacacaacaattccgatctctctcacttcaactcctcattcttcagaaccgttaggtcactaatctgcaaccatgaagctcgataccactggtctcgaatcgtttcctaaactggttgcacctggaaacgacgtcgttggggagttcaccgcacccccatcattcgagcttcccaattccaatgattttgatggcttcgttaaagaagctattcagatggtgaagcccgcgaagggtacgacgactcttgcttttatatttaaggatggtgtcatggtagctgctgattctcgtgctagcatgggagggtatatatcttcgcagtctgttaagaaaattattgaaatcaatccgtatatgcttgggacaatggctggaggtgctgctgattgtcagttttggcacagaaatcttgggatcaagtgtcggctacatgagttggcaaataaaaggagaatttcagtaacaggggcctctaagatgcttgcaaacattttatactcttatcgtggaatggggttatctgttggtaccatgatcgctggatgggacgagacgggtcctggtctatattacgttgatagtgaaggaggaagacttaaaggcactagattctctgttggatctggttcaccatatgcttatggtgtattggacagcgggtacaaatatgacatgtcagttgaggaagctgctgagctggctcgacgagcaatttatcatgctacatttcgtgatggagctagtggtggagttgctagcgtttaccacgtgggaccaaacggatggaagaaattgtctggtgatgatgttggggagcttcattaccattacaacccagttgttccaagcaccgtggaacaagaaatggttgaggcagcttgagctttatggagtactcatggatatcttctctagtttcctttcctttcctttgctgcttattttgaatcgatagcatggaactgattattttatatttgaaagttgacactagtgctgtactattctgatatgttgaatgttgagatcaagtcaaatttaccattggaaatgaaagatagagccatatgcgacgtatggagtagtttaaatggga

SEQ ID NO: 2182 - DNA, 1300 bp, Platanus occidentalis
caacgttccttacttcccaagttttcctctttaatttgtgttctctcttctgcaacattctatcagatagctgaatctttttttctcttccattcttcgtctgcttcgaaggtataaaaacatgaagcttgatatgagcggtcttgaatcggtttccccgctgtttggggcaagcaacgagcttgggagtgggttcactacagcgacagccccatcatttgagcttcctagtattactgattttgatggctttcagaaagaagccaaacaaacgctgaagcatgcaaagggtacaactacacttgctttcatatttaaggaaggagtcatggttgctgctgattctcgagctagcatgggaggatatatctcatcacagtctgttaagaaaatcattgaaattaatccgtacatgcttggtactatggctggaggagctgctgattgccagttttggcatagaaacttgggcataaagtgccggctgcatgagcttgcaaacaagcgaaggatttcagttacaggggcttcaaagctgttggcaaacattttgtactcataccgtggaatgggtctatctgttgggaccatgattgccggatgggatgagacaggtcctggattatattacgtggacagtgaaggaggaagactcaaaggaactcgattttctgttggatctggttccccatatgcttatggtgtactggatagcgggtaccggtacgatatgtcggttgaagaagctgcagaattggcccgtcgatccatatatcatgcaactttccgagatggagctagtggcggagttgctagcgtttattatgtgggaccggatggatggaagaaactatctggtgacgatgttggggagctccactacaaatactacccagttgtcccagccaccgttgaacaggaaatggttgaggtcacggtggcctgaatgaggattgctggtggaaatcagcccaggtttgggtctttatcgcacttgatatttaaatggactgcggcggtttgcaagacaaactcctaaatgcacgtgtttgggtgcttcatgaaaactattacaagacgaggcctgtgcttttgtaggtgctataatcctaccgttctgaccctttttaaaatttcagtagtgaatggcattattatcattgattcgtaaagagttctatctgtgtgcttgctttttgcttgagcaatggaaagacttgtgcgcaattaataggtttattatcccaatcgtcagtgttgacgtttcctttgttgaccttgtcatcatcttagttaaatt

SEQ ID NO: 2183 - DNA, 967 bp, Cynara scolymus
  misc_feature (847)..(847): n is a, c, g, or t
  misc_feature (856)..(856): n is a, c, g, or t
  misc_feature (893)..(893): n is a, c, g, or t
  misc_feature (903)..(904): n is a, c, g, or t
ggatcacgtattacgatctgggttatccttctcgatttaaaggttgccataatgaagcttgactttggtggactagaatcgagtgcaccactctatgggggaagtgatgatgttctttctgatgggttctcagctgccccttcatttgaccttccggttacatcagattttgatggattccagaagaattctatccaaatggtaaagccagcaaagggaactacaactttggcttttatctttaaggagggtgtgatggttgccgcagattcccgagctagcatgggaggctatatctcatctcaatctgtgaagaagatcattgaaattaatccttacatgttgggtacaatggctggaggagctgccgactgccagttctggcacagaaatctaggcattaagtgccgtttgcatgaattggctaacaagagaaggatttcggtgacgggcgcttcaaagttgctggcaaacattctttactcttatcgtggaatgggtttgtctgttgggacaatgattgcaggatgggacgagaagggccccggtctgtattatgtcgacagcgaaggaggacgcctgaagggtacaaaattctccgttgggtctggttcaccatatgcttatggtgtattggatagcgggtaccactatgatatgacgatcgatgaagctgctgaattggctagaagatccatctatcatgcgacattccgtgatggagctagtggcggtgttgctagcgtttatcacgtgggaccgactggatggacgaagctatcgggtgatgatgttggggaacttcactactcatactatcctgttgaaccagccattgttgaacagnaatgactgnagctgtagttgcttgagtgctggtaatttgttaaaanatgtatttgnnatgatttatgagttcatatgacatttttagggccttttttgtttactaattgactttctatgg

SEQ ID NO: 2184 - DNA, 1597 bp, Eucalyptus grandis
gtagcttctccttcttcctcaccttcctactctctctctctctctcactacttcacagtgtccgatcagtcaagccgccggaagaccgccggagaaccgcgagagcaacccgcgcggcagcggatcgctcccgcacgcggcggcgagctagggaggagccctcccaattcgtgcgcatccccagcctcgcgagcgccctcacggcttcaggcggcccagcaacgcacttttcctgcagagcaagaaagaagaagaaaggcataaaacctctccgcatcgcgctcgtcgtcctagctctcctccgcatcgcgctcgatcgcttcgcaaggtctcgtctctccatttcttcttcgccgcatcgtctgtaacaaggttttagccatgaagctcgataccagcggcctcgagtccaccatgccggttttcggggtgaacaaggagctttttgaggggttttcagctgccccggcttttgaaattcctggtgcttgtgatttcgacaactttcaaaaagaagctgtgcagatggtgaagccagctaagggaactactaccctcgcttttatttttaaagagggcgttatggttgctgctgattctcgagctagcatgggaggctatatctcatctcagtctgtgaagaagataattgaaataaatccacacatgctcggaacaatggctggaggagctgctgactgccaattttggcaccgaaatctcggtattaagtgtcggctccatgaattggcaaacaaacggaggatttcagtcacaggggcttcaaagctccttgcaaacattctttattcatatcgtggaatgggtctatcagttgggacgatgatcgctggctgggatgagacgggcccaggtctatattatgtggacagtgagggaggaagattgaaagggactcgtttctcggttggatctgggtcaccatatgcatatggggttttggatagcggctatcgttatgacatgtcagttgaagaggctgcagaattggctagaagagccatttaccatgcaacttttcgtgatggagccagtggtggagttgcaagcgtctatcatgtgggaccaaccggttggaagaagctatctggtgatgatgttggggagcttcactaccattaccaccctgtcacgcctagcacagtggagcaggaaatggctgaagtagtggcggcgccatgaaaggatctcttcttcaactgaatgctttgagtgggttcttttgtgttccatctgccggggaagacagatatcttcacgtgcttatgtatcttgatcttcttcttcttcttttttttgctgttggattgatgagcagaacagcccttgatgaacctgaaatgaactaaaattagaagagaatctactcagtgctcattgcctccttggttatcctagtcaactgtacatgtcaacttatagctatcgtaatgtggtactgctttcggccattaaaaatgtcagtccttgcagagttttgaaaaataggacttgacgccctgcctgttgtggcaccttgatgttgggatgcttggaaacctgaatggaagtggcaaattggtcagaaacatctttc

SEQ ID NO: 2185 - DNA, 953 bp, Flaveria ramosissima
aaacactctcagactctcgttcgagcttttcagttttccctattgaatcaacgtatcaacgatctcttttgttcttctcgatcacaaggcggaaatcagtgaagcttgactttagtggactagaatcgggtgcaccactatgcggggggaataatgagttgctatgtgatgtgttctcagctgccccttcatttgatcttccagttacatcagattttgatgaattccagaagaattctatccaaatggtaaagccagcaaaggggacaacaaccctggcttttatttttaaggagggtgtgatggttgctgctgattcccgagctagcatgggaggatatatctcatctcaatctgtgaagaaaatcattgaaattaatccgtatatgctgggtacaatggctggaggagctgcagattgccagttctggcacagaaatctaggcattaagtgtcgtttgcatgaattggcaaacaagagaaggatttcggtgactggggcttcaaaattgctggcaaatatattatattcttatcgtggaatgggcttgtctgttgggacaatgattgcaggatgggatgaaaagggtccaggtctttattatgtagacagcgaaggaggacgcctgaagggaacaaagttctcagttgggtctggttcaccgtatgcttatggtgtactagatagcgggtataaatatgagatgacaatcgatgaagctgctgaattggctagaagagcgatttatcatgcaacattccgtgatggagctagtggtggtgttgctagcgtttatcatgtgggcccaactggatggaccaagctatcgggcgatgatgttggtgaacttcactactcatactatcctgttgagcctgccattgttgaacaggaaatgacggaagctgcagccgcctgagtcgaatgggttgctggtagtttgttataaaaa

SEQ ID NO: 2186 - DNA, 1415 bp, Aristolochia fimbriata
ttcacttccaccaaagaaaactgagctcggactcttgctgtttcttcccctgcaagaattcgtggaaagtcgactacggaaagctcccttgcgggtgttgggttttttgttctgtctcgcatctgtaggtgactcattacatctggttcttctagtatattaacatgaagcttgacacaagcggccttgaaacatttgctccgttccatggggcaaatggagatctttgtggagaactttcatctgtgccatcattctcactccctaaagctgataactttgatgactttcagaagaaagctgtccaaatggtaaaaccagctaaaggaactacaacacttgcgttcatttttaaggagggagtgattgtagctgctgattctcgagctagcatgggcggatatatctcatctcaatctgtgaagaaaataattgaaatcaacccttatatgcttggtacaatggctggaggtgcagctgattgccagttttggcacagaaatttgggcataaagtgtcgtctacatgagcttgcaaacaagcgaaggatttctgttactggtgcctcaaaactactagccaatattctgtactcataccgtggaatgggtctttcagtgggaacgatgattgctggatgggatgaaacgggacctggtttgtattatgtggacagtgaaggtggcagattgaaggggacacgcttctctgttggatctggttccccatatgcttatggagttctagataatgggtatcgctatgacatgtcagttgaggaagctgcagaattggctcgccgatctatttatcatgcgacatttcgagatggagctagtggtggagttgcaagtgtttactatgttggacccaacggatggaaaaagctttctggggatgatgttggggaacttcattataaatattacccagttgttccaagccctgtcgaacaggaaatggctgaagtagcatcttagtaagaaggacgtgagcaagaaggaaaaaacaaggccggtgcgttgtattggatacaaacttttaaaccatgttttgagaacagaatttcttgtggacggctaaaagattattttcgtttcatagcctctatatggtggtgaatttagaatgatacccagcatgtcttacgaatttgacattttagaagaatcccttacggattggatgatgaggaatcaataatgctgttatagagatagctagccactactaatcgcccagtggaaaatattgccgaagttaaatgcgagggaagaacgtttaaggatagaaggcttttaagcggcagtccattcctcggttgggactttttagttgcaggtagcgttaggcactctttctggtcataaacttctttgtttaactatagattttactttaaatatttcattttg

SEQ ID NO: 2187 - DNA, 1241 bp, Phaseolus vulgaris
gaaaacagcgtcgttctactttttccctcattgcttcaaactcaacaattgagatctcactgcaattgcttcttctactagagaaggtcactaatcttccatcatgaagctcgataccactggtcttgaatcgtttccctcactgcttgcacctcaaagcgacgtcgttggagcactctccgccgctccatccttcgaccttccgaattccaatgatttcgatgggttcttgaaagaggctattcagatggtgaagcccgcgaagggtaccacgactcttgcttttatttttaaggagggtgtcatggtagctgccgattctcgagctagcatgggaggatacatatcatcgcagtctgtgaagaagattattgaaatcaatccgtacatgctggggactatggctggaggtgctgctgattgtcagttttggcacaggaatctcgggatcaagtgtcgtttgcatgagttggcgaataaaaggagaatttcagtaacaggagcctcgaagctacttgccaatattctatactcttatcgtggaatggggttatcagttggtaccatgattgctggatgggatgagacgggacctggtctatattatgttgatagtgaaggaggaagacttaaaggcaccagattctctgttggatctggttccccatatgcttatggtgtattggacagcgggtaccgatatgacttgtcggttgaggaggcagctgaacttgctcgacgagcaatttatcatgcaacatttcgtgatggggccagtggtggagttgctagcgtgtactatgtgggaccaaatggatggaagaaattgtctggtgatgatgttggtgaactgcattaccattactacccagtaaccccaagcacagttgaacaagaaatggttgaggcacctggagcatgataaattaactcgtagaggccttttttaaatttcctttgcttgccaagaagcttattttgaatcgattgcatgaaacttgagtaaaatttgacattagtttgatatatacaagtgctgtactatgatgatgtgttttaagatcaagtcaatacttggcattgaaaatgcagattagaggcaatgtggcgtggtttaaacgagtaaagcgcgtgagacgtgaaagttgtaccagaaatttgctaaggagaattattgttctaggttttccattggttaataaggttgcaaaaaaaataaaattaaccttcatgacatgacg

SEQ ID NO: 2188 - DNA, 1216 bp, Phaseolus vulgaris
gtcgttctactttttccctcattgcttcaaactcaacaattgagatctcactgcaattgcttcttctactagagaaggtcactaatcttccatcatgaagctcgataccactggtcttgaatcgtttccctcactgcttgcacctcaaagcgacgtcgttggagcactctccgccgctccatccttcgaccttccgaattccaatgatttcgatgggttcttgaaagaggctattcagatggtgaagcccgcgaagggtaccacgactcttgcttttatttttaaggagggtgtcatggtagctgccgattctcgagctagcatgggaggatacatatcatcgcagtctgtgaagaagattattgaaatcaatccgtacatgctggggactatggctggaggtgctgctgattgtcagttttggcacaggaatctcgggatcaagtgtcgtttgcatgagttggcgaataaaaggagaatttcagtaacaggagcctcgaagctacttgccaatattctatactcttatcgtggaatggggttatcagttggtaccatgattgctggatgggatgagacgggacctggtctatattatgttgatagtgaaggaggaagacttaaaggcaccagattctctgttggatctggttccccatatgcttatggtgtattggacagcgggtaccgatatgacttgtcggttgaggaggcagctgaacttgctcgacgagcaatttatcatgcaacatttcgtgatggggccagtggtggagttgctagcgtgtactatgtgggaccaaatggatggaagaaattgtctggtgatgatgttggtgaactgcattaccattactacccagtaaccccaagcacagttgaacaagaaatggttgaggcacctggagcatgataaattaactcgtagaggccttttttaaatttcctttgcttgccaagaagcttattttgaatcgattgcatgaaacttgagtaaaatttgacattagtttgatatatacaagtgctgtactatgatgatgtgttttaagatcaagtcaatacttggcattgaaaatgcagattagaggcaatgtggcgtggtttaaacgagtaaagcgcgtgagacgtgaaagttgtaccagaaatttgctaaggagaattattgttctaggttttccattggttaataaggttgcaaaaaaaataaaattaa

SEQ ID NO: 2189 - DNA, 1117 bp, Tropaeolum majus
tcttcatttcgtcttctgtttttacttgcttgctgcactaacttccggtgatcgtcgtttgcagtttcatttcatttctgcttcaggaaggttgtaaaaaatgaagcttgatacaagtggcctagagtctgtcgcacctctttgtgatgaaggcactgagaatattcatgggtttataaatgccccatcattcgaacttccaaacactactgattttgatggttttgtgaaagatgctgtacaaatggtgaagcccgcaaagggaacaaccacactagctttcatttttaaggaaggagttatggttgctgccgattctcgagctagcatgggaggctatatctcttcacagtcagtgaaaaaaatcattgaaatcaacccttacatgcttggtacaatggctggaggagctgctgactgccagttttggcacaggaatctaggcattaagtgccgattgcatgaactggcaaacaagcgaagaatttcagttacaggggcatcaaaactgttggccaacattctatattcataccgtggaatgggcttatctgttgggaccatgattgctggatgggatgaaacgggtcctggactatactatgttgacagtgaaggaggaaggctgaaaggaccgcgcttctccgttggatctggttctccttatgcttatggtgtactagataatggttaccgatacgacatgtcaatcgaagaagcggcagagttggcccgtagagccatttatcatgccacattccgagatggtgcaagtggtggagttgctagcgtttattacgtgggatcggagggatggaaaaaactctccggtgacgatgttggtgaattgcactaccactactatcccgttacgccaagtacggtggaacaggaaatgggcgaagtagctggggcataagctatgcgtgtctttactttgaccaggttcaagatcttctcccccttttacagctattattagggacagaaggttttatgaggtgcacttgtgaactagattctcatgttttaagtaatctttgattttatccaagaggtattcaaacagtaaaaaaaaaaactacagataatttaatgtaatgctacacaaattaag

SEQ ID NO: 2190 - DNA, 848 bp, Vinca minor
tattgactttagtgggcttgaatcgagggcttcaattcttggtaactcgaatgaattgttcaatggtctttccatagctcctgaattccagattccgagaactgataattttgatgggttccagaaagaagcaatccagatggttaaaccagctaaaggaacaacaactttggcattcatattcaaggaaggcgtcgtagttgcagctgactctcgtgctagcatgggaggatatatttcatcacaatctgtcaagaaaatcattgaaatcaatccatacatgcttggcacaatggctggaggtgctgctgactgtcagttttggcacagaaacttggggattaagtgccgtctgcatgagctcgcaaacaaaagaagaatttctgttactggagcttcaaagttgcttgcgaacattctatattcttatcgtggtatgggattgtccgtgggaacaatgattgctggatgggacgaaaagggtcccggcctatattatgtcgacagtgaggggggacggcttaaaggaaatcgattctcagttggatctggttcaccatatgcttatggtgttctggatagcgggtataagtttgatatgtctgttgaggaggctgcagagttggccagacgctctatttaccatgctactttcagagatggtgctagtggcggtgttgtcagtgtttatcacgtaggaccaaacgggtggaagaaaatgtctggtgatgatgttggtgaacttcattaccattactatccagttgagccaacaatggtggagcaggaaatgaccgaggcatcaacttcttaatgtaggatatctgggtaatgctgcttgaacttta

SEQ ID NO: 2191 - DNA, 1019 bp, Ambrosia trifida
cggggtaaataaataatactcactctattgaatcaacgacattaacgatctgttctatacttttcgattaaaaggtagaaatcatgaagcttgactttagtggactagaatcaagtgcaccactctacgggggaaagaatgagttgctgtcggatgggttctcagcggccccttcatttgatcttccagtcacatcagattttgatgatttccaaaagaactccatccaaatggtaaagccagcaaaggggacaacaaccttggcttttatcttcaaggacggtgtgatggttgctgctgattcccgagctagcatgggaggctatatctcatctcaatctgtgaagaaaatcattgaaattaacccctatatgttgggtacaatggctggaggagctgcagattgccagttctggcacagaaatttaggtattaagtgtcgtttgcatgaattggcaaacaagagaaggatttcagtgactggtgcttcaaagttgctggcaaatatattatattcttatcgtggaatgggtttgtctgttgggacaatgattgcaggatgggatgagaagggtccaggtctatattatgtagacagtgaaggaggacgcctgaaaggaacaaagttctccgttgggtctggttcaccctatgcttatggtgtactagatagcgggtacaaatatgatttgacaattgatgaagctgctgaattggctagaagagccatttatcatgcaacattccgtgatggagctagtggcggtgttgctagcgtttatcatgtgggaccaaatggatggacaaagctatcaggtgatgatgttggtgaacttcactattcatactatcctgttgaaccagccaccgttgagcatgaaatgacggaagccgtagttgcctgagctgaacggattgctgttggtaatttgtacaaaaaaattattaggagcataatgtacttttgttatgtattttacatgttcaaatgactattaacttgtttcttcttgtttatc

SEQ ID NO: 2192 - DNA, 1162 bp, Vigna unguiculata
catttcttcaaactcaacaattgagatctcattgcaattgcttcttctactagaaaaggtcactaatcttccatcatgaagctcgataccactggtcttgaatcgtttcccacactgcttgcacctcaaagcgacgtcgttggagaactttccgctgctccgtccttcgaccttccgaattctaatgatttcgatgggttcttgaaagaagctattcagatggtgaagcccgcgaagggtaccaccactcttgcttttatctttaaggagggtgtcatagtagctgctgattctcgagctagcatgggaggatacatatcatcgcagtctgtgaagaagattattgaaatcaatccgtacatgcttggtactatggctggaggtgctgctgattgtcagttttggcacaggaatctcgggatcaagtgtcgtttgcatgagttggcgaataaaagaagaatttcagtaacaggagcttccaagctacttgccaatattttatactcttatcgtggaatggggttatcggttggtaccatgattgctggatgggatgagacgggacctggtctatattatgttgatagtgaaggaggaagacttaaaggcactagattctctgttggatctggttcgccatatgcttatggtgtattggacagcgggtaccgatatgacttgtcaattgaggaggcagctgaacttgctcgacgagcaatttatcacgcaacatttcgtgatggggccagtggtggagttgctagcgtgtactatgtgggaccaaatggatggaagaaattgtctggtgatgatgttggtgaactgcattaccattactacccagttaccccaagcacagttgaacaagaaatggtggaggcaactggagcatgatgaagtaactcgtggatacctttttaaattttctttgcttcccaagcttacttttaatcccttgcatgaaactggttattctagtaaaatttgacattcgttgatatatgtaagtgctgtactatcctgatgtggtttaagctgaagtgaatatttacaattaaaaatgacatattagaggccatgtggagtggtttaaacgaggaaagagctagctattgctaatttaatccatcttgccattaatggttttcatggcaactttctg

SEQ ID NO: 2193 - DNA, 1075 bp, Actinidia deliciosa
ctcaaatcgatcgaggttttacagatcttctccttctctctcatatcctgagattcgataatttctctgtttcgaacaggttataggcatgaagttcgatacaagtggccttgagtcccatgggcagcttgttggagcaagcgatggacttttcagtgggttcccaactgccccatcttttgagattcctaatacaactgatttcgattgctttcaaaaggaagctatacagatggtgaaaccagcaaagggcacaacaactctggctttcatttttaaggagggtgtaatggttgctgctgactctcgtgcgagcatgggaggctacatctcttcccaatccgtgaagaaaattattgaaatcaatccttacatgcttggcacaatggctggtggagcagctgactgccaattctggcacagaaatctggggattaagtgccgactccacgagcttgcaaataagcgcagaatttcagtcacaggggcttcgaagctgttggcaaacattctatataattaccgtggaatgggtttatcggttggaaccatgattgctggttgggatgaaacgggtcctgggctgtattacgtggacagtgaaggaggacggctaaagggaatgagattttctgttggatctggttcaccttatgcttatggagtactggataatgggtatcgttatgatatgtcagtggaagaagctgcagagttggctagacgttcaatttatcatgcgacattccgagatggagcaagcggtggtgttgctagcgtgtactatgtgggaccggatggatggaagaaactatctggggatgatgttgctgaacttcactacagttactatccagtcgaaccagcagtggtagaacaggtgatggttgagacttaagggactttgagggagagctgctttgttgttctatctgtcaactcctttattttcaatgtgtttcttcaacaattcctgaacacccttggttactgcatagcagtttagtttttctgaccttttgttgatttcaaaacttcaaattaatctatacaattccctgctatttatgcttta

SEQ ID NO: 2194 - DNA, 1064 bp, Solanum tuberosum
aaggttgtaaatgatgaagatcgattttagcggacttgaaccaagtgccccacttcgaggggagtcttctgagctgtttgatggaatttcgaattctccatcattccatcttcctaatactgctaattttgatggttttcaaaaagaagcaatccaaatggtgaagcccgcgaagggaaccacaacccttgctttcatttttaaaggaggtgtcatggttgctgctgattctcgggctagcatgggaggatatatatcatctcaatctgtgaagaaaatcattgaaattaatccatatatgcttggcacaatggctggtggggctgctgactgccaattctggcatagaaacctgggaatcaagtgccgtcttcatgagctggcaaacaaaaggagaatttcagttactggagcttcaaagctgctggcaaacattttatattcttaccgtggaatgggtttgtctgttggaactatgattgctggttgggatgagaagggtccaggactatattatgtcgatagtgagggaggacggcttaaaggaaacagattctctgttggatctggttctccttatgcttatggtgttttggataatggataccgatatgatctgtctgtggaagaagcagctgagttggctagacgagctatttatcatgctacattccgtgatggagctagtggaggtgttgctagtgtttatcatgttggaccaaatggatggaagaagctatcaggagacgatgttggagaactccactaccactactatcccgttgaagtggcagccgtggagcaggaaatggctgaagtgccagtggcctgaggaaaatcaaaaccatcaaatatgttctcatcttcgctagttaaagagacagtttagttttcttctcagactgtattgtggtctttcaatctgtaaaccgtaaaaaattacctacacccgatgtttaaaccaagccaatagatgcaaggctgtctgtttcgttcacacattcatcacttaattatgttttagttgtatgcacacttcaatttttaactgctaagtttaaatt

SEQ ID NO: 2195 - DNA, 1255 bp, Rosa hybrid cultivar
ggcgacagtatccagggttcttaaatgacgatccgacattgaatttctcttctcgatcttgaagagactctccgttcctcatcgtcttcgttttccggagctgacaatcgccaagaggctttacgacaatgaagttcgacttcagcagtcttcaaaccactgcgccgttgctcggcgacagcggtgggttttcagctgcgccgtcgttcgaggtccctgttactgatgactttgatgggtttcagaaagaggctatccagatggtgaagccggccaaggggactacaacccttgcatttattttcaaggatggtgttatggtggcggctgattctcgagctagcatgggaggatatatatcgtctcagtctgtgaagaagattatcgaaatcaatccttacatgcttggaactatggctggtggagctgctgactgtcagttttggcataggaatttggggattaagtgcagacttcacgaattggcaaacaagcgcagaatttcagttacaggtgcatccaagctcttggccaacattctgtactcttaccgtggcatgggtctgtctgttgggaccatgatagctgggtgggatgaaacgggtcctggactttattatgtggacagtgaggggggaaggttgaaagggatgcggttttcagttggatctggttcaccatatgcttatggtgtcctggataatgggtaccactatgatatgtcagttgaagaagctgctgagttagctaggagagccatatatcatgcaacattccgtgatggagctagtggtggagttgccagcgtttaccatgtcggtccaaatgggtggaaaaagctatctggagatgatgtcggggaacttcactacacatactatcctgtaacccccgagaccgtggaacaagaaatggtggaggtaggtgcagcctaagaggggggactagctaatggaaaaggcaggcaaagagggatttgaagaaagcaaggcataggcagtgggatgctacttttcttattattcaactgaattagcatgatgctgatgttattagattggtcatgtcttgttatattacatcctgttttcttgacatgaatattacgttccctttctgtactcttgcttggaactgctatgttcacttgtggatggtcttagaggcatttagagcctttgcgcaaatttggtgttgatgtgaagtctctcttatgttcatcccattatcaaatatcttttttattctgccgtca

SEQ ID NO: 2196 - DNA, 1401 bp, Glycine max
gaaaaacagtgtacctctttgctttttcccattgcttctaacgtgagatctcagattgcaattgcctcttctcttctcccagaatcggtgtaggttacaggtttaagggttttgttttcatttaggtcactaatccgatatcatgaagctcgatacgactagtctcgaatcgtttcccacactgattgcacctcaaaacgacgtcgccggagaactctccgccgctccgttctttgaccttccgaattccaatgacttcgatgggttcttgaaagacgctattcagatggtgaagcccgcgaagggtactacaactcttgcttttatatttaaagagggtgttatggtagctgctgattctcgagctagcatgggaggatatatatcgtcgcagtctgtgaagaaaattatcgaaatcaatccgtatatgcttgggacaatggctggtggtgctgctgattgccagttttggcacaggaatctcgggattaagtgtcgtttgcatgagttggcaaataaaaggagaatttcagtgacaggagcctcaaagctacttgccaatattttatactcttatcgtggaatgggtttatctgttggtaccatgattgccggatgggatgagacgggccctggtctatattatgttgatagtgaaggaggaagacttaaaggcactagattctcggttggatctggttcaccatatgcttatggtgtattggatagcgggtaccggtatgacctgtcagttgaggaagctgctgaacttgctcgacgagcaatttatcatgcaacatttcgtgatggggccagtggtggagttgctagcgtttactatgtgggaccaaatggatggaagaaactgtctggtgatgatgttggggaacttcattaccattactacccagttaccccaagcaccgtggaacaagaaatggttgaggctactggtgcttgatgaagtaactcgtggatgtctttttaagtttcctttgcttgccagcgtattttgaacccattgcatgaaactgattactttataattggaaattgacaatagtttgataaatacaagtgctgtcctatcctgttgtgttttagatcaagccatatttatcatccaaaatgatagattagagccatatataatgtggagtggtttaaattggtaaagcaggtcagacgtgtattgctagctattgctaatgtaatccatcttgcgattaatggttttcgtggcaacttctgaaagttgtacaagaaacttcctagggagaattgtggttcaatgtcttcgactgattgtagtagttagtaagcatacttttggtacgtcatggttttaatttaaagcttcgtcaaattgagacttaaattaattgttgatttttttttcaa

SEQ ID NO: 2197 - DNA, 1352 bp, Glycine max
ctttttcccattgcttctaacgtgagatctcagattgcaattgcctcttctcttctcccagaatcggtgtaggttacaggtttaagggttttgttttcatttaggtcactaatccgatatcatgaagctcgatacgactagtctcgaatcgtttcccacactgattgcacctcaaaacgacgtcgccggagaactctccgccgctccgttctttgaccttccgaattccaatgacttcgatgggttcttgaaagacgctattcagatggtgaagcccgcgaagggtactacaactcttgcttttatatttaaagagggtgttatggtagctgctgattctcgagctagcatgggaggatatatatcgtcgcagtctgtgaagaaaattatcgaaatcaatccgtatatgcttgggacaatggctggtggtgctgctgattgccagttttggcacaggaatctcgggattaagtgtcgtttgcatgagttggcaaataaaaggagaatttcagtgacaggagcctcaaagctacttgccaatattttatactcttatcgtggaatgggtttatctgttggtaccatgattgccggatgggatgagacgggccctggtctatattatgttgatagtgaaggaggaagacttaaaggcactagattctcggttggatctggttcaccatatgcttatggtgtattggatagcgggtaccggtatgacctgtcagttgaggaagctgctgaacttgctcgacgagcaatttatcatgcaacatttcgtgatggggccagtggtggagttgctagcgtttactatgtgggaccaaatggatggaagaaactgtctggtgatgatgttggggaacttcattaccattactacccagttaccccaagcaccgtggaacaagaaatggttgaggctactggtgcttgatgaagtaactcgtggatgtctttttaagtttcctttgcttgccagcgtattttgaacccattgcatgaaactgattactttataattggaaattgacaatagtttgataaatacaagtgctgtcctatcctgttgtgttttagatcaagccatatttatcatccaaaatgatagattagagccatatataatgtggagtggtttaaattggtaaagcaggtcagacgtgtattgctagctattgctaatgtaatccatcttgcgattaatggttttcgtggcaacttctgaaagttgtacaagaaacttcctagggagaattgtggttcaatgtcttcgactgattgtagtagttagtaagcatacttttggtacgtcatggttttaatttaaagcttcgtcaaattgagac

SEQ ID NO: 2198 - DNA, 911 bp, Tabernaemontana elegans
ttgctattttcttcgtgatcaggatttctctgctgcagcgagaagtgacaatgatgaagattgactttagtgggatcgagccgagggcttcagttctgggaaacgggaatgaattgctaagtgggctttccacagctcctgaattccagattcctaacactgataattttgatgggttccagaaagaagcaatccagatggttaaaccagctaagggaacgacaactttggcattcatattcaaggaaggagtcatagttgcagctgactctcgtgctagcatgggaggatatatatcgtcacaatctgttaagaaaatcattgaaatcaatccctacatgcttggcacaatggctggaggtgcagctgactgccagttttggcacagaaatttggggatcaagtgccgtctacatgaacttgcaaacaaaagaagaatttctgttactggagcttcaaagttgctggcgaacattctatattcttatcgtggtatgggattgtctgtgggaacaatgattgctggatgggatgaaaagggtcctggactatattatgttgacagtgaggggggacggcttaaaggaaacagattttcagttggatctggttcaccatatgcttatggtgttcttgatagcgggtatcgttttgatatgtctgttgaagaggctgcagagttggccagacgtgctatttatcatgctactttcagagatggcgctagtggtggtgttgttagtgtttatcacgtagggcctaatgggtggaagaagttgtctggtgatgatgttggggaacttcattatttgtactatccagtagagccagcagtggtggaacaagaaatggctgaggtaccagtttcttaatacatggcatctggggagtgctgcttgaatgtttttttt

SEQ ID NO: 2199 - DNA, 1090 bp, Solanum lycopersicum
aagttgataccactacaaaaattgcttttctccggtgaattccttacgatctctttctccggcgatatctagatcttattgcagcttaaggttgtaaatgatgaagatcgattttagtggacttgaaccaagtgccccacttcgaggggaatcttctgagctgtttgatggaatttcaaattctccatcattccatcttcctaatactgctaattttgatggttttcaaaaagaagcaatccaaatggtgaagcccgcaaagggaaccacaacccttgctttcatttttaaaggaggtgtcatggttgctgctgattctcgggctagcatgggaggatatatatcatctcaatctgtgaagaaaatcattgaaattaatccctatatgcttggcacaatggctggtggggctgctgactgccaattctggcatagaaacctgggaatcaagtgccgtcttcatgaactggcaaacaaaaggagaatttcagttactggagcttcaaagctgttggcaaacattttatattcgtaccgtggaatgggtttgtctgttggaactatgattgctggttgggatgagaagggtccaggactatactatgtggatagtgagggaggacggcttaaaggaaacagattctctgttggatctggttctccttatgcttatggtgttttggataatgggtaccgatatgatctatctgtggaagaagcagccgagttggctagacgagcaatttatcatgctacattccgtgatggagctagtggaggtgttgctagtgtttatcatgtcggaccaaatggatggaagaagctatcaggtgacgatgttggagaactccactaccactactatcccgtcgaagtggcagctgtggagcaggaaatggctgaagttccagttgcctgaggaaaaacaaaaccaagatcaagatcaaaacatgtgctcatctttgcaagttaaagtgactgtttaattttcttctgagactgtattttgtggtcttgcaatctgtaaaaccgtaaaaacatatttaaaccaaaccaatagatgcaaggctatgtttcatttcatcactta

SEQ ID NO: 2200 - DNA, 1130 bp, Solanum lycopersicum
accactacaaaaattgcttttctccggtgaattccttacgatctctttctccggcgatatctagatcttattgcagcttaaggttgtaaatgatgaagatcgattttagtggacttgaaccaagtgccccacttcgaggggaatcttctgagctgtttgatggaatttcaaattctccatcattccatcttcctaatactgctaattttgatggttttcaaaaagaagcaatccaaatggtgaagcccgcaaagggaaccacaacccttgctttcatttttaaaggaggtgtcatggttgctgctgattctcgggctagcatgggaggatatatatcatctcaatctgtgaagaaaatcattgaaattaatccctatatgcttggcacaatggctggtggggctgctgactgccaattctggcatagaaacctgggaatcaagtgccgtcttcatgaactggcaaacaaaaggagaatttcagttactggagcttcaaagctgttggcaaacattttatattcgtaccgtggaatgggtttgtctgttggaactatgattgctggttgggatgagaagggtccaggactatactatgtggatagtgagggaggacggcttaaaggaaacagattctctgttggatctggttctccttatgcttatggtgttttggataatgggtaccgatatgatctatctgtggaagaagcagccgagttggctagacgagcaatttatcatgctacattccgtgatggagctagtggaggtgttgctagtgtttatcatgtcggaccaaatggatggaagaagctatcaggtgacgatgttggagaactccactaccactactatcccgtcgaagtggcagctgtggagcaggaaatggctgaagttccagttgcctgaggaaaaacaaaaccaagatcaagatcaaaacatgtgctcatctttgcaagttaaagtgactgtttaattttcttctgagactgtattttgtggtcttgcaatctgtaaaaccgtaaaaacatatttaaaccaaaccaatagatgcaaggctatgtttcatttcatcacttaattatatgtacacttcaattttcaactgttaagcttgaattatctctg

SEQ ID NO: 2201 - DNA, 1253 bp, Trigonella foenum-graecum
aactcattgagtttaattcctttttcatccattctcgcatcgcattgctgagatctaacactgcaattccgcaactcataatcgataattttccataatcgattagttacaatcgataatctgcaaccatgaagcttgataccactggtctcgaatcattcccttcattgatttcacatggaatcaatgtcgctggcgaaatctctgcaccaccatcgttcgagcttcccaattcccacgattttgatgggtttgttaaagaagctattcagatggtgaaacccgcgaagggtactacaactcttgcttttatattcaaggagggtgttatggtagctgctgattctcgtgctagtatgggaggatatatatcatcacagtcggttaagaaaattattgaaattaatccatacatgcttggcacaatggctggaggtgctgctgattgccaattttggcataggaatcttggcatcaagtgtcgcttgcatgagttggcaaataaaagaagaatttcagtaacaggagcctctaagttacttgcaaacattttatactcttatcgtggaatgggattatctgttggtaccatgattgctggatgggatgagacgggtcctggtctatattatgttgatagtgaaggaggaaggcttaaaggcacaagattctctgtaggatccggttcaccatatgcttatggtgtcttggacagcgggtacaaatatgacatgtcaattgaggaagcttctgaactggctcggcgtgcaatctatcatgcaacattccgtgatggagctagtggtggagttgctagcgtttactacgttggaccaactggatggaagaaattgtctggtgatgatgttggtgaacttcactaccattacaacccagtcaccccaagcaccgtggagcaagaaatggttgaggcagctggtccttgattcagtaactcggatatcttttgagttccctagacttgtctgcttattttaaatcaattgcatgtacctgatttatattcataactgtcaccagttttatgtatacacaagtgctgctctatgctctgaggttgtgagttttcagatcaagtagctatgtttaatgtggaatagtttaaatgagaaaagcacgtcaaatggatattgtcatgcgcgtttgatatagttgtttgtatccaaatctaggttttaagagaagtgataaaagaaattttcatgtaaagcttaataaaactaatataattt

SEQ ID NO: 2202 - DNA, 996 bp, Flaveria ramosissima
gcttgactttagtggactagaatcgggtgcaccgctctgtgggggaaataatgagttgctatgtgatgggttctcagctgccccttcatttgaccttccagttacatcagactttgatgaattccagaagaattctatccaaatggtaaagccagcaaaggggacaacaaccttggcttttattttaaggagggtgtgatggttgctgctgattcccgagctagcatgggaggatatatctcatctcaatctgtgaagaaaatcattgaaattaatccatatatgctgggtacaatggctggaggagctgcagattgccagttctggcacagaaatctaggcattaagtgtcgtttgcatgaattggcaaacaagagaaggatttcagtgaccggggcttcaaaattgctggcaaatatattatattcatatcgtggaatgggtttgtccgttgggacaatgattgcaggatgggatgaaaagggtccaggtctttattatgtagacagcgaaggaggacgcctgaagggaacaaagttctcagttgggtctggttcaccatatgcttatggtgtactagatagcgggtataaatatgacatgactatcgatgaagctgctgaattggctagaagagcgatttatcatgcaacatttcgtgatggagctagtggtggtgttgctagcgtttatcatgtgggcccaaccggatggacaaagctatcgggcgatgatgttggtgaacttcactactcatactatcctgttgagcccgccgtcattgaacaggaaatgacggaagctgcagctgcctgagtccaacaggttgctggtagtttgatataaaaactcggagcataatgtacttttgttatcatctgttttttcttgttaattacttgagtttgactaccttattgttcattcatctaaaattttatgcatgtattagtacattactttaaagggctaatgtacttaaattagtggcgttac

SEQ ID NO: 2203 - DNA, 1236 bp, Euonymus alatus
tatagtttatatttttttctcctttccattttacatcaatctgcgcaaggctctcgatcacttgcatacactaatcttctcgcacaaagatcatgaagcttgacaccagtggccttgaatcgcctatgccgcactttggggcgggtagcgaaattcttgcggggatttcgactgcacagtctgcacagtcttttgaggttcccgatgttactaattttgatgcattccaaaaggaggctacacagatgttgaagcatgccaaggggacaactactcttgcttttatctttaaggagggtgtcatggttgctgctgattctcgagctagcatgggcggctatatctcatcccagtcagtgaaaaaaatcattgaaatcaatccttacatgcttggtacgatggctggaggagctgctgactgtcagttttggcacagaaatctgggaattaagtgccgactgcatgaattggcaaacaagcgcagaatttcagttacaggagcatccaaacttctggcaaacattctgtattcttatcgtggaatgggtctatctgttgggactatgattgctgggtgggatgaaacgggacctggactatattatgtggatagcgaaggaggaaggcttaaaggaatgcgattctctgttggatctggttctccatatgcttatggtgtacttgataacgggtatcattatgatatgtcggttgaagaagctgcagagttggctagaagagccatttaccatgcaaccttccgagatggagctagtggtggagttgcaagcgtttatcatgtaggaccaaatggctggaagaagctatcaggtgatgatgttggagaactccactaccattactatccagtcacaccgagtacagtggaacaagaaatgactgaagttgccggggcatgaggggtttcggtaaatgtagaccaggtttaagaccatccttctttccttgtacccaatggaagagttgttttttcaaattatgtattatgtgcttattttggaaacagttcattgtagatgtgggtttcagtcaatgcgtgagaagtgagagccatactgctattatgttaagcccatgaaattgaactttacgaggcatttctgtttttactgaaatttcaatatgcttgaccaagctctagtcttgagacacatgatcaatttgtgtgcccttttgtgattgtgtgatatattatgcgaacacctatgcttttat

SEQ ID NO: 2204 - DNA, 1089 bp, Euonymus alatus
ggggcccctttccattttacatcaatctgcgcaaggctctcgatcacttgcatacactaatcttctcgcacaaagatcatgaagcttgacaccagtggccttgaatcgcctatgccgcactttggggcgggcagcgaaattcttgcggggatttcgactgcgcagtctgcacagtcttttgaggttcctgatgttactaattttgatgcattccaaaaggaggctacacagatgttgaagcatgccaaggggacaactactcttgcttttatctttaaggagggtgtcatggttgctgctgattctcgagctagcatgggcggctatatctcatcccagtcagtgaaaaaaatcattgaaatcaatccttacatgcttggtacgatggctggaggagccgctgactgtcagttttggcacagaaatctgggaattaagtgccgactgcatgaattggcaaacaagcggagaatttcagttacaggagcatccaagcttctggcaaacattctgtattcttatcgtggaatgggtttatctgttgggactatgattgccggatgggatgaaacgggacctggactatattacgtcgacagtgaaggaggaaggcttaaaggaatgcgattctctgttggatctggttctccatatgcttatggtgtacttgataatgggtatcgatatgacatgtcagttgaagaagctgcagagttggctagaagagccatttaccatgcaaccttccgagatggagctagtggtggagttgcaagcgtttatcatgtgggaccaaatggctggaagaagctatcaggtgatgatgttggagaactccactaccactactatccagtcacaccgagtacggtggagcaagaaatgactgaagttgctggggcatgagagttgctttgtttaaaccaggtttaagtccttcctcctttccttgtagccaattgaagagttgttttctttcccttttagattatgtattcattggaagatcttggtctctgtcaatgtgtgagaaccttactgctattatcttaagcccatggaattcaatgctacgaggcatttctgttt

SEQ ID NO: 2205 - DNA, 1200 bp, Euonymus alatus
tttttacatcaatctgcgcaaggctctcgatcacttgcatacactaatcttctcgcacaaagatcatgaagcttgacaccagtggccttgaatcgcctatgccgcactttggggcgggcagcgaaattcttgcggggatttcgactgcgcagtctgcacagtcttttgaggttcccgatgttactaattttgatgcattccaaaaggaggctacacagatgttgaagcatgccaaggggacaactactcttgcttttatctttaaggagggtgtcatggttgctgctgattctcgagctagcatgggcggctatatctcatcccagtcagtgaaaaaaatcattgaaatcaatccttacatgcttggtacgatggctggaggagctgctgactgtcagttttggcacagaaatctgggaattaagtgccgactgcatgaattggcaaacaagcgcagaatttcagttacaggagcatccaaacttctggcaaacattctgtattcttatcgtggaatgggtctatctgttgggactatgattgccggatgggatgaaacgggacctggactatattatgtagatagcgaaggaggaaggcttaaaggaatgcgattctctgttggatctggttctccatatgcttatggtgtacttgataacgggtatcattatgatatgtcggttgaagaagcggcagagttggctagaagagccatttaccatgcaaccttccgagatggagctagtggtggagttgcaagcgtttatcatgtaggaccaaatggctggaagaagctatcaggtgatgatgttggagaactccactaccattactatccagtcacacctagtacggtggaacaagaaatgactgaagttgccggggcatgaggggtttcggtaaatgtagaccaggtttaagaccttccttctttccttgtatccaatggaagagttgttttttcaaattatgtattatgtgcttattttggaaacagttcattgtagatgtgggtttggtaatgcgtgagaagtgagagccttactgctatcatgttaagcccatgaaattgaactttacgaggcatttctgtttttactgaaatttcaatatgcttgaccaagctctagtcttgagacacgtgatcaatttgtgtgcccttttgtgattgtgtgatatattatgcgaacacctatg

SEQ ID NO: 2206 - DNA, 1644 bp, Panax ginseng
acccaagtatattgttgatcaagaaaactttggtctgttatttccttaaaaaaaagattcaggagctttcagtacaacaatcttcttcctgaattatcttcccttttacgtttcatatattcaaaaggttattgtcatgaagatcgacttcagtggacttgaatcttctgcatcattttgtggggcaaatactgagttgtttgatggcttttcaactaccccatccttccagattcctgatacaactgattttgatggctttcagaaagatgctatccaaatggtgaaaccagcaaagggaacgactactcttgctttcatttttaaggagggtgtaatggtggcggctgattctcgtgctagcatgggaggctatatctcatcacagtcagtgaagaaaatcattgaaatcaatccccacatgcttggtactatggctggaggtgctgctgactgtcagttttggcacagaaatctgggcattaagtgtcgtttgcatgaactggcaaacaagagaagaatttcagttactggagcttcaaagttgcttgcaaacatcctatattcttaccgtggaatgggtttgtcggttgggacgatgattgcaggttgggatgaaaagggccctggcctgtattacgttgacagtgaaggaggacggcttaaaggaacccgattctctgttggatctggctcaccatatgcttatggtgtactggacagcgggtaccattatgacatgacaatagaagaggctgcagagttggctaggcgatccatttatcacgcaacatttcgtgatggagccagtggtggtactgctagtgtttattatgttggaccaaatggatggaagaagttatctggcgatgatgttggagaacttcattacaagtattatccggttgaaccagcagttgttgaacaggaaatggctgaagtatctggggcctgatatatcaaggaatcttttcaaaactgcatgtagcttattttgatcttaaaactattactgcacctggatataacttaagacctttgttctggtacgaacaacaatatgaacttgaatctttgtttggtatttatcctcaacattttaaacttatatctactctacctcgtatggtatgtcatgttgccctagattttccagctcaagtatctgatatctttcttgcaagtagagactcatttgttttggctccaccaaacatgaaacaaccctcggaagctactacacgcaaggttaataaagcactctcagttgcgggtgagcctattcatccccttcccaatagtcttctaaactgggggagtctatatgtattcataaacgtgcatgttaaagaatgaagtgggatgatgtgttactaataattaagtgggaaacttttggttgaattaatttgagtaatgaagcattagcatatactctttctgtaatggtctgtccgtcgatgctcctgctcctgctcctgctcctgctcctgctccttggtcatgagcaagttaatcaaaggaagacctcaactcttctttgagattaaatgctaagactttattttaacaatttgtttctcttttatctttcaccaaattttagaaaaataatatttaaattttatactaaatttaattaat

SEQ ID NO: 2207 - DNA, 1557 bp, Panax ginseng
ggtatcaacgcagagtacatggggatttcagtaaaaaaaagattcaggagctttcagtataacaatcttcttcctgaattatcttcccttttacgtttcatatattcaaaaggttattgtcatgaagatcgactttagtggacttgaatcttctgcatcattttgtggggcaaatactgagttgtttgatggcttttcaactaccccatccttccagattcccgatacaactgattttgatggctttcagaaagatgctatccaaatggtgaaaccagcaaagggaacgactactcttgctttcatttttaaggagggtgtaatggtggcggctgattctcgtgctagcatgggaggctatatctcatcacagtcggtgaagaaaatcattgaaattaatccccacatgcttggtactatggctggaggtgctgctgactgtcagttttggcacagaaatctgggcattaagtgtcgtttgcatgaactggcaaacaagagaagaatttcagttactggagcttcaaagttgcttgcaaacatcctatattcttaccgtggaatgggtttgtcggttgggacgatgattgcaggttgggatgaaaagggccctggcctgtattacgttgacagtgaaggaggacggcttaaaggaacccgattctctgttggatctggctcaccatatgcttatggtgtactggacagcgggtaccattatgacatgacaatagaagaggctgcagagttggctaggcgatccatttatcacgcaacatttcgtgatggagccagtggtggtactgctagtgtttattatgttggaccaaatggatggaagaagctatctggcgatgatgttggagaacttcattacaagtattatccagttgaaccagcagttgttgaacaggaaatggctgaagtatcaggggcctgatatatcaaggaatcttttcaaaactgcatgtagcttattttgatcttaaaactattactgcacctggatataacttaagacctttgttctggtacgaacaacaatatgaacttgtatttttaacttatatctactctacctcgtatggtatgtcatgttcccctagattttccagctcaagtatctgatatctttcttgcaagtagagactcatttgttttggctccaccaaacatgaaacaaccctcggaagctactacacgcaaggttaataaagcactctcagttgcgggtgagcctattcatccccttcccaatagtcttctaaactggggagtctatatgtattcataaacgtgcatgttaaagaatgaagtgggatgatgtgttactaataattaagtgggaaacttttggttgaattaatttgagtaatgaagcattagcatatactctttctgtaatggtctgtccgtcgatgctcctgctcctgctcctgctcctgctcctgctccttggtcatgagcaagttaatcaaaggaagacctcaactcttctttgagattaaatgctaagactttattttaacaatttgtttctcttttatctttcacaaa

SEQ ID NO: 2208 - DNA, 1063 bp, Ambrosia trifida
atattgttgttcaagaaatcactctcttcaaataaatatactcactctattgaatcaacacgatctgttctatacttgtcgattaaaaggtagaaatcatgaagcttgactttagtggcctagaatcaggtgcaccactctacgggggaaagaatgagttgctgtcggatgggttctcagcggccccttcatttgatcttccagtcacatcagattttgatgatttccaaaagaactccatccaaatggtaaagccagcaaaggggacaacaaccttggcttttatcttcaaggacggtgtgatggttgctgctgattcccgagctagcatgggaggctatatctcatctcaatctgtgaagaaaatcattgaaattaacccctatatgttgggtacaatggctggaggagctgcagattgccagttctggcacagaaatttaggtgttaagtgtcgtttgcatgaattggcaaacaagagaaggatttcagtgactggtgcttcaaagttgctggcaaatatattatattcttatcgtggaatgggtttgtctgttgggacaatgattgcaggatgggatgaaaagggtccaggtctgtattatgtagacagtgaaggagggcgcctgaaaggaacaaagttctccgttgggtctggttcaccctatgcttacggtgtactagatagcgggtacaaatatgatttgacaatcgatgaagctgctgaattggctagaagagccatttatcatgcaacattccgtgatggagctagtggcggtgttgctagcgtttatcatgtgggaccaaacggatggacaaagctatcgggtgatgatgttggtgaacttcactattcgtactatcctgttgaaccagccaccgttgagcacgaaatgacggaagctgtagctgcctgagttgaacggattgctgttgacaatttgtcagaaaaagaattggagcataatgtacttttgttatgattttacatgttcaaatgatgttaacttgtttttcttgtttatcaatagtcattcgtattgctccttcatctataaaa

SEQ ID NO: 2209 - DNA, 1008 bp, Helianthus annuus
cttttgtctgttaatcaaacgcattaacgatctgttctacacttctcgatcaaaaggtgaaaatcatgaagtttgactttagtggactagaatcaagtgcaccactctacgggttaaataacgagctgctgtctgatgggttctcagctgccccttcatttgatcttccggtcacatcagattttgatgatttccagaagaattctatccaaatggtaaagccagcaaaggggacaacaaccttggcttttatcttcaaggatggtgtgatggttgctgctgattcccgagctagcatgggaggctatatctcatctcaatctgtgaagaaaatcattgaaattaatccctatatgctgggtacaatggctggaggagctgcagattgccagttctggcacagaaatttaggtattaagtgtcgtttgcatgaattggcaaacaagagaagaatttcagtcaccggtgcttcaaaattgctggcaaatatattatattcttatcgtggaatgggtttgtctgtcgggacaatgattgcaggatgggatgaaaagggtccaggcctgtattatgtagacagtgaaggaggacgcctgaagggaacaaagttctcagttgggtctggttcaccttatgcttacggtgtactagatagcggatacaaatatgatttgacaattgatgaagctgctgaattggctagaagagccatttatcatgcaacgttccgtgatggagctagtggtggtgttgctagtgtttatcatgtgggcccaaacggatggacaaagctatcgggtgatgatgttggtgaacttcactattcatactatcctgttgaaccagccaccgttgagcacgaaatgacggaagctgtagttgcctgagtcgaacggattgctgttggtaatttgtcaaaaaaacattggagcatgatgtacttttgttatgattttacatgttcgaatgacattaacttgtttttttcttgtttatcgctagagtttg

SEQ ID NO: 2210 - DNA, 998 bp, Helianthus annuus
aatcaacgcattaacgatctgttctacacttctcgatcaaaaaaggtgaaaatcatgaagtttgactttagtggactagaatcaagtgcaccactctacgggttaaataacgagttgctgtctgatgggttctcagctgccccttcatttgatcttccggtcacatcagattttgatgatttccagaagaattctatccaaatggtaaagccagcaaaggggacaacaaccttggcttttatcttcaaggatggtgtgatggttgctgctgattcccgagctagcatgggaggctatatctcatctcaatctgtgaagaaaatcattgaaattaatccctatatgctgggtacaatggctggaggagctgcagattgccagttctggcacagaaatttaggtattaagtgtcgtttgcatgaattggcaaacaagagaagaatttcagtcaccggtgcttcaaaattgctggcaaatatattatattcttatcgtggaatgggtttgtctgtcgggacaatgattgcaggatgggatgaaaagggtccaggcctgtattatgtagacagtgaaggaggacgcctgaagggaacaaagttctcagttgggtctggttcaccttatgcttacggtgtactagatagcgggtacaaatatgatttgacaattgatgaagctgctgaattggctagaagagccatttatcatgcaacgttccgtgatggagctagtggtggtgttgctagtgtttatcacgtgggcccaaacggatggacaaagctatcaggtgatgatgttggtgaacttcactattcatactatcctgttgaaccagccaccgttgagcacgaaatgacggaagctgtagttgcctgagtcgaacggatagctgttggtaatttgtcaaaaaagcattggagcatgatgtacttttgttatgatttcacatgttcgaatgacattaacttgtttttttcttgtttatcactagagtttgc

SEQ ID NO: 2211 - DNA, 939 bp, Centaurea maculosa
gaaatcatgaaactcgactttaaaggactagaatcaagtaccccactctatggggaaagtaatgggatgcttttcgatgggttttcagctgccgcttcgttcgaggttcctgttacatcagattttgatgaatatcagaagaaatctgtccaaatggtaaagccagcaaagggaacaacgaccctggcttttatctttaaggatggtgtaatggtagccgcggattcccgagctagcatgggaggctatatctcgtctcaatccgtgaagaagattattgaaatcaatccttatatgctgggtacgatggctggaggagctgctgattgccagttctggcacagaaatctaggtattaagtgccggttgcatgaacttgcaaacaaaagaagaatatcagttactggggcttcaaagctgttggcaaacattctttattcttatcgtggaatgggtttgtctgttgggacaatgattgcaggatgggatgaaaagggccctggcctgtactatgtggacagtgaaggagggcgactgaagggtactaaattttctgttggatctggctcaccgtatgcctatggtgtattagatagcgggtaccattatgatatgacaatcgatgaagctgctgagttggctagaagatccatctatcatgcaacattccgtgatggagcaagtggtggtgttgctagcgtctatcacgtgggcccaaatggatggaccaagctatcaggcgacgacgttggagaacttcactactcgtattatccagtcgaaccaactgttgtggaacaagaaatggccgaagctgtagttgcctgagtgcaaaaaaatattcttctgcacctttgtctatttgtttttctatgcgtttagtgttgaacatttctgcgtacattttattctacctctgtgtaggatatattgggttcg

SEQ ID NO: 2212 - DNA, 909 bp, Flaveria ramosissima
tattgaatcaacgtatcaccgatctgttttgttcttcccgatcacaaggtggaaatcatgaagcttgactttagtggactggaatcgggtgcaccgctctgcggggaaaataatgagttgctatctgacgggttctcagctgccccttcatttgacctcccagttacatcagattttgatgaattccagaagaattctatccaaatggtaaagccagcaaaggggacaacaaccttggcttttatttttaaggagggtgtgatggttgctgctgattcccgagctagcatgggaggatatatctcatctcaatctgtgaagaaaatcattgaaattaatccatatatgctgggtacaatggctggaggagctgcagattgccagttctggcacagaaatctaggcattaagtgtcgtttgcatgaattggcaaacaagagaaggatttcagtgactggggcttcaaaattgctggcaaatatattatattcatatcgtggaatgggtttgtccgttgggacaatgattgcaggatgggatgaaaagggtccaggtctttattatgtagacagcgaaggaggacgcctgaagggaacaaagttctcagttgggtctggttcaccgtatgcttatggtgtactagatagcgggtataaatatgacatgactatcgatgaagctgctgaattggctagaagagcaatttatcatgcaacatttcgtgatggagctagtggtggtgttgctagcgtttatcatgtgggcccaaccggatggacaaagctatcgggcgatgatgtggtgaacttcactactcatactatcctgttgagcccgccgtcgttgaacaggaaatgacggagctgcagctgcctgaatccaacgggttgcttggtagtttgatataaa

SEQ ID NO: 2213 - DNA, 988 bp, Gerbera hybrid cultivar
cttgtttctccctctcgatttagaaaggttgaaatcatgaagcttgactttagtggactggaatcgagtgcaccactctatgggggaagtaatgagttgctttttgatgggttttcgaatgccctttcatttgaggttccagttacatcagattttgatggattccaaaagaatgctatccaaatggtgaagccagcaaagggaacgacgaccctagcttttatttttaaggagggtgtgatggtagctgcagattctcgagctagcatgggaggctatatctcgtctcaatccgtgaagaaaatcattgaaattaatccctatatgcttggtacaatggctggaggagctgctgattgccagttctggcacagaaatctaggcattaagtgtcgtttgcatgaactggcaaacaagagaaggatttcagtgactggcgcttcaaagatgctggcaaacattctttattcttatcgtggaatgggtttgtccgtcggaacaatgattgcaggatgggatgaaaagggccctggtctgtattatgtggacagcgaaggaggacggctcaagggaacaaaattctccgtggatctggttccccatatgcctatggtgtattagatagtgggtaccgctatgatatgacaattgatgaagctgctgaattggctagaagatccatctatcatgcagctttccgtgatggtgctagtggtggtgttgctagcgtttatcacgtgggacccactggatggacgaagctatcgggagatgatgttggtgaactccactactcatactatcccgttgaaccagccgttgtcgaacaggaaatgactgaagctgtagttgcctgagtggagtgctggtaatttggtataaactgtattttgttatgatttttagaacttcaaatgacacttttgttggcttgggactatagatttaatattctcatgtttccttcatctcagtatttatgcgtttg

SEQ ID NO: 2214 - DNA, 1128 bp, Vinca minor
aactctctactggaataagaagtaacaatgatgaatattgactttagtgggcttgagtcgagggcttcaatggttcctggtaacgcgaatgaattgttcaatggctttccgcagctcctgaattccagattccgaacactgataactttgatggcttccagaaagaagcaatccagatggtcaaaccagctaagggaacgacaactttggccttcatattcaaggaaggcgtcatagttgctgctgattctcgtgctagcatgggaggatatatatcatcacaatctgtcaagaaaatcattgaaatcaatccctacatgcttggcacaatggctggaggtgctgctgactgccagttttggcacagaaatttggggattaagtgccgtctgcatgagcttgcaaacaaaagaagaatttctgttactggagcttcaaagttgctagcgaacattctatattcttatcgtggtatgggattgtccgtgggaacaatgattgctggatgggatgaaaagggtcctggcctatactatgtcgacagtgaaggggggcggcttaaaggaaaccgattctcagttggatctggttcaccatatgcttatggtgttctggatagcgggtataagtttgatatgtctgttgaggaagctgtggagttggctagacgctctatttaccatgctacttttagagatggtgctagtggcggtgttgtcagtgtttatcacgtaggacctaacgggtggacaaagatgtctggtgatgatgttggcgaacttcattatcattactatccagttgacccaacaatggtggagcaggaaatggctgaggcatcaacttcttaaaatagggtatctgaggaatgctgcttgaactttaattttttcgaaatttgcaatcctggacaattcttgaatatgtatggtaatcttgtaatcgttttaaagatttaattcgggtccatgaattattttaactttgattgtttctcctttgtctcctatcgtatccaaggccttttacgtctcatgtgggtattttgatggaaactttattatttagaaatatgctgaactaggtttaaccttccatgttctgtatgataacttggcatatttgtgt

SEQ ID NO: 2215 - DNA, 1093 bp, Chenopodium quinoa
ccttcgttaacaagtactagtattatttcattactttttcgcaaaacctccccaaattttctctttctctctcctaacactcactccgatctgcaatttctaggataacgatatgaagcttgacacaagtggtcttgaatcaactgctccgcttttccggagaagtgatgcagtatttgatggcttgcaaatgaccccttcattcgatctccctaatcctaccgattttgatggatttcagaaagaggccgtacagatggtgaagcctgctaaggggactacaactcttgcttttatcttcaaacatggtgtcatggttgctgctgattcccgagctagcatgggaggatacatatcatctcaatctgtgaagaaaattattgaaattaatccttatatgcttggcaccatggctggtggagctgctgactgccaattttggcatcgcaacttgggaattaagtgccggttacatgaacttgcaaacaaacgaagaatttctgttacaggagcttcaaaattgctagcaaacattctgtataactacagaggcatgggtctctctgttggcacaatgattgctgggtgggatgaaacggggcctggtctatactatgtggacagtgaaggtggaaggctcaaaggaatgcggttctctgttggatctggttccccatatgcttatggtgtgcttgacaatgggtatcgatatgatatgacagttgaagaagcatctgagctagctagaagagctatttaccatgctacataccgtgacggagctagtggtggagttgtcagtgtttatcatgtcggacctgatggatggaagaagctaaccggggacgatgttggggaactccactatcaatataaccctgttgtgcctgccacagtagagcaggaaatggttgaagtagttggagcttaaaagtgaggtggaaggcggcctattttctagttgcagctgaagtggagaatgtcttgatgcttttaaatcgggtggatcatccctcatgaggtgattctctgcaatatcctaatgatttcctgtgttcatatgaaccgaatcagttgtgttattgtactaata

SEQ ID NO: 2216 - DNA, 1020 bp, Triphysaria pusilla
gtttttcaacatttgcaattgttcttcccaaaatctgcagaaaccaggacacgatgatgaaaattgattttagtgggcttgacccggtagcaccaataagaggaaacagagatgatgatttgactgatgagatttcggaaataccgtctttcaagcttcctaatcatgttgatttcgatgggtttcagaaagcttctgtacagatggtgaagcctgcaaagggaacgactactttggcatttatattcaaaggtggtgtaatggtggctgctgattcacgagcgagcatgggaggatatatatcttcacaatctgtgaagaaaatcattgaaattaatccttacatgcttggtacgatggccggaggagctgctgactgccagttctggcacagaaatctcggaattaagtgccgtttgcatgaactggcaaacaagagaagaatttctgttgctggagcctcaaagatgttggctaacattctgtattcttaccgaggaatgggtttgtctgttggcactatgattgctggctgggatgaacagggtcctggtctgtattacgtggacagtgaaggtggacgacttaaaggcacgagattttccgttgggtctggttcaccatatgcttatggtgttttggacagtggataccgttttgatatgtcggtcgaggaagctgctgagctggctagacgatcaatctatcatgcaacattccgtgatggagccagtggtggtgttgctagcgtgtatcatgtggggccagtcgggtggaaaaagctatcaggggatgacgttggagaacttcactatcattactatcctgttgaagctgcaatagtcgaacaagagatgagtgaggtcactattgcttgagaatgctaaattaggatgttatcgtttcgtttgcttcggattgtatgatgatatttgcttcggtttgtaactttttaattcgaattaatcaactttcttccaaccaatttcactatctattatctttctacgaaaaaaaaaa

SEQ ID NO: 2217 - DNA, 1036 bp, Persea americana
gcagcttgagagagagagagagagagagagagcgagaggaaagctcttaccagatcttcaaagttcgtagcttggtgtatcttacttaatctacaaggatgaaacttgatactagcggtcttgaatcatttgcatctttccgtggcggaagtgaaattcttagtagtgacttctctcaagtaccatcatttgagctccccagaagtgctgattttgatgagtttcagaaaaaagcagtgcagatggtgaagcctgctaaagggacaacaactcttgctttcatttttaaggaaggagtcatagttgctgctgattctcgagcaagcatgggaggatatatttcatctcagtcggtgaagaaaataattgaaatcaacccttacatgattggtactatggctggaggtgctgctgactgccagttttggcatagaaatttgggcattaagtgccgtctgcatgagctagcaaataagcgaagaatatcagttacaggtgcttcaaaactactagctaatattttgtactcgtaccgtgggatgggtctatcagttggaaccatgattggtggatgggatgaaacggggccaggtttgtattatgtagacagtgaaggtggaaggcttaagggaacgcgattctctgttggatctggatctccatatgcttacggtgtgctggataatgggtatcgctatgacatgtcaattgaagaagctgctgaattggctagaagatctatttatcatgcgacttttcgcgatggagctagtggtggagttgttagcgtttattacgttggacccgatggttggaagaagctttctggggatgatgttggagaacttcactacaaatactacccagttgttccaagctctgttgaacaagaaatggctgaggtggcagcaacctgagaggtttgattatcgatgggcccgtgttcctcttttctttgcttttcccttttaacaattgaaggcaaaattggtcacaaactctcttataatgtaccagagtgattatagactgactt

SEQ ID NO: 2218 - DNA, 1056 bp, Eschscholzia californica
ccccaccatttcatttctgtgaacattccaaatctctcgtctctttgctccaaactaaaggtgtgtaagcatgaaacttgatagtgggcttgaaaattcttctactattctccttggaggaagcaacgcattcggcacagatttttctgctcccccgtcgtttgaacttcccattacccatgatttcgatgattatcagaaaaagtcagtacagatggtcaagcctgcaaaagggacgaccacacttgctttcatttttaaggaaggagtcatggttgcagctgattctcgagctagcatgggaggatatatctcatcacaatctgtgaagaaaatcattgagattaatccttacatgcttggtacaatggctggaggagctgcagattgtcagttttggcatagaaatttgggcgttaagtgtcggttgcatgagttggcaaacaaaagaaggatttctgtaacaggagcgtcaaaacttctggctaacattctttactcatatcgcggaatgggtctttcagttggtaccatgattgcaggatgggatgaaaagggtcctggactatactatgtagacagtgaaggaggaaggctcaaaggaatgaaattttctgtcggatctggttctccatatgcttatggtgttcttgataacgggtaccggtatgacatgtcagttgaagaagcggcagagcttgcccgcagagctatataccatgcaacatttcgtgatgcagctagtggtggagtcgctagcgtttatcacgttggacccaatggatggacgaagatgtctggagacgatgtcggcgagcttcactataagtactacccagttgtcccgactactgttgaacaggaaatggctgaagttccagctgcttgagttcatttagatgatcttgccatgtcaaaatctgtttcgttattgtaatgattcattcacactgatcaggaactctacacatgaatctgttggatatgtgtaattcaattttctaggactattgtctattttggtctttggttaaaagtagaaccatctttttcacc

SEQ ID NO: 2219 - DNA, 1089 bp, Solanum tuberosum
ctccggcgaattccttacgatctatttctccggcgatttataaatcctaaaggttgtaaatgatgaagatcgattttagtggacttgaaccaagggccccacttcgaggggagtcttctgagctgtttgatggaatttcgaattctccatcattccatcttcctaatactgctaattttgatggttttcaaaaagaagcaatccaaatggtgaagcccgcaaagggaaccacaacccttgctttcatttttaaaggaggtgtcatggttgctgctgattctcgggctagcatgggaggatatatatcatctcaatctgtgaagaaaatcattgaaattaatccctatatgcttggcacaatggctggtggggctgctgactgccaattctggcatagaaacctgggaatcaagtgccgtcttcatgaactggcaaacaaaaggagaatttcagttactggagcttcaaagctgctggcaaacattttatattcttaccgtggaatgggtttgtctgttggaaccatgattgctggttgggatgagaagggtccaggactatactacgtggatagtgagggaggacggcttaaaggaaacagattctctgttggatctggttctccttatgcttatggtgttttggataatgggtaccgatatgatctgtctgtggaagaagcagccgagttggctagacgagcaatttatcatgctacattccgtgatggagctagtggaggtgttgctagtgtttatcatgtcggaccaaatggatggaagaagctatcaggtgacgatgttggagaactccactaccactactatcccgtcgaagtggcagctgtggagcaggaaatggctgaagttccagtggcctaaggaaaaacaaaaccaagatcaaatatgtgctcatcttcgcaagttaaagcgactgtttaattttcttctgagactattttgtggtcttgcaatctgtaaaaccgtaaaaacttatctacaccatatgtttaaactttaaaccgagccaatagatgcaaggctatgtgtgttccattcatcacttaagtgtgtttggtatggacaaaat

SEQ ID NO: 2220 - DNA, 1021 bp, Salvia sclarea
ctactagaccttggctgtcactcagataacattttctggaaactatttcactgcatcggcgactcgattttccttccagaatcaagggaacaatgatgaagattgattttagtgggcttgatcccgccatgccggttaaggcaaatggggatgatttggatgacgagattttggccgcaccatcgtttaaacttcctgtcactgttgattttgatgggtttcagaaagctgcagtacagatggtgaagccagccaagggaacaacaactctggctttcatattcaaagacggtgtcatggttgctgctgattcccgtgctagcatgggaggatatatttcatcacaatctgtcaagaaaatcattgaaatcaacccctacatgcttggtacaatggctggtggagctgctgactgccagttctggcacagaaatctcggaattaagtgtcgtttacatgaattggcaaataagagaagaatttctgttgctggagcttcaaaattgttggcaaacatcctgtattcttatcgaggaatgggtttgtcagttggaactatgatagctggctgggatgaacagggccctggtctctattatgttgatagtgaaggtggtcggcttaaaggcaccagattctcggttgggtctggttctccatatgcttatggtgttttggacagtggataccgctttgatttgtctgttgaggaggctgcagagctagctagaagagcaatctatcacgctacattccgtgatggagccagtggtggtgttgctagcgtataccatgttggtcccagtggatggaagaagctttctggtgatgatgttggagagctgcactattcatactatcctgttgaacccaccacggtggagcaggagatggcagaagtagcaattgcatgagggacatgactttagctgccattcttcattttcttctgtaattgtttgtgtttacttagtatactcttcaaaaactctgcatatgaaaaacctaaatacctaaatca

SEQ ID NO: 2221 - DNA, 1176 bp, Silene vulgaris
gcagcatcacacaaacacactctctctctaactttttcgcttcgaaatctacattccaaggttaacaagatgaagcttgacacaagtggtcttgaatcaactgctccactggttggagccagacatgttattatggatggcctgcagatgactccttcatttgaccttccaaacacttctaactttgatggatttcaaaaagaggctatacagatggtgaagccagcaaaggggactacaactcttgcttttattttcaaagaaggtgtcatcgttgctgctgattcacgagccagcatgggaggatacatatcatctcaatctgtcaagaagattattgagatcaatccttacatgcttggcacgatggctggtggtgctgctgactgccagttttggcatcgtaatttgggcatcaagtgccggctgcatgaactagcgaacaagcgaagaatttctgtcaccggtgcttcaaaattgctggcaaatatcctgtatagctacagaggcatgggcctctctgtgggtacaatgattgctggatgggatgaaacggggcctggtctatactatgtggacagtgaggggggaaggctcaaagggatgcgattctctgttggatctggttcaccttatgcttatggtgtgcttgacaatgggtatcggttcgatatgtcaattaaggaagcggctgagttagcaagacgatctatctatcatgctacattccgtgatgcagctagtggtggagttgctagcgtttactatgttggacctaatggatgggagaaactctccggtgatgatgttggtgaacttcactttgaatattacccagttgtgccagctaccgtggagcacgaaatggttgaagttggtgcagcttaagagtaaagtgccgaagatgcacatcaagtaccaatgaattggatcgattaatgttggtttcgcttgacagatatagcacctttgatgttcatgtacttgaaacttgatgtattattgtacccagttgtgccagctacccttttttttcatgtttgtttttcttcggaatgaaaaactcgaggactgtgttacttttttatgctttcacgcagtgttagtctagctctgttactaatcacgggattcaatcccttaagttgaaaaccggagtgattaagtaccttaact

SEQ ID NO: 2222 - DNA, 1120 bp, Solanum phureja
aaaattgcttttcaatttttctccggcgaattccttacgatctatttctccggcgatttataaatcctaaaggttgtaaatgatgaagatcgattttagtggacttgaaccaagggccccacttcgaggggagtcttctgagctgtttgatggaatttcgaattctccatcattccatcttcctaatactgctaattttgatggttttcaaaaagaagcaatccaaatggtgaagcccgcaaagggaaccacaacccttgctttcatttttaaaggaggtgtcatggttgctgctgattctcgggctagcatgggaggatatatatcatctcaatctgtgaagaaaatcattgaaattaatccctatatgcttggcacaatggctggtggggctgctgactgccaattctggcatagaaacctgggaatcaagtgccgtcttcatgaactggcaaacaaaaggagaatttcagttactggagcttcaaagctgctggcaaacattttatattcttaccgtggaatgggtttgtctgttggaaccatgattgctggttgggatgagaagggtccaggactatactatgtggatagtgagggaggacggcttaaaggaaacagattctctgttggatctggttctccttatgcttatggtgttttggataatgggtaccgatatgatctgtctgtggaagaagcagccgagttggctagacgagcaatttatcatgctacattccgtgatggagctagtggaggtgttgctagtgtttatcatgtcggaccaaatggatggaagaagctatcaggtgacgatgttggagaactccactaccactactatcccgtcgaagtggcagctgtggagcaggaaatggctgaagttccagtggcctaaggaaaaacaaaaccaagatcaaatatgtgctcatcttcgcaagttaaagcgactgtttaattttcttctgagactattttgtggtcttgcaatctgtaaaaccgtaaaaacttatctacaccatatgtttaaactttaaaccgagccaatagatgcaaggctatgtgtgttccattcatcacttaagtgtgtttggtatggacaaaatgttttccaatt

SEQ ID NO: 2223 - DNA, 1168 bp, Triphysaria pusilla
tttcagcattcgcaattgttcttcacaaaatctgcagaaaccaggacacgatgatgaaaattgatttcagtgggcttgacccggtagcaccgataagaggaaacagagatgatgatttgactgatgagatttcggaaataccgtctttcaagcttcctaatcatgttgatttcgatgggtttcagaaagcttctgtacagatggtgaagcctgcaaagggaacgacgactttggcatttatattcaaaggtggtgtaatggtggctgctgattcacgagcgagcatgggaggatatatatcttcacaatctgtgaagaaaatcattgaaattaatccttacatgcttggtacgatggccggaggagctgctgactgccagttctggcacagaaatctcggaattaagtgccgtttgcatgaattggcaaacaagagaagaatttctgttgctggagcctcaaagatgttggctaacattctgtattcttaccgaggaatgggtttgtctgttggcactatgattgctggctgggatgaacagggtcctggtctgtattacgtggacagtgaaggtggacgacttaaaggcaccagattctccgtcgggtctggttcaccatatgcttatggtgttttggacagtggataccgttttgatatgtcggtcgaggaagctgctgagctggctagacgatcaatctatcatgcaacattccgtgatggagccagtggtggtgttgctagcgtgtatcacgtggggccagtcgggtggaagaagctatcaggtgatgacgttggagaacttcactatcattactatcctgttgaagctgcaatcgtcgaacaagagatgagtgaggtcactattgcttgagaatgctaaattaggatgttatcgtttcgtttgcttcggattgtatgatgatatttgcttcggtttgtaacattttaattcgaattaaacaactttcttccaaccaatttcactatctatgatctttctctatatttatttcgtacatgatgaaagggttgggatagaataatgcaaaaatctggatgcctttgcttcatagccaattcaagattgtatattcactaaatgtggataacagggcccattgaaatcaatttggagatcaattggaaattatctttgcttattct

SEQ ID NO: 2224 - DNA, 1185 bp, Triphysaria pusilla
agcattcgcaattgttcttcacaaaatctgcagaaaccaggacacgatgatgaaaattgatttcagtgggcttgacccggtagcaccgataagaggaaacagagatgatgatttgactgatgagatttcggaaataccgtctttcaagcttcctaatcatgttgatttcgatgggtttcagaaagcttctgtacagatggtgaagcctgcaaagggaacgacgactttggcatttatattcaaaggtggtgtcatggtggctgctgattcacgtgcgagcatgggaggatatatatcttcacaatctgtgaagaagatcattgaaataaatccttacatgcttggtacgatggccggaggagctgctgactgccagttctggcacagaaatctcggaattaagtgccgtttgcatgaattggcaaacaagagaagaatttctgttgctggagcctcaaagatgttggctaacattctgtattcttaccgaggaatgggtttgtctgttggcactatgattgctggctgggatgaacagggtcctggtctatattacgtggacagtgaaggtggacgacttaaaggcaccagattctccgtcgggtctggttcaccgtatgcttatggtgttttggacagtggataccgttttgatatgtcggtcgaagaagctgctgagctggctagacgatcaatctatcatgcaacattccgtgatggagccagtggtggtgttgctagcgtgtatcacgtggggccagtcgggtggaagaagctatcaggtgatgacgttggagaacttcactatcattactatcctgttgaagctgcaatcgtcgaacaagagatgtctgaggtcactattgcttgagaatgctaaattaggatgtttcgtttcgtttgcttcggattgtatgatgatatttgcttcggtttgtaacattttaattcgaattaaacaactttcttccaaccaaattcactatctatgatctttctctatatttatttcgtacatgatgaaagggttgggatagaataatgcaaaaatctggatgcctttgcttcatagccaattcaagattgtatattcactaaatgtggataacagggcccattgaaatcaatttggagatcaattggaaattatctttgcttattctaaagtttaaaaaaaaaaaaaaa

SEQ ID NO: 2225 - DNA, 1014 bp, Euonymus alatus
cgccacaagaaaacgtcttcatattcaattttttttcttttctcaagtcactcccttccagttttcatcaatctgagcaaagctatcgatcactctcatacactaatcatctagatcatgaagcttgacaccagcggccttgaatcgcctatgcagcactttggggcgggcaatggaattcttgaggggatttcgactgcacagtctgcagagtcttttgaggttcccgatgttacgaattttgatgcgttccaaaaggagactacacagatgttgaagcatgccaaggggacaactactcttgcttttatttttaaagagggtgtcatggttgctgctgattctcgagctagcatgggcggctatatctcatcccagtcagtgaaaaaaatcattgaaatcaatccttacatgcttggtacgatggctggaggagccgctgactgtcagttttggcacagaaatctgggaattaagtgccgactgcatgaattggcaaacaagcggagaatttcagttacaggagcatccaagcttctggcaaacattctgtattcttatcgtggaatgggtttatctgttgggactatgattgctggatgggatgaaacgggacctggactatattacgtcgacagtgaaggaggaaggcttaaaggaatgcgattctctgttggatctggttctccatatgcttatggtgtacttgataatgggtatcgatatgacatgtcagttgaagaagctgcagagttggctagaagagccatttaccatgcaaccttccgagatggagctagtggtggagttgcaagcgtttatcatgtgggaccaaatggctggaagaagctatcaggtgatgacgttggagaactccactaccactactatccagtcacaccgagtacggtggagcaagaaatgactgaagttgctggggcatgagggttttgcttagtttaaaccaggtttaagaccttccctcctttccttgtagccaattgaagagttgtt

SEQ ID NO: 2226 - DNA, 1884 bp, Cirsium arvense
agaaaaaggttgaaatcatgaaactcgactttaaaggactagaatcaaatgccccactctatggggaaagtaatgggatgctttttgatgggttttcagctgccgcttcgttcgaggttcctgttacgtcagattttgatgaatatcagaagaaatctgtccaaatggtaaagccagcaaagggaacaacgaccctggcttttatctttaaggatggtgtaatggtagccgcggattcccgagctagcatgggaggctatatctcgtctcaatccgtgaagaagattattgaaatcaatccttatatgctgggtacgatggctggaggagctgctgattgccagttctggcacagaaatctaggtattaagtgccggttgcatgaacttgcaaacaaaagaagaatatcagttactggggcttcaaagctgttggcaaacattctttattcttatcgtggaatgggtttgtctgttgggacaatgattgcgggatgggatgaaaagggccctggcctgtactatgtggacagtgaaggagggcgactgaagggtactaaattttctgttggatctggctcaccgtatgcctatggtgtattagatagcgggtaccattatgatatgacaatcgatgaagccgctgagttggctagaagatccatctatcatgcaacattccgtgatggagcaagtggtggtgttgctagtgtctatcacgtgggcccaaatggatggaccaagctatcaggcgacgacgttggagaacttcactactcgtattatccagtcgaaccaactgttgtggaacaagaaatggccgaagctgtagttgcctgagtgcaaaaaaatattcttctgcacctttgtctatttgtttttttaatgcgtgctaagttgaacatttctgcgtacattttattctacctctgtgtaggataattgggttcgttcggtttggttttttaattattctaagttatcccttttgagccaaaaagaaaaagtaccgactgcgacggcactataaggccccctgaagccccagcagcggccaatagaatttcataggcggtttcacggagatcatcatcagttatacctgatgcaaatggaggcaaaccgacgacaaggtcagaagtatcattcatcgttctccttgaatacctaagactgttgatttcctctaaatcatcttcatcctcgaaatcctcaatgtcatcaacggttaactcctgagcttgcccagtattagactgagattttgaaataatagcgggttcatcctcttctgttgcctcaaagggcaatgatgcgtttggcataatgggtgatggtgccacaaaaggtacggctggcggggccctccttggaggtgaacctgatgaatcaggattggtagccaaaaaaaactcaccttcagaccctgcattcatatgagggtatccagtgctatcatgataatctctaatagcatctgagagctcaagcatgtcaccttttttgacagaattgaggacaaaatcaacactaacttgatccagatccacatcatccaatgaaacagcaccaggtggcattacaactttcttaatcaaagtaccagatagcaagtaattaagaagtatccgcctatctcgcctgtacctctgtaaaagctccacttcattttcctcttccatggtggattcagaaggtggatagttgatgagttagtagcagggcatttagatgaagaaagaagttgaatttgaggaaaaaagagagatctgtggcaggttaaacttcaaaatcgaaaatgtagggcgacttctttgaactctatggatcccccttgataactttgaaagagtgagaatggaccgagcaactgtgtgtgtccccg

SEQ ID NO: 2227 - DNA, 1000 bp, Triphysaria pusilla
aatttttctccgattagttttcaacttttgcaattgttcttctcaaaatctgcagaaaccaggacacgatgatgaaacttgattttagtgggcttgacccggtagcaccaataagaggaaacagagatgatgaattgactgatgagatttcggatataccatctttcaagcttcctagtcatgttgatttcgatgggtttcagaaagcttctgtacagatggtgaagcctgcaaagggaacgacgactttggcatttatattcaaaggtggtgtgatggtggctgctgattcccgtgcgagcatgggaggatatatatcatcgcaatctgtgaagaaaataattgaaatcaatccatacatgcttggtaccatggccggaggagctgctgactgccagttctggcacagaaatctcggaattaagtgccgtttgcatgaattggcaaacaagagaagaatttctgttgccggagcttcaaagatgttggctaacattctctattcttaccgcggaatgggtttatccgttggcactatgattgctggctgggatgaacagggccctggtctctattatgttgatagtgaaggtggccgacttaaaggcaccagattctcagttggctctggttcaccatatgcttatggtgttttggacagtggataccgtttcgatatgtcggttgaggaagctgctgagctggctagacgatcaatttatcatgcaacattccgtgatgagccagtggtggtgttgctagcgtgtatcacgtggggccagtcgggtggaaaaagctatcaggtgatgacgttggagaacttcactatcattactatcctgttgaagctgcaatcgtcgaacaagagatgagtgaggtcactattgcttgagaatgctaaattaggatgttatcgtttcgtttgcttcggattgtatgatgatatttgcttcagtttgtaacattttaattcgaatttatcaactttcttccaaccata

SEQ ID NO: 2228 - DNA, 985 bp, Chenopodium quinoa
tactttttcgcaaaacctccccaatttctctctttctctctcctaacagtcactccgatctgcaatttctaggataacaatatgaagcttgacacaagtggtcttgaatcaactgctccgcttttccggagaagtgatgctgtatttgatggcttgcaaatgaccccttcatttgatctcccgaatcctaccaattttgatggatttcagaaagaggccgtacagatggtgaagcctgccaaggggactacaactcttgcttttattttcaagcatggtgtcatggttgctgctgattcccgagctagcatgggaggatacatatcatctcaatctgtgaagaaaattattgaaattaatccttatatgcttggcaccatggctggtggagctgctgactgccaattttggcatcgcaacttgggaatcaagtgccggttacatgaacttgcaaacaaacgaagaatttctgttacaggagcttcaaaattgctagcaaacattttgtataactaccgaggaatgggtctctctgttggcacaatgattgctgggtgggatgaaacggggcctggtctatactatgtggacagtgaaggtggaaggctcaaaggaatgcggttctctgttggatctggttccccatatgcttatggtgtgcttgacaatgggtatcgatatgatatgacagttgaagaagcatccgagctagctagaagagctatttaccatgctacataccgtgacggagctagtggtggagttgttagtgtttatcatgtcggacctgatggatggaagaagctaaccggggacgatgttggggaactccactatcaatataaccctgttgtgcctgccaccatagagcaggaaatggttgaagtaattggagcttaaaagtgaggtggaaggcggtctatttttaagttgcagctgaagtggagaatgtcttaatgcttttaaatcgggtggatcatccctc

SEQ ID NO: 2229 - DNA, 1002 bp, Triphysaria pusilla
tttctccgacgagctttcaacattggcaattgttcttcccaaaatctgcagaaatcaggacacgatgatgaaaattgatttcagtgggcttgacccggtggcaccaataagaggaaacagagatgatgaattgactgatgagatttcggaaataccgtctttcaagcttcctaatcatgttgatttcgatgggtttcagaaagcttctgtacagatggtgaagcctgcgaagggtacgacgactttggcatttatattcaaaggtggtgtaatggtggctgctgattcacgagcgagcatgggaggatatatatcttcacaatctgtgaagaaaatcattgaaattaatccttacatgcttggtacgatggccggaggagctgctgactgccagttctggcacagaaatctcggaattaagtgccgtttgcatgaactggcaaacaagagaagaatttctgttgctggagcctcaaagatgttggctaacattctgtattcttaccgaggaatgggtttgtctgttggcactatgattgctggctgggatgaacagggtcctggtctatattacgtggacagtgaaggtggacgacttaaaggcaccagattctccgttgggtctggttcaccatatgcttatggtgttttggacagtggataccgttttgatatgtcggtcgaagaagctgctgagctggctagacgatcaatctatcatgcaacattccgtgatggagccagtggtggtgttgctagcgtgtatcacgtggggccagtcgggtggaagaagctatcaggtgatgacgttggagaacttcactatcattactatcctgttgaagctgcaatagtcgaacaagagatgagtgaggtcactactacttgagaatgctaaattaggacttatcgtttcatttgcttcggattgtatgatgatatttgcttcagtttgtaaaattttaattcgaattaaacaactttcttccaaccaatttcact

SEQ ID NO: 2230 - DNA, 696 bp, Brassica juncea
gaagcagtacagatggtgaagcctgcaaaaggaacaaccacgctcgcttttatcttcaaagagggtgtcatggtcgctgctgattctcgtgctagcatgggtggatatatctcgtcacaatctgtgaagaagattattgaaatcaatccttatatgcttggtacaatggctggaggagctgctgactgtcaattttggcaccgaaaccttggaattaagtgccgtctacatgagctggcaaacaagaggagaatctctgtttccggagcttcaaagcttctcgcaaacatgctctactcataccgtggaatgggactttccgtcggcacgatgattgctggatgggacgaaactggtcctggactatactacgtggacaacgaaggaggaaggctcaagggggacaggttttcagtgggttccggttcaccatacgcttatggtgtactagacagcgggtacaaattcgatatgtcagttgaagaagcttccgagctagcaaggagatcaatctaccatgcgacattccgtgatggagccagtggtggagttgctagcgtgtaccacgtgggtcctaatggatggaagaaactgtcaggagatgatgttggggagctacactatcactactaccccgtgccaccggccattgcggaacaagtcatggaggaggcagccgccgagtaaaactaagat

SEQ ID NO: 2231 - DNA, 1095 bp, Chelidonium majus
ggcttcaaatctgtgaaaccatcaatttctctctcgttccgaactgaggtttataatcatgaagcttgatagtggtcttgagaattcttctaccatccttcttggaggaagcaatgagcttgacactgatttttcagcacccccgtcgtttgagctcccaattactactaattttgatgactttcagaaaaaatccgtacaaatggtgaaaccagcgagagggacaaccacacttgctttcatttttaaggatggagtcatggttgctgccgactctcgagctagcatgggaggatatatttcatcacaatctgttaagaaaatcattgaaattaatccgtacatgcttggcacaatggctggaggggctgcagactgtcagttctggcataggaatttgggcgttaagtgccggttgcatgagttggcaaacaagagaaggatttctgttacaggagcatcaaagcttctggcgaacattctctactcatatcgtgggatgggtctatctgttggtaccatgattgcaggatgggatgaaaagggtcctggactatattatgtagacagcgaaggaggacggctgaagggaacaagattctctgttggatccggttcaccatatgcttatggtgtattggataatgggtaccgctatgacatgtcagttgaggaagctgcagaactagctcgcagggctatctaccatgcaacattccgtgatgcagctagtggtggagttgctagcgtttatcatgttggacctaatggatggaagaaactatctggagatgatgttggtgaactccactacaagtattacccagttgtcccaagcacagttgaacaggaaatgactgaggtgccaattgcttgagtgactttaggattgcctggtcaaaatcttagctctcggtttgggatgttttctgtatgatatggattcacctattttctggaactcataaacacatggatatgggtggatctatgaaaacaattgcaattacaagacaggctttggcttggttaagatagaatgatgctgttttgaaccttatatcatgtttttaccttctatcaaattttagttgc

SEQ ID NO: 2232 - DNA, 1137 bp, Solanum melongena
aattgctcattcatctttctccggcgaatttcttacgatctctttctctggcgccgatttctacatcctaaacgttgtaaatgatgaagattgattttagtggatttgaaccaagtgccccacttcgaggggagtcctctgagctgtttgatggaatttcaaattctccatcattccatcttcctaatactgctaattttgatggttttcaaaaagaagcgatccaaatggtgaagcccgcaaagggaaccacaacccttgctttcatttttaaaggaggtgtcatggttgctgctgattctcgagctagcatgggaggatatatatcatctcaatctgtgaagaaaatcattgaaattaatccctatatgcttggcacaatggctggtggagctgctgactgccaattctggcatagaaaccttggaatcaagtgccgtcttcatgaactggcaaacaaaaggagaatttcagttactggagcttcaaagctgctggcaaacattttatattcttaccgtggaatgggtttgtctgttggaactatgattgctggttgggatgagaagggtccaggactatactatgtggatagtgagggaggacggcttaaaggaaacagattctctgttggatctggttctccttatgcttatggtgttttggataatgggtaccgatatgatctctctgtggaagaggcagctgagttggctagacgagcaatttatcatgcgacattccgtgatggagctagtggaggtgttgctagtgtttatcatgttggaccaaatggatggaagaagctgtctggcgacgatgttggagaactccactaccagtattatcccgctgaaatagcagccgtggaacaggaaatggcagacgtaccagtggcctgagaaaaaaaatcgaatatgttatcattttcgcaagttaaagagacagtttaattttcttgtcagactctattgtggtcttcaatctgtaaaccgtaaaaatttatctacatccgatgtcaaggctatgtgtgtatttatcacttaattatgtttagttatatttacacttcaatttttaactgctaaggttagattatctaatttgcaggcctattggaaatatacttcctgccct

SEQ ID NO: 2233 - DNA, 1102 bp, Fraxinus spp
gaagaaatcattgctgctcttcactattttaacattttttctgttatttgttcaaattcacaatttctctgctataattcgacgaagaaaagggaaaatgatgaagattgattttagtggactcgcggcctcagcccccctttgtggcaacacggatgaattgaacaatgagatttcgactggacagaaatttgaacttcctattgccgatgactttgatgggtttcagagagaagcagtacggatggtgaagccagcaaagggaaccacaactcttgcgtttatatttaaggaaggtgtcatggtggctgctgattcccgtgccagcatgggaggatatatatcatcacaatctgtcaagaaaataattgaaatcaatccttacatgcttggcacaatggctggaggagctgctgactgccaattctggcacagaaatctgggaattaagtgccgtttacatgaattggcaaataagagaaggatttctgtgactggagcttcaaagttgctggcgaacattctgtattcttaccgaggaatgggtttgtctgttggaactatgatagctggctgggatgaaacgggtcctggcctgtattatgtggacagtgaaggaggacgacttaaaggaactagattctctgttggatctggttcaccatatgcttatggcgttttggacagtggataccgttttgatatgtctgttgaagaaggtgctgagctggctagacgtgcaatttatcatgcaactttccgtgatggagccagtggtggtgttgccagcgtttatcacgttggaccaaatggatggaaaaagctgtcaggtgacgacgttggagaacttcactatatgtactatcctgtggagcctgcatctgtggaacaggagatgactgaggtatccgggtcgtgagagacttataggaagtaggatatttgacatcagtctgttctgaagtacatgtggtttaatctgcaaatgctcctaaagtgcatgttttactcgactatgtaccagaggcaacaaaacttttttgctcggagctctttgttgcaaattatgaaatgtcatgtattatttatccagttggcctcg

SEQ ID NO: 2234 - DNA, 1015 bp, Nicotiana benthamiana
agcaagtcggaatcactcctcagcgatctgtcttctgcgacgaactctaaggcgatctctttctgcggccatatcgtgttgttgtaaaatgatgaagattgattttagtggactcgaaccgactgccccactcaagggggagtcctctgtgctatgtgatggcatcctgagttctccatcattccaaattcctaatactactaattttgatggttttcagaaagaagcaatccaaatggtgaagcctgcaaagggtaccacaactcttgctttcatttttaagggaggtgtaatggtggctgctgattctagggctagcatgggaggatatatctcatctcaatcagtgaagaaaatcattgaaataaatccttatatgcttggaacaatggctgggggtgctgctgactgccaattctggcatagaaacctaggaatcaagtgtcgtctacatgaactggctaacaaaaggagaatttctgttgctggagcttcaaaactgctggcaaatattttatattcttaccgaggaatgggtttgtcggtcggaactatgattgctggatgggatgagaagggtccaggactgtattatgtggacagtgagggaggacgacttaaaggaaacagattctctgttggatctggttcgccttatgcttatggtgttttggatagtgggtaccgctttgatttatctgtggaagaagctgccgagctggcaagacgagctatttatcatgcaacattccgtgatggagctagtggtggtgttgctagtgtttatcatgttggaccaaacggatggaagaagctatctggtgatgatgttggagaacttcactacaattactatcccgttgaactcgaatcagttgaacaggaaatggctgaagtgcccgtggcctgaggagaaaaagcccttggcaattgttgttattttgtttcatgattgtgtaaaccagatcaaatttgtttcagtcttccaacattatagaatttaagtttattctct

SEQ ID NO: 2235 - DNA, 1171 bp, Citrus sinensis
ctccaatttatttattctcactgcagcttttatgctcgatttctgcttgcaactctcagttacattgtcgtttaatcttatattcagtgcgtagacatgaagctcgacactagcggtcttgagtccacttctccttttttcgggtcaggcgacgagctctgtcctgagttatcagctgcaccatcattttctctacctctttctactgattttgatgaatttcaaaaggacactaaagctacactgaagcatgccaaggggacaaccacacttgcttttatctttaaagagggtgttatggtggctgctgattctcgagctagcatgggaggctatatctcatcacagtctgtgaagaaaattatagaaatcaatccttacatgcttggcacaatggctggaggagcagccgattgccagttttggcacagaaatctgggcattaagtgccgactacatgaattggccaacaagcgtagaatttcagttacaggggcatcaaagctgctggccaacattctctactcttatcgtggaatggggttgtctgttgggactatgattgctggatgggatgagactggtcctgggctgtattatgtggacagtgaaggagggaggctcaaaggaacacggttctctgtgggatcaggttcaccatatgcttatggtgtattggacagcgggtacaagtttgacatgtctattgaagaagctgcggagttggctagaagagctatttatcatgcgacattcagagatgcagccagtggtggtgttgcaagcgtttattatgtgggaccaaatggatggaagaagctgtctggtgatgatgttggagagcttcactaccattattatccagtcacacccagtacagtggagcaagaaatggctgaagtcgcaggggcataattgagtcttgctcaatttggaccaggtttgagatattcctcatattcacagatccagtggaggactttacggatatgcttctgaactttgtcaatgtaccttgggttgatcccagagatgactcgtgaattcaacctagttaagttgatgctttaagaaccctgcattttcttttggtattttcattatgacaagtacagttctattttctattaagcagtttgttatagtaatttagttcctgagattgcgatta

SEQ ID NO: 2236 - DNA, 963 bp, Petunia hybrida
cgatctctctttttctccggcgaaaattgaattgttgtaagcaatgaagatcgattttagtggacttgaaccgagtgccccacttcggggggagtcttctgagctgtttgatggcattcagagttctccatcattccagattcctaatactactaattttgatggttttcaaaaagaagcaatccagatggtgaagcccgcgaagggaaccacgacccttgctttcatttttaaagatggtgtcatggtagctgctgattctcgtgctagcatgggaggatatatatcatctcaatctgtgaagaaaatcattgaaattaacccatatatgcttggcacaatggctggtggggctgctgactgccaattctggcatagaaacctgggaatcaagtgccgtctgcatgaactggcaaacaaaaggagaatttcagttactggtgcttcaaagctgctggcaaacattttatattcttaccgtggaatgggtttgtcagttggaactatgattgctggttgggatgagaagggtccaggactatattatgtggatagtgagggaggacggcttaaaggaaccagattttctgtaggatctggttcaccttatgcttatggtgttttagataacgggtaccgatatgatttgtctgtggaagaagcagccgagctggctagacgagcgatttatcatgctacattccgtgatggagctagtggaggtgttgctagtgtttatcacgtcggaccaaatggatggaagaagctatcaggtgacgatgttggcgaactccactacaactactatcccgttgaagcagcagctgtggaacaggaaatggctgaagtgccagtggcctgaggagaaaggacctgtaatagcgtggtcatttgtgtcatgattatgtaaaccagatcatttctcacctttgaatattaaaagggatgttggatttttttttg

SEQ ID NO: 2237 - DNA, 993 bp, Sarracenia psittacina
catgaagttcgatacaagtggtctcgagacgaatgggatgttccttggatcgaacgatgagcttttcagtggattcccaaccactccatcttttgagattcctagcactactgattttgatggatttcagaaagaagctatacagatggtgaaaccagcaaagggcacaactacactagctttcatttttaaggagggtgtgatggttgctgctgactcccgtgcaagcatgggaggctacatctcttcacaatctgtgaagaaaatcattgaaattaatccctacatgcttggcacgatggctggcggagcagctgattgtcaattttggcatagaaacctgggcattaagtgccgactccatgaacttgcaaataagcgaagaatttccgttacaggggcctcaaaactgttagcaaacattctatataattaccgtggtatgggtttgtctgttggaaccatgattgctggttgggacgaaacgggtcctgggctgtattatgtggacaatgatggaggacgcctaaagggaatgagattttctgttggatctggttctccttatgcttatggagtgctggataacgggtatcgctatgatatgacagtggatgaagctgcagagttggctagacgtgcaatttatcatgcaacattccgagatggagcaagtggtggtgttgctagtgtgtatcatgtgggacccaatggatggaagaaactttctggggatgatgttgctgaacttcattacaattactatccggttgaatcgacagtggtagaacaggagatggctgagacttagaggcttgtgggaggcgtccgatggctgctttgataatgcctctttctgtaatttattgccagtagtgttttggctccaagaattactgaacagccttattattattgcatggcaatttagttttgctgacagctttttgtaacttgtttcaaaaccttataattaagttttacattcctctg

SEQ ID NO: 2238 - DNA, 1222 bp, Tabernaemontana elegans
taagccccagcgtctgcgctcttaatcacctcgctcctctgcgatcctccacctctcttggcatctcttccaccaccgtctaccgccctcgatctccttccttacatcggtagcgtgggaagtaattgcagacactgtttagtaactagaaaaggtcacaatgatgaagattgattttagcggacttgattcgactcctcggtttcttgggaacagcgatgacttgcttagtgggatttcgaccgctccggcattccagattgctgatactaatgatttcgatggatttcaaaacgaagcaatccaaatggttaagccagccaagggaactacaactttggctttcatatttaaggaaggtgtcatagtggctgcagattcacgtgctagcatgggaggatatatttcatcacagtcggtcaagaaaatcattgaaatcaatccctacatgcttggcacaatggctgggggtgctgctgactgccagttctggcacagaaatctggggattaagtgccgtctgcatgaacttgctaataagagaagaatttctgtcactggggcatcaaagttgctggccaacattctatattcttaccgtggtatgggcctgtctgtgggcacaatgattgccgggtgggatgagaagggtcctggcctgtactatgtggacagtgagggaggacggcttaaaggaaaccgattttcagttggatctggttcaccttatgcttatggtgttcttgacagcgggtaccgctttgatatgtccgtcgaagatgctgcggagttggctcgacgtgctatttaccatgcaaccttcagagatggtgccagtggtggtgttgccagcgtctatcatgtcggacccaatggatggaagaagctttctggagatgatgttggggaacttcactacacatattatccagttgagacaacaccaattgaacaggaaatggcagaagtttccatttcttagaagatagtatggggggaaagtcctttgaggttctccacaagcattttaattttctgtacaattcttttggagtagctctgagttggaatagtaaccccggttcttggttctgcatatgaatgaatctaagtgttatactttcttgatggctaatttgatctcttcccgggttttgtgtagtaaatggtagtagtatcatttttatttgggaatctgcaaccaattcattgacattcaagc

SEQ ID NO: 2239 - DNA, 1033 bp, Citrullus lanatus
atggttgaaaacaagcagtttccgaatcgtttcccctacacttcagcgttcgtcgtccttgatatacgctcgcaatcgtttctgcatcctcctttaaacggtatccttgaaagcttattctctaaccctcctatcttgagcatgaagctggacactagcggtcttgaatcggccgcttttctctctggcgcgggcagtgctgatctgctcaatgggttatcctcggcgccatcttttgatattccaaatgctactaattttgatggatttcagaaagaggctattcagatggtgaagccagcaaaggggacgacaactctggccttcattttcaaggaaggagtcatggttgctgctgattcccgagcgagcatgggaaggtacatatcatcccaatctgtgaagaagatcgttgaaataaatccatacatgcttggcacaatggctggaggagctgctgattgccagttttggcacagaaatcttggaattaagtgtcgaccacatgagttggcaaacaagcgtagaatttcagtgacgggtgcatccaagttgctggctaacattctctattcgtaccggggaatgggtctttcagttggtaccatgattgctggatgggatgaaactggtcctggattgtattatgttgacagtgaaggaggaagattgaaaggaattcgattttcagttggatctggttcaccttatgcatatggtgtcctggacaatggttatcggtacgatttatcagttgaagaagccgctgaattgggtcgaagagcaatttatcatgcaacattccgagacggggccagcggtggcgttgcaagtgtttattatgttggaccaaatggatggaagaaactatctggtgatgatgttggagaacttcactacaaatattatccggttgtgtctgatacagttgaacagaaaatgcttgaagtcgctcagtagagctttttaacgattggatcccaggtttcaatgttctttccaaacaaactccttgatgtattttgttaactag

SEQ ID NO: 2240 - DNA, 1084 bp, Tripterygium wilfordii
aaagctctctatcaccataccctacactaatcatctctgacttagatcatgaagcttgacaccagcggccttgaatcgcctatgctgcactttggggcgggcaacgaaattgttgaggggatttcgagtgcacagtctgtagagtctttcgaggttcccgatgttaccaattttgatgcgttccaaaaggaggctacgcagatgttgaagcatgccaaggggacgactactcttgcttttatttttaaagagggcgttatggttgctgctgattctcgagctagcatgggcggctatatctcttcccagtcagtgaaaaaaatcatcgaaatcaatccttacatgcttggtacgatggctggaggagctgctgactgtcagttttggcacagaaatctgggaattaagtgccgactgcatgaattggcaaacaagcggagaatatcagttacaggagcatccaagcttctggcaaacattctgtattcttatcgtggaatgggtctatctgttgggactatgattgctggatgggatgaaacgggacctggactatattacgtggatagtgaaggaggaaggcttaaaggaatgcgattctctgttggatctggttctccatatgcttatggtgtacttgataatgggtatcaatatgacatgtcagttgaagaagctgcagagttggctagaagagccatttaccatgcaaccttccgagatggagctagtggtggagttgcaagcgtttatcatgtgggaccaaatggctggaagaagttatcaggtgatgatgttggagaactccactacaaatactatccagtcacaccgggtacggtggagcaagaaatgaccgaagttgctggggcatgagggtttcgcttaatttagaccagatctgggtttctgtccatgttgagaaccttgccgctattatcttaagaccatggaatacaatgctaggaggcatttcttttttactgaagtctcaatatgcttgagcaagctctactctggagacacatgataaattcatatgcccttttctgatcgtgtgatatattatgtgaacacttatgac

SEQ ID NO: 2241 - DNA, 913 bp, Amsonia hubrichtii
acttttcctctgatttttggtattttcttcgtgataaccagttctcagctacgaagtaacgatgatgaagattgattttagtgggcttgagcctagggcttcagtgccgggaaacgcgaatgaattgctgaatgggatctccactgctcctgaattccagattcctaacactgagaattttgatgggttccaaaaagaagcaattcaaatggttaaaccagctaagggaacgactactttggcattcatattcaaggaaggagtcatagttgcagctgactctcgtgctagcatgggaggatatatatcctcgcaatctgttaagaaaatcattgaaatcaatccctacatgcttggcacaatggctggaggtgcagctgactgccagttttggcacagaaatttggggattaagtgtcgtttgcatgaacttgcaaacaaaagaagaatttctgttactggagcttcaaagttgctggcaaacattctatattcttatcgtggtatgggattgtccgtgggaacaatgattgctggctgggatgaaaagggtcctggcctatattatgttgacagtgaggggggacggcttaaaggaaacagattttcagtgggatctggctcaccatatgcttacggtgttctcgatagcgggtatcgttttgatatgtctgttgaagaggctgtagaattggccagacgtgctatttaccatgctactttcagagatggcgctagtggtggtgttgtcagtgtttatcatgtaggacctaacgggtggaagaagatgtctggtgatgatgttggggaacttcattacatgtactatccagttgagccaacagtggttgaacaggaaatggctgaagtatcagtttcttaaaatagggtgtctagggaatgctgcttgttt

SEQ ID NO: 2242 - DNA, 987 bp, Medicago truncatula
ccgagatctaacaccacaatcgataatctgaaacaatgcttgataccactgctctcgaatcgttcccatctttgatttcacatggaatcaacgttgctggagaaatctctgcacccccatcgttccagcttcccaattccaacgatttcgatgggtttgttaaagaaactattcagatggtgaaacccgcgaagggtactacaactcttgcttttatattcaaggagggtgttatggtagctgctgattctcgtgctagtatgggaggatatatatcatcacagtctgtgaagaaaattattgaaattaatccgtacatgcttggaactatggctggaggtgctgctgattgccaattttggcataggaatctcggcatcaagtgtcgcttgcatgaattggcaaataaaagaagaatttcagtcacaggagcctctaagttacttgcgaacattttatactcttaccgtggaatgggattatctgttggtaccatgattgctggatgggatgagacgggtcctggtctatattatgttgatagtgaaggaggaagactaaaaggcaatagattctctgtaggatctggttcgccatatgcttatggtgtactggacagcgggtacaaatatgacatgtcagttgaggaagcttcggaactggctcgacgggcaatttatcatgcaacatttcgtgatggagccagtggtggagttgctagcgtttactatgtgggaccaactggatggaagaaattgtctggtgatgatgttggtgaacttcactaccattacaacccagttaccccaagcaccgtggagcaagaaatggttgaggcagctggaccctgattcaataactcatggatatcttgagtttcttatacttgtctgcgtattttgaatcaattgcatggacatgatttatattcaaaactgtcgccagttctatgtttacacaagtgctgctagctatgctctaaggttg

SEQ ID NO: 2243 - DNA, 994 bp, Triphysaria pusilla
tttctccgacgagttttcaacatttgcaattgttcttctcaaaatctgcagaaaccaggacacgatgatgaaaattgatttcagtgggcttgacccggtagcaccaataagaggaaacagagatgatgaattgactgatgagatttcggaaataccatctttcaagcttcctagtcatgttgatttcgatgggtttcagaaagcttctgtacagatggtgaagcctgcaaagggaacgacgacgttggcatttatattcaaaggtggtgtgatggtggctgctgattctcgtgcgagcatgggcggatatatatcatcgcaatctgtgaagaagattattgaaatcaatccttacatgcttggtaccatggccggaggagctgctgactgccagttctggcacagaaatctcggaattaagtgccgtttgcatgaattggcaaacaagagaagaatttctgttgctggagcttcaaagatgttggcgaacattctgtattcttaccgcggaatgggtttatccgttggcactatgattgctggctgggatgaacagggtcctggtctctattacgtggacagtgaaggtggacgacttaaaggcaccagattctcagtcggctctggttcaccatatgcttatggtgttttggacagtggataccgtttcgatatgtcggttgaggaagctgctgagctggcaagacgatccatctatcatgcaacattccgtgatggagccagtggtggtgttgctagcgtgtatcacgtggggccagttgggtggaagaagctatcaggtgatgacgttggagaacttcactatcattactatcctgtcgaacctgcaactgtcgaacaagagatggctgatgttcctgttgcttaatggtatgctaaactaggatttttagtttcatttgcttcggattgtacgtgagacgatatttgcttcggtttgtaactttttaattcgatccatgatctttttcgg

SEQ ID NO: 2244 - DNA, 1173 bp, Citrus clementina
ctccaatttatttattctcactgcagcttttatgctcgatttctgctcgcaactcttagctacattgtcgtttaatcttaaattcagtgcgtagacatgaagctcgacactagcggtcttgagtccacttctccatttttcgggtcaggtgacgagctctgtcctgagttattagctgcaccatcatttgctctacctctttctactgattttgatgaatttcaaaaggacactaaagctacactgaagcatgccaaggggacaaccacacttgcttttatctttaaagagggtgttatggtggctgctgattctcgagctagcatgggaggctatatctcatcacagtctgtgaagaaaattatagaaatcaatccttacatgcttggcacaatggctggaggagcagccgattgccagttttggcacagaaatctgggcattaagtgccgactacatgaattggccaacaagcgtagaatttcagttacaggggcatcaaagctgctggccaacattctctactcttatcgtggaatggggttgtctgttgggactatgattgctggatgggatgagactggtcctgggctgtattatgtggacagtgaaggagggaggctcaaaggaacacggttctctgtgggatcaggttcaccatatgcttatggtgtattggacagcgggtacaagtttgacatgtctattgaagaagctgcggagttggctagaagagctatttatcatgcaacattcagagatgcagccagtggtggtgttgcaagcgtttattatgtgggaccaaatggatggaagaagctgtctggtgatgatgttggagagcttcactaccattattatccagtcacgcccagtacggtggagcaagaaatggctgaagtcgcaggggcataattgagtcttgctcaatttggaccaggtttgagatattcctcatattcacagatccagtggaggactttacggatttgcttctgaactttgtcaatgtaccttgggttgatcccggcgatgacttgtgaattcaacctagttaagttgatgctttaagaaccctgcattttcttttggtattttcattatgacaagtacagttctattttctattagcattttgttatagtaatttagttcctgagattgcgattgcat

SEQ ID NO: 2245 - DNA, 1194 bp, Medicago truncatula
ttttaacctcccttatatttgcttcaaacaaccgagatctaacaccacaatcgataatctgaaacaatgcttgataccactgctctcgaatcgttcccatctttgatttcacatggaatcaacgttgctggagaaatctctgcacccccatcgttccagcttcccaattccaacgatttcgatgggtttgttaaagaaactattcagatggtgaaacccgcgaagggtactacaactcttgcttttatattcaaggagggtgttatggtagctgctgattctcgtgctagtatgggaggatatatatcatcacagtctgtgaagaaaattattgaaattaatccgtacatgcttggaactatggctggaggtgctgctgattgccaattttggcataggaatctcggcatcaagtgtcgcttgcatgaattggcaaataaaagaagaatttcagtcacaggagcctctaagttacttgcgaacattttatactcttaccgtggaatgggattatctgttggtaccatgattgctggatgggatgagacgggtcctggtctatattatgttgatagtgaaggaggaagactaaaaggcaatagattctctgtaggatctggttcgccatatgcttatggtgtactggacagcgggtacaaatatgacatgtcagttgaggaagcttcggaactggctcgacgggcaatttatcatgcaacatttcgtgatggagccagtggtggagttgctagcgtttactatgtgggaccaactggatggaagaaattgtctggtgatgatgttggtgaacttcactaccattacaacccagttaccccaagcaccgtggagcaagaaatggttgaggcagctggaccctgattcaataactcatggatatcttgagtttcttatacttgtctgcgtattttgaatcaattgcatggacatgatttatattcaaaactgtcgccagttctatgtttacacaagtgctgctagctatgctctaaggttgtgtcaagttttcagatcaagtagctatgtgtaatgttgaatagtttgaatgggaaaagaacgtttgatgtagaattgtttgtccaaattcaggttttaagagaagcgataacaagaagttttcatgttaaccttaaaaaaaactaatctaattttcaggtcaaacttatattagaa

SEQ ID NO: 2246 - DNA, 1190 bp, Cucumis melo
atcatttccttcgacgttgtggggtttttgtttggttctagtttgcgttgctgttctcttattgctctaggttctacctcaaggagttgaaaaatgaagcttgataccagtggtcttcaaacaaccgccccgatgtttgggccaagaatggaggctctggaagggtttgcagctgctccatcctttgagatccctaattccagtgactttgatggctttcagaaagatgccattcaaatggtaaagccagccaaaggaacaaccacactggcttttatttttaaggaaggagtcatggttgctgctgattctcgtgccagcatgggaggctatatatcatcacaatctgtgaaaaaaattattgaaatcaatccttacatgcttggcactatggctggaggtgctgctgattgccagttttggcatagaaaccttggtgttaagtgccgccgacacgagttagcaaacaagcgccgcatttcagttgcaggagcctccaaattacttgccaacattctgtactcctatcgtggaatgggtctctctgttgggactatgattgctggatgggatgaaacaggtcctggtctatattacgtagacagtgagggagggaggctgaaaggaacaagattttctgttggatctggttcaccctatgcctacggtgtcttggataatggatatcggtatgatttgtctgttgaagaagctgctgaactggctagacgagctatttatcatgcaactttccgagatggtgccagtggtggagttgctagcgtttattacgtgggaccaaatggatggaaaaagctttctggcgatgatgtaggagaacttcattacaactactatcccgtgacaccaactacagtcgatcaggaaatgactgaagtaactgccgcttgatgattggatatagactcgagcaagttaagacaacactccctgtggatttgtgttaggggcaactgattctaaagagatgctttaaatgtggtatttttaaagtttaagtgtttacaactcaaggacagaaccgtagaaagttcgattggatctaggtttggaaacttgtgctgcaaggaactttctgttacgttattctagttgtatggtttgttggaggaccttgtctgtgtttcctaaattttaaatccatttcttcattgggactaccctcttta

SEQ ID NO: 2247 - DNA, 1107 bp, Nicotiana benthamiana
tctttctttttgtgttataggttgtaaaatgatgaagattgattttagtggacttgaaccgactgccccaatcaagggggagtcctctgagctgtgtgatggcatcctgagttctccatcattccaaattcctaatgctactaattttgatggttttcagaaagaagcaatccaaatggtgaagcctgcaaagggtaccacaactcttgctttcatttttaagggaggtgtaatggtggctgctgattctagggctagcatgggaggatatatctcatctcaatcagtgaagaaaatcattgaaataaatccttatatgcttggaacaatggctgggggtgctgctgactgccaattctggcatagaaacctaggaatcaagtgtcgtctacatgaactggctaacaaaaggagaatttctgttgctggagcttcaaaactgctggcaaatattttatattcttaccgaggaatgggtttgtcggtcggaactatgattgctggatgggatgagaagggtccaggactgtattatgtggacagtgagggaggacgacttaaaggaaacagattctctgttggatctggttcgccttatgcttatggtgttttggatagtggataccgctttgatttatctgtggaagaagctgccgagctggcaagacgagctatttatcatgcaacattccgtgatggagctagtggtggtgttgctagtgtttatcatgttggaccaaacggatggaagaagctatctggtgatgatgttggagaacttcactacagttactatcccgttgaactcgaatcagttgaacaggaaatggctgaagtgcccgtggcctgaggagaaaaagcccttggcaattgttgttattttgtttcatgattgtgtaaaccagatcaaatttgtttcaatcgtccaacattatagaatttaagtttattttcttgaaattgaattatactcgctcaatctggatatacttctccttgcataacttgtaagctcccattctcctccattcaagttctgtcctaatttggagaaggaaaaggttgagtattctagccaatagttttgtaacctactgtgctactacc

SEQ ID NO: 2248 - DNA, 1174 bp, Nicotiana benthamiana
ggcttccggtggacacaaagagatccggtccaacccgatatacttcaaaagtaacaagcctatttcttcttcagcaagtcggaatcactcctcagctgctttttatctgcgatctctgtcttctccgacaaactcttaggcgatctctttctgcggctatatcgtgttgttgtaaaatgatgaagattgattttagtggacttgaaccgactgccccaatcaagggggagtcctctgagctgtgtgatggcatcctgagttctccatcattccaaattcctaatgctactaattttgatggttttcagaaagaagcaatccaaatggtgaagcctgcaaagggtaccacaactcttgctttcatttttaagggaggtgtaatggtggctgctgattctagggctagcatgggaggatatatatcatctcaatcagtgaagaaaatcattgaaataaatccttatatgcttggaacaatggctgggggtgctgctgactgccaattctggcatagaaacctaggaatcaagtgtcgtctacatgaactggctaacaaaaggagaatttctgttgctggagcttcaaaattgctggcaaatattttatattcttacagaggaatgggtttgtcggtcggaactatgattgctggatgggatgagaagggtccaggactgtattatgtggacagtgagggaggacgacttaaaggaaacagattctctgttggatctggttcgccttatgcttatggtgttttggatagtggataccgctttgatttatctgtggaagaagctgccgagctggcaagacgagctatttatcatgcaacattccgtgatggagctagtggtggtgttgctagtgtttatcatgttggaccaaacggatggaagaagctatctggtgatgatgttggagaacttcactacaattactatcccgttgaactcgaatcagttgaacaggaaatggctgaagtgcccgtggcctgaggagaaaaagcccttggcaattgttgttattttgtttcatgattgtgtaaaccagatcaaatttgtttcaatcgtccagcattatagaatttaagtttattttcttgaaattgaattatactcgctcaatctggatatacttctccttgcatagcttgtaagctcccattctcctc

SEQ ID NO: 2249 - DNA, 1220 bp, Olea europaea
tctcctgtattgctgcacaagcaaactgactttacatcttcacaaatttctgcgattccatttcagatcacaatttctctgctacagcccacggaaatcagttgaagaaagttgaatgatgaagattgactttagcggactggaacccttggcctcgctttgcgtaatcaaagagcatgacgagatctcaaagcctctttcgtttgaacttcctattactggtgattttgatgggtttcagagagaagccgtccaaatggtgaagccagcaaagggaaccactaccctagcttttattttcaaggaaggtgttatggttgctgctgattcgcgtgctagcatgggaggatatatatcatcacaatctgttaagaaaatcattgaaattaatccctacatgcttggcacaatggctggaggagctgctgactgccagttctggcacaggaatctgggtgttaagtgtcgattgcatgaactggcaaataagagaagaatatcagtaactggagcctcaaagttgctggctaacattctctattcttatcggggaatgggtttgtctgttggaactatgatagctggctgggatgagaagggtcctggcctgtactatgtggacagtgaaggaggaaggctgaaaggaactagattctctgttggatctggttcgccatatgcttatggtgttttggacagtggctaccgttatgatatgtctgttgaagaagctgcagagttggcaagacgggctatttatcatgcaacattccgtgatggagctagtggtggcgttgccagcgtttatcacgttggaccaaatggatggacaaagctatcaggtgatgatgttggagaacttcactacaaatactatccagttgaagcagaagttgtagaacaggagatggctgaattacctgtgacctgagagagagccagtgagaagaagtagaatatttgctactatgtgcttctgaactataactatcgcattagacgtgttcaaacttgttttgcttgtagtattctgttttataaccaagtcctgccattcttgatgcagttcaattctttactccccttttcctttcaaattttgccaccgaatttcttcatttgtgggtgctttgttttgtgtaactcaagtgaatctctttgttacttacgttgtaattttttaagagtaattaaaaatgtacgtacttctgtcgttagac

SEQ ID NO: 2250 - DNA, 948 bp, Sesamum indicum
tgcagcgcaagaaaacatttgctttttcttatatacattttcgttgcttctcaaaatttctgctttcagtcttctaccattgtagtttcttcgtatagcttgcctagatcagggaaagatgatgaagattgattttggtggtcttgatccctccgcgccgctcaagggaaacacagatgatttgcataacgagattttggctgcaccatcttttaaactaccaattactgctgattttgatgggttccaaaaagcggcagtgcagatggtgaagcctgcaaagggaacgacaactctggcttttatattcaaagaaggtgtaatggttgcagctgattcccgtgccagcatgggaggatatatatcatcacaatctgtcaagaaaatcattgaaataaatccatacatgcttggcacaatggctggaggagctgctgactgccagttttggcacagaaatctgggaattaagtgtcgtttacatgaattggcaaacaagagaagaatttctgttgctggagcttcaaagttgttggcaaacattctttattcttaccgaggaatgggtttgtctgttggaactatgatagccggctgggatgagcagggtcctggtctctattatgtggacagtgaaggtggacgacttaaaggcactagattctcagttgggtctggttcaccatatgcttatggtgttctggacaatggatatcgctttgatttgtcagttgaggaagctgcagagctggctagacgggcaatttatcacgcaacattccgtgatggagccagtggtggtgttgccagcgtataccatgttgggccaaatggatggaaaaagctatcaggggatgatgttggagagctccactacaagtactatcctgttgaacctacagctgtggaacaggagatgactgaggtatccattgcatgagggaaaga

SEQ ID NO: 2251 - DNA, 991 bp, Helianthus annuus
gcattaacgatccgttctacacttctcgatcaaaaggtggaaatcatgaagtttgactttagcggactagaatcgagtgcaccactctacgggggaaacaatgagttgctgtctgatgggttctcagctgccccttcatttgatcttccagtcacatcagattttgatgatttccaaaagaattctatccaaatggtaaagccagcaaaagggacaacaaccttggcttttatattcaaggatggtgtgatggttgctgctgattcccgagctagcatgggaggctatatctcatctcaatctgtgaagaaaatcattgaaattaatccctatatgctgggtacaatggctggaggagctgcagattgccagttctggcacagaaatttaggtattaagtgtcgtttgcatgaattagcaaacaagagaagaatttcagtcaccggtgcttcaaaattgctggcagatatattatattcttatcgtggaatgggtttgtctgtcgggacaatgattgcaggatgggatgaaaagggtccaggcctgtattatgtagacagtgaaggacgacgcctgaagggaacaaagttctcagttgggtccggttcaccttatgcttacggtgtactagatagcgggtacaaatatgatttgacaattgatgaagctgctgaattggctagaagagccatttatcatgcaacgttccgtgatggagctagtggtggtgttgctagtgtttatcatgtgggcccaaacggatggacaaagctatcgggtgatgatgttggtgaacttcactattcatactatcctgttgaaccagccaccgttgagcacgaaatgacggaagctgtagttgcctgagtcgaacggattgctgttggtaatttttcaaaaaagaacattggagcatgatgtacttttgttatgattctacatgttcgaatgacattaacttgtttttttcttgtttatcgccagagtttgc

SEQ ID NO: 2252 - DNA, 1234 bp, Nicotiana tabacum
  misc_feature (1116)..(1116): n is a, c, g, or t
  misc_feature (1139)..(1139): n is a, c, g, or t
ggggggttcctgtggacacaaagagatccagtccaacccgatatattcaaaagtaacaagcctgtttcttcttcagcaagtcggaatcactcctcagctgctatttgtctgcgatctctgtcttctgcgacgaactctaaggcgatctctttctgcggccatatcgtgttgttgtaaaatgatgaagattgattttagcggacttgaaccgactgccccaatcaagggggagtcctctgagctgtgtgatggcatcctgagttctccatcattccaaattcctaatgctactaattttgatggttttcagaaagaagcaatccaaatggtgaagcctgcaaagggtaccacaactcttgctttcatttttaagggaggtgtaatggtggctgctgattctagggctagcatgggaggatatatatcatctcaatcagtgaagaaaatcattgaaataaatccgtatatgcttggaacaatggctgggggtgctgctgactgccaattctggcatagaaacctaggaatcaagtgtcgtctacatgaactggctaacaaaaggagaatttctgttgctggagcttcaaaattgctggcaaatattttatattcttaccgaggaatgggtttgtcggtcggaactatgattgctggatgggatgagaagggtccaggactgtattatgtggacagtgagggaggaagactcaaaggaaacagattctctgttggatctggttcaccttatgcttatggtgttttggatagtgggtaccgctttgatttatctgtggaagaagctgctgagctggcaagacgagctatttatcatgcaacattccgtgatggagctagtggtggtgttgctagtgtttatcatgttggaccaaacggatggaagaagctatctggtgatgatgttggagaacttcactacaattactatcccgttgaactcgaatcagttgaacaggaaatggctgaagtgcccgtggcctgaggagaaaaagccctaggcaattgttgttattttgtttcatgattgtgtaaaccggatcaaatttgtttcaatcgtccaatattagagaatatcagtattttcttgaaattgaattntactctcaatctggatatacttntccttgcatagcttgtaagctcccattctcctccattcaagttctgtcctaatttggagaaggaaaaagttgagtattctagccaatggttttgt

SEQ ID NO: 2253 - DNA, 1384 bp, Triphysaria pusilla
tttcaacttttgcaattgttcttctcaaaatctgcagaaaccaggacacgatgatgaaaattgattttagtgggcttgacccggtagcaccaataagaggaaacagagatgatgaattgactgatgagatttcggatataccatctttcaagcttcctagtcatgttgatttcgatgggtttcagaaagcttctgtacagatggtgaagcctgcaaagggaacgacgacgttggcatttatattcaaaggtggtgtgatggtggctgctgattctcgtgcgagcatgggaggatatatatcatcgcaatctgtgaagaaaatcattgaaatcaatccatacatgcttggtaccatggccggaggagctgctgactgccagttctggcacagaaatctcggaattaagtgccgtttgcatgaattggcaaacaagagaagaatttctgttgctggagcttcaaagatgttggctaacattctgtattcttaccgcggaatgggtttatccgttggcactatgattgctggctgggatgaacagggtcctggtctctattacgtggacagtgaaggtggacgacttaaaggcaccagattctcagtcggctctggttcaccatatgcttatggtgttttggacagtggataccgtttcgatatgtcggttgaggaagctgctgagctggcaagacgatccatctatcatgcaacattccgtgatggagccagtggtggtgttgctagcgtgtatcacgtggggccagttgggtggaagaagctatcaggtgatgacgttggagaacttcactatcattactatcctgtcgaacctgcaactgtcgaacaagagatggctgatgttcctgttgcttaatggtatgctaaactaggatttttagtttcatttgcttcggattgtacgtgagacgatatttgcttcggtttgtaactttttaattcgatccatgatctttttcgggaagaaaatagctgggaagttgttatgggcacacttcagcttgtgcaatgtcactatttttatgggtattttctaaagcttcaaacaatattattacaaaattccctttattttttcattccaagtcaaaaaatgggtgtcaagaagtttttccaggaattgaaaatgaaggtatctccatcaaggttgttcaaggcattggtaaccgagtcccatgacgtcatccctaaggtcacaccttcagtcaagagcattgagactattgaaggtgaatacggtgccgttggctgcttaaggaaaactaccttccctgaaacttcccaaatcaagtccgtgacacacagagtcgatgccatagaccacgataactacacgtgcaaatacacaatggtcgctggagatgt

SEQ ID NO: 2254 - DNA, 1065 bp, Valeriana officinalis
cttacgacttgctcgagaagacaagctcgcgatctgattcttcgctcagttttggcagtttccggtggtcacaggtggatacagaactatgaagatcgacttcagtggactagaatcaggtgccccgtcctgtggagcaagcaatgagctgtttgttgatgggattacaagcgcgccagcttttcagattccgaattcaattgattttgatggctttcagaaggaagctatccaaatggtgaagccagcaaagggaacaacaactctggcttttatatttaaagacggcgttatggttgctgctgattcccgtgctagcatgggaggatatatttcgtcgcagtctgtgaagaaaataatagaaataaacccatatatgcttggcactatggctggaggtgctgctgattgccagttctggcatagaaatttgggaatcaagtgtcgactccatgaacttgcaaataagagaagaatatcagtgactggggcttcaaagttactggcaaacattctttactcttatcgtggaatgggattgtccgtgggaacaatgattgctggatgggatgaaaagggtcccggtctgtattatgtggacagtgaaggaggacgtctaaaaggaaacaaattctcagttggatcaggttcgccatatgcttatggtgtactcgacagcgggtatcgctatgatatgagtgtcgaagaagctgcagagctggcaaaacgatccatttatcatgccaccttccgtgacggagccagtggtggtgttgctagcgtttatcacgttggaccaaatggatggaagaagctgtctggggacgatgttggggagcttcactacatgtactatccggttgaacctactgttgtggagcaagagatgactgaagtcgctattgcctaactttgatatctttttcatcttgttaaattgttatatactgctgtatcacattattattactgcgctagttttcttttattattactgctcagaatatggaaacatttttattgaaagtttaagcatgagcaaaatactattacaagacgaaatat

SEQ ID NO: 2255 - DNA, 1219 bp, Beta vulgaris
tctctctctcacacacactgtctaactatccgatctgctattgaaggttaacaatatgaagcttgacacaagtggtcttgaatcaaccgcgccgctttttcggtctagcaatgtcatatttgatggcttgcagatgactccatcctttgagctccccaatgctctcgattttgatggatttcagaaggatgctatacagatggtgaagcctgcgaaggggactacaactcttgcttttatttttaaacatggtgtcattgttgctgctgattcccgagccagcatgggaggatatatatcgtctcaatctgtgaagaaaatcattgaaatcaatccctatatgcttggcaccatggctggtggagctgctgactgccagttttggcatcgtaacttgggcatcaagtgccggttacacgaactagcaaacaagcgaagaatttctgtcacaggtgcttcgaaattgctggcgaacattttgtataactaccggggcatgggtctttctgttggcacaatgattgctggttgggacgaaacggggcctggtctgtattacgtggacagtgaaggaggacgtctcaaggaatgcggttctctgttggttctggttcaccatatgcttatggtgttcttgacaatgggtaccaatatgatatgaccgttgaagaagcatcagagcttgccagaagagctatttaccatgccacataccgtgatggagctagtggtggagttgtcagtgtttatcatgtcggacctgatggatggaagaagctcactggggatgacgttggagaacttcactatcagtattacccggttgtgcctgccacagtagagcaggaaatggctgaagtaggtgcagcttaagactggatgtggaagaatacgtatcttctagttgccgtagaagtgccgaatgatgtaatgctttaatcagttgggtgaattgcccttaacgaggtgactctctgcagttccctgatgatttattgagttctcatgtgaacagaaccagctgtatgttatattgtactgcaaaactaacactttgaggttgtagtcatagcttcaatgaattgcgcttgggttctgcagagattcttagtgaaaactgaaagtgaatgctttgagatgttacctcctttcaggtttcatgcgctttctagtgaaactttttcatctctttaatttattgtcatcaaatgatactatt

SEQ ID NO: 2256 - DNA, 1049 bp, Amorphophallus konjac
tctctttctttcatctcagcaggtcggaggagatcaacaccagggagcactgcttccagccttccatctctcgacaaggttttgaaggatgaagctcgacacaggcggccttaattctttggcttccttctacgggggagacaacgatcttggagagaactcgctttcagccgcatcatcctttgagcttcccagaacgaccgattttgatggtttccaaaagaaagctgtggagatggtgaagccggcgaaggggacgacaactcttgcctttatttttaaggaaggcgttatagttgcggctgattcacgggcgagcatgggtggatatatctcttctcagtctgtgaagaaaatcattgaaatcaatccatacatgcttggcacaatggctggaggggccgcagattgccaattttggcatcggaatttgggcattaagtgtcgtctacatgaactggcaaacaagaggaggatttcagtgacaggtgcttcaaaattgttggccaatattttgtattcctacaggggtatgggcctttcaattggaactatgattgctggatgggatgaaacgggccctggcctgtactatgttgatgctgaaggaggaaggcttataggcaaaaggttctctgtggggtcggggtcaccatatgcatacggtgttttggacagtgggtatcgctatgacatgtctattgaagaagctgcagaactggctcgacgagctatctaccatgcaacatttcgtgatggagctagtggtggagttgctagtgtttaccatgttggacctgatggctggaaaaagctctccggtgatgatgttggcgagttgcactaccagtactatccagtcatcccgagccctgttgagcaggaaatggttgagataccaatatcttgagcggtcctgactgcttttagggtcacatacttcaattgaaattcccgtttggctttacccctctgatgttttgttttgtatacgttaaatgctgtgtctacacagaacccaaatttctccaatgtcatatttgaaggtt

SEQ ID NO: 2257 - DNA, 993 bp, Amsonia hubrichtii
aaggtcacaatggtgaagattgactttagcggacttgattcgactcctcaatttcgggggaacagcgatgaattgctctgtgggatttcgactgccccggcattccagattccccacactaataattttgatgggtttcagaaagaagcgatccaaatggttaagccagccaagggaaccacaactctagctttcatattcaaggaaggtgttatagtggctgcagattcacgtgctagcatgggaggatatatttcatcacagtcagtcaagaaaatcattgaaatcaatccctacatgcttggtacaatggctggaggtgctgctgactgccagttctggcacagaaatttggggattaagtgccgtctgcatgaacttgcgaataagagaagaatttctgttactggggcatcaaagttactggccaacattctatattcttaccgtggtatgggcctgtccgtgggcacaatgattgctgggtgggatgaaaagggtcctggcctgtactatgtagacagcgagggtggaagacttaaaggaaaccgattttctgtgggatctggttcaccttatgcatatggtgttctagacagcgggtaccgctttgatatgtccgtcaaagaagctgcagagttggctcgacgtgctatttaccatgccacattcagagacggtgccagtggtggtgttgtcagcgtctatcatgtcggacccaacggatggacaaagctatccggagatgatgttggggaacttcactacacatattatccagttgaaacaacaccaatcgaacaggaaatggctgaagtttccttttcttgagaagatagtacaggggaaaagttccttttatgttctccacgaatttttagatattttctgaacaaatcttttcgaatagtattctggttttgtcattgttgataaatcttgtcattctcaaccaaatcgttgctaacaactttcaaattttatttaattaac

SEQ ID NO: 2258 - DNA, 1170 bp, Catharanthus roseus
gcttttagaaacagggtcgacgttgcaaaaacaccttacatcgccgaggaccaccgcgatcctccgcccgccaccttcgactgccctcgatctcctctgttactgcgataggcttggaattactttccttcatccgctcgttactgatttgaaggtgacaatgttgaagattgactttagcgaacttaattcgacccctcaattttgcgggaacagcgatgatttgctgagtgggatttcggctgcccctacgttcccgattcctcacaccaatgattttgacgggtttcagaaagaagcaatccaaatggttaagccagccaagggaacaacaactctggctttcatattcaaggaaggtgttatagtggctgcagattcacgtgccagcatgggaggatatatttcgtcacagtcagtcaagaaaatcattgaaatcaatccctacatgcttggtactatggctggaggtgctgctgactgccagttctggcacagaaatttggggattaagtgtcgactacatgaactagcaaataagagaagaatttcagttactggagcatcaaagttgctggccaacattctatactcttatcgcggtatgggcctgtccgttggcacaatgattgccgggtgggatgaaaagggtcctggtctttactatgtagacagcgagggaggacggcttaaagggaaccgattttctgttggatctggatcaccttatgcttatggtgttcttgacagtgggtaccgctttgatatgtccgttgaagaagctgcagagttagctcgtcgtgctatttaccatgccacattcagagacggtgctagtggtggcgttgttagcgtttatcatgttggacctaatggatggaaaaagctctctggagatgatgttggggaacttcattacacttattatccagttgaaacaacaccaattgaacaagaaatggctgaagtttccatttcttgaacagaaaatggcttgaagttaccaaatcatttggagtattgcctcttagttgtgatagttcttgactttgaatgtgaaattatatgttttttaatccaaagttttttctgattttttaagccatatacattaaagctgtatctgaatttgatatggtatctccatcaatttatgttttattaaaaatg

SEQ ID NO: 2259 - DNA, 1101 bp, Orobanche aegyptiaca
ctctcagtttcatcaaattcctccgattaaatttctacatctgcaattgttcttcttaaaatctactcagaaatcaggaagcgatgatgaaaattgattttagtgggctcgatccctcagcaccgattaagggaaacacagatgatttccatgatgagatttcggctataccatctttcaagctgcctactactgttgattttgatggatttcagaaagctgcagtacagatggtgaagcctgcaaaggggacgacaactttagcgtttatattcgaaggaggtgtcatggtagcagctgattctcgtgcgagcatgggaggatatatttcttcgcaatctgtgaagaaaatcattgaaatcaatccgtacatgcttggtacaatggctggaggagctgctgactgccagttttggcacagaaatctgggtatcaagtgccgtttacatgaattggcaaacaagagaaggatttctgttgctggagcttcgaagttgttggcgaacattctatattcttaccgaggaatgggtttgtctgttggaactatgattgctggctgggatgaacagggtcctggtctctattatgtggacagtgagggtggacggcttaaaggaactagattttcagttggttctggttcaccatatgcttatggtgttttggacagtgggtaccgttttgatatgtcggtagacgaagctgcagagttggctagacgggcaatctatcatgccacattccgtgatggagctagtggtggtgttgccagcgtatatcacgtgggtccagttgggtggaagaagctatcgggtgatgacgttggagaacttcactaccactactatcctgtcgaacctacaactgtggaacaggagatgactgatgtccctattgcttgcccatgatgactcataggattcggttcatttgcttcggatcttatgttagacgatattatctgaatgaattctgcatctgtttgtaacattttaaattctgaattaaacatcttgcattcactaatatttcactatttctgcacaatgaaatctcttcgacccgtgatctttcctttagaaaaaatatcagaataaa

SEQ ID NO: 2260 - DNA, 935 bp, Senecio madagascariensis
tcgagcggccgcccgggcaggtcttgactttagtggactagaatcgggtgtaccacactacggggtacataacgagttactatctgatggattctcagacgcaccttcatttgatcttccagttacatcagactttgatggattccagaagaattctatccaaatggtaaagccagcaaagggaacgacaactttggcttttatcttcaaggacggtgtaatggttgctgctgattctcgagctagcatgggaggctatatctcatcccaatctgtgaagaaaatcattgaaatcaatccctatatgcttggaacaatggccggaggagctgctgattgtcaattctggcacagaaatctcgggatcaagtgtcggttacatgagttggcaaacaagagaaggatttcagtaactggtgcttcaaagctgctggcaaatattctatattcttaccgtggaatgggtttatctgttgggacaatgattgcaggatgggacgagaagggtccaggtttgtattatgtggacagtgaaggaggacgcctaaaaggacaaaagttctctgttggttctggttcaccgtatgcttatggtgtattggatagcgggtacaactatgatatgtcaatcgatgaagccgctgaattggctagaagagccatttatcatgcaacattccgtgatggagacctgcccggggtgttgctagcgtttatcacgtgggacctactggatggacaaagttatcgggtgatgatgttggtgaacttcactactcatactatcctgttgaaccagctgttgttgaacaagaaatggccgaagcataactgcccgagtggaaaccagttgctggttatttgttataaaaacgtgttctcagaatgtactttgtgacaatttccgactcttacttgtttgctagggtttgaca

SEQ ID NO: 2261 - DNA, 1079 bp, Triphysaria pusilla
aatttttatccgattagttttcaacgtttgcaattgttcttctcaaaatctgcagaaaccaggacacgatgatgaaaatcgattttagtgggcttgacccggtagcaccaataagaggaaacagagatgatgagttgactgatgagatttcggatataccatctttcaagcttcctagtcatgttgatttcgatgggtttcagaaagcttctgtacagatggtgaagcctgcaaagggaacaacgactttggcatttatattcaagggtggtgtgatggtggctgctgattctcgtgcgagcatgggcggatatatatcatgcaatctgtgaagaaaatcatagaaatcaatccgtacatgcttggtaccatggccggaggagctgctgactgccagttctggcacagaaatctcggaattaagtgccgtttgcatgaattggcaaacaagagaagaatctctgttgctggagcttcaaagatgttggctaacattctctattcttaccgcggaatgggtttatccgttggcactatgattgctggctgggatgaacagggtcctggtctctattacgtggacagtgaaggtggacgacttaaaggcaccagattctcagtcggctctggttcaccatatgcttatggtgttttggacagtggataccgtttcgatatgtcggttgaggaagctgctgagctggcaagacgatccatctatcatgcaacattccgtgatggagccagtggtggtgttgctagcgtgtatcacgtggggccagttgggtggaagaagctatcaggggatgatgtcggagaacttcactatcattactatcctgtcgaacctgcaactgtcgaacaagagatggctgatgttcctgttgcttaatggtatgctaaactaggatttttagtttcatttgattcggattgtacgtgagacgatatttgcttcggtttgtaactttttaattcgatccatgatctttttcgggaagaaaatagatgggaagttgttatggacacacttcagcttgtgcaatgtcactatttttatgggcacaaatgttatattg

SEQ ID NO: 2262 - DNA, 1205 bp, Picea glauca
tggacggcctgtctatcctccggttctcgttctgagttgcaagatgaagcttgacttgagtggtcttgagcctgcaactctccatcagctgtcaaatgataacctttgcgatgtcttctctccaactccatcattcgagattcctaacgataccgattttgacggctttcaaaagcagcagtgcaaatggtgaaaccagcaaaagggacaacaactttggcatttatattcaaggaaggaatcatggttgctgctgattctcgtgccagcatgggaggatatatttcatcacaatctgtgaagaaaattattgaaatcaatccttatttacttggtactatggccgggggtgcagctgattgccaattctggcacagaaacctgggcattaagtgtcggttgcatgagctggcaaacaagcgaagaatatcagtgacaggtgcttctaaattgttggctaatatcctgtactcatatcgaggaatgggcctgtcaataggcacaatgattgctggatgggatgaaacgggccctggcctatattatgtagatagtgaaggaggaagacttaagggaacacgtttttctgttggatctggttcaccatatgcctatggtgtcctggacagcgggtatcgctgggatatgccagtggaagaagctgcagaactagctcgccgttctatataccatgcaacgttccgtgatggtgccagtgggggtgtggcaagtgtgtactatgtgggtcctcaaggttggaagaaattgtctggtgatgatgttggtgaacttcatttcaaatactatccagtcacagaaaatgttgtagagcaggagatggtcgaagtcagtgcttgaaagcctctatagattgcaccatgtatcttgaggttgctggctttacaagctgatgcttgttttttatgcaagttttcctttcctagtgctattatacatttggcaaagaggaaaccttgataattaactttgtcctttcttattcgagggaggtttctggttgaaacaatcaagatttgcaatcataaaatttttcaattactagttacgccaattaaagaagctcaatcatgcatcaatttattgtggttagcaataccattgtactgtttagcaacggattaatgcagtttcttttggttgacataagtttggtgtatttgacttatgaaatggtctcattaata

SEQ ID NO: 2263 - DNA, 1016 bp, Panax ginseng
gttgtagttatgaagatagacttcagtggactagaatcatctgtaccactttgtggggcaaacaccgagctgtttgatggtttttcaagtgctccaacattccagattcccgataccactgatttcgatggctttcagaaagaggctatccaaatggtgaaaccggcaaagggaacaacaactcttgctttcatttttaaagagggtgtcatggtggctgctgattctcgtgctagcatgggaggctacatctcatcacaatctgtgaagaaaatcattgaaattaattctcacatgcttggtacaatggctggaggtgctgctgactgccagttttggcacagaaacttaggcattaagtgccgtttgcatgaactggcaaataagagaaaaatttcggtgactggggcttcaaagttactggcaaacattctatattcttaccgtggaatgggtttgtcagttgggacaatgattgcaggttgggacgaaaagggtcctggactgtattatgtagacagtgaaggaggaaggctcaagggaatcaggttctctgttggatctggctcaccatatgcttatggtgtactggatagcggataccgatatgacatgacaatagaagaggctgctgagttggctagacgatccatttatcatgcaacatttcgtgatggagcgagtggtggtactgctagtgtttactatgtcggaccaaatggatggaagaagctatctggtgatgacgttggagaacttcactacaagtactatccagttgaaccatcggtggttgaacaggatatggcggaagtgtgaagagcctgagaaatcaaggaccattacttcaaaaaatgcatgtaaaatgtttggatttgaaacaattattagacctgaatatagcttagaacttcttcctggttatgaacaatataactgggcatcattgtttggtgttagttgtgaagtttttagaaaaatatgcctgatacatcgttattgttttcttaaagtta

SEQ ID NO: 2264 - DNA, 1114 bp, Panax ginseng
ccccccctatcccctgtgtgccttgcctcccacgactaagtatagtattgctcaagaaaactttattcgtagtttcatatatttatgcccaccaatcggcaaacaatctctttctctcttacaggttgtagttatgaagatagacttcagtggactagaatcatctgtaccactttgtggggcaaacaccgagctgtttgatggtttttcaagtgctccaacattccagattcccgataccactgatttcgatggctttcagaaagaggctatccaaatgttgaaaccggcaaagggaacaacaactcttgctttcatttttaaagagggtgtcatggtggctgctgattctcgtgctagcatgggaggctacatctcatcacaatctgtgaagaaaatcattgaaattaatcctcacatgcttggtacaatggctggaggtgctgctgactgtcagttctggcacagaaacctaggcattaagtgccgtttgcatgaactggcgaataagagaagaatttcagtgactggggcttcaaagttgctggcaaacattctatattcttaccgtggaatgggtttgtcggttgggacaatgattgcaggttgggacgaaaagggtcctggactgtattatgtagacagtgaaggaggaaggctcaagggaaccaggttctctgttggatctggctcaccatttgcttatggtgtactggatagcggataccgatatgacatgacaatagaagaggctgctgagttggctagacgatcaatttatcatgcaacatttcgtgatggagcgagtggtggtactgctagtgtttactatgtcggaccaaatggatggaagaagctatctggtgatgacgttggagaacttcactacaagtactatccagttgaaccatcggtggttgaacaggatatggcggaagtgtgaagagcctgagaaatcaaggaccattacttcaaaaaatgcatgtaaaatgttttgatttgaaacaattattagacctgaatatagattagaacattcttcctggttatgaacaatataactgggcatcattgtttggtgtgtgttgtgaagtttatagaaaaatatgcctga

SEQ ID NO: 2265 - DNA, 1050 bp, Triphysaria pusilla
gcaattgttcttctcagaatctgcagaaaccaggacacgatgatgaaaattgattttagtgggcttgacccggtagcaccaataagaggaaacagagatgatgaattgactgatgagatttcggaaataccatctttcaagcttcctagtcatgttgatttcgatgggtttcagaaagcttctgtacagatggtgaagcctgcaaagggaacgacgacgttggcatttatattcaaaggtggtgtgatggtggctgctgattctcgtgcgagcatgggaggatatatatcatcgcaatctgtgaagaaaatcatagaaatcaatccatacatgcttggtaccatggccggaggagctgctgactgccagttctggcacagaaatctcggaattaagtgccgtttgcatgaattggcaaacaagagaagaatttctgttgctggagcttcaaagatgttggctaacattctgtattcttaccgcggaatgggtttatccgtcggcactatgattgctggctgggatgaacagggccctggtctctattatgttgacagtgaaggtggacgacttaaaggcaccagattctcagtcgggtctggttcaccatatgcttatggtgttttggacagtggataccgttttgatatgtcgattgaggaagctgctgagctggcaagacgatccatctatcatgcaacattccgtgatggagccagtggtggtgttgctagcgtgtatcacgtggggccagttgggtggaagaagctatcaggtgatgacgttggagaacttcactatcattactatcctgtcgaacctgcaactgtcgaacaagagatggctgatgttcctgttgcttaatggtatgctaaactaggatttttagtttcatttgcttcggattgtacgtgagacgatctttgctttggtttgtaactttttattcgatccatgatctttttcgggaagaaaatagctgggaagttgttatgggcacacttcagcttgtgcaatgtcactatttttatgggcacaaatgttatattg

SEQ ID NO: 2266 - DNA, 1988 bp, Musa acuminata
ccttcccccgtcgcctattaactcgtcactcgatctagggtttcttctcgcttgttctcgactcatctcccctcctcgtcttcgcatctcgtggatcatgaagcttgatctgagtggtcttcagtcgtttacttcgatccccggcggcgccgtcgacggtctcggggaagacctcttcgcggccccttcgttccaacttccggcctgctccgacttcgatgggtttcagaaggacgcgatccagatggtgaagccagcgaaagggacgacgacgctcgccttcatcttcaaggaaggcgtcattgtcgccgccgattcgcgtgctagcatgggaggatatatctcttctcagagtgttaagaaaattattgagatcaatccatatatgcttggtacaatggctggaggtgctgcagattgccaattctggcacaggaacttagggatcaagtgccgcctgcatgaactggcaaacaagagaaggatctcagtcacaggtgcttcaaagctgttggcaaacatactttactcttatcgtggaatgggcctttcagtaggaaccatgatcgctggatgggatgaaaaggggcctggattgtactatgttgacagtgaaggtggaaggctcaagggaacacgcttttcagttgggtcaggaagtccatatgcttatggtgttcttgatagtgggtatcgttttgacatgccagtcgaggaagctgcagaactggcacgccgagccatttaccatgcaacttttcgtgatggagctagtggtggagtggctagtgtttatcatgttggccctgatggttggaagaaactttctggagatgatgtgggtgagcttcattacaagtattatcctgtggccccaacccctgtggagcaggaaatgaccgacgccccagcagcctgagagagcagcctttgattctttcaaattcctgttgggtgcggtaaattgaacctggtaatagtagttcatacataaacttgacatgttgaaagcagctttatcggacctttgtagtctgattaaatttaatcgtgatcaccgtctttttctttcattcaagcatgagaaaacgtcatcttcaactgaaaggaagaaacatcaatctgaattttatgttgatgaatcgccaggttgtgttgaatccctcggatggatgcttgatcgttgttgcatttgatctacatgctgttcactaatttgagttgctgccctctcaaattggcgttaacatttgcatatcattgaatttgatcgaccggcctaatcttctccatatgatgtctttgtctgtagaagttattttcattagacgttgcttcatctttctatttcagtcataggttggttgatatgaactaccatcccatcccgaatccagtcaccaaagcatccaaatagctacaacaaaaccactattcaggcatttaggtctgcttgcgactgtaatgtaattgctagcaattatgaatacttgttaagaaaactttcatgtgtggagatgaattaaggatagtcactagaagaaggtagaagagatggagtctatacacatgatagtggtctcacaacttactgctagagatatagtgacaatcgcgagctgtactgtgtcaaggtgggcaacatcgtcgtctacaagcatgacggtttaaccaacgggtgcatgaacctgactgacggcacaagtgcaacaacagaccaacctcacctccaggactcgatcttacttgcagcgcttctccgacaacctccagaccaatcccccatcatcgaaatcctacgaagattcagcaccactcaggctacctcaatcgtagcacccatcgcgtcgccaacccccagtaaaccttctcatctcggccacgatagagagagtacgtaagtccgcgttttccgacgaaaagctagattcctgccaaatttcttgtattggaaaggtgggcggggcagagactgtcatgatggggga

SEQ ID NO: 2267 - DNA, 939 bp, Cucumis sativus
attccgatcatttccatcgacgttgtgtgttttttttttgtgaggttgtagttcgcgttcctgttctcctattgctcttgattctacctcaaggagttgaaatatgaagcttgataccagtggtcttcaaacaaccgccccgctgtttgggccaacaatggaggctatggaagggtttgcagctgctccatcctttgagatccctaattccagtgactttgatggctttcagaaagatgccattcaaatggtaaagccagcaaaaggaacaaccacactggcttttatttttaaggaaggagtcatggttgctgctgattctcgtgccagcatgggaggctatatatcatcacaatctgtgaaaaaaattattgaaatcaatccttacatgcttggcactatggctggaggtgctgctgattgccagttttggcatagaaacctcggtgttaagtgccgcctacacaagttagcaaacaagcgccgaatttcagttgcaggagcctccaaattactggccaacattctgtactcctatcgtggaatgggtctatctgttgggactatgattgctggatgggatgaaacaggtcctggtctatattacgtagacagtgagggagggaggctgaaaggaacaagattttctgttggatctggttcaccctatgcctacggtgtcttggataatggatatcggtatgacttgtctgttgaagaagctgctgaactggctagacgagctatttatcatgcaactttccgagatggtgccagtggtggagttgctagcgtttattacgtgggaccaaatggatggaaaaagctatctggcgatgacgtaggagaactccattacaactactatcctgtgacaccaactacagtcgatcaggaaatgactgaagtaaccgccgcttgatgatccgatatagactt

SEQ ID NO: 2268 - DNA, 1284 bp, Pinus pinaster
aggggaaaagatcatccaacttctctttccttcttcctcaagtaaaggcaatgatagcaaaaccatattcatgttcacatgttcacgtcgctgcgagtgagattataaaaacaggggggataccagcaatcgcagtgttcaaagcgaggaaacatcaggttgcaagatgaagcttgacttgagtggccttgagcctgcaaccctccatcaacagtcagatgataacctctatgatgtcttatctccaagtccatcattcaagattcctaatgatacagattttgatggcttccaaaaggcagcattgcaaatggtgaaaccagcaaagggaacaacaactcttgcatttatattcaaggagggaattatggttgctgccgattctcgtgccagcatgggaggatacatttcatcacaatctgtgaagaaaattatcgaaatcaatccttacttacttggtacaatggctgggggtgcagctgattgccaattctggcacagaaacctgggcattaagtgtcggttgcacgagctggcaaacaagcggagaatatcagtgacaggtgcatctaaattgttggctaatatcctgtactcataccgaggaatgggcctgtcagtaggcacaatgattgctggatgggatgaaacgggccctggtctatattatgtagacagtgaaggaggaagacttaagggaacacgtttttctgttggatctggttcaccatatgcctatggtgtcctggacagcgggtatcgctgggatatgccagtggaagaagctgcagaactagctcgccgttctatataccatgcaacatttcgtgatggtgccagtgggggtgtggcaagtgtgtactatgtgggtcctcaaggttggaagaagttgtctggtgatgatgttggtgaacttcatttcaaatactatccagtcacagaaaatattgtagagcaggagatggttgaagtcagtgcttgaaagcctcaattgatgcaccatgtatcttgaggttgctggctttacaagctgatggtcattttgtatgcaagttttccttttctagtgctattatccatttggcaaaggggatatcttgattattaacttcctccattcttatttgagggaggtttctggttgaaacaatcaatatttgcaatcacaaattttttaattactagttaagccaagtaaagatgcttaaacatgcatcaattcattgtgtttagcaataccattgtattagcaacggattaatgcagttacttttggttgacaca

SEQ ID NO: 2269 - DNA, 1118 bp, Primula obconica
cagtaagaaagacgtacagcttcctccctccacctcgtttcgctctcaaggtaaactttatccggaggtgtagattcggtgaaaccataatcagataatttcttgaactcggttaaatcctttgaaagcaacacaatcatgaagctcgacacaagtggtcttcaagcccacggaccagtccttggaggtagcgacgagcttttcagtgggataccaacggctccctctttcgaaatccctaacactactaattttgatggctttctgaaagacgctatacaaatggtgaagccagcaaagggcacaactactctggctttcatattcaaggacggtgttatggttgctgctgactctcgagcgagcatgggaggctacatctcctcgcaatctgtgaagaagattattgagattaatccttacatgcttgggacaatggctggtggagcagctgactgccaattttggcatagaaatctcggcattaagtgccgactccatgaacttgcaaataagcgtagaatttctgttactggggcctcgaagctcttggcaaacattttatacaattaccgtggaatgggattgtctgttggaaccatgattgctggttgggatgaaacgggtcctgggctgtattatgtggacagtgaaggtgggcgtctgaaggggatgagattctcagttggatctggttcaccctatgcctatggggttctcgataatgggtatcgatacgatatgagtgtggaagaagctgctgagttggctaggcgtgcaatttatcacgctacattcagggatggagcaagtggtggcgttgccagcgtatatcacgtgggacccaatgggtggaagaaactctccggagacgacgttgcagaacttcactacaattactatccggtacagcctgctctggttgagcacgagatggccgagacttcgtaatttgtgacgttgctttggcgtttattccatagactcttttatctttcacctgtgttgttggcatgctatttttccttttttgttaagactgaattcggcatcggtatctgctttacgttcaaacatatttcagttccggaaacctataaatttctgattaaaccttt

SEQ ID NO: 2270 - DNA, 1710 bp, Picea glauca
cggggtaattagtaaattgtaaaaaaagagatatatataaacatttttaaaaagaccggctttatcattcttaaatttgttgatttattgttgattgcgagggttctgtctcgaatctctccataaaagggttcggctgattacagttttggcttctaatacccagctacactttaatttctcattgttctcaacttattgacgggagtttttgcgaatttggtggtgtttgggttggttttggtctagtctactatttttcttccttggacggcctgtctatcctccggttctcgttctgagttgcaagatgaagcttgacttgagtggtcttgagcctgcaactctccatcagctgtcaaatgataacctttgcgatgtcttctctccaactccatcattcgagattcctaatgatgccgattttgatggctttcaaaaagcagcagtgcaaatggtgaaaccagcgaaagggacaacaactttggcatttatattcaaggaaggaatcatggttgctgctgattctcgtgccagcatgggaggatacatttcatcacaatctgtgaagaaaattattgaaatcaatccttatttacttggtactatggccgggggtgcagctgattgccaattctggcacagaaacctgggcatcaagtgtcggttacatgagctggcaaacaagcggaggatatcagtgacaggtgcttctaaattgttggccaatatcctctattcatatcgtggaatgggcctgtcagtaggtacaatgatcgctggatgggatgaaacgggccctggtctgtattatgtagacagtgaaggaggaagacttaagggaacacgtttttctgttggatctggttcaccatatgcatacggtgtcctggacagtgggtaccgctgggatatgccagtggaagaagctgcagaactagctcgtcgctctatataccatgcaacatttcgtgatggtgccagtgggggtgttgcaagtgtgtactatgtgggtcctcaaggttggaagaagttgtctggtgatgatgtggcggaacttcatttcaattactatccagtcacagaaaatattgtagagcaggagatggttgaagtcagtgcttgaaaatatcttacgcattgcaccatgtatcttgagtttactggcttactctacaagctaatatgtgttttgtatgcgagtattctcattctttagtgtcatgattcatttgggaaatgagaaaccttgattattaactttgtcctttcttactatagggaggtttctgttggaaacaatctagattttcaatcataaagtttttcaattactagttaagcctgacttttgaaacggtctccttaatattgattatgcattagtgtaaactatacaaatcttgggcttcagttactgtattctccacttctttgcatgaggttgcgtatggtgtacttgatatgaaggttactggaaacgttgctcgtagtgatggaaatctacaggggtgtgacctcagattatgattttccatgagtcaataaaacttgatttatggttaatgtagaatttatagtcaggttggaaaggatggcaacgtcctccttaatgtatcttttccatttttagaagaccctgcaatgttgcaaatgtagttttggggaatatatggaagagggtttggaaaaaaactcatcagaaatatt

SEQ ID NO: 2271 - DNA, 1105 bp, Vinca minor
ccaccttccaccgcctccaatctcctccatcctcactgctatagcgtgggaattactctccttcgtcttctcttccctgactaaaaacgtttacaatgatgaagattgactttagcggacttgattccactcctcgattcagtgggaatagtgacgaattgttcaatggaaattcgaaatcgccttcattcccgattcctgatactaatgattttgatgggtttcagaaagaagcaattcaaatggttaagccagctaagggaacaacaactctggctttcatattcaaggaaggtgttatagtcgctgcggattcgcgtgctagcatgggaggatatatttcttcacagtcggtcaagaaaatcattgaaatcaatccctacatgcttggcacaatggctggaggtgccgctgactgtcagttctggcacaggaatttgggaattaagtgccgtcttcatgagcttgcaaataagagaagaatatcagttactggggcatcaaagttactggcaaacattctatactcttaccgtggtatgggcctgtcagtgggcacaatgattgccgggtgggatgaaaagggtcctggtctgtactatgtagacagcgagggaggacgtcttaaagggaaccgattttctgttggatctggttcaccttatgcttatggtgttctagacagcgggtatcactttaatatgtccgttgaagaagccgcagagttggctcgtcgtgctatctaccacgccacattcagagatggtgccagtggtggcgttgtcagcgtctatcacgtcggagctaacgggtggaaaaagctatcgggagatgatgttggggagcttcactacacatattatccagttgaaacaacaccaattgaacaggaaatggctgaagtttccatttcttgaaaagatagtattctccacaaccctttataaatttcttgaacaaatcttttggagcatctccggattgtaatagtttctcttgttcttgattctgcctgtgaatctacatactttctccaaatcttgatctgatttgttcccggattttgtgtatcaaatttttaatcatttatgaaaaggttgtatga

SEQ ID NO: 2272 - DNA, 1197 bp, Aquilegia formosa
cttctcgctctttatattttctcataaacacaaacacgaagaagaaaaagaaaaaaacaaaagatttaaaaccagatctctcgaacgaaaccacattctttcaatcataactctcaaaggttttagaaatatgaatatcgatttcagtggaattggatcacaatcatcttcagctttatttaatggaagtaatgagattggacttggaaaagaaggatttgatacacctccttcttttgaactaccttgtagtactgattttgatggatttcagaagaaagctatacaaatggtgaaacctgctaaaggaacaacaacacttgcttttatctttaaggaaggtgttatggttgctgctgattctagagctagcatgggaggatatatctcatcccaatctgttaagaaaattatagagataaatccttacatgcttggcacaatggctggaggagctgctgattgccagttttggcatagaaatctgggcattaagtgccgtttgcatgagctagcaaacaagcgtaggatttcagttactggggcctcaaagctgctggccaacattttgtactcgtaccgtggaatgggtctttctgttggaaccatgattgctggatgggacgaaacgggtcctgggttgtactatgtagatagtgaaggaggaaggctgaaaggaacacgattctctgttggatctggttcaccgtatgcttatggtgtattggataatgggtatcgttatgacatgtctattgaggaagctgctgaattggctcgtcgatctatctaccatgcaactttccgtgatggtgctagtggtggagttgctagcgtttattacgttggaccaaatggatggaagaaactatctggtgatgacgttggcgagctgcactacatgtactacccagttgtcccgagcacagtcgaacaagagatggctgaggtatctggcgcttgagtcaagcgagaccgcctagtcaaattcatatcctatctgggcatctggtcttgtgttttattaacaaaaacaaatgaatttggcggaatttgttgaaatacatgataggctccttttatgtatgcattattaatttgttatgtaggtgcctgccattacactcttcttgatgacatgttttgtaaatttgacaagctaaaaatggttgattgttaacatatctggtattcagt

SEQ ID NO: 2273 - DNA, 1139 bp, Catharanthus roseus
ttttttcatatttcatcgtaatctcaagctttctctgcgactgtaaaggagtaacaatgatgaagattgactttagtgagcttgagtcgagggcttcatttccggatcaggcgaatgaattgttcagtggtctttccacagctcctgaatttcagattcctagcactgataattttgatgggttccagaaagaagcaattcagatggttaaaccagctaagggaaccacaactttggcattcatattcaaggaaggagtcatagttgcagctgactctcgtgctagcatgggaggatacatatcatcgcaatctgttaagaagatcatcgaaatcaatccctacatgctcggtacaatggctggaggtgctgctgactgtcagttttggcacagaaatttggggattaagtgccgccttcatgaacttgcaaacaaaagaagaatttccgttactggagcttcaaagttactagcgaacattctatattcttatcgtggtatgggattgtcagtgggaacgatgattgctggatgggatgaaaagggtcctggcctatattatgttgacagtgaggggggacggcttaaaggaaacagattctcagttggatctggttcaccatatgcttatggcgttctggatagcgggtatcgcttcgatatgtctgttgaagaagctgcagagttggccagacgtgctatttaccatgctactttcagagatggtgctagtggtggtgttgtcagtgtttatcacgtaggacctaatgggtggaagaagatgtctggtgatgatgttggagaacttcattatacgtactatccagttgagccaacagttgtggagcaggaaatggcggaggtatcagcttcttaaatagggtatctggggaatgctccttgaattcttcctacccccctctcacaaatttgtaatagatattaattgacatgaatatgtatggtattcttgtatacctttgcctcatctcctcttccaggctttttgtatgcccttttgcgtgttttgatgggaaaaattgattgacttttcattagaaatatggtaatctagtttaaacttccatgttctctaaaataacttagcagttttgagttgatcctttttcttttgcaa

SEQ ID NO: 2274 - DNA, 1757 bp, Populus trichocarpa
ataaaaaccgggcgcggagtcctgctcttgccttgcctgttgaacaagaaaagattatagctttaataaaacccagcaatccaattcttaagcttgaaatccagtagccagtaatcttactcgatctctgcacagattcttctctctcgcaatctctctcttcctaagataatgaagtttgatactagcggtctcgagtccactgcttcggtctttggaacggccggcagtgagcttgttgatgggttttctgctgctccagcttttgagctacccactactacagattttgatggcttccagaaggaagctgtacagatggtgaagccggccaaggggacaactacgcttgcctttatctttaaggatggtgtcattgttgcggctgattctcgtgctagcatgggaggctatatttcatcacagtcagttaaaaaaatcattgaaatcaatccctacatgcttggtacaatggctggaggagctgctgattgtcagttttggcacagaaatctgggcattaagtgccgactgcatgaattggcaaacaagcgtagaatatcagtcacaggggcatcaaagcttctggcaaacattctgtactcttaccgtggaatgggcttgtctgttgggaccatgattgctggttgggatgaaacgggtcctggactatattacgtggacagtgaaggtggaaggctgaagggaacaagattctctgttggatctggttctccatatgcatatggtatactggatagtgggtatcgatttgatatgtcaatcgaggaagctgcagagttgggcagaagagctatttatcatgcaactttccgtgatggagccagtggtggagtagcaagcgtttattatgtgggacctgatggatggaagaaattatctggtgatgatgtctcagagctccactacaattattatccagttgtgtcaactgaagcttcagaaccggaccgaatggttgaagcataaaggagggccttggtgctcatctttccaaaatgtagctctgtttctttcagcattgttttttgctgatgacatttcaaattactaattaaactctccttatggaggctttagaatttctaaattctcttgtgcttaaaaccttgaagatgaaatatattggatttggtacttgaggaatgggattgtagatatgccttttatacagttacaagcaacaaccagtgtaattcctgcttagaatgcaggggctcgaaacgtggagataggaggttaaaccgtatgcattgggggtcttacgagggctgttcttctatgttcctattttggtatgtgtgaactgacgactgttgaactgaacctatttgggggtataaatggcaccaatatttttcatgatcacattgaataaaaaccaaatgctcataagggcaagatttgacatcatgccacatcaattgctttccttcaatacaaagcaaaggattgtgtgatcctctctccctctctctgttgcttcaggtcggaaattgcgttcctaggctgaaacaaagcgtttctccttcccgattcaaaaggatgggagagcagagaaggtctttgtcaggaaatatacacacagacacggaaacctgatgcaatgccattttcctcagggaaagaagactccaaaattcttgcaaaccccagcaacagtacttgcttcggcctattacaggaacaatggagaccagtacttcaagcgacttcagagtgcagagagaggagtc

SEQ ID NO: 2275 - DNA, 1336 bp, Amborella trichopoda
ctcgtccctttctctctctctaaatttgcttatctttttctacacgtttacctcttcgacgctatctgagagggcaatcctcaaaactaatatttactaaatagtttttagagggggatctcgtttttgtgtcttctttctacattttttttctggaatcgagggtttcaagctttttggtctaggttcttcaataccactgaaaggcatcagaatcaggattaaacatgagacttgacacgagtggtcttaattctttggctccagcacatgtggtaaatgatgaactttgtgaaggatttatgtcactgccgtcattccagcttcctaacagtgcggattttgatactttccagaagaaagcagtgcagatggtcaaacctgcaaaggggacgacaactcttgcatttatatttaaagaaggagtgatggttgcagctgattctcgagctagcatgggaggatacatttcatcacaatctgtgaagaaaatcatagaaatcaatccttacttaattgggactttggctggaggggctgctgattgtcagttttggcataggaacttgggtattaagtgccgtcttcatgagttggcaaacaagcgacggatctcagttacaggagcttcaaaactactggctaatattctctactcataccggggaatgggcctatctgttggcaccatgattgctggatgggatgaaacggggcctggtttgtattatgttgacagtgaaggaggacggctcaaaggaacgcgtttttctgttgggtcaggttcaccatatgcatatggtgtattggatagcgggtatcgatatgatatgtcatgtgaagaagctgctgaattggcacgccgatctatatatcatgccacatttcgtgatggggccagtggtggtgttgctagcgtttattatgtgggacccaatggttggaagaagctttcaggcgatgatgttggggagctacattacaagtactatccagtgccaaagggcaatgtggaacaagagatggttgaagcctctagctgagattccatataaaaattatggacttgttatttatgtcctccgctcttttgcaggagggtcagttgggcctatttgttttcaaatctggtactttgtatgtccatgaagtgtgaaactgtgaaaacccgccccatttctacatcatttggaccttagtatacaatagtcacaatatttttttcctttctttttcgttttcttttttttgcttgaatgtgtcactgctttcatatccaaatatgctcatggaaacattttgcctttatcaaaaggatattttttctttgaaatgt

SEQ ID NO: 2276 - DNA, 1087 bp, Ipomoea nil
gttcatattcgccgattgtcccttaggttgagtcgacaccttcgttttattctcgatatttggtcgtaacaatggtgagaattgattttagtgggctcgaatcaactgctccgattcgcggtgagagttccgagttgtttgatgagattcccagagtcccatcttttcagattccaaatattactgattttgatggatttcagaaggatgcgatccaaatggtgaagccagctaagggaaccaccactttagcttttatttttaaggagggtgtgatggtggcagctgattctcgtgccagcatgggagggtatatatcatcacagtctgtgaagaagataattgaaataaatccctatatgcttggtacaatggcaggaggagcagctgattgccagttctggcacaggaatcttggtgtaaagtgtcgtctccatgaactggcaaataaaagaagaatttcagttgctggagcttccaagttgttggcaaacattctatattcttaccgtggaatgggcttgtctgttggaactatgattgctggctgggatgaaaagggtccaggactctattatgtggatagtgaaggtggacggctgaagggaaacagattctctgtgggatctggttctccatatgcttatggagttcttgataatgggtaccggtttgatttgtctgttgaagaagctgcagagttggctaggcggtctatttatcatgcaacgttccgtgatggagctagtggaggtgttgccagtgtttaccatgttgggccaaatggatggaagaaactgtcgggtgatgatgttggagagcttcactaccattactacccagttgaagcagcagcagtggagcatgaaatgaccgaagtgcccattgcttgaactgatccttttttagagaacaagagtgtgtgttcagaattgaaaagtgcaattttcaactttttttaagaaagtctaaacttattcgactctttttagtttgcactgaagtttatttgacccttttagttaagagattaaattgcactattgggtatttgggatactggttgatcagccattttcagtttatt

SEQ ID NO: 2277 - DNA, 1386 bp, Pinus pinaster
ctagagtaattgaaatgaaaatagggaatgcctaatatttttaaaagattgactttattcttaaataggttgttctcttcttgcttgcgaggattctggcacgaattttgtaccatcaaaaggttcggctgagcacagtttttgcttctaatacccggctccgcttgaatctgaatctcacattgttttcagcttatttacgggagtttctgcgaatttggtggtgttttgattggtttttgtccactcgaccgttttttttctctggaccactgtataggttcgggttcttgttctgagttgcaagatgaagcttgacttgagtggccttgagcctgcaactctccatcaactgtcaaatgatgatctttgtgatgttttcactccaggtccatcattcaagattcctaatgatgcagattttgatggctttcaaaaggcagcaatgcaaatggtgaaaccagcaaaagggacgacaacattggcttttatattcaaggaaggaatcatggttgctgctgattctcgtgcgagcatgggaggatacatttcatcacaatctgtgaagaaaattattgaaatcaatccttatttacttggtactatggctgggggtgcagctgattgccaattctggcacagaaacctgggcattaagtgtcggttacatgagctggcaaacaagcggagaatatcagtgacaggcgcttctaaattgttggcaaatatcctctattcatatagaggaatgggcctgtcagtgggtacaatgattgccggatgggatgaaacgggccctggtctatattatgtagacagtgaaggaggaagacttaaggggacacgtttttctgttggatctggttcaccgtatgcttacggtgtcctggacagtgggtaccgctgggatatgccagtggaagaagctgcagaactagctcgacgctctatataccacgcaacatttcgtgatggtgccagtgggggtgtggcaagtgtgtactatgtgggtccgcaaggttggaagaaattatctggtgatgatgtagcggaacttcattacaattactatccagtcacagaaaatgtcgtagagcaggagatggttgaagtcagtgcttgaaagcatcttctgcactgcaccatgcaacttgagtttactggcttactttacaaactactgcatgttttgtatgcaaattttctcgttctttattattgggaaagggaaaaccttgattattaattggcctttctcattataaggaggtttctgtcagaaacaatctatattttcaatcaaattttcaattactagttaagcctgactttcgaaataattgatgatacgctagtgtaaaccatacaaattataggcttcagtta

SEQ ID NO: 2278 - DNA, 1211 bp, Olea europaea
ttccaatcttcactattttaacgttttttctgttatttcttcacagtcacaatttctctgctataattcgacgaaaaagagggaaatgatgaagattgattttagtgggctcgcggcctcagccccacttcgtggcaacacggatgcattgtgcaatgagatttcgtctggacagaaatttgaacttcctattgctgctgattttgatgggtttcagagagaagcagtacggatggtgaagccagcaaagggaaccacaactcttgcctttatatttaaggaaggtgtcatggtggctgctgattcccgtgccagcatgggaggatatatatcatcacaaactgtcaagaaaatcattgaaatcaatccttacatgcttggcacaatggctggaggagctgctgactgccaattctggcacagaaatctgggaattaagtgccgtttacatgaattggcaaataagagaaggatttctgtgactggagcttcaaagttgctgtcaaacattctgtattcttaccgaggaatgggtttgtctgttggaactatgatagctggctgggatgaaacgggtcctggcctttattatgtggacagtgaaggaggacggcttaagggaactagattctctgttggatctggttccccatatgcttatggcgttttggacagtggataccgttttgatatgtctgttgaagaaggtgctgagctggctagacgtgcgatttatcatgcaactttccgtgatggagctagtggtggtgttgccagcgtttatcacgttggaccaaatggatggaaaaagctatcaggtgacgatgttggagaattacactatatgtactatcctgtggagcctgcgtctgtggaacaggagatgactgaggtatccgggtcgtgagagacttataagtagcagcataatttgacatcattctgttctgaagtacatgtggtttaatctgcaaatactcctaaactgagagacaacaaaactgtttttgcttgtagctttttgttgcaaattatgaaatgtaatttaatgtttatcctgtttgcctcaaatgaatgtttggaataagattatgaggatgtttgggaaatgattttttataagctctggaactcacaaattgtatgaaccataatgtacatgactaggtctcaaagctcataaaaaggccaacctggctatctcattttga

SEQ ID NO: 2279 - DNA, 1545 bp, Pinus taeda
gttctcttcttgcttgcgaggattctggcacgaatttgtaccatcaaaaggttcggctgagcacagtttttgcttctaatacccggctacgcttgaatctgaatctcacattgttttcagcttatttacgggagtttctgcgaatttggtggtgttttgattggttttggtccactcaaccgtttttttttctctggaccactgtatatgttcgggttctcgttctgagttgcaagatgaagcttgacttgagtggccttgagcctgcaactctccatcagctgtcaaatgatgatctttgtgatggtctcactccaggtccatcattcaagattcctaatgatgcagattttgatggctttcaaaaggcagcaatgcaaatggtgaaaccagcaaaagggacgacaacattggcttttatattcaaggaaggaatcatggttgctgctgattctcgtgcgagcatgggaggatacatttcatcacaatctgtgaagaaaattattgaaatcaatccttatttacttggtactatggctgggggtgcagctgattgccaattctggcacagaaacctgggcattaagtgtcggttacatgagctggcaaacaagcggagaatatcagtgacaggcgcttctaaattgttggcaaatatcctctattcatatagaggaatgggcctgtcagtgggtacaatgatcgccggatgggatgaaacgggccctggtctatattatgtagacagtgaaggaggaagacttaaggggacacgtttttctgttggatctggttcaccgtatgcttacggtgtcctggacagtgggtaccgctgggatatgccagtggaagaagctgcagaactagctcgacgctctatataccacgcaacctttcgtgatggtgccagtgggggtgtggcaagtgtgtactatgtgggtccccaaggttggaagaaattatctggtgatgatgtagcggaacttcattacaattactatccagtcacagaaaatgtcgtagaacaggagatggttgaagtcagtgcttgaaagcatcttatgcactgcaccatgcaacttgaatttactggcttactttacaaactaatgcatgttttgtatgcgacttttctcgttctttattattgggaaagggaaaaccttgattattaattggcctttcttattataaggaggtttctgtcagaaacaatctatattttcaatcacagatattttcgattactagttaagcctgatttttgaaacaatcgatgatacgctagtgtaaaccatacaaattttaggcttcagttactggattctccatctttttgcatgagattgtgtatggtgtgcatgatataaaggtcagtggaaacactgctcgtggtgatgaaaatctacaggggtttgacctcagctaatgattttccatgagtcaacaaatcttgatttgtggttcatagtgacgttgaaaaagatggcaacgtatcaatgttgcaactgtagttttggggagtatagaaaaaaaaaaaaaaaa

SEQ ID NO: 2280 - DNA, 1381 bp, Pinus taeda
acttcataattttatgttttttctatcagaaagtagcagggtttaattttacagttttgaagtcattgtcagagcttgatcgcgttggatttctgtaactgagaggggcggataccagcaatcgcagtgttcaaagcaaggaaacatcaggttgcaagatgaagcttgacttgagtggcctcgagcctgcaaccctccatcaacagtcagatgataacctttatgatgtcttatctccaagtccatcattcaagattcctaatgatacagattttgatggcttccaaaaggcagcattgcaaatggtgaaaccagcaaagggaacaacaactctggcatttatattcaaggagggaattatggttgccgccgattctcgtgccagcatgggaggatacatttcatcacaatctgtgaagaaaattattgaaatcaatccttacttacttggtacaatggctgggggtgcagctgattgccaattctggcacagaaaccttggcattaagtgtcggttgcacgagctggcaaacaagcggagaatatcagtgacaggtgcatctaaattattggctaatatcctgtactcataccgaggaatgggcctgtcaataggcacaatgattgctggatgggatgaaacgggccctggtctatattatgtagacagtgaaggaggaagacttaagggaacacgtttttctgttggatctggttcaccatatgcctatggtgtcctggacagcgggtatcgctgggatatgccagtggaagaagctgcagaactagctcgccgttctatataccatgcaacatttcgtgatggtgccagtgggggtgtggcaagtgtgtactatgtgggtcctcaaggttggaagaagttgtctggtgatgatgttggtgaacttcatttcaaatactatccagtcacagaaaatattgtagagcaggagatggttgaagtcagtgcttgaaagcctcaattgatgcaccatgtatcttgaggttgctggctttacaagctgatggtcattttgtatgcaagttttccttttctagtgctattatccatttggcaaagggatatcttgattattaacttcctccattcttatttgagggcggtttctggttgaaacaatcaatatttgcaatcacaatttttttcaattactagttaagccaagtaaagatgctcaaacatgcatcaattcattgtgtttagcaataccattgtattagcaacggattaatgcagttacttttggttgacacatgttggtgtatttgacttgtgaaatggtctcattaatattgataattggattaataaatctctgcaaattttgggcttcaattagtggatcctgtaccttttagc

SEQ ID NO: 2281 - DNA, 1115 bp, Primula obconica
ccattacggccgaaactctctctctatattctccttcgattttgatcaattctcagtgaaagaaacacaatcatgatgctcgacacaagtggtcttcaggcccacggaccagtccttggaggtagcgacgagctcttcagtgggataccaactgctccctcttttgaaatccctaataccactaattttgatggctttctgaaagatgctatacaaatggtgaagccagcaaagggaacaactactctggctttcatattcaaggacggtgttatggttgctgctgactctcgtgcgagcatgggaggctacatctcctcgcaatctgtgaagaagatcattgaaattaatccttacatgcttgggacaatggctggtggagcagctgactgccaattttggcatagaaatctcggcattaagtgccgactccatgaacttgcaaataagcgtagaatttctgtcactggggcctcgaagctcttggcaaacattttatacaattaccgtggaatgggattgtctgttggaaccatgattgctggttgggatgaaacgggtcctgggctgtattatgtggacagtgaaggtgggcgtctgaaggggatgagattctcagttggatctggttcaccctatgcctatggagttctcgataatgggtatcgatacgatatgagtgtggaggaagctgctgagttggctaggcgtgctatttatcacgctacattcagggatggagcaagtggtggcgttgccagcgtatatcacgtgggacccaatgggtggaagaaactctccggagacgatgttgcagaacttcactacaattactatccagtacagcctgctctggttgagcacgagatggccgagacttcgtaatctgtgacattgttgctttggcgtttattccataaactcttttatctttcacctgtgttgttggcagttaatatgctattttccttttttgttaagacttaattcggcatcggtatctgctttacgttcaaacatatttcagttctggaaacctataaatttctaattaaaccttttcttgcctgttcttattgtactttattttcgttgtactggattttcccctcaca

SEQ ID NO: 2282 - DNA, 1623 bp, Picea glauca
gatcattcttaaatttgttcattaattgttgattgcgagggttctgtctcgaatctctccataaaagggttcggctgattacagttttggcttctagtacccagctacactttaatttctcattgttctcaacttattgacgggagtttttgcgaatttggtggtgtttgggttggttttggtctagtctaccatttttcttccttggacggcctgtctatcctccggttctcgttctgagttgcaagatgaagcttgacttgagtggtcttgagcctgcaactctccatcagctgtcaaatgataacctttgcgatgtcttctctccaactccatcattcgagattcctaatgatgccgattttgacggctttcaaaaagcagcagtgcaaatggtgaaaccagcaaaagggacaacaactttggcatttatattcaaggaaggaatcatggttgctgctgattctcgtgccagcatgggaggatacatttcatcacaatctgtgaagaaaattattgaaatcaatccttatttacttggtactatggccgggggtgcagctgattgccaattctggcacagaaacctgggcatcaagtgtcggttacatgagctggcaaacaagcggaggatatcagtgacaggtgcttctaaattgttggccaatatcctctattcatatcgtggaatgggcctgtcagtaggtacaatgatcgctggatgggatgaaacgggccctggtctgtattatgtagacagtgaaggaggaagacttaagggaacacgtttttctgttggatctggttcaccatatgcatacggtgtcctggacagtgggtaccgctgggatatgccagtggaagaagctgcagaactagctcgtcgctctatataccatgcaacatttcgtgatggtgccagtgggggtgttgcaagtgtgtactatgtgggtcctcaaggttggaagaagttgtctggtgatgatgtggcggaacttcatttcaattactatccagtcacagaaaatgttgtagagcaggagatggttgaagtcagtgcttgaaaatatcttacgcattgcaccatgtatcttgagtttactggcttactctacaagctaatatgtgttttgtatgcgagtattctcattctttagtgtcatgattcatttgggaaatgagaaaccttgattattaactttgtcctttcttactatagggaggtttccgttggaaacaatctagattttcaatcataaagtttttcaattactagttaagcctgacttttgaaacggtctccttaatattgattatgcattagtgtaaactatacaaatcttgggcttcagttactgtattctccacttctttgcatgaggttgcgtatggtgtacttgatatgaaggttactagaaacgttgctcgtggtgatggaaatctacaggggtgtgacctcagattatgattttccatgagtcaataaatcttgatttatggttcatgtagaatttatagtcaggttggaaaggatggcaacgtcctccttaatgtatcttttccatttttagaagaccctgcaatgttgcaaatgtagttttggggaatatatggaagagggtt

SEQ ID NO: 2283 - DNA, 1622 bp, Picea glauca
tcattcttaaatttgttcatttattgttgcttgcgagggttctgtctcgaatctctccataaaagggttcggctgattacagttttggcttctaatacccagctacactttaatttcttattgttctcaacttattgacgggagtttttgcgaatttggtggtgtttgggttggttttggtctagtctaccatttttcttccttggacggcctgtctatcctccggttctcgttctgagttgcaaaatgaagcttgacttgagtggtcttgagcctgcaactctccatcagctgtcaaatgataacctttgcgatgtcttctctccaactccatcattcgagattcctaacgatgccgattttgacggctttcaaaaagcagcagtgcaaatggtgaaaccagcaaaagggacaacaactttggcatttatattcaaggaaggaatcatggttgctgctgattctcgtgccagcatgggaggatacatttcatcacaatctgtgaagaaaattattgaaatcaatccttatttacttggtactatggctgggggtgcagctgattgtcaattctggcacagaaacctgggcatcaagtgtcggttacacgagctggcaaacaagcggaggatatcagtgacaggtgcttctaaattgttggccaatatcctctattcatatcgtggaatgggcctgtcagtaggtacaatgatcgctggatgggatgaaacgggtcctggtctgtattatgtagacagtgaaggaggaagacttaagggaacacgtttttctgttggatctggctcaccatatgcatacggtgtcctggacagtgggtaccgctgggatatgccagtggaagaagctgcagaactagctcgtcgctctatataccatgcaacatttcgtgatggtgccagtggtggtgttgcaagtgtgtactatgtgggtcctcaaggttggaagaagttgtctggtgatgatgtggcggaacttcatttcaattactatccagtcacagaaaatgttgtagagcaggagatggttgaagtcagtgcttgaaaatatcttacgcattgcaccatgtatcttgagtttactggcttactctacaagctaatatgtgttttgtatgcgagtattctcattttttagtgtcatgattcatttgggaaatgagaaaccttgattattaactttgtcctttcttactatagggaggtttctgttggaaacaatctagattttcaatcataaagtttttcaattactagtgaagcctgacttttgaaacggtctccttaatattgattatgcattagtgtaaactatacaaatcttgggcttcagttactgtattctccacttctttgcatgaggttgcgtatggtgtacttgatatgaaggttactggaaacgttgctcgtgctgatggaaatctacaggggtgtgacctcagattatgattttccatgagtcaataaatcttgatttatggttcatgtagaatttatagtcaggttggaaaggatggcaacgccctccttaatgtatcttttccatttttagaagccctgcaattttgcaaatgtagttttggggaatatatggaagagggtttg

SEQ ID NO: 2284 - DNA, 997 bp, Picea glauca
caagatgaagcttgacttgagtggccttgagcctgcaaccctccatcagcggtcagatgataacctttgtgatgtcttttctccaagtccatcattcaagattcctaatgatacagattttgatggcttccaaaaggcagcattgcaaatggtgaaaccagcaaagggaacaacaactctggcatttatattcaaggagggaatcatggttgctgctgattctcgtgccagcatgggaggatatatttcatcacaatctgtgaagaaaattattgaaatcaatcctcacttacttggtacaatggctgggggtgcagctgattgccaattctggcacaggaacctgggcattaagtgtcggttgcatgagctggcaaacaagcgaagaatatcagtgacaggtgcttctaaattgttggctaatatcctgtactcatatcgaggaatgggcctgtcaataggcacaatgattgctggatgggatgaaacgggccctggcctatattatgtagatagtgaaggaggaagacttaagggaacacgtttttctgttggatctggttcaccatatgcctatggtgtcctggacagcgggtatcgctgggatatgccagtggaagaagctgcagaactagctcgccgttctatataccatgcaacgttccgtgatggtgccagtgggggtgtggcaagtgtgtactatgtgggtcctcaaggttggaagaaattgtctggtgatgatgttggtgaacttcatttcaaatactatccagtcacagaaaatattgtagagcaggagatggttgaagtcagtgcttgaaaatatcttacgcattgcaccatgtatcttgagtttactggcttactctacaagctaatatgtgttttgtatgcgagtattctcattctttagtgtcatgattcatttgggaaatgagaaaccttgattattaactttgtcttttcttactatagggaggtttctgttggaaacaat

SEQ ID NO: 2285 - DNA, 1202 bp, Citrullus lanatus
ttcctgtaaacattcttattgcggcatttgcccctccattccgatcatttccttcgaagttgtgtttctttgcttggttctaattcccgtttctgttctcttattgctctacattctagctcaaggagttgaaacatgaagctcgataccagtggtcttcaatcaactgccccgctgtttgggctaaaaatggaggttctggaagggtttgcagctgctccatcctttgagatccctaattccagtgactttgatggctttcagaaagatgccattcaaatggtaaagccagcaaaaggaacaaccacactggctttcatttttaaggaaggagtcatggttgctgctgactcccgtgccagcatgggaggctatatatcctcacaatctgtgaaaaaaattattgaaatcaatccttacatgcttggcacaatggctggaggtgctgccgattgccagttttggcatagaaaccttggtgtcaagtgccgccgacatgaattagcaaataagcgccggatttcagttgcaggagcgtcaaaattactggccaacattctgtactcctaccgtggaatgggtctctctgttgggactatgattgctggatgggatgaaacaggtcctggtctatattacgtagacagtgagggagggaggctgaaaggaacaagattttctgttggatctggttcaccttatgcctatggtgtcttggataatggatatcggtatgacttgtctgttgaagaagctgctgaactggcaagacgagctatttatcatgcaactttccgagatggagccagtggtggagttgctagcgtttattacgttggacccaatggatggaaaaagctttctggcgatgatgtaggagaacttcattacaactactatcccgtgacgccaagtacagtcgatcaggaaatggctgaagtaaccgttgcttgatgatcccatatagacatgagcaggttgagatattctctccctatgcatttgttttagggagaactgattctaaagagatgctctagatgtggtatttttaagttggattggatctaggtttggaaacttgtgctgcaaggaactttctgttatatggtgcttggaggacattgtctatgtttcctaaattttaaatccatttcttcattgggagtaccttgtttatcatgcttgtgctttccagttta

SEQ ID NO: 2286 - DNA, 897 bp, Vaccinium corymbosum
gctctctctttccgatctccggcgattcgattctttctcttcctcatttcgaacagttgttgaaggtattaagcatgaagttcgatacaattggtctcgagtcccacgtgctgcgtagtggagtgagcgatgaccttctcagtgagttcccgactgctccatcttttgagattcctagtgcaaccgatttcgatggatttcagaaagaagctatccaaatggaccaccagcaaaaggcacaacgacactggcctttatcttcaaggaaggtgtaatggttgctgctgactcccgtgctagcatgggaggctacatatcttcacagtctgttaagaaaatcattgaaattaatccctacatgctcggcacaatggctggtggagcagctgattgccaattctggcataggaatctgggcattaagtgccgactccatgaacttgcaaataagcgaagaatttcagttacaggggcctcaaagctattagcaaatattctgtacagttaccgtggaatgggtttgtctgttggaaccatgattgctggttgggacgaaacaggtcctgggctgtactatgtggatagtgagggaggacgtctgaagggaatgagattttctgttggatctggttcaccttatgcttatggagtactggatagtgggtatcgttatgatctgtcagtggaagaagctgcagagttggctagacgtgccatatatcatgctacattccgagatggagcaagtggcggcgttgctagcgtatatcatgtgggacccagcggatggaagaaactatctggggatgatgttgctgaacttcactacaattactatcccgttgaagcaacagtggtagaacatgagatggctgagacttcaacagcttgagggga

SEQ ID NO: 2287 - DNA, 1471 bp, Populus trichocarpa
cttgcccgttgaacaagaaaaggttctagctttataaaacccagcaatcttagtactattaaacttgagatccagtaatcactaatcatactcgatctctgcacatatttcttctctttctcgcgaaatccgaagataatgaagtttgatactagtggtctcgaatccactgcttcggtctttggaacggccggtagggagcttgttgatgggttttctgctgctgctgctccagcttttgacctacccacgactaaggattttgatggcttccagaaggaagctgtacagatggtgaagccggctaaggggacaactacgctggcctttatctttaaggagggtgtcattgttgcagctgattctcgtgctagcatggggggctatatttcatcacagtcagttaaaaaaatcattgaaatcaatccctacatgcttggtacaatggctggtggagctgctgattgccagttttggcacagaaatttgggcattaagtgccgactacatgaattggcaaacaagcgtagaatttcagttacaggggcatcaaagcttctggcaaacattctgttctcttaccgtggaatgggcttgtctgttgggacaatgattgctggttgggatgaaacgggtcctggactatattatgtggacagtgaaggtggaaggctgaaaggaacaagattctctgttggatctggttctccatatgcatatggtatactggatagtgggtaccgatttgatatgtcaattgaagaagctgcagagttaggtagaagagctatttatcatgcaacgttccgtgatggggccagtggtggagttgcaagcgtttattatgtgggagcaaatggatggaccaaactatctggcgatgatgtctcagagctccactacaaatactatccagttgtgtcagctgaagcttcagagccggaccagatggttgaagcataaagtaggaaattgccgtcacgcgctgtttacattttcgtactacagaaaagaacaagggaccagttggagtaaagatcaacggccggcatataattgctgtatgagctatcactataatacctgccttcacttgacatgcaatgcagatgtgtaaattatgttgtatttattctcaaaatcaagctcgatcactcttgatttcttgaaacaagtcacaagaaaacaataataggagctggaaagagcatctgtctctctctttattagcttcgaagcatgctttcatgattgagagtgggatataatcattcagctctttctcgataaaagaattgtaaaataatactaataatgcccctactggaagctaacaaatcggacaagtacatgaaaaatgtgaaccaggagtgtcagtcaagttattattatcattaccatgttaatttttgttagtgtgggggagtggaggtggttacatgaaagagattgatccgaggaggaatttaga

SEQ ID NO: 2288 - DNA, 1323 bp, Fragaria vesca
acacacacactaatttcttttctcgatcttgaagagactgcgttcttcatcgtcttcgtttttcagagctaacaatcgccaagaggctttacgattatgaggcagctcgacttcagcagtctccagaccaccgcgccgttgctcggcgatagcagcgggttttctggtgggtttcccggtgacttttcagctgcgccgtcgtttgaggtccctgttactgatgattttgatggatttcagaaagaagctagagatatggtgaagtcgaagaaggggactaccactcttgcctttattttcaaggacggggttatggtggcggcggattctcgagctagcatgggaggatatatatcgtctcagtctgtgaagaagattatcgaaatcaatccttacatgcttggaactatggctggaggagctgctgactgccagttttggcataggaatttggggattaagtgcagacttcatgaattggcaaacaagcgcagaatttcggttacaggtgcgtccaagctcctggccaacattctgtactcttaccgtggcatgggtctgtctgttggaacaatgatagctggttgggatgaaacgggtcctggactttactatgtggacagcgagggaggaaggttgaaaggcatgcggttttcagttggatctggttcaccatatgcttatggtgtcctggataacgggtaccgctatgatatgtcagttgaagaagcttctgagcttgccaggagagccatatatcatgcaacattccgtgatggagctagtggtggagttgccagcgtttaccatgtcggtccaaatgggtggaaaaagctatctggagatgatgtcggggaacttcactacgaatactatcctgtaacccctgagaccgtggaacaagaaatggtggaagtaggtgcagcctaagaggactagctaatggaagaggcaggcaaagtgcgatttgaagaaagcaaggcatatgcattggggtgctatttttctttttattcaactgaattagcatgatgctgatgttattagattggtcatgtcttgtaatactgcatcctgttttcttgtcataaatattacattccgtttctgtactcttgcttggaaccgctatgttcacttgtggatggtcttataggcatttaaaacgtttccccaaattcggttttgatgtgaagtctatccctatcaaatttcttataggctttgatgtgtttattgtttgagaattgagaattgagatagacagcatcgctcaaaaatgaaattgactataaagccactgaaatcataaatcatcacctc

SEQ ID NO: 2289 - DNA, 900 bp, Tripterygium wilfordii
tcaatccgcgcaaagctctcgatcactctcatacactatcatctcttgcaaagatcatgaagcttgacaccagtggccttgaatcccctatgccacactttggggcgggcaacgaaactcttgaggggatttcgaatgcacagtctgcacagtctttcgaggttccggatgttactaattttgatgcatttcaaaaggagacgacacagttgttgaaacatgccaaggggacaactactcttgcttttattttaaggaggtcgttatggttgccgctgattctcgagctagcatgggcggctatatctcatcccagtcagtgaaaaaaataatttgaaattaatccttacatgcttggtacgatggctggaggagctgctgactgtcagttttggcacagaaatctgggaattaagtgtcgactgcatgaattggcaaacaagaggagaatatcagttacaggagcatccaaacttctggcaaacattctgtattcttatcgtggaatgggtctatctgttgggactatgattgctggatgggatgaaacgggacctggactatattatgtggatagtgaaggaggaaggcttaaaggaatgcgattctctgttggatctggttctccatatgcttatggtgtacttgataatgggtatcgatatgatatgtcagttgaagaagctgcagagttggctagaagagccatttaccacgcaaccttccgagatggagctagtggaggagttgcaagcgtttatcatgtgggaccaaatggctggaagaagctttcaggtgatgatgttggagaactccactacaaatactatccagtcacaccgagtacggtggaacaggaaatgactgaagttgccggggcatgagggtttcgcttaattt

SEQ ID NO: 2290 - DNA, 845 bp, Centaurea maculosa
  misc_feature (23)..(23): n is a, c, g, or t
  misc_feature (35)..(35): n is a, c, g, or t
  misc_feature (45)..(45): n is a, c, g, or t
gcgggggacgatcgacgattgtnttttgagctttnatacagaaanaggttgaaatcatgaaactcgactttaaaggactagaatcaagtgccccactctatggggaaagtaatgggatgcttttcgatgggttttcagctgccgcttcgttcgaggttcctgttacgtcagattttgatgaatatcagaagaaatctgtccaaatggtaaagccagcaaagggaacaacgaccctggcttttatctttaaggatggtgtaatggtagccgcggattcccgagctagcatgggaggctatatctcgtctcaatccgtgaagaagattattgaaatcaatccttatatgctgggtacgatggctggaggagctgctgattgccagttctggcacagaaatctaggtattaagtgccggttgcatgaacttgcaaacaaaagaagaatatcagttactggggcttcaaagctgttggcaaacattctttattcttatcgtggaatgggtttgtctgttgggacaatgattgcgggatgggatgaaaagggccctggcctgtactatgtggacagtgaaggagggcgactgaagggtactaaattttctgttggatctggctcaccgtatgcctatggtgtattagatagcgggtaccattatgatatgacaatcgatgaagctgctgagttggctagaagatccatctatcatgcaacattccgtgatggagcaagtggtggtgttgctagcgtctatcatgtgggcccaaatggatggaccaagctatcaggcgacgacgttggagaacttcactactcgtattatccagtcgaaccaactgttgtg

SEQ ID NO: 2291 - DNA, 1347 bp, Mimulus guttatus
agtctccgattaattttttctccattcgccattgttcttccgattctctgcagaaatcaggtaataatgatgaagattgatcttagtgggcttgatccctcggcgccgatgaagagaaacacagatgacttggataatgaaattttggctacaccatcttttgctcttcccaccactgttgattttgatgggtttcaaaaagcgtcaattcagatggtgaagcctgcaaggggaactacaactctggcttttatattcaaaggaggtgtcatggtggctgctgattctcgtgcgagcatgggtggatatatatcatcacaatctgtcaagaaaattattgaaatcaacccatacatgcttggtacaatggctggaggggctgctgactgccagttctggcacagaaatctaggcattaagtgccgtctacatgaattagcgaacaagagaagaatttctattgccggagcctcaaagatgttggcgaatattttgtattcttaccgaggaatgggcttgtctgttggaactatgatagctggctgggatgaacagggtcctggcctctattatgtggacagtgaaggtggacggcttaagggcactagattttctgttggatctggttcaccatatgcttatggtgttttggacagcggatatcgttttgatctatctgttgaggaagctgctgagctggctagacgagcaatctatcatgctacattccgtgatggagccagtggtggtgttgccagcgtataccacgttggaccaaatggatgggaaaagctatctggtgacgatgttggagaactccactacaagtactaccccgttgaaactgcagttgtggaacaggagatgactgaggtagctattgcgtgattgagttacaatttagaacttttcctatcatttgcttctgattagtgtgtaagacaatataatctacaagataaacctaaactggttttgcttttgtaacattttatttttgaattaaacaacttgctcttatcatgtgtgcccccaacaaaactattgttgtatctcgattattcctatgcgtacgctactacaaactaattgtgttggacaagattcatagcgtcgaagccccagccaattactacaggtttattagttgacagcttttagctggaaagacgtgctagttgtttttgaggtaaagaatcttgattgttatctcttcccacctcacttgcatacatatgcatatgtgtgttagttgttttctagtggctttatcttcatcaatgagatattccatgctctatactatcattgttatgtaatctgtgtcaaatctcttacataaagttg

SEQ ID NO: 2292 - DNA, 825 bp, Carthamus tinctorius
ggcgggggttgatcaacgatctggttatccttctcgatttaaaaggttgaaatcatgaagcttgactttggtggactagaatcgagtgcaccactttatggtggaaatgatgacgttctttctgatgggttctcagctgccccttcatttgacctcccagttacatcagattttgatggattccagaagaattctatccaaatggtaaagccagcaaagggaactacaaccttggcttttatctttaaggagggtgtgatggttgctgcagattcccgagctagcatgggaggctatatctcatctcaatctgtgaagaagattattgaaattaatccctatatgttgggtacaatggctggaggagctgccgattgccagttctggcacagaaatctaggcattaagtgccgtttgcatgaattggctaacaagagaaggatttcagtaacgggcgcttcaaagttgctggcaaacattctttactcttatcgtggaatgggtttgtctgtcgggacaatgattgcaggatgggatgagaagggcccgggtctgtattatgttgacagcgaaggtggacgactgaagggtacaaaattctctgttgggtctggttcaccatatgcttacggtgtattagatagcgggtaccactatgatatgacgatcgatgaagctgctgaattggcgagaagatccatctatcatgctacattccgtgatggggctagtggtggtgttgctagcgtttatcacgtgggaccgactggatggacgaagctatcgggtgatgatgttggtgagcttcactactcatactatcct

SEQ ID NO: 2293 - DNA, 1318 bp, Abies balsamea
agacaatcgagggtttaattctactgttttttacagccattctcagagcttgattacattgggtttccctaactgacccgggcgaataccagcattcacagtgcgcaaagcgaaaaaacatcagttttatctgctttacaggttgcaagatgaagcttgacttgagtggccttgagcctgcaaccctccatcagtggtcaaatgataacctttgtgatgtcttctctccaaatccatcattcaacattcctaatgatgctgattttgatggcttccaaaaggcagcaatgcaaatggtgaaaccagcaaagggaacaacaactctggcctttatattcaaggagggaatcatggttgctgctgattctcgtgccagcatgggaggatacatttcgtcacaatctgtgaagaagattattgaaatcaatccttatttacttggtactatggctgggggtgcagctgattgccaattctggcacagaaacctgggcattaagtgtcggttgcatgagttggcaaacaagaagagaatatcagtgacaggtgcttctaaattgttggctaatatcctctactcatatcgaggaatgggcctgtcaataggcacaatgattgctggatgggatgaaacgggtcctggtctatattatgtagacagtgaagggggaagacttaagggaacacgtttttctgttggatcgggttcaccatatgcgtatggtgttctggacagcgggtatcgctgggatatgccagtggaagaagctgcagaactagctcgccgttctatataccatgcaacatttcgtgatggtgccagtgggggtgttgcaagtgtgtactacgtgggtcctcaaggatggaagaagttgtctggtgatgatgttggtgaacttcattacaaatactatccggtgacagaaaatgttgtagagcaggagatggtcgaagtcagtgcttgaaaacctctatccattgcaccatgtatcttgaggttgctggctttacaagctaattcttgttttgtatggaagtttttattatgctattatccatttggcaaaggggataccttgatcatcaacttcatccttttttattctagggaggtttatgttggaaacaatcacgatttgcaatcaaaaagttttcaattatcagttaagccaattgaagatgctcaaacatgcatcaatttattgtggttggcaataccattgtactgttcatcaatgaattaacatagtttattttggttgacttaagttggtgtatttgacttatgaaatggtctccttaatattgatgatggatt

SEQ ID NO: 2294 - DNA, 1247 bp, Cedrus atlantica
ctcgaattgtgtaccatcaaagggttgtgctgagtatcgtttggcttctaatgcccggctacacttgaagctctcattattatcagcgcattgacgggaggttttgcgaatttggcaggttttggttcagtttactttttctctctcgaacggactgtattcgtaacttgcagccttgcattctccggttctcgttctgagttgagagatgaagcttgacttcagtggccttgagcctgcaactcttcatcagctgtcaaatgataacctttgcgatgtcttatctccaagtccatcattcaagattcctaatgatacaaattttgatggcttccaaaaggcagcaatgcaaatggtgaaaccagcaaaaggaacgacaactttggcatttatattcaaggagggcatcatggttgcagctgattctcgtgccagcatgggaggatacatttcatcgcaatctgtgaagaaaattattgaaatcaatccttatttactgggtactatggctgggggtgcagctgattgccaattctggcacagaaacctgggtattaagtgtcggttacatgagctggcaaacaagcggagaatatcagtgacaggtgcttctaaattgttggccaatatcctctactcgtatcgaggaatgggtctgtcagtaggcacaatgattgctggatgggatgaaacgggccctggtctatattatgtggacagtgaaggaggaagacttaaaggaacgcgtttttctgttggatctggttcaccatatgcttatggtgtcctggacagtgggtatcgttgggatatgccagtggaagaagctgcagaattagctcgccgctctatataccatgcgacatttcgtgatggtgctagtgggggtgtcgcaagtgtgtattatgtcggtcctcaaggttggaagaagttgtcgggtgatgatgtgggtgagcttcatttcaactactatccagtcacagaaaatgttgtggagcaggagatggttgaagtcagcgcttgaaagcatcttatccattgcaccatgtatcttgagtttactggcttattcaacaagctaatgcttgttttatatgcaagttttctcattcctatgtgttattatccatttgtgaaagaaaggggagaccttgatcattaactttggcctctcttattatagggaggtttctgttggaaacaatctggattttcaatcataaagttttcacttactagttaagccc

SEQ ID NO: 2295 - DNA, 892 bp, Cucumis sativus
catgaagctggacactagcggtcttgaatcggctacttttctctctggcgcgggcagtactgagctactcgatggattatcctcggcgccttcttttggtattccaaatgctaggaattttgatgggtttcagaaagaggctattcagatggtgaagccagcaaaggggacaaccactctggccttcactttcaaggaaggagtcatggttgctgctgattcccgagcgagcatgggagggtacatatcatcccaatctgcgaagaagattattgaaataaattcatacatgcttggcacaatggctggaggagctgctgattgccagttttggcacagaaatcttggaattaagtgtcgacgacatgagttggaaaacaagcgtagaatttccgtgacgggtgcatctaagttgctagctaacattctatattcgtatcggggaatgggtctttcagttggtaccatgattgctggatgggatgaaactggtcctggattgtactatgttgacagtgaaggaggaagactgaaaggaactcgattctcagttggatcaggttcaccttatgcatattgtgtcctggacaatggttatcagtacgatttatcagttgaagaggctgctgaactggctagaagagcaatttatcatgcaacattccgagacggggccagtggtggagttgcgagtgtttatcatgttggaccaaatggatggaagaaactatctggtgatgatgttggagaacttcactacaaatattatcctgttgtgcatgatacagttgaacaggaaatgattgaagtcaccgtgtagatctttttaacaaatggatcccaggtttcaccttctctccaaacaaactacttgatgtattttgttaactag

SEQ ID NO: 2296 - DNA, 1521 bp, Pseudotsuga menziesii
cgatgcttaaaaaaaggtgggagaaacatttagaaaggaggcgattgaacggaagacataaaatgtcaagccggttttccaagaaatgataaacataacatgatttaacaaactgtaaaggcagaaatgaaaaaggaaatatatcattttaaaatcaaataccgactttatcatccttcaacgcattgtgcttttgttgtttctttgcaagggttttagtagctccggctcgaattttgcaccattaaagctttctgctaagtaccgttctggctcctaatacccaactatacttgaagctctcgttattctcaggttattgacggaagcttttgcgaattcgcggtgttttgatccagcctacaatttataacttgaacggactgtgtacgctccggttctcatctcaatttgcaggatgaagctcgacttgagtggccttgagtctgcaactctccatcagctgtcaaatgataacctttctgatgtcttctctccaagcccatcattcaagattccgaacgatgcagattttgatggcttccaaaaggcagcaatgcaaatggtgaaaccagcaaaagggacaacaactttggcatttatattcaaggagggaatcatggttgctgctgattctcgtgccagcatgggaggatacatttcatctcaatctgtgaagaaaatcattgaaatcaatccttatttacttggtactatggctgggggcgcagctgattgccaattctggcacagaaacctgggcattaagtgtcggttacatgagctggcaaataagcggagaatatcagtgacaggtgcttctaaattgttggccaatatcctctactcatatcgaggaatgggcctgtcagtaggtacaatgattgctggatgggatgaaacgggccctggtctatattatgtagacagtgaaggaggaagacttaagggaacacgcttttctgttggatctggttcaccgtatgcatacggtgtcctggacagtgggtatcgttgggatatgccggtggaagaagctgcagaactagctcgccgctctatataccatgcaacatttcgtgatggtgccagtgggggtgtggcaagtgtttactacgtgggccctcaaggttggaagaagatgtctggtgatgatgtgtctgaacttcattataattactatccagtcacagaaaatgttgtagagcaagagatggttgaagtcagtgcttgaaagcatcttatgaattgcgcattgtatcttgagtttactggcttagtctacaagctaatagcttgttttttatgcaagttttcacattcgctagtgtcattattcatttgggaaaggggaaaccttgattattagctttggcctttcttattatagggaggtttctgttggaaacaatctagattttcaatcataagtttttcaattactagtaaactttgacttttgaaacggtctccttaatattgatgatgcaataatgtaaactatataaattccaggattca

SEQ ID NO: 2297 - DNA, 1609 bp, Picea glauca
aaaaacagctgtcccgcggccttcactttcccttcgaaattctgggtttcagatcagaaagaaacgtgggtttaattctacggttttgcagtcattcgcagagcttgatcgcattgggtttccgtaactgaccagggcgattaccagcattcgcagtgctcaaagcgagaaaacatcaggttgcaagatgaagcttgacttgagtggccttgagcctgcaaccctccatcagcggtcagatgataacctttgtgatgtcttttctccaagtccatcattcaagattcctaatgatacagattttgatggtttccaaaaggcagcattgcaaatggtgaaaccagcaaagggaacaacaactctggcatttatattcaaggagggaatcatggttgctgctgattctcgtgccagcatgggaggatatatttcatcacaatctgtgaagaaaattattgaaatcaatcctcacttacttggtacaatggctgggggtgcagctgattgccaattctggcacagaaacctgggcattaagtgtcggttgcatgagctggcaaacaagcgaagaatatcagtgacaggtgcttctaaattgttggctaatatcctgtactcatatcgaggaatgggcctgtcaataggcacaatgattgctggatgggatgaaacgggccctggcctatattatgtagatagtgaaggaggaagacttaagggaacacgtttttctgttggatctggttcaccatatgcctatggtgtcctggacagcgggtatcgctgggatatgccagtggaagaagctgcagaactagctcgccgttctatataccatgcaacgttccgtgatggtgccagtgggggtgtggcaagtgtgtactatgtgggtcctcaaggttggaagaaattgtctggtgatgatgttggtgaacttcatttcaaatactatccagtcacagaaaatgttgtagagcaggagatggtcgaagtcagtgcttgaaagcctctatagattgcaccatgtatcttgaggttgctggctttacaagctgatgcttgttttttatgcaagttttccttttctagtgctattatacatttggcaaagaggaaaccttgataattaactttgtcctttcttatttgagggaggtttctggttgaaacaatcaagatttgcaatcataaaatttttcaattactagttacgccaattaaagaagctcaatcatgcatcaatttattgtggttagcaataccattgtactgtttagcaacggattaatgcagtttcttttggttgacataagtttggtgtatttgacttatgaaatggtctcattaatattgatgatggattgatgaaacctatgcaaattttgggcttcagttactggatcctatacttttttgcatgaggctgtgtatggtgtacatgatgtgcatgttattggaaacactgcttgtggtggtgaaaatgtatggggatgtgacctcagattataattttctatattctgtggaactgcgcacaacaaatcttgatttgtggtccatgctctggaattcattgtcaggttggaaaggatgacagtgacatttttaa

SEQ ID NO: 2298 - DNA, 1455 bp, Picea glauca
aaaaattaatccaatgactctttccttcttcctcaagtaaaggcagtgatagcaaaaccatgttcatgtccatgtgacggaaattataaaaacagctgtcccgcggccttcactttcccttcgaaattctgggtttcagatcagaaagaaacgtgggtttaattctacggttttgcagtcattcgcagagcttgatcgcattgggtttccgtaactgaccagggcgattaccagcattcgcagtgctcaaagcgagaaaacatcaggttgcaagatgaagcttgacttgagtggccttgagcctgcaaccctccatcagcggtcagatgataacctttgtgatgtcttctctccaagtccatcattcaagattcctaatgatacagattttgatggcttccaaaaggcagcattgcaaatggtgaaaccagcaaagggaacaacaactctggcatttatattcaaggagggaatcatggttgctgctgattctcgtgccagcatgggaggatatatttcatcacaatctgtgaagaaaattattgaaatcaatcctcacttacttggtacaatggctgggggtgcagctgattgccaattctggcacagaaacctgggcattaagtgtcggttgcatgagctggcaaacaagcgaagaatatcagtgacaggtgcttctaaattgttggctaatatcctgtactcatatcgaggaatgggcctgtcaataggcacaatgattgctggatgggatgaaacgggccctggcctatattatgtagatagtgaaggaggaagacttaagggaacacgtttttctgttggatctggttcaccatatgcctatggtgtcctggacagcgggtatcgctgggatatgccagtggaagaagctgcagaactagctcgccgttctatataccatgcaacgttccgtgatggtgccagtgggggtgtggcaagtgtgtactatgtgggtcctcaaggttggaagaaattgtctggtgatgatgttggtgaacttcatttcaaatactatccagtcacagaaaatgttgtagagcaggagatggtcgaagtcagtgcttgaaagcctctatagattgcaccatgtatcttgaggttgctggctttacaagctgatgcttgttttttatgcaagttttccttttctagtgctattatacatttggcaaagaggaaaccttgataattaactttgtcctttcttattcgagggaggtttctggttgaaacaatcaagatttgcaatcataaaatttttcaattactagttacgccaattaaagaagctcaatcatgcatcaatttattgtggttagcaataccattgtactgtttagcaacggattaatgcagtttcttttggttgacataagtttggtgtatttgacttatgaaatggtctcattaatattgatgatggattgatga

SEQ ID NO: 2299 - DNA, 1211 bp, Cedrus atlantica
gtttaattctacggttttactagccatccttggagatttatcaccttggatctccgtaactggccagggcgaacaccagtattcaaagcgaaaaaacaatcaggttgcaagatgaagcttgacttgagcggccttgagcctgcaaccctccatcagcggtcaaatgataacctttgtgatgtcttctctccaagtccatcattcaagattcctaatgatgctgattttgatggcttccaaaaggcagcaatgcaaatggtgaaaccagcaaagggaacaacaactctggcatttatattcaaggagggaatcatggttgctgctgattctcgtgccagcatgggaggatacatttcatctcaatctgtgaagaaaattattgaaatcaatccttacttacttggtaccatggctgggggtgcagctgattgccaattctggcacagaaacctgggcattaagtgtcggttgcatgagctggcaaacaagcggagaatatcagtgacaggtgcttctaaattattggctaatatcctctactcatatcgaggaatgggcctgtcagtaggcacaatgattgctggatgggatgaaacgggtcctggtctatattatgtagacagtgaaggaggaagacttaagggaacacgttttctgttggatctggttcaccatatgcctatggtgtcctggacagtgggtatcgctgggatatgccagtggaagaagctgcagaactagctcgccgttctatataccatgcaacatttcgtgatggtgccagtgggggtgtggcaagtgtgtactatgtgggtcctcaaggttggaagaagttgtctggtgatgatgtcggtgaacttcatttccaatactatccagttacagaaaatgttgtcgagcaggagatggtcgaagtcagtgcttgaaagccttcatccattgcactgcgtatcttaaggtttctggctttacaagctactgcttgttttgtacgcgagttttcattctatagtgttattatccatttggaaaaggggataccttgattattaacttcatcctttcttctctagggaggtttctgttggaaaaaatcaagattttcatttactagttaagccgattaaagatactcaaacgtgcatttattgtagttagcaataccattgtactgcttagcaatgaattaatgcagtttattttggttggca

SEQ ID NO: 2300 - DNA, 1385 bp, Populus trichocarpa
cttgcccgttgaacaagaaaaggttctagctttataaaacccagcaatcttagtactattaaacttgagatccagtaatcactaatcatactcgatctctgcacatatttcttctctttctcgcgaaatccgaagataatgaagtttgatactagtggtctcgaatccacttcttcggtctttggaacggccggtagggagcttgttgatgggttttctgctgctgctgctccagcttttgagctacccacgactaaggattttgatggcttccagaaggaagctgtacagatggtgaagccggctaaggggacaactacgctggcctttatctttaaggagggtgtcattgttgcagctgattctcgtgctagcatggggggctatatttcatcacagtcagttaaaaaaatcattgaaatcaatccctacatgcttggtacaatggctggtggagctgctgattgccagttttggcacagaaatttgggcattaagtgccgactacatgaattggcaaacaagcgtagaatttcagttacaggggcatcaaagcttctggcaaacattctgttctcttaccgtggaatgggcttgtctgttgggacaatgattgctggttgggatgaaacgggtcctggactatattatgtggacagtgaaggtggaaggctgaaaggaacaagattctctgttggatctggttctccatatgcatatggtatactggatagtgggtaccgatttgatatgtcaattgaagaagctgcagagttaggtagaagagctatttatcatgcaacgttccgtgatggggccagtggtggagttgcaagcgtttattatgtgggagcaaatggatggacgaaactatctggcgatgatgtctcagagctccactacaaatactatccagttgtgtcagctgaagcttcagagccggaccagatggttgaagcataaagtaggggcctcactgctcttgtttccaaaatgtagctctgtttctattttttgtcgatggcatttcaaattgtcaagtagactttcctcatggaatcctggtatttttaaattctcgtgtgcttaaaatcttgaaaatgaatattttggattcggtacttgaggaatgcgattctagatatgcctttttacacacttacacagtaacaacttgagaagtttgtgcttagaatgtgggggctcctcggctggtgtgtgctattgtgtgtgcgatgagtgttaaactgaaacctattttggggtaataaatggcatcaaagtttctcatgatcacattgattaaccaaaccaaatgctatttgagggaaagatttcatgccatgccacatcaatcgcattccttaaatgcaaagcaaaggatt

SEQ ID NO: 2301 - DNA, 1102 bp, Phalaenopsis aphrodite
gtttcattttctctgttccgatcaaagccacagttcttccaatccccgccagaccagcgagcacttcggatcccggcaaaggaccccctttttgtttcaatttttttagccgatatacccgaaatgaagctcgacacaagcggcttcgaagctttggcccagcccagcagagaactcgatgttctggcatgcgaattcaggagctcacctgcgtttgatctccctagctgcactgattttgatgggtttcagaagaacgccttacagatggtgaagccggcaaagggaacgactactcttgcatttatattcaaagaaggcgtcattgtggctgccgattcccgagccagcatgggaggatacatctcttcacaaactgtcaagaaaattattgagataaacccatacatgattggtacaatggccggtggagctgcagactgtcaattttggcatagaaacttggggatcaagtgccgtcttcatgaacttgcaaacaaaagaaggatttcagtgacaggtgcttctaagcttttggcaaatattctctactcgtaccgtggaatgggcctctcagttggtacaatgattgctggatgggatgaaacgggcccaggattatactatgtggacagtgaaggtggcagactgaaaggaaaacgattctctgttggatctggttcaccatatgcctatggggtgcttgacagtggatatcgattcgacttgtccattgaagaagcagcagaacttgctcgtcgtgcgatatatcatgctacttttcgtgatggagcgagtggtggaattgctagtgtttactatgttggacctgatggttggaaaaagctttctggggatgatgttggcgagctgcactacaagtattatccaattgctaccccctctgtggagcaggagatggccgaagcaccagttgcttaggttctacttccagctaatgctgctctcacaggaactttggaaatgttgcacgttttgaaaattgagactatcagaaacttttgtggtccatgtcttctatgatttaatgctcaaattcctttttatgacatttacatcagttaaaagttcaacaaaacat

SEQ ID NO: 2302 - DNA, 1149 bp, Cucurbita pepo
cctccatttcgatcgtttccttggacgttgtatattttgtttgttttagttcgtgtttctgttctcccgttgctcaagattctagctaaaggagttgaaacatgaagctcgataccagtggtcttcaaacaagtgctccgctgtttggaccaaaaatggagattttggaagggttttcagctgctccatccttcgaagtccctaattccagtgactttgatggctttcagaaagaggccattcagatggtgaagccagctaaaggaacaacaacactggctttcatttttaaggaaggagtcatggttgctgctgattcgcgtgccagcatgggaggctatatatcatcgcaatctgtgaaaaagattattgaaatcaatccttacatgcttggcacaatggctggaggtgctgccgattgccagttttggcacagaaacctcggtgtcaagtgccgccgtcacgaattagcaaacaagcgccggatttcagttgcaggagcatcaaagttactggcaaacattctatactcctatcgtggaatgggtctttctgttgggactatgattgctggatgggatgaaacaggtcctggtctatactacgtagacagtgagggagggaggctaaaaggaacaagattttctgttggatctggttcaccttatgcctacggtgtcttggataatggatatcgttatgacttgtctgttgaagaagctgccgaacttgctagacgagctatttatcacgcaactttccgagatggagccagtggtggagttgctagcgtttattatgtgggaccaaatggatggaaaaagctttctggcgatgatgtaggggaacttcactacaactactacccagtcacgccaaccacagtggatcaggaaatggctgaaacattgattgataatcaatccgacacagacatataagcaggttaagacgctttctccctgttcatttgtgccaagggggaagatgattctaaagagatgctgtaggtgtaaactttacagatccttagaaggtttgattctagtactttaaggatctttctgtcatgttattacaattatggctgcttggaggagatattgtgtctatgtttcctaaatttttaatccatttctccattggact

SEQ ID NO: 2303 - DNA, 1354 bp, Picea glauca
aagtaaaggcagtgatagcaaaaccatgttcatgtccatgtgacgaaattataaaaacagctgtcccgcggccttcactttcccttcgaaattctgggtttcagatcagaaagaaacgtgggtttaattctacggttttgcagtcattcgcagagcttgatcgcattgggtttccgtaactgaccagggcgattaccagcattcgcagtgctcaaagcgagaaaacatcaggttgcaagatgaagcttgacttgagtggccttgagcctgcaacctccatcagcggtcagatgataacctttgtgatgtcttctctccaagtccatcattcaagattcctaatgatacagattttgatggcttccaaaaggcagcattgcaaatggtgaaaccagcaaagggaacaacaactctggcatttatattcaaggagggaatcatggttgctgctgattctcgtgccagcatgggaggatatatttcatcacaatctgtgaagaaaattattgaaatcaatcctcacttacttggtacaatggctgggggtgcagctgattgccaattctggcacaggaacctgggcattaagtgtcggttgcatgagctggcaaacaagcgaagaatatcagtgacaggtgcttctaaattgttggctaatatcctgtactcatatcgaggaatgggcctgtcaataggcacaatgattgctggatgggatgaaacgggccctggtctgtattatgtagacagtgaaggaggaagacttaagggaacacgttttctgttggatctggttcaccatatgcatacggtgtcctggacagtgggtaccgctgggatatgccagtggaagaagctgcagaactagctcgtcgctctatataccatgcaacatttcgtgatggtgccagtgggggtgttgcaagtgtgtactatgtgggtcctcaaggttggaagaagttgtctggtgatgatgtggcggaacttcatttcaattactatccagtcacagaaaatgttgtagagcaggagatggttgaagtcagtgcttgaaaatatcttacgcattgcaccatgtatcttgagtttactggcttactctacaagctaatatgtgttttgtatgcgagtattctcattctttagtgtcatgattcatttgggaaatgagaaaccttgattattaactttgtcctttcttactatagggaggtttctgttggaaacaatctagattttcaatcataaagtttttcaattactagttaagcctgactttttgaaaacggtctccttaatattgattatgcattagtagtaaactataacaaatcttgggcttcagttactgtat

SEQ ID NO: 2304 - DNA, 1423 bp, Abies balsamea
ataagcacgaatagcctgtcctcgcctttccgggcaaaacatctttatagcctgctgtttttctttttgtcgagtggcactctgtattttaggattttcgggatttatcagcgattttacgtcggtttttcccctatttggaaattgaaggctactcttccttttttggaattttattttcttctcaggagagaggagcagggatagcagaaaccgaagccgtagccgtagccggagaagggagcagcgggagaacgagtttgccacggcttgccttcaaattttctgttgctggtcgagcttggaagcttcaatctgaaccggttgcaagatgaagctcaacttcagtggccttgagcctgcaactctccatcagctgtcagatgataagctttgtgatgtcttatctccaagtccatcattcaagattccgaacgatgcagattttgatggcttccaaaaggcagcaacgcaaatggtgaaaccagcaaaaaggaacaacaactttggcatttatattcaaggagggaatcatggttgctgctgattctcgtgccagcatgggaggatacatttcatcacaatctgtgaagaaaattatcgaaatcaatccttatttacttggtactatggctgggggtgcagctgattgccaattctggcacagaaacctgggcattaagtgtcggttacatgagctggcaaacaagcggaggatatcagtgacaggtgcttctaaattgttggccaatattctctactcatatcgaggaatgggcctgtcagtaggcacaatgattgctggatgggatgaaacgggccctggtctatattatgtagacagtgaaggaggaagacttaagggaacacgtttttctgttggatctggttcaccgtatgcttacggtgtcttggacagtgggtatcgatgggatatgccagtggaagaagctgcagaactagctcgtcgctctatataccatgcaacatttcgtgatggtgccagtgggggtgtggcaagtgtgtactatgtgggtcctcaaggttggaagaagttgtctggcgatgatgtgggtgaacttcatttcaaatactatccggtcacagagaatgttgtagagcaggaaatggttgaagtacatgcttgaaagcatcctatcccttacaccgttgatgttgaatttactggattactctacaagctaatgcctgttttgtatgcgagttttctcattctttagtgttattatccatttgggaagggagactgtgatcataaactttcgcctttcttattatagggaggtttctgttggaaaaaatgtagattttcagtcaaagtttttcaattactagtgaagcccattaaagatgctcaaacatgcatcaatttattgtgtttcacaatagtattgtactgttt

SEQ ID NO: 2305 - DNA, 1210 bp, Cucurbita pepo
ttttccctccattccgatcatttccttcgaggctgtgtatctccgtttggtcgtagttccttttttgttctcatattgctctagattctagctcaagaagttgaaacatgaagttcaataccagtggtcttcaaacaacagctccgctgtttgggccaaaaatggagttcatggaagggtttgcagctgctccatcctttgagatccctaattccagtgactttgatggctttcagaaagatgccattcaaatggtaaagccagcaaaaggaacaaccacactggctttcattttaaggaaggagtcatggttgctgctgattcccgtgccagcatgggaggctacatatcatcgcaatctgtgaagaaaattattgaaattaatccttacatgcttggtacaatggctggaggtgctgctgattgtcagttttggcatagaaatctcggtgtcaagtgccgccgacatgaactagcaaataagcgtcggatttcagttgccggagcatcaaaattactggccaatattctgtactcctatcgtggaatgggtctctctgttgggactatgattgctggatgggatgaaacaggtcctggtctatattacgtagacagtgagggaggaaggctcaagggaacaagattttctgttggatctggttcaccttatgcctacggtgtcttggataatgggtatcggtacgacttgtctgtagaagaagctgctgaactggctagacgagcgatttatcatgcaactttccgagatggagccagtggtggagttgctagcgtttattacgtgggaccaaatggatggaaaaagctatctggcgacgatgtaggagaacttcattacaactactatcccgtgacgccaactacagtggatcaggaaatggctgaagtaaccgccgcttgatgatcccatatagacagacatgagcaggttgagacattctcgctccctattcatttgtgcttctgggggaactgattctaaagagattgctttagatgtggagtgtttttaaagtattatgggatccttaaaatgtttgattggatcattctgtcctgttagtcgagttataatagctgcatggagaagaacattgcttgtgtttcctaaattttagatcccttgcttcattggactaccttgcttgtcatgctcgttctttccagtttagtgagcgacgtatct

SEQ ID NO: 2306 - DNA, 1197 bp, Prunus mume
atgaagcttgatactagcggtcttgaatcagccgcgccgctggttggcgcgagcagtgggtttctcgatgggtttgcagatgctccatcgttcgaggttcctactaccaatgattttgatggctttcagaaagaagctattcaaatggtgaagcctgccaaggggacaaccacacttgcttttatcttcaaggaaggcgtcatggttgccgctgattctcgagctagcatgggaggatatatatcctcacaatctgtgaagaaaattattgaaatcaatccttacatgcttggtacaatggctggaggagccgctgactgccagttttggcatagaaatctagggataaagtgccgattgcatgaattggcaaacaagcgcagaatttcagttacaggggcatcaaagctgttggcaaacattctgtactcttaccgtggcatgggtctctctgttgggaccatgatagctggatgggatgaaacgggtcctggactctattatgtggacagtgagggaggaagattgaaaggcatgcggttttcagttggatctggttcaccatatgcttatggtgttctcgataatgggtaccggtacgatatgtctgttgaagaagctgctgaattggctagaagggctatatatcatgcaacattcctttatcacgtgggaccaaatggatggaagaagctttctggcgacgatgttggggagcttcactatcactattatcctgtagtccaaggtgcagttgaacaggaaatggttgaaccatgtctgcaaccgaaagctcagagtatcggcagtcaaggcaatgtattgctcctttttgttgcgggtatttgcaccttggtcgtctgcctcacaacaagcatttcaaggtcaaacaaaaacctgaattcagtatcagcggtgcttatctctaaccagttcagttacatcgaaaccaaccatactctctcctataaccttaccctcgacatctccctcacaaatccgtgccagaaatactttaagttgattgacaaccaagtctttgcatactctcaaaaccagaaatttggtcttgtgacattgattgataggaggacagcgtttcaccaacaccccaagaacaccaccttttttcagaatgcagttgttgaaggctggaagacaatggggtttgaagaacctgtgcttcccaaagattga

SEQ ID NO: 2307 - DNA, 1290 bp, Picea glauca
ttattgacgggagtttttgcgaatttggtggtgtttgggttggttttggtctagtctaccatttttcttccttggacggcctgtctatcctccggttctcgttctgagttgcaagatgaagcttgacttgagtggtcttgagcctgcaactctccatcagctgtcaaatgataacctttgcgatgtcttctctccaactccatcattcgagattcctaacgatgccgattttgacggctttcaaaaagcagcagtgcaaatggtgaaaccagcaaaaagggcaacaactttggcatttatattcaaggaaggaatcatggttgctgctgattctcgtgccagcatgggaggatacatttcatcacaatctgtgaagaaaattattgaaatcaatccttatttacttggtactatggctgggggcgcagctgattgccaattctggcacagaaaccctgggcatcaagtgtcggttacatgagctggcaaacaagcggaggatatcagtgacaggtgcttctaaattgttggccaatatcctctattcatatcgtggaatgggcctgtcagtaggtacaatgatcgctggatgggatgaaacggcctggtctgtattatgtagacagtgaaggaggaagacttaagggaacacgtttttctgttggatctggttcaccatatgcctatggtgtcctggacagcgggtatcgctgggatatgccagtggaagaagctgcagaactagctcgccgttctatataccatgcaacgttccgtgatggtgccagtgggggtgtggcaagtgtgtactatgtgggtcctcaaggttggaagaaattgtctggtgatgatgttggtgaacttcatttcaaatactatccagtcacagaaaatgttgtagagcaggagatggtcgaagtcagtgcttgaaagcctctatagattgcaccatgtatcttgaggttgctggctttacaagctgatgcttgtttttatgcaagttttccttttctagtgctattatacatttggcaaagaggaaaccttgataattaactttgtcctttcttattcgagggaggtttctggttgaacaatcaagatttgcaatcataaaatttttcaattactagttacgccaattaaagaagctcaatcatgcatcaatttattgtggttagcaataccattgtactgtttagcaacggattaatgcagttacttttagttgacataagtttggtgtatttgacttatgaaatggtctcattaatattgatgatggattga

SEQ ID NO: 2308 - DNA, 1228 bp, Picea glauca
ttctacggttttccagtcattcgcagagcttgatcgcattgggtttccgtaactgaccagtgcgattaccagcattcgcagtgctcaaagcgagaaaacatcaggttgcaagatgaagcttgacttgagtggccttgagcctgcaaccctccatcagcggtcagatgataacctttgtgatgtcttctctccaagcccatcattcaagattcctaatgatacagattttgatggcttccaaaaggcagcattgcaatggtcaaaccagcaaagggaacaacaactctggcatttatattcaaggagggaatcatggttgctgctgattctcgtgccagcatgggaggatacatttcatcacaatccgtgaagaaaattattgaaatcaatcctcacttacttggtacaatggccgggggcgcagctgattgccaattctggcacagaaacctgggcatcaagtgccggttacatgagctggcaaacaagcgaaggatatcagtgacaggtgcttctaaattgttggccaatatcctctattcatatcgtggaatgggcctgtcagtaggtacaatgatcgctggatgggatgaaacgggccctggtctgtattatgtagacagtgaaggaggaagacttaagggaacacgttttctgttggatctggttcaccatatgcatacggtgtcctggacagtgggtaccgctgggatatgccagtggaagaagctgcagaactagctcgtcgctctatataccatgcaacatttcgtgatggtgccagtgggggtgttgcaagtgtgtactatgtgggtcctcaaggttggaagaagttgtctggtgatgatgtggcggaacttcatttcaattactatccagtcacagaaaatattgtagagcaggagatggttgaagtcagtgcttgaaaatatctaaagattgcaccatgtatcttgaggttgctggctttacaagctgatgcttgttttttatgcaagttttcctttcctagtgctattatacatttggcaaagaggaaaccttgataattaactttgtcctttcttattcgagggaggtttctggttgaaacaatcaagatttgcaatcataaattttcaattactagttacgccaattaaagaagctcaatcatgcatcaatttatgtggttagcaataccattgactgtttagcaacggattaatgcagtttcttttggttgaca

SEQ ID NO: 2309 - DNA, 1085 bp, Eschscholzia californica
cttctcctttctaatactctgaatccaaatctctctcgctctctcactttaacccaaggtgtgtgcaaacatgaagcttgatagtggtcttgaaaattcttcttccattcttcttggaggaagcaatgagtttggcgcagatttttcagctcccccatcattcgacctccccactactaatgattttgatggctttcagaaagcatccctaaagatgatgaagcatgcaaaagggacaaccacacttgctttcattttcaaggatggagtcatggttgcagctgactctcgagctagcatgggaggatatatctcatcacagtctgtgcagaaaatcattgagatcaatccgtacatgcttggtacaatggctggtggtgctgccgactgccagttttggcatagaaatttgggtgttaagtgccggttgcacgagctggcaaacaagagaaggatttctgtgaccggagcatcaaagcttctggccaacattctctactcgtaccgtggaatgggtctatctgttggtaccatgattgcaggatgggatgaaaagggtcctgggctatactgtgttgacagtgaaggtggtcgcctcaaaggaatgaaattttctgttggatctggttcaccatatgcttatggtgttctagataacgggtaccggtatgacatgtcagtcgaggaagctgcagaacttgctcgtagagctatttatcatgcaacatatcgtgatgccgcaagtggtggagttgctagcgtttatcatgtcggacctaacggatggacgaagttatctggggatgatgttggtgagctccactacaagtattacccagttgtcccaagtacagttgagcaggaaatgactgaggtaccagttgcttaagagttgcctgatcaaaatagtgcttgtgttctaggatcttcggtatgttattttacaaattctcgttcattatgagcaacttataaacacatgaatctcgggtggatatatgaaaaccaactacatgagagggcttttgtgttggcgtaacaatgatagatttcttctttgaatcataatgctagcatctgtttat

SEQ ID NO: 2310 - DNA, 1162 bp, Capsicum annuum
ctaatagttgtaaatgatgaagatcaattttagcggacttgaaccaactgccccacttcaaggggagccttctgagctgtttgatggaatttcaaattctccatcattcgcgattcctaatactactaattttgatggctttcaaaaagaagcaatccaaatggtgaagcccgcgaagggaaccacgacccttgctttcatttttaaaggaggtgtcatggttgctgctgattctcgggctagcatgggaggatatatatcatctcaatctgtgaagaaaatcattgaaattaatccctatatgcttggcacaatggctggtggggctgctgactgccaattctggcatagaaacctgggaatcaagtgccgtcttcatgaactggcaaacaaaaggagaatttcagttactggagcttcaaagctgctggcaaacattttatattcttaccgcggaatgggtttgtctgttggaactatgattgctggttgggatgagaagggtccaggactatattatgtggatagtgagggaggacggcttaaaggaaacagattctctgttggttctggttctccttatgcctatggtgttttggataatgggtaccgatatgatctgtctgtggaagaagcagccgagttggctagacgagcaatttatcatgctacattccgtgatggagctagtggaggtgttgccagtgtttatcatgtcggaccagatggatggaagaagctatcaggcgacgacgttggagaactccactaccactactatcccgctgaagttgcagccgtggatcatgaaatgactgaagtgccagtggcctgaggaaaaacaaaaaccaagatcaattatcttcttcttatctttgctagttaaagagagtttaattttcttctcagactgtattgtgttcttgcaaatctgtaaaccattaaaacttactcgcactcggtgtttacaccaagtcaatagatgcaaggctacgtgtgttccgtacacattcatcacataattatgtttttgttactctttaatttttagttactagggttaaattatctaatttgcagcgtttcgaaaatagactcataatgtttgtatacattatagtatattttttagatcccacttgtggcctatgagatcatactg

SEQ ID NO: 2311 - DNA, 1103 bp, Antirrhinum majus
  misc_feature (27)..(27): n is a, c, g, or t
cggcacgagcgcaattattcagctganaaactacataatatcagggaaggatgatgaagatcgattttggcgggcttgatccccgggccccaattaaagaaagatcggatgaaatgtgtgatgagattttggctacaccttcgtttaaactccctgctgctactgatatgagtgattttgatgggtttcagaaagctgcagtacaaatggtgaagccagcaaggggaacaaccactctagcttttatattcaaagacggtgtcatggtggccgctgattcccgtgcaagcatgggagggtatatatcatcacaatccgtcaagaaaattattgagatcaacccctacatgcttggaacaatggctggaggagctgctgactgccagttctggcatagaaatctgggaattaagtgccgcttacatgaattggcaaacaagagaagaatttctgttgctggggcttcaaagatgttggcaaacattctgtattcttatcgggggatgggtttatctgttggaactatgatagctgggtgggatgaaaagggtcctggcctttattatgtggatagtgaaggaggacggcttaagggcactagattctcggttggttctggttctccatatgcttatggtgtcttagacagtggatatcgttttgatttgtcggttgatgaagctgcggagcttgctagaagagcaatttatcatgcaacattccgtgatggagccagtggtggtgttgccagcgtataccatgtcgggccaaatggatggaaaaagctatcaggtgatgatgttggagaacttcactaccattactatcctgtggaaccgacaacagtggaacaggagatgactgaggtttctattgcctgagggagaagacagggagtggaatatttcctgtcatttacttctgattagacgtgtaatggtttaatcttcaacgacttggcagataaaactacgtttgttatgtttgtaacattttattttgtttcaaattaaacaaattattttcagacattcataactttgtttgctggctgaatatgtaatttggttggtacctgtttgaatgtcagctttatttccatc

SEQ ID NO: 2312 - DNA, 878 bp, Brassica juncea
gtgggttcgagacatccatgcctacgattggattcgggtcgagcaacgatatgcttgatgggttttctactgtgccctcctttgaccttccccgcactactgattttgatgggtttcagaaagaggctgtgcagatggtgaagcctgcgaaaggaacaaccacacttgcttttatcttcaaagaaggtgtcatggtcgctgctgattctcgtgctagcatgggtggatatatctcctcacaatctgtgaagaagattattgaaatcaatccttatatgcttggtacaatggctggaggagctgctgactgccaattctggcacagaaatcttggtattaagtgccgtctacatgagctggcaaacaagaggagaatctctgtttccggagcttcaaaacttctagcaaacatgctctactcataccgtggaatgggactttccgtcggcacgatgattgctggatgggacgaaactggtcctggactatactatgtcgacaacgaaggaggaaggctcaagggagacaggttttcagtcggttctggttcaccatacgcttacggtgtactagacagcggatacaagttcgatatgtcagttgaagaagcttccgagttggcaaggagatcaatctatcatgcgacattccgtgatggagccagtggtggtgttgctagcgtgtaccacgtgggtcctaatggatggaagaaactgtcggggatgatgttggtgagctacactatcactactaccccgtgccaccggccattgcggaacaagtcatggaggaggcagccgccgagtaaaactaagattctcttttacttccaaatctttagcttaagctgtggtattcactctattaagattctcctt

SEQ ID NO: 2313 - DNA, 1042 bp, Plantago ovata
gttctcgttctcacagtactagtgattttacaactgcgcttgtaatctactgaatcaaccaggtaaaaaagatgatgaagattgatttcagcgggcttcagcccttagccccaaataaggaacaggccgacgaattctcggacgaaattaccgctgccccggcattcaagctacctgttgctgttgattttgatgggtttcagaaagcagcagtgcagatggtgaagccggcaaaggggactacgactcttgcttttatatttaaagatggtgttatggtggctgctgattcgcgtgccagtatgggaggatatatatcctcacagtccgtcaagaaaatcattgaaatcaatccatatatgctgggaacaatggctggaggagctgctgactgccagttctggcatagaaatctgggaattaagtgccgtttacatgaattggcgaacaaaagaagaatttcagttgctggagcttctaagatgttggcaaacatcctttattcttacagaggaatgggtttgtctgttggaactatgatagctggctgggatgagcagggccctggcctttattacgtggatagtgaaggggggcggcttaaaggcaagaaattttccgttgggtctgggtctccatatgcttatggtgttttagacagcggctatcgctttgacatgccagttgaagaagctgcagagctagctagacgagcaatttatcatgcaacattccgtgatggcgcaagtggtggtgttgccagcgtataccatgttggtccgaatggatggaaaaagctatcgggtgatgatgttggagaactccactacaagtactatcctgttgaacctacaaccgtggagcaagagatggcagaagtacctgttgcctgaggaagaaggcaagacctagacgatatttaatgtcatttacttctagcagcatttgtatgtccaatgttcttctatacatggaataacttttaatttgtgtgttagtgacatttatgttgtttcaaattataaaagaaattttctttcct

SEQ ID NO: 2314 - DNA, 1228 bp, Podocarpus macrophillus
ccgacttctgtgaagcgtctgttttctttcctcgcaagttttcttcatcaaacgctctcagctacaaaggttgcaagatgaagcttgatctcagtggccttgagcctgcaactctacaccaactctcaaacaatagcatttctgacactttctctcagacaccatcattcaagttaccaaatgatactgattttgatggcttccaaaaggcagcaatacaaatggtgaaacctgcaaaagggacaactacccttgcatttatattcaaagagggaataattgttgctgctgattcccgtgctagcatgggaggatacatttcatcacagtctgtaaagaaaattattgaaatcaatccacatttacttggtaccatggctgggggtgctgctgattgccagttttggcaccgaaaccttggtattaagtgtcgattacatgagctggctaacaaacggagaatatcagtgacaggtgcttccaaattgttggccaatattctttattcatatcgtggaatgggactttcaataggcacaatgattgctgggtgggatgaaacgggtccaggtttatattatgtagacagcgaaggaggacgacttaaggggacacgtttctctgttggatctggttcaacatatgcctatgggattctcgatagtggttaccattgggatatgcctgtggaagaagctgctgagcttgctcggcgagctatataccatgcaacatttcgtgatggagctagtgggggtgtagctagcgtgtactatgtgggtcctgaaggttggaagaaaatgtctggagacgatgtgtctgaacttcattacaagtactatccagttacagaaagtattatagagcacgaaatggctgaagccagtgcttgaaaacacttccattatgccacacaaattaatattctcaagcatctgcatctgcagagagggtatctttgatcaataatttgagctttttgttttgggtatttttacttgtaattaatcataaaattgccggttgtaatttttctagatacttgttaggagctttcaagattgtctaacacaaatctgttctttgttgttagcagttactattctgtttggataatgcatatttatgttaactcataggagatgttgcatttcatcagtgacagtcttcttaatttgcatggtgcaatagtgtaaactgcagaatttacgatattcaactagcgatt

SEQ ID NO: 2315 - DNA, 1150 bp, Papaver somniferum
ttccaaagcttcccttcgaccactgctacttaatatatttgctttcctctctgaaaaccccccaaattccatcgattttaatcagtatctcagaaataaggtatataagtatgaagctagacagtggacttgaaaactcttcttcaatctttctcggaggatgtagtgggcttgaagctgatttttcagctcccccatcgtttgatcttccaattactaatgattttgatgggtggcagaagaagtcagtacagatggtaaaacctgcaagggggacaactacacttgcttttattttcaaggaaggagttatggttgcagctgattctagagctagcatgggaggatatatctcatcacaatctgttaagaaaatcattgaaatcaacccatacatgcttggaacaatggctggaggagctgcagactgtcaattttggcacagaaatttgggtgttaagtgccggttgcatgagttggcaaacaagagaaggatttctgtcactggagcatcaaagcttctggccaacatcctctactcgtaccgaggaatgggtctgtccgttggtaccatgattgcaggttgggatgaaaagggtcctggattgtattacgtagacagcgaaggtggacgactgaaaggaaccagattttctgttggatctggttcgccatatgcatacggtgtactggataatgggtataagtatgacatgtcaattccagaagctgctgaattagctcgcagagctatctaccatgcaactttccgtgatgcagctagtggtggtgttgctagcgtttattatgttggacctgatggatggaagaagatgtcagggaatgatgttggtgaactccattacagctactacccagttgtcccaagcgttgtcgaacaagaaatgacagaggtaccagtagcttgattggataagaattgcgcagtaaaatcttagcttgtttctaatgttttctcttggattgatgtatatggtttgttgggaacttggtgggatggaaactgtggaaacaataaccaaacagaatttgacttggttatagagacaagttgtatttggaacctttttacattatcagttccagttttttaagttattttctaattgaatctaggggaatttaccgg

SEQ ID NO: 2316 - DNA, 1076 bp, Raphanus sativus
cttttctacagtaaggggtttaaaaagatgaagcttgatacaagtgggtttgagacctcaatgcctacgattggcttcggctctagtaacgatatgcttgattgattttctactgtgccctcctttgatcttcccctcaccacagattttgatgggtttcagaaagaggcagtacagatggtgaagccagcgaaaggaacaaccacgctcgcttttatattcaaagaaggtgtcatggtcgctgctgattctcgtgctagcatgggtggatatatctcctcacaatctgtgaagaagattattgaaatcaatccttatatgcttggtacaatggctggaggagctgctgactgccaattctggcacagaaatcttggaattaagtgccgtctacatgagctggcaaacaagaggagaatctctgtttccggagcttcaaaacttctggcaaacatgctctactcataccgtggaatgggtctttctgtcggcacgatgatcgctggatgggacgaaactggtcctggactatactatgtcgacaacgaaggaggaaggcttaagggagacaggttttcagtcggttctggttcaccatacgcttacggtgtactagacagcgggtacaaatttgatatgtcagttgaagaagcttccgagttagcaaggagatcaatctaccatgcgacattccgtgatggagccagtggtggagttgctagcgtgtaccacgtgggtcctaatggatggaagaaactgtcaggagatgacgttggggagctacactatcactactaccccgtgccaccagaaactgctgaacaagtcatggaggaagcagccgctgagtaaggagatccgtttttacttccaaatgattcgctctcttttatgtgtgttttgcttctagtaagtatactgagtttttatctagctcttaagttttggtattcactattacaaggttctcctttttttatctgcaaatacatgttcccattactttgttcaagcagctctttttaactctcaccctgtgttttaaagtatgaaataatctgtgattgttttgaaca

SEQ ID NO: 2317 - DNA, 964 bp, Nicotiana benthamiana
atctgatttatcaattattgcagttaaaggttttcaatgatgaagatcgattttagtggacttgaaccgactgccacacttcgaggggagtctctggagctatttgatgacattcctagttctccgtcattccagattcctaacactactaattttgacggttttcaaaaagaagcaatccaaatggtgaagcctgcgaagggaaccacaacccttgctttcatttttaaagaaggtgtcatggttgctgctgattctcgggctagcatgggaggatatatatcatctcagtctgtgaagaaaatcattgaaattaatccacatatgcttggcacaatggctggtggggctgctgactgccaattctggcacagaaacttgggaatcaagtgccgtctgcatgaactggcaaacaaaaggagaatttcagttactggagcttcaaagctgctggcaaacattttgtattcttatcgcggaatgggttgtctgtcggaactatgatttcgggttgggatgagaagggtccaggactatattatgtggatagtgaaggaggacggcttaaaggaaccagattctctgttggatctggttcaccctatgcttatggtgttttggataatggttaccgatatgatttgtccgtggaagaagcagccgagttagctacacgagcgattatcatgctacgttccgtgatggagctagtggaggtgttgctagtgtttatcatgtcggaccaaatggatggaagaagctatcaggtgacgatgttggagaactccattacaactactatcccgttgaagtagcagcagtggaacaggaaattgctgaagtgccagtgggttgaggataaaggaccctgtaataatgtttgtttatgtcatgatttttgtaaaccagatgaaatatgttctcatctttgcaaattaaagatacatcaatgtttatttttctg

SEQ ID NO: 2318 - DNA, 1183 bp, Arachis hypogaea
gcttcaacctcaacgatacctcacacacgcagatcccacttcacttgacctagtctaaaatctgaaatcatgaagctcgatacttctggtctagaatcgttctctacactcaccgcacccggagacgacatcgttggagagttctctgctccgccgtcattccagcttcctaattccaatgatttcgatggctttgtgaaagaagctattcagacggtgaagcctgcaaagggtactacaacgcttgcttttatatttaaggacggtgtcattgtagctgctgattctagagctagcatgggaggatatatatcttcacagtctgtaaagaagattattgaaattaatccatatatgcttggaacaatggccggaggtgccgcggattgccaattttggcacagaaatctcgggataaagtgtcggttgcacgagttggcaaataaaaggaggatatcagtaaccggagcctcaaagctacttgcaaatattttatactcttatcgtggaatgggtttatcagtcggtaccatgattgctggatgggatgaaacgggtcctggtctatattatgttgatagtgaaggaggaagattgaaaggcactagattctctgttggatctggttcaccatatgcttatggtatattggacagtgggtaccgatatgacctgtcagttgatgaagctgttgaactaggtcgacgagcaatatatcatgcaacattccgtgatggagctagtggtggagttgttagcgtttaccatgtgggaccagaaggatggaagaaatggactggtgatgatgttggggacctacattaccaatactaccctgttgtcccaagcactgtggaacaagaaatggctgaggcaacaggagcttaataaaagaagtaacttatggatatgtttcttagtttcttctctgccttttcatattctcaatcaactgtgtgagactaactattttatttttgaaatatggcattcctttgatgtggacaattgctgcctttatgatgtgtttagacttgagattaaagaaaatttagcatcgaaagtaaggattaagccacttgtttcgaagttggtaaatatgaaattgaaagcacatcagagtggtgtaatagagagtagagagttgtaagtcaatcattatccttcttaaaaggaaatttct

SEQ ID NO: 2319 - DNA, 1152 bp, Arachis hypogaea
acacgcagatcccacttcacttgaatcagtctaaaatctgaaatcatgaagctcgatacttctggtctcgaatcgttctctacactcactgcacccggagacggcgtcgttgtagagttctctgccccgccgtcattccagcttcctaattccaatgatttcgatggctttgtgaaagaagctattcagatggtgaagcctgcaaagggtactacaacgcttgcttttatatttaaggacggtgtcattgtagctgctgattctagagctagcatgggaggatatatatcttcacagtctgtaaagaagattattgaaattaatccatatatgcttggaacaatggccggaggtgccgctgattgccaattttggcacagaaatcttgggataaagtgtcggttgcacgagttggcaaataaaaggaggatatcagtaaccggagcctcaaagctacttgcaaatattttatactcttatcgtggaatgggtttatcagtcggtaccatgattgctggatgggatgaaacgggtcctagtctatattatgttgatagtgaaggaggaagattgaaaggcactagattctctgttggatctggttcaccatatgcttatggtgtattggacaatgggtaccgatatgacctgtcagttgaggaagctgttgaactaggtcgacgagcaatatatcatgcaacattccgtgatggagctagtggtggagttgttagtgtttaccatgtgggaccagaaggatggaagaaatggactggtgatgatgttggggacctacattaccaatactaccctgttgtcccaagcactgtggaacaagaaatggctgaggcaacaggagcttaataaaagaagtaactcatggatatgtttcttagtttcttctttgccttcatattctcaatcaactgtgtgagactaattattttatttttgaaatatggcattcgtttgatatgtacaattgctgcccctttatgatgtgtttagacttgagattaaggaaaatttagcatcgaaaagtaaggattaagtaagccacttgtttcgaagttggtaaatatgaaagcacatcagacaaaaatgttgccatcttgtgagttatggttttcattgccattcctgaaattcata

SEQ ID NO: 2320 - DNA, 1341 bp, Cryptomeria japonica
  misc_feature (2)..(2): n is a, c, g, or t
  misc_feature (32)..(32): n is a, c, g, or t
gntgcattaacttcacactgcttctcttaaanacatttagaacttaccttagggctacaaggttttactttctcacgttctatcaacaggactaagcaaactttatgtgcttcagattattgctgaatcttcaaaggctggcaaattcatccgattaacatctgcagggagaaacctcggttacaagatgatgaagcttgacttcagtggccttgagcctgcgacactgcatcagctcccaaatgataacatgtctgacattttgtcccaagcaccatcgttcaagttgccaaatgacactgattttgatggtttccaaaaagcagcagtgcaaatggtgaaaccagcaaaagggacaacaactctggcttttatattcaaagagggtattattgttgctgctgattctcgtgccagcatgggaggatatatatcatcacagtccgtgaagaaaattattgaaatcaacccatatttacttggtaccatggctggaggtgctgctgattgtcagttttggcacagaaacctgggtattaagtgtcgattgcatgagctggcaaacaaacggaggatatcggtcacaggtgcttcaaaattgttggccaatattctgtattcataccgaggaatgggtctatcgataggcacaatgattgctgggtgggatgaaacgggccctggtctatattatgttgacagtgaaggaggacgacttaagggaacacttttctctgttggatctggttcaacgtatgcctatggtattctagatagtggttaccgttgggatatgcctgtggaagaagctggtgaacttggtcgtcgagctatataccatgcaacatttcgtgatggggccagtgggggtgtagcaagtgtttactatgtgggccctcaaggttggaagaaattgtctggagatgatgtgggtgaacttcattacaactactatccagttacagaaaatgttgtagagcaggagatggctgaaggcagtgcttgaaagttctattgtcattccattaaggttattggatcaaactacagattataacttactttatgcacgactacattctccagttctgtgacgcacccacatagctggtggttgtgatcattaattttggtttgttgtcgtggggattctgtgctagaaatgattcacaaaatttgcaattgtaaaatttttatattcattttaagacggttcacaatagtcaaatgggatcagatttttgttgcaataatttagatggctttatatttctgattgataagcttggggcatttcacctgataatatcatcttaatattcatgatgtcgagttcaatct

SEQ ID NO: 2321 - DNA, 1005 bp, Distylium racemosum
ggcaagggtgctgcgctctctatcgttctgtttttttaatttattcaacattggcggaggtttaattcgaactcctgtactttcctcagcaggggcaaggttaaaagatgaagctcgatttcagtggccttgagcctgcaactctacatcgactcagtaatgataatatttctgacacattctctcagacaccatcgttcaacttaccaaatgatgctgattttgatggtttccaaaaggcagcagtacaaatggtaaaaccagcaaaagggacaacaacattggcattcatattcaaagagggcatcattgttgctgctgattcacgagctagtatgggaggatatatatcatcgcagtctgtgaagaaaattattgaaatcaatccgtatttacttggtaccatggctgggggtgctgctgattgtcagttttggcacagaaatctgggtattaagtgtcgattgcatgagctggcaaacaaaaggaggatatcagtgacgggtgcttccaagctgttggcaaacattctttattcatatcgtggaatgggactgtcaataggcacaatgattgctggatgggatgaaacgggccctggtctatattatgtagacagtgaaggaggacggcttaaggggacacgtttctctgttgggtcaggttcaacatatgcctatggtgtcctggatagtggttatcgttgggatatgcctgtggaggaggcaggtgaacttgctcggcgctcaatatatcatgcaacctttcgtgatgcagctagtgggggtgtagcaagtgtgtactatgtgggccctgatggatggaagaaattgtctggagatgatgtgggtgaactccatttcaagtattatccagtcacagaaaatgttgtagagcaggagatggctgatgtcagtgtttaatattctccactatggctgccagtacgattgttggatcagactaaagattgatatttgttttaagtacaagttcacattctga

SEQ ID NO: 2322 - DNA, 1133 bp, Elaeis guineensis
tacgcgggggcctgaccccctccgcattccctccccaacaagaaacccttcttggcattcgacctcccgcagagcccgatcagcgtgttcctctgatctctactcgtcccaaactatttccggctgcagggttgtggcgatgaagctcgatactagcggtttcgaatcatttgcccctctaagcgggtcaatcgacgacgtctgctctgatctctcagcgcaccaatttttcgatctccctaactgttccgattttgatggatttcagaagaacgcgattcagatggtgaagccggcgaaagggacgactactcttgctttcgtcttcaaggaaggagtcatcgtcgcagccgattctcgagctagcatgggtggatatatctcttctcaaactgtcaaaaaaatcattgagataaatccatacatgattggaacaatggctggaggtgctgcagactgccagttttggcataggaatttgggcatcaagtgccgcttgcatgaattggcaaacaagcgaaggatatcggtagcaggtgcttcaaagctgttggccaatattctatactcatatcgtggaatgggcctttcagttgggaccatgattgctggatgggatgagacaggacctggtttgtattatgttgacagtgaaggaggaagacttaaaggtacacgtttttctgttggatctggatcaccatatgcatatggcgtactggataatgggtatcggtatgacatgtcaattgaggaagctgcagaactggctcgtcgagccatctatcatgcaacctttcgtgatggagctagtggtggcgtagtcagtgtgtattatgttggatgtgatggctggaaaaagctctcaggagatgatgtgggggagcttcattacacatactacccagttgccccaagtcctgttgaacatgagatggctgaggtcccaccagcttgagggcattatcccttaagaatgccctgcctttgatattctaactttactttttttttatttattttaagttaagacgaacgagtaagttacttagtttatcgaagttaaatttaaattaattactagtctacgatcgttttatttggttacgttaaactttagaggttaagttaag

SEQ ID NO: 2323 - DNA, 1316 bp, Arachis hypogaea
accaacacttgaaaacagttctttttttctactggatctgtgaatctcccgttcttcttttctcgcttcaacctcaacgatacctcacacacgcagatcccacttcacttgacctagtctaaaatctgaaatcatgaagctcgatacttctggtctagaatcgttctctacactcaccgcacccggagacgacatcgttgtagagttctctgccccgccgtcattccagcttcctaattccaatgatttcgatggctttgtgaaagaagctattcagacggtgaagcctgcaaagggtactacaacgcttgcttttatatttaaggacggtgtcattgtagctgctgattctagagctagcatgggaggatatatatcttcacagtctgtaaagaagattattgaaattaatccatatatgcttggaacaatggccggaggtgccgcggattgccaattttggcacagaaatctcgggataaagtgtcggttgcacgagttggcaaataaaaggaggatatcagtaaccggagcctcaaagctacttgcaaatattttatactcttatcgtggaatgggtttatcagtcggtaccatgattgctggatgggatgaaacgggtcctggtctatattatgttgatagtgaaggaggaagattgaaaggcactagattctctgttggatctggttcaccatatgcttatggtatattggacagtgggtaccgatatgacctgtcagttgatgaagctgttgaactaggtcgacgagcaatatatcatgcaacattccgtgatggagctagtggtggagttgttagcgtttaccatgtgggaccagaaggatggaagaaatggactggtgatgatgttggggacctacattaccaatactaccctgttgtcccaagcactgtggaacaagaaatggctgaggcaacaggagcttaataaaagaagtaacttatggatatgtttcttagtttcttctctgccttttcatattctcaatcaactgtgtgagactaactattttatttttgaaatatggcattcctttgatgtggacaattgctgcctttatgatgtgtttagacttgagattaaagaaaatttagcatcgaaagtaaggattaagccacttgtttcgaagttggtaaatatgaaattgaaagcacatcagagtggtgtaatagagagtagagagttgtaagtcaatcattatccttcttaaaaggaaatttcttgctgctgtgttttctatagttgtttcttagtgagcacatggaaaacaaaaggattgagttgctgagtc

SEQ ID NO: 2324 - DNA, 1093 bp, Allium cepa
atatcgttcctaaaacagttagttttaacttcggaatttaaacaaaaatgattctcgataccagcggtttagaatccaaggcctcgcatcccgttgtatctgacgagctatgttcggatctcgctgcaccgtcatcctttgatcttccaaactgcacggatttcgatgggttccagaagaaatcaattcaaatggtgaaaccagcaaaaggaacgacaacgcttgcgtttatattcaaagagggtgtgattgttgctgctgattctagagctagcatgggaggatacatttcttctcaatctgtgaagaaaattattgagataaatccgtatatgattggtacaatggctggaggtgctgcagattgccaattttggcacagacaccttggcatcaaatgccggcttcatgaactggccaacaagcgaagaatctcagtaactggagcttcaaagcttttggcaaacattcttttctcatatcgtggaatgggcctttctgtaggtactatgattgctggatgggatgagaccggtcctggtttgtactatgttgatagtgaaggtggaagattgaaaggaaacaaattttcggtaggatcagggtctccatatgcatatggtgttcttgacaaggggtatcggtatgacatgtcaattgaggaagctgcagagctagctcgtagatctatttatcatgcaacttttcgtgatggagctagtggtggcgttgcgagtgtatactatgttggacccactgggtggaaaaagctatcgggcgacgatgttggtgagctgcactacaagtactaccctgtagtcccagctacagttgagcatgaaatggccgatgctcctgctgcttaaaagtgctctgtttgtcaattttattgtattttctgcaactactgagacttatatatttgtatgatgcattcaattcatatgagaatatctgtcttgttatgaattgatgttttttagacttaactgtcagcttttctgcttaaaagtaattttgttctgggtgagaatagctattattacaactctctcttgttgcttagtgctcatttggaacaatttgttctatt

SEQ ID NO: 2325 - DNA, 1476 bp, Gossypium raimondii
aaacgttttaactattctcaaagtagagatagactagggactaaacaaagaagactctgagattaaaagaagattgctgcaataattataaaggaaaggtggctttccaggatcacaaatacgaaattccctgtgaactatttcacagtaaacaaagataactccaaatcaacctcgagtgacgaacctgcccgcctgcctgcctgccacgctcccttcgctcaacctgctcatcttcaccctccacgtttcatcccatccctctctcacgcttttactttgctttcctaatctcacctctctttcctttctgctgctgcttcagctgtcttttcatcaaaagcttgggtttctttttcttcttttttgcgccatgttgctgaaagctgctccagctttttcttcgttaaatcctcaactggaaaatcagggtgccctgttttcccctttttcttcttcgattaatcatcagctatcttctctaagaaatggacctgggtctcttgtagtttgtgcagccaaaggagccaaccacaagccactaagtggtgttgttttccagccctttgtggaagtgaaaaaggaactcgatcttgtcccctccgtgcctcaactttctctggctcgccaaaagttcactgatgactgtgaagcttccatcaacgaacaaatcaatgtcgaatacaatgtttcctatgtgtatcatgctatgtttgcttacttcgatagggacaacgttgcactcaagggtcttgccaagttcttcaaggaatcgagtttagaagagagagaacatgctgagaaatttatggaataccagaacaaacgaggtggaaaagtgaagctgcagtccatagtgatgcccctctctgagtttgatcatgcagagaaaggagatgcattatacgcaatggagcttgccttgtccctggagaaactaacaagtgaaaagctctttaacctacgtaatgtagccgtgcggaaccatgatgtgcagttaacggatttcattgaaggcgaattcttagctgagcaggtggaggccatcaagaaaatatcagaatatgtagctcaattgagaagagttggaaaaggacacggggtgtggcacttcgatcaaatgcttcttcgtgagggagaggaagctattgcatgaagccccaacttgctgcttcgttccatgtcaaaagtttgtgcataaggtcttatttcagtagttctttgtttatatattttggctgtatgttgaaagatagtgccggatctttggtttgatgataaaagctcgtaagggatatatttttagtagtccttttaatcgaagtagttatagattcgtggatttcctatataggtatttttcttctccgagatctttccttctgtgttttttcttttaaatttgccctagcgacgtttatgacagttttcttcggttatatcctgcagcaacggtagattgccaataggaaaagt

SEQ ID NO: 2326 - DNA, 1222 bp, Gossypium hirsutum
atggggcatccatccatccatccctctctcaatctttatctccttcaattgtttgtttttgggtttagaaagctctgtttttttattacccttttcatcaaaaagcttcaatctttcaaccatgttgcttaaagcttcccctgctttttctttgttgaagaatccccaagttgaaactcgggttcctctgttttcaagaaacggttctggggttgggtctggggctgttgttgtttgtgctaccaaaggagccaataataagccattaacaggtgtgatttttgagccttttgaggaagttaagaaggaacttaatcttgtcccaactgtgcctcaaatgtccttggctcgtcaaaagtttgctgatgagtgtgaagctgccatcaacgaacaaatcaatgtggagtacaatgtttcatatgtctaccatgctatgtttgcctattttgatagggacaacgttgctctcaagggtcttgccaagttcttcaaggaatcaagcttagaagagagagagcatgctgagaaattgatggaataccagaacaaaagaggtggacaagtgaagctgcaatccataataatgcccctctctgagtttgatcatgcagagaaaggggatgctttatatgcaatggagcttgccttgtctctcgagaaactaacaaacgaaaagctcttgaacttgcacaacgtggctgagcgaaaccatgattcgcagttgaccgatttcatcgaaggcgagttcttagctgagcaggtcgaatccatcaagaaaatatcggaatacgtggctcagctgagaagagttggcaaaggacatggggtgtggcactttgatcaaatgcttctccacgagggagctgttgcatgaaaacttgaccagagaaaccgccgcttgcttctgataccagcgatccttcttttaagttcccgtgttagtagttgttgagagattaagttttgcaagttgtatggctagtttagaaaactttgtgttgatgatataagaagattgagagactcaaaagggataatttgtaagtcctcttgatcatagctatagattttcatggtttttgacttttcgtatcgacatttttcgactgttttttcttcggttaaatgctctgcatagttagcagataaaataatacaagtagggatcattttgaagtttcgattgtgtttctatgaatgaaaaaaacgaagctaatatggg

SEQ ID NO: 2327 - DNA, 1339 bp, Gossypium hirsutum
tttttttattacccttttcatctaaaagcttcaatctttcgaccatgttgcttaaagcttcccctgctttttctttgttgaagaatccccaagttgaaactcgggttcctctgttttcaagaaacggttctgggtttgggtctggggctgttgttgtttgtgctaccaaaggagccaataataagccattaacaggtgtgatttttgagccttttgaggaagttaagaaggaacttaatcttgtcccaactgtgcctcaaatgtccttggctcgtcaaaagtttgctgatgagtgtgaagctgccatcaacgaacaaatcaatgtggagtacaatgtttcatatgtctaccatgctatgtatgcctattttgatagggacaacgttgctctcaagggtcttgccaagttcttcaaggaatcaagtttagaagagagagagcatgctgagaaattgatggaataccagaacaaaagaggtggacaagtgaagctgcaatccatattgatgcccctctctgagtttgatcatgcagagaaaggggatgctttatatgcaatggagcttgccttgtctctcgagaaactaacaaacgaaaagctcttgaacttgcacaacgtggctgagcgaaaccacgattcgcagttgactgatttcattgaaggcgagttcttagctgagcaggttgaatccatcaagaaaatatcggaatacgtggctcagctgagaagagttggcaaaggacatggggtgtggcactttgatcaaatgcttctccacgagggagctgttgcatgaaaacctgaccaaagaaaccgccgcttgcttctgataccagccatcgttcttttaagttcccgtgttagtagttgttgagagattaagttttgcaagttgtatggctagtttagaaaactttgtgttgatgatataagaagattgagagactcgaagggataatttgtaagtcctcttgatcatagctatagattttcatggttttcgacttttcgtatcaacatttttcgactgttttttcttcggttaaatgctctgcacagttagcagataaaataatacaagtagggatcattttgaagtttggattgtgtttctatgaatgaaaaaaacgaagctattatgggttaaaatgtggtcgcggccatggctgcttgaaggtctctgctagcatgggttaaaaagattttggtttaaatatgattttactccttttactatgttgaatgttggaatttaatctactagctttagatttatacaattttttttcactttattaaagaatgagatttatttaaaaaaatatgtactttttattt

SEQ ID NO: 2328 - DNA, 1736 bp, Gossypium raimondii
taattttcatatttattacattacctcaaataataaaaaatctaatttaaaagaaaataatatatataaaaaaagaaaatttatcattatttaacaaaaatattccatcttttttgtcttctagggtaaaagacaagaagacaataaagaagccctttttagggtcacaaatcacaaaaagaggggatttttctacacgagccagccacactcccacactgccaccctttcacctcctcatctctatcgtccacgtgccattcatccaatggttatcctcatccctagctatcctttttattgcctttgctgatccggtctctccttcatccatccatccctctctcaatctttatctccttcaattgtttgtttttgggttaaaaagctctgttttttttattacccttttcatcaaaaagcttcaatctttcaaccatgttgcttaaagcttcccctgctttttctttgttgaagaatccccaagttgaaactcgggttcctctgttttcaagaaacggttctggggttgggtctggggctgttgttgtttgtgctaccaaaggagccaataataagccattaacaggtgtgatttttgagccttttgaggaagttaagaaggaacttaatcttgtcccaactgtgcctcaaatgtccttggctcgtcaaaagtttgctgatgagtgtgaagctgccatcaacgaacaaatcaatgtggagtacaatgtttcatatgtctaccatgctatgtatgcctattttgatagggacaacgttgctctcaagggtcttgccaagttcttcaaggaatcaagtttagaagagagagagcatgctgagaaattgatggaataccagaacaaaagaggtggacaagtgaagctgcaatccatattgatgcccctctctgagtttgatcatgcagagaaaggggatgctttatatgcaatggagcttgccttgtctctcgagaaactaacaaacgaaaagctcttgaacttgcacaacgtggctgagcgaaaccatgattcgcagttgaccgatttcatcgaaggcgagttcttagctgagcaggtcgaatccatcaagaaaatatcggaatacgtggctcagctgagaagagttggcaaaggacatggggtgtggcactttgatcaaatgcttctccacgagggagctgttgcatgaaaacctgaccaaagaaaccgccgcttgcttctgataccagccatcgttcttttaagttcccgtgttagtagttgttgagagattaagttttgcaagttgtatggctagtttagaaaactttgtgttgatgatataagaagattgagagactcgaagggataatttgtaagtcctcttgatcatagctatagattttcatggttttcgacttttcgtatcaacatttttcgactgttttttcttcggttaaatgctctgcacagttagcagataaaataatacaagtagggatcattttgaagtttggattgtgtttctatgaatgaaaaaaacgaagctattatgggttaaaatgtggtcgctgccatggctgcttgaaggtctctgctagtatgggttaaaaagattttggtttaaatatgattttactccttttactatgttgaatgttggaatttaatctactagctttagatttatacaattttttttcactttattaaagaatgagatttatttaaaaaaatatgtactttttatttaaa

SEQ ID NO: 2329 - DNA, 1204 bp, Gossypium raimondii
catccatccatccctctctcaatctttatctccttcaattgtttgtttttgggttaaaaagctctgttttttttattacccttttcatcaaaaagcttcaatctttcgaccatgttgcttaaagcttcccctgctttttctttgttgaagaatccccaagttgaaactcgggttcctctgttttcaagaaacggttctgggtttgggtctggggctgttgttgtttgtgctaccaaaggagccaataataagccattaacaggtgtgatttttgagccttttgaggaagttaagaaggaacttaatcttgtcccaactgtgcctcaaatgtccttggctcgtcaaaagtttgctgatgagtgtgaagctgccatcaacgaacaaatcaatgtggagtacaatgtttcatatgtctaccatgctatgtatgcctattttgatagggacaacgttgctctcaagggtcttgccaagttcttcaaggaatcaagtttagaagagagagagcatgctgagaaattgatggaataccagaacaaaagaggtgggcaagtgaagctgcaatccatattgatgccctgctctgagtttgatcatgcagagaaaggggatgctttatatgcaatggagcttgccttgtctctcgagaaattaacaaacgaaaagctcttgaacttgcacaacgtggctgagcgaaaccacgattcgcagttgactgatttcattgaaggcgagttcttagctgagcaggtcgaatccatcaagaaaatatcggaatacgtggctcagctgagaagagttggcaaaggacatggggtgtggcactttgatcaaatgcttctccacgagggagctgttgcatgaaaacctgaccaaagaaaccgccgcttgcttctgataccagccatcgttcttttaagttcccgtgttagtagttgttgagagattaagttttgcaagttgtatggctagtttagaaaactttgtgttgatgatataagaagattgagagactcgaagggataatttgtaagtcctcttgatcatagctatagattttcatggttttcgacttttcgtatcaacatttttcgactgttttttcttcggttaaatgctctgcacagttagcagataaaataatacaagtagggatcattttgaagtttggattgtgtttctatgaatgaaaaaaacgaagcta

SEQ ID NO: 2330 - DNA, 1197 bp, Theobroma cacao
cgtgtcatccatctaatggcatcaacccccatccccaagcttactttttatcgccctgcctgcttgctccctccccgatcttcattcacaacacagtaagcgttacttcaaaaccctcgtcaattcttcttcccttgtttgcaagaagtctatcttttgcctttgcgttgaagagtctgtttaccgtttttgagccatgttgctgaaagctgctccagctttttctttgttgaatcctcaagtggaaaatcagggatccctgttttcctctgtttcttcatctcaaagctctcttttcagttctttttcttctccgactcttcgggtttccacgccgagaaatagaactggggctgttattgtttgtgctgccaaaggagccaacaacaagccactaactggtgtcgtttttgagcccttcgaggaggttaagaaggagctcgatcttgtcccaaaagtgcctcaggtttctttggctcgtcaaaagtatactgatgagtgtgaagctgctgtcaatgaacaaatcaatgtcgaatacaatgtctcctatgtgtaccatgctatatttgcctacttcgacagagacaacattgcgctcaagggtcttgccaagttcttcaaggaatcgagcttagaagagagagggcatgctgagaaactgatgaaataccagaacaaacgaggtggaaaagtgaagctgcagtccatcgtgatgcctctctctgagtttgaccatgcagagaaaggagatgcattgtatgcgatggagcttaccctgtccctggagaaactaacaaacgcaaagctcctgaacttgcacagtgttgctgaacggaaccacgatgtgcagttgacagagtttattgaagctgaatacttatctgagcaggtggaggccatcaagaaaatagcagaatatgtggctcagttaagaagagttggaaagggacatggggtgtggcactttgatcagatgcttctccatgagggagaggaagctattgcatgataccgaaacttgctgatcggttccatgtctgaggttgttctataaggtcttgtgtcagtagttccttgtcaagagattttggttgtaatctgtataattagtgcagacagaaacttttgtgttgatgatcagagctcatatgggatatttttaagtcctcttaatcgaagtagttatagattcatgga

SEQ ID NO: 2331 - DNA, 1627 bp, Arabidopsis lyrata
gagtatcgacgggaattatccgtaacagagtgacagtgaggtgtgaaggaagaagacgatggcgtcgatgtctctctccttttcttcttcgctatgttcgtctcgaattcccgaaggaaagcgtaggtttcgtcacagagatgcgagcttcgtacgatgcgttttggctgcttctaaatcttctccgggaagtgttacgaagaagaggctttggaaagacggcgaatttcccggaatcacggaacctgttaatccgagaagaactccgattaagaatgtgaagaagaaacttgacaggagaagcaaagctaacggatgggctaacaccgtcactgaaactttgtccgatctcatcgccaaaaagcagtggttacaagctcttgaggtttttgatatgttgagggaacaaacgttttatcaaccaaaggaaggaacttacatgaagctgcttgttcttctggggaaatctggtcaacccaatcgagcacagaagctgttcgacgaaatgcttgaagaaggacttgaaccaactgttgaactctacactgctcttctcgctgcttacactcgtagcaatctcatcgacgatgctttttcaattcttgatacaatgaaaggcttgcctcaatgccaacctgatgttttcacgtacagcactctgctcaaggcgtgtgtggatgcttctcagtttgacttggtggattcgttatacaaggaaatggacgagcgtttgataactccaaacactgttacccagaacatagttttaagtgggtacggtagggtcggaaggtttgatcagatggagaaagttttgtctgatatgctggtgagtactgcttgcaaacccgatgtgtggactatgaatatcatccttagtgtgtttgggaacatgggtaagatagacatgatggagagctggtacgaaaagttcaggaacttcgggattgagccagagactcgtactttcaatattttgattggttcttatgggaagaagagaatgtacgataagatgtcgtctgtcatggaatacatgcggaagcttgagtttccatggacaacatcgacctacaacaatatcatcgaggcgtttgcggatgttggcgatgcaaagaacatggagttgacatttgatcagatgcgtagcgaaggtatgaaagcagacacaaagaccttttgctgtctcataaatggatatgccaatgccggtctttttcacaaggtcataagtagtgtccagttggctgctaagtttgagatacccgagaatactgccttttacaacgcggttatagcagcatgcgctaaagccgatgatctgatagagatggaaagagtgtacacaagaatgaaggagagacaatgcgtatgtgattcaagaacgtttgagatcatggtcgaggcatatgaaaaggaaggtatgaatgataagatatattacttggaacaagagaggcaaaagcttatggatcgcgctgtagctacaaaagagatggagaatcttccagcaggatgattgccgtttgtggtatgtctctctgcaaggagagatcagagatcgatgacttccttgaaagagtagaataaagagtttgtaatacacttgattgttcttgcagctatg

SEQ ID NO: 2332 - DNA, 1682 bp, Arabidopsis lyrata
gagtatcgacgggaattatccgtaacagagtgacagtgaggtgtgaaggaagaagacgatggcgtcgatgtctctctccttttcttcttcgctatgttcgtctcgaattcccgaaggaaagcgtaggtttcgtcacagagatgcgagcttcgtacgatgcgttttggctgcttctaaatcttctccgggaagtgttacgaagaagaggctttggaaagacggcgaatttcccggaatcacggaacctgttaatccgagaagaactccgattaagaatgtgaagaagaaacttgacaggagaagcaaagctaacggatgggctaacaccgtcactgaaactttgtccgatctcatcgccaaaaagcagtggttacaagctcttgaggtttttgatatgttgagggaacaaacgttttatcaaccaaaggaaggaacttacatgaagctgcttgttcttctggggaaatctggtcaacccaatcgagcacagaagctgttcgacgaaatgcttgaagaaggacttgaaccaactgttgaactctacactgctcttctcgctgcttacactcgtagcaatctcatcgacgatgctttttcaattcttgatacaatgaaaggcttgcctcaatgccaacctgatgttttcacgtacagcactctgctcaaggcgtgtgtggatgcttctcagtttgacttggtggattcgttatacaaggaaatggacgagcgtttgataactccaaacactgttacccagaacatagttttaagtgggtacggtagggtcggaaggtttgatcagatggagaaagttttgtctgatatgctggtgagtactgcttgcaaacccgatgtgtggactatgaatatcatccttagtgtgtttgggaacatgggtaagatagacatgatggagagctggtacgaaaagttcaggaacttcgggattgagccagagactcgtactttcaatattttgattggttcttatgggaagaagagaatgtacgataagatgtcgtctgtcatggaatacatgcggaagcttgagtttccatggacaacatcgacctacaacaatatcatcgaggcgtttgcggatgttggcgatgcaaagaacatggagttgacatttgatcagatgcgtagcgaaggtatgaaagcagacacaaagaccttttgctgtctcataaatggatatgccaatgccggtctttttcacaaggtcataagtagtgtccagttggctgctaagtttgagatacccgagaatactgccttttacaacgcggttatagcagcatgcgctaaagccgatgatctgatagagatggaaagagtgtacacaagaatgaaggagagacaatgcgtatgtgattcaagaacgtttgagatcatggtcgaggcatatgaaaaggaaggtatgaatgataagatatattacttggaacaagagaggcaaaagcttatggatcgcgctgtagctacaaaagagatggagaatcttccagcaggatgattgccgtttgtggtatgtctctctgcaaggagagatcagagatcgatgacttccttgaaagagtagaataaagagtttgtaatacacttgattgttcttgcagctatgtgtgttatatttgttgatgggccaaaaattatgaatagagcccaaaaagataaaa

SEQ ID NO: 2333 - DNA, 1795 bp, Eutrema halophilum
tgtaaccggctattaccatatccaaccgaaatgagtattgacgggaattatccgtaacagagtgacagcgaggtgtgaaggaagaagacgatggcgtcaatgtctctctcgttttcttcttcgctatgttcgtctcgaattccccaaggagagcgtagatttcttcagagagatgtgagcttcgtacgatgcgttctggctgcttcaaaaccttctccgggaggtgctacgaagaagaggctttggaaggaaggcgagtttcctggaatcacggagccagttaatcccagacgaaccccgatcaagaatgtgaagaagaaattggacaggagaagcaaagctaacggatgggtttgcacagtcactgaaaccttgtccgatctcatcgccaaaaagcagtggttacaagctctcgaggttttcggtatgttgagggagcaaccattttaccaaccaaaggaaggaacttacatgaagctgcttgttctgctggggaaatctggacaacccaaccgtgcacagaagctgttcgacgaaatgcttgaagaaggacttgagcccactgctgagctctacactgctcttctcgcggcttacactcgcaacaatctcatcgacgaggccttttcaatacttgaccgaatgaaaagcctgcctcgatgccaacctgatgttttcacatacagcactctgctcaaggcgtgtgtggacgcttctctatttgacctggtggactcgttatacaaagaaatggacgaacgtttgataactccaaacaccgtgacccagaacatagtcttaagtgggtttggtagggtcggaaggtttgatcagatggagaaagttctgtctgatatgctggtgagtacttcttgcaaacctgatgtgtggactatgaacatcatccttagcgtgtttggcaacatgggaaagatagacatgatggagagctggtacgaaaagttcaggaacttcgggattgagccagagactcgaagcttcaacatcttgatcggtgcttatgggaagaagagaatgtatgataagatgtcgtccgtgatggaatacatgcgaaagcttgagtttccatggacgacatcgacttacaacaacatcatcgaggcgtttgcggatgttggtgatgcaaagaacatggagtacacgtttgatcagatgagaagcgaaggtatgaaagcagacacaaagaccttttgctgcctcataaacggatacgccaatgcaggtcttttccacaaggtgataagcagcgtacagctggctgcaaagtttgagatacccgagaatacatcgttttacaacgcggttatatcagcgtgtgcaaaagccgatgatctgatagagatggaaagagtgtacaaaagaatgaaggagagggaatgtgtatgcgattcaagaacgtttgagatcatgatcgaggcgtatggaaaagaaggaatgaatgataagatctattacttggaacaagagaggcaatttgcagctacgaaagaggaggagaatctccctggatgatcgaggtttgtgatttattctctgcattgaaacagtagaagtaagagttttgtaatacacttgattgttcgttcttgcagcttatgtgtataaaaagcttttatttatgaaagtcttgtgcgttgtttgatgtgggccaaaatttatatatattgggcccataaataaagcctgacttgcccaggaagtcggatgagtccagtttgactagccttgcggtaactgcttggctttttctataaaatctgtctcgtttttctct

SEQ ID NO: 2334 - DNA, 1805 bp, Eutrema parvulum
tgtaaccgaattttaccatatccaaccgaaatgaggattgacgggaattatccgtaacagagagtgacagcgaggtgtgaaggaaggaagaagacgatggcgtcaatgtctctctcgttttcttcttcgctatgttcgtctcgaattcccgaaggaaagcgtagatttcatcagagagatgcgagcttcgtgcgatgcgttctggctgcttctaaatcttctccgggaggtgttacgaagaagaggctttggaaggaaggcgaatttcctggaatcacggagccggttaatccgagacgaaacccgatgaaaaatgtgaagaagaaactagacagaagaagcaaagccaacggatgggttaacaccgtcaccgaaaccttgtccgatctcatcgccaaaaagcagtggttacaagctctcgaggtttttgaaatgttgaaagaacaaccattttaccaaccaaaggaaggaacttatatgaagctgcttgttcttctggggaagtctggacaacctaaccgtacacagaagctgttcgacgaaatgctcgaagaaggacttgaacccactgctgagctctacactgctcttctcggggcttactgtcgcaataatctcatcgacgaggctttttcaattcttgaacgaatgaaaagtttgcctcaatgccaacctgatgttttcacatacagcactctcctcaaggcgtgtgtggacgcttctctatttgacttggtcgagtcgttatacaaagaaatggacgaacgtctgatatctccaaacacagtgacccagaacatagtcttaagtgggtacggtagggttggtaggtttgatcagatggagaaagttttgtctggtatgctggtgagcacttcgtgtaaacctgatgtgtggactatgaacatcatccttagcgtgtttggaaacatgggtaagatagacatgatggagagctggtacgaaaagttcaggaacttcgggattgagccagagactcgaagtttcaatatcttgattggtgcttatgggaagaagagaatgtatgataagatgtcgtccgtgatggaatacatgagaaagcttgagtttccatggacaacatccacctacaataatatcatagaggcgtttgcggatgtcggtgatgcaaagaacatggagtatacgtttgatcagatgcgtagcgaaggtatgaaagcagacacaaagaccttttgctgcctcataaatggatatgccaacgctggtcttttccataaggtgataagtagtgttcaattggctgcaaagtttgagatacccgagaacacttccttttacaacgcggttatatcagcgtgtgccaaagccgatgatttgatagagatggaaagagtgtacacaagaatgaaggagagagaatgtgtatgcgattcaagaacgtttgagaccatgatcgaggcgtatgaaaaggaaggaatgaacgataagatctattacttagaacaagagaggcaaaaggctatggatcgcgctgcagctacgaaagaggaggagaatatcccgggatgattgcggtttgtgaatctctgcaatgagagagatgtttcccttcagacaatagaaggaaggagtttgtaatacacttgattgttcttgcagctatgtgtataaaagcttttgatgggccaacaaattatatattgggcccataaaagaaagcctgacgtgtccaagaagtcggatgagtccaaatttataattttgactaggcttgcggtaactgcttggctttattctataaatttgtctcgtctctctct

SEQ ID NO: 2335 - DNA, 1857 bp, Eutrema parvulum
gaggattgacgggaattatccgtaacagagagtgacagcgaggtgtgaaggaaggaagaagacgatggcgtcaatgtctctctcgttttcttcttcgctatgttcgtctcgaattcccgaaggaaagcgtagatttcatcagagagatgcgagcttcgtgcgatgcgttctggctgcttctaaatcttctccgggaggtgttacgaagaagaggctttggaaggaaggcgaatttcctggaatcacggagccggttaatccgagacgaaacccgatgaaaaatgtgaagaagaaactagacagaagaagcaaagccaacggatgggttaacaccgtcaccgaaaccttgtccgatctcatcgccaaaaagcagtggttacaagctctcgaggtttttgaaatgttgaaagaacaaccattttaccaaccaaaggaaggaacttatatgaagctgcttgttcttctggggaagtctggacaacctaaccgtacacagaagctgttcgacgaaatgctcgaagaaggacttgaacccactgctgagctctacactgctcttctcggggcttactgtcgcaataatctcatcgacgaggctttttcaattcttgaacgaatgaaaagtttgcctcaatgccaacctgatgttttcacatacagcactctcctcaaggcgtgtgtggacgcttctctatttgacttggtcgagtcgttatacaaagaaatggacgaacgtctgatatctccaaacacagtgacccagaacatagtcttaagtgggtacggtagggttggtaggtttgatcagatggagaaagttttgtctggtatgctggtgagcacttcgtgtaaacctgatgtgtggactatgaacatcatccttagcgtgtttggaaacatgggtaagatagacatgatggagagctggtacgaaaagttcaggaacttcgggattgagccagagactcgaagtttcaatatcttgattggtgcttatgggaagaagagaatgtatgataagatgtcgtccgtgatggaatacatgagaaagcttgagtttccatggacaacatccacctacaataatatcatagaggcgtttgcggatgtcggtgatgcaaagaacatggagtatacgtttgatcagatgcgtagcgaaggtatgaaagcagacacaaagaccttttgctgcctcataaatggatatgccaacgctggtcttttccataaggtgataagtagtgttcaattggctgcaaagtttgagatacccgagaacacttccttttacaacgcggttatatcagcgtgtgccaaagccgatgatttgatagagatggaaagagtgtacacaagaatgaaggagagagaatgtgtatgcgattcaagaacgtttgagaccatgatcgaggcgtatgaaaaggaaggaatgaacgataagatctattacttagaacaagagaggcaaaaggctatggatcgcgctgcagctacgaaagaggaggagaatatcccgggatgattgcggtttgtgaatctctgcaatgagagagatgtttcccttcagacaatagaaggaaggagtttgtaatacacttgattgttcttgcagctatgtgtataaaagcttttgtcaaacatctgaaagtagtccttgtattgctaagtagaatcaagagatttgaaggttttatttatgtagtctctgtgttatcttatgggccaacaaattatatattgggcccataaaagaaagcctgacgtgtccaagaagtcggatgagtccaaatttataattttgactaggcttgcggtaactgcttggctttattctataaatttgtctcgtctctctct

SEQ ID NO: 2336 - DNA, 1564 bp, Eutrema halophilum
gtgaaggaagaagacgatggcgtcaatgtctctctcgttttcttcttcgctatgttcgtctcgaattccccaaggagagcgtagatttcttcagagagatgtgagcttcgtacgatgcgttctggctgcttcaaaaccttctccgggaggtgctacgaagaagaggctttggaaggaaggcgagtttcctggaatcacggagccagttaatcccagacgaaccccgatcaagaatgtgaagaagaaattggacaggagaagcaaagctaacggatgggtttgcacagtcactgaaaccttgtccgatctcatcgccaaaaagcagtggttacaagctctcgaggtatttaggttttcggtatgttgagggagcaaccattttaccaaccaaaggaaggaacttacatgaagctgcttgttctgctggggaaatctggacaacccaaccgtgcacagaagctgttcgacgaaatgcttgaagaaggacttgagcccactgctgagctctacactgctcttctcgcggcttacactcgcaacaatctcatcgacgaggccttttcaatacttgaccgaatgaaaagcctgcctcgatgccaacctgatgttttcacatacagcactctgctcaaggcgtgtgtggacgcttctctatttgacctggtggactcgttatacaaagaaatggacgaacgtttgataactccaaacaccgtgacccagaacatagtcttaagtgggtttggtagggtcggaaggtttgatcagatggagaaagttctgtctgatatgctggtgagtacttcttgcaaacctgatgtgtggactatgaacatcatccttagcgtgtttggcaacatgggaaagatagacatgatggagagctggtacgaaaagttcaggaacttcgggattgagccagagactcgaagcttcaacatcttgatcggtgcttatgggaagaagagaatgtatgataagatgtcgtccgtgatggaatacatgcgaaagcttgagtttccatggacgacatcgacttacaacaacatcatcgaggcgtttgcggatgttggtgatgcaaagaacatggagtacacgtttgatcagatgagaagcgaaggtatgaaagcagacacaaagaccttttgctgcctcataaacggatacgccaatgcaggtcttttccacaaggtgataagcagcgtacagctggctgcaaagtttgagatacccgagaatacatcgttttacaacgcggttatatcagcgtgtgcaaaagccgatgatctgatagagatggaaagagtgtacaaaagaatgaaggagagggaatgtgtatgcgattcaagaacgtttgagatcatgatcgaggcgtatggaaaagaaggaatgaatgataagatctattacttggaacaagagaggcaatttgcagctacgaaagaggaggagaatctccctggatgatcgaggtttgtgatttattctctgcattgaaacagtagaagtaagagttttgtaatacacttgattgttcgttcttgcagcttatgtgtataaaaag

SEQ ID NO: 2337 - DNA, 1730 bp, Brassica napus
gtgaaaggaagaagacgatggcgtcaatgtctctctcgttttcttcttcgctatgctcatctcgaatccccgaatcaaaacgcagattccaccaaagagaaccaatcttcgcgcgatgcgttctcgccgcttctaaatcatctccgggaggaggcgccaccgccgcgacgaagaagaggctctggaaggaaggagagttccccggaatcacggagcctgctaacactcgaagagccccgatgaagaacgtgaagaagaagctcgacaggaggagcaaagccaacgggtgggcttgcaccgtcaccgaaacgttatccgatctcatcgcgaagaagcagtggctgcaagctctcgaggtgttcgagatgctgagggagcaaccgttttatcagccaaaggaaggaacttacatgaagctcctcgttcttttggggaaatcaggacagcctcaccgtgcacagaaggtgttcgacgaaatgcttgaagaaggacttgaaccaactgctgagctctacactgctctactcggtgcttactgtcgtagcaatcttatagactctgctttctcagttctcgaacggatgaaaagtttacctcagtgtcaacctgatgtttacacttacagcactctcctcaaagcctgtgtggacgcttctttgtttgatttggttgagtctttgtatagagagatggatgagcgtttgataactccaaacactgtgactcagaacatagttttaagcgggtacgggagagttggtaggtttgatcagatggagaaagttttatcagatatgctggtgagtactgagtgtaagcccgatgtgtggacgatgaacattatcctcagcgtgtttgggaacatggggaagatagacatgatggagagctggtacgagaagttcaggaacttcgggatcgagcctgagactcggagtttcaatatcttgatcggtgcgtatgggaagaagagaatgtatgataagatgtcgtccgtgatggagtacatgagaaagctcgagtttccgtggacgacgtcgacttacaacaacatcatcgaggcctttgcggatgtgggtgatgcgaagaacatggagtatacgtttgatcagatgcgtagcgaaggtatgaaagcagatacaaagaccttttgctgtctcattaatggatatgccaatgctggtcttttccataaggtgataagtagtgttcagttagctgcgaagtttgagatacctgagaatacttctttttataatgcggttatatcggcgtgtgccaaagcggatgatcttatagagatggagagagtgtacacgaggatgaaggagagggaatgtgtgagggattcgagaacgtttgagatcatggcggaggcgtatgagaaggaaggtatgaatgataagatctattacttggagcaagagaggcagcaggttatggatcatcatgctgcagctacgaaagaggaggagaatctcccgggatgattgcaaggagagtggagatctttaccatttcaaacagtagagtaaaagagagtttgtaatacacttggattggtcttgcagctatgtgtataaagcttttcttgtttttgttatgttgaatgtttggtttttaagtaaaaggtaatcattctcttgcgttgttttctttatgggccataaaattatatattcagcccataaagcccagtaactacttgtcaattctataaagatgtttca

SEQ ID NO: 2338 - DNA, 1821 bp, Brassica rapa
aagctgaaccgtgtaaccggatttgaccatatccaaccgaaacgagttttaacgagaattatccgaaacacagagagagagaggagtgaaaggaagaagacgatggcgtcaatgtctctctccttttcttcttcgctatgctcatctcgactccccgaatcaaaacgcagattccaccagagagaaccaaccttcgcgcgatgcgttctcgccgcttcgaaatcctctccgggaggaggaggcgccaccgccacgacaaagaagagactctggaaagaaggagagttccccggaatcacggagcatgctaacactcgaagagctccgatgaagaacgtgaagaagaagctcgacaggaggagcaaagccaacgggtgggcttgcaccgtcaccgaaacgttatccgatctcatcgccaagaagcagtggctgcaagctctcgaggtgttcgagatgctgagggagcaaccgttttatcaaccaaaggaagggacttacatgaagcttctcgttcttttggggaaatcaggacagcctcaccgtgcacagaaggtgttcgacgaaatgcttgaagaaggacttgaacccaccgctgagctctacactgctcttctcggtgcttactgtcgtagcaatcttatagactctgctttctcagttcttgaacggatgaaaacgttacctcagtgccaacctgatgtttatacatacagcactctcctcaaggcctgtgtggacgcttctttatttgatttggttgagtctttgtatagagagatggatgagcgtttgataactccaaacactgtgacgcagaacatagttttgagtgggtacgggagagttgggaggtttgatcagatggagaaagttttatccgatatgctggtgagtactgagtgtaagcctgatgtgtggacgatgaacattatcctcagcgtgtttgggaacatggggaagattgacatgatggagagctggtatgagaagttcaggaacttcgggatcgagcctgagactcggagtttcaatatcttgatcggtgcttatgggaagaagagaatgtatgataagatgtcgtccgtgatggagtacatgcgtaagcttgagtttccttggacgacgtcgacttacaacaacatcatcgaggcgtttgcggatgtgggtgatgcgaagaacatggagtacacgtttgatcagatgcgtagcgaaggtatgaaggcggacacgaagacgttttgctgtctcattaatggatacgccaacgctggtcttttccataaggtgataagtagtgttcagttagctgcgaagtttgagatacctgagaacacttctttctacaacgcggttatatcagcgtgtgccaaagcggatgatcttatagagatggagagagtgtacacgaggatgaaggagagggaatgtgtgagggattcgagaacgtttgagatcatggtggaggcctatgagaaggaaggtatgaatgataagatatattacttggagcaagagaggcaaaaggttatggatcatcatgctgcagctactaaagaggaggagaatctccctggatgattgcaaggagagtggagatattgaaagaatcattctcttggattgaaacagtagaattaaaagagagtttgtaatacacttggattgttcttgcagctatgtgtataaagcttttcttgttttggttatgttgaatgttatctcattctcttgcgtgttttcgttatgggccgtaaaattatatattaggcccagaaaagcccagtaactgcttgtctatattataaatatgtctcatctttc

SEQ ID NO: 2339 - DNA, 2335 bp, Glycine max
aaaatccttttaaaatccgtttaattgtcatttggaggagaaaatggtgatttgaagtgcagtcttgttctatagctatctgtgggtggctatggcttccatgtctttgtctttttgttcttgcatcgtcccctctcgaattccccacgacaaatccaacaaaacccacagccatcatcagcctactttccctctcattcgctttggcatttcagctcccgccgtcaaaaagcgacactggaaaaaaggggagtttcctgctacttcccaaccatccttccccaacgacactaggaggaagacccctcttaagaacctcaagaagaaattcgacaaaaagaacgatgccaaggcatgggtcaacactgtcaccgaatccttatccgaacgcatccacaacaaacactggcttcaggccctccaggtatttgatatgcttagagagcaaaccttttaccaacccaaagaagggacttacatgaaactcattgtgttgcttggaaaatctggtcaaccccaccgtgcccatcagctttttaccacaatgattgaagaaggtttagaacctactcctgaactgtacacagcgttgctcgctgcgtattgcaggagcaacatgattgatgaggcgttttcagttcttaatgagatgaagaagcttcctcgttgccagcctgatgttttcacttacagtaccttgatcaaagtttgtgtcgatgctttcaaatttgatttggttgagttgctgtatgaagaaatggctgaaaggtctatcatgccaaacacagtcactcagaacattgttttgggtggttatggcaaggcgggcatgtttgatcagatggagaaagtactgtccagcatgctgctgagcactacatgcaagcctgatgtttggacaatgaacacaatcatcagtgtttttggtaacatgggtcagattgatatgatggaaaaatggtatgaaaaattccgttattttgggatagaaccagagacgcgcacttttaatattttgatcggtgcctatgggaagaaaagaatgtatgacaaaatgtcatctgttatggagtatatgcgtaagttgcaatttccatggacgacctctacttacaacaatgtgattgaggcatttgcagatgcaggtgatgcgaagcacatggaatgtacatttgatcagatgcgtgctgagggtatgaaagcagataccaaaactttatgctgccttatcaatggttatgcaaatgctggtctcttccataaagtaattagcagtgttcgcttggctggaaagctcgagatacctgagaatatcaccttttataatgcggtcttatctgcgtgtgcaaaggcagaggatttgatggaaatggagagagttttcaagcgtatgaaagatagccagtgtcagccagatgacacaacatacacgatcatgatcgaggcatatagaaaagagggtatgaatgacaagatatactatttggagcaggaaaagcagacgatgatgactgatgataaaaaagttagccagtttgagaatgaaatcttgatttgatttttgatttatagttcagactgctaatgcatctgtattctatacctccattttccgggagcggctgttaatttttgttttgacatggagtgaccagttgctgagttgtgctatcaaacttcatttttcacgatgaatgacagctagtcctgcctaacttctgtatgttgttcaagttaaatttatgttttagcatccatttgattcgcagaaaagaacttaacatctgcagcttttggtgtacagatttaatgaactgatagtagagtttattagtttatttttgtcaatttagagctcatgttatattgaagtgctgcctttcattcctgctgcttaccagccttgtctgaaggaggctatgtttgatgacaggattagaaagtgttgctagtgctccaaactatacatgggtacatgcttttgtaatgtacttaattataagatatctagatttcagtattattatcgagagagaaactgaaattagttgcatggatgacaacctttgatctgtctaaatcacattagcgatcaagtttatttaggctagggtgttcattgaattttgaaggtcaagagtaagagcggtgctgtggaaatactgaattttcaacttcaaactgagccaaattaagttgatgtttggatgacataggtattctgtccgagtctcagtggatcctcttctagcacttcagccgcccaccatttatttttactggtggttgttaggcaaaaagaccagtgttcctcttgtcaaatgcagtactggca

SEQ ID NO: 2340 - DNA, 2362 bp, Glycine max
aattgtcatttggaggagaaaatggtgatttgaagtgcagtcttgttctatagctatctgtgggtggctatggcttccatgtctttgtctttttgttcttgcatcgtcccctctcgaattccccacgacaaatccaacaaaacccacagccatcatcagcctactttccctctcattcgctttggcatttcagctcccgccgtcaaaaagcgacactggaaaaaaggggagtttcctgctacttcccaaccatccttccccaacgacactaggaggaagacccctcttaagaacctcaagaagaaattcgacaaaaagaacgatgccaaggcatgggtcaacactgtcaccgaatccttatccgaacgcatccacaacaaacactggcttcaggccctccaggtatttgatatgcttagagagcaaaccttttaccaacccaaagaagggacttacatgaaactcattgtgttgcttggaaaatctggtcaaccccaccgtgcccatcagctttttaccacaatgattgaagaaggtttagaacctactcctgaactgtacacagcgttgctcgctgcgtattgcaggagcaacatgattgatgaggcgttttcagttcttaatgagatgaagaagcttcctcgttgccagcctgatgttttcacttacagtaccttgatcaaagtttgtgtcgatgctttcaaatttgatttggttgagttgctgtatgaagaaatggctgaaaggtctatcatgccaaacacagtcactcagaacattgttttgggtggttatggcaaggcgggcatgtttgatcagatggagaaagtactgtccagcatgctgctgagcactacatgcaagcctgatgtttggacaatgaacacaatcatcagtgtttttggtaacatgggtcagattgatatgatggaaaaatggtatgaaaaattccgttattttgggatagaaccagagacgcgcacttttaatattttgatcggtgcctatgggaagaaaagaatgtatgacaaaatgtcatctgttatggagtatatgcgtaagttgcaatttccatggacgacctctacttacaacaatgtgattgaggcatttgcagatgcaggtgatgcgaagcacatggaatgtacatttgatcagatgcgtgctgagggtatgaaagcagataccaaaactttatgctgccttatcaatggttatgcaaatgctggtctcttccataaagtaattagcagtgttcgcttggctggaaagctcgagatacctgagaatatcaccttttataatgcggtcttatctgcgtgtgcaaaggcagaggatttgatggaaatggagagagttttcaagcgtatgaaagatagccagtgtcagccagatgacacaacatacacgatcatgatcgaggcatatagaaaagagggtatgaatgacaagatatactatttggagcaggaaaagcagacgatgatgactgatgataaaaaagttagccagtttgagaatgaaatcttgatttgatttttgatttatagttcagactgctaatgcatctgtattctatacctccattttccgggagcggctgttaatttttgttttgacatggagtgaccagttgctgagttgtgctatcaaacttcatttttcacgatgaatgacagctagtcctgcctaacttctgtatgttgttcaagttaaatttatgttttagcatccatttgattcgcagaaaagaacttaacatctgcagcttttggtgtacagatttaatgaactgatagtagagtttattagtttatttttgtcaatttagagctcatgttatattgaagtgctgcctttcattcctgctgcttaccagccttgtctgaaggaggctatgtttgatgacaggattagaaagtgttgctagtgctccaaactatacatgggtacatgcttttgtaatgtacttaattataagatatctagatttcagtattattatcgagagagaaactgaaattagttgcatggatgacaacctttgatctgtctaaatcacattagcgatcaagtttatttaggctagggtgttcattgaattttgaaggtcaagagtaagagcggtgctgtggaaatactgaattttcaacttcaaactgagccaaattaagttgatgtttggatgacataggtattctgtccgagtctcagtggatcctcttctagcacttcagccgcccaccatttatttttactggtggttgttaggcaaaaagaccagtgttcctcttgtcaaatgcagtactggcaactgattttcaactggttaccaaatatcaattccttatatgaatttatg

SEQ ID NO: 2341 - DNA, 2449 bp, Glycine max
atctgtatatccttttcaatgaaaaatttaaaaaaagaaactcttgttctatagctatctgtgggtggctatggcttccatatctttgtctttttgttcttccatcgtcccctctcgaattccccacgacaaatccaacaaaacccacagccatcataaccctactttccctctcattcgctttggcatttcagctcccgccgtcaaaaagcgacactggaaaaaaggggagtttcctgctacttcccaaccatccttccccaacgacactaggaggaagacccctcttaagaacctcaagaagaaattcgacaaaaagaacgatgccaaggcatgggtcaacactgtcaccgaatccttatccgaacgcatccacaacaaacactggcttcaggccctccaggtatttgatatgcttagagagcaaaccttttaccaacccaaagaagggacttgcatgaaactcattgtgttgcttggaaaatctggtcaaccccaccgtgcccatcagctttttaccacaatgattgaagaaggtttagaacctactcctgaactgtacacagcgttgctcgctgcgtattgcaggagcaacatgattgatgaggcgttttcagttcttaatgagatgaagaagcttcctctttgccagcctgatgttttcacttacagtaccttgatcaaagtttgtgtcgatgctttcaaatttgatttggttcagttgctgtatgaagaaatggctgaaaggtctatcacgccaaacacagtcactcagaacattgttttgggtggttatggcaaggcgggcatgtttgatcagatggagaaagtgctgtccagcatgctgcagagcactacatgcaagcctgatgtttggacaatgaacacaatcatcagtgtttttggtaacatgggtcagattgatatgacggaaaaatggtatgaaaaattccgttattttgggatagaaccagagacgcgcacttttaatattttgataggtgcctatgggaagaaaagaatgtatgacaaaatgtcatctgttatggagtatatgcgtaagttgcaatttccgtggacgacctctacttacaacaatgtgattgaggcatttgctgatgcaggtgatgcgaagcacatggaatgtacatttgatcagatgcgtgctgagggtatgaaagcagataccaaaactttatgctgccttatcaatggttatgcaaatgctggtctcttccataaagtaattagcagtgttcgcttggcgggaaagcttgagatacctgagaatatcaccttttataatgcggtcttatctgcgtgtgcaaaggcagaggatttgatggaaatggagagagttttcaagcgtatgaaagatagccagtgtcagccagatgacacaacatacacgatcatgatcgaggcatatagaaaagagggtatgaatgacaagatatactatttggagcaggaaaagcagacgatgatgactgatgataaaaaagctagccagtttgagaatgaaatcttaatttgatttttgatttatagttcagactgctaatgcatctgtattctatacctccattttccgggagcggctgtaaatttttgttttgacatgaagtgaccagttgctgagttgtgctatcgaacttcatttttcacgatgaatgacagctagtcctgcctaacttctgtatgttgtacaggttaaatttatgttttagcatccatttgattcgcagaaaagaacttaacatctgcagcttttggtgtacagatttaatgaactgatagtagagtttattagtttatttttgtcaatttagagctcatgttatattgaagtgctgcctttcattcctgctgcttaccagccttgtctgaaggaggctatgtttgatgacaggattagaaagtgttgctagagctccaaactatacatgggtacatgcttttgtaatgtacttaattataagatatctagatttcagtattattatcgagagggaaactgaaattagttgcatggatgacaacctttgatctgtctaaatcacattagcgatcaagtttatttaggctagggtgttcattgaattttgaaggtcaacagtaagagcggtgctgtggaaatactgaattttcaagttcaggctgagccaaattaagttgatgttcggatgacataggtattctgtccgagtctcagtggatcctcttctagcacttcatccgcccaccatttatttttactggtggttgttaggcaaaaagaccagtgttcctcttgtcaaatgcagtactggcaactgattttcaactggttaccaaatatcaattccttatatgaatttatgtgcatcatgtgacaaaagatgtattttatgttttaatcttttgaagaacatagaaccaagtgaaataccaattgaccgagtttatt

SEQ ID NO: 2342 - DNA, 2432 bp, Glycine max
aatgaaaaatttaaaaaaagaaactcttgttctatagctatctgtgggtggctatggcttccatatctttgtctttttgttcttccatcgtcccctctcgaattccccacgacaaatccaacaaaacccacagccatcataaccctactttccctctcattcgctttggcatttcagctcccgccgtcaaaaagcgacactggaaaaaaggggagtttcctgctacttcccaaccatccttccccaacgacactaggaggaagacccctcttaagaacctcaagaagaaattcgacaaaaagaacgatgccaaggcatgggtcaacactgtcaccgaatccttatccgaacgcatccacaacaaacactggcttcaggccctccaggtatttgatatgcttagagagcaaaccttttaccaacccaaagaagggacttgcatgaaactcattgtgttgcttggaaaatctggtcaaccccaccgtgcccatcagctttttaccacaatgattgaagaaggtttagaacctactcctgaactgtacacagcgttgctcgctgcgtattgcaggagcaacatgattgatgaggcgttttcagttcttaatgagatgaagaagcttcctctttgccagcctgatgttttcacttacagtaccttgatcaaagtttgtgtcgatgctttcaaatttgatttggttcagttgctgtatgaagaaatggctgaaaggtctatcacgccaaacacagtcactcagaacattgttttgggtggttatggcaaggcgggcatgtttgatcagatggagaaagtgctgtccagcatgctgcagagcactacatgcaagcctgatgtttggacaatgaacacaatcatcagtgtttttggtaacatgggtcagattgatatgacggaaaaatggtatgaaaaattccgttattttgggatagaaccagagacgcgcacttttaatattttgataggtgcctatgggaagaaaagaatgtatgacaaaatgtcatctgttatggagtatatgcgtaagttgcaatttccgtggacgacctctacttacaacaatgtgattgaggcatttgctgatgcaggtgatgcgaagcacatggaatgtacatttgatcagatgcgtgctgagggtatgaaagcagataccaaaactttatgctgccttatcaatggttatgcaaatgctggtctcttccataaagtaattagcagtgttcgcttggcgggaaagcttgagatacctgagaatatcaccttttataatgcggtcttatctgcgtgtgcaaaggcagaggatttgatggaaatggagagagttttcaagcgtatgaaagatagccagtgtcagccagatgacacaacatacacgatcatgatcgaggcatatagaaaagagggtatgaatgacaagatatactatttggagcaggaaaagcagacgatgatgactgatgataaaaaagctagccagtttgagaatgaaatcttaatttgatttttgatttatagttcagactgctaatgcatctgtattctatacctccattttccgggagcggctgtaaatttttgttttgacatgaagtgaccagttgctgagttgtgctatcgaacttcatttttcacgatgaatgacagctagtcctgcctaacttctgtatgttgtacaggttaaatttatgttttagcatccatttgattcgcagaaaagaacttaacatctgcagcttttggtgtacagatttaatgaactgatagtagagtttattagtttatttttgtcaatttagagctcatgttatattgaagtgctgcctttcattcctgctgcttaccagccttgtctgaaggaggctatgtttgatgacaggattagaaagtgttgctagagctccaaactatacatgggtacatgcttttgtaatgtacttaattataagatatctagatttcagtattattatcgagagggaaactgaaattagttgcatggatgacaacctttgatctgtctaaatcacattagcgatcaagtttatttaggctagggtgttcattgaattttgaaggtcaacagtaagagcggtgctgtggaaatactgaattttcaagttcaggctgagccaaattaagttgatgttcggatgacataggtattctgtccgagtctcagtggatcctcttctagcacttcatccgcccaccatttatttttactggtggttgttaggcaaaaagaccagtgttcctcttgtcaaatgcagtactggcaactgattttcaactggttaccaaatatcaattccttatatgaatttatgtgcatcatgtgacaaaagatgtattttatgttttaatcttttgaagaacatagaaccaagtgaaataccaattgaccgagtttatt

SEQ ID NO: 2343 - DNA, 1892 bp, Phaseolus vulgaris
aatggtgcagtggattgatttaagggatgtgagtcttccacactcactattcttcttcttcttcttcttcttcttcttcttcttcttctctggctatggcttccctatctctctccttttcatcttccattgttccctctcgaattccccaccacaattctaacagaacccatactcaacactccacttttagggttacctgcttcgccatttcctctcccccttccaaacccgttgtcaaaaagcgacactggaaaaaaggtgagtttcctggtacttcggaaacattgttacacgatagtacgaggaggacccccatcaagaatatcaagcagaagttggagaaaaagaacagtgcgaaggcatgggtcaacactgtcaccgaatccttatctgaacaaatcgacaagaagcagtggcttcaagcccttcaggtatttgatatgcttagagaacaaaccttctacagacccaaagaaggggcttacatgaaacttattgtgctgcttggaaaatctggtcaaccccaccgtgcccaccaacttttcaccacaatgattgaagaaggtttagaacctactcctcatctgtacacagcattgcttgctgcgtattgcaggagcaaccttattgatgaagctttttcaattcttaatgagatgaagaaacttcctctttgccagcctgatgttttcacttacagtaccttgatcaaagtttgtgtggatgctttcaaatttgatttggttgagttattgtatgaagaaatggctgaaaggtccgtcacgccaaacacagtgactcaaaatattgttttgggtggttatggtaaggcggggaagtttgatcagatggagaaagtgctttccagcatgctggagagcactacctgcaagccggatgtttggacaatgaacacgatcatcagtgtctttggtaacattggtcagattgatatgatggagaaatggtatgaaaaattccgaaattttgggatagaacctgaaacgcgcacttttaatattttgattggcgcctatgggaagaagagaatgtatgacaaaatgtcatctgttatggagtatatgcgaaggttgcaatttccatggacaacctcgacttttaacaatgtgattgaggcatttgcagatgcaggtgacgtgaggcacatggagtgtacatttgatcagatgcgtgctgagggtatgaaagcagataccaaaactttctgctgccttatcaaaggttatgcaaatgctggtctctttcataaagtaattagcagtgttcacttggctggaaagtttgagatacctcaaaatattgccttttataacgcagtcttatctgcatgtgcaaaggcagaggatttgatggaaatggaaagagtttataagcgtatgaaagataaccaatgtcaaccagacgaaacaacatacatgatcatgattgaagcatataaaaaagacaatatgaatgacaaaatatactatttggagcaggaaaagcagacaatgataactgacaacaaaaaagtgagccgttccgaggatgatatctttagttcagacagttaatgcatcgtattctatacttattttatgggagcagctgcttatttttgttttgaaatggaagaagtgaccggttgctgaattaggcaatcaagcttcatttgtcatggtgaattgcagaacttcttcctaacttctgtgtgcttgttctaaagttaaatttaagctttaacatccattttgctttcagaaaagaacttaaacatccatgttttttaggtgtacagggatagtggatagatggtagagttaatagtttgttttgtcaaattgagcttatttattgaagtgctgcctttttttattcatgctgcaaga

SEQ ID NO: 2344 - DNA, 2019 bp, Phaseolus vulgaris
aataaaaaatggtgcagtggattgatttaagggatgtgagtcttccacactcactattcttcttcttcttcttcttcttcttcttcttcttcttctctggctatggcttccctatctctctccttttcatcttccattgttccctctcgaattccccaccacaattctaacagaacccatactcaacactccacttttagggttacctgcttcgccatttcctctcccccttccaaacccgttgtcaaaaagcgacactggaaaaaaggtgagtttcctggtacttcggaaacattgttacacgatagtacgaggaggacccccatcaagaatatcaagcagaagttggagaaaaagaacagtgcgaaggcatgggtcaacactgtcaccgaatccttatctgaacaaatcgacaagaagcagtggcttcaagcccttcaggtatttgatatgcttagagaacaaaccttctacagacccaaagaaggggcttacatgaaacttattgtgctgcttggaaaatctggtcaaccccaccgtgcccaccaacttttcaccacaatgattgaagaaggtttagaacctactcctcatctgtacacagcattgcttgctgcgtattgcaggagcaaccttattgatgaagctttttcaattcttaatgagatgaagaaacttcctctttgccagcctgatgttttcacttacagtaccttgatcaaagtttgtgtggatgctttcaaatttgatttggttgagttattgtatgaagaaatggctgaaaggtccgtcacgccaaacacagtgactcaaaatattgttttgggtggttatggtaaggcggggaagtttgatcagatggagaaagtgctttccagcatgctggagagcactacctgcaagccggatgtttggacaatgaacacgatcatcagtgtctttggtaacattggtcagattgatatgatggagaaatggtatgaaaaattccgaaattttgggatagaacctgaaacgcgcacttttaatattttgattggcgcctatgggaagaagagaatgtatgacaaaatgtcatctgttatggagtatatgcgaaggttgcaatttccatggacaacctcgacttttaacaatgtgattgaggcatttgcagatgcaggtgacgtgaggcacatggagtgtacatttgatcagatgcgtgctgagggtatgaaagcagataccaaaactttctgctgccttatcaaaggttatgcaaatgctggtctctttcataaagtaattagcagtgttcacttggctggaaagtttgagatacctcaaaatattgccttttataacgcagtcttatctgcatgtgcaaaggcagaggatttgatggaaatggaaagagtttataagcgtatgaaagataaccaatgtcaaccagacgaaacaacatacatgatcatgattgaagcatataaaaaagacaatatgaatgacaaaatatactatttggagcaggaaaagcagacaatgataactgacaacaaaaaagtgagccgttccgaggatgatatctttagttcagacagttaatgcatcgtattctatacttattttatgggagcagctgcttatttttgttttgaaatggaagaagtgaccggttgctgaattaggcaatcaagcttcatttgtcatggtgaattgcagaacttcttcctaacttctgtgtgcttgttctaaagttaaatttaagctttaacatccattttgctttcagaaaagaacttaaacatccatgttttttaggtgtacagggatagtggatagatggtagagttaatagtttgttttgtcaaattgagcttatttattgaagtgctgcctttttttattcatgctgcaagagtttcaaaatatacatgggtccctgcttttgtaaattgtgatacatctagagtgcaatattttaacccgaaaaaccttttatatgtctaaaattgtatgtgcattcaagtctaggctagg

SEQ ID NO: 2345 - DNA, 1641 bp, Vigna unguiculata
ccattgttccctcttcaattccccaccacaaatccaccaaaattcacactcaagactccacttttagggttacctgcttcgccatttcctctcccccttccaaacccgttgtcaaaaagcgacactggaaaaaaggggagtttcctggtacttccgaaacatcgttagacgatagtacgaggaggagccccatcaagaacatcaagaagaagttggagaaaaagaacagtgcgaaggcatgggtcaacactgtcaccgaagccttatttgaacaaatcgacaagaagcagtggcttcaagcccttcaggtatttgatatgcttagggaacaaactttctacaaacctaaagaaggggcgtatatgaaactcattgtgctgcttggaaaatctggtcaaccccaccgtgcccaccaacttttcaccacaatgattgaagaaggtttagaacctactccttatctgtacacagcattgcttgctgcgtattgcaggagcaacctcattgatgaagctttttcggttcttaatgagatgaagaggcttcctctttgccagcctgatgttttcacttacagtaccttgatcaaagtttgtgttgatgctttcaaatttgatttggttgaattattgtatgaagaaatggctgaaagggccatcacaccaaacacagtgacacagaacatcgttttgggtggttatggtaaggcggggaagtttgatcaaatggaaaaagtgctttccagcatgctggagagcattacctgcaagcctgatgtttggacaatgaacaccatcatcagtgtctttggtaacatgggtcagattgatatgatggagaaatggtatgaaaaattccgtaattttgggatagaacctgaaacgcgcacttttaacattttgattggtgcctatgggaagaaaaaaatgtatgacaaaatgtcatctgtcatggagtacatgcgcaagttgcaatttccatggacaacctcgacttataacaatgtgattgaggcatttgccgatgctggtgatgtgaggcacatggagtgtacatttgatcaaatgcgtgctgagggtatgaaagcagataccaaaactttctgttgccttatcaatggttatgcaaatgcaggttactttcataaagtaattagcagtgttcaattggctggaaaatttgagatacctgaaaatattgccttttataacgcagtcttatctgcatgtgcaaaggcagatgatttgatggaaatggaaagagtttttaagcgtatgaaagataaccaatgtcaaccggacgaaacaacatacatgatcatgattgaagcatatagaaaagacggtatgaatgacaaaatatactatttggagcaggaaaagcagacaatgataactgacaataaaatagtgagccattatgaggatgggatctttagttcagacagctaatgcatctgtattccatacttattttatgggagcagctgcttatttttgttttgaaatggaagaagagaccagttgctgatttacgcaatcaagcttcagatgtcatggtgaattatagaacttcttcctaacctctgtttgcttgttgtaaagttaaatttgagctttaacatccattttattttcagaa

SEQ ID NO: 2346 - DNA, 2163 bp, Cicer arietinum
aattgtcacgcctaatttgtgtattaaattttgtccatacttgaaattgtgcgtctttagtcaatttttgataaacaaaaaattaataaaaataaaccctaaaaccctttatcaacttaccaaataagtccatgaaaaatgtaaaaatatcatgactttgatttcaatcaaatgttaaaacctttgttgatgaattgaaattcatactcattccagtgtggcattaaatgctaagctgttgaatctatagatatggcttccctctctctcacattctcttcttcaatcgctccctctccaatttctccacacaaattcaacaaaacccgcaaccctaaacccaaagttccaatttttcccattacccgtttcgcaatttcatctccaccttctgcatctgcttctaattcctcctcagttgtcaaaaagaaacactggaaacagggtgagtttcctggtttttccgaaacatcgttacctgggagtacgaagaggagtcccattaaaaacctcaagaaaaaattggacagaaagaacgatgctaaagcatgggttaacactgttactgaagccttatctgaatgcattgacaagaagcaatggcttcaagctcttcagacatttgacatgctcagagaacaatccttttaccaacccagagaagggacttacatgaaactcattgtgctacttggaagatccagtcaaccccatcgtgcccgtcagctttttaccacaatgattgaagagggttgtgatcctactcctgaactatacacggcgttacttgctgcatattgcaggagcaacatgattgatgaggcgctttcaattcttaatgagatgaagaatcatcctctttgtcagcctgatgttttcacttacagtacgctgataaaagtctgtgtggatgcctttaaattcgaattggttgagttgatgtatgaagaaatggctcaaagatccatcatgcctaacactgtcacgcagaacattgttttgagtggttatggcaaggcagggatgtttgatcagatggagaaagtactgtcaagtatgctgcagagcactagttgcaagcctgatgtttggacaatgaacacaatcattagtgtctttggtaatatgggtcagattgatatgatggagaaatggtatgaaaagttccgtaatttcggaatagaaccagaaacacgcacttttaatatcttgattggtgcgtatggaaagaaaagaatgtacgacaaaatgtcgtctgttatggagtatatgcggaagttgcaatttccatggaccacgtctacttataacaatgtgattgacgcatttgctgatgcaggtgatgctaaaaacatggagtatacatttaatcagatgcgttctgaaggtatgagagcagataccaagacattctgctgccttatcaacggctttgcaaatgcaggcctctttcataaagtgattagcagtgttcacttggctgcgaagcttgagacacctgagaacactgcgttttataatgcagtcttatctgcatgcgcaaaggcagaggatttgatggaaatggagagagttttcaagcgtatgaaagataaccaatgtcaaccggacaacacaacatactcgatcatggtcaaggcatatagaaagcagggtatgagtgacaagatatattatctggagcaagaaaagcagacgatgataaccgatgataagatagtgaaccagcctgaggatgaactctttagttgatttgtggattatagtccagagtattgctagtacatctgttttcttcagtctcctccatctgtcatgagcagctgtttaattttgttttggcatggaagagagtgactagctgccgggttgcatttccagcttcatttttcatgatgaatgacagcaactcctgcctaacttctacatttttgtagttgtaaagttgaatttattttttacatccatttaacttacagaaaataaatttaaacatctgcattttttagtgtacagggttcatgaactgataactgactttagtagtgtctaaaattatagggcaccaactatacttgtgctcttacttttgtaatttacgtaattgtatgatatatctggatgatggcttatagtttagttttataaacgtgattcaccgta

SEQ ID NO: 2347 - DNA, 2045 bp, Lupinus angustifolius
ataaggagaaaatagtaatttgaaacagagtttgagggtaagatttttgttgttgatggttaggggtttagagttattttgagtctaaaaaaacaatgagttccatatctatctccttttcttgttccatcattccctctccaattccccttcacaacaacaattaccctttccccacaacaacccaagctccaatctttagggttaccctcttcgccatttcatctcccccttcaaaatctgcttcttcaacatcacaagatgtcaaaaagaaacattggaaacgaggtgaatttcctggtacttctcaaacacagagtacgaggaggaccccaatcaagaacattaagaagaggttggataaaaagaacatcgctaaggcatgggtcaacactgttgctgaagctttgtctgaacgtgttgaaaagaagcagtggcttcaagcacttgagatatttgacatgcttagagaacaatcgtggtaccaacccaaagaagggacctacatgaaactcattgtgttgcttggaaaatctggtcaaccccaccgtgcccgtcagctttttacgacaatgattgaagatggtttggagcctactcctgaactatacacagccttactcgctgcatattgcaggagcaatctgattgacgaggcattttcaattcttaatgagatgaagagccatcctttttgccagccagatattttcacttacagcaccttaataaaaccttgtgtggatgcttttaaatttgacttggttgagttgttgtatgtagaaatggcggaaagatctatcacacctaacactgtcactcagaacattgttttgaatggttatggcaaggcagggaagtttgatgagatggagaaagtactgtctggtatgctggagagcactacgtgcaagcctgatgtttggacaatgaacacattcatcagtgtctttggtaatattggtcagattgatatgatggagaaatggtacaaaaaattctgtaacttcgggatagagccagaaacacgtacttttaatgttctgattagtgcctatgtaaagaaacgaatgtatcacaaaatgtcatctgttatggagtatatgcgtaagttgcaacttccatggacaacctctacttacaacaacatgattgaggcatttgcagatgtaggtgatgctaaacacatggagtatacgtttgatcaaatgcgtaccgagggtatgaaagcagataccaggactttctgctgccttatcaatggttatgcaaatgcaggtctcttccataaagtaattagcagcattcgcttggctgccaagttagagatagctgagaatatcaccttttataatgcagtattatctgcatgcgcaaaagcagatgatttgatggaaatggagagagttttcaatcgaatgaaagataaccaatgtcagccagatgacacaacattctcgatcatgatcgaggcatatagaaaagagggtatgaacgacaagatatactatttggagcaggaaaaacagacaatgcttactgatgataaaatagtgagtgagcctgaggataaaatagttcagtcttaagactgccactgcatttgtattacctccatttttccggagcatatgtttagtgaccggttgcatgacgaaccttcatttttcatgatgaatgataacagctcctgcctaacatcatgtttgtttgttgtaaagtcatgtttcatttttggcttcccatcctattgacaaagaatttaagcatatctttatttttttatgtacagagttgatggactaattagtttatttgtcttttgtcaagtttgagctcatgttattatattttacttggaaattgaccaattttcctgtatggtcaatatctttgtaaaatgttgaattgacaacaagtaccagtttcttttgaactgattcaaaatcgctttccttaggttaattcatcctcatcaccctcaagtatctgatggctaaggttaaggattgcttcattatgtgacttcattatgtgactgtaat

SEQ ID NO: 2348 - DNA, 2748 bp, Mimulus guttatus
gctctccgacgaccaccaccaccaccagcgcctcccaattctccgacgacaccaccacttgcgcctcccgattctccaaccaccaccacaacttgcgcctcccgattctccaaccaccaccatcgccacctggcctcccggctctctgaagaccaccaccaccagcgcctcccggctctccgacgaccaccaccaacggtatttgttcggaagcaaggaaggattcgtttctttgttgtacagctgcagaatagtcaaaagacagagacagctcaacttgaaaactagtagtaataaagcatgattagtactaatctaattagcgttttgctgctcttattattatcaagtcttctcttctcttttttagttgcaaccagtcgtcaaagtaaataaataaataaatagagataatctcatgactttctggtttgttttccaaccatcttcaacaacaacagttacaattggaggcgtttctcagatttaggtctgacaccaccacaattgaagcaagcaacaatgcaaatggcgtttcaactctctctttcctcctccttcctcccatctccactccccacaaccaccaccaccacaaccagaatgaccgttacccagtcaccccgcaggctgatttatatctcctcctccaccaattcatcatcgtcgacaaccgtcaattctcccaagaaaaagcactggaaagtaggggaatatcctggcctcactcatacctccaaccctaaattctcaaccaataagaagagaacccccattaagaacatcaagaaaaagctcgacagaaagattaatgccaacgcttgggttaatactgtcaccgaagctctttctgatgccatcgataaaaagcaatggctccgggctcttcaggtatttgagatgctaaaggtgcaacctttttaccacccaaaagaagggacttacatgaagctacttgttcttctaggaagatccggtcaacctggacaagcctctcagctgtttgatgaaatgcttcaaacaggattagaaccaaccccagaactttacacagcattgcttgctgcatgttgcaggagcaatctgattgataaagcttatgaagttcttgaacaaatgaagtctctccctctttgccagcctgatgtctatacctatagtatactgattaaggcctgtgccgatgcttttcgtttcgaactggttgactccctatatgatgaaatggctgaaagattaatcaccccaaatactgtaactcaaaatacagtactgagtggttatggaaaggcggggaaatatgaagagatggagaagattctctccaagatgcttgaaagtacgacaagcgaacctgatgtatggactatgaatacgattatcggtttgtttggcaatgtgggtcagattgaaatgatggagaaatggtacgagaagtttcgcaatttcgggatcgagccggaaacacgcacattcaacattctgattggtgcgtatggtaagaaaaggatgtacgataagatgtcatctgtgatggagtacatgcggaggctttcatttccgtggacaacatcgacctacaacaatgtgattgaggcattttctgatgccggtgatgcaaagcacatggagtacacatttgatcagatgcgtgctgaaggcattaaggcggacaccaaaacattgtgctgcctcatacgaggttttgccaatgctggtctctttcataaagtgatcagcatggttcagttggctgggagattggagatacctgagaatacctcattctttaatgcagtcatatatgcttgctctagagcagatgatttaatggagatggaaagagtgttcaagagaatgaaagataagtcatgtcaaccagattccacaacttactcggttatgatggatgcgtatagaaaagaaggtatgagtgacaaggtgtatgacctggagcaagaaatgcagaggatgaatggtggtaaggtatccaaagggtacgatgatgtagaaacagaggctaatgatgatgtcagcaaagaggtgttggtaatggtatgagtgttggtggtgtcaattaatttctgggaaaattgctatgaaaagttgatcatgattgatatccagagtgggtaaatcacaaataaagccatgctggtcgtagtagtgttagtaatcgtggcatgaaggtagttacaaatatctaatagctgtttgtctttgtgtttctcccttaccgtgattctgaactccgagaatgaattgatatcatacttgctgcgggctaaagaatgaattgatatcataaacctgcagttgtcctcacatatgtaattttgtagccgtgttataaatcttaaagttgtaatttcgtaaggcatcaattgtttatgaagtgttgtttttgcagtagcactgccacagatgatctaattagatcatatggtttcattttctttctttctttctttctttctttctttctttctttctttctttctttgtttattaggagtgttgtattgaagttaggagtgttgtattgaagtttaggctgtaaaaagataaattgttgtataaggggtggaaatcggaatgaaagttcagatttccgccgaatccgatccgaaatataacgattttggaacgactttttcaattccgaattccgaaattccgatttccgaaaattccgaaaaaaatcggatcggaatcgaaaatacataacagaatttccgatttccgaaa

SEQ ID NO: 2349 - DNA, 1944 bp, Lippia dulcis
cacacaacaccaaagaaactgcagaagcaaattcagcgaaacgccaatggcgtcagcatttcagctttccctttcctcctccttccttccatcccctctccccaccaaaaccaccgccgcccctcagccgctccgccgcctcattatcttggctgccgcctcgtcttcgtcgtcatcaacattgaatttgcccaagaaaaagcactggaaaattggtgaatatcctggcgtcatcgaaacttcaaccccgaaattctcgagcaatagtaagaagagggccccaattaagaacatcaagaaaaagctggacaagaagaacaatgccacgggatgggctaatacagtcactgaagctctctcggaagccattgatagaaagcagtgggaacgggctcttcaggtatttgagatgctaaaggtgcagcctttttaccaaccaaaagaagggacttatatgaagctccttgttcttcttggaagatgtgggcaacctggacaagcctgtcaactgtttgatgaaatgcttgaagaaggattggaacgaactccacaactatttacagctttgctcggtgcatgttgcaggagcaaccttgttgataaagctttctctattcttgagcaaatgaaatctcttcctacttgccagccggatgtctacacctacagtatactgataaaggcctgtgctgatgctggtcgttttgaactaatcgagtccctctatgatcaaatggacgaacgattaattactccaaacactgttactcaaaatatagtactgagtggttatggaaaggcaggaaaatacgaagagatggagaagattctatctaaaatgcttgacagtacaatgagcccacctgatgtgtggacaatgaataccattattagtttgtttggtaatgagggtcagattgaaatgatggaaagatggtacgaaaaatttagaaattttggaatcgagccagaaacgcgcaccttcaacattctgattggtgcttatgggaagaaaaggatgtacgacaagatgtcgtctgtgatggaatatatgcgcaggttatcattgccctggactacctcaacttacaacaatgtaatagaggcattttcatatgctggtgatgcaaaacacatggagtacgcatttgatcagatgcgtgctgagggaatgaaggcagacaccaagactttgtgctgtctgatcagagggtatgcaaatgctggcctctttcataaagtcatcagcatggttcaattggctggaagactggagatacccgagaatacctccttttttaatgcggtcatatatgcttgctcaagggcggaggacttaatggagatggagagagttttcaagagaatgaaagataaaaaatgcaagccggataccacaacttactccataatgatggatgcatatagaaaagaaggtatgagtgacaaggtgtatgatcttgagcaagaacagcagatgatgactgctaatgtttccaaactctgccatgatgctggaacaggcagcttctgatgatgtcaaagtaggggtgttatgattgtacttttagttgaaacctctctttagaagatcaccatgaggcatgccatattcagataaatcaactaaagacctcgctcttgattgaggcatcaacgtacagatattctggcacaattcagtctcttacagatggttagatgtatgttgtgtgcgaaagcaagaattggtagcataacctgttgccacttcaatcctgctattgtagcttcttctgtcggatgagttttcagacttgaagtaaaaaaaagtcactttacatttctcttctggataaatttaaacacctttcatttcttcagcacaaaaatatagttaagaataaatgtaatgacactcttaatggttaaataagaagtcacccatacttgttccaaaaagaa

SEQ ID NO: 2350 - DNA, 2151 bp, Mimulus guttatus
gtaaaaacacagaggacaccaccacaattgaagcaagcaacaatgcaaatggcgacgactgcgtttcaactctctctttcctcctccttcctcccatctccactccccacaaccaccaccaccaccaccagaatgaccgttactcagtcaccccgcaggctgctttatatctcctcctcctccaccaattcatcatcgtcgacaaccgtcaattctcccaagaaaaagcactggaaagtaggggaatatcctggcctcactcatacctccaaccctaaattctcaaccaataagaagagaacccccattaagaacatcaagaaaaagctcgacagaaagagtaatgccaacgcttgggttaatactgtcaccgaagctctttctgatgccatcgataaaaagcaatggctccgggctcttcaggtatttgagatgctaaaggtgcaacctttttaccacccaaaagaagggacgtacatgaagctacttgttcttcttggaagatccggtcaacctggacaagcctctcagctgtttgatgaaatgcttcaaacaggattagaaccaaccccagaactttacacagcattgcttgctgcatgttgcaggagcaatctgattgataaagcttatgaagttcttgaacaaatgaagtctctccctctttgccagcctgatgtctatacctatagtatactgattaaggcttgtgccgatgcttgtcgtttcgaactggttgactccctatatgatgaaatggctgaaagattaatcaccccaaatactgttactcaaaatacagtactgagtggttatggaaaggcggggaaatatgaagagatggagaagattctctccaagatgcttgaaagtacgacaagcgaacctgatgtatggactatgaatacgattatcggtttgtttggcaatgcgggtcagattgaaatgatggagaaatggtacgagaagtttcgcaatttcgggatcgagccggaaacacgcacattcaacattctgattggtgcgtatggtaagaaaaggatgtacgataagatgtcatctgtgatggagtacatgcggaggctttcatttccgtggacaacatcgacctacaacaatgtgattgaggcattttctgatgccggtgatgcaaagcacatggagtacacatttgatcagatgcgtgctgaaggcattaaggcggacaccaaaacattgtgctgcctcatacgaggttttgccaatgctggtctctttcataaagtgattggcatggttcagttggctgggagattggagatacctgagaatacctcattctttaatgcagtcatatatgcttgctcaagagcagatgatttaatggagatggaaagagtgttcaagagaatgaaagataagtcatgtcagccagattccacaacttactcggttatgatggatgcgtatagaaaggaaggtatgagtgacaaggtgtatgacctggagcaagaaatgcagaggatgaatggtggtaaggtatccaaagggtacgatgatgtagaaacagaggctaatgatgatgtcagcaaagaggtgttggtaatggtatgagtgttggtggtgtcaattaatttctgggaaaattgctatgaaaagttgatggtgattgattatatcatccagagtgggtaaatcaaataaagccgtgccggtcgtagtgttagtgatcgtggcatgaaggtagttacaaatatctaatagctgtttgtctttgtgtttctcccttaccgtgattctgaatcaatgtttctagctccgagaatgaattgatatcatacttgctgcgggctaaagaatgaattgatatcataaacatgcagttgtgctcacattttctgatgtaattttgtagccgtgttgtaaatcttaaagttgttctaatttcgtaaggcatctatgtttatgatgttgtttagcacaattagttaaaagtatagcttgacaatgatggtattgccacagatgatctaattagatcatatggtttcattttatttcttctttctttctttcatttggttattaggagtgttgtattgaagtttaggctgtaaaaaaataaattgttgtatttcatgctttaagtaagatgattgacatgataaaaca

SEQ ID NO: 2351 - DNA, 2191 bp, Avena sativa
ctccggcccagcttctcgcgccacgcagtaacacggtaaaaccaaacgcgcgcagcagtggcgccggctgccgctgccgcagcatgcactgttaataatagctagattttgctaccaatcgctccggccggcccctccgtgactctgcctctcttccctttctcggcgtgtggtgtccatagagcttctggttagttcgtaccagtacttgcttagtgtctccgccgtcgtcttcctcttcctcaccttctctcgtccgcttgattgttcgttgccgccgccgccgccgcacagacaatcgagagcggcgagacatgacggcgacgcccgcggtgatcgggctgagcgccggcaaccgcctcctgagcacgtccttcggcccgccaaacgacctgctatccgacaaggtcaacagccacatggcctgcgcgacgggggacgcccacggctccacctcgctgcagttcgcgccgcatgcagcgcccaagctcaccgtcgccgcgcacaggctcaagctctccccccacggccgcgcgcaggttatgcgggccctcagacagagcgcgcccgcggccgcgctcgcgccgccgccgcccccgccacgctcgacagcgatggagcccgcccacgacgagttctcgctcgaggccatcatcctgctccagaggtccatgctcgagaagcagtggcagctccccttcgaggacgatgaccaggccgtcagttcgcccgaggaggaggaggaggacgacggcaatagcagagcctcctcagtcgtcgtggtggcgcgctccggcgtctcggcacggcagagacggatgagcggccgtaggcgagggaggtccaagaacggcggtgccgccgcgcacctgaacatcagccccgagctgctgcagagcaggaaccggatatacctccggggcaccgtcagcaaggagctcctcacgcacaagcaggttgtccacctctccaagaagatcaaggacggcatgtggctacagcagcaaagatcaaagctgaaagagaaattagggaatgagccgtcatacaagcagatggcgcaatcgctccggatatcgacgccagagctgcggtccaggatgcgcgagtccttccttgcgagagaggtgctaacaatgagcaacatccgtttggtcatatccatcgcgcagaagtatgataagctgggggttgagctggccgacctgattcagggtggtctgatagggctactccgtgggatcgaaaaattcgatgcgtcgaggggcttcaaaatatccacttatgtgtactggtggattcgtcagggtgtttcgagagcattggccgagaactcaaaaacattcagactccctacttacctccatgagagactcatcgcaattcgaggtgcaaagtacacgttggaagaccagggaatttctccaacagcaaaaaacatcgcagtgtcgctcaacatatctgaaaagaaagtacacaatgctacagaggctgtcaacaaggttctttcgttggatcaacaggcattcccctccttaaacggcctacctggagatacactccatagctatatagaggatcaaaatgtcgccaatgatccatggcatggatttgagcagtggtatctcaaggaggaagtcaacaagcttctaaactcgactctcaccgaacgcgaaagggacattattcggttataccatggtataggaaaacagtgccatacatgggaggatattagcagacagttcgggttgtcaagggagcgggtgaggcaagtcgggctcatcgcaatgcagaagctgaagcacgctgcgaggaggaaaaaactggacgcgctgctcgaggactagtgagctgaggtgtttttcgtgttgagtcagatcgaatccgcgtacgcattggttgtatatactcggaaagagggaacacagcaacatagggtacatcgttgaaaaggcttctactgccactcacctacagataatcatacctgtacattttttgtgataataggcatgcatgatcaaagtcccaatgcctgtgccgtaggccatattttccttggaagccttactactattctgtatttgtgtatataatggatgtcgcatagcttgatcagatagagcaagaaatctgccaacataaatctttgttctttttaaaaagagtaaaatacgctgcaaagtgc

SEQ ID NO: 2352 - DNA, 2002 bp, Lolium multiflorum
cctctcggcgtgtggtgtccatagagcttctggttggttcgtaccagtacttggttattgtctccgccgccgtgttgctcttcctccccttctcgtcatcttggttcttcgtcgcctccgcctgccgctgctgcttctgtcccgcgccgccgcacagatagataatcgagcggcgagacatgacggcgacgccggcggtgatcggcctgagcgccggcaaccgcctcctgagcacgtccttcgggccgcccagcgacctgctcaccgacaaggtgaacagccacatggcctgcgcgacgggggacgcccacggctccacctcgctgcagttcgcgccgccgccggcgcccaagctcaccgtcgccgcgcacaggctcaagctctccccgcacggccgcgcgcaggtcatgcgggcgctcaggcagagcgcgcccgcggccgtgctcgcgccgccgccccgcccacggtcggcagcgatggatcatcccaccgacgagctcgcgctcgaggccatcatccagctgcagaggtccatgctcgagaagcagtggcagctccccttcgaggacgatgacgacctggccgaggaggacgacggcggcaagaccatggcctcctcagtcggcgtcgtggcgcgctccggcgtctcggcaaggcagagacggatgagcggccggaggcgcgggaggtccaagaacggcgccgccgccgcgcacctgagcatcagccccgagctgctgcagagcaggaaccgtatctacctacggggcaccgtcagcaaggagctcctcacgcacaagcaggttgtccaactctccaagaagatcaaggacggcatgtggctgcagcagcaaagatcaaagctgaaagagaagctgggaaatgagccatcgtaccagcagatggcgcagtcgctccggatatcgacggcggagctgcggtccaggatgcgcgagtccttcctcgcgagggaggtgctaacgatgagcaacctccgtttggtcatatccatcgcacagaagtatgataagctaggggtggagctggccgacctgattcagggtggtctgatagggctactccgtgggatcgagaagttcgatgcgtcgaggggcttcaaaatatccacttatgtgtactggtggattcgtcagggtgtttcaagagcattggccgagaactcaaaaacattcaggctccctacttacctccatgagaggctcattgcaattcgtggtgcaaagtacgcgttggaagaccaaggaatttctccgacaacagagaacatcgcagtgtcgctcaatatatcggaaaagaaagtacacaatgctacagaggctgtcaacaaggttctttcattggatcaacaggcattcccctccttaaacggcctacctggggatacactccatagttatatagaggatcaaaatgttgcgaatgatccatggcatggatttgaggagtggtatctcaaggaggaagtcaacaagcttctagactcaactctcaccgaacgcgagagggacattattcggttatatcatggtatagggaaacaatgccatacatgggaggatattagcagacagttcgggttgtcgagagagcgggtgaggcaagtagggctcattgcaatggagaagctgaagcacactgcgaggaggaaaagattggacgcgctgctccaggactactgagctgaggtgtttttcgtgtcgagtcggatcgaatccacacacgcagtggttgtatatagtcggaaagagagaacatcaacatagggtacatccttcaaatggctccactgccactcacctgcagataatcatacctgtacattttgtgacaataggcatgcatgatgaaaatcccccaatgcctgtgctgtcaagagtcagtcaaggccatattttccttggaagccttacaagtattatgtattgtatatataatgaatgtctcatagcatgatcaaatagagcaagaaatttgacctgaa

SEQ ID NO: 2353 - DNA, 2092 bp, Flaveria ramosissima
aatatatgatttttaagaaattaaacgtctttaaaaaagcgagaaagcccatacatacagtcatactcaaactaccatcaccacgagttaaccacggtctccatatctctgtcatagatctctttcgaattacagcagcaatcagctacatctgttaaggagttaaaagtgatctttaagaaacctgaagttcagcatatccgtttatggttgctgcgaaacaacattctcaatgtatgtggtactatttctgttaagttaactcgtgtgacatatatgatggctacaaatgcagttgttggattaagagcaggagaacggttattaggttcaacttgttattactctgaggtcagtgaaaagctgtcctgcagtagcaatcttgggttcatttttgttccaactacaagttcaatcacttctaagaagtcacccaactatagccatagtcttgtgaacaaacgagatactcaccctactagagccgtgaaggaacatgtagatactactcttgattcttcaagtacagatcaatgggatgattgggttcagaggcttgactatccaaatgaagaagtttctgaacatgagcttccagttgatgctttactcttattgcataaatctttattagaaaaacagtggacactctcaactgaggagataacaactacagaaaaaaacagcaaaaaggtagtcactggttcagggatatcagctcgtacgcgtcgattaaatgctcagaataaaacacctgccaaaaattcttctgtaaatcaagatggcagaaacaagcagttgcgatccataatcagtccggagctccttcaaaattgtcaaaaagggtatcttaaaggtataaaaaacgaagcgttgttgactcattcagaggttgttgctttatcagaaaagatcaaaattggtctacagttagaggaagagaagtcaagtttgagggaaagattgggatctgaaccatcggagaaacaactagcagattttctaaagatttcgcaagtagacttgcaaaccaaacagatggagtgcgctttggcaagagagaagctgactctgagcaacattcgtctggtgatgtctgttgcacaaaaatataaacacatgggagcagatatgtctgacctaattcagggtggtctaattggactgcttagagggatagagaaatacgattcatctaggggacacaagatttcgacatatgtctattggtggatacgacagggtgtcacgagaaccttctttgaaaactctaaaacccttagattgcctacacatttgcatgaaagattgagtgcaatccgaactgccaaggccaaactggaaagaaagggaataactccatcaattgatagaattgcagaaagcctgcgtatgtcaagaaagaaagttacaaatgccactgaggcagtctgtaaagtgttctcgctcgacaaggaagctttcccttctctaaatggtcttcctggagatacgcttcatagttacattgcagatgattgcccggacaacaacccatggcatggagtagatgaaggggctctcaaggaagaagttagaaatctcattaaaaggactctaggggaacgggagagagagatcatatatctttactatggtctggacaatgaataccttacttgggaggatatcagtagaaggaaggggttgtcaagggaacgagttaggcaggttggtcttgttgcacttgagaaactaaaacacgcggccaaaaatacaaagttagctgcaatgcttgtctgtgattgatttttggtacactttttttttgagaaaaaatatccctgtacatattaatggtcattatttaaattttcacgtactaatatttctaaaccagtatacattactgactcgaagggcctgtgttttataaatttggagggcagtgtatagaagcttcatactgcaggaaagttaatcaatttgttcacatttgtgcaatgtaggtctattgctagctcaccattggttacctaatttcgttccctatggttacctaatttagtaatgtactttgtattctaatatactaatgtgagtccgcccatcg

SEQ ID NO: 2354 - DNA, 1845 bp, Flaveria ramosissima
ttagtcaatgtatgtggtactctttctattagttaactcgcgtgacatatatgatggctacaaatgcagttgttggattaagagcaggagaacggttattaggttaacttgttattaccctgaggtcagtgaaaagctgtcctgcagtagcaatcttggggggatatttgttccaactacaagttcaatcacttctaagaagtcacccaactatagccatagtcttgtgaacaaacgagatattcaccctactagagccgtgaaggaacatgtagatactgctctgaattcttcaagtacagatcaatgggatgattgggttcagaggctcgactatctgaatgaagaagtctctgaacatgagcttccagttgatgctttactcttattacataatctttattggaaaaacagtggacactctcaactgaggagataacaactacagaaaaaaacagcaaaaaggtagtcactggttcagggatatcagctcgtacgcgtcgattaaatgctcagaataaaacaccagccaaaaattgttctgtaaatcaagatggcagaaacaagcagttgcgatccataatcagtccagagctccttcaaaattgtcaaaaagggtatcttaaaggtgtaaaaaacgaagcgttgctaactcattcggaggttgttgctttatcagaaaagatcaaaattggtctacaattagaggaagagaagtcaagtttgagggaaagattgggatctgaaccatcagacaaacaactagcagattttctaaagatttcacaagttgacttgcaaaccaaacagatggagtgcgctttggcaagagagaagctgactctgagcaacattcgtctggtgatgtctgttgcacaaaaatataaacacatgggagcagatatgtctgacctaattcagggtggtctaattggactgcttagagggatagagaaatacgattcatctagggggcacaggatttcgacatatgtctattggtggatacgacagggtgtcacgagaaccttctttgaaaactctaaaacccttagattgcctacacatttgcatgaaagattgagtgcaatccgaactgccaaggccaaactggaaagaaagggaataactccatcaattgatagaattgcagaaagcctgcatatgtcaagaaagaaagttacaaatgccactgaggcagtttgtaaagtgttctcgctcgacaaggaagctttcccttctttaaatggtcttcctggagatacgcttcatagttacattgcagatgattgcccggacaacaacccatggcatggagtagatgaaggggctctcaaggaagaagttagaaatctcattaaaaggactctaggggaacgggaaagagagatcatacatctttactatggtctggacaatgaataccttacttgggaggatatcagtagaaggaaggggttgtcaagagaacgagttaggcaggttggtcttgttgcacttgagaaactaaaacacgcggccaaaaatacaaagttggctgcaatgcttgtctatgattgatttttggtacacttttttgtgaaagaaaatatccctgtacatattaatggtcattatttaaatgttcacgtactaatatttctaaaccagtatacattactgactcgaagggcctgtgttttatacatttggagagcagtgtatagaaagcttcatacggcaagaaaatctttaattttgttcacatttgtgcaatgtatgctattgctagctgaccatttatctcatggttccattatgtaatgcttttgattcagtatctagtatggaaaggttagctcgaac

SEQ ID NO: 2355 - DNA, 1728 bp, Flaveria ramosissima
ctttaaaaaagcgagaaagcccatacatacagtcatactcaaactaccatcaccacgagttaaccacggtctccatatatctgtcatagatctctttcgaattacagcagcaatcagctacatctgttaaggagttaaaagtgatattcaagaaacctgaagttcagcatatccgtttatggttgctgtgaaacaacattctaaatgtatgtggtactatttctattaagttaactcgcgtgacatatatgatggctacaaatgcagttgttggattaagagcaggagaacggttattaggttcaacttgttattactctgaggtcagtgaaaagctgtcctgcagtagcaatcttgggttcatatttgttccaactacaagttcaatcacttctaagaagtcacccaactatagccatagtcttgtgaacaaacgagatattcaccctactagagccgtgaaggaacatgtagatactgctctgaattcttcaagtacagatcaatgggatgattgggttcagaggcttgactatctgaatgaagaagtctctgaacatgagcttccagttgatgctttactcttattacataaatctttattggaaaaacaatggacactatcaacagaggagacaacaactacagaaaagaacagcaaaaaggtagtcactggttcagggatatcagctcgtaggcgtcgattaaatgctcagaataaaacaccagcaagaagttgttctgtaaatcaagatggcagaaacaagcagttgcgatccataatcagttcagagctccttcaaaattgtcaaaaagggtatcttaaaggtgtaaaaaacgaagcgttgctaactcattcggaggttgtttctttatcagaaaagatcaaaattggtctacaattagaggaagagaagtcaagtttgagggaaagattgggatctgaaccatcagagaaacaactagcagattttctaaagatttcacaagttgacttgcaaaccaaacagatggagtgcgctttggcaagagagaagctgactctgagcaacattcgtctggtgatgtctgttgcacaaaaatataaacacatgggagcagatatgtctgacctaattcagggtggtctaattggactgcttagagggatagagaaatacgattcatctagggggcacaagatttcgacatatgtctattggtggatacgacagggtgtcacgagaaccttctttgaaaactctaaaacccttagattgcctacacatttgcatgaaagattgagtgcaatccgaactgccaaggccaaactggaaagaaagggaataactccatcaattgataaaatcgcagaaagcctgcatatgtcaagaaagaaagttacaaatgccactgaggcagtctgtaaagtgttctcgctcgacaaggaagctttcccttctttaaatggtcttcctggagatacacttcatagttacattgcagatgattgcccggacaacaacccatggcatggagtagatgaaggggctctcaaggaagaagttagaaatctcattaaaaggactctaggggaacgggaaagagagatcatacatctttactatggtctggacaatgaataccttacttgggaggatatcagtagaaggaaggggttgtcgagggaacgagttaggcaggttggtcttgttgcacttgagaaactaaaacatgcggccaaaaata

SEQ ID NO: 2356 - DNA, 1724 bp, Flaveria ramosissima
cgagttaaccacggtctccatatctctgtcatagatctctttcgaattacagcagcaatcagctacatctgttaaggagttataagtgtgatcttcaagtaacctgaagttcagcatatccatttatgtttgctgtgaaacaacattgtcaatgtatgtggtactctttctattaagttaactcgcgtgacatatatgatggctacaaatgcagttgttggattaagagcaggagaacggttattaggttcaacttgttattactctgaggtcagtgaaaagctgtcctgcagtagcaatcttgggttcattattgttcaactacaagttcaatcacttctaagaagtacacccaactatagccatagtcttgtgaacaaacgagatattcaccctactagagccgtgaaggaacatgtagatactgctctgaattcttcaagtacagatcaatgggatgattgggttcagaggcttgactatctgaatgaagaagtctctgaacatgagcttccagttgatgctttactcttattacataaatctttattggtaaaaacaataggacactatcaacagagagacaacaactacagaaaagaacagcaaaaggtaagtcactggttcagggatatcagctcgtaggcgtcgattaaatgctcagaataaaacaccagcaaaaagttgttctgtaaatcaagatggcagaaacaagcagttgcgatccataatcagttcagagctccttcaaaattgtcaaaaagggtatcttaaaggtgtaaaaaacgaagcgttgctaactcattcggaggttgttgctttatcagaaaagatcaaaattggtctacaattagaggaagagaagtcaagtttgagggaaagattgggatccgaaccatcagagaaacaactagcagattttctaaagatttcacaagttgacttgcaaaccaaacagatggagtgcgctttggcaagagagaagctgactctgagcaacattcgtctggtgatgtctgttgcacaaaaatataaacacatgggagcagatatgtctgacctaattcagggtggtctaattggactgcttagagggatagagaaatacgattcatctagggggcacaagatttcgacatatgtctactggtggatacgacagggtgtcacgagaaccttctttgaaaattctaaaacccttagattgcctacacatttgcatgaaagattgagtgcaatccgaactgccaaggccaaactggaaagaaagggaataactccatcaattgatagaatcgcagaaagcctgcatatgtcaagaaagaaagttacaaatgccactgaggcagtctgtaaagtgttctcgctcgacaaggaagctttcccttctttaaatggtcttcctggagatacacttcatagttacattgcagatgattgcccggacaacaacccatggcatggagtagatgaaggggctctcaaggaagaagttagaaatcttattaaaaggactctaggggaacgggaaagagagatcatacatctttactatggtctggacaatgaataccttacttgggaggatatcagtagaaggaaggggttgtcaagggaacgagttaggcaggttggtcttgttgcacttgagaactaagacatgcggccaaaatacaaagttagctgcaatgcttgtctatgattgatttttggtacactttttt

SEQ ID NO: 2357 - DNA, 1965 bp, Flaveria ramosissima
ctttaaaaaagcgagaaaacccatacatacagtcatactcaaactaccatcaccacgagttaaccacggtctccatatctccgtcatagatctctttcgaattacagcagcaatcagctacatctgttaaggagttataagtgattttcaagaaaccgaaattcagcatttggtttatgattgctgtgaaacaacactctcaaagtatgttgtactatttctattaagttaattcgagtggcgtatatgatggctacaaatgcagttgttggattaagagcaggagaacggttatttggttcaacttgttattactctgaggtctgtgaaaagctgtcctgcagtagcaattttgggttcatatttgtgccaactacaagttcaatcacttctaagaagtcacccaactatagccatagtcttgtaaacaaacgagatactcaccccactagagccgtgaaggaacatgtagatactgctcttgattcttcaagtacagatcaatgggttgattgggttcagaggcttgactatctgaatgaagaagtatctgagcatgagcttccagttgatgctttactcttattacataaatctttattggaaaaacagtggacactttcaacagaggagacaacaactacagaaaagaaaagcaaaaaggtagtcactggttcagggatatcagctcgtaggcgtcgattaaatgctcagaataaaacaccagtaaaaagttctgtaaatcaagatggcagaaacaagcagttgcgatccataattagtccaaagctccttcaaaattgtcaaaaagggtatcttaaaggtgtaaaatccgaagcgttacttactcattcagaggtggtttctttgtcagaaaagatcaaaattggtctacaattagaggaagagaagtcaagtttgaaggaaagattgggatctgaaccatcagagaaacaacttgctgattttctaaagatttcacaagttgacttgcaaaccaaacagatggagtgcgctttggcaagagagaagctgacactaagcaacattcgtcttgtgatgtctgttgcacaaaaatataaacacatgggagcagatatgtctgacctaattcagggtggtctaattggactacttagagggatagagaaatatgattcatctagggggcacaagatttcgacatatgtctattggtggataagacagggtgtcacaagaaccttctttgaaaattctaaaacccttagattacctactcatttgcatgaaagattgagtgcaatccgaactgccaaggccaaactggaaagaaagggaataactccatcaattgataaaatcgcagaaagcctgcatatgtcaagaaagaaagttacaaatgccactgaggcagtctgtaaagtgttctcgctcgacaaggaagctttcccttctttaaatggtcttcctggagatacgcttcatagttacattgcagatgattgcccggacaacaacccatggcatggagtagatgaaggggctctcaaggaagaagttagaaatctcattaaaaggactctaggggaacgggaaagagagatcatacatctttactatggtctggacaatgaataccttacatgggaggatatcagtagaaggaaggggttgtcaagggaacgagttaggcaggttggtcttgttgcacttgagaaactaaaacatgcggccaaaaatacaaagttagctgcaatgcttgtgaatgattgatttttggtatactttgtgtgatgaaaaatatcctgtacatattaatgctcattatttgaatttcgggtactaatatttctgaaacagtatacattactgacttggagagcctgtgttttatacattttgagagcagtgtatagaaagcttcataccgcaggaaaatcaatcattttgttcacatttgtgcaatgtatcctattgctagct

SEQ ID NO: 2358 - DNA, 1718 bp, Helianthus annuus
ttaactcgcgttacgtatatgatggctacaaatgcagttgttggattaagagcaggagaacggttattaggttcatcgtcttactactctgaagtcagcgaaaagctgtcttgcagtagcaatatcgggttcatatttgtcccgactacaagttcaatcatttcaaagaagtcaaccaactatagccatagtcttgtaaacaaacgcgatactcaccccactagagccgtaaaggaacacgtagataccgctcttgattcttcaactacagatcaatgggttcacagattcgactatctggatgaagaagtctcggaacatgagtttccggttgatgctttactattgttacataaatctttattggaaaaacaatggacactaacaaccgaggagacaataactacggaaaagaagagcaaaaaggttgtcacgggttcaggggtatctgcccgaaggcgtcgattaaatgctcaaaataaaacactagccaaaaattgtcaagatggtggaaataagcagttgagatctatcatcagtccggagcttcttcaaagttaccaaaaagcgtatcttaaaggtgtaaaaaacgaagcgttgttgactcattcggaggttgttgctttatccgaaaagatcaaaattggtctacaattagaggaagagaagtcaagtttgaaggaaagattggggactgaaccgtcagagaaacaacttgcggattttctaaagatttcacaagttgacttgcaaaccaaacaaatggagtgcacgttggcaagagagaagttgacgttgagcaacattcgtctggtgatgtctgttgcgcaaaaatataaacacatgggagcagatatgtctgatctaattcagggcggtctaattggattacttagagggatagagaaatatgattcatctagggggcacaagatttctacgtatgtttattggtggatacgacagggtgtcacgagaaccttctttgaaaattctaaaactcttagattgcctactcatttgcatgaaagattgagtgcaatccgaagcgccaaggccaaactagagagaaagggaataactccatcgatcgatagaattgccgaaaccctgaatatgtcaagaaagaaagttacaaacgccactgaggcagtctgtaaagtgttctcacttgacaaggaagccttcccttctttgaacggtattcctggagatacgcttcatagttacatcgcagacgattgcccagacaacaacccatggcacggggtagacgtaggggctctcaaggaagaagtaagaaatctcattaaaacgactctgggggaacgggaaagagagatcatacatctttactatggtttggacaatgaatatcttacttgggaggatataagtagaaggaaggggttgtcaagggaaagagttaggcaggttggccttgttgcactggagaaactaaaacatgctgccagaaatacaaatttagctgcaatgcttgtatatgactaatttttggtacacttttgtcttgaggaaaatatccctgtacatattaatgttcattatttaattttcgaatgttgctaaaccggtatacattactgactcgaaaggcctgttttttgtaacaattggagagcagtgtatagaaagcttcatactgcaggaaaatctatcattttgttcacatttgtacctcggccgcgaccacgcta

SEQ ID NO: 2359 - DNA, 2014 bp, Ambrosia trifida
aaattaaatgtcttaataataaagtacatacacacagtcatactcatataagtccctctctctgtttttggtttatcactgtcttcatccattaagaaattttaagtgatcatcaagaagcatttggatttatagttgctgtgaaacaacttcctcaaagtatgtggtaccatttctattaagttaactcgcgtgacatatatgatggctacaaatgcagttgttggattgagagcaggggaacggttattaggttcatcatcttattactccgaagtctgcgaaaagctgtcctgcagtagcaatattgggttcatatttgtcccaactacaagttcaatcatttcaaagaagtcacgtaactatagccatagtcttgtaaacaagcgtgatactcaccccacgagagccgtgaaggaacatgtagatactgctattgattcttcaagttcagatcaatgggttcagagatttgactatctggatgaagaagtcgctgaccatgagattgcagttgatgctttactattgttacataaatctttattagaaaaacaatggaccctatcaacagaggagacgacaactacagaaaagaacagcaaaaaggttagtcactggttcagggatatctgctcgaaggcgtcgattaaatgctcaaaataaaacgtcagtccaaagttgttctagaaatcaagatggtggaaataagaagttgagatccataatcagtccagagctccttcaaaattaccaaaaagcgtatcttaaaggtgttaaaacgaaacgttgctgactcattcagaggttgttgctttatcagaaaagatcaaaattggccttcagttagaggaagagaagtcaagtttgaaggaaagattgggaattgatccttcagagaaacaacttgcagattttctaaagatttcacaagttgatttgcaaaccaaacaaatggagtgcactttggcaagagagaagctgacactgagcaacattcgtctggtgatgtctgttgcacaaaatataaacacatgggagcagatatgtctgatctaattcagggtggcctaattggactacttagagggatagagaaatatgattcatccaggggacataagatttccacatatgtctattggtggatacgacagggtgtcacaagaaccttctttgagaattctaaaacccttagactgcctactcatttgcatgaaagattgagtgcaatccgaagtgccaaagccaaactagagagaaagggaataactccatcaattgataaaattgcagaaagcctgcatatgtcaagaaagaaagttacaaatgccactgaggcagtctgtaaagtgttctcgcttgacaaggaagctttcccttctttaaatggtcttcctggagatacgcttcatagttacattgcagatgattgcccagacaatgacccgtggcatggagtagatgaaggggctctcaaggaagaagtaagaaatctcataaaaaagactctaggtgaacgggaaagagagatcatatatctttactacggcctggacaatgaatatcttacttgggaggatatcagtagaaggaaggggttgtcaagggaacgagttaggcaggttggccttgttgcactggagaaactaaaacatgcggccagaaatacaaatttagctgcaatgcttgtgaatgattgatttttggcacacttttttgtgtgaggaaaaatatccctgtacatataaacgttcattatttaattttcaggtactaatattcctaaaccagagtacattagtgactcgtaaggccttttttttacaattggagagcagtgtatagaaagcttcatattgcagaaaaatctatcattttcttcacatttgtgcaatgtatatctattgctagtccaccatttatctcatggttccaatttgtaataatttaaactcaacgtctattgtaaagatgtacttgactatgtccgagctcaatcggacttctctca

SEQ ID NO: 2360 - DNA, 1881 bp, Helianthus annuus
aatagtctgttttggttaaccagcaccacacatttaccaccgtcttcatctctctgttatagatctctttcagctacatccattaagaaatttttaagtgatcatcaagaagtctgaagtccagcatttggatttatgattgctgtgaaacaacttcctaatagtatgtgctaccatttctattaagttaactcgcgttacgtatatgatggctacaaatgcagttgttggattaagagcaggagaacggttattaggttcatcgtcttactactctgaagtcagcgaaaagctgtcttgcagtagcaatatcgggttcatatttgtcccgactacaagttcaatcatttcaaagaagtcaaccaactatagccatagtcttgtaaacaaacgcgatactcaccccactagagctgttaaggaacacgtagataccgctcttgattcttcaacttcagatcaatgggttcatagatttgactatctggatgaagaagtctcgaaacatgagtttccggttgatgctttactattgttacataaatctttgttggaaaaacaatggacactatcaaccgaggagacaataactacggaaaagaagaccaaaaaggttgtcacgggttcaggggtatctgcccgaaggcgtcgattaaatgctcaaaataaaacactagccaaaaattgtcaagatggtggaaataagcagttgagatctatcattagtccggagcttcttcaaagttaccaaaaagcgtatcttaaaggtgtaaaaaacgaagcgttgttgactcattcggaggttgttgctttatccgaaaagatcaaaattggtctacaattagaggaagagaagtcaagtttgaaggaaagattggggactgaaccgtcagagaaacaacttgcggattttctaaagatttcacaagttgacttgcaaacaaaacaaatggagtgcacgttggcaagagagaagttgacgttgagcaacattcgtctggtgatgtctgtagcgcaaaaatataaacacatgggagcagatatgtctgatctaattcagggcggtctaattggattacttagagggatagagaaatatgattcatctagggggcacaagatttctacgtatgtctactggtggatacgacagggtgtcacgagaaccttctttgaaaattctaaaacgcttagattgcctactcatttgcatgaaagattgagtgcaatccgaagcgccaaggccaaactagagagaaagggaataactccatcaatcgatagaattgccgaaaccctgaatatgtcaagaaagaaagttacaaacgccactgaggcagtctgtaaagtgttctcacttgacaaggaagccttcccttctttgaacggtattcctggagatacgcttcatagttacatcgcagacgattgcccagataacaacccatggcacggggtagacgtaggggctctcaaggaagaagtaagaaatctcattaaaacgactctgggggaacgggaaagagagatcatacatctttactatggtctggacaatgaatatcttacttgggaggatatcagtagaaggaaggggttgtcaagggaacgagttaggcaggttggccttgttgcactggagaaactaaaacatgctgccagaaatacaaatttagctgcaatgcttgtatatgactaatttttggtacacttttgtcttgaggaaaatatccctgtacatattaatgttcattatttaattttcgggtactaatgtttctaaaccggtatacattactgactcgaaatgcctgttttttgtaacaattggagagcagtgtatagaaagcttcatactgcaggaaaatctaccattttgtt

SEQ ID NO: 2361 - DNA, 2080 bp, Helianthus annuus
aaaaacataaatgttctacacacagtcctactcataataaatagtcagttttggttaaccagcaccacacatttaccaccgtcttcatctctctgttatagatctctttcagcaacatccaataagaaatttttaagtgatcatcaagaagtctgaaggatttatgatcgctgtgaaacaacttcctaatattatgtgctaccatttctattaagttaactcgcgttacgtattaggtatatgatggctacaaatgcagttgttggattaagagcaggagaacggttattaggttcatcgtcttactactctgaagtcagcgaaaagctgtcttgcagtagcaatatcgggttcatatttgtcccgactacaagttcaatcatttcaaagaagtcaaccaactatagccatagtcttgtaaacaaacgcgatactcaccccactagagccgtaaaggaacatgtagataccgctcttgattcttcaacttcagatcaatgggctcatagatttgactatctggatgaagaagtctcggaacatgagtttccggttgatgctttactattgttacataaatctttattggaaaaacaatggacactatcaaccgaggagacaataactacggaacagaagaccaaaaaggttgtcacgggttcaggggtatctgcccgaaggcgtcggttaaatgctcaaaataaaacactagccaaaaattgttctggaaatcaagatggtgggaataagcagtttaaatccataatcagtccggagcttcttcaaagttaccaaaaagcgtatcttaaaggtgtaaaaaacgaagcgttgttgactcattcggaggtcgttgctttatccgaaaagatcaaaattggtctacaattagaggaagagaagtcaagtttgaaggaaagattggggactgaaccgtcagagaaacaacttgcggattttctaaagatttcacaagttgacttgcaaacaaaacaaatggagtgcacgttggcaagagagaagttgacgttgagcaacattcgtctggtgatgtctgttgcgcaaaaatataaacacatgggagcagatatgtctgatctaattcagggcggtctaattggattacttagagggatagagaaatatgattcatctagggggcacaagatttctacgtatgtttattggtggatacgacagggtgtcacgagaaccttctttgaaaattctaaaacgcttagattgcctactcatttgcatgaaagattgagtgcaatccgaggcgccaaggccaaactagagagaaagggaataactccatcaatcgatagaattgccgaaaccctgaatatgtcaagaaagaaagttacaaacgccactgaggcagtctgtaaagtgttctcacttgacaaggaagccttcccttctttgaacggtattcctggagatacgcttcatagttacatcgcagacgattgcccagataacaacccatggcacggggtagatgtaggggctctcaaggaagaagtaagaaatctcattaaaacgactctgggggaacgggaaagagagatcatacatctttactatggtttggacaatgaatatcttacttgggaggatatcagtagaaggaaggggttgtcaagggaacgagttaggcaggttggccttgttgcactggagaaactaaaacatgctgccagaaatacaaatttagctgcaatgcttgtatatgactaatttttggtacacttttgtcttgaggaaaatatccctgtacatattaatgttcattatttaattttcgggtactaatgtttctaaaccggtatacattactgactcgaaaggcctgttttttgtaacaattggagagcagtgtatagaaagcttcatactgcaggagaatctatcattttgttcacatttgtacaatgttttctatcgctcgctcaccatttatcccaatattttttgggttgaccaagcttgaggttagcttgggcttcgctagatttttagttaattgtttttacgtatagagaaattatatatattaatttgttttattaaatat

SEQ ID NO: 2362 - DNA, 1693 bp, Helianthus annuus
gttttggttaaccagcaccacacatttaccaccgtcttcatctctctgttatagatctctttcagcaacatccaataagaaatttttaagtgatcatcaaaaagtctgaagtccagcatttggatttatgattgctgtgaaacaacttcctaatagtatgtgctaccatttctattaagttaactcgcgttacgtatacgatggctacaaatgcagttgttggattaagagcaggagaacgcttattaggttcatcgtcttactactctgaagtcagcgaaaagctgtcttgcagtagcaatatcgggttcatatttgtccctactacaagttcaatcatttcaaagaagtcaaccaactatagccatagtcttgtaaacaaacgcgatactcaccccactagagctgttaaggaacacgtagataccgctcttgattcttcaacttcagatcaatgggctcatagatttgactatctggatgaagaagtctcggaacatgagtttccggttgatgctttactattgttacataaatctttattggaaaaacaatggacactatcaaccgaggagacaataactacggaaaagaagagcaaaaaggttgtcacgggttcaggggtatctgctcgaaggcgtcgattaaatgctcaaaataaaacactagccaaaaattgtcaagatggtggaaataagcagttgagatctatcatcagtccggagcttcttcaaagttaccaaaaagcgtatcttaaaggtgtaaaaaacgaagcgttgttgactcattcggaggttgttgctttatccgaaaagatcaaaattggtctgcagttagaggaagagaagtcaagtttgaaggaaagattggggactgaaccgtcagagaaacaacttgcggattttctaaagatttcacaagttgacttgcaaacaaaacaaatggagtgcacgttggcaagagagaagttgacgttgagcaacattcgtctggtgatgtctgtagcgcaaaaatataaacacatgggagcagatatgtctgatctaattcagggcggtctaattggattacttagagggatagagaaatatgattcatctagggggcacaagatttctacgtatgtttattggtggatacgacagggtgtcacgagaaccttctttgaaaattctaaaacgcttagattgcctactcatttgcatgaaagattgagtgcaatccgaggcgccaaggccaaactagagagaaagggaataactccatcgatcgatagaattgccgaaaccctgaatatgtcaagaaagaaagttacaaacgccactgaggcagtctgtaaagtgttctcacttgacaaggaagccttcccttctttgaacggtattcctggagatacgcttcatagttacatcgcagacgattgcccagataacaacccatggcacggggtagacgtaggggctctcaaggaagaagtaagaaatctcattaaaacgactctgggggaacgggaaagagagatcatacatctttactatggtctggacaatgaatatcttacttgggaggatatcagtagaaggaaggggttgtcaagggaacgagttaggcaggttggccttgttgcactggagaactaaaacatgctgccagaaatacaaatttagctgcaatgcttgtatatgactaattt

SEQ ID NO: 2363 - DNA, 1837 bp, Echinacea purpurea
ctttagaacagggtgaagcccacacacagtcattctcatagtagtccctctctctgttttggcttacaaccaccacacgtttaccacgaaatttaagttcagcatttcggtttatggatgctgcaaaacaacttcctaagtatgggctactatatctattaagttaactcgcgtgacatatacgatggctacaaacgcatttgccggattaagagcaggagagcggttattaggttcgtcatcttactactccgaagtcagtgaaaagctgtcctgcagtagcaaccttgggttcatatctgccccaactacaaattctattgtttccaagaagtcaccgaaccatagccatggtcttgtaaacaaacgagttactcaccccactcgagctgtgaaggagcatgtagtcgatactgctcttgattcttcacccactgatcaatggtttcagaggtttggttatctaaatgatgacgtctctgagcttgagtttccggttgatgctttactgttgttacagaaatctttattggaaaaacagtggactctttcaaccgatgagacaacgatagtagaaaagagcagtaaaaaggtagttactggttcagggatatctgcccgaaggcgtcggttatttgctcagaataaaacaccagctaaaaactgttctgttaaacaagatggtggacataagcagctgagatcagtaatcagcccagagctccttctaaattaccaaaaagggtatcttaaaggtgtaaaaaccgaagcgttgctgactcattcagaggttgttgcattatcagaaaagatcaaaattggtctgcagttagaggaagagaagtcaagtttgaaggaacgactgggaaccgaaccttcagagaaacaacttgcagattttctgaagatttcgcgagttgacttgcaaaccaaacagatggagtgcagtttagcaagagagaagctgacactgagcaacattcgtctggtgatgtcggttgcacaaaaatataaacacatgggagcagatatgtctgatctgattcagggtggtttaatcggactacttagagggatagagaaatatgattcatctagagggcacaagatttctacatatgtatattggtggatacgacagggcgtcacaagaaccttctttgaaaattctaaaacgcttagattgcctactcatttgcatgaaagactgagtgcaatccgaagtgccaaggccaaactagagagaaagggaatatccccatcaattgatagaattgcagaaaccttgaatatgtcaagaaagaaagttacaaacgcgactgaggcagtctgtaaagtgttctcaattgacaaggaagctttcccttctttaaatgggattcccggagatacgcttcatagctacattgcagatgattgcccggacaacgacccatggcacgttgtagatgaaggggctctcaagaatgaagtaagaaatctcatcaaaatgacgctaggggaacgggaaagagagatcatacatctttactatggtctggataatgaatatcttacttgggaagatatcagtagaaggaagggtttgtcaagggaacgagttaggcaggttggccttgttgcacttgaaaaactaaaaaggcggccagaaatacaaatttagctgcaatgcttgtaaatgattgatttttggtacacttttgtgtgaggaaaatacccctgtacatataaatggtcattattttttatttccgggtagtaataattctaaaccagtatacattactgactcaaaaggcctgttttttgtaacaattggagagctcagagcagtgta

SEQ ID NO: 2364 - DNA, 1580 bp, Ambrosia trifida
accgggttcatatttgtcccaactacaagttcaatcatttcaaagaagtcacgtaactatagccatagtcttgtaaacaagcgtgatactcaccccacgagagctgtgaaggaacatgtagatactgctcttgattcttcaagtacagatcaatgggttcagagatttgactatctggatgaagaagtcgctgaccatgagattgcggttgatgctttactattgttacataaatctttattagaaaaacaatggaccttaacaacagaggagacgacaactacagaaaagaacagcaaaaaggtagtcactggttcagggatatctgctcgaaggcgtcgattaaatgctcaaaataaaacaccagtcgaaatttgttctggaaatcaagatggtggaaataagaagttgcgatccataatcagtccagagctccttcaaaattaccaaaaggcttatcttaaaggtgtaaaaaacgaaacgttgctgactcattcagaggttgttgctttatcagaaaagatcaaaattggccttcagttagaggaagagaaatcaagtttgaaggaaagattgggaactgatccttcagagaaacaacttgcagattttctaaagatttcacaagttgacttgcaaaccaagcagatggagtgcactttggcaagagagaagctgacactgagcaacattcgtctggtgatgtctgttgcacaaaagtataaacacatgggagcagatatgtctgatctaattcagggtggcctaattggactacttagaggcatagagaaatatgattcatctaggggacataagatttccacatatgtctattggtggatacgacagggtgtcacaagaaccttctttgaaaattctaaaacccttagattgcctactcatttgcatgaaagattgagtgcaatccgaagtgccaaagccaaactagagagaaagggaataactccatcaattgataaaattgcagaaagcctgcatatgtcaagaaagaaagttacaaacgccactgaggcagtctgtaaggtgttctcgcttgacaaggaagcttcccttctttaaatggtcttcctggagatacgcttcatagttacattgcagatgattgtccggacaatgacccgtggcacggagtagatgaaggggctctcaaggaagaagtaagaaatctcataaaaaagactctaggggaacgggaaagagagatcatatatctttactacggcctggacaatgaatatcttacttgggaggatatcagtagaaggaaggggttgtcaagggaacgagttaggcaggttggccttgttgcactggagaaactaaaacatgcggccagaaatacaaatttagctgcaatgcttgtgaatgattgatttttggcacacttttttgtgtgaggaaaaatatccctgtacatataaacgttcattatttaattttcaggtactaatattcctaaaccagagtacattagtgactctaaaggcctttttttatacaattggagagcagtgtatagaaagcttcatattgcataaaaatctatcattttcttt

SEQ ID NO: 2365 - DNA, 2042 bp, Ambrosia trifida
agaaattaaatgtcttaataataaagtacatacacacagtcatactcatataagtccctctctctgtttttggtttaccactgtcttcatccattaagaaattttaagtgatcatcaagaagcatttggatttatagttgctgtgaaacaacttcctcaaagtatgtggtaccatttctattaagttaactcgcgtgacatatatgatggctacaaatgcagttgttggattgagagcaggggaacggttattaggttcatcatcttattactccgaagtctgcgaaaagctgtcctgcagtagcaatattgggttcatatttgtcccaactacaagttcaatcatttcaaagaagtcacgtaactatagccatagtcttgtaaacaagcgagatactcaccccacgagagccgtgaaggaacatgtagatactgctcttgattcgtcaagttcagatcaatgggttcagagatttgactatctggatgaagaagtcgctgaccatgagattgcagttgatgctttactattgttacataaatctttattagaaaaacaatggaccctatcaacagaggagacgacaactacagaaaagaacagcaaaaaggtagtcactggttcagggatatctgctcgaaggcgtcgattaaatgctcaaaataaaacgtcagtccaaagttgttctagaaatcaagatggtggaaataagaagttgagatccataatcagtccagagctccttcaaaattaccaaaaagcgtatcttaaaggtgtaaaaaacgaaacgttgctgactcattcagaggttgttgctttatcagaaaagatcaaaattggccttcagttagaggaagagaagtcaagtttgaaggaaagattgggaattgatccttcagagaaacaacttgcagattttctaaagatttcacaagttgatttgcaaaccaaacaaatggagtgcactttggcaagagagaagctgacactgagcaacattcgtctggtgatgtctgttgcacaaaaatataaacacatgggagcagatatgtctgatctaattcagggtggcctaattggactacttagagggatagagaaatatgattcatctagggggcataagatttccacatatgtctattggtggatacgacagggtgtcacaagaaccttctttgaaaattctaaaacccttagattgcctactcatttgcatgaaagattgagtgcaatccgaagtgccaaagccaaactagagagaaagggaataactccatcaattgataaaattgcagaaagcctgcatatgtcaagaaagaaagttacaaatgccactgaggcagtctgtaaggttttctcgcttgacaaggaagctttcccttctttaaatggtcttcctggagatacgcttcatagttacattgcagatgattgcccagacaatgacccgtggcatggagtagatgaaggggctcccaaggaagaagtaagaaatctcataaaaaagactctaggggacgggaaagagagatcatatatctttactacggcctggacaatgaatatcttacttgggaggatatcagtagaaggaaggggttgtcaagggaacgagtttaggtcaggtttggccttgttgcactggagaactaaaacatgcggccagaatacaaatttagctgcaatgcttgtgaatgattgatttttggcacacttttttgtgtgaggaaaaatatccctgtacatataaacgttcattatttaattttcaggtactaatattcctaaaccagcgtacattagtgattcgaaaggcctttttttatacaattggagagcagtgtatagaaagcttcatattgcaagaaaaatctatcattttcttcacatttgtgcaatgtatatctattgctagtccaccatttatcccatggttccaatttgtaataatttaaactcaacgtctattgtaaagatgtacttgactatgtctgagcccaatcggacttctctcatttatcttctaactaaaaaagaa

SEQ ID NO: 2366 - DNA, 1380 bp, Ambrosia trifida
gacgtctgtgaaaagctggcctgcagtagcaatactgggttcatacttgtcccaactacaagttcaatcgtttcaaagaagtcacgtaactatagccatagtcttgtaaacaagcgtgatactcaccccaccgagagctgtgaaggaacatgtagatactgctcttgattcttcaagtacggatcaatgggttcagagatttgactatctggatgaagaagtcgctgaccatgagattgcggttgatgctttactattgttacataaatctttattagaaaaacaatggacactatcaacagaggagacgtcaactacagaaaagaacggcaaaaaggtagtcactggttcagggatatctgctcgaaggcgtcgattaaatgcgcaaaataaaacaccagtcgaaagttgttatggaaatcaagatggtggaaataagaagttgcgatccataatcagtccagagctcctacaaattaccaaaaggcgtatcttaaaggtgtaaaaacgaacgctgctgactcattcagagttgttgctttatcagaaagatcaaaattggccttcagttagaggaagagaagtcaagtttgaaggaaagattgggaattgatccttcagagaaacaacttgctgattttctaaagatttcacaagttgacttgcaaaccaagcagatggagtgcactttggcaagagagaagctgacactgagcaacattcgtctggtgatgtctgttgcacaaaaatataaacacatgggagcagatatgtctgatctaattcagggtggccttattggactactaagaggcatagagaaatatgattcatctaggggacataagatttccacatatgtctattggtggatacgacagggtgtcacaagaaccttctttgaaaattctaaaaccttagattgcctactcatttgcatgaaagattgagtagcaatccgaagtagccaaagccaaactagagagaaagggaataactccatcaattgataaaatagcagaaagcctgcatatgtcaagaaagaaagttacaaacgccactgaggcagtctgtaaggtgttctcgcttgacaggaagctttcccttctttaaatggtcttcctggagatacgcttcatagttacattgcagatgattgcccagacaatgacccgtggcacggagtagatgaaggggctctcaaggaagaagtaagaaatctcataaaaaagactctaggggaacgggaaagagagatcatatatctttactacggcctggacaatgaatatcttacttgggaggatatcagtagaaggaaggggttgtcaagggaacgagttaggcaggttggccttgttgcactggagaaactaaaac

SEQ ID NO: 2367 - DNA, 1580 bp, Ambrosia trifida
gaagtacacgtaactatagccatagccttgtaaacaagcgtgatactcaccccaccgagagccgtgaaggaacatgtagatactgctattgattcttcaagttcagatcaatgggttcagagatttgactatctggatgaagaagtcgctgaccatgagattgcagttgatgctttactattgttacataaatctttattagaaaaacaatggaccctatcaacagaggagacgacaactacagaaaagaacagcaaaaagttagtcactggttcagggatatctgctcgaaggcgtcgattaaatgctcaaaataaaacgtcagtccaaagttgttctagaaatcaagatggtggaaataagaagttgagatccataatcagtccagagctccttcaaaattaccaaaaagcgtatcttaaaggtgttaaaaacgaaacgttgctaactcattcagaggttgttgctttatcagaaaagatcaaaattggccttcaattagaggaagagaagtcaagtttgaaggaaagattgggaactgaaccttcagagaaacaacttgcagattttctaaagatttcacaagttgacttgcaaaccaaacaaatggagtgcactttggcaagagagaagctgacactgagcaacattcgtctggtgatgtctgtcgcccaaaagtataaacacatgggagcagatatgtctgatctaattcagggtggcctaattggactacttagaggcatagagaaatatgattcatctagggggcataagatttccacatatgtctattggtggatacgacagggtgtcacaagaaccttctttgagaattctaaacccttaggttgcctactcatttgcatgaaagattgagtgcaatccgaagtgccaaagccaaactagagagaaagggaataactccatcaattgataaaattgcagaaagcctgcatatgtcaagaaagaaagttacaaatgccactgaggcagtctgtaaggttttctcgcttgacaaggaagctttcccttctttaaatggtcttcctggagatacgcttcatagttacattgcagatgattgcccagacaatgacccgtggcacggagtagatgaaggggctctcaaggaagaagtaagaaatctcataaaaaagactctaggtgaacgggaaagagagatcatatatctttactacggcctggacaatgaatatcttacttgggaggatatcagtagaaggaaggggttgtcaagggaacgagttaggcaggttggccttgttgcactggagaaactaaaacatgcggccagaaatacaaatttagctgcaatgcttgtgaatgattgatttttggtactacttttttgtgtgaggaaaaatatccctgtacatataaacgttcattatttaattttcaggtactaatattcctaaaccagagtacattagtgactcgtaaggtcctttttttttactaattggagagcagtgtatagaaagcttcatattgcaagaaaaatctatctattttcttcactatttgtgcaattgtatatctattgctagtccacc

SEQ ID NO: 2368 - DNA, 1742 bp, Centaurea maculosa
ccacacatcaaccacgctctccatctcaactcctaaaatctctctcaccagctgagccagttaagaaattttttaagtgatctccaagaaacctgaagacctattcagcaattctgttgcttaatgatggttgctgtaagacgactttctgagaggatgtgattctatttcttgtaaattgacgaactccacatatatgatgtctacaactgcagttactggactaagagcaggaaaaaggttattaggttcatcaccttattactccgaggtcagtgaaaagctgacctgcagtagcaatcttgggttcatatctgtcccaactacgaatttgatcacttcaaaaaagtcacccaactttagccatggttctatatacagccgggatactcattccgtcagagctcttaaggaacatgtagataccgctttagatgttccgagtacagaccaatgggctcagaggtttgatcatctggatgaggaagtctccgactctgagcatgagctttcagttgaagctatgctcttattacataagtctttgctcgaaaagcagtggaccctttcaacggagaggacaactacaagtactcccacaaagagaaacagcagaaaggtgcatgtaactggttcaggggtatctgctcgaaggcgtcgaatagatgctcaaaataaagcaccaaatagcaattattctgtaaatcaagttagtgggagtagacagttgagatccataatcagtccggaactccttcaaaattgtcaaagaggatatcttaaaggtgtaagaaacgaagcgttgcttactcattcagaggtggttgctctatcggaaaagatcaaaattgggctacacttagaggaggagaagtcaagactgaaggaaagattgggatctgaaccttcagagaagcaacttgcaacttccctacagatttcccaacttgacttgcaaactaaacagaccgagtgcactttggcaagagagaaactggcactgagcaatgtccgtctggtgatgtctgttgcacaaaaatacaaacacatgggagccgacatgtctgacttaattcagggaggtctaattggactactcagagggatagagaaatatgattcatctagagggcacaagatttctacatacgtctattggtggatacggcagggtgtcacgagaactttctttgaaaattctaagacccttagattgcctactcacttgcatgaaagacttggtgcaatccgaaatgccaagtccaaactagagagaaagggaatcactccatcaattgataaaattgcggaaagcctgaagatgtcgagaaagaaagttacaaatgccaccgaggcagtctataaagtgttctcacttgataaggaagcttttccatctttaaatggtcttcctggagatacactacactgttacattgcagatgattccccacagaacaacccatggcatggagtagatgaggaggctctcaaggatgaagtaagaaagctgattgccatgactctaggggaaagggagagagagatcatccatctttactatggtctcgacaatgaatatcttacatgggaggatatcagtaggaggaaaggtttgtcaagggaacgagttaggcaggttggccttgttgcacttgagaagctaaaacatgctgccaaaaatacaagactagccgaaatgttggactatgattgactttccggtatgctttcacgtgata

SEQ ID NO: 2369 - DNA, 1834 bp, Cirsium arvense
ctgaagacctattcagcaattctgttgcttagtcatggttgctgtaaaacgactttccgagatgatgtgattctgtttcttgaaaattgacaaactccacatatatgatgtctacaactgcagttactggactaagagcaggaaaaaggttattaggttcatcaccttattactccgaggtcagtgaaaagctgacctgcagtagcaatcttgggttcatatctgtcccaactacgaatttgatcacttcaaaaaagtctaccaactttagccatggttctatatacagccgggatactcattccgtcagagctcttaaggaacatgtagatactgctttagatgttccgagtacagaccaatgggctcagaggtttgatcatctggatgaggaagtctccgactctgagcatgagctttcagttgaagctatgctcttattacataagtctttgctcgaaaagcagtggaccctttcaacggagaggacaactacaagtactcccataaagagaaacagcagaaaggtgcatgtaactggttcaggggtatctgctcgaaggcgtcgaatagatgctcaaaataaagcaccaaatagcaattattctgtaaatcaagttagtgggagtagacagttgagatccataatcagtccggaactccttcaaaattgtcaaagaggatatcttaaaggtgtaagaaatgaagcgttgcttactcattcagaggtggttgctctatcggaaaagatcaaaattgggctacacttagaggaggagaagtcaagactgaaggaaagattgggatctgaaccttcagagaagcaacttgcaacttccctacagatttcccaacttgacttgcaaactaaacagaccgagtgcactttggcaagagagaaactggcactgagcaatgtccgtctggtgatgtctgttgcacaaaaatacaaacacatgggagccgacatgtctgacttaattcagggaggtctaattggactactcagagggatagagaaatatgattcatccagagggcacaagatttctacatatgtctattggtggatacggcagggtgtcacgagaactttctttgaaaattctaagacccttagattgcctactcacttgcatgaaagactgggtgcaatccgaaatgccaagtccaaactagagagaaagggaatcactccatcaattgataaaattgcggaaagcctgaagatgtcgagaaagaaagttacaaatgccaccgaggcagtctataaagtgttctcacttgataaggaagcttttccatctttaaatggtcttcctggagatacacttcactgttacattgcagatgattccccacagaacaacccatggcatggagtagatgaggaggctctcaaggatgaagtaagaaagctgattgccatgactctaggggaaagggagagagagatcatccatctttactatggtctcgacaatgaatatcttacatgggaggatatcagtaggaggaaaggtttgtcaagggaacgagttaggcaggttggccttgttgcacttgagaagctaaaacatgctgccaaaaatacaagactagccgaaatgttggactatgattaactttccggtatgctttcatgtgataggaaataattccatgtacatacaaacgtttgttattaatttttccattaccaaaccggtatatgtttactgacttaaaaaggcatgttttccgcgacaaaagaggggtgtatagaaagtgttatgaattatatatatgctacaggtcaccattctccatccaaaaagaaaaaataccgactgcg

SEQ ID NO: 2370 - DNA, 2138 bp, Centaurea maculosa
catgttaccatcaccaccacacatcaaccacgctctccatctcaacaactcctaagaaatattaagtgattccaggaaacctctgaagacctattcagcaattctgttgcttagtcatggttgctgtaaaacgactttccgagaggatgtgattctttttcttgtaaattgacgagctccacatatatgatgtctacaactgcagttactggactaagagcaggaaaaaggttattgggttcatcaccttattactctgatgtcagtgaaaagctgacctgcagtagcaatcttgtgttcatatctgtcccaactacgaatttgatcacttcaaaaaagtctaccaactttagccatggttctatatacagccgggatactcattccgtcagagctcttaaggaacatgtagacactgctttagatcttccgagtacagaccaatgggctcagaggtttgatcatctggatgaggaagtctccgactctgagcatgagctttcagttgaagctatgctcttattacataagtctttgctggaaaagcagtggaccctttcaacggagaggacaactacaactactcccacaaaaagaaacaacagaaaggtgcatgtaactggttcaggggtatctgctcgaaggcgtcgaatagatgctcaaaataaaacaccaagtagaaattattctgtaaatcaagttagtgggagtcgacagttgagatccataattagtccggaactccttcaaaattgtcaaagaggatatcttaaaggtgtaagaaatgaagcgttgctcactcattcagaggtggttgctctatcggaaaagatcaaaattggtctacacttagaggaggagaagtcaagactgaaggaaagattgggatgcgaaccttcagagaagcaacttgcaacttccctacagatttcccaacttgacttgcaaactaaacagaccgagtgcactttggcaagagagaagctggcactaagcaatgtccgtctggtgatgtccgttgcacaaaaatacaaacacatgggagccgacatgtctgacttaattcagggaggtctaattggactactcagagggatagagaaatatgattcatctagagggcacaagatttctacatacgtctattggtggatacggcagggtgtcacgagaactttctttgaaaattctaagacccttagattgcctactcacttgcatgaaagactgggtgcaatccgaaatgccaagtccaaactagagcgaaagggaatcaccccatcaattgataaaattgcggaaagcctgaagatgtcgagaaagaaagttacaaatgccaccgaggcagtgtataaagtgttctcacttgataaggaagctttcccatctttaaatggtcttcctggagatacacttcactgttacattgcagatgattccccacagaacaacccatggcatggagtagatgaggaggctctcaaggatgaagtaagaaagctgattaccaagactctaggggaaagggagagagagatcatccatctttactacggtctcgacaatgaatatcttacatgggaggatattagtaggaggaaaggtttgtcaagggaacgagttaggcaggttggccttgttgcacttgagaagctaaaacatgctgccaaaaatacaagactagcggaaatgttggactatgattgactttccggtatgctttcatgtgataggaaataattccatgtacatacaaacgtttgttattaaattttccattaccaaaccggtatatgtttactgacttaaaaaggcatgttttccacgacaaaagaggggtgtatagaaagtgttatgaattatatatatatgctataggtcaccattctccatcccgtgattcgaatttgtaccaattttgattgattatctattggaaaatctaccagtacatgtaaatgcactcggctaaatgttaaatcgattgcttgtacttttttcttttttgaggtaggcaccccttctcccgaagttacggggcttattttgccgagttccttagagtagagttgtctcgcgcccctaggtattctactacctacccacctgtgttcggtttcgggtactaggttaccctt

SEQ ID NO: 2371 - DNA, 1455 bp, Ambrosia trifida
agcatttggatttacggttgctgtgaaacaacttcctcaaagtatgtggtaccgtttctattaagttaactcgcgtgacatatatgatggctacaaatgcagttgttggattgagagcaggggaacggttattaggttcatcatcttattactccgacgtctgtgaaaagctggcctgcagtagcaataccgggttcatatttgtcccaactacaagttcaatcgtttcaaagaagtcacgtaactatagccatagtcttgtaaacaagcgtgatacgcaccccacgagagctgtgaaggaacatgtagatactgctcttgattcctcaagtacagatcaatgggttcagagatttgactatctggatgaagaagtcgctgaccatgagattgcggttgatgctttactattgttacataaatctttattagaaaaacaatggaccctatcaacagaggagacgacaactacagaaaagaacggcaaaaaggtagtcactggttcagggatatctgctcgaagacgtcgattaaatgctcaaaataaaacaccagtcgaaagttgttctggaaatcaagatggtggacataagaagttgcgatccataatcagtccagagctccttcaaaattaccaaaaggcgtatcttaaaggtgtaaaaacgaaacgttgctgactcattcagaggttgttgctttatcagaaaagatcaaaattggtcttcagttagaggaagagaaatcaagtttgaaggaaagattgggaactgatccttcagagaaacaacttgcagattttctaaagatttcacaagttgacttgcaaaccaaacaaatggagtgcactttggcaagagagaagctgacactgagcaacattcgtctggtgatgtctgttgcacaaaaatataaacacatgggagcagatatgtctgatctaattcagggtggccttattggactactaagaggcatagagaaatatgattcatctaggggacataagatttccacatatgtctattggtggatacgacagggtgtcacaagaaccttctttgaaaattctaaaacccttagattgcctactcatttgcatgaaagattgagtgcaatccgaagtgccaaagccaaactagagagaaagggaataactccatcaattgataaaattgcagaaagcctgcatatgtcaagaaagaaagttacaaacgccactgaggcagtctgtaaagtgttctcgcttgacaaggaagctttcccttctttaaatggtcttcctggagatacgcttcatagttacattgcagatgattgtccggacaatgacccgtggcacggagtagatgaaggggctcgtacaaggaagaagtaagaaatctacaataaaaagactacgtaaggggaacgggaaagaggaagatacaatatattacttactacggctaggaacaa

SEQ ID NO: 2372 - DNA, 2065 bp, Tragopogon dubius
gctttcgtgtagagtgaatatatttaatttaaaatttatacgtcttttatgaagtaagaagttgatgcgtacagtcatactagtccctctcttctctcttcaggttaccaacaccacatatctccatcggaatctccctcctatatctccttcaaattgcagtgacgccgattaagttgcaggaatctcaagtgatctccaagaaacctgaagacctgttcagcagttctgttcattcattgttcatggttgctgtaaaccgactttttcaaagtatgtgatactagttcttgccagttgactaacgccacatatacaatggcgacaactgcagtagtaggactaagaacaggaaacagaatcttaagttcatcatcttattactctgatgtctctgaaaagctatcctgcagtagcaatatgtggttcatatatgtcccaaccacaaatctcatcacttcaaagaaatcacccaactatagccatagttatatatacagtcgagatattcaccctgtcagagctctgaaggaacatgtagatacaactttagatcctccaattacagaccaatggattcaggggtttgatcatctggaagagaatgaaatcccggttgaagctttactcttattacaaaaatctttgctggaaaagcagtggactctttcaacggatacggatacagaaaaaatcagtagaaagttacgtgtcactggttcaggggtatctgctagaaggcgtcgaatagattctcagaataaaacaccaactagaactagttctgtaaatcaagttggtggaaataagcagttgagatccataattagtccagaacttttgcaaaattgtcagaaggggtatcttaaaggtgctaaaaatgaagcgttgctcactcattcagaggtggttgctctatcggaaaagatcaaaatcggtctacacttggaggaagagaagttaagactgaaagaaagattgggatcggaaccttcagagaagcaactggcagcttccttaaagatatcccgcgttgaattgcaagccaaacagatcgagtgcagtttagcaagagagaagctagcactaagcaacgtgggtctggtgatgtctgttgcactcaagtataaacacatgggagccgatatgtctgacctaattcagggaggtctaattggactactcagagggatagagaaatacgattcatcaaggggacacaagatttccacatatgtctattggtggatacgccagggtgtcacgagaactttctttgaaaattctagaacccttagactgcctactcacttgcatgaaagactgggtgcaatccgaaatgccaaggccaaactagaacgaaagggaattaccccatcaatcgataaaattgcggaaagcctgaatatgtcaaaaaagaaggttacgaatgcgactgaggcagtctgtaaagtgttctcgcttgataaggcagctttcccttctttaaacggtcttcctggagaaactcttcacagttacattgcagacgattgcccggagaacaacccatggcatggtgtagatgaaggggctctcaaggatgaagtaagaaaacttattcaatcgactctaggggaacgagaaagagaaatcatccatctttattacggtctcgacaatgaatatcttacttgggaggatatcagtcgaaggaagggattgtcaagggaaagagttaggcaggttgggcttgttgcactagagaaattaaaacacgctgcaagaaatacaaaactagccgaaatgctggtcaaccattaatttttttccggtaattatatttcgtgtacatacaaatgatgttttgttttatttaatttccggtattaatatttgtgaatcagtatacattactgacctcataagtctgtttttaaccacgaaagagcagtgtatagagaaagcattatactgcaggaaaaacgcgttatatttgtaccaattttgattctacatccacaatttatatgcatataactttaaactcaaagatccgtttgtgatacaaaaaaaaaaaaaaaaa

SEQ ID NO: 2373 - DNA, 2062 bp, Gossypium raimondii
taaaaaaataatggagaaatttgtaagaaaactgtggaagacaggtttcaactccgacaacctcatgttttgctaaatattctgatttccacattggaacattcgtctctttctttctttatttttttccttatatttcttcttgggtgtaacatttccttcctcttttagctaatatctaccctttttttgagtgacacaatatcataaaggagtttatcatatcaaagaagtttagcttaattgcctattgaatatacagttgaagagttgtatgaaattgaaacagcttgttaaaattgtgtgatggtaattgtgccatccggagaagaagctgtatgatggcaacagctgctattatcggacttactgttggaaagcgattcttgagttcttcgttttcgtattccgatatcattgagaagcactcgtatgccggtgattatggcggagctccacattatcaaactgctcccactaaaagtctaatagttgcaaagaaatcatctaattgtagccaaagtgttccttcatatgatcggcgtagtcggtcgatcaaagctcttaaggagcatgtggatactgcttcccttgtttcaactgccggaccttggtgtcagggatccgatgattttgaagaagaaagctatgaacttgactactctgtggaggctcttcttttgtttcagaagtctatgctcgaacagcaatggactctttcgttcgaaaggacggtgttcactgaatcaccaagtagaaaaactaaaaagaaggtacctgttacttgttctggggtgtcagctcggcaacggagattcaatactaggatgcaacctaatgctaagcagctaagatcattgatcagtccggagctgcttcgaagtcgtttgaagggttatgtgcgaggtgttgtaagtgaagagttgctcagccatgcggaagttgttcgattgtcgaagaaaatcaaagccggactttccttggaggatcagagattgagactgaaggagaggctcgggtgtgacccgtccgatgaacagcttgcaacttccctgaagatttctcgtgccgagttgcgttcaatgttaattgaatgttcattggcaagagacaaattggcaatgagcaatgttcgtttggttatgtccatagctcaaagatacgataacatgggtgctgaaatgcctgatcttattcagggtggtttgatcggactattgcgcggcatcgaaaaattcgattcttcaaagggatataaaatttcaacttacgtttactggtggatacgtcagggtgtatcgagagcattagttgataactcgagaactttaaggttgcctactcatatgcatgaacgactgggattaatccgaaatgcaaaatatagactcgaagagaaaggaataacgccaactattgataggattgccgagagtctgaacatgtctcagaagaaagtccggaatgcaacgaaggcagacagtaaggtcttctcactcgaccgcgttgcgttcccctcattgaacggtcttcccggagagactcatcatagttacattgcagataaccatgaagaaaacaatccttggcatggagtagatgaaggggcactcaaggatgaagtgaacagactcatcggtataacactgggagaacgagaaagggagatcataaaactttatcatggtctcggtaaagaaagtcttacatgggaggacatcagtaaacggatcggtttgtcgagagagagagtccggcaaatcgggcttgtcgcgctggagaaactaaaaaacgcggcgaggaagaatggaatggaagctatgctattgaaacagtgattttcgaaattcagacataaacattggtaaaaatgattgtatatatatacagaaagcaaaattgtatcttcaatgtcaagactaaaagggcatggctgccatgaacttaaaactccctgtaaccagagttcaacaaactgactgtattacggatcgggaaaaaattttatgcatcgaatttttctgtaattatgatgataaacatgttgtttgaatgcatatag

SEQ ID NO: 2374 - DNA, 2194 bp, Gossypium raimondii
ctcctattctcctccccaatccaatatcccttccaattttcccttttctttattaataaataaataaaaatctcagtatattttgaacgttatatatattttaatatttatttattaaaaaaataatggagaaacttgtaagaaaactgtggaagacaggtttcaactccgacaacctcatgttttgctaaatattctgatttccacattggaacattcgtctctttctttctttctttcttttttccttatatttcttcttgggtgtaacatttccttcctcttttagctaatgtctaccatttttttgagtgacacaataccataaaggagtttatcatatcaaagaagtttagcttaattgcctattgaatatacagttgaagagttgtatgaaattgaaacagcttgttaaaattgtgtgatggtaattgtgctatccggagaagaagctgtatgatggcaacagctgctattatcggacttactgtcggaaagcgactcttgagttcttcgttttcgtattccgatatcattgagaagcactcgtatgccggtgattatggcggagctccacattatcaaactgctcccactaaaagtctaatagttgcaaagaaatcatctaattgtagccaaagtgttccttcatatgatcggcgtagtcggtcgatcaaagctcttaaggagcatgtggatactgcttcccttgtttcaactgccggaccttggtgtcggggatccgatgattttgaagaagaaagctatgaacttgactactctgtggaggctcttcttttgtttcagaagtctatgctcgaacagcaatggactctttcgttcgaaaggacggtgttcactgaatcaccaagtagaaaaactaaaaagaaggtacctgttacttgttctggggtgtcagctcggcaacggagattcaatactaggatgcaacctaatgctaagcagctaagatcattgatcagtccggagctgcttcgaagtcgtttgaagggttatgtgcgaggtgttgtaagtgaagagttgctcagccatgcggaagttgttcgattgtcgaagaaaatcaaagccggactttccttggaggatcagagattgagactgaaggagaggctcgggtgtgacccgtccgatgaacagcttgcaacttccctgaagatttctcgtgccgagttgcgttcaatgttaattgaatgttcattggcaagagacaaattggcaatgagcaatgttcgtttggttatgtccatagctcaaagatacgataacatgggtgctgaaatgcctgatcttattcagggtggtttgatcggactattgcgcggcatcgaaaaattcgattcttcaaagggatataaaatttcaacttacgtttactggtggatacgtcagggtgtatcgagagcattagttgataactcgagaactttaaggttgcctactcatatgcatgaacgactgggattaatccgaaatgcaaaatatagactcgaagagaaaggaataacgccaactattgataggattgccgagagtctgaacatgtctcagaagaaagtccggaatgcaacgaaggcagacagtaaggtcttctcactcgaccgcgttgcgttcccctcattgaacggtcttcccggagagactcatcatagttacattgcagataaccatgaagaaaacaatccttggcatggagtagatgaaggggcactcaaggatgaagtgaacagactcatcggtataacactgggagaacgagaaagggagatcataaaactttatcatggtctcggtaaagaaagtcttacatgggaggacatcagtaaacggatcggtttgtcgagagagagagtccggcaaatcgggcttgtcgcgctggagaaactaaaaaacgcggcgaggaagaatggaatggaagctatgctattgaaacagtgattttcgaaattcagacataaacattggtaaaaatgattgtatatatatacagaaagcaaaattgtatcttcaatgtcaagactaaaagggcatggctgccatgaacttaaaactccctgtaaccagagttcaacaaactgactgtattacggatcgggaaaaaattttatgcatcgaatttttctgtaattatgatgataaacatgttgtttgaatgcatatagtgattttatattta

SEQ ID NO: 2375 - DNA, 2009 bp, Gossypium hirsutum
ggagaaatttgtaagaaaactgtggaagacaggtttcaactccgacaacctcatgtttttgctaaatattctgatttccacattggaacattcgtctctttctttctttatgtttttccttatatttcttcttgggtgtaacatttccttcctcttttagctaatatctaccctttttttgagtgacacaatatcataaaggagtttatcatatcaaagaagtttagcttaattgcctattgaatatacagttgaagagttgtatgaaattgaaacagcttgttaaaattgtgtgatggtaattgtgctatccggagaagaagctgtatgatggcaacagctgctattatcggatttactgtcggaaagcgactcttgagttcttcgttttcgtattccgatatcattgagaagcactcgtatgctggtgattatggcggagctccacattatcaaactgctcccactaaaagtctaatagttgcaaagaaatcatctaattgtagccaaagtgttccttcatatgatcggcgtagtcggtcgatcaaagctcttaaggagcatgtggatactgcttcccttgtttcaactgccggaccttggtgtcggggatccgatgattttgaagaagaaagctatgaacttgactactctgtggaggctcttcttttgtttcagaagtctatgctcgaacagcaatggactctttcgttcgaaaggacggtgttcactgaatcaccaagtagaaaaactaaaaagaaggtacctgttacttgttctggggtgtcagctcggcaacggagattcaatactaggatgcaacctaatgctaagcagctaagatcattgatcagtccggagctgcttcgaagtcgtttgaagggttatgtgcgaggtgttgtaagtgaagagttgctcagccatgcggaagttgttcaattgtcgaagaaaatcaaaactggactttccttggaggatcagagattgagattgaaggagaggctcgggtgtgacccgtccgatgaacagcttgcaacttccttgaagatttctcgtgctgagttgcgttcaatgttaattgaatgttcattggcaagagacaaattggcaatgagcaatgtccgtttggttatgtccatagctcaaagatacgataacatgggtgctgaaatgcctgatcttattcagggtggtttgattggactattgcgtggcatcgaaaaattcgattcttcaaagggatataaaatttcaacttacgtttactggtggatacgtcagggtgtatcgagagcattagttgataactcgagaactttaaggttgcctactcatatgcatgaacgactgggattaatccgaaatgcaaaatatagactcaaagagaaaggaataacgccaactattgataggattgccgagagtctgaacatgtctcagaagaaagtccggaatgcgacagaggcagacagtaaggtcttctcacttgaccgcgttgcgttcccctcattgaatggtcttcctggagagactcatcatagttacattgcagatcaccatgaagaaaacaatccttggcatggagtagatgaaggggcactcaaggatgaagtgaacagactcatcggtataacactgggagaacgagaaagggagatcataaaactttatcatggtctcggtaaagaaagtcttacatgggaggacatcagtaaacgcatcggtttgtcgagagagagagtccggcaaatcgggcttgttgcgctggagaaactaaaaaacgcagcgaggaagaatggaatggaagctatgctattgaaacagtgattttcgaaattcagatataaaaattggtaaaaatgattgtatatatatacagaaagcaaaattgtatcttcaatatcaagactaaaagggcatggctgccatgaacttaaaactccctgtaaccagagttcaacaaactgactgtattacggatcgggaaaaaaatttatgcatcgaatttt

SEQ ID NO: 2376 - DNA, 2153 bp, Theobroma cacao
aaaaaaaaaagggaaaggttgtaatatactgtggaagacaggttccaactcctacaacctcttcttttgccaactgtttagttcccactttggaacaaccgttctcttttcttcttcttcttcttcttcttggttgtttcatttccttcttcttaagcttatagctggcagtttttttaagttaagattgtcttaaagagattgagcatacaagacaacaagtttgttagcctagtcgcctacagaatatgctgttgaagatttatattaaattgttttaaattgacaagcttgttaaactgtgtgatggttattgtgccaacgtgagaaggagctgtatgatggccacagctgctgtgattggacttaccactggaaagagactcttgagttcttccttttcttattctgatatcatagagaagctctcatatgccaatgattatggatcttcacatcatcagacttcttccacaaaaagtttaatagttgcaaaaaaatcatctaactgtagccaaagtcttccatcatccaatcggcgtgctcagtcaattaaagctctcaaagagcatgtcgattctgcctccattgtttcaactgcagagcctttgtttcagggatccaatgacttagaagtagaaagctatgaccttgactactctgtggaggctcttcttttgctgcagaagtctatgctggaaaagcaatggactctttcttttgagaggacagtgttcactgaatcacctagtagaaaaattcacaagaagatacctgttacttgttctggggtgtctgctcggcaaaggagattcaatacaaagaggaaaattctgatccaaaataaatcaatcatacaaccaaacgctaagcagctaagatctttgatcagtccagagctgcttcaaagtcgtttgaagggttacgtgaagggtgtagtaagtgacgagttgctcagccatgcagaagttgtgcgcttgtcaaagaaaatcaaagctggactttccttagaggagcacaggttaagattgaaggagagactgggatgtgagccttctgatgaacagcttgcaacttccttgaagatttctcgtgctgagttacggtcaaagttaattgaatgttctttggcaagagaaaaattggcaatgagcaatgttcgtttggttatgtcgatagctcaaagatatgataacatgggtgctgaaatgtccgatcttattcagggtggtttgattggattgttgcgtggcattgaaaaatttgattcttcaaagggatataagatttcaacttatgtgtactggtggatacgtcagggtgtttctagagcattagttgagaactcaagaacactaaggttgccaacgcatttgcatgaaagactgggattaatccgaaatgcaaaaattagactggaagagaaaggaattacaccaactattgataggattgccgagagtctgaacatgtctcagaagaaagttaggaatgctacagaggcagtcagtaaggtcttctcacttgacagggatgcattcccctctttgaatggtcttcctggagagactcatcatagttacattgcagataaccatgtagaaaacattccatggcatggagtagatgagtgggcactcaaggatgaagtgaacagactcattactataacgcttggagaacgagaaagagagattatacgcctttattacggtctagataaggaaagtcttacatgggaggacattagtaaacgcataggtttgtccagagagagagtcaggcaagttggacttgtcgcgctagagaaactaaaacacgcagcgaggaagaagaaaatggaggctatgctagtaaaacattgattttgtatgcttaaacatacacatggtaaaaaagactgtatatagatacagaaaggaaaattgtatcttcgatttatttttcctatcaagagtaactatagttcgacaaacttcctgtaacacgagttcatcaaactgatttaagagcctgtaagttggagcgaagaaaattcttttttatgtattatatttatggagacaataactggttgtgcgtcaaaattttcatgtagttatgatgataaacaagtagtttcaatgcagatattgagctgacctttcatcaaa

SEQ ID NO: 2377 - DNA, 2729 bp, Theobroma cacao
gggacccaccccgttcatcgatttttgctcggatttcgccgtcagtttattggtgatgtgtggtgaccaaacccatccgtacatgtatatctaacagattaaaagagaattttaaataaaaaaaaaaagaacagaggagagagaagcaaaatggcaagctatgcaccactcaaagatggacccaatatctaaagtagccaatggaatctctccttccaatatcctttttgtccatttggcaccctttttcttcattttatcataaattaaatcccacagttttatcaaagccaacgtaacaaaataaatttataaacccaaataattaaaaaaagggaaaggttgtaatatactgtggaagacaggttccaactcctacaacctcttcttttgccaactgtttagttcccactttggaacaaccgttctcttttcttcttcttcttcttcttcttggttgtttcatttccttcttcttaagcttatagctggcagtttttttaagttaagattgtcttaaagagattgagcatacaagacaacaagtttgttagcctagtcgcctacagaatatgctgttgaagatttatattaaattgttttaaattgacaagcttgttaaactgtgtgatggttattgtgccaacgtgagaaggagctgtatgatggccacagctgctgtgattggacttaccactggaaagagactcttgagttcttccttttcttattctgatatcatagagaagctctcatatgccaatgattatggatcttcacatcatcagacttcttccacaaaaagtttaatagttgcaaaaaaatcatctaactgtagccaaagtcttccatcatccaatcggcgtgctcagtcaattaaagctctcaaagagcatgtcgattctgcctccattgtttcaactgcagagcctttgtttcagggatccaatgacttagaagtagaaagctatgaccttgactactctgtggaggctcttcttttgctgcagaagtctatgctggaaaagcaatggactctttcttttgagaggacagtgttcactgaatcacctagtagaaaaattcacaagaagatacctgttacttgttctggggtgtctgctcggcaaaggagattcaatacaaagaggaaaattctgatccaaaataaatcaatcatacaaccaaacgctaagcagctaagatctttgatcagtccagagctgcttcaaagtcgtttgaagggttacgtgaagggtgtagtaagtgacgagttgctcagccatgcagaagttgtgcgcttgtcaaagaaaatcaaagctggactttccttagaggagcacaggttaagattgaaggagagactgggatgtgagccttctgatgaacagcttgcaacttccttgaagatttctcgtgctgagttacggtcaaagttaattgaatgttctttggcaagagaaaaattggcaatgagcaatgttcgtttggttatgtcgatagctcaaagatatgataacatgggtgctgaaatgtccgatcttattcagggtggtttgattggattgttgcgtggcattgaaaaatttgattcttcaaagggatataagatttcaacttatgtgtactggtggatacgtcagggtgtttctagagcattagttgagaactcaagaacactaaggttgccaacgcatttgcatgaaagactgggattaatccgaaatgcaaaaattagactggaagagaaaggaattacaccaactattgataggattgccgagagtctgaacatgtctcagaagaaagttaggaatgctacagaggcagtcagtaaggtcttctcacttgacagggatgcattcccctctttgaatggtcttcctggagagactcatcatagttacattgcagataaccatgtagaaaacattccatggcatggagtagatgagtgggcactcaaggatgaagtgaacagactcattactataacgcttggagaacgagaaagagagattatacgcctttattacggtctagataaggaaagtcttacatgggaggacattagtaaacgcataggtttgtccagagagagagtcaggcaagttggacttgtcgcgctagagaaactaaaacacgcagcgaggaagaagaaaatggaggctatgctagtaaaacattgattttgtatgcttaaacatacacatggtaaaaaagactgtatatagatacagaaaggaaaattgtatcttcgatttatttttcctatcaagagtaactatagttcgacaaacttcctgtaacacgagttcatcaaactgatttaagagcctgtaagttggagcgaagaaaattcttttttatgtattatatttatgtagacaataactggttgtgcgtcaaaattttcatgtagttatgatgataaacaagtagtttcaatgcagatattgagctgacctttcatcaaatatttacaattttatattaaatgtataatgctctagtccagaaagaagaagaggaatgggcatgagtttggaagtacttgtttgccttcattgatccttgcaacccagatcaggtccaggtcgacaagaacagaaactagtagcgaattttatatatatgaaggcttgatccttgcaatcatgatgtgggtactagacataaggtttcgctttgttgagaaaggagattgccaatcaaaccctactttaatc

SEQ ID NO: 2378 - DNA, 3404 bp, Gossypium raimondii
ataaatgattatttaccaggcctatatcgataaatattttttaaaaaaaacttttatatgtaatttgcccgcaatactaaatattagtttagataaaaatataaaagaaaagaaaaacgaagtaacgggagtgaggcacactgtttgttgggggatgacgtggaagtgggcccatcattcatcgatatttgctcacatttgttattagttaatttgttagtggtgcccaaacccaacccatcctcaaatatatgaaacagattaaaccgagaaaaaaatccccaaaaaataaaaacagagaagcgaaatggaaagctatgcaccactcaaacatggacccaatatctagtgtagccaatggaatctatcttctctatatcctttatgtccattttgcaccctttcttcttcaattttatcataaaattaaatcccaacataatcactatatatatatttttacaaattattaaatctaaaaaagcttctagtttctaaaacaaactccggaataccggttccaaactctttcctcttcctttgctaactgttctactttacactttggaacacacgtctttctttcttcttcttgtttctttcatttccttcttgttgtagctggcaattttttaagtgtcatacaggagatttagagtacaagaggagaatatttttgtttagcttagtcgcctacgggatataacggttgaattgttttaattttgacaagcgtgctaaattgtgtgatggtaattgtatcaaagtgagaagaatctgtatgatggccactgctgctgtgattggacttagcaccggaaagagactcttgagctcttccttttcttattcggaaaccgtagataagctgtcgtatgctggtgattatggatcttcatattatcaaactccttccacaaagactttaatggttgcaaaaagatcatctaattgtagccaaaatcttccatcatccaatcggcacacgcagtcaattaaagcttttaaagagcatgtggatactgcatccagtatttcaacagtagagccttggatccatggaaccaatgacttagaacaagaaagctatgatcttgactactctgtagaggctcttcttttgcttcagaagtctatgctggaaaagcaatggacactttcttttgagaggacgatgttcactgaatcaccaagtcgaaaaactcacaacaaggtacctgttacatgttctggggtgtctgctcggcaacgaagattcaatactaagaggaagattctgagccaaaataaatcaatgatacaacctaacgctaagcagctaagatcattgatcgggccagagctgcttcaaaatcgcttgaagggttatgtgaagggtgtagtgagtgaagatttgcttagccatgcggaagttgtgcgcttgtcaaagaaaatcaaagctggactttccttggaggagcacagattaagattgaaggagagactgggatgtgagccatctgatgaacagcttgcaacttccttgaaagtttctcgtgctgagttacggtcaaggtcaatcgaatgttctttggcaagagaaaaattggcaatgagcaacgttcgcttggttatgtcgatagctcaaagatatgataacatgggtgctgaaatgtctgatcttattcagggtggtttgatcggactattgcgtggtatcgaaaaatttgattcttcaaagggatataaaatttcaacttatgtgtactggtggatacgtcagggtgtttctagagcactggttgagaactcaagaacattaagattgcctacatatttgcatgaaagattgggattaatccgaaatgcaaaatataggctggaggagaaaggaataacaccgactattgataggattgctgagagtctgaacatgtctcagaagaaagttaggaatgccacagaggcagtcagtaaggtcttctcccttgacagggatgcattcccgtctttgaatggtcttcctggagagactcaccatagttacattgcagataaccatgtagaaaacaatccatggcatggagtagatgagtgggcactcaaggatgaagtgaacagactgatcaatataacgctcggagaacgagaaagggagattatacggctttatcatggtttggataaggaaagtcttacatgggaggacatcagtaaacgcataggtttatccagggagagagttaggcaagtcggacttgtggcgctggagaaactaaaacacgcagcgaggaagaagaaaatggaagccatgcttgtcaaacattgattttgtaacgcttcaacatacacatgataaaaaatgactgtatatatatacagagggaaaatttgtatcttcaaattacttttccttgtcaagagtcactatagaagctcagggtaagggaccaaaaatcctaaacttgctgtgacaagagtccaagtgtccaacaaactgattaagaatctctaagttggagcaaattttttatgtattatatttctggacacaaatacctggttttggatcatttttttctgtagttttgatgataaacaaagtactttaaaagcttaatagtcaacaaacaggaaaaagttcggccaaaaaatttcgactaccaaaacttcatagtaattctgttctacaataatccaccgatagcttcacgggggtttctagactcgaagccttctagactctctctctctctctctttcgacactctttttaacatttcaaagatagcaactccattcaagcaaacgaaaataagctgaaaaaagttcaaagtcctctcagaattttctagcagtaaccaagataagatcaagaaagcaaagattagatcagaatgttccaagtgctacaaattagagctctccaaatcggccaaaatgaatgatcctactagttcagctgctgcaccaggcccttcagattcggttgtttctgcaaccttaatttctagtccctcaaaaatcaacaacaggtgtgaaagctgcaacaggaagcttggcttgatggggtttacatgtcggtgtggcagagttttctgtcagttcgaccgctaccccttggaacattcctgcaactacgatttcaagaaggccggtcgtcaaagtttagctaaagaaaacccggttataaggggagacaaactcaaatccaggatgtaactctatcttattcgtataattggtctgcttcattttcccttatcttgcttttgttgcagcaagtattaaactattgacattctatttaccggttatcaagttttgtgctaacatgtctggtttgtggttagaaattgatcagattaattctacgatgaccattcaaagcaagccaattcaacctgcacaatattagcttcaag

SEQ ID NO: 2379 - DNA, 2130 bp, Gossypium raimondii
gcttctagtttctaaaacaaactccggaataccggttccaagctctttcctcttcctttgctaactgttctactttacactttggaacacacgtctttctttcttcttcttgtttctttcatttccttcttgttgtagctggcaattttttaagtgtcatacaggagatttagagtacaagaggagaatatttttgtttagcttagtcgcctacgggatataacggttgaattgttttaattttgacaagcgtgctaaattgtgtgatggtaattgtatcaaagtgagaagaatctgtatgatggccactgctgctgtgattggacttagcaccggaaagagactcttgagctcttccttttcttattcggaaaccgtagataagctgtcgtatgctggtgattatggatcttcatattatcaaactccttccacaaagactttaatggttgcaaaaagatcatctaattgtagccaaaatcttccatcatccaatcggcacacgcagtcaattaaagcttttaaagagcatgtggatactgcatccagtatttcaacagtagagccttggatccatggaaccaatgacttagaacaagaaagctatgatcttgactactctgtagaggctcttcttttgcttcagaagtctatgctggaaaagcaatggacactttcttttgagaggacgatgttcactgaatcaccaagtcgaaaaactcacaacaaggtacctgttacatgttctggggtgtctgctcggcaacgaagattcaatactaagaggaagattctgagccaaaataaatcaatgatacaacctaacgctaagcagctaagatcattgatcgggccagagctgcttcaaaatcgcttgaagggttatgtgaagggtgtagtgagtgaagatttgcttagccatgcggaagttgtgcgcttgtcaaagaaaatcaaagctggactttccttggaggagcacatattaagattgaaggagagactgggatgtgagccatctgatgaacagcttgcaacttccttgaaagtttctcgtgctgagttacggtcaaggtcaatcgaatgttctttggcaagagaaaaattggcaatgagcaacgttcgcttggttatgtcgatagctcaaagatatgataacatgggtgctgaaatgtctgatcttattcagggtggtttgatcggactattgcgtggtatcgaaaaatttgattcttcaaagggatataaaatttcaacttatgtgtactggtggatacgtcagggtgtttctagagcactggttgagaactcaagaacattaagattgcctacatatttgcatgaaagattgggattaatccgaaatgcaaaatataggctggaggagaaaggaataacaccgactattgataggattgctgagagtctgaacatgtctcagaagaaagttaggaatgccacagaggcagtcagtaaggtcttctcccttgacagggatgctttcccgtctttgaatggtcttcctggagagactcaccatagttacattgcagataaccatgtagaaaacaatccatggcatggagtagatgagtgggcactcaaggatgaagtgaacagactgatcaatataacgctcggagaacgagaaagggagattatacggctttatcatggtttggataaggaaagtcttacatgggaggacatcagtaaacgcataggtttatccagggagagagttaggcaagtcggacttgtggcgctggagaaactaaaacacgcagcgaggaagaagaaaatggaagccatgcttgtcaaacattgattttgtaacgcttcaacatacacatgataaaaaatgactgtatatatatacagagggaaaatttgtatcttcaaattacttttccttgtcaagagtcactatagaagctcaggtaagggaccaaaaatcctaaacttgctgtgacaagagtccaagtgtccaacaaactgattaagaatctctaagttggagcaaattttttatgtattatatttctggacacaaatacctggttttggatcatttttttctgtagttttgatgataaacaaagtactttaaaagcttaatagtcaacaaacagg

SEQ ID NO: 2380 - DNA, 1683 bp, Brassica juncea
aagttcggtggatcctcggtggcaacggcggggagaatgagggaagtggcggatttggttttgacgtttccggaagagagtcccgtcattgttctttccgctatggggaaaaccaccaacaacctcttgcttgcgggagagaaggcggttagttgcggtgtttctaatgcttctgagatcgaggaattgagcattatcaaggaactgcatctcaggacagtgaaagagctcgagatcgacccctctgttgtttcgtcgtttttggaagaactagagcaactactgaaaggtatagccatgatgaaggagctgacacttagaaccagagactacttggtctcttttggagagtgcttgtctacaaggattttcgcagcttatcttaataaaatcggtgtcaaggcacgccaatatgatgcatttgaaattggtttcattacaacggatgatttcactaatggagatatcttggaagcaacttatccagctgttgccaagagattatatgatgactggatgcatgatcctgctgttccagttgtaacaggtttccttggaaagggttggaaaacatgtgcggttactaccttgggtaggggtggcagtgatttgacggcaaccacaattggtaaagcattgggtttgcaagagattcaggtgtggaaagatgttgatggtgttctaacatgtgaccctactatttataaacgagctacaccagtaccatatctaacattcgatgaagcagccgagctagcttattttggtgcacaggtgctgcacccacagtcaatgagaccagcaagagagggtgggattcctgttagggtgaaaaattcttataaccctaaagctcctggaactatcatcacgaaaacaagagacatgaccaagacagttttaacgagcattgttctgaaacgcaatgtgaccatgctggatatagcaagcacccgaatgcttggtcaagttggatttcttgccaaggtattttcgatatttgaagatcttgaaatatccgtagatgttgttgccactagtgaagtcagcatatctctgacactggacccgtcaaaactttggagcagggaactgattcaacaggagcttgatcatgtagttgaagaactggagaagattgcggttgtgaatcttgcgaaaggaagagcaataatctctctaattggaaatgttcagcattcctccctgattctagagagggcgtttcatgttctttggaccaaaggcatcaatgtccagatgatatcacaaggagcatccaaggttaacatttcccttatagtaaatgatgctgaagctgaaggatgcgtcgaggctcttcacaaatccttcttcgagagcggtgacctctcagagttattgatacaacccagacttggcaacgggtcacctgttaggacaatgcaagtagagaactgacttgacgagctcactgcttgatctttagttttcatcaagaactgcttgttgtattgttcacgtttaggctagtgaaccgcttgccatcttttcatttggtgtgagaacgatctcttggaccatttttgatttagcgtgatcaaacattaaccagtaagagaataagaaacatattgagatgtaactacagatgcttgaataggttttggtacaagaacatattaggctaaaagctgtggagtt

SEQ ID NO: 2381 - DNA, 1972 bp, Setaria italica
aaatggcgacctcagtgcgatcggcagcagcgccgcgccgcctcgctccgtcggcacctccggcgagcgccgggcatgtccgaggattggcgcgcttcggtaatcgaaccgggcccctcggtgcccgaggattgtcaatggtggttgccgactccacccgccgtcgggccaagtttggcagcggggacagcgtcctcggggctcccgtccttggagggcccggggcggaattgggggatcagttgagcgtggtgatgaagttcgggggatcctcggtgtcgtcggccgcgaggatggaggaggttgccgacctcatcctggcgttccccgaggagcgccccgtcgtcgtcctctctgcaatggggaaaaccaccaacctcctgctcctcgctggagagaaggcagtgggttgtggagtgatccatgtttctgaaatcgaagagtggaacacaatcaaagacctgcatattaaaactgttgatgaacttggactgccaagatccgaaatacatgacatgctggatgaactggagcaactcttgaaaggtatcgcaatgatgaaagagctgacacttcgaaccagagactaccttgtttcatttggagaatgcatgtccacacggatctttgctgcttatttgaacaaaattggtgtcaaagcacggcagtatgacgcatttgatattggtttcataacaacagacgatttcggtaacgctgatgtcttggaagcaacttatcctgctgttgctaagagacttcatggagactggatacgggatccagcaatacccgtagtaactggattccttgggaagggctggaaatcaggagctgttactactttaggccgaggtggtagtgacttgactgctacaaccattggtaaagccttgggactgagagaaattcaggtatggaaggatgttgatggtgtactcacttgtgatccaaatatctacccacatgcaaagactgttccgtacttaacatttgaagaggctacagaacttgcttattttggtgcccaggttttgcatccacaatcaatgagacctgctagagaaggtgatataccagttagggttaagaattcatacaaccctaaagctccaggcacccttatcactaaacaaagagagatggataaggttgtacttactagtatagtgctgaagtcaaatgtcactatgttggacatagtgagcactcggatgcttggtcagtttggttttctggcaagggtattttctatatttgaagatctaggcatatctgtggattgtgttgccactagtgaagttagcatttctgtgtcacttgatccatcaaagatctggagtagggaacttattcagcaggaacttgacaatgtagtcgaagagcttgagaaaatagcaattgttcatctacttcagcagagggcaataatttcgctcatcggaaacgtgaaacgatcatctcttatactagaaaagaccttccaggtgctgaggaaatgcggtgtcaatattcagatgatctcacaaggggcatccaaggttaacatgtcgctgatagttcatgacagcgaggcgaaggcctgcatcaaagccctccatcaggcattcttcgaggacgaggatgttctcacacaagttgaaacggagaacctgctggtgggttgaccgatacaggtcgccgtctccagcatgttatccagcatcagctccaccttgtcatctatctccatcatcagtggcttaatccgctttgcgtgaacagcattgtgtatttaatttgtcagtctgcttcccactgaatggctgaaaaaagacatggctttttattgttcccaactcgggtgaacacaacgaacaccgcttgtgcatgaacactgaatggatgtttttgagagagataacaatgagcagttgaacagcatttgaatgcacagttgtgcacacatcaatgaacacagtgtgtactcgcc

SEQ ID NO: 2382 - DNA, 2004 bp, Setaria italica
gacagcctggcagtgtatagaaggtgctaagaaatggcgacctcagtgcgatcggcagcagcgccgcgccgcctcgctccgtcggcacctccggcgagcgccgggcatgtccgaggattggcgcgcttcggtaatcgaaccgggcccctcggtgcccgaggattgtcaatggtggttgccgactccacccgccgtcgggccaagtttggcagcggggacagcgtcctcggggctcccgtccttggagggcccggggcggaattgggggatcagttgagcgtggtgatgaagttcgggggatcctcggtgtcgtcggccgcgaggatggaggaggttgccgacctcatcctggcgttccccgaggagcgccccgtcgtcgtcctctctgcaatggggaaaaccaccaacctcctgctcctcgctggagagaaggcagtgggttgtggagtgatccatgtttctgaaatcgaagagtggaacacaatcaaagacctgcatattaaaactgttgatgaacttggactgccaagatccgaaatacatgacatgctggatgaactggagcaactcttgaaaggtatcgcaatgatgaaagagctgacacttcgaaccagagactaccttgtttcatttggagaatgcatgtccacacggatctttgctgcttatttgaacaaaattggtgtcaaagcacggcagtatgacgcatttgatattggtttcataacaacagacgatttcggtaacgctgatgtcttggaagcaacttatcctgctgttgctaagagacttcatggagactggatacgggatccagcaatacccgtagtaactggattccttgggaagggctggaaatcaggagctgttactactttaggccgaggtggtagtgacttgactgctacaaccattggtaaagccttgggactgagagaaattcaggtatggaaggatgttgatggtgtactcacttgtgatccaaatatctacccacatgcaaagactgttccgtacttaacatttgaagaggctacagaacttgcttattttggtgcccaggttttgcatccacaatcaatgagacctgctagagaaggtgatataccagttagggttaagaattcatacaaccctaaagctccaggcacccttatcactaaacaaagagagatggataaggttgtacttactagtatagtgctgaagtcaaatgtcactatgttggacatagtgagcactcggatgcttggtcagtttggttttctggcaagggtattttctatatttgaagatctaggcatatctgtggattgtgttgccactagtgaagttagcatttctgtgtcacttgatccatcaaagatctggagtagggaacttattcagcaggaacttgacaatgtagtcgaagagcttgagaaaatagcaattgttcatctacttcagcagagggcaataatttcgctcatcggaaacgtgaaacgatcatctcttatactagaaaagaccttccaggtgctgaggaaatgcggtgtcaatattcagatgatctcacaaggggcatccaaggttaacatgtcgctgatagttcatgacagcgaggcgaaggcctgcatcaaagccctccatcaggcattcttcgaggacgaggatgttctcacacaagttgaaacggagaacctgctggtgggttgaccgatacaggtcgccgtctccagcatgttatccagcatcagctccaccttgtcatctatctccatcatcagtggcttaatccgctttgcgtgaacagcattgtgtatttaatttgtcagtctgcttcccactgaatggctgaaaaaagacatggctttttattgttcccaactcgggtgaacacaacgaacaccgcttgtgcatgaacactgaatggatgtttttgagagagataacaatgagcagttgaacagcatttgaatgcacagttgtgcacacatcaatgaacacagtgtgtactcgcca

SEQ ID NO: 2383 - DNA, 3354 bp, Panicum virgatum
ttatgccaataaattgaccactttgatcaaaactatggtaaattactaaaaactttttgaaccttaccggagaagaaagttttagttggaactaaactaaatgaatacctaaatttcttatcaacaatttggcacgtcctaattttggtgagctaagacttgctataattttgactgggcataaaattggcatccaaccaagcaagcttttacttccaccgttcaaaattgtatatatctagatatattgtaaaatctatgtatctagatttgttaaaacaatctatagtttgaaatcgtgggagtagtatatactaaattgtttaagtttctaaatcccacgatttttgagttcaattatatggccctgaaatattccagaaatggatcccatcgtttacgactaagtttccgccttgatggccttatcacgtaaacttgaaaacccgccttctcttggtcgtctcctgtctccacggctgacagactagaagcctagaagggacaagaaatggcgacctcagtgcgatcggcggccgcaccgcgccgcctcgttccagcgatacctccggcgagcgcgggacatgttcgaggacaggcaagcttcggtacgcggacctggtccgacggtgcccgaggattgtcaatggtggtcgccggctccacccgccgtcgggccagagaagggggcgacggggacggcgtccatgtggctcccgttgttggagggcccggagcagaattgggagatcagctgagcgtggtgatgaagttcggggggtcctcggtgtcgtcggccgcgaggatgaaggaggtggccggcctcatcctggccttccccgaggagcgccctgtcgtcgtcctctctgccatggggaaaaccaccaacctcctgctcctcgctggagagaaagcagtgggttgtggagtgatccatgtttctgacattgaagagtggaacacgatcaaggatctacatatcaaaactgtggatgaacttggcctgcaaagatcagtagtacacgacatgctggatgaactggagcaactcttgaaaggtatcgcaatgatgaaagagctgacacttcgaaccagagactaccttgtttcatttggagagtgcatgtccacacggatctttgctgcttatttgaacaaaattggtgtcaaagcacggcagtatgacgcatttgatattggcttcataacaacagacgactttggtaacgcggatatcttggaagcaacttatcctgcagttgctaagagacttcatggagactggatacgggatccagcaatacctgttgttactgggttccttgggaagggctggaaatcaggagctgttactactttaggccgaggtggtagtgacttgactgctacaaccattggtaaagccttgggactgagagaaattcaggtatggaaggatgttgatggtgtactcacttgtgatccaaatatctacccaaatgcaaagactgttccgtatttaacatttgaagaggctacagaacttgcttatttcggtgcccaggtcttgcatccacaatcaatgagacctgctagagaaggtgatataccagttagggttaagaattcatacaaccctaaagctccaggtacccttattactaaacaaagagagatggataaggttgtactaactagtatagtgctgaagtcaaatgtcactatgttggacatagtgagcactcggatgcttggtcagtttggttttctggcaagggtatttgctatattcgaagatctaggcatatctgtggattgtgttgctactagcgaagttagcatttccgtgtcgctcgatccatcaaagatctggagtagggaacttattcagcaggaacttgacaatgtagtcgaagagcttgagaaaatagcaattgttcatctacttcagcagagggcaataatttcgctcatcggaaatgtgcgacgatcatctcttatactagaaaaggcgttccatgtgctcagaaaaagtggtgtcaatgttcagatgatctcgcaaggggcatccaaggttaacatgtcgctgatagttcacgacagcgaggcgaaggcatgcgtaaaggccctccatcaggcgttcttcgaggacgatgatgtcctgacacaagttgaagcggagaatttgctcgtgagttgatgaacgcaggccgccacctccatcagcgagacgacgatgttctccagcaccagcttcatctccatcggtggccttaatatgacagctcattccatggacagcatcgtgtattcagtacgtcagtcaggttcccgctgaatgacagtaaaatacttggctttcttgttccctactcggatgaacaacacagtgcggctcgcaaaaatgtttccatgatcttgagagagatcacaatgaacagtaattgcatgcgcctttttgtgcacacatcaatcaacaccttttctactcaagatggcacttcttggaataatgctggctggtatgtatgctccggacgatcttgtgctgggtaagtaccagatcagaaggccacgacacctgcaacaatccgccactggaggggtcgtgttgcgttgtttcttcttccacgacgacgagggagaccagaccgccggtccggtcgtctcctgcgctcagccgcgtcaaagatgcggtgctgacgctggttcccggtcgttccccgcctccccaggacgagccggccggggcagctccggagcattcacttggctacagcgtcgcggtaaacccaagccggtgtgcccttgacccttgtccacgaaagtgtcggtgcctccagactccaccggaagggaagactccggcgagtccaagcacagtagcatagcacaccatttctgtttcagctgctccaaccgctagccgccgtcgtccatgaggaaaacgaggtcgtcagagacggcgagccgaggcgcgggcctgtggactggcgagagtaggcgcagctgctgcctgcgccggccacgacgagtaaagccggccttgtcgccacgccacgcgcttggactggcctggggcctgcctagatccatttcacgtccgcgtcagcggttgggccccagcccggtgcggtggtgcagcgcgggccccacctgcctccctctcccctcttggtgggctggtggccacctgggctccctagcctctgccgcccaaactagtcagtgatagctgccgcccgcggccgctgctgctcgcctcgtagtcccagcgtgaggacgacactacagtagcacagcccacggcgtcataaatacggcagccccacacctcgtactgcagagtaaatgtgcctcggggtgggcccctgg

SEQ ID NO: 2384 - DNA, 2043 bp, Brachypodium distachyon
gaagggcatcatccagtcctccctgcaactgaagccgaagagaggaagaaaatggcgatcgcgctccgattcgccgccaccccgcgccgcctagccgcttcgataccggaatcctatcctggccacggagtaggaggagtggcgcgcgccggtgccctgtggggtactcgccgtggctggagactggcaatggtggtggtccccgactccactcgctgtcgggccaagagagggggcgacggcgacggcgtcctgggagtcgccgccgacggaggagatgccgcagtgggaggcggagatcagctgagcgtggtgatgaagttcgggggctcgtccatgtcgtcggcggcgaggatggaggaggtggcagggctcatcaccgccttccccgaggagcgccccgtcgtcgttctctccgccatggggaagaccaccaatcttctcctcctcgctggagagaaggcagtgggatgtggagtaatctacgtttctgaaatcgaagagtggaacatgatcaaagatcttcatattaaaacagtggatgaactgggactgccaagatctgtgatacactctatgctggatgaactggaacagctcttgaaaggtattgccatgatgaaagagctcacgcttcgcaccacggactaccttgtgtcatttggagaatgcatgtccacacggatctttgctgcttacttaaacaaaattggcatcaaagcacggcagtgcgacgcatttgatattggtttcataacaacagacgattttggtaatgcggaaatcttggaagcaacttatcctgctgttgcgaagagactacatggagactgggttcgagatccagcaatacctattgttaccgggttcctagggaagggttggaaatcaggtgcggttactactttaggccgaggtggcagtgacttgactgctacaaccattggtaaagccttgggattgagagaaattcaggtatggaaggatgttgatggtgtactgacttgtgatccaaatatctacccaaatgcaaagactgtcccttacctaacatttgaagaggcgtcagaacttgcttattttggtgcccaggttttgcatccacaatcaatgagacctgctagagaaggtgatatacctgttagggttaagaattcatacaaccctaaagctccaggcactcttatcacaaaacgaagagagatggataaggttgtgctaactagtttagtgctgaagtcaaatgtcactatgttggatatagtgagcactcggatgcttggtcaatttggttttctggcgaaggtgttttctatatttgaagatctaggcatatccgtggactgtgtggctactagtgaagtcagcatttctgtatcgcttgatccatcaaagatctggagcagggaacttattcagcaggaactcgaccatgtggtcgaagagctggagaaaatcgcagtggtccatctacttcagcagagggcgataatctcgctcatcggaaacgtacgacggtcatctctcatactagaaaaggccttccatgtgctgaggaaaagcggggtcaacgtccagatgatctcacaaggtgcatcaaaggtcaacatgtcgctgatcgtccacgacagtgaggcgaagcagtgcatgaaagccctccatcaggccttcttcgagggcgaccatcccctggtggtggaaatcgaagaagaggacgtggagattttgcaactgagagctgatcatccagtttaggcttagtctgcctgtgtcttcagtccgaccatgctctgtaaggtgtaccatatcgtcggcttttgcttatgtttgtttgcagaattggcgcctggctttcctggcatgtccctccttgtttccaaaacttaatccatgcgttctgattaaggtttaagtttcgtcaaaaacttacctacgtgacaaaaaaagagaggatataactcaatattgcctgtgaacacgagttcagcaagatgttttgtgtgtgtgccatactacagtacaaacctgtgttttattagtcta

SEQ ID NO: 2385 - DNA, 1984 bp, Brachypodium distachyon
ctccctgcaactgaagccgaagagaggaagaaaatggcgatcgcgctccgattcgccgccaccccgcgccgcctagccgcttcgataccggaatcctatcctggccacggagtaggaggagtggcgcgcgccggtgccctgtggggtactcgccgtggctggagactggcaatggtggtggtccccgactccactcgctgtcgggccaagagagggggcgacggcgacggcgtcctgggagtcgccgccgacggaggagatgccgcagtgggaggcggagatcagctgagcgtggtgatgaagttcgggggctcgtccatgtcgtcggcggcgaggatggaggaggtggcagggctcatcaccgccttccccgaggagcgccccgtcgtcgttctctccgccatggggaagaccaccaatcttctcctcctcgctggagagaaggcagtgggatgtggagtaatctacgtttctgaaatcgaagagtggaacatgatcaaagatcttcatattaaaacagtggatgaactgggactgccaagatctgtgatacactctatgctggatgaactggaacagctcttgaaaggtattgccatgatgaaagagctcacgcttcgcaccacggactaccttgtgtcatttggagaatgcatgtccacacggatctttgctgcttacttaaacaaaattggcatcaaagcacggcagtgcgacgcatttgatattggtttcataacaacagacgattttggtaatgcggaaatcttggaagcaacttatcctgctgttgcgaagagactacatggagactgggttcgagatccagcaatacctattgttaccgggttcctagggaagggttggaaatcaggtgcggttactactttaggccgaggtggcagtgacttgactgctacaaccattggtaaagccttgggattgagagaaattcaggtatggaaggatgttgatggtgtactgacttgtgatccaaatatctacccaaatgcaaagactgtcccttacctaacatttgaagaggcgtcagaacttgcttattttggtgcccaggttttgcatccacaatcaatgagacctgctagagaaggtgatatacctgttagggttaagaattcatacaaccctaaagctccaggcactcttatcacaaaacgaagagagatggataaggttgtgctaactagtttagtgctgaagtcaaatgtcactatgttggatatagtgagcactcggatgcttggtcaatttggttttctggcgaaggtgttttctatatttgaagatctaggcatatccgtggactgtgtggctactagtgaagtcagcatttctgtatcgcttgatccatcaaagatctggagcagggaacttattcagcaggaactcgaccatgtggtcgaagagctggagaaaatcgcagtggtccatctacttcagcagagggcgataatctcgctcatcggaaacgtacgacggtcatctctcatactagaaaaggccttccatgtgctgaggaaaagcggggtcaacgtccagatgatctcacaaggtgcatcaaaggtcaacatgtcgctgatcgtccacgacagtgaggcgaagcagtgcatgaaagccctccatcaggccttcttcgagggcgaccatcccctggtggtggaaatcgaagaagaggacgtggagattttgcaactgagagctgatcatccagtttaggcttagtctgcctgtgtcttcagtccgaccatgctctgtaaggtgtaccatatcgtcggcttttgcttatgtttgtttgcagaattggcgcctggctttcctggcatgtccctccttgtttccaaaacttaatccatgcgttctgattaaggtttaagtttcgtcaaaaacttacctacgtgacaaaaaaagagaggatataactcaatattgcctgtgaacacgagttcagcaagatgttttgtgt

SEQ ID NO: 2386 - DNA, 2193 bp, Hordeum vulgare
acagtgaaggagtcagcagtccagtcctctctgctgccgaaagatatggcgatcgcgctcagattcgccgccaccccgccccgcctcgccgcgccgatacctccgacgggtgcccctcgcgcacatggaggagctgcgcgcgtcggcgccctggtcgggactcgccgtggcaggatactggcaatggcggccgcggattccgctcgctgtcgggcaaagatagggggcgacggcgacggcgttctcgccggagtggccgtgcacggaggaactggagaggaaggggaagatcagctgagcgtggtgatgaagttcggtggttcgtccgtgtcgtcggcggcgaggatgaaggaggtggcggggctcatccaagctttccccgaggagcgccccgtcgtcgtcctctccgccatggggaagaccaccaatctactactcctcgctggagagaaggcagtgggatgtggagtgaccaacgtttcccaaatcgaagagtggaacatgctcagagacctccatatcaggacagttgatgaacttggactgccaagatctgttatacatactaagctagatgaactggagcagctcttgaaaggtgttgccatgatgaaagagctgacacttcgcagcactgactaccttgtgtcatttggagaatgcatgtccacacgggtttttgcggcttatttaaacaagattggcgtcaaagcacgtcagtgtgatgcttttgatattggtttcataacgacagacgatttcggtaatgctgagatattggaagcaacttatcctgctgttgcaaagagattacatggggattggattcgggatccggcaatacctattgttactgggttccttgggaagggctggaaatcaggtgccgttactactttaggcagaggtggcagtgacttgactgctacaaccattggtaaagccttgggattgagagaaattcaggtgtggaaggatgttgatggtgtacttacttgtgatccaaatatctacccaaatgcaaagactgtcccgtacttaacatttgatgaggctgctgaacttgcttattttggtgcccaggttttacatccacagtcgatgcgacctgctagagaaggtgatataccagttagggttaagaattcatacaaccctaaagctccaggcacccttattgccaaaggaagagatatggataaggttgtgctaacaagtatagtgctgaagtcaaatgtcactatgttggatatagtgagcactcggatgcttggtcaatttggtttccttgcaaaggtgttttctatattcgaagatctaggcatatccgtagattgtgtggcgaccagtgaagtcagcatttctgtatcactcgatccatcaaagatctggagcagggaacttattcaacaggagcttgaccatgtggtggaagagctggagaagatcgcattcgtccatcttctccagcaaagagcgatagtctcgctcatcgggaacgtgagaaaatcatcgctcatactagagaaggctttccatgtgttgaggagaatcggggtcaatgtccagatgatctcgcaaggcgcatcaaaggtgaacatgtcgctgatcgtccacgacagcgaggcgaagctgtgcgtggaagccctccaccaggccttcttcgagggcgacggggatggcgatgatcgcctgacggcggaattcgacgaggaggagaacctgcggcttgagctgtgatgagcattcagttagtagtgtgtgttatcagtcaggacgcccagagaaaccgctgctgcaagagcaaaacaacggcaaggtgtagacttgcagactgtgatgtatctacacgtgcagtcgcggacgatgcgtgcgtgcgtgcgtgcgcgcacacacacacacacacatgcaccagtacatgcgatgaatgctggctgaataatcgagtcagatgaccggacctgtggtggtcgtctcgaccgtctggtacgtgtagaggatgcacacgtactacgtatacgcaacacatgtacatgtacccgcaaaaaaaatgtacatgtgatgaataatcgatcgagtctaatgaccgggcccgtggtcgtgtaaacatacggacgacatttgtcaaaaaagatgatctgccactagtcttcgatctcggtgcagaagtgcataccactgttgccatgatcc

SEQ ID NO: 2387 - DNA, 1784 bp, Secale cereale
gactccagtcccccctgctgccgaaagatatggcgatcgcgctcagattcgccgccaccacgccccgcctcgccgcgccgatacctccgacgagtgcccctcgcgcccatggaggtgttgcgcgcgtcggcgccctgggcgggactcgccgtggcaggagactggcaatggcggccgcggattccgctcgctgtcgggccaagagagagggcgacggcgacggcgtcctcgcaggagtcgccgtccacggaggaaccggagcagaaggggaagatcagctgagcgtggtgatgaagttcggtggttcgtccgtgtcgtcggcggcgaggatgaaggaggtggcggggctcatccaagctttccccgaggagcggcccgtcgtcgtcctctccgccatggggaagaccaccaatctactcctcctagctggagagaaggcagtgggatgtggagtgacccgcgtttccgaaatcgaagagtggaacatgatcagagatctccatatcatgacagttgatgaacttggactgccaagatctgttatacatgctaagctagatgaactggagcagctcttgaaaggtgttgccatgatgaaagagctgacacttcgcagcactgactaccttgtgtcatttggagaatgcatgtccacacgggtttttgcggcttatttaaaccaaattggtgtcaaagcacgtcagtgtgacgcgtttgatattggtttcataacgacagacgatttcggtaatgctgagatattggaagcaacttatcctgctgttgcaaagagattacatggggactggattcgggatccagcaatacctgttgttactggttccttgggaagggctggaaatcaggtgccgttactactttaggcagaggtggcagtgacttgactgctacaaccattggtaaagccttgggattgagagaaattcaggtgtggaaggatgttgatggtgtacttacttgtgatccaaatatctacccaaatgcaaggactgtcccgtacttaacatttgatgaggctgctgaacttgcttattttggtgcccaggttttacatccacaatcgatgcgacctgctagagaaggtgatataccagttagggttaagaattcatacaatcctaaagctccaggcacccttattgccaaaggaagagatatggataaggtcgtgcttacaagtatagttctgaagtcaaatgtcactatgctggatatagtgagcactcggatgcttggtcaatttggtttcctggcaaaggtgttttctatattcgaagacctaggcatatctgtagattgtgtggcgaccagtgaggtcagcatttctgtgtcgctcgacccatcaaagatctggagcagggaacttattcaacaggagcttgaccatgtggtggaagagctggagaaaattgcattcgtccatcttctccagcagagagcgatagtctcgctcatcgggaacgtgcgaaaatcatctctcatactagagaaggccttccacgtgttgaggaaaatcggggtcaatgtccagatgatctcgcaaggcgcgtcaaaggtgaacatgtcgctgatcgtccacgacagcgaggccaagctgtgcgtggaagccctccaccaggccttcttcgagggcgaggggccgatggcgatgatcgcctgacggcagaattcgacgaggaggagacctgcggcttgagctgtgaatctgtgatgagtattcagtagtacgtgtttcagtcaacacgcctggacgaaaccgctgc

SEQ ID NO: 2388 - DNA, 2047 bp, Sorghum bicolor
agtctccaactctccactccacgctggagtccccacggagtaggagggccaagaaatggcgaccccagtgcgatcggcggccgcaccccgccgcctcgttccgtcgatacctccggcgagctccggacatgttcaacaactggcgtgcttcggtacccgaaccgagccttgcggtgcccgagggttgtcaatggtggtcgccgactccacccgccgtcgggccaagttaggggacggcggggacggcgtcctcggggcgtctgttctcggagggctcgggatggcgggattgggggatcagctgagcgtggtgatgaagttcggagggtcctcagtggcgtccgccgcgaggatggcggaggtggctggcctcatcttgacgttccccgaggagcgccccgtcgtcgtgctctctgccatggggaaaaccaccaacaaccttctccttgctggagagaaggcagtggggtgtggagtgatccacgtttctgaaatcgaagagtggaacatgatcaaagacctacatatcaagacagtggatgaactggggcttccaagatctgtaatacaagacatgctggatgaactggagcaactattgaaaggtatcgctatgatgaaagagctgacgcctaggaccagtgactaccttgtttcatttggagaatgcatgtccaccaggatttttgccgcttatttgaacaaaattggtgtcaaagcacggcagtatgacgcatttgatattggtttcatgacgactgatgaatttggtaatgcggatatcttagaagcaacctatcctgctgttgcaaagagacttcatggggactggatactggatccagcgatacctgttgttactggattccttgggaagggctggaaatcgggtgctgtaactactttaggccgaggtggtagtgacttgactgctacaaccattggtaaagccttgggactgagagaaattcaggtatggaaagatgttgatggtgtactgacttgtgatccaaatatctacccacatgcaaagactgttccatacttaacatttgaagaggctacagaacttgcttattttggtgcccaggttttgcatccacaatcaatgagacctgctagagaaggtgatattccagttagggttaagaattcatacaaccctaaagctccaggcacccttattaccaaacaaagagacatggataaggttgtactaactagcatagtgctcaagtcaaatgtcactatgttggatatcgtgagcactcggatgcttggtcagtatggttttctggcaagggtatttgctatatttgaagatctaggtatatctgtggattgtgttgctaccagtgaagtcagtgtttctgtgtcacttgatccatcaaagatttggagtagggaactgatacaacaggaacttgacaatgtagttgaagagcttgagaaaatagcaatcgttcatctacttcagcagagggcaataatttcgcttatcggaaatgtgcggcaaatgtctcttatactagaaaagaccggacatgtgctgaggaaaagtggggtcaatgttcagatgatctcgcaaggagcgtccaaggttaacatgtcgctgatagtccatgacagcgaggcaaaggcactcgtagaagcccttcatcaagcgttctttcaagacgatgtcctggcgcaagtcgaagtggagaacctactcgtgggctgatcgacgtaggttgttttgtctctaggcatgttatctcaacaacggcttgaacctatcttttgcatcaaaagtatttgtctttccagcttcccagcgaatgactgcaagactttgcgtttcttgtttccaaacctggttgcagacaccagggaacaccgactgtcagcaagatggcaagcctttgatatagtaattccaagtttccaattgcctctaatccaaatttgtaaggtttgcctaaggttatgagaacattattaatatctgtaacacaaaatagatatactatgaaaataagtctcatgacgaataaactcggcgaaa

SEQ ID NO: 2389 - DNA, 2119 bp, Sorghum bicolor
agtctccaactctccactccacgctggagtccccacggagtaggagggccaagaaatggcgaccccagtgcgatcggcggccgcaccccgccgcctcgttccgtcgatacctccggcgagctccggacatgttcaacaactggcgtgcttcggtacccgaaccgagccttgcggtgcccgagggttgtcaatggtggtcgccgactccacccgccgtcgggccaagttaggggacggcggggacggcgtcctcggggcgtctgttctcggagggctcgggatggcgggattgggggatcagctgagcgtggtgatgaagttcggagggtcctcagtggcgtccgccgcgaggatggcggaggtggctggcctcatcttgacgttccccgaggagcgccccgtcgtcgtgctctctgccatggggaaaaccaccaacaaccttctccttgctggagagaaggcagtggggtgtggagtgatccacgtttctgaaatcgaagagtggaacatgatcaaagacctacatatcaagacagtggatgaactggggcttccaagatctgtaatacaagacatgctggatgaactggagcaactattgaaaggtatcgctatgatgaaagagctgacgcctaggaccagtgactaccttgtttcatttggagaatgcatgtccaccaggatttttgccgcttatttgaacaaaattggtgtcaaagcacggcagtatgacgcatttgatattggtttcatgacgactgatgaatttggtaatgcggatatcttagaagcaacctatcctgctgttgcaaagagacttcatggggactggatactggatccagcgatacctgttgttactggattccttgggaagggctggaaatcgggtgctgtaactactttaggccgaggtggtagtgacttgactgctacaaccattggtaaagccttgggactgagagaaattcaggtatggaaagatgttgatggtgtactgacttgtgatccaaatatctacccacatgcaaagactgttccatacttaacatttgaagaggctacagaacttgcttattttggtgcccaggttttgcatccacaatcaatgagacctgctagagaaggtgatattccagttagggttaagaattcatacaaccctaaagctccaggcacccttattaccaaacaaagagacatggataaggttgtactaactagcatagtgctcaagtcaaatgtcactatgttggatatcgtgagcactcggatgcttggtcagtatggttttctggcaagggtatttgctatatttgaagatctaggtatatctgtggattgtgttgctaccagtgaagtcagtgtttctgtgtcacttgatccatcaaagatttggagtagggaactgatacaacaggaacttgacaatgtagttgaagagcttgagaaaatagcaatcgttcatctacttcagcagagggcaataatttcgcttatcggaaatgtgcggcaaatgtctcttatactagaaaagaccggacatgtgctgaggaaaagtggggtcaatgttcagatgatctcgcaaggagcgtccaaggttaacatgtcgctgatagtccatgacagcgaggcaaaggcactcgtagaagcccttcatcaagcgttctttcaagacgatgtcctggcgcaagtcgaagtggagaacctactcgtgggctgatcgacgtaggttgttttgtctctaggcatgttatctcaacaacggcttgaacctatcttttgcatcaaaagtatttgtctttccagcttcccagcgaatgactgcaagactttgcgtttcttgtttccaaacctggttgcagacaccagggaacaccgactgtcagcaagatggcaagcctttgatatagtaattccaagtttccaattgcctctaatccaaatttgtaaggtttgcctaaggttatgagaacattattaatatctgtaacacaaaatagatatactatgaaaataagtctcatgacgaataaactcggcgaaagtttactcgatagacgaagagagcgggagtatcgatcaacctttatataaactcggtgcttgggacaacggg

SEQ ID NO: 2390 - DNA, 2028 bp, Secale cereale
gccgatacctccgacgagtgcccctcgcgcccatggaggtgttgcgcgcgtcggccccctgggcgggactcgccgtggcaggagactggcaatggcggccgcggattccgctcgctgtcgggccaagagagagggcgacggcgacggcgtcctcgcgggagtcgccgtccacggaggaaccggagcagaaggggaagatcagctgagcgtggtgatgaagttcggtggttcgtccgtgtcgtcggcggcgaggatgaaggaggtggcggggctcatccaagctttccccgaggagcgccccgtcgtcgtcctctccgccatggggaagaccaccaatctactcctcctagctggagagaaggcagtgggatgtggagtgacccgcgtttccgaaatagaagagtggaacatgatcagagatctccatatcatgacagttgatgaacttggactgccaagatctgttatacatgctaagctagatgaactggagcagctcttgaaaggtgttgccatgatgaaagagctgacacttcgcagcactgactaccttgtgtcatttggagaatgcatgtccacacgggtttttgcagcttatttaaaccagattggtgtcaaagcacgtcagtgtgacgcgtttgatattggtttcataacgacagacgatttcggtaatgctgagatattggaagcaacttatcctgctgttgcaaagagattacatggggactggattcgggatccagcaatacctgttgttactgggttccgttgggaagggctggaaatcaggtgccgttactactttaggcagaggtggcagtgacttgactgctacaaccattggtaaagccttgggattgagagaaattcaggtgtggaaggatgttgatggtgtacttacttgtgatccaaatatctacccaaatgcaaggactgtcccgtacttaacatttgatgaggctgctgaacttgcttattttggtgcccaggttttgcatccacaatcgatgcgacctgctagagaaggtgatataccagttagggttaagaactcatacaaccctaaagctccaggcacccttattgccaaaggaagagatatggataaggtcgtgcttacaagtatagttctgaagtcaaatgtcactatgctggatatagtgagcactcggatgctaggtcaatttggtttcctggcaaaggtgttttctatattcgaagacctaggcatatctgtagattgcgtggcgaccagtgaggtcagcatttctgtgtcgctcgacccatcgaagatctggagcagggaacttattcaacaggagcttgaccatgtggtggaagagctggagaaaatcgcattcgtccatcttctccagcagagagcgatagtctcgctcatcgggaatgtgcgaaaatcatctctcatactagagaaggccttccacgtgttgaggaaaatcggggtcaacgtccagatgatctcgcaaggcgcatcaaaggtgaacatgtcgctgatcgtccacgacagcgaggccaagctgtgcgtggaagccctccaccaggccttcttcgagggcgatggcgatgatcgcctgacggcagaattcgacgaggaggagaacctgcggcttgagctgtgaatctgtgatgagtattcagtagtacgtgttttcagtcaacacgcctggagaaaccgctgctgcaaaagcaaaacaacggcggggtgtggacttgtagactgtgatgtatctacacgtggagtcgcggacgatgcgtgcgtacgtgcgtgcacacacgcatgtacagtacatgtgatgaatacactgaataatcgagtcggatgaccggacctgtggtcgtcgtctcgaccgtccggtacatgacacgtacgtacacagcacacgtacatgtatgtgatgaataatcgaagtcccatgaccaggcctacgatcgtcgtctcggccgtctgctcggcggcagacggccggtcgccgatgacagtggtctccgctggtcgtgtaaaca

SEQ ID NO: 2391 - DNA, 1909 bp, Brassica rapa
gaagatacaaaaagatgaagcaggagcaactgtgtcttctagttgcgaaggtttcgtctacgcaggaactttggagtcttctcgtctcccaatcttttgatggcatttatacaacaacctgttcaaggcgtgtagcctctgtttcagtggtgcccacaacgtgctcgacgaaaagccccaaagaacgtaaagataaaaagagctctgggttgatatcaacaaaacaccaagtagatcccaagagagaattatctcggattcttagaacagacgctgctgttaagagcatagagaggaaagccaactccgaaaagtacaacactttatggccaaaagctgttctcgaagcacttgatgatgctgtcaaagagaatcgatggcagtctgctctcaagatattcagtctcctcagaaagcagcattggtacgaaccaagatgcaaaacctacacaaaactcttcaaactccttggcaactgcaaacagcctgagcaagcgagcttactcttcgaactaatgctatccgaaggactaaaacccaccatcgacgtctacacatctcttatctccgtctacggcaaatgctctcttctagaaaaggcctttgcaactctcgaatacatgaaatcagtcagcgactgcaccccggacgtcttcactttcaccgttctcatcagctgctgctgcaaactcgcccggtttgatctagttaaccgcgtcctcctcgagatgtcgtaccttggagtcaggtgcagcacggtgacttacaacactatcctcgatgggtatggtaaagcaggaatgtttgaggagatggagaacgttttagctgatatgatcgaggatggagactctcttccagatgtttacacgtttaactcaatcattggctcttatggaaacggcggcaacattaggaagatggagagctggtataaccgtttccagcttatgggagtggagccagacatcaccacgttcaacgtactgatcctgtcctttggtaaagctgggatgtataagaagatgagctctgttatggattacatggagaaaagattcttctccccgacggttgtcacttacaatatagtgatcgagacgtttgggaaagcggggaggatcgagaagatggaggaggtgttcaggaagatgaagtatcgaggagtgaagcctaactcaatcacttactgttcgcttgttgacgcgtatagcaaagctggtcttgtgggtaagatagattcggttttgaggcaggttgtgaattcggatgtggtgctggatacggtcttcttcaattgtataatcaatgcgtatggtgaggctggtgatctggctacgatgaaggagttgtatatacagatggaagagagaaaatgtaagcctgataagattacttttgcgactatggtgaagacttatgctgctcatgggatatttgatgcggttcgtgaacttgagaaacagatgatttccacttgcgagagttcaggcaagaagaggctcatggggtgatgtggtgatttggatgctgttcacagtaagaggataactcacaagcctgtaacttaagctctggaatcggcatggttagcaagattactagaccgtcatggtcatcacttaatagaatgtcagcattatggataattcttggtctttgttacgtagataagggacaacctttgtagctctgttgtgtaaagggtctgattgttgtgtgttacgtcttattattatttttaaaatgtgtgtgtttgaattgtattatcggcgtaacctcaaagttggaatcaaggtctgttcatatccataggcccaggattagacagttaataatacatttacattgtaaaacatccttttgaaaagggattggatttttaacacaataaaaccaacttttaatt

SEQ ID NO: 2392 - DNA, 2393 bp, Arabidopsis thaliana
ccaaggacaatctcgttttaacaaattcgaattcaaaattaaattggaaaaagctccatttggttcttccttcatcaatccaatcctttaaaccggacaagaaaaaactgattaatgctaaatttttaattttgtaaatccaaattaaaccggcatccaaatcaaaactaaaaccatttcattatattttacaaaccgaagagaagctacaccaaaccggagaagaagaaaaaaacgaaggaaaaacaacggtatcgtcgtcgtcttctagctctgctttctacccagaaaatttgcagtttctttttctccaccttatctttctaccatttttcttcgatggcattgatacaaaatcctgttcaaggaactacttccgcgtacgccaatgagatcgcacaacttggtttttctcgaagcgtggttcagcaacatatatcttcccctgtttattttcggtgtataccaactatttcaataacgcccacaatgtgttcgacaaaggtccccaacgaacgtacagagaaaatgaattctggtttgatctcaacaagacaccaagtagatcctaagaaagaattgtctcggattctgagaacagatgctgctgtgaagggcattgagaggaaagccaattccgaaaagtacttaactttatggccaaaagctgttctagaagctcttgacgaagctatcaaagagaatcgatggcagtctgctctcaagattttcaatcttcttaggaagcagcattggtatgaaccaagatgcaaaacttatacaaagctgtttaaagtgcttgggaattgtaaacagcctgatcaagccagcttgcttttcgaagttatgttatctgaaggattgaaaccaaccattgatgtgtatacctctcttatctctgtttatggcaaaagcgagcttctagacaaggcgttttctacacttgagtatatgaaatctgttagtgactgcaagccagatgtgttcacctttactgttctcatcagttgttgctgcaaactgggtcggtttgatctggttaaaagtatcgttcttgagatgtcgtatcttggagttggatgcagcacggttacttacaatactattattgatgggtatggaaaggctggaatgtttgaggaaatggaaagtgttctggctgatatgatcgaggacggagattctcttccggatgtttgtacgcttaactcgatcattgggtcatatggaaatggtcgcaacatgaggaagatggagagctggtatagtcggttccagctgatgggggtgcaaccggatatcactacatttaacatactgatcctgtcatttggaaaagctggtatgtataagaagatgtgctctgttatggattttatggagaaaaggttcttctccctgacgactgtcacttacaatatagtgattgagacgtttggaaaagctggaagaattgagaaaatggatgatgtattcaggaaaatgaagtatcaaggagtgaaaccaaactcaatcacttattgttcgcttgttaacgcgtatagcaaagcaggtcttgtcgttaagatagattcggttttgaggcaaattgtgaattcagatgtggtactggatacaccgttcttcaattgcataatcaatgcatatggtcaggctggtgatttggctacaatgaaagaattatacatacaaatggaagagagaaaatgtaagcctgataaaatcacttttgctactatgatcaaaacctatactgctcatgggatattcgatgcagtccaggaactcgagaaacaaatgatttcctctgatataggcaagaagaggcttacggagtgatgctttagtttgtgaatgagcaaatctaatgcagaaggaatttagaagttgtgaattgttccaactaagagaatcacttgaggtaacctttttgttataaactgttatttttactctaaacttcaagataaaatggagacacatgcttgtaagtttaagtgtttgttcaggtgtttggagcgttggttagcaagatcccaagagaggcatggccattactaatgagaatttgggtcggttctgaaataaccaaatcagcattggggagaaaacgtaatgattccagtcaatgtaagtaataaaagccatcactagtctaaatgttatggtctatttttcacatgtattagaaaatattatcacatattgtgtctgtatattttggatttgttttcatcgtataggttgggacagctgtctagaaccaaaactcaattcaaagttttcttggtaaagtaaaatataattttcttacgcaggctctttagacgggtcaaaacaaactgtgatctaaaactttatcgtagctatatacacataaattattttccaac

SEQ ID NO: 2393 - DNA, 2872 bp, Vigna unguiculata
gcgttcattctatttccatagtgaagttttgcccctgaagaaatggcgcatcatcctttgacgcactctcactctttccgcgagagggttgatgaaactctctcgggtaacaggaatgaaattttggcccttctgtcaaggcttgaagccaagggcaagggaatcctgcaacaccaccaggtcattgcagagtttgaagaaatccctgaggagaacaggaagaagcttcaagatggagcctttggagaggttttgagatctacacaggaagccatagtgctgccaccttttgttgctctggctgttcgaccaaggcctggtgtttgggagtatctgcgtgtgaatttgcacatgcttgtcgttgatgagctaagtcctgctgagtatctgcgtttcaaggaggagcttgttgagggaagtgctaacggaaacttcgtgcttgagttggactttgaaccgtttaatgcctctttccctcgtccaactctgaacaagtccattgggaatggcgtggagttcctcaaccgccatctttcagccaaactcttccatgacaaggagagcatgcagccgctgcttgaattcctcaggcttcacagttataagggcacgaccatgatgctgaatgacaaagttcagaatctgaattctctccaacatgttttaagaaaagcagaagaatatctaacttctgttgctcctgcaacgccctactcagaatttgaaagcagattccgggagattggtttggagagggggtggggtgacaccgccgagagggtcctcgagatgatccagcttctcttggatcttctggaggcacctgatccttgcacccttgagacattccttggaagagttcctatggtcttcaatgttgtaatcctttctccccatggttactttgcccaagataatgtcttgggataccctgacaccggtgggcaggttgtttacatcttggatcaagttcgtgccttggagaatgagatgctcaaccgcatcaagaaacaaggcttggatatcactcctcgtattctcattatcactcgtcttctccctgatgcagtaggaacaacctgtggccaacgtctagagagggtatatgatactgaatattgtgacattctccgagttcctttcagaacagaggagggaattgttcgcaaatggatctcaagattcgaagtctggccatacctagagacttacgctgaggatgttgctgttgaacttgctaaggagttgcaagccaagccagatctgattgttggaaactacagtgatggaaacatcgttgcctctttgttagcccataaattaggagtgactcagtgtaccattgctcatgctctagaaaagaccaaataccctgagtctgacatttactggaaaaaattcgaagagaaatatcacttttcatgccaattcactgctgatctttttgcgatgaaccacacagactttatcatcaccagcaccttccaagagattgctggaagcaaggatactgttggacagtacgagagtcacactgccttcacccttcctggtctttaccgagttgttcacggcattgatgtctttgatccgaagttcaacattgtctctccaggagctgacatgggcatatacttcccatacaccgaaactgagcgtaggttaacaaatttccaccctgagattgaagagcttctttacagctcagtggagaacgaggaacacatatgtgtactgaaggaccgcaacaagccaatcatcttcaccatggcaagacttgaccgtgtgaagaacatcacgggacttgtggagtggtacggcaagaacgcgcggctccgggagttggtgaacctggttgttgttgccggagacaggaggaaggagtcgaaggacttggaagagaaggctgagatgaagaagatgtacggcctgatcgagacctacaagctgaatgggcaattcagatggatctcttctcagatgaacagagttagaaatggagaactgtaccgtgtgatttgtgacacaaagggtgcttttgttcagcctgcagtttatgaagcttttgggttgacagtggttgaagccatgacttgtggattgccaacatttgccacattcaatggtggtcctgctgagatcatcgtgcatggaaaatctggataccacattgatccctaccatggtgaccaggctgctgagctccttgttgacttctttgagaagagcaaagcagacccatctcactgggacacaatctctcagggaggactcaagcgtattcaagagaagtacacatggcagatttactctgagaggctcttgacactgacgggtgtctatggcttctggaagcatgtcaccaaccttgaacgccgtgagagcaaacgttacctcgagatgttctatgctctcaagtaccgcaaattggctgagtctgttccccttgccattgaagagtaaaatcatattgttgaagagaaaatcgatggagaaaccggcttttggtcttttggagctttctttcataaataacgccattgattttgattgtcatcagcttttggatttaaagagtctaaaaagagtgtctttgtttttatattttgcttaggttctgggtcagaaaaaaaaaagtgaaaggaaaaaatgtcatttttattctttatcgtcgttgcaacatcgaatatgattggaatctttgaatttgggtgttgagcccccatcaattcagtgctcattggtctacagttccccctcaacttcactttatcattttcttgttctgctttctggttgaatctcacgattcctacttcaacatgtaagatatttgaaaggaaactaaataaacaattaatctactttttcc

SEQ ID NO: 2394 - DNA, 3088 bp, Glycine max
ttttcctcttttttctttctttttctcttgtacgttttctcttgttctgtttcgcgctccttgcctataaattaacacctcctcaacttcattcttcattcattcatttcattttccccttcaccccttccttttttgcgttcattctgttttcatagtgacgaacttctgaagaaatggcaaatcatcctttgacacactctcactctttccgcgagaggtttgatgaaactctcactggtcacaggaacgaaattttggcccttctgtcaaggcttgaagccaagggcaagggaatcctgcaacatcaccaagtggttgcagagtttgaagaaatccctgaggagagcagaaagaaactccaagatggtgtctttggagaagttttgagatccacacaggaagccatagtgctgccaccatttgtagctcttgctgttcgaccaaggcctggtgtatgggaatatctgcgtgtgaatgtgcacatgcttgttgttgatgagcttcgtcctgctgagtatctgcgtttcaaggaggagcttgttgagggaagttcaaacggcaactttgtgcttgagttggactttgaaccgtttaatgcatccttccctcgcccaactctgaacaagtccattggaaatggcgtcgagttcctcaaccgccacctttcggccaagctcttccatgacaaggagagcatgcagccactgcttgagttcctcaggcttcacagttataagggaaagaccatgatgttgaatgacaaagttcaaagcctggattctctccaacatgttttgagaaaagcagaagagtatctgatttcagttgctcctgaaacaccctactcggaattcgagaacagattccgggagattggtctggagagggggtggggtgacactgccgagcgtgtcctcgagatgatccagcttctcctggaccttcttgaggcacctgacccttgcaccctcgagacattccttggaagagtccctatggtcttcaatgttgttatcctttctccccatggttactttgcccaagataatgtcttgggataccctgacactggtggacaggttgtttacatcttggatcaagttcgtgccttggagaatgagatgctcaaccgcatcaagaaacaaggccttgatatcacccctcgtattctcattatcactcgtcttctccctgatgcagtaggaactacctgtggccaacgtctagagagggtatatgatactgaatattgtgacattctcagagttcctttcagaacagaaaagggaattgttcgcaaatggatctcaagattcgaagtctggccatacctagagacttacactgaggatgtcgcccttgaacttgccaaggagttgcaagccaagccagatctgattgttggaaactacagtgatggaaacattgttgcctctttgttagcacataaattaggagtaactcagtgtaccattgctcatgctctagaaaagaccaagtaccctgagtctgacatttactggaaaaaatttgaagagaaatatcatttctcatgccaatttactgctgatctttttgcaatgaaccacacagactttatcatcaccagcaccttccaagagattgctggaagcaaggacactgttggacagtatgagagtcacactgccttcacccttccaggactttaccgtgttgttcacggtattgatccatttgatccaaagttcaacattgtctctcccggtgcagacatgggtatatacttcccatacactgaaactgagcgtaggttaacagaattccactctgacattgaagagcttctttacagctcagtggagaatgaggaacacatatgcgtattgaaggaccgcaacaaaccaataatcttcaccatggcaaggcttgaccgtgtgaagaacatcacggggcttgtcgagtggtacgggaagaacgcacgcctccgcgagttggtgaacctggtggtggtggctggagacaggaggaaggagtcgaaggacttggaagagaaggccgagatgaagaagatgtatggcctcatcgagacctacaagttgaacggccaattcagatggatatcctctcagatgaaccgtgtgaggaacggagagctctaccgtgtcatctgtgacacaaggggtgcctttgtgcagcctgcagtttatgaggcctttgggttgactgtggttgaggccatgacttgtgggttgccaacgtttgccacatgcaatggtggtcctgctgagatcattgtgcatggaaaatctggttaccacattgatccttaccatggtgaccatgctgctgagatccttgttgagttctttgagaagagcaaggctgatccatctcactgggacaaaatctcccagggtggactcaagcgtattcatgagaagtacacatggcaaatttactcggacaggctcttgacactcactggtgtgtatggcttctggaagcacgtgaccaatcttgaacgccgtgagagcaaacgttacctcgagatgttctatgctctcaagtaccgcaaattggctgagtctgtgccccttgctattgaagagtaaattcatgtttgaagagaacatcaatggagaaaccggcttttggtcgtttgaagtcttatggagctttcataaataacgccattgattttgattgtgatcagcttttggatttaaagagtctaaaaaaaagtgtcgtttgtttttatattttgcttaggttttgggtaaaaaaagtaaaaaaagaaagtcttttttttttaaaattctttttgttgttgcaatattgtgtatgattggaaatctttaaattcgggttttccaccccatcaattcaatttaaagatatgccttcttccattcaatttcggtgtttactggtccacatttcccctccaactttatcatttatagatccttttatatctttatctattcgagcaatgtgcataaaaaaataatctatttgagctatgctatataacatgggcttggatcagtaacattcttagtggcaattgaaaaagggttgttgctttctgttccccaaaaat

SEQ ID NO: 2395 - DNA, 3200 bp, Glycine max
attcattcatttcattttccccttcaccccttccttttttgcgttcattctgttttcatagtgacgaacttctgaagaaatggcaaatcatcctttgacacactctcactctttccgcgagaggtttgatgaaactctcactggtcacaggaacgaaattttggcccttctgtcaaggcttgaagccaagggcaagggaatcctgcaacatcaccaagtggttgcagagtttgaagaaatccctgaggagagcagaaagaaactccaagatggtgtctttggagaagttttgagatccacacaggaagccatagtgctgccaccatttgtagctcttgctgttcgaccaaggcctggtgtatgggaatatctgcgtgtgaatgtgcacatgcttgttgttgatgagcttcgtcctgctgagtatctgcgtttcaaggaggagcttgttgagggaagttcaaacggcaactttgtgcttgagttggactttgaaccgtttaatgcatccttccctcgcccaactctgaacaagtccattggaaatggcgtcgagttcctcaaccgccacctttcggccaagctcttccatgacaaggagagcatgcagccactgcttgagttcctcaggcttcacagttataagggaaagaccatgatgttgaatgacaaagttcaaagcctggattctctccaacatgttttgagaaaagcagaagagtatctgatttcagttgctcctgaaacaccctactcggaattcgaaaacagattccgggagattggtctggagagggggtggggtgacactgccgagcgtgtcctcgagatgatccagcttctcctggaccttcttgaggcacctgacccttgcaccctcgagacattccttggaagagtccctatggtcttcaatgttgttatcctttctccccatggttactttgcccaagataatgtcttgggataccctgacactggtggacaggttgtttacatcttggatcaagttcgtgccttggagaatgagatgctcaaccgcatcaagaaacaaggccttgatatcacccctcgtattctcattatcactcgtcttctccctgatgcagtaggaactacctgtggccaacgtctagagagggtatatgatactgaatattgtgacattctcagagttcctttcagaacagaaaagggaattgttcgcaaatggatctcaagattcgaagtctggccatacctagagacttacactgaggatgtcgcccttgaacttgccaaggagttgcaagccaagccagatctgattgttggaaactacagtgatggaaacattgttgcctctttgttagcacataaattaggagtaactcagtgtaccattgctcatgctctagaaaagaccaagtaccctgagtctgacatttactggaaaaaatttgaagagaaatatcatttctcatgccaatttactgctgatctttttgcaatgaaccacacagactttatcatcaccagcaccttccaagagattgctggaagcaaggacactgttggacagtatgagagtcacactgccttcacccttccaggactttaccgtgttgttcacggtattgatccatttgatccaaagttcaacattgtctctcccggtgcagacatgggtatatacttcccatacactgaaactgagcgtaggttaacagaattccactctgacatcgaagagcttctttacagctcagtggagaatgaggaacacatatgcgtattgaaggaccgcaacaaaccaataatcttcaccatggcaaggcttgaccgtgtgaagaacatcacggggcttgtcgagtggtacgggaagaacgcacgcctccgcgagttggtgaacctggtggtggtggctggagacaggaggaaggagtcgaaggacttggaagagaaggccgagatgaagaagatgtatggcctcatcgagacctacaagttgaacggccaattcagatggatatcctctcagatgaaccgtgtgaggaacggagagctctaccgtgtcatctgtgacacaaggggtgcctttgtgcagcctgcagtttatgaggcctttgggttgactgtggttgaggccatgacttgtgggttgccaacgtttgccacatgcaatggtggtcctgctgagatcattgtgcatggaaaatctggttaccacattgatccttaccatggtgaccatgctgctgagatccttgttgagttctttgagaagagcaaggctgatccatctcactgggacaaaatctcccagggtggactcaagcgtattcatgagaagtacacatggcaaatttactcggacaggctcttgacactcactggtgtgtatggcttctggaagcacgtgaccaatcttgaacgccgtgagagcaaacgttacctcgagatgttctatgctctcaagtaccgcaaattggctgagtctgtgccccttgctattgaagagtaaattcatgtttgaagagaacatcaatggagaaaccggcttttggtcgtttgaagtcttatggagctttcataaataacgccattgattttgattgtgatcagcttttggatttaaagagtctaaaaaaaagtgtcgtttgtttttatattttgcttaggttttgggtaaaaaaagtaaaaaaagaaagtcttttttttttaaaattctttttgttgttgcaatattgtgtatgattggaaatctttaaattcgggttttccaccccatcaattcaatttaaagatatgccttcttccattcaatttcggtgtttactggtccacatttcccctccaactttatcatttatagatccttttatatctttatctattcgagcaatgtgcataaaaaaataatctatttgagctatgctatataacatgggcttggatcagtaacattcttagtggcaattgaaaaagggttgttgctttctgttccccaaaaattccttcctacacctttccagaatactttttaaatttctgaactgttcaattcggaagctattactttttttacacgtgtaattaatttggaatgtaattttacattccagattgaccccaaaagtcaaaaagggtgaagtaactttttggtgtaggaaacaatagtcatgaaaaagaagtccttgtcagctagatttcatgtttttggg

SEQ ID NO: 2396 - DNA, 3483 bp, Glycine max
actaagatctagcacggtctctgtgttacaaccattggatcagagtctgagacataatcctgtgtttctagtacttcgttttcaattctagttctgttttggggtgctgtctttgttgagtttttggctcattttcattggaattaccattctgcacttcatgcttggtttctgggaagaccgttctgaacttttgtcggattgccctttttcattaaattaaattgaattaataacaaatgaaaatgaaataaaaatttattttttgtctgcagactggtcttgaactaagatcttctttgttagtttctcattgttatgttatggttatgttttggatgcatgctgttactggggtttaagagttttttgatcctgcaatgatcaatataaaattttaaaaatactaacatttaagatcttagttcaattaaggtacaggatctggaattaaattttttttttggacctgtggttggtgagagagggtacttactggtcggtcttggaatccaatacagtcttctagaaagaaaagaaaaaaaaataattccacattgttttggttttgatttttgacttttggtgactaatccttatccttttttatggtggcttgttgcattcaattctaatcagtttcttcttatgcttcttttcttgttgcagtgaggatcttctgaagaaatggcaaatcaccctttgacacactctcactctttccgcgagaggtttgatgaaactctcactggtcacaggaatgaaattttggcccttttgtcaaggcttgaagccaagggcaagggaatcctgcaacaccaccaggtggttgcagagtttgaagaaatccctgaggagagcagaaagaaactccaaggtggtgtctttggagaagttttgagatctacacaggaagccatagtgctgccaccatttgtggctctggctgttcgaccaaggcctggtgtttgggagtatctgcgggtgaatgtgcacatgcttgttgttgatgagctgcttcctgctgagtatctgcgtttcaaggaggagcttgttgagggaagttctaatggcaactttgtgcttgagttggactttgaaccgtttaatgcatccttccctcgcccaactctgaacaagtccattggaaatggcgtcgagttcctcaaccgccacctttcggccaagctcttccatgacaaggagagcatgcagccactgcttgaattcctcaggcttcacagttataagggaaagaccatgatgttgaatgacaaagttcaaagcctggattctctccagcatgttttgagaaaagcagaagagtatctgacttcagttgctcctgaaacaccctactcagaattcgaaaacaaattccgggaaattggtttggagagggggtggggtgacatcgccgagcgtgtcctcgagatgatccagcttctcttggaccttcttgaggcacccgacccttgcaccctcgagacattccttggaagagttcctatggtcttcaatgttgttatcctttctccccatggttactttgcccaagataatgtcttggggtaccctgacactggtggacaggttgtttacatcttggatcaagttcgtgccttggagaatgagatgctcaaccgcatcaagaaacaaggccttgatatcacccctcgtattctcattattactcgtcttctccctgatgcagtaggaactacctgtggccaacgtctagagagggtatatgatactgaatattgtgacattctccgagttcctttcagaaccgaaaagggaattgttcgcaaatggatctcaagattcgaagtctggccatacctagagacttacactgaggatgttgcccttgaacttgccaaggagttgcaagccaagccagatctgatcgttggaaactacagtgatggaaacattgttgcctctttgttagcacataaattaggagtaactcagtgtaccattgctcatgctctagaaaagaccaagtaccctgagtctgacatttactggaaaaaatttgaagagaaatatcacttctcatgccaatttactgctgatctttttgcaatgaaccacacagactttatcatcaccagcaccttccaagagattgctggaagcaaggacactgttggacagtatgagagtcacactgccttcacccttccaggactctaccgtgttgttcacggtattgatccctttgatccaaagttcaacatcgtctctcccggtgccgacatgagcatatacttcccatacactgaaactgagcgtaggttaacagagttccaccccgacattgaagagcttctttacagctcagtggagaatgaagaacacatatgtgtattgaaggaccgcaacaagccgatcatcttcaccatggcaagacttgaccgtgtgaagaacatcacgggacttgtggagtggtatggcaagaatgcgcgcctccgcgagttggtaaacctcgtggtggtggccggagacaggaggaaggagtccaaggacttggaagagaaggccgagatgaagaagatgtatggcctcatcgagacctacaagttgaacggccaattcagatggatctcctctcagatgaaccgtgtgaggaacggagagctctaccgtgtcatctgtgacacaaggggtgcctttgtgcagcctgcagtttatgaggcctttgggttgactgtggttgaggccatgacttgtgggttaccaacatttgccacatgcaatggtggtcctgctgagatcattgtgcatggaaaatctggttaccacattgacccttaccatggtgaccgtgctgctgagatccttgttgagttctttgaaaagagcaaggctgacccatctcactgggacaaaatctcccagggtggactcaagcgtattcatgagaagtacacatggcaaatttactctgacaggctcttgacactcactggtgtgtatggcttctggaagcatgtgaccaatcttgaacgccgtgagagcaaacgttaccttgagatgttctatgctctcaagtaccgcaaattggctgagtctgtgccccttgctattgaagagtaaaatcatgtttgaagagaacatgaatggagaaaccggcttttggtcgtttggagtcttatggagctttcataaataaagccattgaattttgattgtgatctgtttttggatttaaagagtctaaaaaaaaaagtgtcgttgatttttgatattttgcgtaggttttgtgtaaaacaaaaaacaaaaaaatagttttttttttattcttttcttttttgttgttgcaatattgagtatgattggaaatctttaaatttgggtgttccaccccatcaattcaatttaaagatatgccttcttcaattcaatttcggtgtttattggtccacatttaccctccaactttatcgtttatagatccttttttatctttat

SEQ ID NO: 2397 - DNA, 2919 bp, Glycine max
ttcgtgctccttgcctataaattaacacctccacctcattctccattcattcatttcgtcttccccttcaccccttcttcttttacgttcattctgttttcatagtgaggatcttctgaagaaatggcaaatcaccctttgacacactctcactctttccgcgagaggtttgatgaaactctcactggtcacaggaatgaaattttggcccttttgtcaaggcttgaagccaagggcaagggaatcctgcaacaccaccaggtggttgcagagtttgaagaaatccctgaggagagcagaaagaaactccaaggtggtgtctttggagaagttttgagatctacacaggaagccatagtgctgccaccatttgtggctctggctgttcgaccaaggcctggtgtttgggagtatctgcgggtgaatgtgcacatgcttgttgttgatgagctgcttcctgctgagtatctgcgtttcaaggaggagcttgttgagggaagttctaatggcaactttgtgcttgagttggactttgaaccgtttaatgcatccttccctcgcccaactctgaacaagtccattggaaatggcgtcgagttcctcaaccgccacctttcggccaagctcttccatgacaaggagagcatgcagccactgcttgaattcctcaggcttcacagttataagggaaagaccatgatgttgaatgacaaagttcaaagcctggattctctccagcatgttttgagaaaagcagaagagtatctgacttcagttgctcctgaaacaccctactcagaattcgaaaacaaattccgggaaattggtttggagagggggtggggtgacatcgccgagcgtgtcctcgagatgatccagcttctcttggaccttcttgaggcacccgacccttgcaccctcgagacattccttggaagagttcctatggtcttcaatgttgttatcctttctccccatggttactttgcccaagataatgtcttggggtaccctgacactggtggacaggttgtttacatcttggatcaagttcgtgccttggagaatgagatgctcaaccgcatcaagaaacaaggccttgatatcacccctcgtattctcattattactcgtcttctccctgatgcagtaggaactacctgtggccaacgtctagagagggtatatgatactgaatattgtgacattctccgagttcctttcagaaccgaaaagggaattgttcgcaaatggatctcaagattcgaagtctggccatacctagagacttacactgaggatgttgcccttgaacttgccaaggagttgcaagccaagccagatctgatcgttggaaactacagtgatggaaacattgttgcctctttgttagcacataaattaggagtaactcagtgtaccattgctcatgctctagaaaagaccaagtaccctgagtctgacatttactggaaaaaatttgaagagaaatatcacttctcatgccaatttactgctgatctttttgcaatgaaccacacagactttatcatcaccagcaccttccaagagattgctggaagcaaggacactgttggacagtatgagagtcacactgccttcacccttccaggactctaccgtgttgttcacggtattgatccctttgatccaaagttcaacatcgtctctcccggtgccgacatgagcatatacttcccatacactgaaactgagcgtaggttaacagagttccaccccgacattgaagagcttctttacagctcagtggagaatgaagaacacatatgtgtattgaaggaccgcaacaagccgatcatcttcaccatggcaagacttgaccgtgtgaagaacatcacgggacttgtggagtggtatggcaagaatgcgcgcctccgcgagttggtaaacctcgtggtggtggccggagacaggaggaaggagtccaaggacttggaagagaaggccgagatgaagaagatgtatggcctcatcgagacctacaagttgaacggccaattcagatggatctcctctcagatgaaccgtgtgaggaacggagagctctaccgtgtcatctgtgacacaaggggtgcctttgtgcagcctgcagtttatgaggcctttgggttgactgtggttgaggccatgacttgtgggttaccaacatttgccacatgcaatggtggtcctgctgagatcattgtgcatggaaaatctggttaccacattgacccttaccatggtgaccgtgctgctgagatccttgttgagttctttgaaaagagcaaggctgacccatctcactgggacaaaatctcccagggtggactcaagcgtattcatgagaagtacacatggcaaatttactctgacaggctcttgacactcactggtgtgtatggcttctggaagcatgtgaccaatcttgaacgccgtgagagcaaacgttaccttgagatgttctatgctctcaagtaccgcaaattggctgagtctgtgccccttgctattgaagagtaaaatcatgtttgaagagaacatgaatggagaaaccggcttttggtcgtttggagtcttatggagctttcataaataaagccattgaattttgattgtgatctgtttttggatttaaagagtctaaaaaaaaaagtgtcgttgatttttgatattttgcgtaggttttgtgtaaaacaaaaaacaaaaaaatagttttttttttattcttttcttttttgttgttgcaatattgagtatgattggaaatctttaaatttgggtgttccaccccatcaattcaatttaaagatatgccttcttcaattcaatttcggtgtttattggtacacatttaccctccaactttatcgtttatagatccttttttatctttat

SEQ ID NO: 2398 - DNA, 2765 bp, Cajanus cajan
ggaggtttttcctctgaggatcttctgggaaaatggctaatcatcctttgacccactctcgctctttccgcgagaggcttgatgaaactcttgctggtcacaggaatgaaattattgcccttctatcaaggcttgaagccaagggcaagggaatcctgcaacaccaccaggtcattgcagagtttgaagaaatccctgaggaaaacaggaagaagttgcttgatgggacctttggagaagttttgcgttctacacaggaagccatagtgttgccaccatttgttgctcttgctgttaggccaaggcctggtgtttgggagtatctgcgtgtgaatgtgcacatgcttgttgttgatgagttgcgtcctgctgagtatttgcgtttcaaggaggaactcgttgagggaagttccaacggcaactttgtgcttgagttggactttgaaccctttaatgcatccttccctcgtccaactctgaacaagtctattggaaatggtgttgagtttctcaaccgccatctttctgccaagctcttccatgacaaggagagcatgcagccactgcttgaattcctcaggcttcacagttacaagggaaagactatgatgttgaatgacaaagttcaaaacttgaatgctctccaacatgttttgagaaaagcagaagagtatctgaccacagttgctcctacaacaccgtcctcggaatttgaaaacaaattccgagatattggtttggagagagggtggggtgacaacgcggagcgtgtcctcgagatgattcagcttctgctagatcttctcgaggcacctgatccgtgcaccctcgagacattccttggaaggatccctatggtcttcaatgttgttatcctttctccccatggttacttcgcccaagataatgtcttgggataccctgacactggtggacaggttgtttacatcttggatcaagttcgtgccttggagaatgagatgctcgaccgcatcaagaaacaaggcttggatatcacccctcgtactctcattatcactcgtcttctccctgatgcagtaggaactacctgtggccaacgtcttgagagggtgtatggtactgaacattgtgacattctccgaattcctttcagaacagaaaagggaattgttcgcaaatggatctccagattcgaagtctggccatacctagaaacttacaccgaggatgttgcccttgaacttgccaaggagttgcaagccaagccagatctgattgttggaaactacagtgatggaaacattgttgcctctttgttagcacataaattaggagtaactcagtgtaccattgctcatgctctagagaagaccaagtaccctgagtctgacatttactggaaaaaatttgaagagaaatatcacttctcatgccaatttactgctgacctttttgcaatgaaccacacagactttatcatcaccagcaccttccaagagatagctggaagcaaggatagtgttggacagtatgagagccacactgctttcaccctaccaggactttaccgtgttgttcacggtattgatgtctttgatccaaagttcaacatcgtatctcccggagctgatatgagcatatacttcccatacactgaaactgagcgtaggttaacaaacttccaccctgagattgaagagcttctttacagctcagtggagaatgaggagcacatatgtgtgttgaaggaccgcaacaagccaatcatcttcaccatggcaaggcttgaccgtgtgaagaacatcacagggcttgtcgagtggtatggcaagaatgcacgcctccgtgagttggtgaatcttgttgttgttgccggagacaggagaaaggagtccaaggacttggaagagaaggccgagatgaagaagatgtatggcctcattgagacctacaagctgaatggccaattcagatggatttcatcccagatgaacagagtgaggaatggagaattgtaccgtgtcatttgtgacacaaagggtgcatttgtgcagcctgcaatttatgaagcttttgggttgactgtggttgagtccatgacttgtggattgccaacttttgctacctgcaatggtggtcctgctgagatcattgtgcatggaaaatctggataccacattgaccctcaccatggtgaccgtgctgctgagctccttgttgagttctttgagaagagcaaggctgatccatctcactgggacaaaatctcccagggtggactcaaacgtattcatgagaagtacacatggcaaatttactctgataggctcttgacactcactggtgtctatggcttctggaagcatgtgaccaaccttgaacgccgtgagagcaaacgctacctcgagatgttctatgcactcaagtaccgcaaattggctgagtctgtgccccttgctattgaagagtaaaatcatggctgaagagaaaatcgatggagaaaccggctattggtcgtttggagtcttgtggagctttcataaataacgccattgattttgattgtgattaggttttggattaagaaaaaaagtgtcgttgattttgatattttgcttagctttcggatcaaaaaagtaaaaaaaaaaaaaaaaaaaaaagaagtcctttcattcttttttattgcaatattgaatatgattggaaatctttaaatatgggtgttcaaccccatcaattcaatttaaagacgtttcttcaatttaatttcggtgtttattggt

SEQ ID NO: 2399 - DNA, 2665 bp, Arachis hypogaea
tttcgtttggggccatggctttgactcgctctcactctctcaaggagaggctcgatgagactcttgctggacagaggaatgagattttggcccttcttgctaggatcgaggctaagggcaagggaatcctgcagcatcaccaggtcattgctgagtttgaagaaatccctgaagagaagaggcagaagctatatgatggtgcctttggagaagttctgagatctactcaggaagccatagtgctgccaccatttgttgctttggcagttcgtccaaggcctggtgtttgggagtacctgcgcgtgaatgtgcacgcgcttgttgttgatgagttgcgtcctgctgagtacctcaagttcaaggaagagcttgttgatggcagttccaacggcaactttgtgcttgagttggactttgagccttttaacgcatccttcccccgcccaacacttaacaagtcaattgggaatggcgttgagttccttaaccgccacctttccgctaagcttttccatggcaaggagagcatgcagccattgttggagttcctaaggcttcatagttacaatggaaagactatgatgttgaatgacaggattcaaaacctgaattctcttcaacatgttctgagaaaggcagaggactatctggttacacttgctcccgaaacaccctactcagtattcgagcacaaattccaggagataggtttggagagagggtggggtgacaccgccgagcgtgtcctcgagatgatccagcttctcctggatctcctcgaggcacctgacccttgtaccctggagacattccttggaaggatccctatggtcttcaatgtggtgatcctttctccccatggttactttgctcaagacaatgtcttgggataccctgatactggtggccaggttgtttacatcttggatcaagttcgtgcattggagaatgagatgctcaaccgcatcaagaaacaaggcttggacatcacccctcgcattctcattctcacccggcttctccctgatgctgttggaactacttgcggccaacgtcttgagaaggtattcggcactgagcattgccacattcttcgagttccctttagaacagagaaaggaattgttcgcaaatggatctcaagattcgaagtctggccctacctagaaacttacactgaggatgctgctcatgaacttgccaaagagttgaaaggcaagccagatctgattgttggaaactacagtgatggaaacattgttgcctctctgttagcacacaaattgggtgtaactcagtgtaccattgctcatgcacttgagaagaccaaatatccagaatctgacatttactggaagaaatttgatgacaaatatcacttctcatgccaattcacagctgatctttttgcaatgaaccacacagatttcatcatcaccagtaccttccaagaaattgctggaagcaaggacactgttggacaatatgagagccacactcacttcacccttcctggactctaccgtgttgtccacggcattgatgtcttcgatccaaagtttaacattgtctctcctggtgccgacatgagcatttacttcccatacactgaaaccgagcgcaggttgacatccttccacccggagattgaagagctactgtatagcaatgtagagaacgaggagcacatatgtgtactgaaggatcgtaccaagccaattatcttcaccatggcgaggttggaccgtgtgaagaacatcacaggacttgttgagtggtatggcaagaacgcccgccttagggagctcgtgaaccttgtcgtggtagccggagacaggcggaaggagtccaaggacttggaagagaaagctgagatgaagaagatgtatggcctcattgagacttacaagctaaacggccaattcaggtggatctcctcacaaatgaacagagtgaggaatggagagctttaccgtgtgatctgcgacaccaaaggtgcgttcgtgcagcctgcgatctacgaagcgttcggtctgacagttgttgaggccatgacttgtggattgccaacatttgcaacttgcaatggtggtcctgctgagatcattgtcaatggaaaatctggctaccatattgatccttaccatggtgatcgtgctgctgagattcttgttgatttcttcgagaagagcaaggctgatccatctcactgggacaagatctctcagggtggtctcaagcgtattcatgagaagtatacgtggcaaatttactccgaccgcctgctgactctcactggagtctacggcttctggaagcatgtgaccaaccttgaccgccgcgagagcaagcgttaccttgagatgttctatgccctcaaataccgcatgctggctgagtctgtgccccttgctgtcgagtaaaatcaagtcaagtgaagattgaggaacttcatatatggtgaaatcggctttttctcttctggagtcttgtggagttgatatatatatatttcaattattttgatattgtatttgattaggttttggtattataagaaaagcttaaaaaagtgttttatttttatttttattattattatgtattattggatgttttgaaatctttaaatttggggtctaccccatcatttcaattctaagca

SEQ ID NO: 2400 - DNA, 3049 bp, Cicer arietinum
ggacaacactttcatggaaacaggggcaattaaaatgtgaaattctcttttttcctcatttcactataaaaagggcattccaaatacatctttcttcacacattcaatcctccatttcattcatttctttgtagcattcttaatttgcgttttgtttgcttcattgcacttagtgttgttgttcctcttttcaatttgctttattccatatcattcagtgttgctattacaaatacaagttttaaggttttgaagcaaatgggtagtgatcgtcttacccgctctcactctatccgtcagaggtttgatgaaattctcactggtcacaggaatgaaattttggcccttctctcaaggattgaagcaaagggaaagggaatcctgcaacaccatcaagtcattgccgagtttgaagaaattcctgaggagaataggcaaaaactagttaatggagcctttggagaagttttgagatctacccaggaagccatagtgttgccaccatttgttgctcttgctgttcgtccaaggcctggtgtttgggagtatctgagagtcgatgtacacggccttgttgttgatgagctgagcgctgctgagtatctcaagttcaaggaggaacttgttgaaggaagttctaacggcaactttgtgcttgagttggactttgaaccattcaacgcctcttttccgcgaccaaccttgaacaagtcgattggaaatggtgtggagttccttaatcgccatctttctgctaagcttttccatggcaaagagagcttgcagccactgctggaattcctcaggcttcacaactataatggaaagactatgatggtgaatgacagaattcaaaatctgaattctcttcaacatgttttgataaaagcagaagagtatctgagcacaattgctccggaaacatcctactcggaatttgaacacaagttccaggagattggtttggagagagggtggggagacaccgctgagcgcgtccttgaaatgatccagcttctattggatcttcttgaggcacccgatccttgcacccttgagacattccttggaagaatccctatggtctttaatgttgtcatcctttctccacatggttactttgcccaagataatgttttaggataccctgatactggtggacaggttgtttacatcttggaccaagttcgcgccttggagaatgagatgctcaagcgtataaagcaacaaggcttggatatcacccctcgcattctcatcatcactcgtcttctccctgatgcagtgggaactacctgcggccaacgtcttgagaaagtttatgataccgaacattgccacattcttcgagttccctttagaacagagaagggaattgttcgcaaatggatctcgagatttgaagtctggccttacctagagactttcaccgaggatgttgccaatgaacttgctaaagagttgcaaggaaagcctgatcttatcgtcggaaactacagtgatggaaacattgttgcatctttgttagcacataaattaggtgtaactcagtgtactattgctcatgcacttgagaagaccaagtatccagaatctgacatttactggaaaaagtttgatgacaaatatcacttctcatgccaatttactgctgatctttttgcaatgaaccacacagattttattatcactagtaccttccaagagatcgctggaagcaaggatactgttggacaatatgagagtcacactgccttcacccttccaggactttaccgagtggttcacggtatcgatgttttcgatccaaagtttaacattgtctctcccggagctgatatgagcatttacttcccttatactgaaaccgagcgtaggttgacatcattccaccctgagattgaagaacttctttatagctcagtggagaatgaggaacacatatgtgtattgaaggaccgcagcaagccaattatcttcaccatggcaaggttggaccgagtgaagaacattacaggacttgtagaatggtacggtaagaacgctcgcctaagggagttagtaaaccttgttgttgttgccggagacaggaggaaggagtccaaagatctagaagaaaaagctgagatgaagaaaatgtatggcctaatcgagacctacaaactaaacggccaattcagatggatttcctcacagatgaaccgaattcggaacggagagctctaccgtgtcatttgtgacacaaagggtgcttttgtgcagcctgcaatttatgaagcttttggtttgactgttgttgaggctatgacttgtggattgcccacatttgctacttgtaatggtggtcctgctgagataattgtgcatggaaaatctggttaccatattgatccttaccatggcgaccttgccgctgagactctcgttgagttctttgagaagagcaaggctgatccatcttattgggacaaaatctctcatggaggtctcaaacgtattcatgagaagtacacatggcagatttactctgacaggcttctgactctgactggtgtgtatgggttttggaagcatgtgacaaaccttgatcgccgtgagagcaaacgctaccttgagatgttctatgcactcaagtacaacaaattggctgaagctgtgcctcttgctgttgaagagtaaaatcaatggagaaaattgagaagattgcggaaccttttattatttggagtcttatggagcttttctaaataaataaataataccattaattgatattgtgataagattttggattgaaaaaacgaagtgtcgttcttttctaaattgttagtagtttaggatgaaagttgaattgtccttttctttttgcatttttggatctgattggaaatcttcaaatttgggtgtttaccccataaattcaatttcatgatgtgccttcaattcaatttgggtgtttattttgtcaacatttattatacacatattttctattatgttatcttttaaaacacaaataaataattaaacactctcttttacctcaaat

SEQ ID NO: 2401 - DNA, 2919 bp, Cicer arietinum
tgcctcccacgactcatttctaaaatcctcctttgcagagagagaattgtgtttgtcctttgttgaattttttgccttttttatttcatacgtttctctgttatgtttcgcgctccaatgtctataaattaacacatccactacttcttttttccattcattcatttctcttccttcttccccctcattttttgcattcactctatttctattgcttaagttttaaggttttgaagcaaatgggtagtgatcgtcttacccgctctcactctatccgtcagaggtttgatgaaattctcactggtcacaggaatgaaattttggcccttctctcaaggattgaagcaaagggaaagggaatcctgcaacaccatcaagtcattgccgagtttgaagaaattcctgaggagaataggcaaaaactagttaatggagcctttggagaagttttgagatctacccaggaagccatagtgttgccaccatttgttgctcttgctgttcgtccaaggcctggtgtttgggagtatctgagagtcgatgtacacggccttgttgttgatgagctgagcgctgctgagtatctcaagttcaaggaggaacttgttgaaggaagttctaacggcaactttgtgcttgagttggactttgaaccattcaacgcctcttttccgcgaccaaccttgaacaagtcgattggaaatggtgtggagttccttaatcgccatctttctgctaagcttttccatggcaaagagagcttgcagccactgctggaattcctcaggcttcacaactataatggaaagactatgatggtgaatgacagaattcaaaatctgaattctcttcaacatgttttgataaaagcagaagagtatctgagcacaattgctccggaaacatcctactcggaatttgaacacaagttccaggagattggtttggagagagggtggggagacaccgctgagcgcgtccttgaaatgatccagcttctattggatcttcttgaggcacccgatccttgcacccttgagacattccttggaagaatccctatggtctttaatgttgtcatcctttctccacatggttactttgcccaagataatgttttaggataccctgatactggtggacaggttgtttacatcttggaccaagttcgcgccttggagaatgagatgctcaagcgtataaagcaacaaggcttggatatcacccctcgcattctcatcatcactcgtcttctccctgatgcagtgggaactacctgcggccaacgtcttgagaaagtttatgataccgaacattgccacattcttcgagttccctttagaacagagaagggaattgttcgcaaatggatctcgagatttgaagtctggccttacctagagactttcaccgaggatgttgccaatgaacttgctaaagagttgcaaggaaagcctgatcttatcgtcggaaactacagtgatggaaacattgttgcatctttgttagcacataaattaggtgtaactcagtgtactattgctcatgcacttgagaagaccaagtatccagaatctgacatttactggaaaaagtttgatgacaaatatcacttctcatgccaatttactgctgatctttttgcaatgaaccacacagattttattatcactagtaccttccaagagatcgctggaagcaaggatactgttggacaatatgagagtcacactgccttcacccttccaggactttaccgagtggttcacggtatcgatgttttcgatccaaagtttaacattgtctctcccggagctgatatgagcatttacttcccttatactgaaaccgagcgtaggttgacatcattccaccctgagattgaagaacttctttatagctcagtggagaatgaggaacacatatgtgtattgaaggaccgcagcaagccaattatcttcaccatggcaaggttggaccgagtgaagaacattacaggacttgtagaatggtacggtaagaacgctcgcctaagggagttagtaaaccttgttgttgttgccggagacaggaggaaggagtccaaagatctagaagaaaaagctgagatgaagaaaatgtatggcctaatcgagacctacaaactaaacggccaattcagatggatttcctcacagatgaaccgaattcggaacggagagctctaccgtgtcatttgtgacacaaagggtgcttttgtgcagcctgcaatttatgaagcttttggtttgactgttgttgaggctatgacttgtggattgcccacatttgctacttgtaatggtggtcctgctgagataattgtgcatggaaaatctggttaccatattgatccttaccatggcgaccttgccgctgagactctcgttgagttctttgagaagagcaaggctgatccatcttattgggacaaaatctctcatggaggtctcaaacgtattcatgagaagtacacatggcagatttactctgacaggcttctgactctgactggtgtgtatgggttttggaagcatgtgacaaaccttgatcgccgtgagagcaaacgctaccttgagatgttctatgcactcaagtacaacaaattggctgaagctgtgcctcttgctgttgaagagtaaaatcaatggagaaaattgagaagattgcggaaccttttattatttggagtcttatggagcttttctaaataaataaataataccattaattgatattgtgataagattttggattgaaaaaacgaagtgtcgttcttttctaaattgttagtagtttaggatgaaagttgaattgtccttttcttttgccatttttggatctgattggaaatcttcaaatttgggtgtttaccccatcaattcaatttcatgatgtgcc

SEQ ID NO: 2402 - DNA, 2783 bp, Lotus japonicus
ctccattttccctctcatttttttcgttcactctgcactttctttctacaggtttttcacctgaggatcttgtgaaggtatggctaatgactatttgacccgttctcactctttcagagagaggcttgatgaaacccttgctggtcaaaagaatgaaattttgactcttctgtcaaggattgtagccaagggcaagggaatcctgcaacaaaatcagatcattgcagagtttgaagaaatccctgaggagagtaggcaaaaactcttcaatggggcctttggagaaattttaagatctacccaggaagctattgtgttgccaccatttgttgctctggcggttcgtcctaggcctggtgtttgggagtatctgcgagtggatgtgtactccattgttgttgatgagctgcgtcctgctgagtatctgaagttcaaggaggaacttgttgatggaagttctaatggaaactttgtgcttgagttggactttgaaccattcaatgcatccttcccccgaccaactctgaacaagtcaattgggaatggtgttgagttcctcaaccgccacctttctgccaagcttttccatggcaaagaaagtctgcagccactgctggagttcctcaggcttcacagctataatggacagactatgatgttgaatgacagagttcagaacttgaattctctgcaacatgttttgagaaaagctgaagagtatctgatatcagttgctcctgaaacaccctactctgaatttgaacataaattccaggagattggtttggagagaggatggggtgacactgctgagcgtgtcctcgagatgattcagcttctgttggatcttttcgaggcaccggatcctttcaccctcgagaaattcctcggaagaatccctatggtcttcaatgttgttatcctttctccccatggatactttgcccaagataatgtcttaggataccctgatactggaggacaggttgtttacatcttggatcaagttcgtgccttggagaatgagatgctaagtcgcatcaagaaacaaggcttggatatcacccctcgtattctcattctcacccgtcttctcccagatgcagtgggaactacttgtggccaacgtcttgagaaggtgtacaacactgagcattgccacattcttcgagttccctttagaaccgagaagggaattgttcgcaaatggatctcaagattcgaagtctggccctacctagagagatacactgaggatgttgccactgaactttccaaggagttgcagggcaagccagatctgatagttggaaactacagtgatggaaacattgttgcctctttgttggcacataaattaggtgtaactcagtgtactattgctcatgcacttgagaagacaaagtaccctgagtctgacatctactggaaaaaatttgaagagaaatatcacttctcagcccaattcactgctgatctttttgcaatgaaccacacagacttcattatcaccagtaccttccaagagattgctggaagcaaggacaaagttggacagtacgagagtcacactgccttcaccctcccaggactttaccgtgtggttcacggtatcgatgtctttgatccaaagtttaacatcgtctctcctggagctgatatggacatttacttcccatacactgaaactgagcgtaggctgacacatttccatcctgacattgaagagcttcttttcagctctgtggagaatgaggaacacatatgtgtactgaaggaccgcaacaagccaatcatcttcaccatggcaaggttggaccgtgtgaagaacataacaggactagttgaatggtacggcaagaatgcccgcctgagggagctggtgaaccttgtggttgttgctggagataggaggaaggagtccaaggacttggaagagatagctgagatgaagaagatgtacggcctcatcgagacatacaagctgaatggccaattcaggtggatttcctcacagatggaccgcataaggaacggggagctctaccgtgtgatctgtgacaccaagggtgcttttgtgcagcctgcaatctatgaagcttttggtttgactgttgttgaggccatgacttgcgggttgccaacattcgccacctgcaatggtggtcctgctgagatcattgtgcatggaaaatctggttaccacattgacccttaccatggtgatcgtgctgctgagactcttgttgagttctttgagaagagcaaagcagacccatcttactgggacaaaatctcccaaggaggtctccagcgtattcatgagaagtacacatggaaaatttactctgataggcttctgactctcactggtgtctatggcttctggaagcatgtgaccaaccttgatcgccgtgagaacaagcgttaccttgagatgttctatgccctcaagtacagcaaattggctgagtcagtgccccttgctgttgaagagtaaaatcaaggcatgcagctaagtgaagagaagcggcttttggtcttttgaagtgtcaaggagcttttattaataataccctcgattttggaaaaaaaaagtgttattgtttgttattgtcactaggttttagatgaaaaaagtgtcttgtttttcttttccttttccttctcttcattattggatctgattggaaatctttaaatttgggtgttgccctatcaattcaattttaagatgtgcctttctattcaatttggttggttactgatccacatctctcctc

SEQ ID NO: 2403 - DNA, 2849 bp, Medicago truncatula
cccatttcatttacttgtaatttcttccttgcttttcctcattttgtgccaccctttttttatctcattcaatatttgctctatttcttcattaggtcttggcatttcaactacaaacaagttgaagttttaagcttttgaagcaatggctagtcttacccgttctacttctctccgtgagaggtttgatgaatctctcactgctcacaggattgaaattttggccctcttgtcaaggattgaagcaaaggggaagggaatcctacagcaccatcaagtaattgctgagtttgaagaaatccctgaggagaagaggcaaaaactagttaatggagcattcggagaagttttgagatctactcaggaagctgtagtattgccaccatttgttgctcttgctgttcgcccaaggcccggtgtttgggagtatctaagagttgatgtgcacagccttgttgtcgatgaacttcgtgctgccgagtatctcaagttcaaggaggaacttgttgaaggaagttctaatggcaactttgtgcttgagttggactttgaaccattcaacgcctcttttcctcgaccaaccctgaacaagtcgattggaaatggtgttgagttcctcaatcgccatctttctgctaagcttttccatggcaaagaaagtttgaagccactgttggaattcctcaggcttcacaactataatggaaagactatgatggtgaatgacagaattcaaaatctggattcacttcaacatgttttgagaactgcagaagattatcttcgcataattgctcccgaaacaccttactcggaatttgaacacaaattccaggatagtggtttggagagagggtggggagacacggccgagcgtgtcctcgaaatgatccagcttctattggatcttctcgaggcacctgatcctttcaccctcgagaaattccttggaagaatccctatggtctttaatgttgtcatcctttctccacatggttacttcgcccaagataatgtcttgggataccctgataccggtggacaggttgtgtacattttggaccaagtccgtgccttggagaacgagatgctcagacgtatcaagcaacaaggcttggatatcaaacctcgcattctcattatcacccgtcttctccctgatgcagtgggaactacttgtggtgaacgtcttgagaaagtatacgataccgaacattgccacattcttcgagttccatttagaacagagaagggaattgttcgcaaatggatctcaagattcgaagtctggccctaccttgagactttcagtgaggatgttgccaatgaacttgcaaaggagttggaaggaaaacctgatctgatcgtcggaaactacagtgacggaaacatcgttgcctctttgttagctcataaattaggcgtaactcagtgtactattgctcatgcactggagaagaccaagtatcctgagtctgaactttactggaaaaaatttgaagacaagtatcacttctcatgccaatttaccgctgatctttttgcaatgaaccacacagattttattatcacaagtaccttccaagagattgctggaagcaaggatactgttgggcagtatgagagtcacactgccttcacccttcccggactttaccgtgttgttcacggtatcgatgtttttgatccaaagttcaacattgtctcacccggagctgatatgagcatctacttcccatacaccgagactgagcgtagattgacatcattccaccctgagattgaagaacttctttacagctcagtggagaacgaggagcacatttgcgtgttgaaggaccgcagcaagccaatcatcttcacaatggcaaggctggaccgagtgaagaacattacaggacttgttgagtggtacggcaagaacgctcgcctgagggagctagtaaaccttgtcgtcgtagctggagacaggaggaaggaatccaaagacttagaagagaaagccgagatgaagaaaatgtacggcctaatcgagacctacaaattgaacggccaattcagatggatttcctcacaaatgaaccgaattcggaacggagagctttaccgtgtcatttgcgacacaaagggagcttttgtgcagcctgctatttatgaagcttttggtttgactgttgttgaagctatgacttgtggattgccgacattcgcaacgtgtaatggtggtcctgctgagatcattgttcatggaaaatctggttaccatattgatccttatcatggtgaccaagctgctgagactcttgttgaattctttgagaagagtaaggctgatccatcttattgggacaaaatctctcatggaggtctcaaacgtattcatgagaagtacacatggcagatttattctgacaggcttttgactctaactggtgtttatggcttctggaagcatgtgactaaccttgatcgccgtgagagcaaacgttaccttgagatgttctatgcacttaagtacagcaaattggctgaatctgtgcctcttgctgttgaagagtaagatcaatgatgaagtatgaagagattgcgggattggctttttgttgtttggagttgatggagcatttataaataaaatattagtaccattgatttgatattgagattatattttcaattggaaaaaaaaattgtcgttcttctttaaattgttagtaggttcacctaaacttttggtaacaaaaaaaaatgttgttggtatgtttaggatgaaaaatgaagaaaaataaagtgtactttactttttccatttttggatcttattggaaatcttcaaatttggagtgttt

SEQ ID NO: 2404 - DNA, 2999 bp, Cicer arietinum
ggtgaatgtcttaaatcataaaataattccccttaattaattaatttccacttcagcatgtgaaattcccattctgcttctcacttcttgtcctataaattgacttagccaccacttcattttccattcattcattccttctctttatacaccccctctcttttttgcgtttattctgttttcatagtttgattttgtgagccaatggctacggatcgtttgactcgagttcacagtctccgtgagaggattgatgaaaccttaactgctaatagaaatgaaattttggcccttctatcaaggattgaagcaaagggaaagggaatcctgcaacatcaccaaatcattgctgagtttgaggaaattcctgaggagcctagacagaagttgactgatggtgcatttggtgaagttttgagatccacacaggaagcaatagttttgccaccatgggttgctctagctgttagaccaaggcctggtgtttgggaatatctgagagtgaatgtgcatgctcttgttgttgaagaattgcaacctgctgagtttttgaaattcaaggaagaacttgttgatggaagtgctaatggaaactttgtgcttgagttggactttgaaccatttactgcatctttccctcgtcccactctcaacaagtcaattggaaatggtgtccaattcctcaaccgtcacctttctgctaaactcttccatgacaaggagagtttacatccacttcttgaattcctcagacttcacagctacaagggaaagacattgatgttgaatgacagaattcaaaaccccgatagtcttcaacatgtgctgaggaaagctgaagagtatctagccacacttgctcctgaaacaccatactcagaatttgaacacaggttccaagagattggattggagagaggttggggtgacaccgccgagcgtgtcctcgagtccattcaacttctcttggatcttcttgaggctcctgacccttgcacccttgagacattccttgacagaatccctatggtgttcaatgttgtcattctttctcctcatggttactttgctcaagataatgtcttaggataccctgataccggtggccaggttgtttacatcttggatcaagttcgtgccttggagaatgagatgctccatcgcattaagcaacaaggcttggatatcgtccctcgaattctcattatcactcgtcttctccctgatgcagttggaactacttgtggccaacgacttgagaaggtctttggaaccgagcattgccacattcttcgagttccattcagaaacgagaagggaattgttcgcaagtggatctcacgattcgaagtctggccatatctagaaacttacactgaggatgttgctcacgagcttgccaaagaattgcaaggaaaaccagatctgattgttggaaactacagtgatggaaacattgttgcttccttgttggcacataaattaggtgtcactcagtgtaccattgcgcatgcacttgagaagacgaaatatcccgaatccgatatttactggaaaaaattcgaagagaagtatcacttctcctgccaatttacagctgatctctttgcaatgaaccacacagatttcatcatcacaagtaccttccaagagattgctggaagcaaggatactgttggacagtatgagagtcacactgccttcacccttccaggactctaccgtgttgtccacggtatcgatgtctttgatccaaagttcaacattgtgtctccaggagctgatgagaccatttacttcccttacaccgaaactagccgaagattgacatccttccaccctgaaatcgaagagcttctttatagcacagtcgagaatgaagaacacatatgtgtactgaaggaccgcaacaagccgattatcttcaccatggcaaggttggaccgtgtgaagaacatttcaggacttgtggaatggtacggcaagaacgccaagcttcgtgagttggtgaaccttgttgttgttgccggagacaggaggaaggagtcaaaggacttggaagagaaagctgagatgaagaagatgtacgccttgatcgacacctacaagctgaatggacaattccgatggatttcgtctcagatgaaccgtgttagaaacggagagctgtaccgtgtgatctgcgacacgaagggagctttcgtgcagcctgctgtgtatgaagctttcggtttgacagttgttgaggccatgggttgtggtttgccaacatttgcaacattaaatggtggtcctgctgagattattgttcatggaaaatctggatttcacattgatccttaccacggcgaacgcgccgctgatctccttgttgaattctttgagaagtgcaaggttgatccatctcactgggacaaaatctctcagggtggtctcaaacgtattgaagagaagtatacatggcaaatttactcccagaggcttctcacactcactggtgtctatggtttctggaagcatgtgtctaaccttgaccgccttgagagtcgccgttatcttgagatgttctatgctctcaaataccgcaaattggctgagtcggtgcccctagctgttgaggagtaaaaatatgatgcttgaagagttacatgaagaaatggaggaaccggctttttattatcttatttggagtcagttgtttcttttgagttttataaataataatgtgaatgattttgattttgttgattaagctttttgataaagagaaaagtgaatgtatttttcttttgcatgatttgaatgtgattgggaagcttgaatgaagggtgttttgcccatcaatttaattttaagccgtgccccttcttcactttgttgctgtccatattctactccaactttattttatcaaattattgttccaccttttcgtctttatatattatatatacaaccgataatgaattggtgtaagtggtaagggatttagccctttt

SEQ ID NO: 2405 - DNA, 2689 bp, Cicer arietinum
ttctgtttctatagtttgattttgtgagccaatggctacggatcgtttgactcgagttcacagtctccgtgagaggattgatgaaaccttaactgctaatagaaatgaaattttggcccttctatcaaggattgaagcaaagggaaagggaatcctgcaacatcaccaaatcattgctgagtttgaggaaattcctgaggagcctagacagaagttgactgatggtgcatttggtgaagttttgagatccacacaggaagcaatagttttgccaccatgggttgctctagctgttagaccaaggcctggtgtttgggaatatctgagagtgaatgtgcatgctcttgttgttgaagaattgcaacctgctgagtttttgaaattcaaggaagaacttgttgatggaagtgctaatggaaactttgtgcttgagttggactttgaaccatttactgcatctttccctcgtcccactctcaacaagtcaattggaaatggtgtccaattcctcaaccgtcacctttctgctaaactcttccatgacaaggagagtttacatccacttcttgaattcctcagacttcacagctacaagggaaagacattgatgttgaatgacagaattcaaaaccccgatagtcttcaacatgtgctgaggaaagctgaagagtatctagccacacttgctcctgaaacaccatactcagaatttgaacacaggttccaagagattggattggagagaggttggggtgacaccgccgagcgtgtcctcgagtccattcaacttctcttggatcttcttgaggctcctgacccttgcacccttgagacattccttgacagaatccctatggtgttcaatgttgtcattctttctcctcatggttactttgctcaagataatgtcttaggataccctgataccggtggccaggttgtttacatcttggatcaagttcgtgccttggagaatgagatgctccatcgcattaagcaacaaggcttggatatcgtccctcgaattctcattatcactcgtcttctccctgatgcagttggaactacttgtggccaacgacttgagaaggtctttggaaccgagcattgccacattcttcgagttccattcagaaacgagaagggaattgttcgcaagtggatctcacgattcgaagtctggccatatctagaaacttacactgaggatgttgctcacgagcttgccaaagaattgcaaggaaaaccagatctgattgttggaaactacagtgatggaaacattgttgcttccttgttggcacataaattaggtgtcactcagtgtaccattgcgcatgcacttgagaagacgaaatatcccgaatccgatatttactggaaaaaattcgaagagaagtatcacttctcctgccaatttacagctgatctctttgcaatgaaccacacagatttcatcatcacaagtaccttccaagagattgctggaagcaaggatactgttggacagtatgagagtcacactgccttcacccttccaggactctaccgtgttgtccacggtatcgatgtctttgatccaaagttcaacattgtgtctccaggagctgatgagaccatttacttcccttacaccgaaactagccgaagattgacatccttccaccctgaaattgaagagcttctttatagcacggtcgagaatgaagaacacatatgtgtactaaaggaccgcaacaagccgattatcttcaccatggcaaggttggaccgtgtgaagaacatttcaggacttgttgaatggtacggcaagaacgccaagcttcgtgagttggtgaaccttgttgttgttgccggagacaggaggaaggagtcaaaggacttggaagagaaagctgagatgaagaagatgtacgccttgatcgacacatacaagctgaatggacaattccgatggatttcgtctcagatgaaccgtgttagaaacggagagctgtaccgtgtgatctgcgacacgaagggagctttcgtgcagcctgctgtgtatgaagctttcggtttgacagttgttgaggccatgggttgtggtttgccaacatttgcaacattaaatggtggtcctgctgagattattgttcatggaaaatctggatttcacattgatccttaccacggcgaacgcgccgctgatctccttgttgaattctttgagaagtgcaaggttgatccatctcactgggacaaaatctctcagggtggtctcaaacgtattgaagagaagtatacatggcaaatttactcccagaggcttctcacactcactggtgtctatggtttctggaagcatgtgtctaaccttgaccgccttgagagtcgccgttatcttgagatgttctatgctctcaaataccgcaaattggctgagtcggtgcccctagctgttgaggagtaaaaatatgatgcttgaagagttacatgaagaaatggaggaaccggctttttattatcttatttggagtcagttgtttcttttgagttttataaataataatgtgaatgattttgattttgttgattaagctttttgataaagagaaaagtgaatgtatttttcttttgcatgatttgaatgtgattgggaagatactaggtgtgggtcggcgttctctcgaaggcacgacgaggggta

SEQ ID NO: 2406 - DNA, 2990 bp, Cajanus cajan
attcattcatcgtttctctttatccccccctctctattttgcgttcattctgttttcttagttgaagtctttccctgagatcttcgaagccaatggctaccgatcgtttgactcgtgttcacagtctccgtgagaggcttgatgaaaccctcactgccaacagaaacgaaattttggctcttctgtcaaggcttgaagccaagggcaaggggatccttcaacaccaccaggtcattgctgagtttgaggaaatcccagaagagaacagacagaagcttactgatggagcctttggagaagttctgagatctacacaggaagccatagttttgccaccatgggttgctttggctgttcgtccaaggcctggtgtgtgggagtacctgagagtgaatgtgcacgctcttgttgttgaggagttgcaacctgctgagtttctgcgcttcaaggaggaacttgttgatggaagttccaatggaaattttgtgcttgaattggactttgaaccattcactgcatccttccctcgcccaactctcaacaagtctatcggaaatggtgtgcaatttctcaaccgccacctttctgccaagctcttccatgacaaggagagcttgcaccctcttttggagttcctcaggcttcacagtgtcaagggaaagactttgatgttgaatgacagaattcaaaacccggattctcttcaacatgttctgaggaaagctgaggagtatctgggaacaattcctcctgaaactccctactcagcatttgagcacaagttccaggagattggtttggagagagggtggggtgacaccgcagagcgtgttcttgagtcaattcagcttctcttggatcttcttgaggcccctgacccgtgcacccttgagaccttccttggaagaatccctatggtcttcaatgttgttattctttctccccacggttactttgctcaagacaatgtgttgggataccctgacactggtggtcaggttgtttacatcttggatcaagtccgtgctttggagaatgagatgctccatcgcattaagcaacaaggattggacattgttcctcgcattctcatcatcacccgtcttctcccagatgccgtaggaactacctgtggccaacgtcttgagaaggtgttcggaaccgagcactcccacattcttcgagttcccttcagaaatgagaagggtattgttcgcaagtggatctcaagattcgaagtctggccctacttggaaacctacaccgaggatgttgctcatgagcttgccaaggagttgcaaggcaagccagatctgatcgttggaaactacagtgatggaaacattgttgcttctttgctggcacacaaattaggtgtcactcagtgtaccattgctcacgcacttgagaagaccaaataccccgaatccgacatttactggaaaaaattggaagagagatatcacttctcttgccaattcacagctgatctctttgccatgaaccacactgacttcattatcaccagtaccttccaagagattgctggaagcaaggacactgttggacagtatgagagtcacactgccttcacccttcctggactctaccgtgttgtgcatggtattgatgtctttgatccaaaattcaacattgtctcccccggagctgatcaaaccatttacttcccatacaccgaaaccaaccgcaggttgacctccttccaccccgaaattgaagagcttctctacagctcagtggagaatgaggaacacatatgtgtgttgaaggaccgcagcaagccaatcatcttcaccatggccaggttggaccgtgtgaagaacatcaccggacttgtggagtggtacggcaagaacgcgaaactgagggagttggtgaaccttgtggtggttgccggagacaggaggaaggagtcgaaggacttggaggagaaggctgagatgaagaagatgtatggcctgattgagacctacaagttgaacggccaattcagatggatttcctctcagatgaaccgtgtgaggaacggagagctctaccgtgtgatctgtgacacaaagggagcctttgtgcagcctgcagtgtatgaggcttttggtttgacagtggttgaggccatgacttgtggtttgccaacctttgccacatgcaatggtggccctgctgagatcattgtgcatggcaagtctggcttccacattgacccttaccatggtgaccgtgctgctgaacttcttgttgaattctttgagaagtgcaaggttgacccatctcactgggacaagatctccctgggtggtctccagcgtattgaagagaagtacacatggcaaatttactctcagaggcttcttactctcactggtgtctatggcttctggaagcatgtctctaaccttgaccgccgtgagagccgccgctatcttgagatgttctatgctctcaaataccgcaaattggctgagtctgtgcctcttgctgttgagtaaactgaggatgaagagttggatggataaagaaatggaggaaccggctttttctttctcatttggagtctgtcgtacttgagttttataaataatgttcaatattttagttttgtgattaagctttcgataagaggagagagagggagaaaaaaaaagccttttttttttttttttgcatgatttggatcttgattggaaaaagcttcgaattggggtgttttacccgtcaattcaattttaagccgtgccttcttcactttgcacgtgtccatgttcccctcccaagtcccaactttacttttatgcactgtagttctttttatctttaaactcaaacaaaatcttaaaaaacaagacatcatcataatagctagaggctaagtaaggagtaaggtccccccgcaatttcatccgttgttgtctatgaatcggaagaaagtgaaaattgatgtcggaatttaaagatttaattgtcgttgt

SEQ ID NO: 2407 - DNA, 2779 bp, Trigonella foenum-graecum
tcatcccttctctttacacccccccttcttttttgcgttcactctgttttcatagttgaagattttgaatggctactgaacgtttgactcatgttcatagtctccgtgagaggcttgatgaaaccttaactgctaatagaaatgaaattttggcccttctttcaaggcttgaagcaaagggaaagggaattttgcaacaccatcaagtgattgctgagtttgaggaaattcctgaagagagtagaaagaagctgactgatggtgcatttggtgaagttctaagatccacacaggaagcaatagttttgccaccatgggttgcacttgctgttcgtccaaggccaggtgtttgggagtatctgagagtgaatgtgcatgctcttgttgttgagaatttgcaacctgctgagtttctcaaattcaaggaagaacttgttgatggaagtgctaatggaaactttgtacttgaattggactttgaaccatttactgcatctttccctcgtcctactctcaacaagtcaattggaaatggtgttcaattcctcaatcgccacctttctgctaaactcttccatgacaaggaaagtttacacccacttttggaatttctcagacttcacagctacaagggaaagacattgatgttgaatgacagaattcaaaaccctaattctcttcaacatgttctgaggaaagctgaagagtatctaagcacaattgctcctgatacaccatactcagaatttgaacacaggttccaggagattggtttggagagaggttggggtgacaccgcagagcgcgtcctcgagtccatccaacttctcttggatcttcttgaggctcctgacccttgcacccttgagagtttccttgatagaatccccatggtctttaatgttgtcatcctttctcctcatggttactttgctcaagatgatgttttgggataccctgatactggaggccaggttgtttacatcttggatcaagtccgtgccttggagagcgagatgctcaatcgcattaagaaacaaggcttggatatcgtccctcgtattctcattatcactcgtcttctccccgatgcagtcggaactacttgtggccaacgacttgagaaggtctatggaaccgagcattgccacattcttcgagttcccttcagagatcagaagggtattgttcgcaagtggatctcacgatttgaagtctggccctatctagaaacttacactgaggatgttgctcatgagcttgccaaagagttgcaaggaaaaccagatctgattgttggaaactacagtgatggaaacattgttgcctctttgttggcacataaattaggtgtcactcagtgtaccattgctcatgcacttgagaagactaagtaccccgaatccgatatttactggaaaaaattcgaagagaagtatcacttctcctgccaatttaccgctgatcttttcgcaatgaaccacacagatttcatcatcactagtaccttccaagagattgctggaagcaaggataaggttggacagtatgagagtcacactgcctttactcttccaggactctaccgtgtcgtgcacggtattgatgtctttgatccaaagtttaacattgtatctccaggagctgatcagaccatttacttcccttacactgaaactagccgccgattgacatccttctaccctgaaatcgaagagcttctttacagctcagttgaaaatgaagagcacatatgtgtgctgaaggaccgcaacaagccaattatcttcaccatggcaaggttggaccgtgtgaagaacattacaggacttgttgagtggtacggcaagaatgccaagcttcgtgagttggtgaaccttgttgttgttgccggagacaggaggaaggagtcaaaggacttggaagagatagctgagatgaagaagatgtatggcctaatcgagacctacaagttgaatggccaattcagatggatttcctctcagatgaaccgtgtcagaaacggagagctgtaccgtgtgatttgtgacaccaagggagctttcgtgcaaccggctgtgtacgaagctttcggtttgacagttgttgaggccatggctactggactgccaacatttgcaactcttaatggtggccctgctgagatcattgtccatggcaaatctggattccacattgatccttaccatggcgaccgcgctgctgatctccttgttgaattctttgagaaggtcaaggttgatccatctcactgggacaagatctctcaaggtggtctccaacgtattgaagagaagtatacatggacaatttactctcagagacttcttacactcactggtgtctatggcttctggaagcatgtgtctaacctcgaccgtcttgagagccgccgctatcttgagatgttctatgctctcaagtaccgcaaattggctgagtctgttcccctagctgttgaggagtaaaatctgaggcttgaagagttaagatgaagaaaatggagaaaccggctttgttcttatttggagtcttgttttgagttttataaataaaaatgtcaatgattttgattttgttcatttaagctttggataaaaaaaaagtaattgtcaatgtctttttcttttgcatgatttgaaatgtaattgggaagcttgaatggtgggtgttatacccatcaattcaattttaagccgtgcctttttattgtccatattctcctccaacttttctctttatgttttttctttctatt

SEQ ID NO: 2408 - DNA, 2713 bp, Arachis hypogaea
tcttttttgcgtttactgtgttttctttctctcataggtggatcggtgagagggcatggccagcgaccgtttgacccgcgttcacagcctccgtgaaaggcttgacgaaaccctgacagccaacaggaatgagattctagctcttctgtcgaggatcgaagccaagggtaaggggatcttgcaacaccaccaagtgattgctgagtttgaggaaatccctgaggagaacaggcagaagctaactgatggtgcttttggagaagttcttagatctactcaggaagcaattgttttgcctccctgggttgctctggcagttcgtccaaggcctggtgtttgggagtaccttcgtgtcaatgtccatgctcttgttgtagaagagttgcaagctgccgagtacttgcgcttcaaggaggagcttgttgatggaagttctaatgccaacttcgttcttgagttggacttcgagcccttcactgcctccttccctcgcccaactctcaacaagtctatcggtaacggcgtgcagttccttaaccgccacctgtccgcaaaactcttccatgacaaggagagcttgcatccgcttcttgaattcctcaggcttcacagctacaagggcaagacgttgatgttgaacgacagaatccataacccagattcactccaacatgttctaaggaaggcggaggagtatctgggaacccttcccgctgagactccttactcagaattcgagcacaagttccaggagattggattggagagagggtggggtgacaccgccgagcgtgtccttgagtccatccaactcctcttggaccttcttgaggctcctgatccctgcacccttgagaccttcctcgatagaattcccatggtcttcaacgttgtcatcctctctccccatggttacttcgcccaagacaacgttttgggctaccctgacaccggtggccaggttgtttacatcttggatcaagttcgtgctttggaaaatgagatgctccaccgcatcaagcaacaaggcttggatatcgtacctcgcattctcatcatcacccgtcttctccctgatgccgtaggaaccacttgtggccaacgtcttgagaaggtttttgggaccgagcactctcacattcttcgtgttcccttcagaacagagaagggaattgttcgcaaatggatctcaagattcgaagtctggccctatttggaaacttacaccgaggatgttgcacatgaacttgccaaggaattgcaaggcaagccagatttgattgttggaaactacagtgatggaaacattgttgcctccttgttggcacacaaactaggtgtcactcagtgtaccattgctcatgcacttgagaagaccaagtatccggaatccgacatttactggaagaagtttgaagagaagtatcacttctcatgccaattcacagctgatcttttcgccatgaaccacactgacttcatcatcaccagtacattccaagaaattgccggaagcaaggacacagttggacagtatgagagtcacacagcattcaccctccccggactgtaccgtgttgttcacggcattgatgtgttcgatccaaagttcaacattgtgtcccctggtgctgaccaaaccatttacttcccatacaccgatggtagccgcaggttgactgcattccacccggagatcgaagagcttctctacagctcagtggagaatgaagaacacatttgtgtgttgaaggaccgcagcaagccaatcatcttcaccatggctaggttggaccgcgtcaagaacatcaccggacttgtggaatggtacggcaaaaacgcccgcctgcgcgagcttgtgaacttggttgtggtggccggagacaggaggaaggagtcgaaggatcttgaggagaaggcggagatgaagaagatgtacgggctgatcgagacgtacaagctgaacgggcagttcaggtggatctcgtcacagatgaaccgtgtgaggaatggagagctgtaccgtgtaatctgcgacaccaagggagcgttcgtgcagcccgccgtgtacgaagcgttcgggttgacggtggttgaggccatgacatgcggcttgccaaccttcgcaacatgcaatggtggtcctgctgagatcattgttcatggcaagtcgggcttccacatcgacccttaccatggtgaccgcgccgctgatctgctcgttgatttctttgacaagtgcaaggttgatccaacccactgggacaagatttcccagggtggtctccagcgtattgaagagaagtacacatggcaaatctactctcagaggcttttgactctaaccggtgtctatggcttctggaagcatgtctccaaccttgaccgccgtgagagccgccgttaccttgagatgttctatgctcttaaataccgcaaattggccgagtctgtgccacttgctgtggaggagtaaacgagcaagctaagagaatatggatgatggaggatccggctttttctctatttcgagtctttatttctctttgggttttataaataatgtggaaaatgattttgaattttgtcaattaggattttggataaaaaaagttgagaaaaatagtcttttctcggttttttttttttttgggtatgatttgaatgttgattgcaaagccttgaatgttgggtggggtttacccgttatttc

SEQ ID NO: 2409 - DNA, 2760 bp, Arachis hypogaea
attcctcttctcattaaccccccctctcttttttgcgtttactgtgttttctttctctcataggtggatcggtgagagggcatggccagcgaccgtttgacccgcgttcacagcctccgtgaaaggcttgacgaaaccctgacagccaacaggaatgagattctagctcttctgtcgaggatcgaagccaagggtaaggggatcttgcaacaccaccaagtgattgctgagtttgaggaaatccctgaggagaacaggcagaagctaactgatggtgcttttggagaagttcttagatctactcaggaagcaattgttttgcctccctgggttgctctggcagttcgtccaaggcctggtgtttgggagtaccttcgtgtcaatgtccatgctcttgttgtagaagagttgcaagctgccgagtacttgcgcttcaaggaggagcttgttgatggaagttctaatgccaacttcgttcttgagttggacttcgagcccttcactgcctccttccctcgcccaactctcaacaagtctatcggtaacggcgtgcagttccttaaccgccacctgtccgcaaaactcttccatgacaaggagagcttgcatccgcttcttgaattcctcagacttcacagctacaagggcaagacgttgatgttgaacgacagaatccacaacccagattcactccaacatgttctaaggaaggcggaggagtatctgggaacccttccctcggagactccttactcagaattcgagcacaagttccaggagattggattggagagagggtggggtgacaccgccgagcgtgtccttgagtccatccaactcctcttggaccttcttgaggctcctgatccctgcacccttgagacattcctcgatagaattcccatggtcttcaacgttgtcatcctctctccccatggttacttcgcccaagacaacgtcttgggctaccctgacaccggtggccaggttgtttacatcttggatcaagttcgtgctttggaaaatgagatgctccaccgcatcaagcaacaaggcttggatatcgtacctcgcattctcatcatcacccgtcttctccctgatgccgtaggaaccacttgtggccaacgtcttgagaaggtttttggaaccgagcactctcacattcttcgtgttcccttcagaacagagaagggaattgttcgcaaatggatctcaagattcgaagtctggccctatttggaaacttacaccgaggatgttgcacatgaacttgccaaggaattgcaaggcaagccagatttgattgttggaaactacagtgatggaaacattgttgcctccttgttggcacacaaactaggtgtcactcagtgtacaattgctcatgcacttgagaagaccaagtatcccgaatccgacatttactggaagaagtttgaagagaagtatcacttctcatgccaattcacagctgatcttttcgccatgaaccacactgacttcatcatcaccagtacattccaagaaattgccggaagcaaggacacagttggacagtatgagagtcacacagcattcaccctccccggactgtaccgtgttgttcacggcattgatgtgttcgatccaaagttcaacattgtgtcccctggtgccgatcaaaccatttacttcccatacactgatggtagccgcaggttgactgcattccacccggagatcgaagagcttctctacagctcagtggagaatgaagaacacatttgtgtgttgaaggaccgcagcaagccaatcatcttcaccatggctaggttggaccgtgtgaagaacatcaccggacttgtggagtggtacggcaaaaacgcccgcctgcgtgagctggtgaacttggttgtggtggccggagacaggaggaaggagtcgaaggatcttgaggagaaggcggagatgaagaagatgtacgggctgatcgagacgtacaagctgaacgggcagttcaggtggatctcgtcacagatgaaccgtgtgaggaatggagagctgtaccgtgtaatttgcgacacgaagggagcgttcgtgcagcccgccgtgtacgaagcgttcgggttgacggtggttgaggccatgacatgcggcttgccaaccttcgcaacatgcaatggtggtcctgctgagatcattgttcatggcaagtcgggcttccacattgacccttaccatggtgaccgcgccgctgatctgctcgttgatttctttgacaagtgcaaggttgatccaacccactgggacaacatttcccagggtggtctccagcgtattgaagagaagtacacatggcaaatctactctcagaggcttttgactctaaccggtgtctatggcttctggaagcatgtctccaaccttgaccgccgtgagagccgccgttaccttgagatgttctatgctcttaaataccgcaaattggccgagtctgtgccacttgctgtggaggagtaaacgagagacgagtagatacaagcaagctaagggaatatggatgatggaggatccggctttttctctatttcgagtctttatttctctttgggttttataaataatgtggaaaaatgattttgaattttgtcaattaggattttggataaaaaaagttgagaaaaatagtcttttctcggttttttttttttttcttttttatgatttgaatgttgattgcaaagccttgaatgttgggtggggtttacccgttatttc

SEQ ID NO: 2410 - DNA, 2687 bp, Vigna unguiculata
gtttttttgaagtctttccctgtgatatttcaagccaatggctaccgatcgtttgacccgtgttcacagtctccgtgagaggcttgatgaaaccctgtctgccaacaggaacgaaattctggcccttctgtcaaggatcgaaggcaagggcaaggggattttgcaacaccatcaggtcattgccgagtttgaggaaatccccgaggagagcagacagaagcttactgatggtgcctttggagaagttttgagatctactcaggaagccatagttttgccaccatgggttgctctggccgttcgtccaaggcctggtgtgtgggagtacctgagagtgaatgtgcacgctctagttgttgaggtgttgcaacctgctgagtacctgcgcttcaaggaggaacttgttgatggaagttctaatggcaactttgtgcttgagttggactttgaaccctttaccgcatccttcccccgcccaactcttaacaagtcaattggaaatggcgtgcagttcctcaaccgtcacctttctgccaaactcttccatgacaaggagagcttgcacccgcttttggaattcctcaggcttcacagcgtcaagggaaagactttgatgttgaatgacagaattcaaaacccggatgctcttcaacatgttctgaggaaagctgaggagtatctgggcacagtgcctcctgaaaccccctactcagcatttgagcacaagttccaggagattggtttggagagagggtggggtgacaacgcagagcgtgtactcgagtcaattcaacttctcttggatcttcttgaggcccctgatccgtgcacccttgagactttccttggaagaatccctatggtctttaatgttgttattctttctccccatggctactttgcccaagataatgtcttgggataccctgacaccggtggtcaggttgtttacatcttggatcaagttcgtgctttggagaatgaaatgctccatcgcattaagcaacaaggattggacattgttcctcgtattctcatcatcacccgtcttctaccagatgcagtaggtactacttgcggccaacgtcttgagaaggtgtttggaactgaacactctcacattctacgagttccctttagaactgagaacggaattgttcgcaagtggatctcaagattcgaagtctggccctacttggaaacttacaccgaggatgttgctcatgagcttgcaaaagagttgcaaggcaagccagatctgatcgttggaaactacagtgatggaaacattgttgcctctttgttggcacataaattaggtgtcactcagtgtaccattgctcatgcacttgagaagaccaaataccctgaatccgacatttactggaaaaaactggaagagagataccacttctcttgccaattcacagccgatctatttgccatgaaccacacagatttcatcatcaccagtacattccaagagattgctggaagcaaggacactgttggacagtatgagtctcacacagccttcacccttcctggactctaccgtgttgtgcacggtattgatgtcttcgacccaaaattcaacattgtctctcccggagctgatcaaaccatttacttcccccacaccgaaactagccgcaggttgacctctttccacaccgaaatcgaagagcttctctacagttcagtcgagaacgaagaacacatatgtgtgctgaaggaccgcacgaagccaataatcttcaccatggcaaggttggaccgcgtgaagaacatcacaggactggtggagtggtacggtaagaacgcgaagctgagggagttggtgaacctcgtggtcgttgccggagacaggaggaaggagtcgaaggacttggaagagaaggcggagatgaagaagatgtatagcctgatcgagacgtacaagttgaacgggcaattcagatggatttcatctcaaatgaaccgtgtgaggaatggagagctgtaccgtgtgatcgccgacaccaagggtgcgtttgtgcagcctgcagtgtacgaggcatttggtttgacagtggttgaggccatgacttgtgggttgccaacatttgcaacatgcaatggaggacctgccgagatcatcgtccatggaaaatctgggttccacattgatccttaccacggtgaccgtgctgctgacctccttgttgagttctttgagaaggtcaaggttgacccatctcactgggacaagatctctcaagccggtctccaacgtattgaagagaagtacacatggcaaatttactcccagaggcttctcacactcaccggtgtgtatggtttctggaagcatgtgtctaacctggatcgccgtgagagtcggcgctatcttgagatgttctatgctctcaagtaccgcaaattggctgagtctgtgccccttgctgttgagtaaaaaactgaggatgaagaaatggaggaaccggctttttctttctcatttggagtttgtcgtacttgagtttcataaataatgtccatcatgttaattctgtgattaagtttcgataagaagagagagagagagagagaggaaaaaaaaagctcttttgttttttttctttttgcatgatttggatctttgattgaaaaatcttggaattggggtgttttgcccatcaattcag

SEQ ID NO: 2411 - DNA, 2774 bp, Lotus japonicus
ttcattcatcccttctcttcgtacatcccctctctattttgcgtttactctgttttcatcatggccaatggcctgacccgagttcacagcctccgggagaggcttgatgagacccttgctaccaacaggaatgaaattttgacccttctgtcaaggattgaagccaagggcaaggggatcctgcaacatcaccagatcattgctgagtttgaggaaattcctgaagagaacaggcagaagctaactgatggagcttttggagaagttttgagatccacacaggaagccatagttttaccaccatgggttgctcttgctgttcgtccaaggcctggtgtttgggagtatctgagagtgaatgtgcatgctcttgttgttgaagagctgcaacctgctgagtttctgcacttcaaggaggaacttgttgatggaagttctaatggcaactttgtgcttgagttggactttgaaccatttaatgcatcgtttcctcgcccaactctgaacaagtcaattgggaatggtgtggaattcctcaatcgccacctttctgctaaactcttccatgacaaggagagcttgcatccacttctggaatttctcagacttcacaactacaatggaaagactttgatgttgaatgacaggattcagaccccaaatgctctccaacatgttctgaggaaagctgaagagtacctaggcacacttcctcttgagacaccttactcagaatttgagcacaagttccaggaaattggtttggagagagggtggggtgacactgctgagcgtgtccttgagtccattcaactccttttggatcttcttgaggcacctgacccgtgcaccctcgaaactttcctaggaagaatccctatggtctttaatgtggtgatcctttcaccccatggttactttgctcaagacaatgtcttgggttaccctgatactggtggccaggttgtttacatcttggatcaagtgcgtgcattggagagtgagatgctccaacgcattaagcaacaaggcttggatattgttcctcgcattctcattatcactcgtcttctccctgacgcagtgggaactacttgtggccaacgtcttgagaaggtgtataacaccgagcactgccacattcttcgagtgcccttcagaaatgagaagggaattgtccgtaaatggatctcaagattcgaagtctggccctacctagaaacttatactgaggatgttgctcatgagcttgccaaagagttgcaagggaagcctgatctgatcgttggaaactacagtgatggaaacatcgttgcctctttgttggcacataaattgggtgtcactcagtgtaccattgctcatgcacttgagaagaccaaataccccgaatccgacatctactggaagaaattcgaagagaagtatcacttctcatgccaatttacagctgatctctttgcaatgaatcacactgacttcatcatcaccagtacattccaagagattgctggaagcaaggatactgtaggacagtatgagagccacactgccttcacccttccaggactctaccgagtcgtccacggtatcgatgtcttcgatccaaagttcaacattgtctcacccggagctgatcagaccatttacttcccgtacactgaaactagccgtaggttgacatccttccaccctgaaattgaagagcttctatacagctcagtcgagaacgaagaacacatatgtgtgttgaaggaccgaagcaagccgattatcttcaccatggcgaggttggaccgtgtgaagaacattacaggacttgttgagtggtatggcaagaatgctaagctgagggagctggtgaaccttgtggttgttgctggagacaggaggaaggagtcaaaggacttggaagagaaagctgagatgaagaagatgtatagcctgattgagacctacaagctaaatgggcaattccggtggatttcatctcagatgaacagggtcaggaacggagagctgtaccgtgtcatttgcgacacgaagggagcgttcgtgcagcctgctgtgtatgaagcttttggtttgacagtggttgaggccatgacttgtgggttgccaacatttgctacctgcaatggtggtcctgctgagatcattgtgcatggaaaatctggtttccacattgacccttaccatggtgaccgtgctgccgatttacttgttgagttctttgagaaggttaaggttgatccaactcactgggacaatatctctcatggtggtcttcagcgtattgaagaaaagtacacatggcagatttactctcagaggcttctcactctcactggtgtctatggcttctggaagcatgtgtctaaccttgaccgccttgagagccgccgctatcttgagatgttctatgcacttaagtaccgcaaattggctgagtctgtgccccttgctgttgaagagtgaaaacatgaggctgacgaagagtagataaaagaaatggaggaaccggctttttcctttttatttttatttggagtctgttgttttgagtcttataaataatgtcaattattttgattttgttattaagctttggataaaatgaagaaaaaaaagagtcattgtcttttgttgtagcatgatgtgaatgtaattggaaaaagctttgaaagggtgttgtccccatccattcaatttcaagtagtgctttcttctttgttcactttgctgtttgttaatgacttttgttgtctttatcc

SEQ ID NO: 2412 - DNA, 2711 bp, Pisum sativum
tttacaccccctatctttcttgcgttcaccctgttttcattttcatagttgaagaatttcaatggctactgatcgattgactcgtgttcatagtctccgagagaggctcgatgaaaccttgactgctaataggaatgaaattttagctcttctttcaaggattgaagcaaagggaaagggaattttgcaacaccatcaagtgattgctgagtttgaagaaattcccgaagagaatagacagaagctgactgatggtgcatttggtgaagttctcagatccacacaggaagctatagttttgccaccatgggttgctcttgctgttcgtccaaggccaggtgtctgggagtatctgagagtgaatgtgcatgctcttgtggttgaaaatttgcaacctgctgagtttctcaaattcaaggaagaacttgttgatggaagtgctaatggtaactttgtgcttgaattggactttgaaccatttactgcatctttccctcgtcctactctcaacaaatcaattggaaatggtgttcagtttctcaaccgtcacctttctgccaaactcttccatgacaaggagagtttgcatccacttttggaatttctcagacttcacagctacaaggggaagacattgatgttgaatgacagaattcagaaccctgattctcttcaacatgttctgagaaaggctgaagagtatctaggcacagttgctccggatacaccgtactccgaattcgaacacaggttccaggagattggtttggagagaggttggggagacaccgcagagcgcgtgctcgagtccattcagcttctattggatcttcttgaggctcctgatccttgcacccttgagactttccttgacagaatccctatggtgtttaatgttgtcattctttctcctcacggttactttgctcaagatgatgtcttgggataccctgataccggtggtcaggttgtttacattttggatcaagttcgtgccttggagagcgagatgctcaatcgcattaagaaacaaggcttggatatcgttcctcgcattctcattatcacccgtcttctcccagacgcagtcggaactacttgtggccaacgactcgagaaggtctatggaaccgagcattgccacattcttcgagttcccttcagagatcagaagggaattgttcgcaagtggatctcgcgtttcgaagtctggccatatctagaaacctacaccgaggatgttgctcatgagcttgccaaagagttgcaaggcaaaccagatttgattgttggaaactacagtgatggaaacattgttgcttctttgttggcacataaattaggtgtcactcagtgtactattgctcatgcacttgagaagactaagtatcctgaatctgatatttactggaaaaaattcgaagagaagtatcacttctcctgccaatttaccgccgatcttttcgcaatgaaccacacagatttcatcatcacaagtaccttccaagagattgctggaagcaaggatactgttggacagtatgagagtcacactgccttcactcttccgggactgtaccgtgtcgtgcacggtattgatgtctttgatcctaagttcaacattgtatctcctggagctgatcagaccatttacttcccttacaccgaaactagccgcaggttgacatcattctaccctgaaattgaagagcttctttacagcacaggggaaaatgaagaacacatatgtgtgctcaaggaccgcaacaagccgattatcttcaccatggcaaggttggaccgtgtgaagaacattacaggacttgttgaatggtacggaaagaatgccaagcttcgtgagttggtgaacctcgtagttgttgccggagacagaaggaaggagtcaaaggacttggaagagaaagctgagatgaagaagatgtacgaacatatcgagacctacaagttgaatggccaattcagatggatttcgtctcagatgaaccgtgtcagaaacggagagctctaccgtgtgatctgtgacacaaaaggagctttcgtgcagcctgctgtctacgaggctttcggtctaacagtcgttgaggccatggctaccggattaccaacattcgcaacactcaatggtggacctgctgagatcattgtccatggaaaatctggattccacatcgatccataccacggcgaccgcgctgctgatctcctagtcgaattcttcgagaaagttaagactgatccatctcactgggacaagatctctcaaggtggtctccaacgtattgaagagaagtacacatggcaaatttactctcagaggcttcttacactcactggtgtctatggtttctggaaacatgtttctaacctcgaccgcctcgagagccgccgctatctcgagatgttctatgctctcaagtaccgcaagttggctgagtctgtgcctctagctgttgaggagtgattgaagaaatgaaggaaccggctttttttctttcttatctggagtctgttgtttttgagtttttataaataaatttgtcaatgattttgattttgttgttgattaagctttggataaagaaaatgtcaatgtctttttcttttgcatgatttgaaatgtgattgggaatgtggtcccttcttcaaattgttgttaatattcgttcaacttatgttatcaaatcaaattc

SEQ ID NO: 2413 - DNA, 3058 bp, Glycine max
catctgtgaaattccaattctgcttcgcgctcctgtctataaattgacttagccaccacctcagtttccattcattcacttcttctctttataccccccctctcttttttgcgttcattctgttttcctgttgaagtctttccctagccaatggccaccgatcgtttgacccgggttcacagtctccgtgagaggcttgatgaaaccctcactgccaacaggaatgaaattttggcccttctgtcaaggatcgaagccaagggcaagggcatcctgcaacaccaccaggtcattgctgagtttgaggaaatccctgaggagaacagacagaagctcactgatggtgcctttggagaagtcttgagatctacacaggaagccatagttttgccaccatgggttgctctggctgttcgtccaagacctggtgtgtgggagtacctgagagtgaatgtgcacgctcttgttgttgaggagttgcaacctgctgagtacctgcacttcaaggaagaacttgttgacggaagttctaatggcaactttgtgcttgagttggactttgaaccattcaatgcagccttcccccgcccaactcttaacaagtcaattggaaatggtgtgcaattcctcaaccgtcacctttctgccaaactcttccacgacaaggagagcttgcacccacttttggagttcctcaggcttcacagcgtcaagggaaagactttgatgttgaatgacagaattcaaaacccagatgcactccaacatgttctgaggaaagctgaggagtatctgggcacagtgcctcctgaaactccctactcagaatttgagcacaagttccaggagattggtttggagagagggtggggtgacaacgcggagcgtgtccttgagtcaattcaacttctcttggatcttcttgaggcccctgacccgtgcacccttgagactttccttggaagaatccctatggtgttcaatgttgttattctttctccccatggttactttgcccaagataatgtcttgggataccctgacactggtggccaggttgtttacatcttggatcaagttcgtgctttggagaatgagatgctccatcgcattaagcaacaaggattggacattgttcctcgtattctcattatcacccgtcttctccccgatgcagtaggaactacttgtggccaacgtcttgagaaggtgttcggaactgagcactcccacattcttcgagttccctttagaactgagaagggaattgttcgcaagtggatctcaagattcgaagtctggccctacttggaaacttacactgaggatgttgcccacgagcttgccaaagagttgcaaggcaagccagatctgattgttggaaactacagtgatggaaacattgtcgcttctttgttggcacataaattaggtgtcactcagtgtaccattgctcacgcacttgagaagaccaaataccccgaatccgacatttactggaaaaaattggaagagagataccacttctcttgccaattcacagctgatctatttgccatgaaccacacagatttcattatcaccagtaccttccaggagattgctggaagcaaggacactgttggacagtacgaatctcacacagccttcacccttcctggactctaccgcgttgtgcatggtattgatgtctttgatccaaaattcaacattgtctcccctggagctgatcaaaccatttacttcccccacactgaaaccagccgtaggttgacatccttccaccctgaaatcgaagaactcctttacagctcagtggagaatgaagaacacatatgtgtgctgaaggaccgcagcaagccaattatcttcaccatggcaaggttggatcgagtgaagaacatcacaggacttgtggagtggtacggtaagaacgcgaagctgagggagctggtgaaccttgtggttgttgctggagacaggaggaaggagtcaaaggacttggaagaaaaggccgagatgaagaagatgtacggcctgatcgagacctacaagttgaacggccaattcagatggatttcatcgcagatgaaccgtgtgaggaatggagagctctaccgcgtgatctgcgacaccaggggtgctttcgtgcagcctgctgtatacgaggcttttggtttgacagtggttgaggccatgacttgcggcttgccaacattcgccacatgcaatggtggtcctgctgagatcattgtgcacggcaagtctggcttccacattgacccttaccatggtgaccgtgctgctgatctccttgttgacttctttgagaagtgcaagcttgacccaactcactgggacaagatctcaaaggctggtctccagcgtattgaagagaagtacacatggcaaatttactctcagaggcttctcactctcaccggtgtctatggcttctggaagcatgtgtctaaccttgaccgccgtgagagccgccgctatctcgagatgttctatgctctcaagtaccgcaaattggctgagtctgtgccccttgctgctgagtaaactgaggataaagagttggataaagaaatggaggaaccggctttttctttctcatttggagtttgtcgcacttgagttttataaataatgtccgtgattttagttttgtgattaagctttcgataagaggagagaaagagaaggaaaaaaaaagttgcttttttttttgttgttgcatgatttggatcttgattggaaaagcttcgaattggggtagttttacccatcaattcaattttaagccgtgccttcttcactttgccgtgtctaatagtatcccttcccaacttaaacttttatatactgtagttctttttatctttaaacttaaaacaaagccatgaaaaagcatcatcatcatcataataactagagactagagtattgtaggacaaaggggcccccgcaatttcatccgttattgtctatatcaatatggtggaagaaagtgaaaattgacgttggaatttaaagatttaattgtcgttgt

SEQ ID NO: 2414 - DNA, 2763 bp, Glycine max
ctttataccccccctctcttttttgcgttcattctgttttcctgttgaagtctttccctagccaatggccaccgatcgtttgacccgggttcacagtctccgtgagaggcttgatgaaaccctcactgccaacaggaatgaaattttggcccttctgtcaaggatcgaagccaagggcaagggcatcctgcaacaccaccaggtcattgctgagtttgaggaaatccctgaggagaacagacagaagctcactgatggtgcctttggagaagtcttgagatctacacaggaagccatagttttgccaccatgggttgctctggctgttcgtccaagacctggtgtgtgggagtacctgagagtgaatgtgcacgctcttgttgttgaggagttgcaacctgctgagtacctgcacttcaaggaagaacttgttgacggaagttctaatggcaactttgtgcttgagttggactttgaaccattcaatgcagccttcccccgcccaactcttaacaagtcaattggaaatggtgtgcaattcctcaaccgtcacctttctgccaaactcttccacgacaaggagagcttgcacccacttttggagttcctcaggcttcacagcgtcaagggaaagactttgatgttgaatgacagaattcaaaacccagatgcactccaacatgttctgaggaaagctgaggagtatctgggcacagtgcctcctgaaactccctactcagaatttgagcacaagttccaggagattggtttggagagagggtggggtgacaacgcggagcgtgtccttgagtcaattcaacttctcttggatcttcttgaggcccctgacccgtgcacccttgagactttccttggaagaatccctatggtgttcaatgttgttattctttctccccatggttactttgcccaagataatgtcttgggataccctgacactggtggccaggttgtttacatcttggatcaagttcgtgctttggagaatgagatgctccatcgcattaagcaacaaggattggacattgttcctcgtattctcattatcacccgtcttctccccgatgcagtaggaactacttgtggccaacgtcttgagaaggtgttcggaactgagcactcccacattcttcgagttccctttagaactgagaagggaattgttcgcaagtggatctcaagattcgaagtctggccctacttggaaacttacactgaggatgttgcccacgagcttgccaaagagttgcaaggcaagccagatctgattgttggaaactacagtgatggaaacattgtcgcttctttgttggcacataaattaggtgtcactcagtgtaccattgctcacgcacttgagaagaccaaataccccgaatccgacatttactggaaaaaattggaagagagataccacttctcttgccaattcacagctgatctatttgccatgaaccacacagatttcattatcaccagtaccttccaggagattgctggaagcaaggacactgttggacagtacgaatctcacacagccttcacccttcctggactctaccgcgttgtgcatggtattgatgtctttgatccaaaattcaacattgtctcccctggagctgatcaaaccatttacttcccccacactgaaaccagccgtaggttgacatccttccaccctgaaatcgaagaactcctttacagctcagtggagaatgaagaacacatatgtgtgctgaaggaccgcagcaagccaattatcttcaccatggcaaggttggatcgagtgaagaacatcacaggacttgtggagtggtacggtaagaacgcgaagctgagggagctggtgaaccttgtggttgttgctggagacaggaggaaggagtcaaaggacttggaagaaaaggccgagatgaagaagatgtacggcctgatcgagacctacaagttgaacggccaattcagatggatttcatcgcagatgaaccgtgtgaggaatggagagctctaccgcgtgatctgcgacaccaggggtgctttcgtgcagcctgctgtatacgaggcttttggtttgacagtggttgaggccatgacttgcggcttgccaacattcgccacatgcaatggtggtcctgctgagatcattgtgcacggcaagtctggcttccacattgacccttaccatggtgaccgtgctgctgatctccttgttgacttctttgagaagtgcaagcttgacccaactcactgggacaagatctcaaaggctggtctccagcgtattgaagagaagtacacatggcaaatttactctcagaggcttctcactctcaccggtgtctatggcttctggaagcatgtgtctaaccttgaccgccgtgagagccgccgctatctcgagatgttctatgctctcaagtaccgcaaattggctgagtctgtgccccttgctgctgagtaaactgaggataaagagttggataaagaaatggaggaaccggctttttctttctcatttggagtttgtcgcacttgagttttataaataatgtccgtgattttagttttgtgattaagctttcgataagaggagagaaagagaaggaaaaaaaaagttgcttttttttttgttgttgcatgatttggatcttgattggaaaagcttcgaattggggtagttttacccatcaattcaattttaagccgtgccttcttcactttgccgtgtctaatagtatccct

SEQ ID NO: 2415 - DNA, 2694 bp, Cicer arietinum
ttttgcgtttattctgttttcatagtttgattttgtgagccaatggctacggatcgtttgactcgagttcacagtctccgtgagaggattgatgaaaccttaactgctaatagaaatgaaattttggcccttctatcaaggattgaagcaaagggaagggaatcctgcaacatcaccaaatcattgctgagtttgaggaaattcctgaggagcctagacagaagttgactgatggtgcatttggtgaagttttgagatccacacaggaagcaatagttttgccaccatgggttgctctagctgttagaccaagacctggtgtttgggaatatctgagagtgaatgtgcatgctcttgttgttgaagaattgcaacctgctgagtttttgaaattcaaggaagaacttgttgatggaagtgctaatggaaactttgtgcttgagttggactttgaaccatttactgcatctttccctcgtcccactctcaacaagtcaattggaaatggtgtccaattcctcaaccgtcacctttctgctaaactcttccatgacaaggagagtttacatccacttcttgaattcctcagacttcacagctacaagggaaagacattgatgttgaatgacagaattcaaaaccccgatagtcttcaacatgtgctgaggaaagctgaagagtatctagccacacttgctcctgaaacaccatactcagaatttgaacacaggttccaagagattggattggagagaggttggggtgacaccgccgagcgtgtcctcgagtccattcaacttctcttggatcttcttgaggctcctgacccttgcacccttgagacattccttgacagaatccctatggtgttcaatgttgtcattctttctcctcatggttactttgctcaagataatgtcttaggataccctgataccggtggccaggttgtttacatcttggatccaagttcgtgccttggagaatgagatgctccatcgcattaagcaacaaggcttggatatcgtccctcgaattctcattatcactcgtcttctccctgatgcagttggaactacttgtggccaacgacttgagaaggtctttggaaccgagcattgccacattcttcgagttccattcagaaacgaggaagggaattgttcgcaagtggatctcacgattcgaagtctggccatatctagaaacttacactgaggatgttgctcacgagcttgccaaagaattgcaaggaaaaccagatctgattgttggaaactacagtgatggaaacattgttgcttccttgttggcacataaattaggtgtcactcagtgtaccattgcgcatgcacttgagaagacgaaatatcccgaatccgatatttacttggaaaattcgaagagaagtatcacttctcctgccaatttacagctgatctctttgcaatgaaccacacagatttcatcatcacaagtaccttccaagagattgctggaagcaaggatactgttggacagtatgagagtcacactgccttcacccttccaggactctaccgtgttgtccacggtatcgatgtctttgatccaaagttcaacattgtgtctccaggagctgatgagaccatttacttcccttacaccgaaactagccgaagattgacatccttccaccctgaaatcgaagagcttctttatagcacagtcgagaatgaagaacacatatgtgtactgaaggaccgcaacaagccgattatcttcaccatggcaaggttggaccgtgtgaagaacatttcaggacttgtggaatggtacggcaagaacgccaagcttcgtgagttgtgaacctgtgtgttgccggagacaggaggaaggagtcaaaggacttggaagagaaagctgagatgaagaagatgtacgccttgatcgacacctacaagctgaatggacaattccgatggatttcgtctcagatgaaccgtgttagaaacggagagctgtaccgtgtgatctgcgacacgaagggagctttcgtgcagcctgctgtgtatgaagctttcggtttgacagttgttgaggccatgggttgtggtttgccaacatttgcaacattaaatggtggtcctgctgagattattgttcatggaaatactggatttcacattgatccttaccacggcgaacgcgccgctgatctccttgttgaattctttgagaagtgcaaggttgatccatctcactgggacaaaatctctcagggtggtctcaaacgtattgaagagaagtatacatggcaaatttactcccagaggcttctcacactcactggtgtctatggtttctggaagcatgtgtctaaccttgaccgccttgagagtcgccgttatcttgagatgttctatgctctcaaataccgcaaattggctgagtcggtgcccctagctgttgaggagtaaaaatatgatgcttgaagagttacatgaagaaatggaggaaccggcttttattatcttatttggagtcagttgttctttgtagtttataaataataatgtgaatgtatttgtatttgttgattaagtctttgataagagaaagtgaatgttatttcttttgcatgtatttgaatgtgagttgggaagcttgaatggaagggttgtttcgccatctaattaatttaagccgtcgccc

SEQ ID NO: 2416 - DNA, 2818 bp, Lupinus angustifolius
attctttatttcttctctttaccagccatttattattttgcgtttattctgttttcatagttgaagttttttctgtgtgacaatggctactgatcgattgacccgagttcacagtctccgcgaaaggattgatgaaaccctcagtattaaccggaatgaaattctgtctcttctcgcaagggttgaaggcaagggcaagggactcctgcaacaccatcagatcattgctgagtttgaagaaattcctaaggagaataggcagaagctaagtgatggtccctttggtgaagttttgagatccacacaggaagctatagttttatcaccatgggttgctttggctgttcgtccaaggcctggtgtttgggagtacctgaaagtgaatgtgcatgctcttgttgttgaggagttgcaagctgctgagtacttgaaattcaaggaggaaattgttgatggaagttccaatggtaactttgtgcttgaattggactttgaaccatttaatgcatctttcccgcgcccaactctgaacaagtcaattggaaatggtgtgcaattcctcaaccgccacctttctgccaaactcttccatgacaaggagagcttgcaccctcttctggaattcctcagatctcacagctacaatggaaagacactgatgttgaatgatagaattcagactccagattctcttcaacatgtgctcagggaagctgaggagtatcttggcacacttgctcctgaaacaccctactcagaatttgaatacaaattccaggagattggtttggagagagggtggggtgacaccgccgagcgtgtccttgagatgatccaacttctgttggaccttcttgagtcacctgacccttgcacactcgagtcattccttggaagaatccctatggtcttcaatgttgttatcctttctccccatggttactttgcccaagataatgtcttaggataccctgacactggtggccaggttgtttacatcttggatcaagttcgtgccttggagaatgagatgctcaaacgcattaagcaacaaggcttggatatcgtccctcgcattctcattatcacccgtcttctccctgaggcagtaggaactacttgtggccaacgtcttgagaaggtatatgatactgaacattgccacattcttcgagttccatttagaaccgagaagggaattgttcgcaaatggatctccagatttgaagtctggccatacctagaaactttcaccgaggatgttgcccatgaacttgccaaggagttgaaaggcaagccagatctgattgttggaaactatagtgatggaaacattgttgcctctttgctggcacataaattaggtgtaactcagtgtacaattgctcatgcactcgagaagaccaaatatcctgaatctgacctttactggaagaaatttgatgagaagtatcacttctcctcccaatttacagctgatctttttgcaatgaaccacacagactttattatcacaagtaccttccaagagattgctggaaacaaggatactgttggacagtacgagagtcacactgccttcacccttcctggactctaccgtgttgtgcatggtatcaatgtttttgatccaaagttcaacattgtctctcccggagctgatcaaaccatttacttcccatacactgaaactagccgtaggttgacatccttccacccggagattgaagagcttctttacagcacagtggagaatgaagagcacatatgtgtattgaaggaccgcaacaagccgattatcttcaccatggcaaggttggaccgtgtgaaaaacatcacaggacttgttgagtggtatggtaagaatgctcgccttcgggagttggtgaaccttgttgttgtggctggagataggaggaaggagtccaaggacctggaagagaaagctgagatgaagaagatgtatggcctcattgagacatacaagttgaatggacaattcagatggatttcttctcagatgaatagaataaggaatggcgagctgtaccgtgtgatctgtgacacgaagggtgcttttgttcagcctgctgtgtatgaagcttttggtttgactgttgttgaggccatgacttgtggtttgccaaccttcgctacttccaatggtggtccagctgagataattgtgcatggcaagagtggataccacattgacccttatcatggtgaccgtgctgctgatcttcttgttgaattctttgagaagtctaaggcagatccatctctctgggacaaaatctcccaaggaggcctgcagcgtattgaagagaagtatacctggcaaatttactccgagaggcttctaactctcactggtgtctatggcttctggaagcacgtgtctaaccttgaccgccgtgagagtcgccgctaccttgaaatgttctatgctctcaagtaccgcaaattggctgagtctgtgccccttgctgttgaggagtaaaccaaggcttgaagttgaagagtatataaagaaatggaggatccggctttttcttatttgcactgtctgttgagtttcattaataatgtggatgattttagttttgtgattaggctttggataaaaaaagaaacaagtatttttctttttattttccttttgcaagattggagtttgggtgtataccctcattgattcaatttgaagccgtgccttctttacttggtgtctacattcccatccaactttatcttatcatttgctgaacctttttattctttatcctttaaagttagaataaagtaagcaataaat

SEQ ID NO: 2417 - DNA, 2923 bp, Medicago truncatula
ccaccaccttattttccattcattcatcccttctctttacacccccccctcttttttgcgttcactctgttttcttttcatagttgaagattttcaatggctaccgaacgtttgactcgtgttcatagcctcaaggagaggcttgatgaaaccttaactgctaataggaatgaaattttggcccttctttcaaggcttgaagcaaagggaaagggaattttgcaacaccatcaagtgattgctgagtttgaggaaattcctgaagatagtagacagaagttgactgatggtgcatttggtgaagttttgagatccacacaggaagcaatagttttgccaccatgggttgcacttgctgttcgtccaaggccaggtatttgggagtatctgagagtaaatgtgcatgctcttgttgttgaaaatttgcaacctgctgagtttctcaaattcaaggaagaacttgttgatggaagtgctaatggaaactttgtgcttgagttggactttgaaccatttactgcatctttccctcgtcctactctcaacaagtcaattggaaatggtgtgcaattccttaatcgccacctttctgctaaactcttccatgacaaggagagtttacatccacttttggaatttctcagacttcacagctacaagggaaagacattgatgttgaatgacagaattcaaaaccctgattctcttcaacatgttctgaggaaagctgaagagtatctaagcacaattgatcctgaaacaccatactcagaatttgaacacaggttccaggagattggtttggagagaggttggggagacaccgcagagcgcgtcctcgagtccatccaacttctcttggatcttctcgaggctcccgacccttgcacccttgagactttccttgatagaatccccatggtctttaatgttgtcatcctttctcctcatggttactttgctcaagatgatgtcttgggataccctgatactggaggccaggttgtttacatcttggatcaagttcgtgccttggagagcgagatgctcagtcgcattaagaaacaaggcttggatatcatccctcgcattctcattatcacccgtcttctccccgatgcagtcggaacgacttgtggccaacgacttgagaaggtctacggaactgagcattgccacattcttcgagttcccttcagagatacgaagggaattgtccgcaagtggatctcacgatttgaagtctggccatatctagaaacttacactgaggatgttgctcatgagcttgccaaagagttgcaaggcaaaccagatctgattgttggaaactacagtgatggaaacattgttgcctctttgttggcacataaattaggtgtcactcagtgtaccattgctcatgcactcgagaagactaagtaccccgaatccgacatttactggaaaaaattcgaagagaagtatcacttctcctgccaatttaccgctgatcttttcgcaatgaaccacacagatttcatcatcactagtaccttccaagagattgctggaagcaaggacaaggttggacagtatgagagtcacactgcctttactcttccaggactctaccgtgtcgtgcacggtattgatgtctttgatccaaagttcaacattgtatctccaggagctgatcagaccatttacttcccttacaccgaaactagccgccgattgacatccttctaccctgaaatcgaagagcttctttacagctcagttgagaatgaagagcacatatgtgtgctgaaggaccgcaacaagccaattatcttcaccatggcaaggttggaccgtgtgaagaacattacaggacttgttgagtggtacggcaagaatgccaagcttcgtgagttggtgaaccttgttgttgttgccggagacaggaggaaggagtcaaaggacttggaagagatagctgagatgaagaagatgtatggcctaatcgagacctacaagttgaatggccaattcagatggatttcctctcagatgaaccgtgtcagaaacggagagctgtaccgtgtgatttgtgacaccaagggagctttcgtgcaacctgctgtgtatgaagctttcggtttgacagttgttgaggccatggctactggattaccaacatttgcaactcttaatggtggccctgctgagatcattgtccatggcaaatctggattccacattgatccttaccatggcgaccgtgctgctgatctcctcgttgaattctttgagaaggtcaaggttgatccatctcactgggacaagatctctcaaggtggtctccaacgtattgaagagaagtacacatggacaatatactctcagaggcttcttacactcactggtgtctatggcttctggaagcatgtgtctaacctcgaccgtcttgagagccgccgctatcttgagatgttctatgctctcaagtaccgcaaattggctgagtctgtgcccctagctgttgagtaaaatctgaggctttgaagagttaaatgaagaaatggagaaaccggctttgttctcttatttggaatcttgttttgagttttataaataaaaatgtcaatgattttgattttgttaatttaagctttggataaaaaaaattgtcaatgtcctctcaaaaaaaaaaattgtcaatgtctttttcttttgcatgatttgaaatgtaactgggaagcttgaatggtgggtgttttgcccccatcaattcaattttaagccatgcctttttattgtccatattctcctccaactttattttatcaaattctagttctaccttttctctttatgttttttttctttctatgatcaccttttgtcttcatatatatactttacttttgaataatatacttgcaactataacaaaaaa

SEQ ID NO: 2418 - DNA, 2726 bp, Medicago truncatula
tctttacacccccccctcttttttgcgttcactctgttttcttttcatagttgaagattttcaatggctaccgaacgtttgactcgtgttcatagcctcaaggagaggcttgatgaaaccttaactgctaataggaatgaaattttggcccttctttcaaggcttgaagcaaagggaaagggaattttgcaacaccatcaagtgattgctgagtttgaggaaattcctgaagatagtagacagaagttgactgatggtgcatttggtgaagttttgagatccacacaggaagcaatagttttgccaccatgggttgcacttgctgttcgtccaaggccaggtatttgggagtatctgagagtaaatgtgcatgctcttgttgttgaaaatttgcaacctgctgagtttctcaaattcaaggaagaacttgttgatggaagtgctaatggaaactttgtgcttgagttggactttgaaccatttactgcatctttccctcgtcctactctcaacaagtcaattggaaatggtgtgcaattccttaatcgccacctttctgctaaactcttccatgacaaggagagtttacatccacttttggaatttctcagacttcacagctacaagggaaagacattgatgttgaatgacagaattcaaaaccctgattctcttcaacatgttctgaggaaagctgaagagtatctaagcacaattgatcctgaaacaccatactcagaatttgaacacaggttccaggagattggtttggagagaggttggggagacaccgcagagcgcgtcctcgagtccatccaacttctcttggatcttctcgaggctcccgacccttgcacccttgagactttccttgatagaatccccatggtctttaatgttgtcatcctttctcctcatggttactttgctcaagatgatgtcttgggataccctgatactggaggccaggttgtttacatcttggatcaagttcgtgccttggagagcgagatgctcagtcgcattaagaaacaaggcttggatatcatccctcgcattctcattatcacccgtcttctccccgatgcagtcggaacgacttgtggccaacgacttgagaaggtctacggaactgagcattgccacattcttcgagttcccttcagagatacgaagggaattgtccgcaagtggatctcacgatttgaagtctggccatatctagaaacttacactgaggatgttgctcatgagcttgccaaagagttgcaaggcaaaccagatctgattgttggaaactacagtgatggaaacattgttgcctctttgttggcacataaattaggtgtcactcagtgtaccattgctcatgcactcgagaagactaagtaccccgaatccgacatttactggaaaaaattcgaagagaagtatcacttctcctgccaatttaccgctgatcttttcgcaatgaaccacacagatttcatcatcactagtaccttccaagagattgctggaagcaaggacaaggttggacagtatgagagtcacactgcctttactcttccaggactctaccgtgtcgtgcacggtattgatgtctttgatccaaagttcaacattgtatctccaggagctgatcagaccatttacttcccttacaccgaaactagccgccgattgacatccttctaccctgaaatcgaagagcttctttacagctcagttgagaatgaagagcacatatgtgtgctgaaggaccgcaacaagccaattatcttcaccatggcaaggttggaccgtgtgaagaacattacaggacttgttgagtggtacggcaagaatgccaagcttcgtgagttggtgaaccttgttgttgttgccggagacaggaggaaggagtcaaaggacttggaagagatagctgagatgaagaagatgtatggcctaatcgagacctacaagttgaatggccaattcagatggatttcctctcagatgaaccgtgtcagaaacggagagctgtaccgtgtgatttgtgacaccaagggagctttcgtgcaacctgctgtgtatgaagctttcggtttgacagttgttgaggccatggctactggattaccaacatttgcaactcttaatggtggccctgctgagatcattgtccatggcaaatctggattccacattgatccttaccatggcgaccgtgctgctgatctcctcgttgaattctttgagaaggtcaaggttgatccatctcactgggacaagatctctcaaggtggtctccaacgtattgaagagaagtacacatggacaatatactctcagaggcttcttacactcactggtgtctatggcttctggaagcatgtgtctaacctcgaccgtcttgagagccgccgctatcttgagatgttctatgctctcaagtaccgcaaattggctgagtctgtgcccctagctgttgagtaaaatctgaggctttgaagagttaaatgaagaaatggagaaaccggctttgttctcttatttggaatcttgttttgagttttataaataaaaatgtcaatgattttgattttgttaatttaagctttggataaaaaaattgtcaatgtctttttcttttgcatgatttgaaatgtaactgggaagcttgaatggtgggtgttttgcccccatcaattcaattttaagccatgcctttttattgtcca

SEQ ID NO: 2419 - DNA, 3057 bp, Glycine max
tccatctgtgaaattcccgttctgcttcgcgctcctgtctataaattgactcagtcaccacttgagtttccattcattcacctcttctctttacacccccctctctattttgcgttcattctgttttccagttgaagtctttccctagccaatggccactgatcgtttgacccgggttcacagtctccgtgagaggcttgatgaaaccctcactgccaacaggaacgaaattttggcccttctgtcaaggatcgaagctaagggcaaggggatcctgcaacaccaccaggtcattgctgagtttgaggaaatccctgaggagaacaggcagaagcttactgatggtgcctttggagaagtcttgagatctacacaggaagccatagttttgccaccatgggttgctctggctgttcgtccaaggcctggtgtgtgggagtacctgaaagtgaatgtgcacgctcttgttgttgaggagttgcaacctgctgagtaccttcacttcaaggaagaacttgttgatggaagttctaatggcaactttgtgcttgagttggactttgaaccattcaatgcagccttccctcgcccaactcttaacaagtcaattggaaatggtgtgcagttcctcaaccgccacctttctgccaaactcttccacgacaaggagagcttgcacccacttttggaattcctcaggcttcacagcgtcaagggaaagactttgatgttgaatgacagaattcaaaacccagatgcactccaacatgttctgaggaaagctgaggagtatctgggcacagtgcctcctgaaactccctactcagaatttgagcacaagttccaggagattggtttggagagagggtggggtgacaacgcagagcgtgttcttgagtcaattcaacttctcttggatcttcttgaggcccctgacccttgcacccttgagactttccttggaagaattcctatggtcttcaatgttgtcattctttctccccatggttactttgcccaagataatgtcttgggataccctgacactggtggccaggttgtttacatcttggatcaagttcgtgctttggagaacgagatgctccatcgcattaagcaacaaggattggacattgtacctcgtattctcattatcacccgtcttctccccgatgcaatcggaactacttgtggccaacgtcttgagaaggtgttcggaaccgagcactcccacattcttcgagttccctttagaactgagaagggaattgttcgtcagtggatctcaagattcgaagtctggccatacttggaaacttacactgaggatgttgctcatgagcttgccaaagagttgcaaggcaagccagatctgattgtcggaaactacagtgatggaaacattgttgcctctttgttggcacataaattaggagtcactcagtgtaccattgctcatgcacttgagaagaccaaataccccgaatccgacatttactggaaaaaattggaagagagataccacttctcttgccaattcacagctgatctatttgccatgaaccacacagatttcattatcaccagtaccttccaggagattgctggaagcaaggacactgttggacagtatgagtctcacacagcctttacccttcctggactctaccgtgttgtgcacggcattgatgtctttgatccaaaattcaacattgtctcccctggagctgatcaaaccatttacttcccccccaccgaaactagccgtaggttgacctccttccaccccgaaatcgaagaacttctttacagctctgtggagaatgaagaacacatatgcgtgctgaaggaccgcagcaagccgattatcttcaccatggcaaggttggaccgtgtgaagaacatcacaggactcgtggagtggtacggtaagaacgcgaagctgagggagttggtgaaccttgtggttgttgccggagacaggaggaaggagtcgaaggacttggaagagaaggccgagatgaagaagatgtacggcctgatcgagacctacaagttgaacgggcaattcagatggatttcatctcagatgaaccgtgtgaggaacggagagctgtaccgtgtgatctgcgacaccaagggagctttcgtgcagccggctatatacgaggcttttggtttgacagtggttgaggccatgacttgtgggttgccaacattcgccacatgcaatggtggtcctgctgagatcattgtgcatggcaagtctggcttccacattgacccttaccatggtgaccgtgctgctgatctccttgttgacttctttgagaagtgcaagcttgacccaacccactgggaaacaatctcaaaggctggtctccagcgtattgaagagaagtacacatggcaaatttactcacagaggcttctcactctcactggtgtctatggcttctggaagcatgtgtctaaccttgaccgccgtgagagccgccgctatctcgagatgttctatgctctcaagtaccgcaaattggccgagtctgtgccccttgctgttgagtaaactgaggatgaagagttggataaagaaatggaggaaccggctttttgtttctcatttggagtttgtcttacttgagttctataaataatatgtccctgatgattttaattttgtgattaagctttcgataagagacagagagagaaaaaaaaggaaaaaaaaaaaagccttttactttttttcttttgcatgatttgaatcttgattggaaaagcttcgaattggggtgttttacccatcaattcaattttaagccgtgccttcttcacttgctgtgtccataatacccctcccaactttatacttttatatactgtagttctttttatctttaaacttaaaacaaagccatgaaaaagcatcatcatcataataactagaaactagagacgagtattgtaggacaaaggaccccctgcaatttcatccgttatggtggaagaaagtgaatattgacgttggaatttaaagatttaattgtcgttgtc

SEQ ID NO: 2420 - DNA, 2778 bp, Glycine max
attcattcacctcttctctttacacccccctctctattttgcgttcattctgttttccagttgaagtctttccctagccaatggccactgatcgtttgacccgggttcacagtctccgtgagaggcttgatgaaaccctcactgccaacaggaacgaaattttggcccttctgtcaaggatcgaagctaagggcaaggggatcctgcaacaccaccaggtcattgctgagtttgaggaaatccctgaggagaacaggcagaagcttactgatggtgcctttggagaagtcttgagatctacacaggaagccatagttttgccaccatgggttgctctggctgttcgtccaaggcctggtgtgtgggagtacctgaaagtgaatgtgcacgctcttgttgttgaggagttgcaacctgctgagtaccttcacttcaaggaagaacttgttgatggaagttctaatggcaactttgtgcttgagttggactttgaaccattcaatgcagccttccctcgcccaactcttaacaagtcaattggaaatggtgtgcagttcctcaaccgccacctttctgccaaactcttccacgacaaggagagcttgcacccacttttggaattcctcaggcttcacagcgtcaagggaaagactttgatgttgaatgacagaattcaaaacccagatgcactccaacatgttctgaggaaagctgaggagtatctgggcacagtgcctcctgaaactccctactcagaatttgagcacaagttccaggagattggtttggagagagggtggggtgacaacgcagagcgtgttcttgagtcaattcaacttctcttggatcttcttgaggcccctgacccttgcacccttgagactttccttggaagaattcctatggtcttcaatgttgtcattctttctccccatggttactttgcccaagataatgtcttgggataccctgacactggtggccaggttgtttacatcttggatcaagttcgtgctttggagaacgagatgctccatcgcattaagcaacaaggattggacattgtacctcgtattctcattatcacccgtcttctccccgatgcaatcggaactacttgtggccaacgtcttgagaaggtgttcggaaccgagcactcccacattcttcgagttccctttagaactgagaagggaattgttcgtcagtggatctcaagattcgaagtctggccatacttggaaacttacactgaggatgttgctcatgagcttgccaaagagttgcaaggcaagccagatctgattgtcggaaactacagtgatggaaacattgttgcctctttgttggcacataaattaggagtcactcagtgtaccattgctcatgcacttgagaagaccaaataccccgaatccgacatttactggaaaaaattggaagagagataccacttctcttgccaattcacagctgatctatttgccatgaaccacacagatttcattatcaccagtaccttccaggagattgctggaagcaaggacactgttggacagtatgagtctcacacagcctttacccttcctggactctaccgtgttgtgcacggcattgatgtctttgatccaaaattcaacattgtctcccctggagctgatcaaaccatttacttcccccccaccgaaactagccgtaggttgacctccttccaccccgaaatcgaagaacttctttacagctctgtggagaatgaagaacacatatgcgtgctgaaggaccgcagcaagccgattatcttcaccatggcaaggttggaccgtgtgaagaacatcacaggactcgtggagtggtacggtaagaacgcgaagctgagggagttggtgaaccttgtggttgttgccggagacaggaggaaggagtcgaaggacttggaagagaaggccgagatgaagaagatgtacggcctgatcgagacctacaagttgaacgggcaattcagatggatttcatctcagatgaaccgtgtgaggaacggagagctgtaccgtgtgatctgcgacaccaagggagctttcgtgcagccggctatatacgaggcttttggtttgacagtggttgaggccatgacttgtgggttgccaacattcgccacatgcaatggtggtcctgctgagatcattgtgcatggcaagtctggcttccacattgacccttaccatggtgaccgtgctgctgatctccttgttgacttctttgagaagtgcaagcttgacccaacccactgggaaacaatctcaaaggctggtctccagcgtattgaagagaagtacacatggcaaatttactcacagaggcttctcactctcactggtgtctatggcttctggaagcatgtgtctaaccttgaccgccgtgagagccgccgctatctcgagatgttctatgctctcaagtaccgcaaattggccgagtctgtgccccttgctgttgagtaaactgaggatgaagagttggataaagaaatggaggaaccggctttttgtttctcatttggagtttgtcttacttgagttctataaataatatgtccctgatgattttaattttgtgattaagctttcgataagagacagagagagaaaaaaaaggaaaaaaaaaaaagccttttactttttttcttttgcatgatttgaatcttgattggaaaagcttcgaattggggtgttttacccatcaattcaattttaagccgtgccttcttcacttgctgtgtcc

SEQ ID NO: 2421 - DNA, 2732 bp, Pisum sativum
ttcattcttttctttcttcaacctttcaccatttccacttagttttttttcttcatttctcaaagcttttgaagcaatggcgagtctcacccattccacctcactccggcagaggtttgatgaaactctcactgctcacaggaacgaaattctgtctcttttgtcaaggattgaagcaaagggaaagggaatcctgcaacatcatcagatcattgctgagtttgaagaaatccccgaggagaataggcagaagcttgttaatggagtctttggagaagttctgagatctactcaggaagctatagtgttagtgccgtttgttgctcttgctgttcgtccaaggcctggcgtttgggagtatctgagagtcgacgtgcacggtcttgttgtcgatgaactgagtgctgctgagtatctcaagttcaaggaggagcttgttgaaggaagttctaatgaaaactttgtgcttgagttggactttgaaccattcaatgcctcgattccgaaaccaacgcagaataagtcaattggaaatggcgttgagtttctcaatcgccatctttctgctaagcttttccatggcaaagaaagcttgcagccactgctggagttccttaggcttcacaaccataacgggaagactataatggttaatgacagaattcaaaatctgaattctcttcaacatgttttgcgaaaagcagaagattatctgatcaaaattgctcctgagactccgtactcggagtttgaacacaaattccaggaaattggtttggagagagggtggggagacacagctgagcgtgtcgttgaaacgatccagcttctgttggatcttctcgacgcacctgatcctggcaccctcgagacattcctcggaagaatccctatggttttcaatgttgtcatcctttctcctcacggctatttcgcccaagataatgtcttgggataccccgataccggtggccagattgtgtacattttggatcaagttcgtgccttggaggaggagatgctcaaacgcatcaagcaacaaggcttggatatcacgcctcgcattctcattatcacgcgtcttctccccgatgcagtgggaactacttgtggtcagcgtcttgagaaggtatacaataccgaacattgccacattcttcgagttccctttagaacagaaaagggaatcgttcgcaaatggatctcaagatttgaagtctggccttacctagagactttcagtgaggatgttgccaatgaacttgccaaagagttgcaaggcaagcctgatctgatcgttggaaactatagcgatggaaacatcgttgcctctttgttagcacataaattaggcgtaacacagtgtactattgctcatgcactcgagaaaaccaagtatccggagtcggacatttattggaaaaaatttgatgacaagtatcacttctcgtcccaatttactgctgatctttttgcaatgaaccatacagactttatcatcacaagtaccttccaagagattgctggaagcaaggatactgttggacagtatgagagtcacactgccttcacccttccgggactttaccgtgtcgttcacggtatcgatgtctttgatccaaagttcaacattgtctcgccgggagctgatttgagcatttacttcccatataccgaaaccgagcgtagattgacatccttccaccctgatatcgaagaacttctctacagcacggtggagaacgaggagcacatatgtgtactgaaggatcgcagcaagccgattatcttcacgatggcaaggttggaccgagtcaaaaacattacaggacttgttgagtgttacggcaagaatgctcgcctaagggaactggtaaaccttgtcgttgttgccggagacagaaggaaggagtcaaaggatttagaagagatagccgagatgaagaaaatgtacggcctgatcgaaacctacaaattgaacggccaattcagatggatttctgcacaaatggaccgaattagaaacggagagctttaccgtgtcatctgcgacacaaagggcgctttcgtgcagccagctatttatgaagcttttggtttaactgttattgaagctatgagttgtggactgccaacatttgcgacatgtaatggtggtcctgctgagatcattgttcatggaaaatctggttaccatattgatccttatcacggcgaccgcgctgccgagactcttgttgaattcttcgagaagtctaaggctgatcctacttattgggacaaaatctcccatggaggtctcaaacgtattcacgagaagtacacatggcagatttattccgacaggcttctgactcttactggcgtgtacggcttctggaagcatgtgacgaatctcgaacgccgtgagagcaaacgctacctcgagatgttttatgcactcaaatacagcaaattggctgaatctgtgcctcttgctgtggaagagtaaatgaagaagagggaagatattgcggaaccaacattttgtcatttggagtcatggagcgattttaaataaaataaaaccattgattttgatattgtgattaggtttctgatcgaaaaaaaaggtgttttttttagtaagaataaagtgtatttttcttttttgcatttttggatgttactggaatcttccaatttgggtgttagccccatgaattaaatttgagaggtgctttgaattcaag

SEQ ID NO: 2422 - DNA, 2841 bp, Phaseolus vulgaris
cattcattcacttcttctctttctacccccctctctattttgcgttcattctgttttcttgaagtctttccctgtgatcttccttgccaatggccgctgatcgtttgacccgtgttcacagtctccgtgagaggcttgatgaaaccctgtctgccaacaggaacgaaattctggcccttctgtcaaggatagaagccaagggcacggggatcttgcaacaccatcaggtcattgctgagttcgaggaaattcccgaggagagcagacagaagcttattgatggtgcctttggagaagttttgaggtctactcaggaagccatagttttgccaccatgggttgctctggctgttcgtccaaggcctggtgtctgggagtacctgagagtgaatgtgcacgctctagttgttgaggtgttgcaacctgctgagtacctgcgcttcaaggaggaacttgttgatggaagttctaatggaaactttgtgcttgagttggactttgaaccctttacggcatccttcccccgcccaactcttaacaagtcaattggaaatggtgtgcagttcctcaaccgccacctttctgccaaactcttccatgacaaggagagcttgcacccacttttggaattcctcaggcttcacagcgtcaacggaaagactttgatgttgaatgacagaattcaaaaccctgatgctcttcaacatgttctgaggaaagctgaggagtatctgggtacagtgcctcctgaaaccccctactcagaatttgagcacaagttccaggaaattggtttggagagagggtggggtgcgaacgcagagcttgtacttgagtcaattcaacttctcttggatcttcttgaagcccctgatccgtgcacccttgagactttccttggaagaatccctatggtctttaatgttgttattctttcgccccatggttactttgcccaagataatgtcttgggataccctgacactggtggtcaggttgtttacatcttggatcaagtccgtgctttggagaatgagatgctccatcgcattaagcaacaaggattggacattgttcctcgtattcttattatcactcgtcttctcccagatgcagtaggtactacttgtggccaacgtcttgagaaggtgtttggaactgaacactcccacattcttcgagttccctttagaactgagaatgggattgttcgcaagtggatctcaagattcgaagtctggccctacttggaaacttacaccgaggatgttgctcatgagcttgccaaagagttgcaaggcaagccagatctgatcgttggaaactacagtgatggaaacattgttgcctctttgttggcccataaactaggtgtcactcagtgtaccattgctcatgcacttgagaagaccaaataccctgaatccgatatttactggaaaaaattggaagagagataccatttctcttgccaattcacagctgatctatttgccatgaaccacacagatttcattatcacaagtacattccaagaaattgctggaagcaaggacactgttggacagtatgagtctcacacagctttcacccttcctggactctaccgtgttgtgcacggtattgatgtcttcgatccaaaattcaacattgtctctcccggagctgatcaaaccatttacttctcccacaaggaaactagccgtaggttgacctccttccaccccgaaatcgaagagcttctttacagctcagtcgagaatgaagaacacatatgtgtgctgaaggaccgcacgaagccaattatcttcaccatggcaaggttggaccgtgtgaagaacatcacaggacttgtggagtggtatggtaagaatgagaagctgagggagttggtgaaccttgtggttgttgctggagacaggaggaaggagtctaaggacttggaagagaaggccgagatgaagaagatgtacagcctgattgagacctacaagttgaacgggcaattcaggtggatttcctctcagatgaaccgtgtgaggaatggagagctgtaccgtgtgatcagtgacaccaggggagcctttgtgcagcctgcagtgtatgaggcatttggtttgacagtggttgaagccatgacttgtgggttgccaacatttgccacatgcaatggtggtcctgctgagatcattgttcatggaaaatctggcttccacattgatccctaccatggtgaccgtgctgctgacctccttgttgagttctttgagaagtgcaaggttgagccatctcactgggacaccatctctcaagctggtctccaacgtattgaagagaagtacacatggcaaatttactcccagaggcttctcaccctcactggtgtctatggtttctggaagcatgtgtctaaccttgatcgcctcgagagtcgccgctatctcgagatgttctatgctctcaagtaccgcaaattggctgagtctgtgccccttgctgttgagtaaactgaggatgaagagttggacaaagaaatggaggaaccggctttttctttctcttttggagtttgtcgtacttgagtttcacaaataatgcccatgactttaattctgtgattaagctttcgataagaaggagagagggagagaaaaaaaaaaaggaggaaaaaaaaaacccttttgtttgttcttttgcatgatttggatcttgattgaaaaagcttcaaattggggtgttttacccatcagttcagttttaagccgagccttctttctcactttgtcgtgttcatgatatccttctccaactttagattcatgcactgttgctcttctctct

SEQ ID NO: 2423 - DNA, 2818 bp, Phaseolus vulgaris
attcattcacttcttctctttctacccccctctctattttgcgttcattctgttttcttgaagtctttccctgtgatcttccttgccaatggccgctgatcgtttgacccgtgttcacagtctccgtgagaggcttgatgaaaccctgtctgccaacaggaacgaaattctggcccttctgtcaaggatagaagccaagggcacggggatcttgcaacaccatcaggtcattgctgagttcgaggaaattcccgaggagagcagacagaagcttattgatggtgcctttggagaagttttgaggtctactcaggaagccatagttttgccaccatgggttgctctggctgttcgtccaaggcctggtgtctgggagtacctgagagtgaatgtgcacgctctagttgttgaggtgttgcaacctgctgagtacctgcgcttcaaggaggaacttgttgatggaagttctaatggaaactttgtgcttgagttggactttgaaccctttacggcatccttcccccgcccaactcttaacaagtcaattggaaatggtgtgcagttcctcaaccgccacctttctgccaaactcttccatgacaaggagagcttgcacccacttttggaattcctcaggcttcacagcgtcaacggaaagactttgatgttgaatgacagaattcaaaaccctgatgctcttcaacatgttctgaggaaagctgaggagtatctgggtacagtgcctcctgaaaccccctactcagaatttgagcacaagttccaggaaattggtttggagagagggtggggtgcgaacgcagagcttgtacttgagtcaattcaacttctcttggatcttcttgaagcccctgatccgtgcacccttgagactttccttggaagaatccctatggtctttaatgttgttattctttcgccccatggttactttgcccaagataatgtcttgggataccctgacactggtggtcaggttgtttacatcttggatcaagtccgtgctttggagaatgagatgctccatcgcattaagcaacaaggattggacattgttcctcgtattcttattatcactcgtcttctcccagatgcagtaggtactacttgtggccaacgtcttgagaaggtgtttggaactgaacactcccacattcttcgagttccctttagaactgagaatgggattgttcgcaagtggatctcaagattcgaagtctggccctacttggaaacttacaccgaggatgttgctcatgagcttgccaaagagttgcaaggcaagccagatctgatcgttggaaactacagtgatggaaacattgttgcctctttgttggcccataaactaggtgtcactcagtgtaccattgctcatgcacttgagaagaccaaataccctgaatccgatatttactggaaaaaattggaagagagataccatttctcttgccaattcacagctgatctatttgccatgaaccacacagatttcattatcacaagtacattccaagaaattgctggaagcaaggacactgttggacagtatgagtctcacacagctttcacccttcctggactctaccgtgttgtgcacggtattgatgtcttcgatccaaaattcaacattgtctctcccggagctgatcaaaccatttacttctcccacaaggaaactagccgtaggttgacctccttccaccccgaaatcgaagagcttctttacagctcagtcgagaatgaagaacacatatgtgtgctgaaggaccgcacgaagccaattatcttcaccatggcaaggttggaccgtgtgaagaacatcacaggacttgtggagtggtatggtaagaatgagaagctgagggagttggtgaaccttgtggttgttgctggagacaggaggaaggagtctaaggacttggaagagaaggccgagatgaagaagatgtacagcctgattgagacctacaagttgaacgggcaattcaggtggatttcctctcagatgaaccgtgtgaggaatggagagctgtaccgtgtgatcagtgacaccaggggagcctttgtgcagcctgcagtgtatgaggcatttggtttgacagtggttgaagccatgacttgtgggttgccaacatttgccacatgcaatggtggtcctgctgagatcattgttcatggaaaatctggcttccacattgatccctaccatggtgaccgtgctgctgacctccttgttgagttctttgagaagtgcaaggttgagccatctcactgggacaccatctctcaagctggtctccaacgtattgaagagaagtacacatggcaaatttactcccagaggcttctcaccctcactggtgtctatggtttctggaagcatgtgtctaaccttgatcgcctcgagagtcgccgctatctcgagatgttctatgctctcaagtaccgcaaattggctgagtctgtgccccttgctgttgagtaaactgaggatgaagagttggacaaagaaatggaggaaccggctttttctttctcttttggagtttgtcgtacttgagtttcacaaataatgcccatgactttaattctgtgattaagctttcgataagaaggagagagggagagaaaaaaaaaaaggaggaaaaaaaaaacccttttgtttgttcttttgcatgatttggatcttgattgaaaaagcttcaaattggggtgttttacccatcagttcagttttaagccgagccttctttctcactttgtcgtgttcatgatatccttctccaactttagattc

SEQ ID NO: 2424 - DNA, 3116 bp, Cannabis sativa
cctcattcatttcccttcatttctttccttcattgcgttcaacctgtttttagagatccattttcttccattctttctttctttctttcatttcatttttatattctcatcactaaagccagttccatattttccttcttctacctcctaagttttaaggtttgtctgatcttactgagctagctagcttaagccatgcctgagcgtgctctgacccgtgtccacagcctccgagagaggttggatgagactctctctgctcacagaaacgaaattgtagctcttctttccaggatcgaggccaaaggaaagggattccttcagccccaccagatcattgctgagtttgaagccatcccagaagtgaacaggaagaaacttttggatggagcttttggtgaagttctgagagccactcaggaagccatatgcttacctccatgggttgctcttgctgtgcgcccaaggcctggtgtgtgggaatacattagagtgaacgtccatgctcttgttattgaagagttgcaggtttctgagtacttgcatttcaaggaagagcttgttgatggaagcgccaatggcaactttgtgcttgaattggactttgagccattcaatgcctctttccctcgtccaactctttccaagtccattggaaatggtgtggagtttctcaatcgccacctttctgcaaaacttttccatgacaaggagagcatgcatcctcttctcgagttcctccgagttcactgttacaagggaaagaatatgatgttgaatgacagaattcacaacctgaatgggcttcaacatgttctaaggaaggcagaggagtacctgaccagtcttgcccccgaaacaccatacgctgaattcgaacacaagttccaggagattggtttggagagagggtggggtgacaccgccgagcgcgtgttggagatgattcagcttctcttggatcttcttgaggcacctgacccttgcacacttgagaagttccttggcagaattccaatggtgtttaacgttgtcattctttctcctcatggatactttgctcaagacaatgttttggggtaccctgatactggaggccaggttgtttacatcttggaccaagttcgtgccttggagaatgagatgcttcttagaattaagcaacaaggacttgacattaaacctcgtattctcattatcactaggctcctccctgatgctgtaggaaccacttgtggtcagcgattggagaaagtttacgatacagaacacacacacattctccgagtgccattcagggacgagaaaggaatggtccgcaagtggatctcaagatttgaagtctggccatacctagagacctacacagaggatgttgcacacgagcttgccaaggagttgcagggcaagcctgatcttatcattggaaactacagtgatggaaacatcgttgcctcccttcttgcccacaaactaggggtcacacagtgtaccatagcccatgcccttgagaaaactaagtaccctgattcagatatttactggaaaaagttggaagagaagtaccatttctcttgccagtttactgctgatctcattgccatgaaccacactgatttcatcatcaccagtaccttccaagagattgctggaagtaaggacactgtgggacagtacgagagccacaccgctttcactcttcccggactctacagagttgttcacggtattgatgttttcgaccccaagttcaacattgtctctcctggagctgacatgagcatctacttcccttacaccgagacggaaaagagactcacctacttccaccccgaaattgaagagcttctctacagtgatgtcgagaatgaggagcacatatgtgtgttgaaggaccgcaacaagcccattatcttcacaatggcgaggttggaccgtgttaagaacatcacggggctagtagagtggtacgggaagaacaagaagctgagagagctagtcaaccttgttgtggtagctggtgacaggagaaaggagtctaaggacattgaagagaaggctgagatggcaaagatgtatggactcattgagacatacaagctgaatggacagttcagatggatttcttctcagatgaacagagtgaggaatggtgagctgtacaggtacatctgtgataccaagggagcttttgtacaacctgctgtgtatgaagcttttggattgactgttgttgaggccatgacttgtggtttgcctactttcgctacctgcaaaggtggccctgctgagatcattgtacatggcaaatcaggctaccatattgatccttatcatggtgatagagcagctgagactcttgttgagtttttcgagaagtgcaaggttgacccttctcactgggacaaaatttcagagggagggttgcaacgtatttatgagaagtacacatggaagatttactctgagaggctactgactttgactggagtttatggcttctggaaacatgtttctaaccttgaccatcaagagagccgtcgttaccttgaaatgttctatgctcttaagtaccgtaagttggctgagtctgttccccttgctgtggacgagtaagcgaagggtgaggttgattgatatgatgatgagtaaataagaggcggaagcaaatttggttggcaaagtggagtttttttaccttgaggaataattgttttctcgattgtgattacatcaaggctttacttttacctttctttttttgtttttgtttttgtttttttttctttttcgatcttgtcgagttttatatttgtttgtaatatttcatttccgggtttgcaaatgtttgaacttgggtgtttaacccacattcaaattgaatgtcagctttgctttgccttacatcagtttcactttccaactctctctctctctctctctctctctctctctctctctctctctctctctctctctctcttaacttgaatcagaatattaggggtgttcgcggtcctccgcaaaaataatagtgcagtgcggtgcggtttatgcagtttggactatcattaaataattaaactatcataaatacaataaagtttaagaaaatt

SEQ ID NO: 2425 - DNA, 2800 bp, Momordica charantia
ggtatattcctatgttgtctttcacttctgaagcaaagtaaggtttttctgagacttctgttcatcttccaagaatggtagccatggccgaacgagccctcacccgtgttcacagcctccgcgagcgcttggatgaaactctcatcactcaacgaaatgaaatcctggccctactctcaaggattgaggccaagggaaaaggcattcttcaacatcatcaactgatcgctgagtttgaaacaattcctgaagagaaccgaaagaaacttgctgatggggcatttggcgaagtcctgagatccacccaggaatccatagttttgcctccatgggttgctcttgctgttcgtccaaggccaggtgtgtgggaatacattagagttaatgtccacgctctggttgttgaagagctccaagttgctgaatatttgcacttcaaagaagaacttgtggatggaagtgtgaacggcaacttcgttcttgagcttgattttgagccgtttactgcttccttccctcaccaactctttccaagtcgatcggtaatggtgttgagttcctcaaccgacacctctctgcgaagctcttccatgataaggagagtatgcagccattgttggacttcctcagagttcactgctacaagggaaagacgatgatgttgaatgatagaattcagaccctgaatgccttccaacatgttctgaggaaggcagaggagtatcttgttacacttgcacccgaaacgccttactctgagtttgcacacaagttccaggagactggcctggagagagggtggggcgacactgccgagcgcgtcctcgaaatgatccaacttcttttggatcttcttgaggcccctgatccttgcacccttgagaagttccttgggagaatacccatggtctttaatgtcgtcatcctttcgccccacggttactttgcgcaagataatgtcttgggctaccccgacactggtggccaggtcgtttacatcttggaccaagttcgtgctttggagcatgaaatgcttcaacgtatcaagcatcaaggattggacataactcctcgtattctcattatcagtagactcctcccagatgcagtaggaaccacctgcacccaacgtctcgaaaaagtattcggcacggagcatgcccacattcttcgagttccattcagaaacgagaaaggaatcatccgaaagtggatctctagattcgaagtctggccttacctagagacttacaccgaggatgttgcacaggaacttaccaaagagttgcagggaaagcctgatctgataatcggaaactacagcgatggaaatatcgttgcctcattgctggcacataaactaggcgttacacagtgtactattgcccacgccttggagaaaaccaagtaccctgattcagatatttattggaagagatttgaggacaagtatcacttctcatgccaattcacagctgatcttatcgccatgaaccataccgatttcattatcacgagtaccttccaagagattgctggcagcaaggatacagttggacaatatgagagtcacactgctttcactcttccggggctctatcgggtggtccacggaatcgatgtgtttgatcccaagttcaacattgtctctcctggagctgacatgagcatctacttcccctacacagagacggagaagaggcttacttccttccaccccgaaatcgaagagcttctttacagtcaagttgagaacaaggaacacttgtgcgttttgaaagatcggtccaagccaatcatattcacaatggcgagattggaccgtgtgaagaacataactggactcgtcgagtggtacggcaagaacaagcgcctgagggagttggttaacctggtggttgtggcgggagacaggaggaaggagtctaaggacaatgaagagaaggctgagatggaaaagatgtatgccctaatagagacctacaacctcaatggccaatttagatggatttcttcacagatgaaccgagtacgaaatggcgaactctaccgatgcattgcggacacaaagggagctttcgtgcagcctgccgtgtatgaagcttttggtttgactgttgtggaggctatgacctgtggattgcctacatttgctacttgcaatggaggccctgccgagatcatcgtcgacggtaaatctggctaccacattgatccataccacggtgaccgagctgctgaaatcctcgtcgaattcttcgagaagagcaaaaaagacccagcacattgggacaaaatctccaaaggaggcctccagcgtatctatgagaagtacacatggcaaatctactcggagagactgctgacactgaccggagtttacggattctggaagcacgtctccaacctcgaccgcctcgagagccgccgttatctggaaatgttctatgctctcaagtaccgtaagttggctgaatctgtgccactggctgtggatgagtgagcagaaagcaggaaagaaacgaaggagagcatcagcaaaggagtaacgagttttttttttttttgtttatctgattttcgaaggagttaataaaagagctatgtgaataatgcaaaaaagaagatttcactgtttttgtttgtgtttgtgtttttggagtctttggaaagggtttgagtttgtgtgagattgttgtaccaattggttcgttcttttgaaccattcatcaattcaagaactactgcccttttttcgctctgtttttcccaattcaacaatctgtcttaccgacttaac

SEQ ID NO: 2426 - DNA, 3744 bp, Citrus clementina
aaattttcaaatcagctgtccctctttgattgtttgacaagtttcgtgcgctgcgatgacggtacatttgtcacctgcatgattctctccgtagctctttgccttgattgttaggttaattttttcccatttttctagcttcaacgtctctgtaattgttgttgactaccgtctcccctcgatttttccgcaacagtaccagtcgcaatcgcaattcacgaagcctcaaacaagatttaccaaaatgccctcgtcaagtgccaatttattggatgtcagaataagttacacatgcagttaaataaattccgagctctcccactataaatctcatcgccaaggctactctagcttgcattcccattctcttcattgcgtttctaccgtccgtacgtttttcttgttttctctaggcactctgtttttctcttcttcccattcttcttcttttcgtttagttttgaattcttcttcgaggtcgaggatcgtgttcaatgctctagtctatcctgttgaattacttgttcatattttacgctgattttatttgaccacctctagaaactcagccttaaaaaaagctcctcagtttcactgttgcctttgctagaattttctcccatgcttttgttggtggaatactaaaaagaaaaaggataaagaaaaaagaaaagctttgatccaaaatttatccctggtagccacacaaagtggtagttcaattattatgcctacgctttaaagattttggtaatattttgtttggcactataccggccaaccagcacataagtgaatattcttaacaaattaagacgcaatgttaatttttaagacggtaatataagttgaacaatatggactctttgcgtaattaatattttaagacttggttgttgaaacttgaaactggaggtgggggtaggtttagaaatttttcgtcttctagatttttttatttgactattcggattatccataatccatttcttctctatataatgaaggttggttttggatagacagctatatctttacgttatttacgtttgcttggttccttgtgttgcagttgaagtttttgtttgtctgagaatcaatggccgaacgtgctttgacccgcgttcacagtctccgcgagcgtttggatgagactctctctgcccacaggaatgaaatcttggcccttttgtcaaggattgagggcaagggcaagggaatcttgcaaaaccatcaacttattgctgagtttgaatcaatttctgaggaaaacagaaagcatctaactgagggggcatttggtgaagttctaagagccacccaggaagcaattgttttgcctccgtgggtagcgcttgccgtgcgtccaaggcccggtgtgtgggagtacatccgagtgaatgtccatgcccttgtcgttgaggagctgcttgtagccgagtacctgcacttcaaggaggaacttgtcgatggaggctccaatggcaacttcgtgcttgagttggattttgagccattcaatgcctcgttccctcgcccaactctttcaaagtctattggaaatggtgtggaattccttaaccgccacctttctgcgaagctcttccatgacaaggagagcatgcatccactgcttgaatttctccgcgtccactgccacaagggcaaaaacatgatgctgaatgacagaattcagaacttgaattctcttcaacacgttctgaggaaggcagaggagtatctgaccacagtggcaccagaaacgccattctctgagttggcactaagatttcaggagattggtttggagagaggttggggtgatactgctgagcgtgcacttgagatgattcagcttcttttggatcttcttgaggcacctgatccatgcactcttgagactttccttggcagaatccccatggtctttaatgttgtgatccttactccccacggttactttgcccaagacgatgttttgggctaccctgatactggtggtcaggttgtttacatcttggatcaagttcgtgccttggaggatgagatgcttcttcgtatcaagcagcaaggacttgatatcacccctcaaatcctcattattacccgtctcctcccagatgcagtaggcacaacatgtggtcagcgacttgagaaagtttatggaactaagtattcagatatacttcgagttccctttagaactgagaagggagttgtccgcaagtggatctcacgatttgaagtctggccttatctagagacctacacggaggatgttgctgttgaaattgccaaggagttgcagggcaagcctgatctaatcattggaaactacagtgatggcaacattgttgcttccttgttagcacataaactaggtgttacccagtgtactattgctcatgctttggagaaaacaaaatatccagattctgacatttactggaaaaatttggatgacaaataccacttctcatgccaatttacagctgatcttatagccatgaatcacactgacttcatcatcaccagtaccttccaagagattgctggaagtaaggacactgttggtcagtatgagagtcacactgctttcactcttcctggactctaccgtgttgtacatggtattgatgtgtttgatcccaagttcaacattgtatctcctggtgctgatatgagcatttacttcccctacactgaggagaagagaaggctgaagtctttccatcccgagattgaggagttgctttacagtgatgttgagaataaggaacacttatgtgtgctgaaagaccgcaacaagcccatcctgtttacaatggcaagattggaccgtgttaagaatttgactgggcttgtggagtggtatggaaagaatgctaagctacgtgagttggttaacttagtcgtagtgggtggtgataggagaaaggagtccaaggacttggaagaacaggctgaaatgaagaagatgtattccctcattgatcaatacaaattgaatggccagttccgatggatctcatctcagatgaatcgggtcaggaacggtgaattgtaccggtacatttgtgatacaaagggagcttttgtgcaacctgcactgtatgaggcctttggcttgactgttgttgaggccatgacctgtggattgccaacatttgcaacttgcaagggtggccccgctgagattatcgttaacgggaaatctggctaccacattgatccttaccatggtgagcaggctgctgagatccttgttgacttctttgagaagtgcaaggcagatccctcatactgggacaagatatcactgggtggcctgaagcgtattgaagagaagtatacatggaaaatttactctcagaggcttctgaccctgactggagtctatgggttctggaaacatgtatctaaccttgatcgtcttgagagccgtcgataccttgaaatgttttatgctctcaagtaccgtaagctggctgaatctgttcctctggctgtggaggagtaaatggacattgagggaagctctcagggtggttggtccgagtggaggtttcttgagttgtggagaataatgtcgcttccgggattgcgattggacaaagacttttttccccccgttaaattttcttttttccaatttttttttgcctttttgcatttctcagcattgtttgtacttttgggtgttccaccctcatcaattccattatagtttgcgactttttggcc

SEQ ID NO: 2427 - DNA, 2652 bp, Theobroma cacao
ttcaaagaatggctgagcgtgttatcacccgcgtccacagcctccgtgagcgtttggatgagaccctcactgctcacaggaacgagattttggccttgcttgcaaggattgagggtaaagggaaaggaattctgcaacatcatcaaattattctcgagtttgaagccatccctgaagagaacagaaagaagcttgctgatggggcattttttgaaatattgagggctagtcaggaagcgatcgtgtttcctccatgggttgcacttgctgttcgtccaaggcctggtgtttgggagtacattagagtgaatgtccacgctcttgttgtcgaggaactcactgttgctgagtatcttcacttcaaggaagagcttgttgatggaagttcaaatggcaattttgttttggaattggattttgagcccttcaatgcatctttccctcgcccaactctttcaaagtccatcggtaacggtgtggagttcctcaatcgccacctttcagcaaaattgttccatgacaaggagagcatgcaccccttgcttgaattcctcagagtccactgccacaagggcaagaacatgatgttgaatgacagaattcaaaacctgaattctctccaacatgttttgagaaaggcagaggagtatctcagtacactgcccgctgggacaccatatgccgaattcgagcacaagttccaggaaattggcttggagagaggttggggtgataccgctgagcgtgtgcttgagatgatccaactccttttggatcttcttgaggcacctgacccttgcacccttgagaagttccttggtagaattcccatggtcttcaatgttgtgattcttactccccatggatactttgctcaggacaatgttttggggtaccccgacactggtggccaggttgtttacatcttggatcaagtccgtgccttggagaatgagatgcttcaccgcatcaagcagcaaggactcaacattacccctcgtatcctcattattactagacttcttcctgatgctgtgggaacaacttgtggtcagagacttgagaaagtatatggaacagagtactcagatattcttcgaattcccttcagaacagagcagggaattgtacgtagatggatctcaagatttgaagtctggccctacttggaaacttatactgaggatgttgctcacgaaatttccaaagagttgcaaggcaagccagatctgatcatcggaaactacagtgatggcaatatcgttgcctccttgttggcacataagttgggagttacacagtgtacaattgcccacgctttggagaagacaaagtatccagattctgacatctactggaagaagcttgaggataaataccatttctcctgccaatttacagctgatctttttgcaatgaaccatacagatttcatcatcaccagtactttccaagaaattgctggaagcaaggacactgttggtcaatacgagagtcacacagcttttactcttcctggcctctaccgcgttgttcatgggattgatgtatttgatcccaaattcaacattgtgtcacctggtgctgacatgagcatatacttctcttatactgaggagaagaggaggttgaaacatttcaaacccgagattgaagaccttctttacagtaaagtcgagaacgaagaacacttatgtgtgctgaacgaccgcaccaagccaattctatttacaatggcaaggcttgaccgtgtcaagaatttaacgggacttgttgagtggtatggcaagaacgctaagttgcgggagttggttaaccttgtagtagtaggtggagataggagaaaggaatccaaggatttggaagagaaggctgaaatgaagaagatgtttgagatgatcgagaagtacaagttgaacggtcaattcagatggatatcatcccaaatgaacagagttaggaacggtgaactctaccgttacatttgtgataccaagggtgcctttgtacaacctgctttgtacgaagcctttggattaacagttgttgaggccatgacatgtggtttgccgacatttgcaacttgcaacggtggacctgcggagattattgtccacggtaaatctggcttcaacattgatccttaccacggtgatcaagctgctgagatcctcgtcgacttctttgagaagtgcaaggcagacccatcttactggaacaagatctccgagggaggcttgaaacgtatccaggagaagtacacatggcagatttactccgagagactattgaccctgactggagtgtatggcttctggaagcacgtttccaaccttgaccgccgcgagagccgtcgttaccttgagatgttctacgcgctgaagtaccgcaagctggctgaatccgtccctctggcagttgaggagtaaattgaaggcgttgaaacaatgggcccgtaggttccccggaggggttttcagagaactttgagaataatctttggttgtttttggaattttgattggacaagaaaagcctcttttgtattttctcttttttttttttttttgctttaaattccggcattgtttgaaccttgggtgttgagcccgttaattacccagcaaaagattgtgactttgctctttcatg

SEQ ID NO: 2428 - DNA, 2753 bp, Gossypium raimondii
attgtattctccattgcgttaaacccccccattcattatttacgttaagttcaaagaaatggctgatcgtgtgatcactcgcgtccacagtctccgtgagcgtttagatgagacccttcttgctcacaggaacgagattttggccttgctctcaaggatcgagggcaaaggaaaaggaattctgcaacaccatcaaattattctagagtttgaagctatccctgaagagaacagaaagaagctcgctaatggtgcattttttgaagtattgaaggctagtcaggaagcgatcgtgttgcctccatgggttgcacttgctgttcgtccaaggcctggtgtttgggagtacattagagtgaatgttcacgcccttgttgttgaggaacttactgttgctgagtatctccacttcaaggaagagcttgttgatggaagttcaaatggaaactttgttttggaattggattttgagcccttcaactcatcattcccccgcccaactctttcaaaatccattggtaatggtgtggagttcctaaatcgtcacctttcggcaaaattgttccatgacaaggagagcatgcaccctttgctcgaattcctcagagtccattgccacaagggcaagaacatgatgttgaatgacagaattcagaacttgaatgctcttcaacatgttttgaggaaagcagaggagtatcttggtaccctacctcctgagacaccatgtgccgaattcgaacaccggttccaggaaatcggtttggaaagaggttggggtgacaccgcagaacgcgtgctcgagatgatccaactccttttggatcttcttgaggcacctgatccttgcacccttgagaagttccttgggagaatccccatggtgttcaatgttgtgattctcactccccacggatacttcgctcaagacaatgttttggggtatcccgacaccggtggccaggttgtttacatcttggatcaagtccgagctttggagaatgagatgctcctccgtataaagcaacaaggactcaacatcacccctcgaatcctcattattactagacttcttcctgatgctgtcggaacaacatgcggtcaacgacttgagaaagtatacggaacagagcactcggatattcttcgagtacccttcagaacagaaaagggaattgttcgtaaatggatctcaagatttgaagtctggccatacttggaaacctacacagaggatgttgctcatgaaatctccaaagagttgcaaggcaagccagatctgatcatcggaaactacagtgatggcaatatcgtcgcctccttgctcgcacataaattgggtgtcacacagtgcaccatcgcccatgctttggagaagacaaaatatcctgattcagatatctactggaagaagcttgaagacaaataccatttctcttgccaatttacagctgatctttttgcaatgaaccatacagatttcatcatcaccagtactttccaggaaattgcaggaagcaaggacactgttggtcaatacgagagccacactgctttcactcttcctggtctctaccgtgttgtacatggtatcgatgtgtttgatcccaaattcaacattgtttcccctggtgctgatatggagatatacttcccttacaccgaagagaagcggaggttgaagcatttccatactgagatcgaagaccttctttacagcaaagttgagaatgaagaacacttatgtgtgctcaatgaccgcaacaagccaattctgttcacaatggcaaggcttgatcgtgtcaagaacttaaccggactcgtcgagtggtacggcaagaacgcaaagttgcgtgagttggctaacctcgtagttgtaggtggtgataggcgaaaggaatctaaagatttggaagagaaggccgaaatgaagaaaatgtttgagctgatcgagaagtacaacttgaacggccaattcagatggatatcatctcaaatgaacagaatccgaaatggtgaactttaccgatacatttgcgacacgaaaggtgcctttgtacagcctgcattgtatgaagcctttggattgacagttgtggaggcaatgacttgcggtttgccaacattcgcaacctgcaacggtggaccagccgagattattgtccatgggaaatctggtttcaacattgatccttaccatggtgatcaagctgctgacatactggtcgatttctttgaaaagtgtaagaaagatccatctcactgggataagatctcccaaggaggcttgaaacgtatcgaggagaagtatacatggaagatttactcggagagactattgaccctgaccggagtgtatggattctggaagcatgtttccaaccttgaacgccgtgagagtcgtcgttaccttgagatgttttatgctcttaagtaccgtaagctggctgaatcagttccattggcagaggagtaaattgaagctgttaaataacattgggccggtttttcttggagaataatattctgttttgtaatttcaattggagaagctcctttgtatttcatcttgtcttttccttttccttttttcgccggcattgtttgaacatggggttgtgcgcccgtcaattccagttaaatatggtgacttttgtttttcaagttcctatcttttttattttttttttaaacgcttatagccattagcgatgctttcagatgtacaaaaaaaaaagagtatttctaaataa

SEQ ID NO: 2429 - DNA, 3172 bp, Theobroma cacao
attccattctccttcatttcgttaaacccctcctttcgttattttcgtttaggtgctcttctgttttctctgttctttccgtttttcttttaagtttggttttgtttttatgtttgatctgctctgcagtttctttgcctttgtcctgactttgaaagttcttgtgaagaattctcttccttcccatgttgctgttcttatttgaccatcttggggttctgtttttctggccattttcgttgtcaaaaactccatcatgaagaaattctctgtcaagtcagaatgttaaaacacgactctgttttcttgttgagcagggtttctctgcttaaatttctctggacaaacagtgcaatatctactcaaaagggtggttgtggggattttctttgaactgcactaagatttgatttttattttaatttttggttcaaagaatggctgagcgtgttatcacccgcgtccacagcctccgtgagcgtttggatgagaccctcactgctcacaggaacgagattttggccttgcttgcaaggattgagggtaaagggaaaggaattctgcaacatcatcaaattattctcgagtttgaagccatccctgaagagaacagaaagaagcttgctgatggggcattttttgaaatattgagggctagtcaggaagcgatcgtgtttcctccatgggttgcacttgctgttcgtccaaggcctggtgtttgggagtacattagagtgaatgtccacgctcttgttgtcgaggaactcactgttgctgagtatcttcacttcaaggaagagcttgttgatggaagttcaaatggcaattttgttttggaattggattttgagcccttcaatgcatctttccctcgcccaactctttcaaagtccatcggtaacggtgtggagttcctcaatcgccacctttcagcaaaattgttccatgacaaggagagcatgcaccccttgcttgaattcctcagagtccactgccacaagggcaagaacatgatgttgaatgacagaattcaaaacctgaattctctccaacatgttttgagaaaggcagaggagtatctcagtacactgcccgctgggacaccatatgccgaattcgagcacaagttccaggaaattggcttggagagaggttggggtgataccgctgagcgtgtgcttgagatgatccaactccttttggatcttcttgaggcacctgacccttgcacccttgagaagttccttggtagaattcccatggtcttcaatgttgtgattcttactccccatggatactttgctcaggacaatgttttggggtaccccgacactggtggccaggttgtttacatcttggatcaagtccgtgccttggagaatgagatgcttcaccgcatcaagcagcaaggactcaacattacccctcgtatcctcattattactagacttcttcctgatgctgtgggaacaacttgtggtcagagacttgagaaagtatatggaacagagtactcagatattcttcgaattcccttcagaacagagcagggaattgtacgtagatggatctcaagatttgaagtctggccctacttggaaacttatactgaggatgttgctcacgaaatttccaaagagttgcaaggcaagccagatctgatcatcggaaactacagtgatggcaatatcgttgcctccttgttggcacataagttgggagttacacagtgtacaattgcccacgctttggagaagacaaagtatccagattctgacatctactggaagaagcttgaggataaataccatttctcctgccaatttacagctgatctttttgcaatgaaccatacagatttcatcatcaccagtactttccaagaaattgctggaagcaaggacactgttggtcaatacgagagtcacacagcttttactcttcctggcctctaccgcgttgttcatgggattgatgtatttgatcccaaattcaacattgtgtcacctggtgctgacatgagcatatacttctcttatactgaggagaagaggaggttgaaacatttcaaacccgagattgaagaccttctttacagcaaagtcgagaacgaagaacacttatgtgtgctgaacgaccgcaccaagccaattctatttacaatggcaaggcttgaccgtgtcaagaatttaacgggacttgttgagtggtatggcaagaacgctaagttgcgggagttggttaaccttgtagtagtaggtggagataggagaaaggaatccaaggatttggaagagaaggctgaaatgaagaagatgtttgagatgatcgagaagtacaagttgaacggtcaattcagatggatatcatcccaaatgaacagagttaggaacggtgaactctaccgttacatttgtgataccaagggtgcctttgtacaacctgctttgtacgaagcctttggattgacagttgttgaggccatgacatgtggtttgccgacatttgcaacttgcaacggtggacctgcggagattattgtccacggtaaatctggcttcaacattgatccttaccacggtgatcaagctgctgagatcctcgtcgacttctttgagaagtgcaaggcagacccatcttactggaacaagatctccgagggaggcttgaaacgtatccaggagaagtacacatggcagatttactccgagagactattgaccctgactggagtgtatggcttctggaagcacgtttccaaccttgaccgccgcgagagccgtcgttaccttgagatgttctacgcgctgaagtaccgcaagctggctgaatccgtccctctggcagttgaggagtaaattgaaggcgttgaaacaatgggcccgtaggttccccggaggggttttcagagaactttgagaataatctttggttgtttttggaattttgattggacaagaaaagcctcttttgtattttctctttttttttttttttgctttaaattccggcattgtttgaaccttgggtgttgagcccgttaattacccagcaaaagattgtgactttgctctttcatgttcatctttgtgttcagtccttttctcttcgtttgtcgtttttctgatttggccaccattacaactcctcacaataaaaaccataatctcca

SEQ ID NO: 2430 - DNA, 2796 bp, Gossypium hirsutum
gtactttccaggaaattgcaggtgatgatgaaatctgtattctccattgcgttaaaccctccattcattatttacgttaagttcaaagaaatggctaatcctgtgatcactcgcgtccacagtctccgtgagcgtttagatgagacccttcttgcccacaggaacgagattttggccttgctctcaaggatcgagggcaaaggaaaaggaattctgcaacaccatcaaattattctagagtttgaagctatccctgaagagaacagaaagaagctcgctgatggtgcattttttgaagtattgaaggctagtcaggaagcgatcgtgttgcctccatgggttgcacttgctgttcgtccaaggcctggtgtttgggagtacattagagtgaatgttcacgcccttgttgttgaggaacttactgttgctgagtatctccacttcaaggaagagcttgttgatggaagttcaaatggaaactttgttttggaattggattttgagcccttcaactcatcattcccccgcccaactctttcaaaatccattggtaatggtgtggagttcctaaatcgtcacctttcggcaaaattgttccatgacaaggagagcatgcaccctttgctcgaattcctcagagtccattgccacaagggcaagaacatgatgttgaatgacagaattcagaacttgaatgctcttcaacatgttttgaggaaagcagaggagtatcttggtaccctacctcctgagacaccatgtgccgaattcgaacaccggttccaggaaatcggtttggaaagaggttggggtgacaccgcacaacgcgtgctcgagatgatccaactccttttggatcttcttgaggcacctgatccttgcacccttgagaagttccttgggagaatccccatggtgttcaatgttgtgattctcactccccacggatacttcgctcaagacaatgttttggggtatcccgacaccggtggccaggttgtttacatcttggatcaagtccgagctttggagaatgagatgctcctccgtataaagcaacaaggactcaacatcacccctcgaatcctcattattactagacttcttcctgatgctgtcggaacaacatgcggtcaacgacttgagaaagtatacggaacagagcactcggatattcttcgagtacccttcagaacagaaaagggaattgttcgtaaatggatctcaagatttgaagtctggccatacttggaaacctacacagaggatgttgctcatgaaatctccaaagagttgcaaggcaagccagatctgatcatcggaaactacagtgatggcaatatcgtcgcctccttgctcgcacataaattgggtgtcacacagtgcaccatcgcccatgctttggagaagacaaaatatcctgattcagatatctactggaagaagcttgaagacaaataccatttctcttgccaatttacagctgatctttttgcaatgaaccatacagatttcatcatcaccagtactttccaggaaattgcaggaagcaaggacactgttggtcaatacgagagccacactgctttcactcttcctggtctctaccgtgttgtacatggtatcgatgtgtttgatcccaaattcaacattgtttcccctggtgctgatatggagatatacttcccttacaccgaagagaagcggaggttgaagcatttccatactgagatcgaagaccttctttacagcaaagttgagaatgaagaacacttatgtgtgctcaatgaccgcaacaagccaattctgttcacaatggcaaggcttgatcgtgtcaagaacttaaccggactcgtcgagtggtacggcaagaacgcaaagttgcgtgagttggctaacctcgtagttgtaggtggtgataggcgaaaggaatctaaagatttggaagagaaggccgaaatgaagaaaatgtttgagctgatcgacaagtacaacttgaacggccaattcagatggatatcatctcaaatgaacagaatccgaaatggtgaactttaccgatacatttgcgacacgaaaggtgcctttgtacagcctgcattgtatgaagcctttggattgacagttgtggaggcaatgacttgcggtttgccaacattcgcaacctgtaacggtggaccagccgagattattgtccatgggaaatctggtttcaacattgatccttaccatggtgatcaagctgctgacatactggtcgatttctttgaaaagtgtaagaaagatccatctcactgggataagatctcccaaggaggcttgaaacgtatcgaggagaagtatacatggaagatttactcggagagactattgaccctgacaggagtgtatggattctggaagcatgtttccaaccttgaacgccgtgagagtcgtcgttaccttgagatgttttatgctcttaagtaccgcaagctggctgaatcagttccattggcagaggagtaaattgaagctgttaaataacattgggccggtttttcttggagaataatattctgttttgtaatttcaattggagaagctcttttgtatttcatcttgtcttttccttttccttttttcgccggcattgtttgaacatggggttgtgcgcccgtcaattccagttaaatatggtgacttttgtttttcaagttcctatcttttttatttttatttttttaaacgcttatagccattagcgatgctttcagatgtacaaataaaaaaataaaaaaattgagtatttctaaa

SEQ ID NO: 2431 - DNA, 3038 bp, Gossypium raimondii
gttcctttaccataatttatcggcttttccttctataaattcccatctcaactccagcttcttccattgtattctccattgcgttaaacccctccattcattatttacgttaagttcaaagaaatggctgatcgtgtgatcactcgcgtccacagtctccgtgagcgtttggatgagacccttcttgctcacaggaacgagattttggccttgctctcaaggatcgagggcaaaggaaaaggaattctgcaacaccatcaaattattctagagtttgaagctatccctgaagagaacagaaagaagctcgctaatggtgcattttttgaagtattgaaggctagtcaggaagcgatcgtgttgcctccatgggttgcacttgctgttcgtccaaggcctggtgtttgggagtacattagagtgaatgttcacgcccttgttgttgaggaacttactgttgctgagtatctccacttcaaggaagagcttgttgatggaagttcaaatggaaactttgttttggaattggattttgagcccttcaactcatcattcccccgcccaactctttcaaaatccattggtaatggtgtggagttcctaaatcgtcacctttcggcaaaattgttccatgacaaggagagcatgcaccctttgctcgaattcctcagagtccattgccacaagggcaagaacatgatgttgaatgacagaattcagaacttgaatgctcttcaacatgttttgaggaaagcagaggagtatcttggtaccctacctcctgagacaccatgtgccggattcgaacaccggttccaggaaatcggtttggaaagaggttggggtgacaccgcacaacgcgtgctcgagatgatccaactccttttggatcttcttgaggcacctgatccttgcacccttgagaagttccttgggagaatccccatggtgttcaatgttgtgattctcactccccacggatacttcgctcaagacaatgttttggggtatcccgacaccggtggccaggttgtttacatcttggatcaagtccgagctttggagaatgagatgctcctccgtataaagcaacaaggactcaacatcacccctcgaatcctcattattactagacttcttcctgatgctgtcggaacaacatgcggtcaacgacttgagaaagtatacggaacagagtactcggatattcttcgagtacccttcagaacagaaaagggaattgttcgtaaatggatctcaagatttgaagtctggccatacttggaaacctacacagaggatgttgctcatgaaatctccaaagagttgcaaggcaagccagatctgatcatcggaaactacagtgatggcaatatcgtcgcctccttgctcgcacataaattgggtgtcacacagtgcaccatcgcccatgctttggagaagacaaaatatcctgattcagatatctactggaagaagcttgaagacaaataccatttctcttgccaatttacagctgatctttttgcaatgaaccatacagatttcatcatcaccagtactttccaggaaattgcaggaagcaaggacactgttggtcaatacgagagccacactgctttcactcttcctggtctctaccgtgttgtacatggtatcgatgtgtttgatcccaaattcaacattgtttcccctggtgctgatatggagatatacttcccttacaccgaagagaagcggaggttgaagcatttccatactgagatcgaagaccttctttacagcaaagttgagaatgaagaacacttatgtgtgctcaatgaccgcaacaagccaattctgttcacaatggcaaggcttgatcgtgtcaagaacttaaccggactcgtcgagtggtacggcaagaacgcaaagttgcgtgagttggctaacctcgtagttgtaggtggtgataggcgaaaggaatctaaagatttggaagagaaggccgaaatgaagaaaatgtttgagctgatcgagaagtacaacttgaacggccaattcagatggatatcatctcaaatgaacagaatccgaaatggtgaactttaccgatacatttgcgacacgaaaggtgcctttgtacagcctgcattgtatgaagcctttggattgacagttgtggaggcaatgacttgcggtttgccaacattcgcaacctgcaacggtggaccagccgagattattgtccatgggaaatctggtttcaacattgatccttaccatggtgatcaagctgctgacatactggtcgatttctttgaaaagtgtaagaaagatccatctcactgggataagatctcccaaggaggcttgaaacgtatcgaggagaagtatacatggaagatttactcggagagactattgaccctgaccggagtgtatggattctggaagcatgtttccaaccttgaacgccgtgagagtcgtcgttaccttgagatgttttatgctcttaagtaccgcaagctggctgaatcagttccattggcagaggagtaaattgaagctgttaaataacattgggccggtttttcttggagaataatattctgttttgtaatttcaattggagaagctcttttgtatttcatcttgtcttttccttttccttttttcgccggcattgtttgaacatggggttgtgcgcccgtcaattccagttaaatatggtgacttttgtttttcaagttcctatcttttttattttttttttaaacgcttatagccattagcgatgctttcagatgtacaaataaaaaaaaaaagagtatttctaaataacgtacatcacgagtgaggtcagcttcaatcaaacaataatttaagtgaacaagtggatggataaaagcttttactaatcattttgtttaaagaaactggggaatctaaatttgatttttgacttgttctcctatgcctttggcaattagataacgcaaacccataataattattgtctatgagcacggcatatatgccaatgctggctctctttg

SEQ ID NO: 2432 - DNA, 2927 bp, Cucumis melo
agctgaagctaactaagatttttctgaaaattctgttcaccctccaagaagatagccatggcagaacgagttctcaaccgtgttcatagcctccgggagcgcttggatgaaactttaattgctcaaagaaatgaaatccttggcctcctctcaaagatcgaagcaaaaggaaaaggcatcctgcaacatcatgaactgatcgctgagtttgaaacaattcctgaagagaatcgaaagaaactagcggatggggcatttggggaagtcctgagatccactcaggaatccatagttttgcccccatgggttgctctagctgtccgtccaaggccaggtgtgtgggaatatattaaagtcaatgtccatgcactggttgtcgaagagcttcaagtttctgaatatttgcgtttcaaagaagaacttgtagatggaagttcaaacggcaactttgttcttgagcttgattttgagccatttaatgcttcctttcctcggcccactctctccaaatcaattggcaatggcgttgagttcctcaaccgtcatctctctgcaaagctattccatggtaaagaaagcatgcagccattgctggacttccttagagttcactgctacaagggaaagacaatgatgttgaatgatagaattcagactctgaatgccttccaacatgtgctgaggaaggcggaagagtatcttgtaacccttgcacccgacacaccctactccgattttgcaaacaagttccaggagattggcctagagagagggtggggtgacaccgccgagcgtgttcttgaaatgatccaacttcttttggatctcctcgaggcccccgatccttgcaccttcgagaaattccttggtagaattcccatggtctttaatgttgtcatcctttcaccccacggttacttcgcacaagataatgtcttgggataccctgacactggtggccaggtggtttacatcttggatcaagttcgtgctttggaacatgaaatgcttcaacgtataaagcagcaaggattggacataactcctcgaattctcattatcaccagactccttccagatgcagtaggaactacctgcacccagcgtctcgaaaaagtatttgggacagaacactcccacattcttcgagttccattcagaaatgaaaaaggaatagtccgaaagtggatctcaagatttgaagtctggccttacctagagacttacactgaggatgttgcacaggaacttaccaaagagttgcagggaaagcctgacctgatcatcggaaactacagcgatggtaatatcgttgcatcattactggcacacaaactgggagttacacagtgtactattgctcacgccttggaaaaaaccaaatatcctgattcagatatttattggaagagatttgatgagaagtatcacttctcaagccaattcacagccgatcttattgccatgaaccataccgatttcattatcacgagtaccttccaagagattgctggcagcaaagatacagttggacaatatgagagtcacacagcttttactcttcccgggctctaccgggtggtccacggaatcgacgtgtttgatcccaagttcaacatagtttcacctggagcagacatgagcatctactttccctacacagagaccgagaagaggctgacttccttccaccctgaaattgaggagcttctttatagtgaagttgagaatgaggaacacttgtgtgtattgaaagatcggtccaagccgatcatattcacaatggcgagattggatcgtgttaagaacataactggacttgttgagtggtacggcaaaaacaaccgccttagggagttagttaacctagtggttgttgctggagaccggaggaaggagtccaaggacaatgaagagaaggctgagatggaaaagatgtataacctcataaagacctacaacctgaatggccaatttagatggatttctgcacagatgaaccgagtaagaaatggtgaactctaccgatgcattgcagacacaaagggagctttcgtgcagcctgccgtatacgaagctttcggtttgacagttgtggaggccatgacctgtggattgcctacctttgccacttgcaatggtggccctgcagagatcattgtcgacggaaaatctggattccatatcgatccataccgtggtgaccgtgctgctgaaatccttgtcgacttcttcgagaagagcaaggaagacccaacacattgggataaaatctcccaagcaggcctcaagcgtatttacgagaagtacacatggcagatctattcggagaggctgctaacactaactggagtttacggattctggaagcacgtatccaacctcgaccgcctcgagagccgccgttatctggaaatgttttacgccctcaagtaccgtaagctggctgattctgtgccaccggctgtggatgagtgagaaacgttggaagggaaatgaaagaagggagcatcagtaaattagttatagaggaagtagttgttgttctctaatatccacagaagttaataaaagagatatgttgatgcttcctacaaatgtgaataatgcaaagcagagtttattgtttttgtttttcgtttttgtcattgctttcttttgaaaggtttgatttatctgatattgttgtaacaatcgggtgttctgaacccgtcatcaatttgagtattattctctttgcgatatttaaactgaatctattcagaaaaattaaagcatgaagttatgttgattgatagtttgatctcagaaaagctaaaaattggggtataacttcataccaaccttgaagcatcaacgtaactaaaggttttatatatgatactccaaattttaagccgaataacaatgttcctctaaattctaat

SEQ ID NO: 2433 - DNA, 3739 bp, Citrus sinensis
aaattttcaaatcagctgtccctctttgattgtttgacaagtttcgtgcgctgcgatgacggtacatttgtcacctgcatgattctctccgtagctctttgccttgattgttaggttaattttttcccatttttctagcttcaacgtctctgtaattgttgttgactaccgtctcccctcgatttttccgcaacagtaccagtcgcaatcgcaattcacgaagcctcaaacaagatttaccaaaatgccctcgtcaagtgccaatttattggatgtcagaataagttacacatgcagttaaataaattccgagctctcccactataaatctcatcgccaaggctactctagcttgcattcccattctcttcattgcgtttctaccgtccgtacgtttttcttgttttctctaggtactctgtttttctcttcttcccattcttcttcttttcgtctagttttgaattcttcttcgaggtcgaggatcgtgttcaatgctctagtctatcctgttgaattacttgttcatattttacgctgattttatttgaccacctctagaaactcagccttaaaaaaagctcctcagattcactgtttcctttgctagaattttctcccatgcttttgttggtggactactaaaaagaaaaaggataaagaaaaaagaaaagctttgatccaaaatttatccctggtagccacacaaagtggtagttcaattattatgcctacgctttaaagattttggtaatattatgtttggcactatactggccaaccagcacataagtgaatattcttaacaaattaagacgcaatgttaatttttaagacagtaatataagttgaacaatatagactctttgcgtaattaatattttaaagacttggttgttgaaacttgaaactggaggtgggggtaggtttagaaatttttcgtcttctagatttttttatttgactattcggattatccataatccatttcttctctatataatgaaggttggttttggatagacagctatatctttacgttatttacgtttgcttggttccttgtgttgcagttgaagtttttgtttgtctgagaatcaatggccgaacgtgctttgacccgcgttcacagtctccgcgagcgtttggatgagactctctctgcccacaggaatgaaatcttggcccttttgtcaaggattgagggcaagggcaagggaatcttgcaaaaccatcaacttattgctgagtttgaatcaatttctgaggaaaacagaaagcatctaactgagggggcatttggtgaagttctaagagccacccaggaagcaattgttttgcctccgtgggtagcgcttgccgtgcgtccaaggcccggtgtgtgggagtacatccgagtgaatgtccatgcccttgtcgttgaggagctgcttgtagccgagtacctgcacttcaaggaggaacttgtcgatggaggctccaatggcaacttcgtgcttgagttggattttgagccattcaatgcctcgttccctcgcccaactctttcaaagtctattggaaatggtgtggaattccttaaccgccacctttctgcgaagctcttccatgacaaggagagcatgcatccactgcttgaatttctccgcgtccactgccacaagggcaaaaacatgatgctgaatgacagaattcagaacttgaattctcttcaacatgttctgaggaaggcagaggagtatctgaccacagtggtaccagaaacgccattctctgagttggcactaagatttcaggagattggtttggagagaggttggggtgatactgctgagcgtgcacttgagatgattcagcttcttttggatcttcttgaggcacctgatccgtgcactcttgagactttccttggcagaatccccatggtctttaatgttgtgatccttactccccacggttactttgcccaagacgatgttttgggctaccctgatactggtggtcaggttgtttacatcttggatcaagttcgtgccttggaggatgagatgcttcttcgtatcaagcagcaaggacttgatatcacccctcaaatcctcattattacccgtctcctcccagatgcagtaggcacaacatgtggtcagcgacttgagaaagtttatggaactaagtattcagatatacttcgagttccctttagaactgagaagggagttgtccgcaagtggatctcacgatttgaagtctggccttatctagagacctacaccgaggatgttgctgttgaaattgccaaagagttgcagggcaagcctgatctaatcattggaaactacagtgatggcaacattgttgcttccttgttagcacataaactaggtgttacccagtgtactattgctcatgctttggagaaaacaaaatatccagattctgacatctactggaaaaatttggatgacaaataccacttctcatgccaatttacagctgatcttatagccatgaatcacactgacttcatcatcaccagtaccttccaagagattgctggaagtaaggacactgttggtcagtatgagagtcacactgctttcactcttcctggactctaccgtgttgtacatggtattgatgtgtttgatcccaagttcaacattgtatctcctggtgctgatatgagcatttacttcccctacactgaggagaagagaaggctgaagtctttccatcccgagattgaggagttgctttacagcgatgttgagaataaggaacacttatgtgtgctgaaagaccgcaacaagcccatcctgtttacaatggcaagattggaccgtgtaaagaatttgactgggcttgtggagtggtatggaaagaatgctaagctacgtgagttggtgaacttagtcgtagtgggtggtgataggagaaaggagtccaaggacttggaagaacaggctgaaatgaagaagatgtattccctcattgatcaatacaaattgaatggccagttccgatggatctcttctcagatgaatcgggtcaggaacggtgaattgtaccggtacatttgtgatacaaagggagcttttgtgcaacctgcactgtatgaggcctttggcttgactgttgttgaggccatgacctgtggattgccaacatttgcaacttgcaagggtggccccgctgagattatcgttaacgggaaatctggctaccacattgatccttaccatggtgagcaggctgctgagatccttgttgacttctttgagaagtgcaaggcagatccctcatactgggacaagatatcactgggtggcctgaagcgtattgaagagaagtatacatggaaaatttactctcagaggcttctgaccctgactggagtctatgggttctggaaacatgtatctaaccttgatcggcttgagagccgtcgataccttgaaatgttttatgctctcaagtaccgtaagctggctgaatctgttcctctggctgtggagtaaatggacattgaggaagctctcagggtggttggtccgagtggagatttctcgagttgtggagaataatgtcccttctgggattgcgattggacaaagacttttttaccggcttaaattttcttttttcaattttttttttcctttttgcatttctcagcattgtttgtactttgggtgttgcaccctcatcaattccattatagtttgtgactttttggcca

SEQ ID NO: 2434 - DNA, 2615 bp, Castanea mollissima
atttctgttttaaggttttttaagaatttttgaaagttggccatggccggaagtgctctgaccagagtccatagcctccgtgaacgtttggatgagaccctctctgctaaccgtaacgaaattgttgcactactttcaaggattgaaggcaagggaaaaggaattttgcaacaccatcagctaattgctgaggtagaagcaatccctgaagctaacaggaagacacttttggatgggccttttggtgaagttttgagagccgctcaggaagccattgttctgcctccatgggttgccttggctgttcgtcctaggcctggtgtttgggaatacataagagtgaatgtccatgctcttgttgttgaggagttgcgtgtgcccgagtacttgcacttcaaagaagaactcgtcgatggaagtgtcaatgggaactttgtgcttgagttggattttgaacccttcactgcatcgtttccccacccaactctttcaaagtccattggaaatggcgtggagttccttaaccgtcacctttctgcgaagctcttccatgacaaggagagcatgcacccactgcttgaatttctcagagttcactgctacaagggcaagactatgatgctgaatgacagaattcacaacgtggattccctacagtatgtacttaggaaagcagaggagtatctgactacacttgcccctgaaaccccttattctacgtttgagcacaagttccaggagattggtttggagagaggttggggtgacacagctgagcgcgtactagaaatgatccaacttcttttggatcttcttgaagctcctgacccctgcaccctcgagacatttcttggcaaaatccctatggtctttaacgttgtaatcatgtctccccatggttactttgcccaggataatgtgttgggataccctgacactggtgggcaggttgtttatatcttggatcaagttcgggccttggagagtgagatgcttaagcgtatcaagcatcaaggcttggatatcacccccagaatcctcattgtcacccgactcctccctgatgcagcaggaaccacatgtggtcagcgtcttgagaaagtgtttgggtgtgagcatgcacatattcttcgagttccttttagagatgagaagggaatggtccgcaaatggatctcaagattcgaagtttggccatatctagagaattacaccgaggatgttgcacaagaacttaataaagagttacaagggaagccagatttgatcattggaaattacagtgatggaaacattgttgcctcattgttggcacataagtttggtgttacacagtgcaccattgcccatgctcttgagaagacaaagtaccctgaatctgacatttactggaaaaaatttgaggagaagtaccacttctcttgccaatttactgctgatcttattgccatgaatcataccgatttcattatcaccagtactttccaagaaattgctggaagcaaagacactgttggtcaatatgagagtcacacttccttcacccttcccggactttatcgcgttgttcacgggataaatgtgtttgatcctaaattcaacatcgtctcccctggagcagatatggatatttacttcccctacactgaggaaaagaaaaggttgacagccttccaccccgaaattgaagagctcctttactcttctgtggagaacgaagaacacttgtgtgtattgaaagacaagaacaagcccatcatattcacaatggccaggttggatcgtgtgaaaaatatcacaggtcttgttgagtggtacggtaagaacaaacgtcttcgcgagttggttaacctcgttgttgttgctggggatcggcgaaaggagtctaaggacttggaagagcaagctgagatgaagaaaatgcatactcttattgaaacctacaagttgaatggccagtttagatggatttcttcccagatgaaccgagtgaggaatggtgaactctaccgtgttattgctgatacaaagggagcctttgtgcagcctgccgtatatgaagcttttgggttgacagttgttgaggccatgacttgtggattgccaacatttgctacttgtaatggtggcccagctgagattattgtacatggtaaatcaggcttccacattgatccttatcatggtgaacaagcagccgagctcctcgtaggcttctttgagaagtgtacgaaagacccttctcactgggaccaaatctctcagggaggattgaagcggatctatgagaagtacacatggcagatttattccgagaggttgttgacccttactggggtttatggcttttggaagcatgtgtctaatctggatcgccgtgagagccgtcgttatcttgagatgttctatgctctcaagtaccgtaagctggctgagtccgttcctcttgccgtcgagaaatgaaattgaaatttgaagggtaaaaaaaaagcggcagcattgcatgggctagaacaagttgagtttttttctgaattctgaggaaataatggccatggttttcgagatatgtgattaaaagtaggattaagcttttttttttttttttttttttt

SEQ ID NO: 2435 - DNA, 2834 bp, Gossypium raimondii
atcccatttcattatttgcgttcatttgattttctgggtttttccccccgttatttttagtatcagcattgtctttttttcttctttagttttgccttgttgaaagctcaagttcgaagaaatggctgagcgtgctctcactcgcgtccacagtctccgtgagcgtttggattccacacttaccgcccacaggaacgagattttggctttgctctcaaggattgaaggtaaaggaaaaggaatccttcttcaccatcaaatcattcttgagtttgaagctatccctgaagagaaccgaaagaaattagctgatggtgcattttttgaaatactgaaagccagtcaggaagccatcgtgttgccgccgtgggtggcgctggccgtccgaccaagacctggtgtttgggagtacattagagttaatgttcatgctcttgttgttgaagaactcactgttgctgagtatcttcgtttcaaggaagagcttgttgatggaagttcaaatgcaaactttgttttggaactggatttcgagcccttcaacgcgtcgttccctcgcccgactctttcgaaatcaatcggtaacggcgtcgagttccttaatcgccacctttcggccaaactgttccatgacaaggagagcatgcaccctttgcttgaattcctgaaagtccattgtcataagggcaagaacatgatgttgaatgataggattcaaaacttgaattctctccaacatgttttgaggaaggcagaggagtatcttgttgcgctgccggctgagacttcttatgccgatttcgaacacaagttccaggagattggtttggagagagggtggggtgatacagctgagcgtgtgctcgagatgatccaactccttttggatcttctcgaggcacccgatccttgcacccttgagaagttcctcgggagaattcccatggtgttcaatgtcgtgattcttacacctcacggttactttgctcaggacaatgttttggggtatcccgacaccggtggccaggttgtttacatcttggatcaagtccgtgccttggagaacgaaatgctcaaccgtatcaagcaacaaggactcaatattacccctcgtattctcatcattactcgacttctccctgatgccgtgggaacaacttgcggtcaacggctcgagaaagtatacgggacggagtactcggatattcttcggatacccttcagaacagagaagggaatcgtacgtagatggatctcgagatttgaagtctggccttacttggaaacttacactgaggatgttgctcatgagatttcaaaagagttgcaaggcaagcccgatttaatcatcggaaactacagtgatggtaatatcgtcgcctccttgctggcacataagttgggagttacacagtgtacgattgcccacgctttggagaagacaaagtatccagattccgacatctactggaagaagctcgaggataaatatcatttctcctgccaatttacagctgatcttttcgctatgaaccatacggatttcatcatcaccagtaccttccaagaaattgccggaagcaaggacactgttggtcaatacgagagtcacactgctttcactcttcccggtctctaccgtgttgttcacggaattgatgtgtttgatcctaaattcaacattgtgtcccctggtgccgacatgagcatatactacccttacaccgaggagaagaagaggttgaagcatttccattccgagatcgaagaacttctttacagcaaagttgaaaatgaagaacactggtgtgtgctaaacgaccgcaacaagccaattctatttacaatggcaaggctggatcgtgttaagaatttaactggacttgttgaatggtacgggaagaatgctaagttgcgtgaattggttaaccttgtagttgtcggtggagatcggagaaaagagtccaaggatttggaagagaaggctgagatgaagaagatgttcgagctcattgagaagtacaagctgaacggtcagttcagatggatatcatcccaaatgaacagagttaggaacggtgaactttaccgttacatttgcgacacaaagggtgcctttgtgcaacccgcattatatgaagcctttgggttgactgtcgttgaggccatgacttgtggtttgccgacattcgcaacttgcaatggtggacctgccgagattatcgttcatggtaaatccggcttcaacattgatccttaccacggcgaccaagctgctgagatccttgtcgacttcttcgagaaatgcaagacagacccatcttactggaccaaaatctctgagggaggtttgaaacgtatcgaagagaagtacacatggaaaatttactctgagagactattaaccttgaccggtgtctacgggttctggaagcatgtgtccaacctcgaccgcctcgagagccgtcgttaccttgagatgttttacgctcttaagtaccgtaagctggccgaatcggtacctttggcagttgaagagtaaattgaagttgccggggaaagaattgggagggatttccgagttcttgagaataatctttgttgttttggcattttgatccaactcttttgttttctcttttcttttatgtgtatttgtttttgttcatgttttgggcattgtttgaacatctgggtgttgagcccatcaattctagtaaagtaaaatatggcaacttttgcttcacatgtttcatcccttttatgtaacaaatcaaagcttgcatcatatatgtagaagctgaaacaactcgcacatggtgagccttcgatta

SEQ ID NO: 2436 - DNA, 2952 bp, Gossypium raimondii
aagttggtggaggtgacagcctccccctttgcgtataaaaggctcactagcctcacctctttcaccatcccatttcattatttgcgttcatttgattttctgggttttccccccccttatttttagtatcagcattgtctttttttcttctttagttttgccttgttgaaagttcaagttcgaagaaatggctgagcgtgctctcactcgcgtccacagtctccgtgagcgtttggattccacacttaccgcccacaggaacgagattttggctttgctctcaaggattgaaggtaaaggaaaaggaatccttcttcatcatcaaatcattcttgagtttgaagctatccctgaagagaacagaaagaaattagctgatggtgcattttttgaaatactgaaagccagtcaggaagccatcgtgttgccgccgtgggtggcgctggccgtccgaccaagacctggtgtttgggagtacattagagttaatgttcatgctcttgttgttgaagaactcactgttgctgagtatcttcgtttcaaggaagagcttgttgatggaagttcaaatgcaaactttgttttggaactggatttcgagcccttcaacgcgtcgttccctcgcccgactctttcgaaatcgatcggtaacggcgtcgagttccttaatcgccacctttcggccaaactgttccatgacaaggagagcatgcaccctttgcttgaattcctgaaagtccattgtcataagggcaagaacatgatgttgaatgataggattcaaaacttgaattctctccaacatgttttgaggaaggcagaggagtatcttgttgcactgccggccgagactccttatgccgaattcgaacacaagttccaggagattggtttggagagagggtggggtgatacggctgagcgtgtgctcgagatgatccaactccttttggatcttctcgaggcacccgatccttgtacccttgagaagttcctcgggagaattcccatggtgttcaatgttgtgattcttacacctcacggttactttgctcaggacaatgttttggggtatcccgacaccggtggccaggttgtttacatcttggatcaagtccgtgccttggagaacgaaatgctcaaccgtatcaagcaacaaggactcaacattacccctcgtattctcatcattactcgacttctccctgatgccgtgggaacaacttgcggtcaacggctcgagaaagtatacgggacggagtactcggatattctccgaatacccttcagaacagagaagggaatcgtacgtagatggatctcgagatttgaagtctggccttacttggaaacttacactgaggatgttgctcatgagatttcaaaagagttgcaaggcaagcccgatttaatcatcggaaactacagtgatggtaatatcgtcgcctccttgctggcacataagttgggagttacacagtgtacgattgcccacgctttggagaagacaaagtatccagattccgacatctactggaagaagctcgaggataaatatcatttctcctgccaatttacagctgatcttttcgctatgaaccatacggatttcatcatcaccagtaccttccaagaaattgccggaagcaaggacactgttggtcaatacgagagtcacactgctttcactcttcccggtctctaccgtgttgttcacggaattgatgtgtttgatcctaaattcaacattgtgtcccctggtgccgacatgagcatatactacccttacaccgaggagaagaagaggttgaagcatttccattccgagatcgaacaacttctttacagcaaagttgaaaatgaagagcactggtgtgtgctaaacgaccgcaacaagccaattctatttacaatggcaaggctggatcgtgttaagaatttaagtggacttgttgaatggtacgggaagaatgctaagttgcgtgaattggttaaccttgtagttgtcggtggagatcggagaaaagagtccaaggatttggaagagaaggctgagatgaagaagatgttcgagctcattgagaagtacaagctgaacggtcagttcagatggatatcatcccaaatgaacagagttaggaacggtgaactttaccgttacatttgtgacacaaagggtgccttcgtacaacccgcattatatgaagcctttgggttgactgtcgttgaggccatgacttgtggtttgccgacattcgcaacttgcaatggtggacctgccgagattatcgttcacggtaaatccggcttcaacattgatccttaccacggcgaccaagctgctgagatccttgtcgacttcttcgagaaatgcaagacagacccatcttactggaccaaaatctctgagggaggtttgaaacgtatcgaagagaagtacacatggaaaatttactctgagagactattaaccttgaccggtgtctacgggttctggaagcatgtgtccaacctcgaccgcctcgagagccgtcgttaccttgagatgttttacgctcttaagtaccgtaagctggccgaatcggtacctttggcagttgaagagtaaattgaagttgccggggaaagaattgggagggatttccgagttcttgagaataatctttgttgttttggcattttgatccaactcttttgttttctcttttcttttatgtgtatttgtttttgttcatgttttgggcattgtttcaacatctgggcgttgagcccatcaattctagtaaagtaaaacatggcaacttttgcttcacatgtttcatcccttttatgtaacaaatcaaagcttgcatcatatatgtagaagctgaaacaactcgcacatggtgagccttcgattatccgcataccaaatcaggcactgcatggtataataacacatttagtcctcaa

SEQ ID NO: 2437 - DNA, 2746 bp, Manihot esculenta
tctttcaatcaccccacttcattgcgtttcccttctttattctccttttttgcgtttgaggttttctgatcataagctatggctgaacgtgttatcactcgcgttcacagcatccgtgaacgtttggatgagactctttctgctcaccgcaatgaaattgtggccttactctcaaggattgaaggcaagggaaaaggaattcttcagcatcaccagatcattgctgaatttgaagcaatccctgaagagaacagaaagaaactattggatggtgcatttggggaagttttgagatctgcacaggaagcaattgtcttgcctccttgggttgctcttgctgtgcgcccaaggcctggtgtttgggagtacattagagtgaatgtgcatgcactcgttgttgaggagctgcgtgttgccgagtatctgcacttcaaggaggaacttgttgatggaagtgtcaatggcaactttgtgctagagttggatttcgaaccattcaatgcatcttttcctcgcccaactctctcaaagtacattggtaatggtgtggagttccttaatcgtcacctttccgcaaaattgttccatgacaaggagagcttgcatcctctgcttgaatttctgaaagtccactgccacaagggaaagaacatgatgctgaatgacagaattcataacttgaattctttgcaatatgttctgaggaaggcagaggagtatctcactgcattgtcacccgatactccctactctcagttcgagcacaggttccaggaaattggcctggagagaggttggggtgataccgctgagcgtgttctagagatgatccggcttcttttggatcttcttgaggcaccagacccctgcactcttgaaacattcttgggaagaatcccaatggtgttcaatgttgtgatcatgtctcctcatggatacttcgcccaagacaatgttttggggtatcctgacactggaggccaggttgtttatatcttggatcaagtccgtgccttagaaacagaaatgcttcaacgtataaagcagcagggacttgatatcaccccccgcattctcattatcactcgacttcttcctgatgcagtaggaaccacttgcggtcaacgtctagaaaaagtatttggaacagagcattcagatatccttcgtgttcctttccgaaatgagaagggaattgttcgtaaatggatctcacgatttgaagtgtggccatatctagagacctacactgaggatgttgccaccgaaattggcaaggagttacaaggaaagcctgatctgatcattggaaattacagtgatggaaacattgttgcctctttgttagcacacaaattaggtgttacagagtgtaccattgctcatgctctcgagaaaacaaaatatccagactcagacatctactggaagaagttcgatgagaagtaccacttttcatgccagtttactgctgatcttatagcaatgaatcatacagatttcatcatcaccagcacattccaagaaattgctggaagcaaggacactgttggtcaatatgagagccacacagctttcacccttcccggcctataccgagttgttcatggtattgatgtctttgatcccaaattcaacattgtctcccctggtgctgacgagagcatatactttgcctacacggaggagaaacgtaggttgacctctttccatccagaaattgaggagcttctctacagccctgttgaaaacgaagaacacttatgtgtgctaaaggatcgcaacaagccgattatattcaccatggcaagactggacagagttaagaatttatctggccttgtagaatggtacggaaagaatgccaagcttcgtgaattggctaaccttgtagtagttggtggtgatagaagaaaagagtctaaagatttggaagagcaagctgagatgaagaaaatgcatagtcttattgagaaatacaatctgaatggccagttcagatggatttcttcccagatgaaccgagtgaggaatggagagctctaccgttgcatttgcgacaccaagggtgttttcgtgcagccagctctatacgaagcttttggtctgactgttgttgaggccatgacctgtggtttaccaacgttcgctacttgcaatggtggacctgctgagattattgtgcatggaaaatccggcttcaacattgatccttaccatggtgatcaggctgctgaactccttgttgagttcttcgagaagtgcaaggccgatccacctcactgggacaagatatcccagggagccatgcaacgtatccaagagaagtatacttggcaaatctactctcagaggctattgactctcactggtgtatatggcttctggaaacatgtctctaagcttgatcgtcgcgaaagccggcgctaccttgaaatgttctatgctctcaagtaccgcaaattggctgaatctgttcctctaactgttgaggattaagtggtgagctacgtaattcaagagagctgaaggttcaagcgggaagtttcggagttgtgaagcataataatggtcattttactgttgtgatcggacgaagaaggaattcccattgcttcattttgctcttttcttctgtttttttgttttttggtttttttcccttcacctttctgcggcattgtttgaactttggctgttgagcccttttcatcaattgcagtaaagattgtctttttttgcttca

SEQ ID NO: 2438 - DNA, 2572 bp, Vigna unguiculata
cgaaggcaagggcaaggggatcttgcaacaccatcaggtcattgccgagttcgaggaaatccccgaggagagcagacagaagcttaccgatggtgcttttggagaagtcttgagatctactcaggaagccatagttttgccaccatgggttgctctggccgttcgtccaaggcctggtgtgtgggagtatctgagagtgaatgtgcacgctcttgttgttgaggtgttgcaacctgctgagtacctgcgcttcaaggaggaacttgttgatggaagttctaatggcaacttcgtgcttgagttggactttgaaccctttaccgcatccttccctcgcccaactcttaacaagtcaattggaaatggcgtgcagttcctcaaccgtcacctttctgccaaactcttccatgacaaggagagcctgcacccgcttttggaattcctcaggcttcacagcgtcaagggaaagactttgatgttgaatgacagaattcaaaacccggatgctcttcaacatgttctgaggaaagctgaggagtatctgggcacggtgcctcctgaaaccccctactcagcatttgagcacaagttccaggagattggtttggagagagggtggggtgacaacgctgagcgtgtgctggagtcaattcaacttctcttggatcttcttgaggcccctgatccttgcacccttgagactttccttggaagaatccctatggtgtttaatgttgttattctttctccccacggttactttgcccaagataatgtcttgggataccccgacactggtggtcaggttgtttacatcttggatcaagttcgtgctttggagaatgagatgctccatcgcattaagcaacaaggattggacattgttcctcgtattctcatcatcacccgtcttctcccagatgcagtaggtactacttgcggccaacgtcttgagaaggtgtttggaaccgaacactctcacattcttcgagttccctttagaactgagaagggaattgttcgccagtggatctcaagatttgaagtctggccatacttggaaacttacaccgaggatgttgctcatgagcttgccaaagagttgcagggcaagccagatctgatcgttggaaactacagtgatggaaacattgttgcctctttgttggcacataaattaggtgtcactcagtgtaccattgctcatgcacttgagaagaccaaataccctgaatccgacatttactggaaaaaactggaagagagataccacttctcttgccaattcacagctgatctttttgccatgaaccacactgatttcattatcaccagtacattccaagagattgctggaagcaaggacactgttggacagtatgagtctcacacagccttcacccttcctggactctaccgtgttgtgcacggtatcgatgtgttcgatccaaaattcaacattgtctctcccggagccgatcaaaccatttacttccccccaaccgaaactagccgcaggttgacctctttccaccccgaaatcgaagagcttctctacagttcagtcgagaacgaagaacacatatgtgtgctgaaggaccgcacgaagccgattatcttcacgatggcgaggttggaccgcgtgaagaacatcacaggactggtggagtggtacggtaagaacgcgaagctgagggagctggtgaaccttgtggtggtggccggagacaggaggaaggagtcgaaggacctggaagagaaggcggagatgaagaagatgtatggcctgatcgagacgtacaagttgaacggacaattcagatggatatcgtctcagatgaaccgtgtgaggaacggagaattgtaccgtgtgatctgtgacacgaggggtgcgtttgttcagcctgcggtgtatgaggcatttggtttgacagtggtggaggccatgacttgtgggttgccaacattcgcaacatgcaatggtggacctgctgagatcattgttcatggaaaatctgggttccacattgatccttaccacggtgaccgtgctgctgatctccttgttgacttcttcgagaagtgcaaggttgacccatctcactgggacaaaatctctcaagctggtctccaacgtattgaagagaagtacacatggcagatttactcccagaggcttctcacactcactggtgtttatggtttctggaagcatgtttctaacctcgatcgccgtgagagtcgccgctatcttgagatgttctatgctctcaagtaccgcaaattggctgagtctgtgccccttgctgttgagtaaaaaactgaggatgaagaaatggaggaaccggctttttctttctcatttggagtttgtcgtacttgagtttcataaataatgtccatcatgttaattctgtgattaagtttcgataagaagagagagagagagagagaggaaaaaaaaagctcttttgttttttttctttttgcatgatttggatctttgattgaaaaatcttggaattggggtgttttgcccatcaattcagtttttttaagccgtgccttctta

SEQ ID NO: 2439 - DNA, 3093 bp, Citrullus lanatus
attttccatttaagactgtagaactctcttttccattttccttccagctgaatcaagacccaaattttgaaaattttgtcagatactccggtagagtctggtttggttggtgggtttaggaatttttaatccagatattagttgtagatgttttgactattgagtatgagtaatcaacccacttgcattagtaggtgaagattgatttggataaaatggattttcacatattttaatgttttctcttgcagctgaacctagataagatttttactgaaattactgtttaccctccaagaagatagtcatggcagaacgagtcctcaaccgtgttcacagcctccgcgagcgcttagatgaaactttaattgctcaaagaaatgaaatcctgggcctcctctcaaagattgaggccaaaggaaaaggaatcctgcaacatcatcaactgattgctgagtttgaagcaattcctgaagagaatcgaaagaaactagctgatggggcatttggggaagtcctgagagccactcaggaatccatagttttgcccccatgggttgctcttgctgttcgtccaaggccaggtgtgtgggaatatattaaagtcaatgtccatgcactggttgttgaagagcttcaagttgctgaatatttgcacttgaaagaagaacttgtagatggaagttcgaacggtaacttcgttcttgagcttgattttgagccatttaatgcttcctttcctcggcctactctctccaagtccattggcaatggcgttgagttcctcaaccgtcacctctctgcaaagctattccatggtaaagagagtatgcagccattgctggacttcctcagagttcactgctacaagggaaagacgatgatgttgaatgatagaattcagaccctgaatgccttccagcatgtgctgaggaaggcagaggagtatctagcaacacttgcacctgaaacaccctactccgagtttgcaaacaagttccaggagattggcctagagagaggatggggcaacactgccgagcgtgttctcgaaatgatccaacttcttttggatctcctcgaggcccctgatccttgcacattcgagaagttccttggtagaatccccatggtctttaatgttgtcatcctttcgccccacggttactttgcacaagataatgtcttgggttaccctgatactggtggccaggtggtttacatcttggaccaagttcgtgctttggagcatgaaatgcttcaacgtataaagcagcaaggattggacataactcctcgcattctcattatcacccgactccttccagatgcagtaggaaccacctgcacccagcgtctcgagaaagtatttgggacagagcactcccacattcttcgagttccattcagaaacgagaaaggaatagtccgaaagtggatctcacgatttgaagtctggccttacctagagacttacaccgaggatgttgcacaggaacttaccaaagagttgcagggaaaacccgatctgatcattggaaactacagcgacggcaatatcgttgcctcattgctggcacataaactgggagttacacagtgtactatcgctcatgccttggagaaaactaaatatcctgattcagatatttattggaagagatttgatgacaagtatcacttctcatcccaattcacagctgatcttattgccatgaaccataccgatttcatcatcacaagtactttccaagagattgctggcagcaaagatacagttggacaatatgagagtcacacagctttcactcttccggggctctaccgagtggtccacggaattgatgtgtttgatcccaagttcaacattgtttcacctggagcagacatgagtatctacttcccgtacacagagaccgagaagaggctgacttccttccaccctgaaatcgaggagcttctttatagtgaagttgagaatgaggaacacttgtgtgtattgaaagatcggtccaagccgatcatattcacaatggcgagattggatcgtgtgaagaacataactggacttgtcgagtggtacggcaagaacaagcgccttagggagttggttaacctagtggttgtggctggagaccggaggaaggagtctaaggacaatgaagagaaggctgagatggaaaagatgtatagcctaataaagacctacaacctgaatggccaatttagatggatttctgcacagatgaaccgagtaagaaacggtgaactctaccgatgcattgcagacacgaagggagcttttgtgcagcctgctgtgtacgaagctttcggtttgacagttgtggaggccatgacctgtggattacctacctttgccacatgcaatggaggccctgctgagattatcatcgacggtaaatctggcttccatatcgatccataccgtggtgatcgtgctgctgaaatccttgtcgacttcttcgaaaagagcaaggaagacccatcacattgggataaaatctcccaagcaggcctccagcgtatctacgagaagtatacatggcagatctattcggagaggctgctaacactaactggagtttacggattctggaagcatgtatccaaccttgaccgcctcgagagccgccgttatttggaaatgttttacgccctcaagtaccgcaagctggctgattctgtgccacaggctgtggatgagtgagaaagcttggaagggaaatgaaagaggggagcatcagtaatggagaaaaatagttgttctctgatttccacaggagttaataaaaagagagatatgttgatgcttcctgcaaatgtgaataatgcaaagaagaagagtttattgttattgttattgtttttgtcattgctttcttttgaaaggtttgaattgtctcatattgttgtatcaattgggtgttttgaacccgtcatcaattggagtattattcccttttttcttctctacaacatttaaacagaatccatacaggaaactaaagcatatttttagaaaaacaaaaagaagttatggtgattcacagtttgatcttagaaacgaaattg

SEQ ID NO: 2440 - DNA, 2737 bp, Cucumis sativus
agctgaagctaactaagatttttctgaaaactctgtgcaccctccaagaagatagccatggcagaacgagttctcaaccgtattcatagcctccgggagcgcttggatgaaactttaattgctcaaagaaacgaaatccttggtctcctctcaaagattgaagcaaaaggaaaaggcatcctgcaacatcatgaactgatcgctgagtttgaaacaattcctgaagagaaccgaaggaaactagctgatggggcatttggggaagtcctgagatcaactcaggaatccatagttttgcccccatgggttgctcttgctgtccgtccaaggccaggtgtttgggaatacattaaagtcaatgtccacgcactggttgtcgaagagcttcaagcttctgaatatttgcgcttcaaagaagaacttgtagatggaagttcgaacggcaactttgttcttgagcttgattttgagccatttaatgcttcctttcctcggcccactctctctaaatccattggcaatggtgttgagttcctcaaccgtcatctctctgcaaagctattccatggtaaagagagcatgcagccattgctggacttccttagagttcactgctacaagggaaagacaatgatgttgaatgatagaattcagactctggatgccttccaacatgtgctaaggaaggcggaagagtatcttgtaacacttgcacccgaaacaccctactccgagtttgcaaacaagttccaggagattggcctagagagagggtggggtgacactgccgagcgtgttctcgaaatgatccaacttcttttggatctccttgaggcccccgatccttgcaccttcgagaaattccttggtagaatccccatggtctttaatgttgtcatcctttcaccccacggttacttcgcacaagataatgtcttgggttaccctgacaccggtggccaggtggtttacatcttggatcaagttcgtgctttggagcatgagatgcttcaacgtataaagcagcagggattggacataactcctcgaattctcattatcaccagactccttccagatgcagtaggaaccacctgcacccagcgtctcgaaaaagtatttgggacagaacactctcacattcttcgagttccattcagaaatgagaaaggaatagtccgaaagtggatctcaagatttgaagtctggccttacctagagacttacactgaggatgttgcacaggaacttaccaaagagttgcagggaaagccagacctgatcattggaaactacagcgacggtaatattgttgcatcattactggcacacaaactgggagttacacagtgtactatcgctcacgccttggaaaaaaccaaatatcctgattcagatatttattggaagacatttgatgataagtatcacttctcaagccaattcacagccgatcttattgccatgaaccataccgatttcattatcacgagtaccttccaagagattgccggcagcaaagatacagttggacaatacgagagtcacacagctttcactcttccggggctctaccgggtggtccatggaatcaatgtatttgatcccaagttcaacatagtttcacctggagcagacatgagcatctactttccctacacagagaccgagaaaaggctaactgccttccaccctgaaattgaggagcttctttatagtgaagttgagaatgaggaacacttgtgtgtattgaaagatcggtccaagccaatcatattcacaatggcgagattggatcgtgttaagaacataactggacttgtcgagtggtacggcaaaaacgatcgtcttagggagttagttaacctagtggttgtggctggagaccggaggaaggagtccaaggacaatgaagagaaggctgagatggaaaagatgtataacctaataaagacctacaacctgaatggccaatttagatggatttctgcacagatgaaccgagtaagaaatggtgaactctaccgatacatcgcagacacaaagggagctttcgtgcagcctgccgtatacgaagcttttggtttgacagttgtggaggccatgacctgtggattgcctacctttgccacttgcaatggaggccctgcagagattatcgtcgacggcaaatctggcttccacatcgatccataccgtggtgaccgtgctgctgaaatccttgtcgacttcttcgagaagagcaaggaagacccaacacattgggatgaaatctcccaagcaggcctcaagcgtatttacgagaagtacacatggcagatctattcggagaggctgctaacactaactggagtttacggattctggaagcatgtatccaacctcgaccgcctcgagagccgccgttatctggaaatgttttacgccctcaagtaccgcaagctggctgattctgtgccaccggctgtggatgagtgagaaacgttggaagggaaatgaaagaagggagcatcagtaaattacttatagaggaagtagtttgtcgttctctgatttccaccacagaagttaataaaaaaagagatatgttgatgcttcctagctacaaatgtgaataatgcaaatgagagtttattgttttgtcattgctttcttttgaaaggtttgaattatctgatgttgttgtaacattcgggtgttctgaactcctcatcaatttgagtattattctcttttc

SEQ ID NO: 2441 - DNA, 2963 bp, Quercus alba
gtttaaggtttttgtaagaattttaagaagttggccatggccggaagtgctctgaccagagtccatagcctccgtgagcgcttggatgagaccctctctgctaaccgtaacgaaattgtcgcactgctttcaaggattgaaggcaagggaaaaggaattttgcaacaccatcaattgattgctgaggtagaagcaatccctgaagctaacaggaagacacttttggatgggcccttcggtgaagttttgagagccgctcaggaagccattgttctgcctccatgggttgccatggctgttcgtccaaggcctggtgtttgggaatacataagagtgaatgtccatgctcttgttgttgaggagttgcgtgtgcccgagtacttgcacttcaaagaggaactcgtcgatggaagtaccaatgggaactttgtgcttgagttggattttgaacccttcactgcatcatttccccaccccactctttcaaagtccattggaaatggcgtggagttccttaaccgtcacctttctgcaaagctcttccatgacaaggagagcatgcacccactgcttgaatttctcagagttcactgctacaagggcaagactatgatgctgaatgacagaattcataacgtagattccctccagtatgtacttaggaaggcagaggagtatctgactacacttgcccctgaaacaccttattctacgtttgagcacaagttccaggagattggtttggagagaggctggggtgacaccgctgagcgcgtactagaaatgatccaacttcttttggatcttcttgaagctcctgacccgtgcacccttgagacatttctcggcaagatccctatggtctttaacgttgtaatcatgtctccccatggttatttcgcccaggataatgtgttgggataccctgacactggtggccaggttgtgtatatcttggatcaagttcgggccttggagagtgagatgcttaagcgtatcaagcatcaaggcttggatatcaccccccgaatcctcattgtcacccgactcctccctgatgcagtaggaaccacatgtggtcagcgtcttgagaaagtatttgggtgtgagcatgcaaatattcttcgagttccttttagagatgagaagggaatggtccgcaaatggatctcaagattcgaagtttggccatatctagagaattacaccgaggatgttgcacaagaacttaacaaagagttgcaaggaaagccagatttgatcattggaaattacagtgatggaaacattgttgcctcattgttggcccataaatttggtgttacacagtgcaccattgctcatgcccttgagaagacaaagtatcctgaatctgacatttactggaaaaaatttgaggagaagtaccacttctcttgccaatttactgctgatcttattgccatgaatcataccgatttcattatcaccagtactttccaagaaattgctggaagcaaagacaccgttggtcaatatgagagtcacacttctttcacccttcccggactttatcgtgttgttcatgggataaatgtgtttgatcctaaattcaacatcgtctcccctggagcagatatggatatttacttcccctacactgaggaaaagaaaaggttgacagccttccaccccgaaattgaagagctcctttactcttctgtggagaatgaagaacacttgtgtgtattgaaagacaagaacaagcctataatctttacaatggcaaggctagatcgtgtgaagaacataaccggacttgttgagtggtatggcaagaataaacgtcttagggagttggttaaccttgttgttgttgctggggatcggcgaaaggagtctaaggacttggaagagcaagctgagatgaagaaaatgcatgctcttattgaaacctacaagttgaatggccagtttagatggatttcttcccagatgaaccgagtgaggaatggtgaactctatcggtatattgctgatacaaagggagcctttgtgcagcctgccgtatatgaagcttttgggttgacagttgttgaggccatgacttgtggattgccaacatttgctacttgtaatggtggcccagctgagattattgtacatggtaaatcaggcttccacattgatccttatcatggtgaacaagcagccgagctcctcgttggcttctttgagaagtgtcagaaagacccttctcactgggaccaaatctctcagggaggattgaagcggatctatgagaagtacacatggcagatttattccgagaggttgttgacccttactggggtttatggcttttggaagcacgtgtctaatctggatcgccgtgagagccgtcgttatcttgagatgttctatgctctcaagtaccgtaagctggctgagtccgtccctcctgccgtcgataattgaaattgaaatttgaagggtaaataaaaagaggcagcattgggcttgaacaatgagtttttttctgaattctgaggaaataatggccatggttttcgagatatgtgattaaaaataggattaagctttttttttttttggttcttttttgcttgatgcttgctgggaatgtttgaacttggtattaagccacatccattttccattcaatttaaagttgtgatgtttgaattttctatctgctgtaaaatgtatttgttttcttagtttcaattatttccttgttatggaaatgaatcaaagatcattttttcctctgcttctatgttaatttaaatggaaaataatgcataaatggaagacttgaaggttctggaggaatttaaaagcatggtccattgctttagtgttgccaacagagcttgtgtactagaatagtataataaagaaaaatcaactattagctttgtaccattgtaattttatcatcacccaaccatgtggattcg

SEQ ID NO: 2442 - DNA, 2877 bp, Gossypium raimondii
tcctttgtttgcatttgcagctttcttcttctataaattcgggctgaaactccagcttctctcattccattctcattcgttttgttaaacccctccctttgttggaaaaatggcagagcgtgtgatcacccgagtacacagcctccgggagcgtctggatgacacccttattgcccatagaaacgaggttttggccttgctcacaaggatcgagggtaagggaaaagggattctgcaacaccatcaaattatcctagagtttgaagccatccctgaagaaaccagaaagaagctcgctgatggagcattttctgaaatattgagagccagtcaggaagcgatcgtgttgccaccatgggttgcacttgcagttcgtccaaggcctggtgtttgggagtatattaaagtgaatgtccacgcccttgttgttgaggaactcactgttgcagagtatcttcacttcaaggaagagcttgttgatggaagtgcaaatggcaatttcgttttggaattggattttgagcccttcaatgcatctttccctcgctcaactctttccaagtctatcggtaatggtgtcgagttcctcaaccgccacctttcggctaaattgttccatgacaaggagagcatgcaccctttgcttgaattcctcaaagtccattgccacaaaggaaagaacatgatgttgaatgacagaattcaaaacctgaattcccttcaacatgtattgaggaaggcagaagaatatcttggtacactgccagctgagacaccgtacgctgaactcgaacacaagttccaggaaatcggtttagagagaggttggggtgataccgcggggcgtgtgctggagatgatccaactccttttggatcttctcgaggcccctgatccttgcacccttgagaagttcctcgggagagtccccatggtgttcaatgttgtcatccttactcctcacggatactttgctcaagacaacgttttggggtaccccgacaccggtggccaggttgtatacatcttggatcaagtccgtgccttggagaacgagatgctcctccgtatcaagcagcaaggactcaacattacccctcgaatcttaattattaccagacttctccctgacgccgttggaacaacttgtggtcaacgagtcgagaaggtatacggaacggaatactcagacatcctccgagtaccctttagaacagagaagggaattgtacgtagatggatctcgagattcgaagtctggccctacttggaaacttacactgaggatgttgctcacgaaatttccaaagagttgcaaggcaagcccgatctcatcatcggaaactatagtgacggcaacattgttgcctcgttgctggctcataaattgggagtcacacagtgtaccattgcccatgctttggagaaaacaaagtacccagattccgatatttactggaagaagctagaggataaataccatttctcctgccaatttacagctgatcttattgcaatgaaccatacagatttcatcatcactagtactttccaagaaattgcaggaagcaaggacactgttggtcaatatgagagtcacactgctttcactcttcctggtctataccgagtcgtacacggtatcgacgtatttgatcccaaattcaacatcgtgtctcccggtgctgacatgagcatatacttcccttacaccgaggagaagaggaggttgaagcatttccaccccgagattgaagacctcctttacagcaaagtcgagaacgaagaacacttatgtgtgctaaacgaccgcaacaagccgatcctattcacaatggcaaggctggaccgtgttaagaacttaaccggactcgtcgagtggtacggaaagaatgcaaagcttcgcgagttggttaaccttgtagtcgtaggtggagacaggagaaaggaatccaaagatttagaagagaaggccgaaatgaagaagatgtttgagctgatagaaacatacaaattgaacggccaattcagatggatatcatcgcaaatgaaccgagttaggaacggtgagctgtaccgctacatttgcgacacaaagggtgccttcgtacaaccagcattgtacgaagcctttggattaacggttgttgaagccatgacttgcgggttgcccacatttgctacctgcaatggtggaccagctgaaatcattgtccacggtaaatctgggttcaacattgatccttaccatggtgatcaagctgcagagatccttgtcgacttcttcgacaaatgtaaaaaagacccatctcactggaacgacatctctgagggtggcttgaaacgtatccaggagaaatacacatggcagatatactcggagaggctattaacactgacgggagtgtatgggttctggaagcacgtttccaaccttgaccgtcgcgagagccgccgttacctggagatgttttatgctcttaagtaccgcaagctggctgaatcggttcctctggcagaggaggagtaaaacaaaggaagaggcgggttttccctggaggatttttctgagttcttcacaataaaataataataatcttttgttgttttcatatttatggtcggacaagaaaaagcctcttttgtatctcttttcctttttttttcttttttttttttgttgttttatttttcccggcattgttagaacatggagggggtactgcgcccctggattccaacaaaagattgtgatttccctcattttctttttttatttgtacgtgtctcccaagtcccaactagtgacgccacctggtatgactagacctgactatgggttatgtacgccatgataaaattttagatctttttaat

SEQ ID NO: 2443 - DNA, 2665 bp, Gossypium hirsutum
tttgccttgttgaaagctcaagttcgaagaaatggctgagcgtgctctcactcgcgtccacagtctccgtgagcgtttggattccacacttaccgcccacaggaacgagattttggctttgctctcaaggattgaaggtaaaggaaaaggaatccttcttcaccatcaaatcattcttgagtttgaagctatccctgaagagaaccgaaagaaattagctgatggtgcattttttgaaatactgaaagccagtcaggaagccatcgtgttgccgccgtgggtggcgctggccgtccgaccaagacctggtgtttgggagtacattagagttaatgttcatgctcttgttgttgaagaactcactgttgctgagtatcttcgtttcaaggaagagcttgttgatggaagttcaaatgcaaactttgttttggaactggattttgagcccttcaacgcgtcgttccctcgcccgactctttcgaaatcgatcggtaacggcgtcgagttccttaatcgccacctttcggccaaactgttccatgacaaggagagcatgcaccctttgcttgaattcctgaaagtccattgtcataagggcaagaacatgatgttgaatgataggattcaaaacttgaattctctccaacatgttttgaggaaggcagaggagtatcttgttgcgctgccagctgagacttcttatgccgatttcgaacacaagttccaggagattggtttggagagagggtggggtgatacagctgagcgtgtgctcgagatgatccaactccttttggatcttctcgaggcacccgatccttgcacccttgagaagttcctcgggagaattcccatggtgttcaatgtcgtgattcttacacctcacggttactttgctcaggacaatgttttggggtatcccgacaccggtggccaggttgtttacatcttggatcaagtccgtgccttggagaacgaaatgctcaaccgtatcaagcaacaaggactcaacattacccctcgtattctcatcattactcgacttctccctgatgccgtgggaacaacttgcggtcaacggctcgagaaagtatacgggacggagtactcggatattcttcgaatacccttcagaacagagaagggaatcgtacgtagatggatctcgagatttgaagtctggccttacttggaaacttacactgaggatgttgctcatgagatttcaaaagagttgcaaggcaagcccgatttaatcatcggaaactacagtgatggtaatatcgtcgcctccttgctggcacataagttgggagttacacagtgtacgattgcccatgctttggagaagacaaagtatccagattccgacatctactggaagaagctcgaggataaatatcatttctcctgccaatttacagctgatcttttcgctatgaaccatacggatttcatcatcaccagtaccttccaagaaattgccggaagcaaggacactgttggtcaatacgagagtcacactgctttcactcttcccggtctctaccgtgttgttcacggaattgatgtgtttgatcctaaattcaacattgtgtcccctggtgccgacatgagcatatactacccttacaccgaggagaagaagaggttgaagcatttccattccgagatcgaacaacttctttacagcaaagttgaaaatgaagagcactggtgtgtgctaaacgaccgcaacaagccaattctatttacaatggcaaggctggatcgtgttaagaatttaagtggacttgttgaatggtacgggaagaatgctaagttgcgtgaattggttaaccttgtagttgtcggtggagatcggagaaaagagtccaaggatttggaagagaaggctgagatgaagaagatgttcgagctcattgagaagtacaagctgaacggtcagttcagatggatatcatcccaaatgaacagagttaggaacggtgaactttaccgttacatttgtgacacaaagggtgccttcgtacaacccgcattatatgaagcctttgggttgactgtcgttgaggccatgacttgtggtttgccgacattcgcaacttgcaatggtggacctgccgagattatcgttcacggtaaatccggcttcaacattgatccttaccacggcgaccaagctgctgagatccttgtcgacttcttcgagaaatgcaagacagactcatcttactggaccaaaatctctgagggaggtttgaaacgtatcgaagagaagtacacatggaaaatttactctgagagactattaaccttgaccggtgtctacgggttctggaagcatgtgtccaacctcgaccgcctcgagagccgtcgttaccttgagatgttttacgctcttaagtaccgtaagctggccgaatcggtacctttggcagttgaagagtaaattgaagttgccggggaaagaattgggagggatttccgagttcttgagaataatctttgttgttttggcattttgatccaactcttttgttttctctgttcttttatgtgtatttgtctttgttcatgttttgggcattgtttcaacatctgggcgttgagcccatcaattctagtaaagtaaaacatggcaacttttgcttcacatgtttca

SEQ ID NO: 2444 - DNA, 2731 bp, Manihot esculenta
cccacttcgttgtgtttccttctctgttctccttttttacgtttggtagttgtaagattttctgacaaggagctatggctgaacgtgttatcactcgcgttcagagcatccgtgaacgtttggatgagacactctctgctcatcgcaatgaaattgtggccttgctctcaaggattgaaggaaagggaaagggaattcttcagcaccaccagatcattgctgagtttgaggaaatcccagaagagaacagaaagaaactattggaaagtgtatttggcgaagttctgagatctgcacaggaagcaattgtgttgcctccctgggttgctcttgctgtgcgcccaaggcctggtgtttgggagtacattagagtgaatgtccatgcacttgttgttgaggagctgcgtgttgctgagtatctgcacttcaaggaggaacttgttgatggaagtgtcaatggcaactttgtgctggagctggactttgagccattcaatgcatctttccctcgtccaactctttctaagtatattggtaatggtgttgagttccttaaccgtcacctttcagcgaaattgttccatgacaaggagagcttgcatcctctgcttgagtttctcaaagttcactgccacaagggaaagaacatgatgcttaacgacagaattcataacttggattccttgcaatatgttctgagaaaggcagaggagtatctcactgcattggcacctgagacaccgtactctcaattcgagcacaagttccaggaaattggcctggagagaggttggggtgataccgctgagcgtgttctagagatgattcgacttcttttggatcttcttgaggcaccagacccctgcactcttgaaacattcttgggaagaatcccaatggtcttcaatgttgtgattatgtctcctcatggatacttcgcccaagacaatgttttggggtatccggacaccggaggccaggttgtttatatcttggatcaagttcgtgccttagagacagaaatgcttcaccgtataaagcagcaaggactcgatatcaccccccgcattctcattattactcggcttcttcctgatgcagtaggaaccacttgtggtcaacgtcttgaaaaagtatttgggacagagcattcagatatcctccgtataccctttagaactgagaagggaattgttcgtaaatggatctcaagatttgaagtgtggccatatctagagacttacactgaggatgttgccactgaaattggtaaggagtttcagggcaagcctgatctgatcattggaaattacagtgatggaaacatcgttgcctctttgttagcacacaaattaggtgttacagagtgtaccattgctcatgctcttgaaaagaccaaatatccggaatcggatatttactggaagaagtttgatgagaagtaccatttttcatgtcagtttacagctgatcttatagcaatgaatcatacagatttcatcatcaccagcacattccaagaaattgctggaagcaaggacaccgttggccaatatgagagccacacggctttcacccttcccggcctctaccgagttgttcatggtattgatgtctttgatccaaaattcaacattgtctcgcctggtgctgatgaaaccatttacttctcctacactgaggagaaacgtaggttgacctctttccatccagaaatagaggagcttctctacagccctgttgagaatgaagaacacttatgtgtgctaaaagatcgcagcaagccaattatcttcaccatggcaaggctggacagagttaagaatttaactggccttgtagaatggtacggaaagaatgccaagctccgcgaattggctaaccttgtagtagttggtggtgatagaagaaaggagtctaaagatttagaagaacaagccgaaatgaagaaaatgcatagccttattgagaaatacaatctgaatggccatttcagatggatttcttcccagatgaaccgggtgaggaacggggagctctaccgttacatttgcgacacgaagggtgttttcgtgcaacctgctatatacgaagctttcggtttgacagttgttgaggccatgacctgtggtttgccaacctttgctacctgcaatggtggccctgctgagatcattgtacatggaaaatctggcttcaacattgacccttaccatggtgatcaggctgctgagctccttgttcagttctttgagaagtgcaaggctgatccatctcactggatcaagatctccgagggagccatgcaacgtatccaagagaagtatacctggcaaatctactctcagaggctgttgaccctcaccggtgtatatggcttctggaaacatgtatctaagcttgaccgccgtgagagccgccgctacctggaaatgttctacgctctgaagtatcgcaaactggctgaatcagttcctctaactgttgaggattaagtggaactacaaaactcgagggaaccagcgatcgaaggttcaagcgggaagtttcgaaggtgtgaagaataatggccatttcacaaatgtggttgaaacaagaagaaatttccattgcttcattttgttcttttcttttcttttttatttcccccccttctcttattgcggcattgtttgaactttggctattgagccccttcatcaattgcagtaaagattgtttctttttgctt

SEQ ID NO: 2445 - DNA, 2728 bp, Gossypium hirsutum
ggaaaaatggcagagcgtgtgatcacccgagtacacagcctccgggagcgtctggatgacacccttattgcccatagaaacgaggttttggccttgctcacaaggatcgagggtaagggaaaagggattctgcaacaccatcaaattatcctagagtttgaagccatccctgaagaaaccagaaagaagctcgctgatggagcattttctgaaatattgagatccagtcaggaagcgatcgtgttgccaccatgggttgcacttgcagttcgtccaaggcctggtgtttgggagtatattaaagtgaatgtccacgcccttgttgttgaggaactcactgttgctgagtatcttcacttcaaggaagagcttgttgatggaagtgcaaatggcaatttcgttttggaattggattttgagcccttcaatgcatctttccctcgctcaactctttccaagtctatcggtaatggtgtcgagttcctcaaccgccacctttcggctaaattgttccatgacaaggagagcatgcaccctttgcttgaattcctcaaagtccattgccacaaaggaaagaacatgatgttgaatgacagaattcaaaacctgaattcccttcaacatgtattgaggaaggcagaagaatatcttggtacactgccagctgagacaccgtacgctgaactcgaacacaagttccaggaaatcggtttagagagaggttggggtgataccgcggggcgtgtgctggagatgatccaactccttttggatcttctcgaggcccctgatccttgcacccttgagaagttcctcgggagagtccccatggtgttcaatgttgtcatccttactcctcacggatactttgctcaagacaacgttttggggtaccccgacaccggtggccaggttgtatacatcttggatcaagtccgtgccttggagaacgagatgctcctccgtatcaagcagcaaggactcaacattacccctcgaatcttaattattaccagacttctccctgatgccgttggaacaacttgtggtcaacgagtcgagaaggtatacggaacggaatactcagacatcctccgagtaccctttagaacagagaagggaattgtacgtagatggatctcgagattcgaagtctggccctacttggaaacttacactgaggatgttgctcacgaaatttccaaagagttgcaaggcaagcccgatctcatcatcggaaactatagtgacggtaacattgttgcctcgttgctggctcataaattgggagtcacacagtgtaccattgcccatgctttggagaaaacaaagtacccagattccgatatttactggaagaagctcgaggataaataccatttctcctgccaatttacagctgatcttattgcaatgaaccatacagatttcatcatcactagtactttccaagaaattgcaggaagcaaggacactgttggtcaatatgagagtcacactgctttcactcttcctggtctataccgagtcgtacacggtatcgacgtatttgatcccaaattcaacatcgtgtctcccggtgctgacatgagcatatacttcccttacaccgaggagaagaggaggttgaagcatttccaccccgagattgaagacctcctttacagcaaagtcgagaacgaagaacacttatgtgtgctaaacgaccgcaacaagccgatcctattcacaatggcaaggctggaccgtgttaagaacttaaccggactcgtcgagtggtacggaaagaatgcaaagcttcgcgagttggttaaccttgtagtcgtaggtggagacaggagaaaggaatccgaagatttagaagagaaggccgaaatgaagaagatgtttgagctgatagaaacatacaaattgaacggccaattcagatggatatcatcgcaaatgaaccgagttaggaacggtgagctgtaccgctacatttgcgacacaaggggtgccttcgtacaaccagcattgtacgaagcctttggattaacggttgttgaagccatgacttgcgggttgcccacatttgctacctgcaatggtggaccagctgaaatcattgtccacggtaaatctgggttcaacattgatccttaccatggtgatcaagctgcagagatccttgccgacttcttcgacaaatgtaaaaaagacccatctcactggaacgacatctctgagggtggcttgaaacgtatccaggagaaatacacatggcagatatactcggagaggctattaacactgacgggagtgtatgggttctggaagcacgtttccaaccttgaccgtcgcgagagccgccgttacctggagatgttttatgctcttaagtaccgcaagctggctgaatcggttcctctggcagaggagtaaaacaaaggaagaggcgggttttccctggaggatttttctgagttcttcacaataaaataataataatcttttgttgttttcatatttatggtcggacaagaaaaagcctcttttgtatctccccggcattgttagaacatggagggggtactacgcccttggattccaacaaaagattgtgatttccctcattttctttttttatttgtacgtgtctcccaagtcccaactagtgacgccacctggtatgactagacctgactatgggttatgtacgccatgataaaattttagatctttttaa

SEQ ID NO: 2446 - DNA, 3066 bp, Gossypium hirsutum
agtttcgtttacctgctcctctgtttctctctttcttttactttctttgcctttgaattctcttcatccccatgttgctcttctttcttcaccttctgcttctgagacttgggctctagcttctttcgccagccaaggaacactatttctccactcaaaatgttgaaacaaaaactctgttttctcgaccaacagaggggttactctgcttcaatttctatacaaaaacactgccatctccacttaataaatggctgttctgagagttttctttcaactccattaatattatctttcggtttcaattaatgggtattaattaaataataaaaaagaagaagaataaaatcagatctcctaaatgttttgttgcaacaaaattaagttgaacagtaaccatagtttgattaacattaaagtctattccatgtggttggtggcttaaggtggtaggtttagaaaaaaaaatgtcttctagaattgtatacgatctatgttggttttgacttttttttggtgcttatccatctccgttactaataatcatgttacatcatcacttactctgtcttttgctctgtttttttagttggaaaaatggcagagcgtgtgatcacccgagtacacagcctccgggagcgtctggatgacacccttattgcccatagaaacgaggttttggccttgctcacaaggatcgagggtaagggaaaagggattctgcaacaccatcaaattatcctagagtttgaagccatccctgaagaaaccagaaagaagctcgctgatggagcattttctgaaatattgagatccagtcaggaagcgatcgtgttgccaccatgggttgcacttgcagttcgtccaaggcctggtgtttgggagtatattaaagtgaatgtccacgcccttgttgttgaggaactcactgttgctgagtatcttcacttcaaggaagagcttgttgatggaagtgcaaatggcaatttcgttttggaattggattttgagcccttcaatgcatctttccctcgctcaactctttccaagtctatcggtaatggtgtcgagttcctcaaccgccacctttcggctaaattgttccatgacaaggagagcatgcaccctttgcttgaattcctcaaagtccattgccacaaaggaaagaacatgatgttgaatgacagaattcaaaacctgaattcccttcaacatgtattgaggaaggcagaagaatatcttggtacactgccagctgagacaccgtacgctgaactcgaacacaagttccaggaaatcggtttagagagaggttggggtgataccgcggggcgtgtgctggagatgatccaactccttttggatcttctcgaggcccctgatccttgcacccttgagaagttcctcgggagagtccccatggtgttcaatgttgtcatccttactcctcacggatactttgctcaagacaacgttttggggtaccccgacaccggtggccaggttgtatacatcttggatcaagtccgtgccttggagaacgagatgctcctccgtatcaagcagcaaggactcaacattacccctcgaatcttaattattaccagacttctccctgacgctgttggaacaacttgtggtcaacgagttgaaaaggtatacggaacggaatactccgacatcctccgagtaccctttagaacagagaagggaattgtacgtagatggatctcgagattcgtagtctggccctacttggaaacttacactgaggatgttgctcacgaaatttccaaagagttgcaaggcaagcccgatctcatcatcggaaactatagtgacggcaacattgttgcctcgttgctggctcacaaattgggagtcacacagtgtaccattgcccatgctttggagaaaacaaagtacccagattccgatatttactggaagaagctagaggataaataccatttctcctgccaatttacagctgatcttattgcaatgaaccatacagatttcatcatcactagtactttccaagaaattgcaggaagcaaggacactgttggtcaatatgagagtcacactgctttcactcttcctggtttataccgagtcgtacacggtatcgatgtatttgatcccaaattcaacatcgtgtctcccggtgctgacatgagcatatacttcccttacaccgagaagaagaggaggttgaagcatttccaccccgagattgaagacctcctttatagcaaagtcgagaacgaagaacacttatgtgtgctaaatgaccgcaacaagccgatcctattcacgatggcaaggctagaccgtgttaagaacttaaccggactcgtcgagtggtacggcaagaatgcaaagctgcgcgagttggttaacctcgtagtcgtaggtggagacaggagaaaggaatccaaagatttagaagagaaggccgaaatgaagaagatgtttgagctgataaaaacatacaaattgaacggtcaattcagatggatatcatcgcaaatgaaccgagttaggaatggtgagttgtaccgctacatttgcgacacaaaaggtgccttcgtacaaccagcattgtacgaagcctttggattaacggttgttgaagccatgacttgcggattgccaacatttgctacctgcaaaggtggaccagctgaaatcattgtccacggtaaatctgggttcaacattgatccttaccatggtgatcaagctgcagaaatccttgttgatttcttcgacaaatgtaaaaaggaaccatctcactggaatgacatctctgagggtggcttgaaacgtatccaggagaaatacacatggcagatatattcggagaggctattaacattgacgggagtgtatggattctggaagcacgtttccaaccttgaccgtcgcgagagccgccgttacctggagatgttttacgctcttaagtaccgcaagctggctgaatcggttcctctggcagaggaggagtaaaacaaaggaagaggcgggttttccctggaggatttttctgagttcttc

SEQ ID NO: 2447 - DNA, 3015 bp, Gossypium raimondii
ctggcattgaagcgcaaatattaagtttctaaacagcagttactgtgtgtcctttgtttgcatttgcagctttcttcttctataaattcgggctgaaactccagcttctctcattccattctcattcgttttgttaaacccctccctttgttggaaaaatggcagagcgtgtgatcacccgagtacacagcctccgagagcgtctggatgacacccttattgcccatagaaacgaggttttggccttgctcacaaggatcgagggtaagggaaaagggattctgcaacaccatcaaattatcctagagtttgaagccatccctgaagaaaccagaaagaagctcgctgatggagcattttctgaaatattgagagccagtcaggaagcgatcgtgttgccaccatgggttgcacttgcagttcgtccaaggcctggtgtttgggagtatattaaagtgaatgtccacgcccttgttgttgaggaactcactgttgcagagtatcttcacttcaaggaggagcttgttgatggaagtgcaaatggcaatttcgttttggaattggattttgagcccttcaatgcatctttccctcgctcaactctttccaagtctatcggtaatggtgttgagttcctcaatcgccacctttcggctaaattgttccatgacaaggagagtatgcaccctttgcttgaattcctcaaagtccattgccacaaaggaaagaacatgatgttgaatgacagaattcaaaacctgaattcccttcaacatgtattgaggaaggcagaagaatatcttggtacactgccagctgagacaccgtacgctgaactcgaacacaagttccaggaaatcggtttagagagaggttggggtgataccgcggggcgtgtgctggagatgatccaactccttttggatcttctcgaggcccctgatccttgcacccttgagaagttcctcgggagagtccccatggtgttcaatgttgtcatccttactcctcacggatactttgctcaagacaacgttttggggtaccccgacaccggtggccaggttgtatacatcttggatcaagtccgtgccttggagaacgagatgctcctccgtatcaagcagcaaggactcaacattacccctcgaatcttaattattaccagacttctccctgatgccgttggaacaacttgtggtcaacgagtcgagaaggtatacggaacggaatactcagacatcctccgagtaccctttagaacagagaagggaattgtacgtagatggatctcgagattcgaagtctggccctacttggaaacttacactgaggatgttgctcacgaaatttccaaagagttgcaaggcaagcccgatctcatcatcggaaactatagtgacggcaacattgttgcctcgttgctggctcataaattgggagtcacacagtgtaccattgcccatgctttggagaaaacaaagtacccagattccgatatttactggaagaagctcgaggataaataccatttctcctgccaatttacagctgatcttattgcaatgaaccatacagatttcatcatcactagtactttccaagaaattgcaggaagcaaggacactgttggtcaatatgagagtcacactgctttcactcttcctggtctataccgagtcgtacacggtatcgacgtatttgatcccaaattcaacatcgtgtctcccggtgctgacatgagcatatacttcccttacaccgaggagaagaggaggttgaagcatttccaccccgagattgaagacctcctttacagcaaagtcgagaacgaagaacacttatgtgtgctaaacgaccgcaacaagccgatcctattcacaatggcaaggctggaccgtgttaagaacttaaccggactcgtcgagtggtacggaaagaatgcaaagcttcgcgagttggttaaccttgtagtcgtaggtggagacaggagaaaggaatccgaagatttagaagagaaggccgaaatgaagaagatgtttgagctgatagaaacatacaaattgaacggccaattcagatggatatcatcgcaaatgaaccgagttaggaacggtgagctgtaccgctacatttgcgacacaaggggtgccttcgtacaaccagcattgtacgaagcctttggattaacggttgttgaagccatgacttgcggattgcccacatttgctacctgcaaaggtggaccagctgaaatcattgtccacggtaaatctgggttcaacattgatccttaccatggtgatcaagctgcagaaatccttgttgatttcttcgacaaatgtaaaaaggaaccatctcactggaatgacatctctgagggtggcttgaaacgtatccaggagaaatacacatggcagatatattcggagaggctattaacattgacgggagtgtatggattctggaagcacgtttccaaccttgaccgtcgcgagagccgccgttacctggagatgttttacgctcttaagtaccgcaagctggctgaatcggttcctctggcagaggaggagtaaaacaaaggaagaggcgggttttccctggaggatttttctgagttcttcacaataaaataataataatcttttgttgttttcatatttatggtcggacaagaaaaagcctcttttgtatctcttttccttttttttttttttttttttgttgttttatttttcccggcattgttagaacatggagggggtactgcgcccctggattccaacaaaagattgtgatttccctcattttctttttttatttgtacgtgtctcccaagtcccaactagtgacgccacctggtatgactagacctgagttatgtcagtttcggctacgccatgataaaattttagatccttttaataggtttgggtttggttcgacttaaaagttgagattaaaattttttctaaactcgacttgaataaaaatattaaaactcaaatttaa

SEQ ID NO: 2448 - DNA, 2745 bp, Gossypium hirsutum
ccctccatttgttggaaaaatggcagagcgggtgatcacccgagtacacagcctccgagagcgtctggatgacacccttattgcccatagaaacgaggttttggccttgctcacaaggatcgagggtaagggaaaagggattctgcaacaccatcaaattatcctagagtttgaagccatccctgaagaaaccagaaagaagctcgctgatggagcattttctgaaatattgagagccagtcaggaagcgatcgtgttgccaccatgggttgcacttgcagttcgtccaaggcctggtgtttgggagtatattaaagtgaatgtccacgcccttgttgttgaggaactcactgttgcagagtatcttcacttcaaggaggagcttgttgatggaagtgcaaatggcaatttcgttttggaattggattttgagcccttcaatgcatctttccctcgctcaactctttccaagtctatcggtaatggtgttgagttcctcaatcgccacctttcggctaaattgttccatgacaaggagagtatgcaccctttgcttgaattcctcaaagtccattgccacaaaggaaagaacatgatgttgaatgacagaattcaaaacctgaattcccttcaatatgtattgaggaaggcagaagaatatcttggtacactgccagctgagacaccgtacactgaactggaacacaagttccaggaaattggtttggagagaggttggggtgataccgcggggcgtgtgctggagatgatccaactccttttggatcttctcgaggcccctgatccttgcacccttgagaagttcctcgggagagtccccatggtgttcaatgttgtcatccttactcctcacggatactttgctcaagacaacgttttggggtaccccgacaccggtggccaggttgtatacatcttggatcaagtccgtgccttggagaacgagatgctcctccgtatcaagcagcaaggactcaacattacccctcgaatcttaattattaccagacttctccctgacgctgttggaacaacttgtggtcaacgagttgaaaaggtatacggaacggaatactccgacatcctccgagtaccctttagaacagagaagggaattgtacgtagatggatctcgagattcgtagtctggccctacttggaaacttacactgaggatgttgctcacgaaatttccaaagagttgcaaggcaagcccgatctcatcatcggaaactatagtgacggcaacattgttgcctcgttgctggctcacaaattgggagtcacacagtgtaccattgcccatgctttggagaaaacaaagtacccagattccgatatttactggaagaagctagaggataaataccatttctcctgccaatttacagctgatcttattgcaatgaaccatacagatttcatcatcactagtactttccaagaaattgcaggaagcaaggacactgttggtcaatatgagagtcacactgctttcactcttcctggtttataccgagtcgtacacggtatcgacgtatttgatcccaaattcaacatcgtgtctcccggtgctgacatgagcatatacttcccttacaccgaggagaagaggaggttgaagcatttccaccccgagattgaagacctcctttacagcaaagtcgagaacgaagaacacttatgtgtgctaaacgaccgcaacaagccgatcctattcacaatggcaaggctggaccgtgttaagaacttaaccggactcgtcgagtggtacggaaagaatgcaaagcttcgcgagttggttaaccttgtagtcgtaggtggagacaggagaaaggaatccgaagatttagaagagaaggccgaaatgaagaagatgtttgagctgatagaaacatacaaattgaacggccaattcagatggatatcatcgcaaatgaaccgagttaggaacggtgagctgtaccgctacatttgcgacacaaggggtgccttcgtacaaccagcattgtacgaagcctttggattaacggttgttgaagccatgacttgcgggttgcccacatttgctacctgcaatggtggaccagctgaaatcattgtccacggtaaatctgggttcaacattgatccttaccatggtgatcaagctgcagagatccttgccgacttcttcgacaaatgtaaaaaagacccatctcactggaacgacatctctgagggtggcttgaaacgtatccaggagaaatacacatggcagatatactcggagaggctattaacactgacgggagtgtatgggttctggaagcacgtttccaaccttgaccgtcgcgagagccgccgttacctggagatgttttatgctcttaagtaccgcaagctggctgaatcggttcctctggcagaggagtaaaacaaaggaagaggcgggttttccctggaggatttttctgagttcttcacaataaaataataataatcttttgttgttttcatatttatggtcggacaagaaaaagcctcttttgtatctccccggcattgttagaacatggagggggtactgcgcccctggattccaacaaaagattgtgatttccctcattttcttttttttatttgtacgtgtctcccaagtcccaactagtgacgccacctggtatgactagacctgagttatgtcagtttcggctacgccatgataaaattttagatcctttt

SEQ ID NO: 2449 - DNA, 2578 bp, Trigonella foenum-graecum
ccgaggagaaaaggcaaaaactagttaatggagcttttggagaagttttgagatctacacaggaagctgtagtgttgccaccatttgttgctcttgctgttcgtccaaggcccggtgtttgggaatatctgagagtcgatgtgcacggccttgttgtcgatgaacttcgtgctgctgagtatctcaagttcaaggaggaacttgttgaaggaagttctaatggcaactttgtgcttgagttggactttgaaccattcaacgcctcttttcctcgaccaactctgaacaagtcgattggaaatggcgtcgagttcctcaatcgccatctttctgctaagcttttccatggcaaagaaagtttgcagccactgttggaattcctcaggcttcacaactataatggaaagactatgatggtgaatgacagaattcaaaatctgaacgctcttcaaaatgttctgagaacagcagaagattatcttcgcacaattgctcctgaaacaccctactcggaattcgaacacaaattccagaatattggtctggagagagggtggggtgacacggctgagcgtgtcctagaaatgatccaacttctattggatcttctcgaggcacctgatcctttcaccctcgagaaattccttggaaaaatccctatggtctttaatgttgtcatcctttctccacatggttactttgcccaagataatgtcttgggataccctgatactggtggacaggttgtgtacattttggaccaagttcgtgccttagagaacgagatgctcaaacgaatcaagcaacaaggcttggatatcaagcctcgcattctcattatcacccgtcttctccctgatgcagttggaactacttgtggagatcgtcttgagaaagtatacgataccgaatactgccacattcttcgagttccatttagaacagagaagggaattgttcgcaaatggatctcaagattcgaagtctggccctaccttgagactttcagtgaggatgttgctaatgaacttgcaaaagagttgcaaggaaaacctgatctgatcgtcggaaactacagtgacggaaacatcgttgcctctttgttagctcataaattaggcgtaactcagtgtactattgctcatgcacttgagaagaccaagtatccagagtctgagctttactggaaaaaatttgaagacaaatatcacttctcatgccaatttactgctgatctttttgcaatgaaccacaccgattttattatcacaagtaccttccaagagattgctggaagcaaggatactgttgggcagtatgagagccacactgccttcactcttccaggactttaccgtgtggttcacggtattgatgtctttgatccaaagttcaacattgtctctcctggagctgatatgagcatctacttcccatataccgaagctgagcgtagattgacatcattccaccctgagattgaagaacttctttacagctcagtggagaatgaggagcacatatgtgtattgaaggaccgcagcaagccaattatcttcacaatggcaaggctggaccgagtgaagaacattacaggacttgtcgaatggtacggcaagaacgctcgcctaagggagttagtaaaccttgtcgtcgttgctggagacaggaggaaggaatccaaagacttagaagagaaagccgagatgaagaaaatgtatggtctaatcgagacctacaaactaaacggccaattcagatggatttcctcacagatgaaccgaattcgaaacggagagctttaccgtgtcatttgtgacacaaaaggagcttttgtgcaacctgctatttatgaagcttttggtttgactgttgttgaagctatgacttgtggattgccaacatttgctacttgtaatggtggtcctgctgagatcattgttcatggaaaatctggttaccatattgatccttatcatggtgaccaagctgctgaaactcttgttgaattctttgagaagagtaaggctgatccatcttattgggacaaaatttcacatggaggtctcaaacgtattcatgagaagtacacatggcagatttattcagacaggcttttaactctaactggtgtctatggattctggaagcatgtgacaaaccttgaacgccgtgagagcaaacgttaccttgagatgttctatgcccttaagtacagcaaattggctgaatctgtgcctcttgctgttgaagagtaaagatcaatgctgaagtgtgaagagattgcgggactggctttttgttgttttatgaagcatttattataaataaataataaattccctttgatatttgagattaggttttcaattgaagaaaaaaaaagtgtcgttcttctttgaattgttagtaggtttaggatgaaaaatgatgaaaataaagtgtacttttctttatgcatttttggatttgattggaatttggaaatcttcaaatttggggtgtttatcgaataaattcaatttctagatgtgccttcaatttaatttgggtgttatctggtacaaaaaaaaacgaa

SEQ ID NO: 2450 - DNA, 2898 bp, Ricinus communis
cggccggggaccacactccattgtgtatcccttctctgttctccttttttgtcgtttggtttttctgagattttctgatcagaagctatggctgaacgtgttatcactcgcgttcacagcatccgtgaacgtttggatgagacacttgctgctaaccgcaatgagattgtggccttacttacaagaattgaaggtaagggaaaaggaatccttcaacaccaccagatcattgctgaatttgaagcaattcctgaagatattaggaagaatctattggatagtgtatttggtgaagtgttgagatcaacacaggaagcaattgttctgcctccttgggttgccctggctgtgcgcccaaggcctggtgtttgggaatatatcagagtgaatgtccatgctcttgttgttgaggagctgcgtgttgccgagtatcttcatttcaaggaggaacttgttgatggaagccaaaatggcaactttgtgcttgagttggactttgaaccatttaatgcatctttccctcgcccaacactttccaagtacattggtaatggtgttgagttcctcaaccgtcacctttccgctaaattgttccatgacaaagagagcttgcatcctctgcttgaatttctgaaggtccactgccacaagggaaagaacatgatgttgaatgacagaatccagaacttgaattccttgcaatatgttctgaggaaggcagaggagtatctcgttacattgccagctaagactccatactccgagtttgagcacaaattccaagaaattggcctggagagagggtggggtgacactgctgagcgcgttcttgagatgatccgacttcttttggatcttcttgaggcaccagacccctgcactcttgagaccttccttggcagaatccctatggtcttcaatgttgtgattatgtctcctcacggatactttgcccaagacaatgttctgggttatcctgatactggaggccaggtggtgtatatcttggatcaagttcgtgctttggagactgaaatgcttcaacgtattaagcagcaaggacttgatatcactccccgcattctcattatcactcgacttcttcctgatgcagttggaaccacttgcggtcagcgtttagagaaagtttttggaacagagcattcagatatccttcgaattccatttagaactgaaaagggaatcgtccgtaaatggatctcacgatttgaagtctggccctatctagagacttacactgaggatgttgccactgaaattggtaaggagtttcaaggcaagcctgatctgatcattggaaattacagtgatggaaacattgttgcctccttgttagcacacaaacttggtgttacagagtgtaccattgctcatgctctagagaaaacaaaatacccggaatcagatatctactggaagaagttagatgacaagtaccacttttcttgccagtttacagctgatcttatagccatgaaccatacagattttattatcaccagtacattccaagaaattgctggaagcaaggacactgttggccaatatgagagccacacagctttcacccttcctggtctctaccgtgttgttcatggtattgatgtctttgaccccaaattcaacattgtctccccaggggctgatgaaagcatatactacccatacactgacacaaagcgtaggttgacttctttccatccagaaatcgaggagcttctctacagccctgttgagaatgaagaacacttatgtgtgctaaaagatcgcagcaagccaattatattcaccatggcaaggatggacagagtaaagaatttaactggcctagtagagtggtatggaaagaatgccaaacttcgtgaattggctaaccttgttgtagtcggtggtgatagaagaaaggagtctaaagatctggaagagcaggctgagatgaagaaaatgcacggtcttattgagaaatacaatctgaatggtcagttcagatggatttcttcccagatgaaccgggtgaggaatggtgagctctaccgatgcatctgtgacactaagggagtgttcgtgcaacctgctttgtatgaggctttcgggttgactgttgtcgagtccatgagctgtggtttgccaacttttgctacctgcaatggtggccctgctgagattattgtgcacggaaaatccggcttcaacattgatccttaccatggtgatcaggctgccgagctccttgttgaattctttgagaagtgcaaggctgacccctgtgtgtgggacgagatctccaagggaggcctgcaacgtatccaggagaaatatacttggcaaatctactctcagcggctattgaccctcactggtgtatacggattttggaaacatgtatctaagcttgaccgtcgcgagagcaggcgttaccttgagatgttctatgccctgaagtacaagaaattggccgactccgttcctctgactgttgaataggaaaattgaaccaagggaaaaatggctggtggttcaagtgggggattgaaggttcaagtgggaagttttgaagttgtgaagaataatagtcatttcacaattgtgattggccccaaaaaaaggctttccattttgtttcattttatcttttccctcttgttttttttttccctttatttcctttttgcggcattgtttgcaatttggctattgagcctcttcaatttcagtaaagtttgcgtctttttggttcagtctctttttactaatccttttcacaatattgaatactcacaagtcatgcctctttgataaatgagtattatgtatatatacacaacacagacacactatctttactaagtaggtgtatgaaaattccctttttgaaac

SEQ ID NO: 2451 - DNA, 2988 bp, Ricinus communis
ttttatttcccttgtttcaacctcattttctctataaattttcacgaattctagtctttcaatcaccacactccattgtgtatcccttctctgttctccttttttgcgtttggtttttctgagattttctgatcagaagctatggctgaacgtgttatcactcgcgttcacagcatccgtgaacgtttggatgagacacttgctgctaaccgcaatgagattgtggccttacttacaagaattgaaggtaagggaaaaggaatccttcaacaccaccagatcattgctgaatttgaagcaattcctgaagatattaggaagaatctattggatagtgtatttggtgaagtgttgagatcaacacaggaagcaattgttctgcctccttgggttgccctggctgtgcgcccaaggcctggtgtttgggaatatatcagagtgaatgtccatgctcttgttgttgaggagctgcgtgttgccgagtatcttcatttcaaggaggaacttgttgatggaagccaaaatggcaactttgtgcttgagttggactttgaaccatttaatgcatctttccctcgcccaacactttccaagtacattggtaatggtgttgagttcctcaaccgtcacctttccgctaaattgttccatgacaaagagagcttgcatcctctgcttgaatttctgaaggtccactgccacaagggaaagaacatgatgttgaatgacagaatccagaacttgaattccttgcaatatgttctgaggaaggcagaggagtatctcgttacattgccagctaagactccatactccgagtttgagcacaaattccaagaaattggcctggagagagggtggggtgacactgctgagcgcgttcttgagatgatccgacttcttttggatcttcttgaggcaccagacccctgcactcttgagaccttccttggcagaatccctatggtcttcaatgttgtgattatgtctcctcacggatactttgcccaagacaatgttctgggttatcctgatactggaggccaggtggtgtatatcttggatcaagttcgtgctttggagactgaaatgcttcaacgtattaagcagcaaggacttgatatcactccccgcattctcattatcactcgacttcttcctgatgcagttggaaccacttgcggtcagcgtttagagaaagtttttggaacagagcattcagatatccttcgaattccatttagaactgaaaagggaatcgtccgtaaatggatctcacgatttgaagtctggccctatctagagacttacactgaggatgttgccactgaaattggtaaggagtttcaaggcaagcctgatctgatcattggaaattacagtgatggaaacattgttgcctccttgttagcacacaaacttggtgttacagagtgtaccattgctcatgctctagagaaaacaaaatacccggaatcagatatctactggaagaagttagatgacaagtaccacttttcttgccagtttacagctgatcttatagccatgaaccatacagattttattatcaccagtacattccaagaaattgctggaagcaaggacactgttggccaatatgagagccacacagctttcacccttcctggtctctaccgtgttgttcatggtattgatgtctttgaccccaaattcaacattgtctccccaggggctgatgaaagcatatactacccatacactgacacaaagcgtaggttgacttctttccatccagaaatcgaggagcttctctacagccctgttgagaatgaagaacacttatgtgtgctaaaagatcgcagcaagccaattatattcaccatggcaaggatggacagagtaaagaatttaactggcctagtagagtggtatggaaagaatgccaaacttcgtgaattggctaaccttgttgtagtcggtggtgatagaagaaaggagtctaaagatctggaagagcaggctgagatgaagaaaatgcacggtcttattgagaaatacaatctgaatggtcagttcagatggatttcttcccagatgaaccgggtgaggaatggtgagctctaccgatgcatctgtgacactaagggagtgttcgtgcaacctgctttgtatgaggctttcgggttgactgttgtcgagtccatgagctgtggtttgccaacttttgctacctgcaatggtggccctgctgagattattgtgcacggaaaatccggcttcaacattgatccttaccatggtgatcaggctgccgagctccttgttgaattctttgagaagtgcaaggctgacccctgtgtgtgggacgagatctccaagggaggcctgcaacgtatccaggagaaatatacttggcaaatctactctcagcggctattgaccctcactggtgtatacggattttggaaacatgtatctaagcttgaccgtcgcgagagcaggcgttaccttgagatgttctatgccctgaagtacaagaaattggccgactccgttcctctgactgttgaataggaaaattgaaccaagggaaaaatggctggtggttcaagtgggggattgaaggttcaagtgggaagttttgaagttgtgaagaataatagtcatttcacaattgtgattggcccaaaaaaggctttccattttgtttcattttatctttttccctcttgtttttttttttccctttatttcctttttgcggcattgtttgcaatttggctattgagcctcttcaatttcagtaaagtttgcgtctttttggttcagtctcttttttactaatccttttcacaatattgaatactcacaagtcatgcctctttgataaatgagtattatgtatatatacacaacacagacacactatctttactaagtaggtgtatgaaaattccctttttgaactaaagcattaaaatatcaacaatttcatttaacaca

SEQ ID NO: 2452 - DNA, 2710 bp, Lupinus angustifolius
attccttcatttcatctcattatttgttctgtttctttagttgttgaaatttttggtctgaagcaatggccacttctttcaaggagagggttgatgaaactcttcagggtcacaaggatgaaattttagcccttctgttaaggattgaagccaagggtaagggaatcttccaacataatcaagtcattgctgaattggaagaaatcccaaaagagaataagcaaaatctagttgatggagctattggagaagttttgagatctatccaagaagctatagttttgccaccatttatagcattggctgttcgtccaaggcctggtgtatggaagtatgcgcgagtgaacgcgcacgagcttgtggttgatgagttgagtgctgctgagtatttgaaattcaaggaggaagttgttgatggaagttctgatggtaaatttgtgcttgagttggactttgaaccatttaatgcatcatttccaaaaccagctttgaacaagtcaattggtaatggtgtggagttcctcaaccgccacctttctgccaaactcttccatgatagggagagcttgaaccttttgctggaattcctcaagcttcatagctacaatggacaaagtctattgttgaatgacaaaattcaaaacgtggatgctctccaacaagttctgagaaaaacagaagagtatttggtcacacttgctcctgaaacaccctactcaaaatttgagaaaaaattccaggagattggtttggagagaggatggggtgacaccgctgagcgcgtcctcgagctaattcgaaatctcttagatcttcttgaggcacctgaaccccgtacccttgagacattcctaggaagtatccctttggtcttcaatgttgttatcctttcaccacatggctactttgctcaagataacgtcttgggataccctgacactggtggccagattgtttacatcttggatcaagttcgtgccttagagaatgagattctcaatcgtatcaagaaacaaggattagatatcacccctcggattctcatcatcactcgtcttctacctgatgcagtaggaactacttgtggcgaacgtcttgagaaggtataccatactgaacattgctatattctccgagttccctttcgaacagagaaaggcattgttcgcaaatggatctcaagattcgaagtctggccctacctagagactttcgctgaggatgttgctcttgaacttgctaaagagttgcaaggcaagcctgatctaattgttggaaactatagtgatggaaacattgttgcatctttgttagcacataaatttgatgtaactcagtgtaccattgctcatgcacttgaaaagaccaaatatccagaatctgacatttattggaaaaaactcgatgacaaatatcacttttccagccaatttactgctgatctttttgcaatgaaccacacagacttcattatcaccagtaccttccaagagattgctggaagcaaggatactgttgggcaatatgagagtcacactgccttcactcttcctggactctaccgtgttgttcacggtattgactctttcgacccaaagttcaatattgtctctccaggagctgacttgagcatttacttcccctacaccgaaactgagcgtaggttgacaaaattccaccttgatattgaagagcttctttacagctcagtagagaatgaggagcacataggtgtattgaaggaccacaacaagccaattatcttcaccatggcaaggttggaccgtgttaagaacataacaggacttgttgagtggtatggcaagaatgagcgcctccgtgagttggtaaaccttgttgttgttgctggagataggaggaaggagtcagaggacttggaagagaaagctgagatgaagaagatgtatggcctaattgagacatacaagttgaatggccaattcagatggatttcctctcagatggatagggtgaggaatggtgaactctaccgtgtcatttgtgacacaaaaggtgcttttgtgcaacctgctatttatgaagcttttggtttgactgttgttgaggccatgacttgtggattgccaacatttgctacctctaatggtggtcctgctgaaatcattgttcatggaaaatctggataccacattgacccttaccagggtgaccaagcagctaagctccttgttgacttttttgagaagagcaagaatgatccttctcattgggacaaaatctcccatggtggtctgaaacgtattcacgagaagtatacatggcaaatttactctgaaaagcttctaactctcactaatgtgtatggtttctggaagcatgtgactaaccttgaccgtcgtgagcataaacgttaccttgagttgttctatgcccttggctttagcaaattggctaagtctgtgccccttgctgttgaagaataaaatcaagtgtgaaggatacataaagagatgaatttagtattatggatctttatcaaataataccattgatttttatattgtgattaggtataggatttaaaatgtaaaaggaaaagtgcttcttttattttctttaaatctttacctcatcaattcaatttgaattttaagcggtcacatttcttctccaacttcactttttatcatttgtgattcctgttatctctaaaaagttattagctaaa

SEQ ID NO: 2453 - DNA, 3018 bp, Populus trichocarpa
tatccatcctcactcgccattgcaagctcctcccccttgctttcttgcttgcgttttttctgtgtatttttactgtccaagatttgccttccctcgtcttgttgaaggctttgttgttaattagctacctataccatctccttcaagtagtttcagcttatatatatatatatatatatattatattatatatatatcgtggcattaagctcaaggagctatgtctgtacttactcgtgtccaaagcattcgtgaacgtttggatgagaccctcaagactcatcgcaacgagattgttgccttactgaccaggattgaaggcaagggaaaaggaattcttcaacaccaccagattattgctgagtttgaagcaatccctgaagagatcaggaagatattggcgggtggtgctttttctgaagttctcagatccacacaggaagcaattgttttgcctccatgggttgcccttgctgtgcgcccaaggcctggtgtctgggagtacgtcagagtgaatgtccaagcacttgttgttgaggagttgcgtgttgctgagtatcttcatttcaaggaggaacttgttgatggaggctccaatggcaacttcgtgcttgaattggactttgaaccattcagtgcatctttccctcgcccaactctttcaaagtacattggtaacggtgttgagttcctcaaccgccacctttcagctaagttgttccatgacaaggaaagcctgcaccccctgcttgcatttctcaaggtgcactgtcacaaggggaagaatatgatgctgaatgacagaattcataacctagactctctgcaatatgttctgagaaaggccgaggaatatctgtcttctctgaaacctgagactccatactctcaattcgaacacaagttccaggagatcggcttagagagaggatggggcaatactgctgagcgtgttcttcagatgattcaacttcttttggatcttcttgaggcaccagatccctgcactcttgaaactttccttggcagaattcctatggtcttcaatgttgtgatcatgtcccctcatggatacttcgcccaagacaatgttttggggtatcctgataccggaggccaggttgtttacattttggatcaagttcgtgccttggagaatgaaatgcttctgcgtatcaagcagcaaggacttgatatcatcccccgaattctcattattactcgactgctccctgatgcagtaggaaccacttgtggacaacgtctggagaaagtctatggatcggagcattgtgatattcttcgagttcccttcagagatgaaaagggaatggtccggaaatggatttctcgctttgaagtttggccatacctagaaacttacactgaggatgttgctgctgaaattgctaaggagttgcagggaaagcctgatctgatcattggaaattacagtgatggaaacgttgttgcctccttgctagcacacaaattaggtgttacagagtgcactattgcacatgctctagaaaaaacaaagtacccagattcagatatttactggaagaagtttgatgaaaagtaccacttttcatgccagtttacagctgatctttttgccatgaaccatacagatttcatcatcaccagcacattccaagagattgctggaagcaaggatactgttggacagtacgagagccacactgctttcactctccctggcctctacagagttgttcatggtatcgatgtatttgatcccaaattcaacattgtatcccctggtgctgacgagagcatatacttcccttacactgagaagaaacttaggttgacttctttccatgaagaaattgaagaacttctttacagctccgttgagaacgacgagcacttatgtgtgctaaaagaccgcaacaagccaattctattcaccatggcgaggctggacagagttaagaatttaactggtcttgtagaatggtatggaaagaataccaagctgcgcgaattagctaatcttgttgtagttggtggtgatagaagaaaggagtctaaagatatagaagagcaagctgagatgaagaaaatgtacagtcatatagagaaatacaaattgaatggccagttcagatggatttcttctcagatgaaccgcgtgaggaatggagagctctaccgttacatttgtgataccaagggagctttcgtgcagcctgctttgtatgaggcttttggattgactgttgttgaggccatgacatgtggtttgccaacctttgctacttgcaatggtggtcctgctgagatcattgtgcatggaaaatccggattccatattgatccttaccatggagtacaggctgctgaactccttgttgacttctttgagaagtgcaaggctgatcccacttactgggacaaaatctcccagggaggcctgcagcgaatccaagagaagtatacctggaaaatttactctcaaaggctcctgactctcacaggagtttatggcttctggaagcatgtttccaaccttgatcatcgtgagagccgtcgctatctggaaatgttctatgcactcaaatatcgcaaattggctgattctgttcctttgactatcgagtaaatggaactggagaaatcaaggaaacatgggttggtttgagtcgggttccgggtccagaataatggtgtcatttcacgatagtgattggacaagaaaggctttgatcttctttttgtttttttgtttttcctttctgtgtgtatcttttttgtctttccttttcttttcatcatgcagcctcttgaatttcagtaaagattgtgtcttttgagttcatcatcccctctatccatttcttgcaaattctgtctcttgagattggaaatcatgggaaatgatccaacatcaattcctgtatttctcctcaatactcgagattggaagttgatggctattcttcatcattatataaagacaaaaataagtttggcctgtggtttgcctaa

SEQ ID NO: 2454 - DNA, 2821 bp, Prunus persica
cattcctttcttcatttctatcattctttgcgttttgtgtattgaaaccctgcgttcactattctttcttcaattcattctttttcattcatttgtttctcctctttctcattactgaagaacattggttggcgctaaatacttggtggcattccaagtttttgaaggttctctgatttaccaatctgctatcaatggcggaacgtgccttgacccgtgtccaaagcctccgcgagaggttggacgtgactctctctgctcaccgcaatgagattgttgccctgctttcaaggattgtaaacaagggaaaagggtttatgcagccccatgagcttgttgctgagtttgaagcaattcctgaaagtaacagacagaagctcttggacggggcttttggtgaagttttgacacacacccaggaagttattgttctacccccatgggtggctcttgctgtgcgcccaaggcctggtgtttgggagtacatccgtgtgaatgtcgacgcacttgttgttgaggagctgcaggtgcctgagtacttgcacttcaaagaggaacttgttgatggaagtgccaatggcaactttgtgcttgagttggacttcgaaccattcaacgcttctttcccccgcccaactctttccaagtccattggaaatggcgttgagttcctcaaccgtcacctttctgcaaagctcttccatgacaaggagagcatgcacccactgctcgaattcctccgagttcactgctacaagggcaagaatatgatgctgaatgacagaattcataatgtgaatgaactccaacatgttctgaggaaggcagaggattacctctccacaattgccccagaaaccccttacaagcaatttgaggacaagttgcaaaagctcggtttggagagaggttggggtgacaccgcagagcgcgttctcgagatgatccaactcctcttggatcttcttgaggcacctgatccttgcactcttgaaaagttccttggccaaatccccatggtctttaatgttgtgatcctttctccccacggctatttcgctcaagacaatgtcttggggtaccctgacactggtggccaggttgtttatatcttggatcaagttcgtgctttggagactgagatgcttaagcgtattaagcaacagggactggatattactccccgcattattattctcacaaggcttcttcctgatgcggttggaaccacatgcggtgagcgtcttgagaaagtatacaacacagagtattcacatattcttcgtgttccctttagaacagagaagggtattgtccgcagatggatctcgagatttgaagtctggccctacctagagacttatgctgaggatgcgatccaggaactttccaaggaattacacggcaagcctgatctcatcatcggaaactacagtgatgggaacattgtggcctcattgatggcacacaaattgggtgttacacagtgcaccattgcccatgccctggagaagacaaagtaccctgattctgacctttactggaagaaattagatgacaaatatcacttctcatcccaatttacagctgatcttatagccatgaaccatactgatttcatcatcaccagtaccttccaagagattgctggaagcaaggacacagttggccagtatgagagccacactgcttttactcttcctgggctttaccgtgtcgttcatggtattgatgtcttcgatcccaagttcaacattgtttcaccaggagcagacatgagcatttacttcccttactctgagaaggaaaagaggctgacatcattccaccctgaaattgaagagctcctttacagccaagttgagaacaaggaacacttatgtgtgttgaaggacaggaacaagccaatcatcttcacaatggcaaggctggaccgtgtgaagaacattactggacttgttgagtggtatggtaagaatgcgaagcttagggaattggttaaccttgttgtggttgccggggaccgccgaaaggagtccaaggacaatgaggagaaggctgagatgaagaagatgtatgagctgattgacacctacaacttgaatgggcagttcagatggatttcatcccagatgaaccgcgtgaggaacggtgaactctaccgtgtcattgctgacaccaagggagcttttgtgcagcctgctgtttatgaagccttcggcttgacggttgttgaggccatgacctgtggacttccaacattcgctacttgcaagggtggccctgctgagattattgtgcatggcaaatctggctaccacattgatccatatcatggtgatcaagctgcggacatccttgttgacttctttgagaagagcagggcagatcctagccactgggacaagatttctcagggtggcttgcagcgtatttatgagaagtatacatggcaaatctactcagaaaggctcttgactctcaccggagtttatggcttctggaagcatgtttccaaccttgatcgccttgagagccgtcgctatcttgagatgttctatgccctcaagtatcgcaagctggctgagtctgttcctcgtgccgaggaggagtgaagggaaagctaaagagtaaataaagaggcggaagcattggttggctaagagtggagttttcctccctagtatgaggattgtttttggatatattttgattttttttttcgtttcttttgaaattttctttttacattcctattggaagtgtttgaacctgggtttttaaccccattaatcaattgaagtcaactttgcttcaccta

SEQ ID NO: 2455 - DNA, 2929 bp, Prunus mume
gacctctctctcctcccccataatataaaagggttgtttgctcctccttctcctccatcccatttctcattcctttcttcatttctatcattctttgcgttttgtgtgttgaacccctgcgttcactgttctttcttcaattcattcttttcattcttttgtttcttttctctctcattactgaagaacattggttgacggtaaattcttgggggcattccaagtttttgaaggttctctgatttaccaatctgccatcaatggcggaacgtgccttgacccgtgtccaaagcctccgcgagaggttggacgtgactctctctgctcaccgcaatgagattgttgccctgctttcaaggattgtaaacaagggcaaagggtttatgcagccccatgagcttgttgctgagtttgaagcaattcctgaaagtaacagacagaagctcttggatggggcttttggtgaagttttgacacacacccaggaagttattgttctacccccatgggtggctcttgctgtgcgcccaaggcctggtgtttgggagtacatccgtgtgaatgtcgacgcacttgttgttgaggaactgcaggtgcctgagtacttgcacttcaaagaggaacttgttgatggaagtgccaatggtaactttgtgcttgagttggacttcgaaccattcaacgcttctttcccccgcccaactctttccaagtccattggaaatggggttgagttcctcaaccgtcacctttctgcaaagctcttccatgacaaggagagcatgcacccactgctcgaattcctccgagttcactgctacaagggcaagaatatgatgctgaatgacagaattcataatgtgaatgaactccaacatgttctgaggaaggcagaggattacctctccacaattgccccagaaaccccttacaagcaatttgaggacaagttgcaaaagctcggtttggagagaggttggggtgacaccgccgagcgcgttctcgagatgatccaactcctcctggatcttcttgaggcacctgatccttgcactcttgaaaagttccttggccaaatccccatggtctttaatgttgtgatcctttctccccacggctatttcgctcaagacaatgtcttggggtaccctgacactggtggccaggttgtttatatcttggatcaagttcgtgctttggagactgagatgcttaagcgtattaagcaacagggactggatatcactccccgcattattattctcacaaggcttcttcctgatgcggttggaaccacatgtggtgatcgtcttgagaaagtatacaacacagagtattcacatattcttcgtgttcccttcagaacggagaagggtattgtccgcagatggatctcgagatttgaagtctggccctacctagagacttatgctgaggatgcgatccaggaactttcgaaggaattacacggcaagcctgatctcatcatcggaaactacagtgatgggaacattgtggcctcattgatggcacacaaattgggtgttacacagtgcaccattgcccatgccctggagaagacaaagtaccctgattctgacctttactggaagaaattagatgacaaatatcacttctcatcccaatttacagctgatcttatagccatgaaccatactgatttcatcatcaccagtaccttccaagagattgctggaagcaaggacacagttggccagtatgagagccacactgcttttactcttcctgggctctaccgtgtcgttcatggtattgatgtcttcgatcccaagttcaacattgtttcaccaggagcagacatgagcatttacttcccttactcagagaaggaaaagaggctgacatcattccaccctgaaattgaagagctcatttacagccaagttgagaacaaggaacacttatgtgtgttgaaggacaggaacaagccaatcatcttcacaatggcaaggctggaccgtgtgaagaacattactggactcgttgagtggtatggtaagaatgccaagcttagggaattggttaaccttgttgtggttgccggggaccgccgaaaggagtccaaggacaatgaggagaaggctgagatgaagaagatgtatgagctgattgacacctacaagttgaatggacagttccgatggatttcatcccagatgaaccgcgtgaggaacggtgaactctaccgtgtcattgctgacagcaagggagctttcgtgcagcctgctgtgtatgaagccttcggcttgacggttgttgaggccatgacctgtggacttccaacattcgctacttgcaagggtggccctgctgagattattgtgcatggaaaatctggctaccacattgatccatatcatggtgatcaagctgcggacatccttgtcgacttctttgagaagagcagggcagatcctagccactgggacaagatttctcagggtggcttgcagcgtatttacgagaagtatacatggcaaatctactcagaaaggctcttgactctcaccggagtttatggcttctggaagcatgtttctaaccttgatcgtcttgagagccgtcgctatcttgaaatgttctatgccctcaagtatcgcaagctggctgagtctgttcctcgtgccgaggaggagtgaagggaaagctaaagagtaaaataaagaggcggaagctttggttggctaagagtggagttttcctccttagtatgaggattgtttttggatatattttgatttttttttttcgtttcttttggaattttcattttacattcctattggaaatgtttgaatctgggtttttaaccccattaatcaattgaagtcaactttgcttcacctagtcttgttctgctatccaatcacatctcctttttcacatt

SEQ ID NO: 2456 - DNA, 2997 bp, Lupinus angustifolius
  misc_feature (1195)..(1286): n is a, c, g, or t
gatatagcacctcatttattcatccactcttcttttctctttaccccatttactattttgcgtttattctgtttccagagtttaaggtttttctgagtgacaatggctactgatcgtttgacccgagttcacagtctccgtgaaaggattgatgaaaccctcactactagcaggaatgaaattctggcccttctctcaagaatcgaaggcaagggtaagggactgctgcaacaccatgaaatcattgctgagtttgaagaaatccctgaggagaatagacagaagctaagtgatggtccctttggtgaagttctgagatccacacaggaagctatagttttatcgccatgggtagctttcgctgttcgtccaaggcctggtgtttgggagtacctgaaagtaaatgtgcatgctcttgttgttgaggagttgcaagctgctgagtacctgaaattcaaagaggaacttgttgagggaagttccaatggtaactttgtgcttgaattggactttgaaccatttaatgcatcttttcctcgcccaactctgaacaagtcaattggaaatggtgtgcaattcctcaaccgccacctttctgccaaactcttccatgacaaggagagcttgcaccctcttctggaattcctcagatctcacagctacaatggaaagacattgatgttgaatgacagaattcagactccggattctcttcaaaatgtcctccggaaagcagaagagtatcttggcacacttgctcctgaaacaccctactcagaatttgaattcaaattccaggagattggtttggagagagggtggggagacacagtcgagcgtgtccttgagatgatccaacttctattggatcttctcgaggcacctgacccttgcacacttgagacattccttggaagaatccctatggtattcaatgttgttatcctttctccccatggttactttgcccaagataacgtcttaggatacccggacactggtggccaggttgtttacatcttggatcaagttcgtgctttggagaatgagatgctcaaacgcattaagcaacaaggcttggatatcgtccctcgcattctcattgtaagtccttgtgtagttttgtgaagagtaagcctatttctgtatatagtgtttggatatttctctaattgttgttgattgtggatgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacattcttcgagttccctttagaactgagaagggaattgtacgcaaatggatctccagatttgaagtctggccctacctagaaacttacacagaggatgttgcccatgaacttgccaaggagttgcaaggcaagccagatctgattgttgggaactatagtgatggaaacattgttgcctctttgttggcacataaattaggtgtcactcagtgtaccattgctcatgcacttgagaagaccaaatatcctgaatctgacatttactggaagaaatttgacgagaaatatcacttctcctcccaatttacagctgatctttttgcaatgaaccacacagacttcattatcaccagtaccttccaagagattgctggaaacaaggatactgttggacagtatgagagtcacactgccttcacccttcctggactctaccgtgttgtacatggtatcgatgtttttgatccaaagttcaatattgtatctcctggagctgaccagaccatttacttcccatacactgaaactagccgtcggttgacatccttccaccccgagattgaagagcttctttacagctcagtcgagaatgaagagcacatatgtgtattgaaggaccgcaacaagcctattatcttcaccatggcaaggttggaccgtgtgaagaacattacaggacttgtggagtggtatggtaagaatgctcgcctgcgtgagttggtgaaccttgtcgttgtggctggagacaggaggaaggagtccaaggacctggaagagaaagctgagatgaagaagatgtatggcctcattgagacatacaagttgaatggccaattcagatggatttcctctcagatgaatagagtaaggaatggagagctttaccgtgtgatctgtgacacaaagggtgcttttgtgcagcctgctgtgtatgaagcttttggtttgacagttgttgaagccatgacttgtggtttgccaacttttgctacatgcaatggtggtcctgctgagatcattgtgcatggaaaatctggataccacattgacccttatcatggtgaccgtgctgctgatcttcttgttgaattctttgagaagtctaaggcagatccatctcactgggacaaaatctcccatggaggcctgcgccgtattgaagagaagtatacatggcaaatctactctgagaggcttctgacactcaccggtgtctacggcttctggaaacatgtgtctaaccttgaccaccgtgagagccgccgctaccttgagatgttctatgctctcaagtaccgcaaattggctgagtctgtgccccttgctgttgaggagtaaagcaaggcttgaagagtatataaagaaatggaggatccggcattttcctgtttgcactgtctgttgagtttcataaataatgtcaatgattttgattctgtgattaggctatggataaaagaaaaaaactagtatttttcttttccttttccttttgcatgattggagtttgggtaagtataccttcatcaattctatttgaagttgtgccttctttacttgattgatgtctacattcccctccaactttatcttatcatttgctttaccttcttgttctttatccttaaaataaacaaaacaataaagcactagtagagtaatctattacaatttcatatgtgatacttatcactatcattagaaaaag

SEQ ID NO: 2457 - DNA, 2807 bp, Populus trichocarpa
tctgcaaacttctcctttgcaatctttctttcttgcgttctgtgtgttcgttgtgatttgtgttcattcttcttgtctattagcttgtccccccgtccgactgctttctgtatttattctggcattaagcttaaggagctatggctgaacgtgctcttactcgtgtccatagcattcgtgaacgtgtagatgagactctcaaggctcatcgcaatgaaattgttgcgttactcacaaggatcgaaagtaagggaaaaggaattctccaacaccaccagattgttgctgagtttgaagcaattcctgaagacaccaggaaaacattggcaggcggtgcttttgctgaagttctcagatccacacaggaagcaattgttgtgcctccatggattgctcttgctctgcgcccgaggcctggtgtctgggagtacattagactgaatgtccaagcacttgttgttgaggagttgcgtgttgctgagtatcttcatttcaaggaggagcttgttgatggaggctgcaacggcaacttcgtgcttgaattggacttcgaaccattcaatgcatctttccctcgcccaactctttcaaagtatattggtaatggtgttgagttcctcaatcgccacctttcggctaagttgttccatgacaaggaaagcctgcatcccctgcttgcatttctcaaagtgcactgtcacaaggggaagaatatgatgctgaatgacagaattcgtaacctagactctctgcaatatgttctgagaaaggctgaggagtttctgtctactctgaaacctgatactccatattctcaatttgaacacaagttccaggagattggcttggagagaggatggggtgatactgctgagcgtgttcttgagatgattcgacttcttttggatcttcttgaggcaccagatccctgcactctcgaaacattcctaggcagaattcctatggtcttcaatgttgtgattatgtcccctcatggatactttgcccaagacaatgttttggggtatcctgatactggaggccaggttgtttacattttggatcaagtccgtgccttggagaatgaaatgcttcagcgtatcaagaagcaaggacttgatattaccccccgaattctcattattactcgactactccctgatgcagtaggaaccacttgtggtcaacgtttggagaaagtgtatggatctgagcattgtgatattcttcgagttcccttcagagatggaaagggtatggtccgcaaatggatctctcgctttgaagtgtggccatacctagaaactttcaccgaggacgttgctgctgaaattgctaaggagttgcagggcaagcctgatcttatcattggaaattacagtgatggaaacatcgttgcctccttgttagcacacaaattaggtgttacagagtgcaccattgcgcatgctctagaaaaaacaaagtatccagactcagatatatactggaagaagtttgatgaaaagtaccacttctcatgccagtttacagctgatctttttgcaatgaaccatacagatttcattatcaccagcacattccaagagattgctggaagcaaggatactgttggacagtatgaaagccacactgctttcactctccctggcctctatagagttgttcatggtattgatgtctttgatcccaaattcaacattgtatcccctggcgctgatgagagcatatacttcccctacactgacgagaaacgtaggttgacttctttccatccagaaattgacgagcttctttacagccctgttgagaatgaagagcacttatgtgtgctaaaagaccgaaacaaaccaattctatttaccatggcaaggctggacagagttaagaatttatctggtcttgtagaatggtatggaaagaacaccaagctacgtgaattagttaatcttgttgtagttggtggagatagaagaaaggagtctaaagatctagaagagcaagctgagatgaagaaaatgtacagtcatatagagaaatacaacttgaatggccagttcagatggatttcttcccagatgaaccgtgtgaggaatggagagctttaccgttacatttgtgataccaagggagctttcgtgcagcctgctttgtatgaggcttttggattgacagttgttgaggccatgacttgtggtttgccaacttttgctacctgcaatggtggtcctgctgagatcattgtgaatggaaaatccggattccacatcgatccttatcatggtgagcaggctgctgagctccttgttgacttctttgagaagtgcaaggttgatcccgctcactgggacaaaatctcccacggaggtctgcaacgaatccaagagaagtatacctggcaaatttactctcaaaggctcctgacgctcacaggagtttatggattctggaagcacgtttcgaaccttgatcgtcttgagagccgtcggtatatggaaatgttctatgcactcaaataccgtaaattggctgagtctgttcctctgactaaggagtaaatgtaactgaagaaatggaggaaacacgggttggtttcagttgggagacagaaccagaataatgttcatttcacaattgtgatgtgataagaaaggctttgatttcatttttatttattgctttccattgtatcttttttccttttcttttcattctgcggcattgtttgcacttcggctgctgagcccattgaatttcagtaaagattgtgtttctttgggtttatccatcatctgctttctatccat

SEQ ID NO: 2458 - DNA, 2809 bp, Malus domestica
ttattattcatcctctcttcatttctatcattctctgtgttctgtatattgaagttcttcgttcattcaatttgttcgtcgattcgttactcttttggttaagggcattcgttggtggtaattttccatcccattttaagcttttaaggttgtctgattttccaagctgctgtcgatggcggaacgtgtgctgacccgcgtccagagtctccgggagaggctggacgaaaccctttctgctcaccgcaatgagattctggcccttctttcaaggattgagagcaaggggaaagggtttctgcaaccccatcagcttcttgccgagttcgaagagattcctgaagcgaacaggcagaagctgttggatggggcttttggtgaagttttgaagaacacccaggaggtaattgttctgcccccatgggtggcgcttgctgtccgcccaaggcctggtgtttgggagtacattcgtgtgaatgtccatgctctcgttgtcgaggagttacgtgtggctgagtacttgcaattcaaggaggaacttgttgatggaagtgccaatggcaactttgtgctcgagttggactttgagccattcaacgcctccttcccccgcccaactctttccaagtccattggaaacggcgttgagttcctcaaccgccacctttctgcaaaactcttccatgacaaggagagcctgcacccgctgctcaagtttctccgtgttcactgctacgagggcaggaacctgatgctgaataacaaaattaaggatgtgaatgagctgcaacatgttctgaggaaggcagaggatttcctatctgcaattgcccctgaaactccgtacaaggacttcgagcccaagttgcaagccattggcttggaaaggggttggggtgacactgctgggcgtgtgctcgaaatgatcgaacttctgttggaccttcttgaggcacccgatccttgcactcttgagaaattccttgaccaaatccccatggtctttaatgttgtgatcctctccccccacggctatttcgcccaagacaatgtcttggggtaccctgacaccggtggccaggttgtctatatcttggatcaagttcgcgcattggaggctgagatgctcaagcgtgttaagcaacagggactggatatcataccccgcattatcattctcacaaggcttcttcctgatgccgttggaaccacatgtggtgatcgacttgagaaagtatacgggactgagcattcagatattcttcgtgttccattcagagatgaaaaaggagccattgtccgcagatggatttcaagattcgaagtctggccctacctagagacatacgccgaggatgcgatcaaggaactttccaaggaaatgcatggcaagcctgatctcatcatcggaaactacagtgatggcaacattgtggcctcactgatggcactcaaattgggtgttacacagtgcaccattgctcatgctctcgagaagtcaaaataccctgattctgacctttactggaagaaattggatgacagttatcacttctcatgccaatttacagctgatcttatcgccatgaaccacactgatttcatcatcaccagtacctatcaagagattgctggaagcaaagaaactgttggtcagtatgagagccacactgcttttactcttcctgggctctaccgtgttgttcatggtattgatgtcttcgatcccaagttcaacattgtttcaccaggagctgacatgagcgtctacttcccttactctgagaaagaaaagaggctgactaacttccaccctgaaatcgaagagctcctttacagccaagtcgaaaataaggaacacttatgtgtgttgaaggacagaaacaagccaatcatcttcacaatggcaaggctggaccgcgtgaagaacatcactgggcttgtcgagtggtatggtaagaatgccaagctcagagagttggttaacctggttgtagttgctggtgatcgccgcaaggagtccaaggacaatgaggagaaggctgagatgaagaagatgtatgagcttattgacacctacaagctgaacgggcagttcagatggatttcttcccagatgaaccgtgtcaggaatggtgaactttaccgctacatttgtgacaccaagggagcctttgtgcagcctgctgtgtatgaagctttcggcttgactgtcgttgaggccatgacttgtggactgcccacatttgccacttgcaagggtggcccggctgaaattatagtgcatggcaaatctggctaccacattgatccatatcacggcgatcaagccgctgagatccttgttgatttctttgagaagagcaaggcagatcctagccactgggacaagatttctcaaggcggcttgcagcgcatttatgagaagtacacatggcaaatctactctcagaggctcctgaccctcaccggagtttatggtttctggaagcatgtttcaaaccttgatcgcctggagagccgccgctatctggagatgttttacgccctcaagtacagcaagctggcggcgtctgttcctcttgctgtggaggagtgaaagagaacgttttcccaagtaaataaagaggcggaggaattggttggctctgggtgaagttttttcctccgtcgaatgcggattttggatatattatgatttacaaaggatctttaacttctttttgtactttttattttcgattcccattggaaatgtttgaacctgggttcttaccccattaatcaattcaagtcaactttgcttcaa

SEQ ID NO: 2459 - DNA, 2932 bp, Eucalyptus grandis
ggatcccggtttcttatactactgtcgtttctgtattgcagtgttaaggttcttgagaggattcagacatggcggaacgcttgcttacgcgtgttcacagcctccgtgaacgtttggatgagaccctcttggctcatcgtaatgacattttggctttcctcaccaggatcgaagccaaaggcaagggtatcttgcagcatcatcaacttattgccgagttcgaggcgatctctgaggaacataggaaaaagctcagtgaaggagcatttggagaaatcttgagatccagtcaggaagcaatagtcttgcctccatggattgcccttgctgtgcgtcccaggcccggtgtgtgggagtacattagggtaaatatccacgcccttgttgttgaggagttgcaagtgaccgagtttcttcatttcaaggaagaacttgtcaatggaaatttgaatggaaactttgtgcttgaattggactttgagccattcactgctcaatttccccgcccaactctttcaaagtccattggaaatggagtggagttccttaaccgccacctttcggcaaagctcttccatgacaaggagagcttgcaccctttgcttgagttccttcaagttcattgctacaaaggaaagaacatgatggtgaacacaagaattcaaaatgtcttctccctccaacatgtcctgaggaaggcagaggagtacctttctgccctcaaacctgagacaccttactctcagttcgagcacaagtttcaggaaattgggctagagaggggctggggcgacaccgccgagcgtgtgcttgaaatgattcggcttctgctggatctacttgaggctcccgatccatgcaccctcgagaatttcttgggaagaatccccatggtctttaacgttgttatcatgtcacctcacggttactttgcccaagacgacgtcctcggatatcccgataccggtggccaggttgtgtacatcttggaccaagttcgtgcattggagagtgagatgcttcaccgtatcaaacaacaaggactggacattactcctcggatcctcatcgtcactcgtcttcttcctgatgcagtaggaaccacgtgcaaccagcgtcttgaaaaggtttttggaacagaatactcccacattcttcgagttccctttagaactgagaaagggatggtccgcaagtggatttcacgatttgaagtgtggccttacttggaaacatacaccgaggatgtcgccaatgaaattgctggagaactacaagggaagcccgatctgatcattggcaattacagtgatggtaacattgttgcttctttgctggcccataagttgggcgttacgcagtgcacgatagctcatgcccttgagaagaccaaatacccggaatctgacatctactggaaaaagttcgaagaaaaatatcatttctcttgccagtttacagcagatctcatagccatgaaccacaccgactttataatcaccagcaccttccaggagattgccggaagcaaggacacggttgggcaatatgagagtcacaccgcttttacacttcctggactgtaccgagtcgtccatggcattgatgttttcgatcccaaattcaacattgtgtcaccaggagctgatatgagcatttatttctcctacacggaggagaagctgaggttgaaatctttccatgccgagatcgaagaacttctgttcagcgatgtggagaacaaggaacacctatgcgtattgaaggaccggaacaagccaatcttgttcaccatggcaagactggaccgtgtcaagaacttgacggggctggtcgagtggtacggaaagaacacccgcttgagagagctggtcaacttggtagtggtcggtggtgaccggaggaaggaatctaaagacttggaagagcaagccgagatgaagaagatgtacgggctgattgagacgtacaatttgaatggccagttcaggtggatctcctcccagatgaaccgggtgaggaacggagagctttaccggtacatctgtgacatgaggggagcatttgtgcagcccgctctctacgaggcttttggattgaccgtggtggaggccatgacatgtggattgccgacctttgcgacttgcaaaggcggtcctgctgagatcattgtgcacggcaagtccggattccacattgatccttatcacggggatcaggcagcggagaccctcgccaacttcttcgagaagtgcaaggtggacccaagccactgggacaagatctcacagggggcgatgcaaagaatcaaggagaagtatacatggcaaatttactccgagaggctgctcaacttgacggcggtgtacggcttctggaagcacgtctcgaatctcgaccgtctcgagagccgccgctacctggaaatgttctatgccctcaagtatcggaaattggccgagtcggttccccttgccgttgagtgagttagaggtgaacaaaagggcagatctcaagaggcagacagctttaaaatctctcgagagttaaggaataattgccattgcattggattggaagagagccttttcttttggatttctttttgcaactgctttcgtcaatctttcttttccttctttctgctgtgaatgtatgttgggttaggttcttcaaaaagtcaattaaatgaaatttccttcttcttttcccagtgtcccctcaatttaccggtcgtcttccacttgtaagttcacgttcaaccattttttctttgcttttaagatagcaatgtgcatccaattgtgttgttactcggatcagcgatggtagcgagtcccttggatgtagcacaagactatccaaaaaaataaattgctgaggcaaaataagtcttttcaactaaatcggaagaaaaacttgtataaccgaa

SEQ ID NO: 2460 - DNA, 2729 bp, Euphorbia peplus
tattctctgatcagtaagtagtagctatggcggaacgtgttattacccgagttcacagcattcgtgaacgtttggatgagactcttgctgctaaccgcaatgaaattgttgctttgctcaccaggattgaaggtaagggaaaaggaattcttcagcaccaccatatcattgctgagtttgaagccattccggaagacaacaggaagaagcttcaggaaggtgtttttggtgaagttttgagggctgcacaggaagcaatagttttgcctccttgggttgcccttgctgtgaggccaagccctggtgtttgggagtacgtcaggatcaattcgcatgctcttgttgttgaggagcttcgtgttgctgagtacctccagttcaaggaggaacttgttgatggaagccaaaatggcaactttgtgcttgagttggacttcgagcctttcaatgcttcatttcctcgcccaactctgtcgaagtacatcggtaatggtgttgagttccttaaccgtcacctctctgcaaaattgttccatgacaaggagagcttgcatcctcttcttgagtttctcaaggtccattgccacaagggcaagaatatgatgttgaatgataggatccagaacttgaattccttgcaatatgttctgagaaaggctgaagagtatctagttgcattgccagctactactccctactctcaattcgagcacaagttccaagagattggacttgaaagaggatggggtgataccgctgagcgtgtccttgagatgatcagacttctcttggatcttcttgaggcaccagatccttgcacccttgaaaccttccttggaagaattcctatggttttcaatgttgtcattatgtctcctcatggatactttgcccaagacaatgttctggggtaccctgataccggaggacaggttgtctacatcttggatcaagttcgcgccttggagaccgaaatgctgcagcgaatcaagcagcagggacttgatatcacccctcgcattctcattattacccgacttctccctgatgcagctggaaccacttgcggtcagcgcctggaaaaagtatatggaagcgagtactcagatatcctgcgtattcccttcagaactgaaaagggaattgttcgtaaatggatctcacgattcgaagtgtggccctacctagaaacatacactgaggatgttgccaccgaaattggcaaggaattccagggaaaacctgatttgatcattggaaactacagtgatggaaacattgttgcctccttgttagctcataagcttggtgttacagagtgtaccattgctcatgctctagagaaaacgaaataccctgaatcagacatttactggaagaagtttgatgacaagtaccacttctcttgccagttcactgctgatctgtttgccatgaatcatacagatttcatcatcacaagtaccttccaggaaattgctggaagcaaggacactgttggtcagtatgagagccacacagcttttacccttcctggtctctaccgagttgttcatggtattgatgtcttcgatcccaaattcaacatcgtctctcctggtgctgacatgagcatttactttgcctacactgagaaggaacgtaggttgactgctttccacaaagaaattgaggatcttctctacagctctgttgagaatgaagaacacttgtgcgtgcttaaggaccgtacaaagccaatcatcttcaccatggctaggctagacagagttaagaatttgtctggccttgtggaatggtatggaaagaatgagaagctccgggaaatggctaatcttgtcgttgtaggtggtgatagaagaaagcagtcccaagatattgaagagcaatctgaaatgaagaaaatgcatgctcatattgagaaatacaatctgaatggccaatttagatggatttcttcccagatgaacagggtgaggaacggtgagctctaccgttacatatgtgactcaaagggagtgttcgtgcagcctgctttgtatgaagctttcggtttgactgttgttgaggccatgacttgtggtctgccaacttttgctacttgcaatggtggtcctgctgagattatcgtacatggaaaatccggcttccacattgatccatatcacggtgaccaggctgctgatctccttgtcgccttcttcgagaggtgcaagaaagaaccatcccactgggatgagatatccaagggagctatgcaacgtatagaggagaagtatacctggcaaatctactctcagaggctattgaccctcactggggtgtatggcttctggaaacatgtttccaagctagaccgtcgcgagagcaggcgttaccttgaaatgttctatgctttgaaataccgtaaattggcggattcagtcccgttgacggtggagtaagtggaagcacaagcacataagaagggaagggagggctagaacaagggttgtttttgagttgtgaaggttgaagtgggaagtttccaagttgtgaagaataataagggtctttttacaatttgtgactagactttaggactttccattttgtttcatttcgtaatatttcccttctttacttgtttttgcggcatttgtttgaatgtttggctaatgagcccccttcaatttcagtaaatgttgtgtttttttcttggttatatcaactccactttgtgctttaac

SEQ ID NO: 2461 - DNA, 2670 bp, Tropaeolum majus
tttttgaaaactgatcggatcggaagaaaatcaatggcggagcgtgtcatcactcgcgttcacagccaacgtgaacggttggatgaaacactttcttctcatagaaatgaagttctagccttgctttccaggattgaaagcaacggaaaagggattctgcaacatcaccaactcatcgctgaattcgagggattaccggaagagaaccggaagaagcttgccgatggtgcacttttcgaaatccttacatcttctcaggaagccatagtttcgccaccatgggttgctctagccgtgcgtccgaggcctggtgtatgggaatacattagagtgaatgttcacgctcttattgtcgaggagttaaccgtggctgagtatcttcactttaaggaggagcttgtcgatggaagtgtgaacgggaactttgtgcttgagttggactttgagccgttcaatgcatctttccctcgcccaactctatcgaagtcaatcggtaacggcgtcgagtttcttaatcgtcacctttcggcgaagttgtttcacgataaggaaagcatgcacccgttgctccagtttcttaaagtacattgccacaagggcaagaatatgatggtgaatgacagaattggaaacctgaactcactccaacatgtacttaggaaagcagaggagtatcttctaacactaacgccagatacggcgtataccgagttcgaactgaagttccagcagattggtctagagagaggttggggggacacagcggagcgagttctctatatgattcaacttcttttagatcttctagaagcacctgacccttgcactctcgagacgttccttgggcggatccccatggttttcaacgtcgtcattcttagcccgcatggatactttgctcaagacaacgttttaggataccccgacaccggtggtcagattgtttacatcttggatcaagttcgcgcgttggagaccgaaatgcttctacgtataaaacaacaaggtctcaatataaccccacgcatcctcattataacccgtctgctcccggatgctgtcgggactacatgtggtcagagactcgagaaagtttacggtaccgaatactccgatattcttcgtgttccctttacaacagagaacggaatcgtccgaaaatggatctctcgattccaagtctggccttacctcgagacttttaccgaggatgttgcaggggaaatctcgaaagagttgcagggaaaacccgatcttatcatcgggaattatagcgatgggaacattgttgcttctttgttggcgcataagttgggtgttactcagtgtaccattgctcatgcactcgagaagacaaagtatcccgactcggatatttactggaaaacgcttgacgacaagtaccacttttcgtgccagtttactgctgatcttatcgctatgaaccataccgatttcatcatcacgagtacgttccaagaaattgcgggaagcaaagataccgtcggtcaatacgagagtcacactgcttttactcttcctggactctaccgtgtcgttcacggtattgacgtgttcgacccgaagttcaacattgtatcacccggtgccgataagaacatctacttcccgtacaccaaggtagagaaaaggttgacatctcttcatcccgagatcgaagatctcctttacagcgcggtcgagaacgaagaacacttatgtgttataaaagaccggaataaaccaatcatattcaccatggcgaggctggaccgggtgaagaatttgagtgggttagtcgagtggttcgggaagaacgcgcgtctacgcgaattggttaacctagttgttgttggtggagataggaggaaagaatctcaagacagcgaggagaaagcggagttaaagaaaatgttcgaacacatcgaaacgtacaaactgaacggcgagttccgatggatttcgtcgcagatggatcgggtgagaaacggcgagctttaccgttacatttgcgatactcgaggagcattcgtgcaacccgctttatacgaggccttcgggttgaccgtagtcgaagccatgacgtgtgggttgccaactttcgctacatgcaaaggtggtcccgcggaaatcatcgtgaacggaaaatccggcttccatatcgatccgtatcacggcgaacaagcggcgcagattcttgtcgatttttttgagaaatgtaaagaggatccgtcttactgggacgaaatatcacgaggcggtctgaagcggattgaggagaagtatacttggcaaatatattctcagaggctgttgacactaactggtgtttatggtttttggaaacatgtatcgaaccttgaccgacgcgagagtcgtcgttatcttgaaatgttttacgcgctcaaatatcgtaagctggccgagtccgtacctctaaccattgatgagtaactgggaaggttctgtacgtattttcagctggttgttgcggttcaaattttccagctggagattataagaataactgtgattgttttgccattgtgaatggcttcggtttctccatttagtttttttttttttgtgtgtatgttgtatgaacttggttgtaattataactccattttcagtcatgtaatggtaattgttgttgttttttttataatg

SEQ ID NO: 2462 - DNA, 2826 bp, Fragaria vesca
ccacatcccatttctctctgtttccttttgcctattctcaagcttagattttggttctttgattcagtaagaagctattaatggcggactcacgtgctctgaaccgtgcccatagcctcagggagaggctggatgacactctctctgctcaccgtaacgagatcctagcctttctgtcaaggattgaagccaagggaaaagggtttttgcagccccatcagctgattgatgagtttgaagcaattcctgaagccagcagaaaaaatttgttggaaagtgaatttggggaagttctgaagaacacccaggaagctattgttcttcctccatgggtggcactggctgttcgtcccaggcctggtgtttgggagtacattcgggtcaatgtgcactcacttgttgccgaggagttgcttgtgcccgagtacttgcacttcaaagaggagcttgttgatggaagtcttaatggcaactttgtgcttgaattggactttgaaccattcaatgccactttccctaagccaactctttccaaatctattggaaatggtgtcgagttcctcaaccgtcacctctctgcaaagctcttccatgacaaggagagcatgcaccctctgctcgagtttctccgagttcactgctacaagggcaagaatatgatgctcaatggcaaaattcagaatgtgaatgcacttcaacataatctgagaaaggccgaggagtatctgtctaagctcgcaccagaaaccccatacaaaacttttgagatcaagttgcaggatcttggtttggagagaggttggggagacaacgctgagcgcgtgctggaaatgatccaactcctattggaactccttgaggcacctgacccttgcaatctggaaaaattccttggcagaattcccatggtgttcaatgttgtgatcatgtctcctcatggttactttgcccaagacaatgtgttggggtaccctgacactggtggccaggttgtttatatcttggatcaagttcgtgctttggagaatgagatgcttaaacgtatcaaggaacaagggcttgacattatccctcgcattcttattgtcacaaggctccttcctgatgcagtaggaactacttgtggtcagcgtcttgagaaggtttacaacaccaaacactccgatattcttcgtgttccctttagaaccgagaagggaattgtccgcaaatggatctcaagatttgaagtgtggccatacctagagacttacaccgaggatgttgcaacagaacttgctaaagagttccagggcaagcctgatctcattattggaaactacagtgatggtaacattgtggcctctttgttggctcataaattgagtgttactcaatgcaccattgcccatgctttggagaagaccaagtaccctgattctgacctttactggaagaaactagatgacaagtaccatttctcttgccagttcacagctgatcttatcgccatgaaccacaccgacttcatcatcaccagtaccttccaggagattgccggaagcaaagataccgttggccagtacgagagtcacaccgctttcaccatgcccggtctctaccgtgttgttcatgggattgatgtctttgatcccaagttcaacattgtttcaccaggagctgacatggacatttacttcccttattccgagaaggaaaagaggttgacacatttccacccggaaattgaagagctcatctacagccaagaggagaacaaagaacacttgtgtgtgttgaaggacaggaacaagccaatcatcttcacaatggcaaggctggaccgtgtaaagaacatcactgggctggttgagtggtatggtaagaacaagaagcttagagagctggttaacttggttgtagttgctggggatcgacgaaaggagtcccaggacaatgaggagaaagctgagctgaagaagatgtatgagctgattgacacctacaagctgaatgggcagttcagatggatttcctctcagatgaaccgcgtgaggaacggtgaactctaccgtgtcatttgtgacaccaagggagcttttgtgcagcctgctgtgtatgaagcctttggcttgactgttgttgaggccatgacctgtggtttgcccacatttgctacttgcaaaggtggcccagcagagattattgtgcatggcaaatctgggtaccatattgatccataccatggtgagcaagctgctgagatccttgttgacttctttgagaagtgcaagaaagacccttctcactgggacaagatttcccagggaggcctgaagcgtatcgaggagaagtacacatggcaaatctactctgaaaggctcctgaccttgactggagtttatgggttctggaagcatgtctctaaccttgatcgccttgagagtcgtcgctacatcgaaatgttttatgccctcaagtacaaaaagctggctgattctgttcctcttgctgaggagtagagtgcaagaacaagtaaataaaaagaggcagaagcaatctgttggctgagagtcatcatcaagttttccttggcggtttaggagaataactaaatattgtgattatatatgttttggttttctttttctttcaagttttcaatttctattcatcattggtggttgtgattggaaatgtttgaacctgggtctcatccccatttatcaattgaagtcaactttgctgtccaattatattttgccaatttctcactttaactattacatgcttcatgcttgtatgatccaatagtaattcccaattacttatctcatcatcttttca

SEQ ID NO: 2463 - DNA, 2867 bp, Euonymus alatus
gggagtcgtcccaactcccaatttgagttagtgttttcattcataatcgttcgtcaggtttatgaaaaaaataagtcagctcccaagtgtcaccacagaacaagagagtgtgtttgtgtatataagggtctctagcagcaccctcttctccatctatcctttgtgtttcttcttgctttgaaggatctgcgttcactctgttcatttattttctctctgtgtgtacattttgtggcgttgcaagaaacatcgtttttgctcgcttcagaagctatggttactgaacacgctctcacccgcactcacagcatccgtgagcgtctcgatgatactctcgctgcgcatcgcaacgaagtcattgctttacttgccaggatcgaagcgaaagggaaaggaatacttcaagggcatcaaattattgctgaactggaagcaatccctgaagagaacagaaagaaactactagagggagcatttgctgaagttctgaaagctgcacaggaagctattgttgctactccatggatcgctctagctctgcgatcaaggcctggtgtgtgggagtatgtacgtgtgaatgtgcacgcccttgttattgaggatttgcgtgtctccgagtatttgcacttcaaagaggaacttgttaacggaactgcgaatggaaactttgtgctagagttggattttgagccattcaatgcatcattccctcgatcaactctgtcaaagtcaattggcaatggtgttgagttccttaaccgacacctttcggctaaattgttccatggcaaagagagtatgcagccgctgcttgattttctccgagttcactgttacaagggaaagaccatgatgctgaatgacagaattcaaaacctaaatactctgcaacatgttctgaggaaggcggaggagtatctgcatactgtggctcctgagacactctactatgagtttgagcacaagttccaggatattggattggagagagggtggggtgatactgcggaacatgtgcaggagatgatccagcttcttctggatcttcttgaggcacctgatccttgcacgcttgagaatttccttggcagaattcctatggtcttcaatgttgtcattctttcccctcatggttactttgcacaagacaatgttttgggataccctgacactggtggtcaggttgtttatatattggaccaagttcgtgcattggaggaggagatgctcctgcggattaagaaacaaggactcgatatcaagccccgtattctcatcatcacacgtctactgcctgatgctgttggcaccacttgtggtcagcgtctcgaacgagtatataatacagaacattctgatatacttagggttccttttagaactgagaaaggcattgtccgcaaatggatctctcgcttcgaagtctggccttatctggagactttcactgaggatgttgccacagaaattggaaaagagctgcagggcaagcctgatctgatcattggaaattacagtgatggcaacattgttgcctctttgctagcacacaaattgggtgttactcagtgtaccatcgctcatgctttagagaagacaaagtatccggaatcggatatttactgggaaaaattagatgagaaataccacttttcttgccaattcacagctgatcttatagctatgaaccataccgatttcatcatcaccagtacataccaagaaattgctggaagcaaggatactgttggacaatatgagagccacactgctttcactcttcctggtctgtatcgtgttgttcatggtattgatgtcttcgatccaaaattcaacatagtttctcccggtgctgacatgggcatatacttcccttacacggaggagaagcgtaggctgaagcatttccatgatgacattgaggagctgcttttcagccctgtcgagaatgaagaacacttatgtgtgttgaaggatcgcaacaagccaatcctcttcacaatggcgaggcttgacaaggtcaagaatttaagtggacttgtcgaatggtatgcaaagaatcctcgcctgagagaacttgttaaccttgtcgtggtcggtggtgatcgaaggaaggaatcaaaagacatagaagagcaatctgaaatgaagataatgcacaatctgattgagacttacaacttgaatggccagttcagatggatttcttcccagatggaccgggttaggaacggagaactctaccgctacattgcagacacaaagggagcttttgtgcagcctgctttgtacgaggcctttggcctgactgttgttgaggccatgacttgtggattgccaacatttgccactttacatggtggacctgctgagattattgtccatggcaaatctggcttccacattgacccataccatggtgaacaggctgcacacacccttgttgatttctttgagaagagcaaggttgatcccacttattgggacaagatttccctgggaggccttcaaagaatccaagaaaagtatacttggaaaatctattctcagagactattgaccctgactggagtttacggtttctggaaacatgtttcgcaccttgatcgccttgagagccggcgataccttgaaatgttttatgctctcaagtatcgcaagctggctcaatctgttcctctggctgttgaggagtgaaaggaggtcgaaggaagctcagcgtcggtccggttgtattaaaataactcccaactttgggattggaagagttcaatgcatcatgttttcttctttttttcttccttttcaaatttctcggcgttgtttgaacttggatgttgttttagtaaagttgtataattttcttc

SEQ ID NO: 2464 - DNA, 2767 bp, Arabidopsis thaliana
cttcactacttatcatttctcttcttcatacttttctcaaaatttgcaatagctccctccatctttcgcttcattcactacatatttctagtgacctccttcgccagtgactttccgtagcaatttaagtttcaaaagctttttgattgtgtttgaaatggaaaacgcagaacgtgtaataacgcgagtccacagccagcgagagcgtttggatgcaactcttgttgctcagaaaaatgaagtatttgctttgctctcaagggttgaagccaaaggcaaaggcattctacaacaccaccagatcattgctgaatttgaggcaatgcctttagagacacagaagaaacttcaaggtggagctttcttcgaaatcctccgatcagctcaagaggcaattgtgttaccaccatttgttgctttagctgtgagaccaagacctggagtttgggaatacgtaagagttaacctccatgatcttgtcgttgaggagcttcaagcttctgaatatcttcaattcaaggaagagctcgtcgatggaattaagaatggaaacttcactcttgaacttgactttgaaccattcaacgcggcattccctcgtcctacgctcaacaagtacattggagatggcgttgagttcctcaaccgccatctctcggctaagctcttccatgacaaggagagcttgcatccgctgctcaagttcctccgcctccattcccacgagggaaagactctgatgcttaacaataggatccagaacctaaacaccctacaacacaatctgagaaaagcagaggaatatctaatggagctgaagcctgagacactctactcagagtttgagcacaagttccaggagattggtcttgagagaggctggggagacaccgcggagcgtgttcttaacatgatccgtcttcttcttgaccttctcgaggcacctgacccttgtactcttgagaatttccttggaagaatcccaatggttttcaacgttgtgatcctctctcctcatggatactttgctcaggacaatgttcttggttaccctgacacaggtggtcaggttgtttacattcttgatcaagttcgtgctctcgaaacagagatgctccaacgcatcaaacaacaaggactcaacatcactccgagaatcctaatcatcactcggctgcttcctgacgcagcaggaaccacttgtggtcaacgtctagagaaagtgtacggatctcagtattgtgatatcctccgtgtgccttttagaacagagaaaggaatcgttcgcaaatggatatcaaggtttgaggtctggccgtatctagagacttttaccgaggatgttgccgctgaaatctcgaaagagttgcaggggaagcctgacttgatcattggaaactacagtgatggtaatcttgttgcatccttgttagcacacaaacttggtgtcactcagtgcaccatcgctcatgctttggagaagactaagtacccggattctgatatctactggaagaagctcgacgagaagtatcacttctcttgccagttcacggctgatcttatcgccatgaaccacacagatttcatcatcacaagtactttccaagaaattgctggaagcaaggacactgttggtcaatatgagagccacagatctttcacacttcccgggttgtaccgtgtagttcacggtattgatgtgtttgatccaaagttcaacattgtctctcctggagcagatatgagcatctacttcgcttacaccgaggagaagcgtagattaactgcattccatctagagatcgaggagctcctctatagtgatgttgaaaacgaagagcacttatgtgtgcttaaggacaagaagaagccaataattttcaccatggctaggcttgaccgtgtaaagaacttatcaggtcttgttgagtggtacggtaagaacactcgcttgcgcgaactggtgaacttggtggttgtgggtggagacaggaggaaagagtcacaggacaacgaagagaaggccgagatgaagaaaatgtatgaactgatagaggaatacaaactcaacgggcaattccgatggatctcttcacagatgaacagagtgagaaacggtgagctttaccgttacatatgtgacactaaaggtgcatttgtgcagcctgctctttatgaagcctttgggttgactgttgttgaggctatgacctgtgggttaccgactttcgctacttgtaatggcggtcctgctgagatcattgtgcatggaaaatctggtttccacattgatccatatcatggtgacaaggcagctgagagtcttgctgatttcttcaccaagtgtaagcatgacccatctcactgggatcagatctcattgggaggacttgagaggatccaggagaaatatacttggcaaatatactcacagaggctcttgacattgactggtgtctacggcttttggaaacatgtctcgaaccttgaccgtcttgagagtcgtcgataccttgagatgttctacgcactgaagtaccgcccactggctcaagctgttcctcttgctcatgaagagtgaaagaagaagattttctacattctacaacaataaagatctctctttgttatttcactcgtcatatttttctttcttttttatgatatgcttcaccattgttttttaaactattgataatgtttaattattagtattcaacatgaacaatgtaaaaaaaactgattactaaactactttaagtct

SEQ ID NO: 2465 - DNA, 2722 bp, Arabidopsis thaliana
acttcactacttatcatttctcttcttcatacttttctcaaaatttgcaatagctccctccatctttcgcttcattcactacatatttctagtgacctccttcgccagtgactttccgtagcaatttaagtttcaaaagctttgtgattgtgtttgaaatggcaaacgcagaacgtgtaataacgcgagtccacagccagcgagagcgtttggatgcaactcttgttgctcagaaaaatgaagtatttgctttgctctcaagggttgaagccaaaggcaaaggcattctacaacaccaccagatcattgctgaatttgaggcaatgcctttagagacacagaagaagcttaaaggtggagctttcttcgaatttctccgatcagctcaagaggcaattgtgttaccaccatttgttgctttagctgtgagaccaagacctggagtttgggaatacgtaagagttaacctccatgatcttgtcgttgaggagcttcaagcttctgaatatcttcaattcaaggaagagctcgtcgatggaattaagaatggaaacttcactcttgaacttgactttgaaccattcaacgcggcattccctcgtcctacgctcaacaagtacattggagatggcgttgagttcctcaaccgccatctctcggctaagctcttccatgacaaggagagcttgcatccgctgctcaagttcctccgcctccattcccacgagggaaagactctgatgcttaacaataggatccagaacctaaacaccctacaacacaatctgagaaaagcagaggaatatctaatggagctgaagcctgagacactctactcagagtttgagcacaagttccaggagattggtcttgagagaggctggggagacaccgcggagcgtgttcttaacatgatccgtcttcttcttgaccttctcgaggcacctgacccttgtactcttgagaatttccttggaagaatcccaatggttttcaacgttgtgatcctctctcctcatggatactttgctcaggacaatgttcttggttaccctgacacaggtggtcaggttgtttacattcttgatcaagttcgtgctctcgaaacagagatgctccaacgcatcaaacaacaaggactcaacatcactccgagaatcctaatcatcactcggctgcttcctgacgcagcaggaaccacttgtggtcaacgtctagagaaagtgtacggatctcagtattgtgatatcctccgtgtgccttttagaacagagaaaggaatcgttcgcaaatggatatcaaggtttgaggtctggccgtatctagagacttttaccgaggatgttgccgctgaaatctcgaaagagttgcaggggaagcctgacttgatcattggaaactacagtgatggtaatcttgttgcatccttgttagcacacaaacttggtgtcactcagtgcaccatcgctcatgctttggagaagactaagtacccggattctgatatctactggaagaagctcgacgagaagtatcacttttcttgccagttcacggctgatcttatcgccatgaaccacacagatttcatcatcacaagtactttccaagaaattgctggaagcaaggacactgttggtcaatatgagagccacagatctttcacacttcccgggttgtaccgtgtagttcacggtattgatgtgtttgatccaaagttcaacattgtctctcctggagcagatatgagcatctacttcgcttacaccgaggagaagcgtagattaactgcattccatctagagatcgaggagctcctctatagtgatgttgaaaacgaagagcacttatgtgtgcttaaggacaagaagaagccaataattttcaccatggctaggcttgaccgtgtaaagaacttatcaggtcttgttgagtggtacggtaagaacactcgcttgcgcgaactggtgaacttggtggttgtgggtggagacaggaggaaagagtcacaggacaacgaagagaaggccgagatgaagaaaatgtatgaactgatagaggaatacaaactcaacgggcaattccgatggatctcttcacagatgaacagagtgagaaacggtgagctttaccgttacatatgtgacactaaaggtgcatttgtgcagcctgctctttatgaagcctttgggttgactgttgttgaggctatgacctgtgggttaccgactttcgctacttgtaatggcggtcctgctgagatcattgtgcatggaaaatctggtttccacattgatccatatcatggtgacaaggcagctgagagtcttgctgatttcttcaccaagtgtaagcatgacccatctcactgggatcagatctcattgggaggacttgagaggatccaggagaaatatacttggcaaatatactcacagaggctcttgacattgactggtgtctacggcttttggaaacatgtctcgaaccttgaccgtcttgagagtcgtcgataccttgagatgttctacgcactgaagtaccgcccactggctcaagctgttcctcttgctcatgaagagtgaaagaagaagattttctacattctacaacaataaagatctctctttgttatttcactcgtcatatttttctttcttttttatgatatgcttcaccattgttttttaaactattgataatgtttaattattagtattca

SEQ ID NO: 2466 - DNA, 2667 bp, Euonymus alatus
tggttgtttcaaggaaataaagagggtggcactaattttttcacaacttgaagcaccaaatgcactctctaggtggatcaagagagtggttgcatgtgtatataaggatctctgaggctttgtttttggtcgcttgagaagctatggctactgaacgagctctcactcgcagtcacagcatccgtgagcgtctcgatgagactctcgttgctcatcgcaatgaaatcgttgccttacttgccaggatcgaagcgaaggggaaaggaatacttcaaaggcatcaaattattgctgaatttgaagcaattcctgaagataatagaaagaaacttgcagagggagcatttgctgaagttctgacagctgcacaggaagctattgttgttactccatggatcgctcttgctctgcgatcaaggcctggtgtgtgggagcatatacgtgtgaatgtgcacgcacttgttgttgaggagttgcgtgtcgccgagtatttgcatttcaaggaagaacttgttaatggaaccgctaacggaaactttgtgctggagttagattttgagccattcaatgcatcagtccctcgatcaactctgtcgaagtcaattggcaatggtgtcgagttccttaaccgtcacctttcggctcaattgttccatggcaaagagagcatgcagcctctgcttgattttctccgagttcactgtcacaaggggaagacgatgatgctgaatgacagaattcaaaacctgaagactctgcaacatgttctgaggaaggcagaggagtatctgcaaactgtggctcctaaaacaccatactctgtttttgagcacaagttccaggatattggattggagagagggtggggtgacaccgcggagcacgtgtttgagatgattcaactgcttttggatcttcttgaggcacctgatccttgcactcttgaaaaattccttggaagaattcctatggttttcaatgttgtcattctttctcctcatggttactttgcccaagataatgttttggggtaccctgacaccggtggtcaggttgtgtatatattggatcaagttcgtgcattggaggaggagatgcttcatcggattcagcagcaagggctcgatatcaagccccgtattctcattatcactcgtctactgcctgatgctgttggcaccacatgtggtcagcgtctagagcgagtatatcatacagaacattgtgatatacttagggttccttttagaacagagaaaggcattgtccgccaatggatttcccgcttcgaagtctggccttatctggagactttcactgaggatgttgcctctgaaattggaaaagagctgcagggcaagcccgatctgatcattggaaactacagtgatggcaacattgtcgcctctctgttagcacacaaattgggtgttactgagtgtaccattgctcatgctttggagaagactaagtatccggaatcggatatttattggaaaaaattggatgagaaataccactttgcatgccaattcactgctgatcttatagctatgaaccacactgatttcatcatcaccagtacataccaagaaattgctggaagcaaggacactgtgggtcaatatgagagtcacaatgctttcactctacctggtctctaccgtgttgttcatggtatcgatgtctttgatccaaaattcaacattgtttcccctggtgctgacatgagcatatacttctcttacacggaggagaagcgtaggctgaaacatttccatcctgacatcgaggaactgcttttcagctcagttgagaatgaagaacacttatgtgtgttgaaggatcgcaacaagccaatcctcttcacaatggcgaggcttgacaaggtcaagaatttaactggacttgtggaatggtacgcaaagaatcctcgcctgagagaactggttaaccttgttgtggttggtggtgaccgaaggaagcaatcaaaagacatagaagagcaatctgaaatgaagaagatgtacagtctgattgagaattacaacttgaatggccagttcaggtggatttcttcccagatggaccgtgttaggaacggtgaactttaccgctgcattgcagacacaaagggagcttttgttcagcctgctttgtatgaagcttttggacttactgttgttgaggccatgacttgtggattgccaacggttgccactttacacggtggacctgccgagattattgtccatggaaaatctggcttccacattgacccttaccatggtgaacaggctgctgaaacccttgtcgatttctttgagaagagcaaggttgatcccacttattgggacaagatttccttgggaggccttcagagaatccaagaaaagtatacttggcaaatctattctcagaggctactcactctgactggagtttatggcttctggaaacatgtttcgcaccttgatcgccttgagagccgtcgatacctggaaatgttttatgctctcaagtatcgcaagctggctgaatctgttcctctggctgttgaggagtaaaaggaagttggaggaagctcaacaccagttatgatttccaggattttaaaaataactcccattttgggattgtgactgaacaaagagttcaatgaaatat

SEQ ID NO: 2467 - DNA, 2916 bp, Euonymus alatus
cggccggggggttgtttctaggaaatagagtgtggcactattttttgcagtgtcaatactgttgaggcagatcaagagagtgtgtttgtgtatataagggtctctagcagcaccctcttctccatcaatcctttgtgtttcttcttgctttgaaggatctgcgttcactctgttcatttattttctctgtgtgtgtacattttgtggcgttgcaagaaacatcgtttttgctcgcttcagaagctatggttactgaacacgctctcacccgcactcacagcatccgtgagcgtctcgatgatactctcgctgcgcatcgcaacgaagtcattgctttacttgccaggattgaagcgaaagggaaaggaatacttcaagggcatcaaattattgctgaactggaagcaatccctgaagagaacagaaagaaactactagagggagcatttgctgaagttctgaaagctgcacaggaagctattgttgctactccatggatcgctctagctctgcgatcaaggcctggtgtgtgggagtatgtacgtgtgaatgtgcatgcccttgttattgaggatttgcgtgtctccgagtatttgcacttcaaagaggaacttgttaatggaactgcgaatggaaactttgtgctagagttggattttgagccattcaatgcatcattccctcgatcaactctgtcaaagtcaattggcaatggtgttgagttccttaaccgacacctttcggctaaattgttccatggcaaagagagtatgcagccgctgcttgattttcttcgagttcactgttacaagggaaagaccatgatgctgaatgacagaattcaaaacctaaatagtctgcaacatgttctgaggaaggcggaggagtatctgcatactgtggctcctgagacactgtactctgtgtttgagcacaagttccaggatattggattggagagagggtggggtgatactgcggaacatgtgcacgagatgatccagcttcttctggatcttcttgaggcacctgatccttgcacgcttgagaatttccttggcagaattcctatggtcttcaatgttgtcattctttcccctcatggttactttgcacaagacaatgttttgggataccctgacactggtggtcaggttgtttatatattggaccaagttcgtgcattggaggaggagatgctcctgcggattaagaaacaaggactcgatatcaagccccgtattctcatcatcacacgtctactgcccgatgctgttggcaccacttgtggtcagcgtctcgaacgagtatataatacagaacattctgatatacttagggttccttttagaactgagaaaggcattgtccgcaaatggatctctcgcttcgaagtctggccttatctggagactttcactgaggatgttgccacagaaattggaaaagagctgcagggcaagcctgatctgatcattggaaattacagtgatggcaacattgttgcctctttgctagcacacaaattgggtgttactcagtgtaccattgctcatgctttagagaagacaaagtatccggaatcggatatttactgggaaaaattagatgagaaataccacttttcttgccaattcacagctgatcttatagctatgaaccacaccgatttcatcatcaccagtacataccaagaaattgctggaagcaaggatactgttggacaatatgagagccacactgctttcactcttcccggtctctatcgcgttgttcatggaattgatgtcttcgatccaaaattcaacatagtttctcccggtgctgacatgggcatatacttcccttacacggaggagaagcgtaggctgaagcatttcaatgatgacattgaggagctgcttttcagccctgttgagaatgaagaacacttatgtgtgttgaaggatcgcaacaagccaatcctcttcacaatggcgaggcttgacaaggtcaagaatttaagtggacttgtcgaatggtatgcaaagaatcctcgcctgagagaacttgttaaccttgtcgtggtcggtggtgatcgaaggaaggaatcaaaagacatagaagagcaatctgaaatgaagataatgcacaatctgattgagacttacaacttgaatggccagttcagatggatttcttcccagatggaccgggttaggaacggagaactctaccgctacattgcagacacaaggggagcttttgtgcagcctgctttgtacgaggcctttggcctgactgttgttgaggccatgacttgtggattgccaacatttgccactttacatggtggacctgctgagattattgtccatggcaaatctggcttccacattgacccataccatggtgaacaggctgcacacacccttgttgatttctttgagaagagcaaggttgatcccacttattgggacaagatttccctgggaggccttcaaagaatccaagaaaagtatacttggaaaatctattctcagagactattgaccctgactggagtttacggtttctggaaacatgtttcgcaccttgatcgccttgagagccggcgataccttgaaatgttttatgctctcaagtatcgcaagctggctcaatctgttcctctggctgttgaggagtgaaaggaggtcgaaggaagctcagcgtcggtccggttgtattaaaataactcccaactttgggattggaagagttcaatgcatcatgttttcttctttttttcttccttttcaaatttctcggcgttgtttgaacttggatgttgttttagtaaagtcgtataattttcttcggtcttatatttccttttttcttcttatcatgtatgtattctgtggaatggcttcaatgaaattcttccattgcttg

SEQ ID NO: 2468 - DNA, 2989 bp, Eucalyptus grandis
gaaggccagaagggggaggtcgagcctcttgcttttttgtgtgtataaaagggcctcccccattcctcatttttcaccatcctccgttcgttcgttcccttccctttccattgttgcgtttaagccctccaattttcttttggcgtcccgtttttggggctcccttgaagatctcctcttcatttcgggatttcctgccttcgccgcgccatttgaagttctttttctgagagaagaatttagacatggctgatcgcatgttgactcgaagccacagccttcgcgagcgtttggacgagaccctctctgctcaccgcaacgatattgtggccttcctttcaagggttgaagccaagggcaaaggcatcttgcagcgccaccagatttttgctgagtttgaggccatctctgaggagagcagagcaaagcttcttgatggggcctttggtgaagtcctcaaatccactcaggaagcgattgtgtcgcctccatgggttgctcttgctgttcgtccaaggccgggcgtgtgggagcacatccgtgtgaacgtccatgcgcttgttcttgagcaattggaggttgctgagtatctgcacttcaaagaagagcttgctgatggaagcttgaatggtaactttgtgcttgagcttgactttgagccattcactgcctcttttccgcgcccgactctttccaagtctattggcaatggcgtcgagtttctcaatcgccatctctccgctaagctcttccatgacaaggaaagcttgcaccctctgcttgaattcctccaagtccactgctacaaggggaagaacatgatggtgaatgccagaatccagaatgtgttctccctccaacatgtcctgaggaaggcggaggagtatctgatcacgctcaaacccgagaccccgtactcccagttcgagcacaagttccaggagatcgggctcgagcgggggtggggtgacacggctgagcgcgtcctcgagatgatccagctcctgttggatctccttgaggctcccgacccgtgcactctcgagaagttcttggatagggttcccatggtcttcaacgtcgtgatcatgtctccccatggatactttgctcaggacgatgtccttggttatccggataccggtggccaggttgtttacatcctggatcaagttcgtgccctagaggaagaaatgcttcaccgcattaagcaacaaggactggatattactcctcggattctcattatcactcggcttcttccagatgcggttggaaccacctgtggccagcgccttgagaaagtttttgggaccgagtactcccacattcttcgcgtccccttcagaaatgagaagggagtcgtccgcaagtggatttcccggttcgaggtgtggccctatttggaaagatacactgaggatgtcgcgagcgaacttgctggagagttgcagggcaagcctgatctgatcatcggaaactacagtgatggaaacattgttgcttccttgttagcacataaattaggtgttacacagtgtacaatagcccatgccctcgagaagacgaagtacccagagtcagacatatactggaagaaatttgaggaaaagtaccacttctcttgccagttcactgctgatctcatcgccatgaaccacaccgacttcattatcaccagcaccttccaagaaattgctggaagcaaggatacagtggggcagtatgagagtcacatgaacttcactcttcctggactctaccgagttgtccacgggatcgacgtcttcgacccgaagttcaacattgtttcaccaggtgctgacatgagcatctactttgcttacaccgaacaggagcggcggttgaaatccttccaccctgagatcgaggaactcctcttcagcgatgttgagaacaaggaacacttgtgtgtgttgaaagataagaagaagcctattattttcaccatggcaaggctggaccgtgtcaagaacttgacagggcttgttgagtggtatggcaagaactccaagttgagggaactcgccaacttggtcgtggttggaggtgacaggaggaaggattcgaaggacttggaagagcagtctgagatgaagaaaatgtacgacctcatcgaaaagtacaagctgaatggccagttcaggtggatttcctcccagatgaaccgggtgaggaatggagagctctaccgctacatctgtgacacgaagggagtcttcgttcaaccggctatctatgaagctttcgggttgaccgtggttgaggccatgacttgtggattgccaacctttgccacttgcaatggtggaccagctgagatcattgtgcatggcaaatcgggctaccacattgatccttaccatggtgaccaggcggccgagcttcttgtagacttcttcaacaagtgcaagattgaccagtcccactgggacgagatctcaaagggtgccatgcagagaattgaagagaagtatacatggaaaatatattctgagaggctgttgaacctgactgccgtgtatggcttctggaagcatgtgactaaccttgatcggcgcgagagtcgccggtaccttgaaatgttctatgccctcaagtatcgcccactggcacagtctgttcctccggctgtcgagtaaacaaagagacagattgttaccagaagacggaagcattggacttttgaagttttcaaggaataaacattggaaattgtttgaatttgggattgccaagagcgatcttttttatttcctttttttggtcctttttctcttctttgtttccattccgcgaatgtttgcattttggggtttgtacccatcaattcagtaaatggttcattttcttttcaacttgtcaatcccactccgtatttcgtacttcattgttgttcacctgtggcggtctatgtctagcttgtctaggtaaaagaaaaaaaaaaaaaaaaaaaaaaaaaaaccaa

SEQ ID NO: 2469 - DNA, 2865 bp, Arabidopsis lyrata
atctcactcaaaccacttctctctactccagtttccaaaaacttttttccactgtttctgcgtctctttgaatcaatggcaaacgctgaacgtatgataacgcgcgtccacagccaacgtgagcgtttgaacgaaacgcttgtttctgagagaaacgaagtccttgccttgctttccagggttgaagccaaaggtaaaggtattttacaacaaaaccaaatcattgctgaattcgaagctttgcctgaagaaacccagaagaaacttgaaggtggtcctttcttcgaccttctcaaatccactcaggaagcaattgtgttgccaccatgggttgctctagctgtgagaccaagacctggtgtttgggaatacataagagtcaatctccatgctcttgtcgttgacgaactccaacctgctgagtttcttcatttcaaggaagaactcgttgatggagttaagaatggtgatttcactcttgagcttgatttcgagccattcaatgcgtctttccctcgtccaacactcaacaaatacattggaaatggtgttgagttccttaaccgtcacttatcagctaagctctttcatgataaggagagtttgcttccattgcttaagttccttcgtcgacacagccaccagggcaagaacctgatgttgagtgagaaaattcaaaacctcaacactctgcaacacaccttgaggaaagcagaggagtatcttgcagagcttaagcccgaaacaccgtatgaagagtttgaggctaagtttgaagagattggtcttgagaggggatggggagacaatgcagagcgtgtccttgacatgatccgtcttcttttggaccttcttgaggcgcctgatccttgcacgcttgagacttttcttggaagagtgccaatggtgttcaacgttgtgatcctctctccacatggttactttgctcaggacaatgttcttggttaccctgacactggtggtcaggttgtttacattcttgatcaagttcgtgctctggaaacagagatgcttcagcgtattaagcaacaaggactcgacattaaaccaagaattctcattctcactcgactcctccctgatgcggtaggaaccacatgtggtgaacgtctcgagagagtttatgattctgaatactgtgatattctccgtgtgcccttcagaacagagaagggtatagttcgcaaatggatctcaagatttgaagtttggccatatctcgagacttacaccgaggatgctgcggttgagctatcgaaagaattgaatggaaagcctgaccttattattgggaactacagtgacggaaatcttgttgcttctttattagctcacaaacttggtgtcactcagtgtaccattgctcatgctctggagaagacaaagtacccggattccgatatctactggaagaagcttgatgagaagtaccatttctcatgccagttcactgcggatattttcgcaatgaaccacactgatttcatcatcaccagtacttttcaagaaattgctggaagcaaggacactgttgggcagtatgaaagccacacggcctttactcttcccggattgtaccgagttgttcacgggatcgatgtgtttgatcccaagtttaacattgtctcccctggtgctgatatgagcatctacttcccttacacagaggagaagcgtagattgactaaattccactctgagatcgaggagctcctctacagcgatgttgagaatgaagagcacctatgtgtgctcaaggacaagaagaagccgatcctcttcacgatggctaggctcgaccgtgtcaagaacttgtcaggtcttgttgagtggtacgggaagaacacccgcctgcgtgagctggctaacttggttgttgtgggaggagacaggaggaaagaatcaaaggacaatgaagagaaagcagagatgaagaaaatgtatgatctcattgaagaatacaagctgaacggtcagttcaggtggatctcctcccagatgaaccgggttaggaacggtgagctgtaccggtacatctgtgacaccaagggtgcgtttgtgcaacctgcattgtatgaagcctttgggttgactgttgtggaggccatgacttgtggattaccgacttttgccacttgcaaaggtggtccagctgagatcattgtgcacggtaaatcgggtttccacattgacccttaccatggtgatcaggctgctaatactcttgctgatttcttcaccaagtgtaaggaggatccatctcactgggatgagatctcaaaaggagggcttcagaggattgaggagaaatacacttggcaaatctattcacagaggctcctgacattgactggtgtgtatggattctggaagcatgtctcgaaccttgaccatcttgaggcccgtcgttaccttgaaatgttctatgcattgaagtatcgcccattggctcaggctgttcctcttgctcaagatgattgaagagaagagaaaagacttggaaccagtagagagtttgaagagagtggttccggtgtttgaagaataaaacatgatctccttttgattcttattatcattcggatttgggaacgcttttgtgttcctctgcttctttgttatttcaatcatttgtctttgttttcctttgcctctctggcattgctttgaattctggttgttgggagatttccctctaattgcagtaaaatgtcttttgctaaatatttctcaatatttacatattccagcaaccaaaagcaccgtattagcaaaagaagtgtgaccattattatcggatcacaaaacaatatcaatattgttagagttgggcttattcctatg

SEQ ID NO: 2470 - DNA, 2916 bp, Arabidopsis lyrata
gatcttattagttattacactctctcttctttttttttttctctctgcagtttccaaaaacttttttccactgtttctgcgtctctttgaatcaatggcaaacgctgaacgtatgataacgcgcgtccacagccaacgtgagcgtttgaacgaaacgcttgtttctgagagaaacgaagtccttgccttgctttccagggttgaagccaaaggtaaaggtattttacaacaaaaccaaatcattgctgaattcgaagctttgcctgaagaaacccagaagaaacttgaaggtggtcctttcttcgaccttctcaaatccactcaggaagcaattgtgttgccaccatgggttgctctagctgtgagaccaagacctggtgtttgggaatacataagagtcaatctccatgctcttgtcgttgacgaactccaacctgctgagtttcttcatttcaaggaagaactcgttgatggagttaagaatggtgatttcactcttgagcttgatttcgagccattcaatgcgtctttccctcgtccaacactcaacaaatacattggaaatggtgttgagttccttaaccgtcacttatcagctaagctctttcatgataaggagagtttgcttccattgcttaagttccttcgtcgacacagccaccagggcaagaacctgatgttgagtgagaaaattcaaaacctcaacactctgcaacacaccttgaggaaagcagaggagtatcttgcagagcttaagcccgaaacaccgtatgaagagtttgaggctaagtttgaagagattggtcttgagaggggatggggagacaatgcagagcgtgtccttgacatgatccgtcttcttttggaccttcttgaggcgcctgatccttgcacgcttgagacttttcttggaagagtgccaatggtgttcaacgttgtgatcctctctccacatggttactttgctcaggacaatgttcttggttaccctgacactggtggtcaggttgtttacattcttgatcaagttcgtgctctggaaacagagatgcttcagcgtattaagcaacaaggactcgacattaaaccaagaattctcattctcactcgactcctccctgatgcggtaggaaccacatgtggtgaacgtctcgagagagtttatgattctgaatactgtgatattctccgtgtgcccttcagaacagagaagggtatagttcgcaaatggatctcaagatttgaagtttggccatatctcgagacttacaccgaggatgctgcggttgagctatcgaaagaattgaatggaaagcctgaccttattattgggaactacagtgacggaaatcttgttgcttctttattagctcacaaacttggtgtcactcagtgtaccattgctcatgctctggagaagacaaagtacccggattccgatatctactggaagaagcttgatgagaagtaccatttctcatgccagttcactgcggatattttcgcaatgaaccacactgatttcatcatcaccagtacttttcaagaaattgctggaagcaaggacactgttgggcagtatgaaagccacacggcctttactcttcccggattgtaccgagttgttcacgggatcgatgtgtttgatcccaagtttaacattgtctcccctggtgctgatatgagcatctacttcccttacacagaggagaagcgtagattgactaaattccactctgagatcgaggagctcctctacagcgatgttgagaatgaagagcacctatgtgtgctcaaggacaagaagaagccgatcctcttcacgatggctaggctcgaccgtgtcaagaacttgtcaggtcttgttgagtggtacgggaagaacacccgcctgcgtgagctggctaacttggttgttgtgggaggagacaggaggaaagaatcaaaggacaatgaagagaaagcagagatgaagaaaatgtatgatctcattgaagaatacaagctgaacggtcagttcaggtggatctcctcccagatgaaccgggttaggaacggtgagctgtaccggtacatctgtgacaccaagggtgcgtttgtgcaacctgcattgtatgaagcctttgggttgactgttgtggaggccatgacttgtggattaccgacttttgccacttgcaaaggtggtccagctgagatcattgtgcacggtaaatcgggtttccacattgacccttaccatggtgatcaggctgctaatactcttgctgatttcttcaccaagtgtaaggaggatccatctcactgggatgagatctcaaaaggagggcttcagaggattgaggagaaatacacttggcaaatctattcacagaggctcctgacattgactggtgtgtatggattctggaagcatgtctcgaaccttgaccatcttgaggcccgtcgttaccttgaaatgttctatgcattgaagtatcgcccattggctcaggctgttcctcttgctcaagatgattgaagagaagagaaaagacttggaaccagtagagagtttgaagagagtggttccggtgtttgaagaataaaacatgatctccttttgattcttattatcattcggatttgggaacgcttttgtgttcctctgcttctttgttatttcaatcatttgtctttgttttcctttgcctctctggcattgctttgaattctggttgttgggagatttccctctaattgcagtaaaatttcgatttttctatcttgaaagtgtcttttgctaaatatttctcaatatttacatattccagcaaccaaaagcaccgtattagcaaaagaagtgtgaccattattatcggatcacaaaacaatatcaatattgttagagttgggcttattcctatgctttggact

SEQ ID NO: 2471 - DNA, 2813 bp, Euonymus alatus
cggccgggggaagaggaaagtggtttgtgaaagggacaaagaacagtgacgatggttgtttctaggaaatagagagtgtggcactatttttgcagtgtcaatagtcttgaggcagatcaagagagtgtgtttgtgtatataagggtctctagcagcaccctcttctccatcaatcctttgtgtttctttttgctttgaaggatctgcgttcactctgttcatttattttctctctgtgtacattttgtggcgttgcaagaaacatcgtttttgctcgcttcagaagctatggttactgaacacgctctcacccgcactcacagcatccgtgagcgtctcgatgatactctcgctgcgcatcgcaacgaagtcattgctttacttgccaggatcgaagcgaaagggacaggaatacttcaagggcatcaaattattgctgaactggaagcaatccctgaagagaacagaaagaaactactagagggagcatttgctgaagttctgaaagctgcacaggaagctattgttgctactccatggatcgctctagctctgcgatcaaggcctggtgtgtgggagtatgtacgtgtgaatgtgcacgcccttgttattgaggatttgcgtgtctccgagtatttgcacttcaaagaggaacttgttaacggaactgcgaatggaaactttgtgctagagttggattttgagccattcaatgcatcattccctcgatcaactctgtcaaagtcaattggcaatggtgttgagttccttaaccgacacctttcggctaaattgttccatggcaaagagagtatgcagccgctgcttgattttctccgagttcactgttacaagggaaagaccatgatgctgaatgacagaattcaaaacctaaatactctgcaacatgttctgaggaaggcggaggagtatctgcatactgtggctcctgagacactctactatgagtttgagcacaagttccaggatattggattggagagagggtggggtgatactgcggaacatgtgcaggagatgatccagcttcttctggatcttcttgaggcacctgatccttgcacgcttgagaatttccttggcagaattcctatggtcttcaatgttgtcattctttcccctcatggttactttgcacaagacaatgttttgggataccctgacactggtggtcaggttgtgtatatattggaccaagttcgtgcattggaggaggagatgctcctgcggattaagaaacaagggctcgatatcaagccccgtattctcatcatcacacgtctactgcccgatgctgttggcaccacttgtggtcagcgtctcgaacgagtatataatacagaacattctgatatacttagggttccttttagaactgagaaaggcattgtccgcaaatggatctctcgcttcgaagtctggccttatctggagactttcactgaggatgttgccactgaaattggaaaagagctgcagggcaagcctgatctgatcattggaaattacagtgatggcaacattgttgcctctttgctagcacacaaattgggtgttactcagtgtaccattgctcatgctttagagaagacaaagtatccggaatcggatatttactgggaaaaattagatgagaaataccacttttcttgccaattcacagctgatcttatagctatgaaccataccgatttcatcatcaccagtacataccaagaaattgctggaagcaaggatactgttggacaatatgagagccacactgctttcactcttcctggtctctatcgtgttgttcatggtattgatgtcttcgatccaaaattcaacatagtttctcccggtgctgacatgggcatatacttcccttacacggaggagaagcgtaggctgaagcatttccatgatgacattgaggagctgcttttcagccctgtcgagaatgaagagcacttatgtgtgttgaaggatagcaacaagccaatcctcttcacaatggcgaggcttgacaaggtcaagaatttaagtggacttgtcgaatggtatgcaaagaatcctcgcctgagagaacttgttaaccttgtcgtggtcggtggtgatcgaaggaaggaatcaaaagacatagaagagcaatctgaaatgaagataatgcacaatctgattgagacttacaacttgaatggccagttcagatggatttcttcccagatggaccgggttaggaacggagaactctaccgctacattgcagacacaaagggagcttttgtgcagcctgctttgtacgaggcctttggcctgactgttgttgaggccatgacttgtggattgccaacatttgccactttacatggtggacctgctgagattattgtccatggaaaatctgggttccacattgacccataccatggtgaacaggctgcacacaccattgttgatttctttgagaagagcaaggttgatcccacttattgggacaagatttccctgggaggccttcaaagaatccaagaaaagtatacttggaaaatctattctcagagactattgaccctgactggagtttacggtttctggaaacatgtttcgcaccttgatcgccttgagagccggcgataccttgaaatgttttatgctctcaagtatcgcaagctggctcaatctgttcctctggctattgaggagtgaaaggaggttgaaggaagctcagcgtcggtccggttgtattaaaataactcccaactttgggattgtgacttaaaggaagagttcaatgcatcatgttttct

SEQ ID NO: 2472 - DNA, 3078 bp, Eutrema parvulum
aatggatggtggataggaatgtttaacgaagctaataaaatgatggataagatagtcataaaatatcattttcaatttgtacacgtccaagttcgaagtcggctcgaaatagttaagtttatggtcaagtattttgaatttaataacctctatggttgtttcgtaataccatggaagcttaaggctgaaaaggtcaagtttttgatcaaatttcttgaccttcgttataatatgtattggttctcttctgtatataaatgtgaatgtgagcaacaacaagactttcatcttattcacttttcctattttcttgcgtctcttcttttctctctctgcagcttccaaaaaaactttcactgttttctgcgtctcatttggatcaatggtgaacggtgcgataacgcgcgtccacagccagcgtgagcgtttgaacgaaacgctcgttgatcagagaaacgaagtccttgccttgctttccagggttgaagccaaaggtaaaggtatcctgcaacaaaaccagatcattgctgaattcgaggctttgcctgaagaaacccagaagaagattgaaggtggtgctttcttcgaccttcttaaaaccactcaggaagcaatcgtgttgccaccatgggttgctcttgctgtgaggccacggcctggtgtttgggagtatctaagagtcaatctccatgcgcttgttgttgaggagcttcaacctgctgagtttctccatttcaaagaagaacttgttgatggagttaagaatggtaattttacgcttgagctcgattttgagccattcaatgcgtctgtccctcgcccaacgctccccaaatacattggagatggtgttgaattccttaaccgtcacctctcggctaagctcttccatgacaaggagagtttgcttccattgcttaagttccttcgtctacacagccacgggggaaagaccctgatgttgaacgagaaaattcaaaacctcaatactctgcaacacatcttgaggaaagcagaggagtatcttgccgagctaaagcccgaaacaccgtatgaagactttgaggccaagtttgaggagatcggtctcgagaggggatggggaaacaatgccgagcgtgtccttgacatgatccgtcttcttttggaccttcttgaggcccctgacccttgcactctagagaactttcttggaagaatcccgatggtgttcaatgtcgtgatcctctctccacatggttactttgctcaagacaatgttctgggttaccctgacactggtggtcaggttgtttacattctggatcaagttcgtgccttggagacagagatgctccaacgtattaagcaacaaggactcaacattactcccagaattcttattctcactcgactgctccctgatgccgtaggaaccacatgtggtgagcgtcttgagcgagtggatggatctgagtactgtgatattctccgtgtgcccttcagaacagaaaagggtattgttcgtaaatggatttcaagatttgaagtctggccatatctggagacttacacggaggatgctgcggtcgagcttgctaaagagttgaaggggaagcctgaccttatcattgggaactacagtgatggaaacctcgttgcctctttattggcacacaaacttggtgtcacgcagtgtaccattgctcacgctctggagaagacaaagtacccggattccgatatctactggaagaagcttgacgataagtaccatttctcatgccagttcactgcggatctgtttgccatgaaccacactgatttcatcatcaccagtactctccaagaaattgctggaagcaaggacactgttgggcagtatgagagccacacagcctttacccttcccggactataccgagttgttcacgggatcgatgtgtttgatcccaagttcaacatcgtttcccctggtgctgatatgagcatctacttcccttacacagaagagaagcgtagattgactaaattccatcccgagatcgaggagctcctctacagcgatgttgaaaacgaagagcacttatgtgtgctcaaggacaagaagaagccgatcctcttcacgatggctaggctcgaccgtgtcaagaacttgtcaggtcttgttgagtggtacggaaaaaacacacgcctgcgtgagcttgttaacttggtggttgttggaggagacaggaggaaagaatcaaaggacaacgaagagaaggccgaaatgaagaaaatgtatgatctcatcgaggaatacaagctcaacggtcagttcagatggatctcctcccagatgaaccgggttaggaacggcgagctctaccggtacatctgtgacagcaagggtgcttttgtgcaacccgcattgtatgaagcctttggtctgactgttgtggaggccatgacctgtgggttacccactttcgccacttgcaaaggtggtccagctgagatcatagtgcacggtaaatcgggattccacattgacccttaccatggtgatcaggctgctgaaactcttgctgatttcttcaccaagtgtaaggaagatccatctcactgggaccagatctcaaagggagggcttcagaggatagaggagaaatacacctggcagatttactcacagaggctcctcacattgaccggtgtgtatggattctggaagcatgtctcgaaccttgaccgtcttgagagccgccgttaccttgagatgttctatgcattgaagtaccgcccactggctcaggctgttcctctagctgaggaggaatgaagatgagagaaaagatgcggaaccatcaaagagcttgaaaagaaaggttcctctgtttaaagaataaaacaaaaatctcttgtgattcttaatatcatttagattgaaggagcgcttgtgtgttcctctgcttctttgttaattcactccttttgtctttgttttttcctttgcctctccggcaatgccttgtattctgattgttgagggatatccctaattggcaatgaaatttcgatttttctcatagttaacatattccaaccatacaaaca

SEQ ID NO: 2473 - DNA, 2599 bp, Malus domestica
ctcttcatttctatcattctctgcgttctgtttattgaagctctccgtccattattacttcgatttattcatcgattcgttactctattggtcaagaacattcgtcggcggtaattcttcgttggattttaagactttaaggttgtctgattttccaagctgctgctgtcaatggcggaacgtgtgctgacccgcgtccagagcctccgggagaggctggacgaaaccctctctactcaacgcaatgattttctggccctgctttctaggattgagagcaaggggaaagggtttctgcaaccccatcagcttcttgccgagttcgaagcgattcctgaaaacaacaggcagaagctgttggatggggcttttggtgaagttttgaagcacacccaggaggctattgttttgcccccatgggtggctcttgctgtgcgcccaaggcccggtgtttgggagtacattcgtgtgaatgtccatgctctcgctctcgaggagctgtgtgtggctgagtacttgcaattcaaggaggagcttgttgatggaagttccaatggcaactttgtgcttgagttggactttcaaccgttcaatgcatctttcccccgcccaactctttccaagtccattggaaacggcgttgagttcctcaatcgtcacctttctgctaagctcttccatgacaaggagagcctgcaccctttgctcgagtttctccgagttcactgctatgagggcaggaacatgatgctgaataacagaattaagaatgtgaatgagctgcaacgtgttctgaggaaggcggaggatttcctctcttcaattgtccccagaactccatacaaggagttcgagcccaagttgcaagccatcggtttggagaggggttggggtgacactgcagagcgcgtgcttgagatgatccaacttctgttggaccttcttgaggcacccaatccttttactcttgagaaattccttggccagatccccatggtctttaatgttgtgatcctttcgccccacggctattttgcccaagaccatgtcttggggttccctgacactggtggccaggttgtctatatcttggatcaagttcgtgctttagagtctgagatgcttaagcgcattaagcagcaggggctcgatatcactccccgcattatcattctaacaaggcttcttcctgatgctgttggaaccacatgtggtgatcgtcttgagaaagtttacgggtgtgagcattcagatattcttcgtgttcctttcagagataagaagggcgccattgtccgcagatggatttcaagatttgaagtctggccctacctagagacatacgctggggatgcgatcacggaactttccaaggaaatgcagggcaagcctgatctcatcattggaaactacagtgatggcaatattgtggcctcactgatggcacacatattgggtgttacacagtgcaccattgcccatgctctggagaagtcaaaataccctgattctgacctttactggaagaaattggatgagaattatcatttctcatgccaatttacagctgatcttatcgccatgaaccacactgatttcatcatcaccagtaccttccaagagattgctggaagcaaagacactgttggccagtatgagagccacactgccttcacccttcctgggctctaccgtgtcgttcatggtattgatgtcttcgatcccaagttcaacattgtttcaccaggagctgacatgaatgtctacttccctttctctgagaaagaaaagaggttgacccacttccaccctgaaattgaagagctcctttacggccaagtcgaaaatattgaacacttatgtgtgttgaaggacaggaacaagccaatcatcttcacaatggcaaggctggaccgcgtgaagaacatcaccgggcttgtcgagtggtatggtaagaatgccaagcttagagagttggttaaccttgttgtggttgctggtgatcgccgcaacgagtccaaggacaatgaggagaaggctgagttgaagaaaatgtatgagctgatcgacacctacaagctgaacgggcagttaagatggatttcatcccagatgaaccgtgtgaggaatggtgaactctaccgctacatttgtgacaccaggggagcctttgtgcagcctgctgtgtatgaagctttcggcctgactgtcattgaggccatgacttgtggactgcccacatttgccacttgcaagggtggcccggctgagattatcgtgaacggaaaatcgggctaccacattgatccataccacggcgatcaggctgctgagatccttgttgatttctttgagaagaacaaggctgatcctagccactgggacaagatttctcaaggcggcttgcagcgcatttacgagaagtacacatggcaaatctactctgagaggctcttgacactcactggagtttatggcttctggaaagatgtttcgaaccttgatcgcctggagagccgccgctatctggagatgttttacgccctcaagttccgcaagctcgcggcgtctgttcctcttgctgtggaggagtgaagag

SEQ ID NO: 2474 - DNA, 2693 bp, Arabidopsis lyrata
ttcattcacttctaattatttccagtgacctccttggccagtaacttttcgtagcattttcagtttcaaaagctttttgattttgtttgaaatggcaaacgcggaacgtgtaataacgcgcgtccacagccagcgagagcgtttggatgctactcttattgctcagaaaaatgaagtccttgctttgctctcaagggttgaagccaaaggcaaaggcattctacaatatcaccagatcattgctgagtttgaggcaatgcctttagagacacaaaagaagcttcaaggtggagctttcttcgaaatcctccgttcagctcaagaagcaattgtgttaccaccatttgttgctttagctgtgagaccaagacctggagtttgggaatacgtaagagttaacctccatgatcttgtcgttgacgagcttcaagcttctgaatatcttcaattcaaggaagagctcgtcgatggaattaggaatggtaacttcactctcgagcttgactttgaaccattcaacgccgcattccctcgtcccacgctcaacaagtacattggaaatggggttgagttcctcaatcgccatctctcggctaagctcttccatgacaaggagagcttgcatcctctgctcaagttcctgcgcctccattcccacgagggcaagactctgatgcttaacgacaggatccagaacctaaacacactgcaacacaatctgaggaaagcagaggagtatcttatggagctgaaacccgagacaccctactcggagtttgaccacaagttccaggggattggtcttgagagaggttggggagacaccgcggtgcgtgtacttgacatgattcgtcttcttcttgaccttctcgaggcacctgacccttgcacacttgggaatttccttggaaggatcccaatggttttcaacgttgtgatcctctctcctcatggatactttgctcaggataatgttcttggttaccctgacactggtggtcaggttgtttacattcttgatcaagttcgtgctctcgaaacagagatgctccaacgcaccaaacaacaaggactcaccatcactccgagaatcctaattatcactcggttgcttcctgatgcagcaggaaccacttgtggtcaacgtctagagaaagtgtacggatctcagtattgtgatatcctccgtgtaccttttagaacagagaaaggaatcgttcgcaaatggatctcaaggtttgaggtctggccatatctagagacttttaccgaggatgttgcagctgaaatctcgaaagagttacaagggaaacctgaccttatcattggaaactatagtgatggtaatcttgttgcctctttgttagcacacaaacttggtgtcactcagtgcaccattgctcatgctttggagaagactaagtacccggattctgatatctactggaagaagcttgacgagaagtatcacttctcttgccagttcactgctgatcttatcgccatgaaccacacagatttcatcatcacaagtactttccaagaaattgctggaagcaaggacactgttggtcagtacgagagtcacacagctttcacacttcccgggctatatcgtgtggttcacggtattgatgtgtttgatcccaagttcaacattgtctctcctggtgcggatatgaacatatacttcgcctacactgaggagaagcgtagattaactgcattccatcaagagattgaggagctcctctacagtgatgttgagaacgaaaagcacctatgtgtgctaaaggacaagaagaagccaatcctcttcaccatggctaggcttgaccgtgtaaagaacttatcaggtcttgttgagtggtatggtaagaacactcgcctgcgcgaactggtgaacttggtcgttgtgggtggagacaggagcaaagagtcgcaggacaatgaagaaaaggctgagatgaagaaaatgtatgatctgattgaggaatacaaacttaacgggcagtttcgatggatctcctcacagatgaaccgagtgagaaacggcgagctttaccgttacatatgtgacaccaaaggtgcatttgtacagcctgctctttatgaagcctttgggttgactgttgttgaggctatgaccagtgggttaccgacttttgctacttgcaatggtggtcctgctgagatcattgtgcatggaaaatctggtttccacattgatccataccatggtgaccaggcagctgagacgcttgctgatttcttcaccaagtgtaagcatgacccatctcattgggatcagatttcattgggaggacttgagaggatccaggagaaatatacatggcaaatttactcagagaggctcctgacattgactggtgtctacggcttctggaaacatgtctcgaaccttgaccgtcttgagagtcgccggtaccttgagatgttctacgcattgaagtaccgcccactggctcaagctgttcctcttgctcaggaagagtgaaagaagattttctaccttctacaacaataaagatctctcattgtcgacggcttctttgttatgtagctcatgtcattttgttttttccttttctgatttgacaaccaaagcctccagagttttatccattagcaacatgaacaatgtaaaaaactgattacttaactactttaag

SEQ ID NO: 2475 - DNA, 2757 bp, Arabidopsis lyrata
ttatccattctcttcttcattcttctctcacaatttgcattatcaccattttctatttcattcacttctaattatttccagtgacctccttggccagtaacttttcgtagcattttcagtttcaaaagctttttgattttgtttgaaatggcaaacgcggaacgtgtaataacgcgcgtccacagccagcgagagcgtttggatgctactcttattgctcagaaaaatgaagtccttgctttgctctcaagggttgaagccaaaggcaaaggcattctacaatatcaccagatcattgctgagtttgaggcaatgcctttagagacacaaaagaagcttcaaggtggagctttcttcgaaatcctccgttcagctcaagaagcaattgtgttaccaccatttgttgctttagctgtgagaccaagacctggagtttgggaatacgtaagagttaacctccatgatcttgtcgttgacgagcttcaagcttctgaatatcttcaattcaaggaagagctcgtcgatggaattaggaatggtaacttcactctcgagcttgactttgaaccattcaacgccgcattccctcgtcccacgctcaacaagtacattggaaatggggttgagttcctcaatcgccatctctcggctaagctcttccatgacaaggagagcttgcatcctctgctcaagttcctgcgcctccattcccacgagggcaagactctgatgcttaacgacaggatccagaacctaaacacactgcaacacaatctgaggaaagcagaggagtatcttatggagctgaaacccgagacaccctactcggagtttgaccacaagttccaggggattggtcttgagagaggttggggagacaccgcggtgcgtgtacttgacatgattcgtcttcttcttgaccttctcgaggcacctgacccttgcacacttgggaatttccttggaaggatcccaatggttttcaacgttgtgatcctctctcctcatggatactttgctcaggataatgttcttggttaccctgacactggtggtcaggttgtttacattcttgatcaagttcgtgctctcgaaacagagatgctccaacgcaccaaacaacaaggactcaccatcactccgagaatcctaattatcactcggttgcttcctgatgcagcaggaaccacttgtggtcaacgtctagagaaagtgtacggatctcagtattgtgatatcctccgtgtaccttttagaacagagaaaggaatcgttcgcaaatggatctcaaggtttgaggtctggccatatctagagacttttaccgaggatgttgcagctgaaatctcgaaagagttacaagggaaacctgaccttatcattggaaactatagtgatggtaatcttgttgcctctttgttagcacacaaacttggtgtcactcagtgcaccattgctcatgctttggagaagactaagtacccggattctgatatctactggaagaagcttgacgagaagtatcacttctcttgccagttcactgctgatcttatcgccatgaaccacacagatttcatcatcacaagtactttccaagaaattgctggaagcaaggacactgttggtcagtacgagagtcacacagctttcacacttcccgggctatatcgtgtggttcacggtattgatgtgtttgatcccaagttcaacattgtctctcctggtgcggatatgaacatatacttcgcctacactgaggagaagcgtagattaactgcattccatcaagagattgaggagctcctctacagtgatgttgagaacgaaaagcacctatgtgtgctaaaggacaagaagaagccaatcctcttcaccatggctaggcttgaccgtgtaaagaacttatcaggtcttgttgagtggtatggtaagaacactcgcctgcgcgaactggtgaacttggtcgttgtgggtggagacaggagcaaagagtcgcaggacaatgaagaaaaggctgagatgaagaaaatgtatgatctgattgaggaatacaaacttaacgggcagtttcgatggatctcctcacagatgaaccgagtgagaaacggcgagctttaccgttacatatgtgacaccaaaggtgcatttgtacagcctgctctttatgaagcctttgggttgactgttgttgaggctatgaccagtgggttaccgacttttgctacttgcaatggtggtcctgctgagatcattgtgcatggaaaatctggtttccacattgatccataccatggtgaccaggcagctgagacgcttgctgatttcttcaccaagtgtaagcatgacccatctcattgggatcagatttcattgggaggacttgagaggatccaggagaaatatacatggcaaatttactcagagaggctcctgacattgactggtgtctacggcttctggaaacatgtctcgaaccttgaccgtcttgagagtcgccggtaccttgagatgttctacgcattgaagtaccgcccactggctcaagctgttcctcttgctcaggaagagtgaaagaagattttctaccttctacaacaataaagatctctcattgtcgacggcttctttgttatgtagctcatgtcattttgttttttccttttctgatttgattcattgcttttcaaactcttgatagttttatccattagcaacatgaacaatgtaaaaaactgattacttaactactttaag

SEQ ID NO: 2476 - DNA, 2723 bp, Brassica napus
aaactctgttatcactgtttcctgcgtctctctgttaaggatcaatggtgaacggtgtgttaacgcgcgtccacagccaacgtgagcgtttgaacgaaacgctcgctgctcaaagaaacgaagtccttgccttactttccagggttgaaggcaaaggtaaaggcatcttgcaacaaaaccagatcattgctgaattcgaggctttgcctgaagaaacccagaagaagattgaaggtggtgctttcttcgaccttctcaaaaccactcaggaagcaatagtgttgccaccatgggttgctcttgctgtgaggccaaggcctggtgtttgggagtacataagagtcaatctccatgctcttgttgttgaggagcttacacctgctgagtttcttcatttcaaggaagagcttgttgatggagttaagaacggtgatttcacgcttgagcttgactttgagccgtttaatgcctctgtccctcgcccaacgctccccaagtacattggagatggtgttgagtttctcaaccgtcacctctcggctaagctcttccatgacaaggagagtttgcttcctttgctcaagttccttcgactacacagctaccagggaaagaccctgatgctgaacgagagagttcaaaacctcaacaatctgcaacacatcttgaggaaggcagaggagtatctggcaggtctttcacctgaaacgccttatgaagattttgaggccaagtttgaggagattggtcttgagaggggatggggaaacaatgccgagcgtgtccttgacatgatccgtcttcttttggacctcctcgaggcccctgacccttgcactctagagaactttcttgggagagtccctatggtgttcaacgttgtcatcctctctccacatggttactttgctcaggacaatgttcttggttaccctgacactggtggtcaggttgtttacattctggatcaagtccgtgccatggagacagagatgctccaacgtattcagcagcaaggactcaacattactccaagaattctcattctcactagactgctccctgatgcagtaggaaccacatgtggtgagcgtcttgagagagttgatggatctgagtactgtgacatcctccgtgtgcccttcagaacagagaagggtatcgttcgcaaatggatctcaagattcgaagtctggccatatctagagacttacaccgaggatgctgccgttgagcttgctaaagagttgaagggcaagcctgaccttatcattggtaactacagtgatggcaacctcgttgcctctttactggcacacaaacttggtgtcactcagtgtaccattgctcacgccctggagaagacaaagtaccctgactcggatatatactggaagaagcttgacgataagtaccatttctcatgccagttcactgcagatctatttgcaatgaaccatactgatttcatcatcacaagtactctccaagaaattgctggaagcaaggacacagttgggcagtatgagagccacacggcctttactcttcctggactgtaccgagttgttcatggcattgatgtgtttgatcccaagttcaacattgtctctcctggtgctgacatgagcatctacttcccatacactgaggagaagcgtagattgactaagttccacccagagattgaggagctcctctacagcaatgttgaaaacgaagagcacttatgtgtgctcaaggacaagaagaagccaatcctcttcacaatggctaggctcgaccgtgtcaagaacttgtcaggtcttgttgagtggtacgggaagaacaaacgcctgcgtgagcttgttaacttggtggttgttggaggagacaggaggaaagagtcaaaggacaacgaagagaaggccgagatgaagaaaatgtatgacctcattgaggaatacaagctcaacggccagttccgttggatctcctcccagatgaacagggttaggaacggcgagctctacaggtacatctgtgacaccaagggtgcttttgtgcaaccagcattgtatgaagcctttggattgactgttgtggaggctatgacctgtgggttaccaacattcgccacttgcaaaggtggtccagctgagatcattgtccacggcaaatcaggtttccacattgacccttaccatggtgatcaggctgctgatactcttgctgatttcttcgccaagtgtaaggaagatccatctcactgggaccagatctcaaagggagggcttcagaggattgaggagaaatacacgtggcagatttactcacagaggctcttgacattgactggtgtgtatggattctggaagcatgtctcgaaccttgaccgtcttgagagccgtcgttaccttgagatgttctatgcattgaagtatcgcccactggctcaggctgttcctcttgctcaagagtaatgaagaaaagagagaaaaaatgtggaaccattgaagagcttgaagataatggttccagtgtttgaagaatatcaaaaatgtcttttgattcctatcatcatttggatttaggagcgcttttgtgttcctcttgcttactttgttgtttcaatccttttgtctttgtgtattttcttttccttgtctttccggcaatggtttgtactctgattgttgagggatctcccttatgattggcaatgagatatcgattattttatc

SEQ ID NO: 2477 - DNA, 2700 bp, Rosa hybrid cultivar
ttttggttctctgatccactaagaagcaatcaatggctgactcgcgtgttctgagccgtgtccacagcctcagggagaggctggatgacacactttctgctcaccgcaatgagatcttgggctttctttcaaggattgaagccaagggaaaagggtttttgcagccccatcagctgattgatgagtttgaagcaattcctgaagccagcagacaaaaattgtcggaaggtgcatttggggaagttctgaagaacacccaggaagctattgttctgcctccatgggtggcactcgctgttcgtcccaggcctggagtttgggagtacattcgggttaatgtgcactcacttgttgccgaggagttgcttgtgcctgagtacttgcacttcaaagaggagcttgttgatggaagtctcaatggcaactttgtgcttgaattggactttgaaccattcaatgcctctttccccaaaccaactctttccaaatctattggaaatggtgtcgagttcctcaaccgtcacctatctgcaaagctcttccatgacaaggagagcatgcacccactgcttgagtttctccgagttcactgctacaagggcaagaatatgatgctgaatgacagaattcagaatgtgaatgcacttcaacatgttctgaggaaggcagaggagtttctggctacactcgcaccagaaaccccatacaagagttttgagatcaagttgcaggatcttggtttggagagaggttggggagacaacgctgggcgcgtgctcgaaatgatccaactcctcttggagctccttgaggcacctgatccttgcaatctagaaaagttccttggcagaattcccatggtgttcaatgttgtgatcatgactcctcatggttactttgcccaagacgatgtgttggggtaccccgacactggtggtcaggttgtttatatcttggatcaagttcgtgctttggagaatgagatgcttaaacgtatcaaggaacaagggctagatatcatccctcgcattcttgttgtgacaaggctccttcctgatgccgtaggaactacttgtggtcagcgtcttgagaaggtttacaataccaaacattccgatattcttcgtgttccctttagaaccgagaagggaattgtccgcaaatggatctcaagattcgaagtgtggccatacctagagacttacaccgaggatgttgcaacagagcttgctaaagagttccagggcaagcctgatctcattattggaaactacagtgacggtaacattgtggcctcattgttggcacataaattgagtgttactcagtgcaccattgcccatgctttggagaagacaaagtaccctgattcagacctttactggaagaaactagacgacaagtaccacttctcttgccagttcacagctgatcttatcgccatgaaccacactgacttcattatcaccagtaccttccaggagattgctggaagcaaagatactgttggtcagtatgagagtcacactgccttcaccatgcctggtctctaccgtgttgttcatgggattgatgtctttgatcccaagttcaacattgtttcaccgggagctgacatggacatttacttcccttacacagagaaggaaaagaggttgacacatttccaccctgaaatcgaagagctcatctacagccaagaggagaacaaagaacacttgtgtgtgttgaaggacaggaacaagccagtcctcttcacaatggcaaggctggaccgtgtaaagaacatcactgggctggttgagtggtatggtaagaacaagaagcttagggagctggttaacttggttgttgttgctggggatcgccgaaaggagtcccaggacaatgaggagaaagctgagctgaagaagatgtatgagctgattgacacctacaagctgaatggccagttcagatggatttcgtctcagatgaatcgcgtgaggaacggtgaactctaccgtgtcattgctgacagcaagggagcttttgtgcagcctgctgtgtatgaagcctttggcttgactgttgttgaggccatgacttgtggtttgcccacatttgctacttgcaaaggtggcccggctgagattattgtgcacggcaaatctgggtaccatattgatccataccacggtgagcaagctgctgagatccttgttgacttctttgagaagtgcaagaaagacccttctcactgggacaagatttcccagggaggcttggagcgtatctatgagaagtacacatggaaaatctactctgaaaggctcttgaccttgactggagtttatggcttctggaagcatgtctccaaccttgatcgccttgagagccgtcgctacattgaaatgttctatgctctcaagtataaaaagctggctgagtctgttcctcttgctaaggagtgaagcgcaagctcaagtaaataaaagaggcggaagcaatttgttggctgagagtcatcatcaagttttccttggcggtttaggagaataactaaatattgtgattataagcgtttcggttttccttttccttttgatgtttcaatttctattcatcattgctggttgtaattgggaacgtttgaacctgggtttcaccccattcatcaatttacttcaacttttgctgtccaaaaaaaaaaaaaaaact

SEQ ID NO: 2478 - DNA, 3140 bp, Brassica rapa
aacggatggtggatagaagtgtataacgaaactaataaaatgatcttaagataactcataagatatcattttcaatttgtacacgtccaagttcgaacaatgattttagtggtcaatattttgagtttaataacctccatggctttctcgtaatacattagaagctcaaggctcaaaaagaaagaaaaaaaagtcaagtttttgatcaaatttcttgactttctcgttataatacatagttttctatgtatataaatatgaatgctgggcaaacacaaaacttacatcttattctcatcatctcatattctatttccttgtgttattctctctctctctgcagttaccaaaagacaaactttgttatcactgtttcctgcgtctctgttaaggatcaatggtgaacggtgtgttaacgcgcgtccacagccaacgtgagcgtttgagcgaaacgctcgttgctcaaagaaacgaagtccttgccttactttccagggttgaagccaaaggtaaaggcatcctgcaacaaaaccagatcgttgctgaattcgaggctttgcctgaagaaacccagaagaagattgaaggtggtgctttcttcgaccttctcaaaaccactcaggaagcaatagtgttgccaccatgggttgctcttgctgtgaggccaaggcctggtgtttgggagtacataagagttaatctccatgctcttgttgttgaggagcttacacctgctgagtttcttcatttcaaggaagagcttgttgatggagttaagaatggtgatttcacgcttgagcttgactttgagccgtttaatgcctctgtccctcgcccaacgctccccaagtacattggagatggtgttgagttccttaaccgtcacctctcggctaagctcttccatgacaaggagagtttgcttcctttgcttaagttccttcgactacacagccaccaggggaagaccttgatgttgaacgagagagttcaaaacctcaacagtctgcaacacatcttgaggaaggcagaggagtatctggcaggtcttgcacctgaaacgccttatgaagattttgaggccaagtttgaggagattggtcttgagaggggatggggaaacaatgccgagcgtgtccttgacatgatccgtcttctcttggacctcctcgaggcccctgacccttgcactctagagaactttcttgggagagtccctatggtgttcaacgttgtcatcctctctccacatggttacttcgctcaggataatgttcttggttaccctgacactggtggtcaggttgtttacattctggatcaagtccgtgccatggagacagagatgctccaacgtattcagcagcaaggactcaacattactccaaggattctcattctcactagactgctccctgatgcggtaggaaccacatgtggcgagcgtctcgagagagttgatggatctgagtactgtgatattctccgtgtgcccttcagaacagagaagggtatagttcgcaaatggatatcaagattcgaagtctggccatatctagagacttacaccgaggatgctgccgtcgagcttgccaaggagttgaagggcaagcctgaccttatcattggtaactacagtgatggaaacctcgttgcctctttgttggctcacaaacttggtgtcactcagtgtactattgctcacgctctggagaagacaaagtaccctgactctgatatctactggaagaagcttgacgataagtaccatttctcatgccagttcactgcggatctatttgcaatgaaccatactgatttcatcatcaccagtactctccaagaaattgctggaagcaaggataccgttgggcagtatgagagccacacggcctttactcttcctggactgtaccgtgttgttcatgggattgatgtttttgatcccaagttcaacattgtctctcctggtgctgacatgagcatctacttcccttacactgaggagaagcgtagattgactaagttccaccctgagattgaggagcttctctacagcaatgttgaaaacgaagagcacttatgtgtgctcaaggacaagaagaagccaatcctcttcacgatggctaggctcgaccgtgtcaagaacttgtcaggtcttgttgagtggtacgggaagaacaaacgcctacgtgatcttgttaacttggtggttgttggaggagacaggaggaaagagtcaaaggacaacgaagagaaggctgagatgaagaaaatgtatgacctcattgaggaatacaagctcaacggccagttcaggtggatctcatcccagatgaacagggttaggaacggtgagctctacaggtacatctgtgacaccaagggtgcttttgtgcaaccagcattgtatgaagccttcggtctgactgttgtggaggctatgacctgtgggttaccaacattcgccacttgcaaaggtggtccagctgagatcattgtccacggcaaatcaggtttccacattgacccttaccatggtgatcaggcggctgatactcttgctgatttcttcaccaagtgtaaggaagatccatctcactgggaccagatctcaaagggagggcttcagaggattgaggagaaatacacgtggcagatttactcacagaggctcttgacattgactggtgtgtatggattctggaagcatgtgtcgaaccttgaccgtcttgagagccgtcgttaccttgagatgttctatgccttgaagtatcgcccactggctcaggctgttcctcttgctcaagagtaatgaagaaaagagagaaaaaatgtggaaccattgaagagcttgagataaaggttccagtgtttgaagaataacaaaattctcttttgattcttattatcatttggatttaggagcgcttttgtgttcctcttgcttactttgttgtttcaatccttttgtctttgtgtattttcttttccttgtctttccggcaatggtttgtactctgattgttgagggatctcccttatgattggcaatgagatatatattatttgatcttgaaatcattgcatttcttccaaatatttaacattttccaacactatagaaacagcaacagagt

SEQ ID NO: 2479 - DNA, 2836 bp, Eutrema halophilum
gaatgtgggcagcacaagactttcatcttatttcatcatcttcatcacttttcctaattttttgcgtctttctctctgcagtttccaaaaaaaaactttttttcactgtttctgtgtctcttttggatcaatggtgaactgtgtgttaacgcgcgtccacagccagcgtgagcgtttggacgaaacgctcgttgctcagagaaacgaagtccttgccttgctttccagggttgaagccaaaggtaaaggtattcttcaacaaaatcagatcattgctgaattcgaggctctgcctgaagaaacccagaagaagattgaaggtggtgctttcttccaccttctcaaaaccactcaggaagcaattgtgctgccaccatttgttgctcttgctgtgaggccaagccctggtgtttgggaatacttaagagtcaatatcgatgctcttatcgttgatgagcttcaacctgcagagtatcttcagttcaaggaagaacttgtcgatggagttaagaatggtgatttcatgcttgagctcgatttcgagccattctgtgcatctatccctcgtccaacgcttcccaaatacattggagatggtgttgagttccttaaccgtcacctctcggctaagctcttccacgacaaagagagcttgtttccattgcttaagttccttcaacgacacagccacgagggacagaccctgatgctgaacgagaaaattcaatccctcaacactctgcaacgcatcttgaggaaagcagaggattatctggccgagcttaagcccgaaacaccgtacgaggagtttgagaccaagtttgaagagattggtcttgagaggggatggggagacaatgccgagcgtgtcctcgacatgatccgtcttcttttggaccttctcgaggcgcctgacccttgcactcttgagaacttccttggaagaattcccatggtgttcaacgtcgtgatcctctctccacatggttactttgctcaggacaatgttcttggctaccctgacactggtggtcaggttgtttacattctggatcaagttcgtgccttggaaacagagatgctccaacgtattaagcatcaaggactcaacattactcctagaattctcattctcactcgactgctccctgatgccgtaggaaccacatgtggtgagcgtcttgagagagttgatggatctgagtactgtgatattcttcgtgttcccttcagaacagagaagggtattgttcgcaaatggatctcaagatttgaagtctggccatatctagagacttacaccgaggatgctgcggttgagcttttgaaagagttgaaggggaagcctgaccttatcattgggaactacagtgacgggaacctcgttgcctctttattggcacacaaacttggtgttactcagtgtaccattgctcacgctctggagaagaccaaatacccggattccgatatctactggaagaagcttgacgataagtaccatttctcatgccagttcactgcggatctattcgcaatgaaccacactgatttcatcatcaccagtactctccaagaaattgctggaagtaaggacactgttgggcagtacgagagtcacacggccttcactcttcccggactttaccgagttgttcatgggattgatgtgtttgatcccaagttcaacattgtgtcccctggtgctgatatgagcatctacttcccttacacagaggagaagcgtagattgactaaattctaccctgagatcgaggagcttctctacagcgatgttgaaaacgaagagcacttatgtgtgctcaaggacaagaagaagccgattctcttcacgatggctagacttgaccgtgtcaagaacctgtcaggtcttgttgagtggtacgggaagaacacacgcctgcgtgagctggttaacttggttgttgtgggaggagacaggaggaaagagtcaaaggacaacgaagagaaggctgagatgaagaaaatgtatgatctcattgaggaatacaagctcaacggtcagttcaggtggatttcttcccagatgaaccgggttaggaacggtgagctctaccgttacatttgtgacaccaagggtgcgtttgtgcaacccgcactgtatgaagcctttggtttgactgttgtggaggccatgacctgtggtttaccgacttttgccacttgcaaaggtggtccagctgagatcattgtgcatggtaaatcgggtttccacattgacccttaccatggtgatcaggctgctgatactcttgctgatttcttcgccaagtgtaaggaagatccatctcactgggacgagatatcaaagggaggacttcagaggatcgaggagaaatacacgtggcagatctattcacagaggctcctgacattgaccggtgtgtatggattctggaagcatgtctcgaaccttgaccatcttgagagccgtcgctaccttgagatgttctatgcattgaagtatcgcccactggctcaggctgttcctcttgctcaggaggaatgaagaaaagagaaaagacagcggaaccattagagagcttgaagagagagagaggttccggtgtttgaagaataaaaataatctcttttttattttttactatcattcggatttttaaggagcgcttttgtgttcctttgcttctttgttcgttttttttttcctttgccaccggcactgctttgtattctggttgttgagggatttcccttgataaatgcaatgaaaatttcgatttttctatcttgaaatttgtcttgctttgttctctcaatataaacatatttc

SEQ ID NO: 2480 - DNA, 3117 bp, Eutrema halophilum
tttcaatttgtacacgtccaagttttgtagtcggctcaaaatagtttaatcacctagctacttaggaaacaaataatcatataaaatgaaacagaattttgcattgcccatctgtagtttagtggtcaagaattttgtatttaataacctctctatggttctttcgtaataccttggaagcttaaggccaaaaaggaatagaaaaaagtcaagcttttgatcaaatatcttgacctttgttataatatctaattcatagttttcgttgtatataatgtgaatgtgggcagcacaagactttcatcttatttcatcatcttcatcacttttcctaattttttgcgtctttctctctgcagtttccaaaaaaaaactttttttcactgtttctgtgtctcttttggatcaatggtgaactgtgtgttaacgcgcgtccacagccagcgtgagcgtttggacgaaacgctcgttgctcagagaaacgaagtccttgccttgctttccagggttgaagccaaaggtaaaggtattcttcaacaaaatcagatcattgctgaattcgaggctctgcctgaagaaacccagaagaagattgaaggtggtgctttcttccaccttctcaaaaccactcaggaagcaattgtgctgccaccatttgttgctcttgctgtgaggccaagccctggtgtttgggaatacttaagagtcaatatcgatgctcttatcgttgatgagcttcaacctgcagagtatcttcagttcaaggaagaacttgtcgatggagttaagaatggtgatttcatgcttgagctcgatttcgagccattctgtgcatctatccctcgtccaacgcttcccaaatacattggagatggtgttgagttccttaaccgtcacctctcggctaagctcttccacgacaaagagagcttgtttccattgcttaagttccttcaacgacacagccacgagggacagaccctgatgctgaacgagaaaattcaatccctcaacactctgcaacgcatcttgaggaaagcagaggattatctggccgagcttaagcccgaaacaccgtacgaggagtttgagaccaagtttgaagagattggtcttgagaggggatggggagacaatgccgagcgtgtcctcgacatgatccgtcttcttttggaccttctcgaggcgcctgacccttgcactcttgagaacttccttggaagaattcccatggtgttcaacgtcgtgatcctctctccacatggttactttgctcaggacaatgttcttggctaccctgacactggtggtcaggttgtttacattctggatcaagttcgtgccttggaaacagagatgctccaacgtattaagcatcaaggactcaacattactcctagaattctcattctcactcgactgctccctgatgccgtaggaaccacatgtggtgagcgtcttgagagagttgatggatctgagtactgtgatattcttcgtgttcccttcagaacagagaagggtattgttcgcaaatggatctcaagatttgaagtctggccatatctagagacttacaccgaggatgctgcggttgagcttttgaaagagttgaaggggaagcctgaccttatcattgggaactacagtgacgggaacctcgttgcctctttattggcacacaaacttggtgttactcagtgtaccattgctcacgctctggagaagaccaaatacccggattccgatatctactggaagaagcttgacgataagtaccatttctcatgccagttcactgcggatctattcgcaatgaaccacactgatttcatcatcaccagtactctccaagaaattgctggaagtaaggacactgttgggcagtacgagagtcacacggccttcactcttcccggactttaccgagttgttcatgggattgatgtgtttgatcccaagttcaacattgtgtcccctggtgctgatatgagcatctacttcccttacacagaggagaagcgtagattgactaaattctaccctgagatcgaggagcttctctacagcgatgttgaaaacgaagagcacttatgtgtgctcaaggacaagaagaagccgattctcttcacgatggctagacttgaccgtgtcaagaacctgtcaggtcttgttgagtggtacgggaagaacacacgcctgcgtgagctggttaacttggttgttgtgggaggagacaggaggaaagagtcaaaggacaacgaagagaaggctgagatgaagaaaatgtatgatctcattgaggaatacaagctcaacggtcagttcaggtggatttcttcccagatgaaccgggttaggaacggtgagctctaccgttacatttgtgacaccaagggtgcgtttgtgcaacccgcactgtatgaagcctttggtttgactgttgtggaggccatgacctgtggtttaccgacttttgccacttgcaaaggtggtccagctgagatcattgtgcatggtaaatcgggtttccacattgacccttaccatggtgatcaggctgctgatactcttgctgatttcttcgccaagtgtaaggaagatccatctcactgggacgagatatcaaagggaggacttcagaggatcgaggagaaatacacgtggcagatctattcacagaggctcctgacattgaccggtgtgtatggattctggaagcatgtctcgaaccttgaccatcttgagagccgtcgctaccttgagatgttctatgcattgaagtatcgcccactggctcaggctgttcctcttgctcaggaggaatgaagaaaagagaaaagacagcggaaccattagagagcttgaagagagagagaggttccggtgtttgaagaataaaaataatctcttttttattttttactatcattcggatttttaaggagcgcttttgtgttcctttgcttctttgttcgtttttttttcctttgccaccggcactgctttgtattctggttgttgagggatttcccttgataaatgcaatgaaaatttcgatttttctatcttgaaatttgtcttgctttgttctctcaatataaacatatttcacca

SEQ ID NO: 2481 - DNA, 2772 bp, Silene vulgaris
gtaggtaaatttgtgtaacaattgaaggtgaattgtctaagaaacaacaggagaaggagaaatggcaggaagattgaccagagttccaagcctcaaagaacgtttggatgaaactctcactgctcaaagaaatgaaattctttccttcctctctagaattttgagtcatgggaagggaattttgcaagctcatgaggtggcggctgagttcgaagcgatatcagacaagaacaagcttgctgatggtccctttggtgaagttttgaggcacacccaggaagcaattgtgttgtctccatggatcacacttgctgttcgtccacggcctggtgtatgggaatacatccgggtcaatgttgatgctcttgctgtggaggagttgaccccctccgagttccttcacgtcaaggaggaattggtgaatggaactgctaatggaaactttgtgcttgagcttgattttgagccattcaatgcatcattcccgcgcccaacactgtccaagtccattggaaatggtgtcgaattccttaacaggcacctctctgctaagatgttccatgacaaggagagcatgcgccctttgctcgatttcctcaggatgcatcactacaaggggaagacaatgatggtgaatgaccgaatccaaaatctggattcccttcaagccgtgataagaaaggctgaggagtttttgagcacccttgctcccgacacaccctactctgagtttgatcacaaatttcaagaaatcggtctggagagaggttggggtgacactgccgagagagtgctcgacatgattcaacttcttctagatcttcttgaggctcctgattcatgcacgcttgagaaattccttgggaggatcccgatggtattcaacgttgtcattctctcgccacatggctactttgcccaagccaatgtccttggttaccccgacactggtggccaggttgtttacatccttgatcaagttcgtgctttggagcatgagatgcttctgcgtatcaagcaacaagggcttgacattgtccctcggatccttattgtaacccgtctcctccctgatgcagtcgggaccacctgtggtcagcgtcttgagaaggtctttggaactgagcattcacacattcttcgagtaccctttagaacggagaagggcattgtcaggaaatggatttctcgattcgaagtctggccttacctggagacttacactgaggatgttgcaaacgaagtcacgggagagcttcaagctaagcctgatctaataatcggaaactatagtgacggtaacattgttgcctctctgttagcccacaagctcggagttacacagtgtactattgctcatgctctggagaaaaccaagtatccaaactcagatatctactggaagtcatttgaggagaagtaccacttctcgtgccagttcactgctgacctgatcgcaatgaatcacactgactttatcatcaccagtacattccaagagatagctggaaacaaagacactgttgggcagtatgagagccacatggcattcacccttcctggactataccgtgttgttcacggaatcgatgtcttcgaccctaaattcaacatagtctcacctggagccgatatgtctatttacttcccttacactgaagagaagaaaagactcactgccctccatcctgaaattgaggagctgctttacagtgatgtagaaaatgaagagcacatatgtgttctgaaggaccgaaataaaccaatcatattctcaatggcaaggctagacagggtcaagaacatgactggccttgttgaatggtacggcaagaatgaaaagctgagagagctcgtcaaccttgttgttgtcgctggtgaccgtagaaaggaatccaaggacacagaagagaaggaagagatgaagaaaatgtatgagctgattgagcagtatgacttgaatggccagttcagatggatctcggcccaaatgaaccgtgtcaggaatggtgagctatacaggtacattgctgacactaagggcgcttttgtccagccagcttactatgaagcctttgggttgactgttgttgaagccatgacttgtggacttccaacctttgctacttgccatggtggcccagctgagatcatagtcaatggaaaatcgggcttccacattgacccgtaccatggagacaaggccgctgatctccttgtcaatttctttgataagtgcaaggctgatccttctcactgggatgctatctcattgggtggacttaagcgaattgaggagaaatatacatggcagatttactctgataggctgctcacacttgctggtgtttacggtttctggaagtatgtctcaaaccttgaccgccttgaggctcgtcgttaccttgaaatgttctatgccctcaaataccgcaaactggctgagtcagttccgcatgccatcgatgagtgaaggagaaggcgagagaagtgttgggttggtgaatgaaaatgcatggaagagcgcgttctctgctgcttgttgaaaataactcaaattctttgagattgtagtccggaatgaaaaccatcagtgttcatttatgttttttctttcctttgttgttcattttgttttgctcttcgcggcattgtctatgattgtggagggatgtgttggtgaaaaaaaaaggtgtttggtgttccatcagtctctgagttttagttctttactcccattggtcccatttccgtccctacctgacttgttct

SEQ ID NO: 2482 - DNA, 2772 bp, Vitis vinifera
tcttggttctcccctcccaccgcaccccatttcatttttctagctttgcctttcaaaggttgtctgaaattaggtaagaacccagagaggagacatggccgacggtgttctgaccggggttcacagcctcagggcacgcgtggatgaaactctaactgcccatcgcaatgaaatcctgtccttcctgtcaaggattgaaggccatggaaaaggaattctgcagccccatcagcttctagctgagtttgaggccttacccgaagtaaacagaaaaaaactaagtgatgggccatttggagatatcctgaagtccatacaggaagccatagttctgcctccatggattgcgtttgctgttcgtccaaggcctggtgtttgggagtatattcgcgtgaatgtgagtgcgcttgttgttgaggagttgcttgtgcctgagtatttgcatttcaaggaagaacttgtggatgggagctgcaatggcaacttcgttcttgagttggactttgaaccattcactgcttccgtccctcgcccaactctttccaagtccattggaaatggtgtcgagttcctcaacagacacctctctgcgaaaatgttccatgacaaagacagcatgcagcccctgcttgatttcctccgaactcaccaatacaaggggaagacaatgatgctgaatgacagaattcagaatctggataccctccaatttgttctaaggaaggcagaggagtatctgtcttcacaggctccagagactccataccctgagtttgagcacaagttccaagagattggcctggaaagagggtggggtgatactgctgagcgtgtgctggagatgattcatctacttttggaccttcttgaggctcctgacccctgcactcttgagcaatttcttgggagaatccccatggttttcaatgttgttattctctccccccatggctactttgctcaggacaatgttctgggctaccctgacactggtggccaggttgtttatattctggatcaagttcgtgccatggagactgagatgcttctccgtatcaagcagcaaggacttgatatcactcccaagatcatcattgtaactagacttctccctgatgcggtagggacaacttgcaaccagcgtatcgagaaagtttatggaacagagcattcaatcatccttcgagttccctttagaactgagaagggaattgtccgcaaatggatctccagatttgaagtgtggccatacctggaaacttacactgaggatgttgcaaaagagcttgctacagagctacagaccaagccagattttatcattggcaattacagtgatggaaacattgttgcctctttgctggctcataagctaggggttacacagtgcaccatagctcatgccctggagaaaaccaaatatccagaatcagacatctattggaagaaactagaggacaagtaccacttctcatgccagtttacagctgatcttattgccatgaaccataccgattttatcatcaccagtaccttccaagagattgctggaagcaaggacactgttgggcaatacgagagtcatactggattcaccatgcctgggctgtacagagtagtccatggtatcgatgtttttgaccccaaattcaacattgtttcaccaggagcagatatgaccatctacttctcctacactgaagagaaaatgaggctgaaggccctccatccagaaattgaagagcttcttttcagccccgttgagaataaagaacacttatgtgtactaaaagaccgtaacaagccaatcatattctcaatggcgaggttggaccgcgtgaagaacttgacgggacttgttgagtggtatggtaagaatacccggctcagggaattggttaaccttgttgtggtgggtggagaccgaaggaaggagtccaaggatttggaagagcagtcagagatgaagaagatgcatgagctcatagaaacctacaaactgaatggccagttcagatggatttcctcccagatggaccgtgtcaggaacggtgaactctaccgctacattgctgacaccaagggcgtatttgtgcagcctgccttctacgaggctttcggattgactgttgtcgaggccatgacctgtggattgccaacatttgcaacctgcaatggtggcccagccgagatcattgtgcatggaaagtcaggcttccacattgatccctaccatggagacaaggcagctgagctccttgccaacttctttgagaaatgcaaggcagacccaactcactgggaaaagatctccaaggcaggcctgaagcgtattgaagagaagtatacatggaaaatttactctgagagactgttgaccctggctggggtttatgggttctggaagtatgtctccaaccttgaccgccgtgagacccgccgctaccttgaaatgttttatgccctcaagtaccgcaagctggctcaatcagttcctctggctgtggaagagtagctaaaaggcagaggcattggctagaagcaagctgcaggttttctgagctgtgtggaataactgtcattgtttgaggcttggccgaaaagaaggcatttcaatttttgctttttgttatctgtaatgtttgaacatgggatgttaaggctcctggatttcaattaaaatctgttacctttattgggtaacactgcttgccaagatttggctctgttatctgtcatattggttaagaatcaaattccaatctttcccct

SEQ ID NO: 2483 - DNA, 2753 bp, Malus domestica
cttcactgttctcaactcttttccttcctccctagctgttaagggtgtctgattttccaagctgctgctgtaatggcggaacgtgcgctgacccgcgtccagagcttacgagagaggctggacgaaaccctctctactcaccgcaatgagattctggcccttctttcaaggattgagagcaaggggaaagggtttctgcaaccccatcagcttcatgccgagttcgaagcgattcctgaaaataacaggcagaagctgttggacggggcttttggtgaagttttgaagcacacccaggaggctgttgtgctgcccccatgggtggcttttgctgtgcgcccaaggcctggtgtttgggagtacattcgtgtgaatgtccatgctctcgttctcgaggagttgcgtgtggccgagtacttgcaattcaaggaggaacttgttgatgggagttccaatggcaacttcgtgcttgagttggactttcagccgttccatgcatctttcccccgcccaactctttccaagtccattggaaaaggcgttgagttcctcaatcgtcacctttctgctaagctcttccatgacaaggagagcctgcaccctttgctcgagtttctccgagttcactgctatgagggcaggaacatgatgctgaataacagaattaagaatgtgaatgagctggaacgtgttctgaggaaggcagaggatttcctctcttcaattgtccccggaactccatacaaggagttcgagcccaagttgcaagccatcggtttggagaggggttggggtgacaccgctgagcgcgtgcttgagatgatccaacttctgttggaccttattgaggcacccgatccatttactcttgagaaatttcttggccagatccccatggtcttcaatgttgtgatcctttcgccccacggatattttgcccaagaccatgtcttggggttccctgacactggtggccaggttgtctatatcttggatcaagttcgtgctttggagtctgagatgcttaagcgcattaagcagcaaggactcgatatcactccccgcattatcattctcacaaggcttcttcctgatgctgttggaaccacatgtggtgatcgtcttgagaaagtttacgggtgtgagcattcagatattcttcgtgttcctttcagagatgagaagggtaccattgtccgcagatggatttcaagattcgaagtctggccctacctacagacatatgctgaggatgcgatcaaggaactttccaaggaaatgcagggcaagcctgatctcatcattggaaactacagtgatggcaatattgtggcctcactgatggcacacaaattgggtgttacacagtgcaccattgcccatgctctcgagaagtcaaaataccctgattctgacctttactggaagaaattggatgagaattatcacttctcatgccaatttacagctgatcttatcgccatgaaccacactgatttcatcatcaccagtaccttccaagagattgctggaagcaaagacactgttggtcagtatgagagccacactgccttcacccttcctgggctctaccgtgtcgttcatggtattgatgtcttcgatcccaagttcaacattgtttcaccaggagctgacaaggatgtctacttcccttactctgagaaagaaaagaggttgacccacttccaccctgaaattgaagagctcctttacggccaagtcgaaaatatcgaacaattatgtgtgttgaaggacaggaacaagccaatcatcttcacaatggcaaggctggaccgggtgaagaacatcactgggcttgtcgagtggtatggtaagaatgccaagcttagagagttggttaaccttcttgtggttgctggtgatcgccgcaacgagtccaaggacaatgaggagaaggctgagttaaagaagatgtacgagctgattgacacctacaagctgaacgggcagttaagatggatctcatcccagatgaaccgtgtgaggaatggtgaactctaccgctacatttgtgacaccaggggagcctttgtgcagcctgctgtgtatgaagctttcggcttgacagtcattgaggccatgacttgtggactgcccacatttgccacttgcaagggtggcccggctgagattattgtgaatggaatatcgggctaccacattgatccataccacggcgatcaggctgctgagatccttgttgatttctttgagaagagcaaggctgatcctagccactgggacaagatttctcaaggcggcttgcagcgcatttacgaaaagtacacatggcaaatctactctgagaggctcttgacactcactggagtctatggcttctggaaagatgtttcgaaccttgatcgcctggagtgccgccgctatctggagatgttttacgccctcaagttccgcaagctggcggcgtctgttcctctagctgtggagtgaagagaaagttttccttatagagtaaataaagaggcggaagcattggttgtttactgtggagttttttcctcctcaggatgaggattttgtatatattttgatttaccaaaggaattttaatgtttcttttattttgttatttgtaattttcgattcccaatggaaatgaagtcattttaatgttttttttttctttccctacttaccattattggttcaagtagaatattttttaacaagatgtttgttcttttttaaaa

SEQ ID NO: 2484 - DNA, 2876 bp, Brassica rapa
gaatgtgggcaatgcaaagactcatcatctcattcattcatagtttctgtgtatcttaattttctctctgcagtttccaaaaacactttctgttgtctcttttggatcaatggtgaacggtgtgttaacgcgcgtccacagccagcgtgagcgtttgaacgaaacgctcgttgctcaaagaaacgaagtccttgccttgctttccagggttgaagccaagggtaaaggcatcctgcaacaaaaccagatcattgctgaattcgaggctttgcctgaagaaacccagaagaagattgaaggtggtgctttcttcgaccttctcaaaaccactcaggaagctattgtgttgccaccatgggtagctcttgctgtgaggccaaggcctggtgtgtgggagtacataagagtcaatctccatgctcttgtggttgaggagcttcaacctgctgagtttcttcatttcaaagaagaacttgttgatggagttaagaatggtgatttcacacttgagcttgattttgagccattcaacgcctctgtccctcgcccaacgctccccaagtacattggagatggtgtcgagttccttaaccgtcacctctcagctaagctcttccatgaaaaagacagtttgcttccattgcttaagttccttcaactacacagccaccagggaaagaccctcatgctgaacgagaaaattcaaaacctcaacactcttcaacacatcttgaggaaagctgaggagtatctagccaagctttcacccgaaacaccgtacgaagactttgaggccaagtttgaggagattggtcttgagaggggatggggaaacaacgccgagcgtgtccttgacatgctccgtcttcttttagaccttcttgaggctcctgacccttgcactctcgagacctttctcggaagaatcccaatggtgttcaacgttgtgatcctctctccacatggctactttgctcaggacaatgtccttggttaccctgacactggcggtcaggttgtttacattctggatcaagtccgtgccttggagacagagatgctgcaacgtattaagcagcaaggactcaacattactccaagaatcctcattctcactagacttctccctgatgcggtgggaaccacatgtggtgagcgtcttgagagagttgatggatctgagtattgtgatattctccgtgtgcccttcagaacagagaagggtatagttcgcaaatggatctcgagatttgaagtctggccatatcttgagacttacaccgaggatgctgccgttgagcttgccaaagagttgaaagggaagcctgaccttatcattgggaactacagtgatggaaaccttgttgcctctttgttggcacacaaacttggtgtcactcagtgtaccattgctcacgctctggagaaaacaaagtaccctgattcagacatctactggaagaagcttgacgacaagtaccatttctcatgccagttcactgctgatttgtttgcaatgaaccacactgatttcatcatcaccagcactctccaagaaattgctggaagcaaggacactgttggacagtacgagagccacacggccttcactcttccaggactgtaccgtgttgttcacggaatcgatgtgtttgatcctaagttcaacattgtctcccctggtgctgatatgagcatctacttcccttacacagaggagaagcggaggttgactaagttccaccctgagatcgaggagctactctacagcgatgttgaaaaccaagagcacttatgtgtgctcaaggacaagaagaagccaatcctcttcacgatggctaggctcgaccgtgtcaagaacttgtcaggtcttgttgagtggtacgggaagaacaaacgcctacgtgatcttgttaacttggtggttgttggaggagacaggaggaaagagtcaaaggacaacgaagagaaggctgagatgaagaaaatgtatgacctcattgaggaatacaagctcaacggccagttcaggtggatctcatcccagatgaacagggttaggaacggtgagctctacaggtacatctgtgacaccaagggtgcttttgtgcaaccagcattgtatgaagccttcggtctgactgttgtggaggctatgacctgtgggttaccaacattcgcgacttgcaaaggtggtccagctgagatcattgtgcacggcaagtcaggcttccacattgacccgtaccatggtgatcaggctgctgatactcttgctgacttcttcacaaagtgtaaggaagatccgtctcactgggatgagatctctaagggagggcttcagaggattgaggagaagtacacgtggcagatatactcacagaggcttctgacattgactggtgtgtatggattctggaagcatgtttctaaccttgaccgtcttgagagccgccgttaccttgagatgttctatgcattgaagtatcgcccactggctaaggctgttcctcttgctgaggaggaatgaagaagatgtgtgaagaattaaagagcttgaagagagaaagaggttgcagtgtgtgaagaataacaaaaaatctcttttgattcttactgtcattttgattttaggagcgctttttgtgttcctttgcttctttgttattttcaatccttttgtctttgttttatcattggcctctgcggcaatgcgttgtattctgattgttgagggaattaaatttcgatttttctatcttaaaaccccttcattcaacagatatgagtgacatgaaagtgataagtgtgagtttgaatgatgaaaaaacagaacaaaacagagaatgaagtagtagaacgatatgactttaaga

SEQ ID NO: 2485 - DNA, 4702 bp, Vitis vinifera
catgggttagcctagaattttcttttatggaaaagtattttttattttatttacttctgtcttggcatgttattttggtgcaggggattttgtctgtaattagaaaaatcacctcccataagctttgatcctttattttgtgcgaggataaggggaacatattttcaacttgatttctcccaccaaccctgtgttgcttacatccaccattctggtctttctataaatttcccacgtttcttccattcctctatctcctttcatttttcattctctagttgattgtgatcaactcacctcttctctaggttgtctgaaattaggtaagaacccagagaggagacatggccgacggtgttctgaccggggttcacagcctcagggcacgcgtggatgaaactctaactgcccatcgcaatgaaatcctgtccttcctgtcaaggattgaaggccatggaaaaggaattctgcagccccatcagcttctagctgagtttgaggccttacccgaagtaaacagaaaaaaactaagtgatgggccatttggagatatcctgaagtccatacaggaagccatagttctgcctccatggattgcgtttgctgttcgtccaaggcctggtgtttgggagtatattcgcgtgaatgtgagtgcgcttgttgttgaggagttgcttgtgcctgagtatttgcatttcaaggaagaacttgtggatgggagctgcaatggcaacttcgttcttgagttggactttgaaccattcactgcttccgtccctcgcccaactctttccaagtccattggaaatggtgtcgagttcctcaacagacacctctctgcgaaaatgttccatgacaaagacagcatgcagcccctgcttgatttcctccgaactcaccaatacaaggggaagacaatgatgctgaatgacagaattcagaatctggataccctccaatttgttctaaggaaggcagaggagtatctgtcttcacaggctccagagactccataccctgagtttgagcacaagttccaagagattggcctggaaagagggtggggtgatactgctgagcgtgtgctggagatgattcatctacttttggaccttcttgaggctcctgacccctgcactcttgagcaatttcttgggagaatccccatggttttcaatgttgttattctctccccccatggctactttgctcaggacaatgttctgggctaccctgacactggtggccaggttgtttatattctggatcaagttcgtgccatggagactgagatgcttctccgtatcaagcagcaaggacttgatatcactcccaagatcatcattgtaactagacttctccctgatgcggtagggacaacttgcaaccagcgtatcgagaaagtttatggaacagagcattcaatcatccttcgagttccctttagaactgagaagggaattgtccgcaaatggatctccagatttgaagtgtggccatacctggaaacttacactgaggatgttgcaaaagagcttgctacagagctacagaccaagccagattttatcattggcaattacagtgatggaaacattgttgcctctttgctggctcataagctaggggttacacagtgcaccatagctcatgccctggagaaaaccaaatatccagaatcagacatctattggaagaaactagaggacaagtaccacttctcatgccagtttacagctgatcttattgccatgaaccataccgattttatcatcaccagtaccttccaagagattgctggaagcaaggacactgttgggcaatacgagagtcatactggattcaccatgcctgggctgtacagagtagtccatggtatcgatgtttttgaccccaaattcaacattgtttcaccaggagcagatatgaccatctacttctcctacactgaagagaaaatgaggctgaaggccctccatccagaaattgaagagcttcttttcagccccgttgagaataaagaacacttatgtgtactaaaagaccgtaacaagccaatcatattctcaatggcgaggttggaccgcgtgaagaacttgacgggacttgttgagtggtatggtaagaatacccggctcagggaattggttaaccttgttgtggtgggtggagaccgaaggaaggagtccaaggatttggaagagcagtcagagatgaagaagatgcatgagctcatagaaacctacaaactgaatggccagttcagatggatttcctcccagatggaccgtgtcaggaacggtgaactctaccgctacattgctgacaccaagggcgtatttgtgcagcctgccttctacgaggctttcggattgactgttgtcgaggccatgacctgtggattgccaacatttgcaacctgcaatggtggcccagccgagatcattgtgcatggaaagtcaggcttccacattgatccctaccatggagacaaggcagctgagctccttgccaacttctttgagaaatgcaaggcagacccaactcactgggaaaagatctccaaggcaggcctgaagcgtattgaagagaagtatacatggaaaatttactctgagagactgttgaccctggctggggtttatgggttctggaagtatgtctccaaccttgaccgccgtgagacccgccgctaccttgaaatgttttatgccctcaagtaccgcaagctggctcaatcagttcctctggctgtggaagagtagctaaaaggcagaggcattggctagaagcaagctgcaggttttctgagctgtgtggaataactgtcattgtttgaggcttggccgaaaagaaggcatttcaatttttgctttttgttatctgtaatgtttgaacatgggatgttaaggctcctggatttcaattaaaatctgttacctttattgggtaacactgcttgccaagatttggctctgttatctgtcatattggttaagaatcaaattccaatctttcccctactccagttgcttcaagagagcattaccttattgggtgtcttcaatctttaatgccacgacaaccttttcttgaagccaatggagatgccttcatatggacccgacttatgaccattgtacttggggtctttctcacactcccaacactaattctctttgcttcatttctcaacgaggaaggagaccaagaactggtccgttcttcaactcaacctcaacctcttcatccactcatcaagaacgcctgcaccaacactctctacccttctctctgcttcaccactctctcttctgctcctgctacttccaagaacaccaccaccctccaccatattcttgagattgcagtcaatgcaacggtgagctccgtgatggattctgggtccgatattaaagcccttttcacctaccaagacttgaattctcaagagaagaatgctctgaatgattgcatggaaatgacagaccaaaccctctatgaacttggacaggccattgacgacctgcatgctttcccgccatctataggggatcctcatcggttatacacgaaccttaagacccttctcagtgcagccatgacaaatgagaacacatgcatcgatggattcactgacctggaagaagccgattctgaaagccagaagggtctcaagggacatctccaatccgtcttaactcctatttctggtatgatcagcaactgcttggccattatcaagtacatggaaaccatagcccttagggacagaaagatcatgaataccacaatgccaagggacgaattcccagcatggatgacagccattgatcggaaactgattgaaatggtgcctaaaataaggccagacatcgttgttgcaagtgatggcagtggacattttagcaccattggggaagcaatcagtacggcgcctaacaagagcagtaatcgatttgtgattaaaataaaggcaggagtatacaaggaaaatgtggagattccaagggaaaaggtcaatatcatgttggtaggagaagggatgaattcaacagtgatcacagggtctaaaagctttgttgatgggttttccaccttcacttcagccaccttaactgtggttggagacaagttcttagcaagggacctaaccatcatcaacacggcaggccccgagaagcaccaggcagttgcagtaagagtgacctccaattctgctttctaccgctgcaacttcagctcgtatcaggacaccctctacgctcattctctccgccaattctatcgtgaatgcacaatccaaggcacaatagatttcatctttggaaatgcagcagcagtcttccaaaactgtcttatactcgttcgcaaaccaagccccggacaaaagaacatgatcactgctcaagggagaggagacccaaatcagaacactggcatctcattacaaaactgcaccataggttggtacaaatggaataagtatagcactttagacactgtggagtacattgaatacctgaactttggaccaggatcagacacaaggcacagagtcacatggggtggctacagaaagaactgcagtgaagacatagccaagcagtttacagctgaagtttttctacatggagccagtgagtggttagagtccattggttttcccctagttcatggctcataaggaaacattgacacg

SEQ ID NO: 2486 - DNA, 2747 bp, Arabidopsis thaliana
catctcactcaaaaccacttctctatactccagttttcaaaaactttctcactgttatctgcgtctcttttttggatcaatggcaaacgctgaacgtatgataacgcgcgtccacagccaacgtgagcgtttgaacgaaacgcttgtttctgagagaaacgaagtccttgccttgctttccagggttgaagccaaaggtaaaggtattttacaacaaaaccagatcattgctgaattcgaagctttgcctgaacaaacccggaagaaacttgaaggtggtcctttctttgaccttctcaaatccactcaggaagcaattgtgttgccaccatgggttgctctagctgtgaggccaaggcctggtgtttgggaatacttacgagtcaatctccatgctcttgtcgttgaagaactccaacctgctgagtttcttcatttcaaggaagaactcgttgatggagttaagaatggtaatttcactcttgagcttgatttcgagccattcaatgcgtctatccctcgtccaacactccacaaatacattggaaatggtgttgacttccttaaccgtcatttatcggctaagctcttccatgacaaggagagtttgcttccattgcttaagttccttcgtcttcacagccaccagggcaagaacctgatgttgagcgagaagattcagaacctcaacactctgcaacacaccttgaggaaagcagaagagtatctagcagagcttaagtccgaaacactgtatgaagagtttgaggccaagtttgaggagattggtcttgagaggggatggggagacaatgcagagcgtgtccttgacatgatacgtcttcttttggaccttcttgaggcgcctgatccttgcactcttgagacttttcttggaagagtaccaatggtgttcaacgttgtgatcctctctccacatggttactttgctcaggacaatgttcttggttaccctgacactggtggacaggttgtttacattcttgatcaagttcgtgctctggagatagagatgcttcaacgtattaagcaacaaggactcaacattaaaccaaggattctcattctaactcgacttctacctgatgcggtaggaactacatgcggtgaacgtctcgagagagtttatgattctgagtactgtgatattcttcgtgtgcccttcagaacagagaagggtattgttcgcaaatggatctcaaggttcgaagtctggccatatctagagacttacaccgaggatgctgcggttgagctatcgaaagaattgaatggcaagcctgaccttatcattggtaactacagtgatggaaatcttgttgcttctttattggctcacaaacttggtgtcactcagtgtaccattgctcatgctcttgagaaaacaaagtacccggattctgatatctactggaagaagcttgacgacaagtaccatttctcatgccagttcactgcggatattttcgcaatgaaccacactgatttcatcatcactagtactttccaagaaattgctggaagcaaagaaactgttgggcagtatgaaagccacacagcctttactcttcccggattgtatcgagttgttcacgggattgatgtgtttgatcccaagttcaacattgtctctcctggtgctgatatgagcatctacttcccttacacagaggagaagcgtagattgactaagttccactctgagatcgaggagctcctctacagcgatgttgagaacaaagagcacttatgtgtgctcaaggacaagaagaagccgattctcttcacaatggctaggcttgatcgtgtcaagaacttgtcaggtcttgttgagtggtacgggaagaacacccgcttgcgtgagctagctaacttggttgttgttggaggagacaggaggaaagagtcaaaggacaatgaagagaaagcagagatgaagaaaatgtatgatctcattgaggaatacaagctaaacggtcagttcaggtggatctcctctcagatggaccgggtaaggaacggtgagctgtaccggtacatctgtgacaccaagggtgcttttgtccaacctgcattatatgaagcctttgggttaactgttgtggaggctatgacttgtggtttaccgactttcgccacttgcaaaggtggtccagctgagatcattgtgcacggtaaatcgggtttccacattgacccttaccatggtgatcaggctgctgatactcttgctgatttcttcaccaagtgtaaggaggatccatctcactgggatgagatctcaaaaggagggcttcagaggattgaggagaaatacacttggcaaatctattcacagaggctcttgacattgactggtgtgtatggattctggaagcatgtctcgaaccttgaccgtcttgaggctcgccgttaccttgaaatgttctatgcattgaagtatcgcccattggctcaggctgttcctcttgcacaagatgattgaagagaagagaaaagactcggaaccagtaaagagtttgaagagagtggttccggtgtttgaagaataaaacaagatctccttttgattcttattatcattcggattgggaagcgcattttgtgttcctctgcttctttgttatttcaatcatttgtctttgttttcctttgcctctgtggcattgctttgaattctggctgttgggagattccccttctaattgcagtaaagtgtcttttgc

SEQ ID NO: 2487 - DNA, 2760 bp, Arabidopsis thaliana
catctcactcaaaaccacttctctatactccagttttcaaaaactttctcactgttatctgcgtctcttttttggatcaatggcaaacgctgaacgtatgataacgcgtgtccacagccaacgtgagcgtttgaacgaaacgcttgtttctgagagaaacgaagtccttgccttgctttccagggttgaagccaaaggtaaaggtattttacaacaaaaccagatcattgctgaattcgaagctttgcctgaacaaacccagaagaaacttgaaggtggtcctttctttgaccttctcaaatccactcaggaagcaattgtgttgccaccatgggttgctctagctgtgaggccaaggcctggtgtttgggaatacttaagagtcaacctccatgctcttgttgttgaagaactccaacctgctgagtttcttcatttcaaggaagaactcgttgatggagttaagaatggtaatttcactcttgagcttgatttcgagccattcaatgcgtctatccctcgtccaacactccacaaatacattggaaatggtgttgacttccttaaccgtcatttatcggctaagctcttccatgacaaggagagtttgcttccattgcttaagttccttcgtcttcacagccaccagggcaagaacctgatgttgagcgagaagattcagaacctcaacactctgcaacacactttgaggaaagcagaagagtatctagcagagcttaagcccgaaacactgtatgaagagtttgaggccaagtttgaggagattggtcttgagaggggatggggagacaatgcagagcgtgtccttgacatgatccgtcttcttttggaccttcttgaggcgcctgatccttgcactcttgagacttttcttggaagagtaccaatggtgttcaacgttgtgatcctctctccacatggttactttgctcaggacaatgttcttggttaccctgacactggtggacaggttgtttacattcttgatcaagttcgtgctctggagatagagatgcttcaacgtattaagcaacaaggactcaacattaaaccaaggattctcattctaactcgacttctacctgatgcggtaggaactacatgcggtgaacgtctcgagagagtttatgattctgagtactgtgatattcttcgtgtgcccttcagaacagagaagggtattgttcgcaaatggatctcaaggttcgaagtctggccatatctagagacttacaccgaggatgctgcggttgagctatcgaaagaattgaatggcaagcctgaccttatcattggtaactacagtgatggaaatcttgttgcttctttattggctcacaaacttggtgtcactcagtgtaccattgctcatgctcttgagaaaacaaagtacccggattctgatatctactggaagaagcttgacgacaagtaccatttctcatgccagttcactgcggatattttcgcaatgaaccacactgatttcatcatcactagtactttccaagaaattgctggaagcaaagaaactgttgggcagtatgaaagccacacggcctttactcttcccggattgtatcgagttgttcatgggattgatgtgtttgatcccaagttcaacattgtctcccctggtgctgatatgagcatctacttcccttacacagaggagaagcgtagattgactaagttccactctgagatcgaggagctcctctacagcgatgttgagaacaaagagcacttatgtgtgctcaaggacaagaagaagccgattctcttcacaatggctaggcttgatcgtgtcaagaacttgtcaggtcttgttgagtggtacgggaagaacacccgcttgcgtgagctagctaacttggtggttgttggaggagacaggaggaaagagtcaaaggacaatgaagagaaagcagagatgaagaaaatgtatgatctcattgaggaatacaagctaaacggtcagttcaggtggatctcctctcagatggaccgggtaaggaatggtgagctgtaccggtacatctgtgacaccaagggtgcttttgtccaacctgcattatatgaagcctttgggttaactgttgtggaggctatgacttgtggtttaccgactttcgccacttgcaaaggtggtccagctgagatcattgtgcacggtaaatcaggtttccacattgacccttaccatggtgatcaggctgctgatactcttgctgacttcttcaccaagtgtaaggaggatccatctcactgggatgagatctcaaaaggagggcttcagaggattgaggagaaatacacttggcaaatctattcacagaggctcttgacattgactggtgtgtatggattctggaaacatgtctcgaaccttgaccgtcttgaggctcgccgttaccttgaaatgttctatgcattgaagtatcgcccattggctcaggctgttcctcttgcacaagatgattgaagagaagagaaaagactcggaaccagtaaagagtttgaagaataaaacaagagatctccttttgattcttattatcattcggatttgggagcgcattttgtgttcctctgcttctttgttatttcaatcatttgtctttgttttcctttgcctctgtggcattgctttgaattctggctgttgggagattccccttctaattgcagtaaagtgtcttttgcaaaatatttctcaatatttacatcttccagtaa

SEQ ID NO: 2488 - DNA, 2892 bp, Eutrema parvulum
gaatgtgagcaacaacaagactttcatcttattcacttttcctattttcttgcgtctcttcttttctctctctgcagcttccaaaaaaactttcactgttttctgcgtctcatttggatcaatggtgaacggtgcgataacgcgcgtccacagccagcgtgagcgtttgaacgaaacgctcgttgatcagagaaacgaagtccttgccttgctttccagggttgaagccaaaggtaaaggtatcctgcaacaaaaccagatcattgctgaattcgaggctttgcctgaagaaacccagaagaagattgaaggtggtgctttcttcgaccttcttaaaaccactcaggaagcaatcgtgttgccaccatgggttgctcttgctgtgaggccacggcctggtgtttgggagtatctaagagtcaatctccatgcgcttgttgttgaggagcttcaacctgctgagtttctccatttcaaagaagaacttgttgatggagttaagaatggtaattttacgcttgagctcgattttgagccattcaatgcgtctgtccctcgcccaacgctccccaaatacattggagatggtgttgaattccttaaccgtcacctctcggctaagctcttccatgacaaggagagtttgcttccattgcttaagttccttcgtctacacagccacgggggaaagaccctgatgttgaacgagaaaattcaaaacctcaatactctgcaacacatcttgaggaaagcagaggagtatcttgccgagctaaagcccgaaacaccgtatgaagactttgaggccaagtttgaggagatcggtctcgagaggggatggggaaacaatgccgagcgtgtccttgacatgatccgtcttcttttggaccttcttgaggcccctgacccttgcactctagagaactttcttggaagaatcccgatggtgttcaatgtcgtgatcctctctccacatggttactttgctcaagacaatgttctgggttaccctgacactggtggtcaggttgtttacattctggatcaagttcgtgccttggagacagagatgctccaacgtattaagcaacaaggactcaacattactcccagaattcttattctcactcgactgctccctgatgccgtaggaaccacatgtggtgagcgtcttgagcgagtggatggatctgagtactgtgatattctccgtgtgcccttcagaacagaaaagggtattgttcgtaaatggatttcaagatttgaagtctggccatatctggagacttacacggaggatgctgcggtcgagcttgctaaagagttgaaggggaagcctgaccttatcattgggaactacagtgacggaaacctcgttgcctctttattggcacacaaacttggtgttacgcagtgtaccattgctcacgctctggagaagacaaagtacccggattccgatatctactggaagaagcttgacgataagtaccatttctcatgccagttcactgcggatctgtttgccatgaaccacactgatttcatcatcaccagtactctccaagaaattgctggaagcaaggacactgttgggcagtatgagagccacacagcctttacccttcccggactataccgagttgttcacgggatcgatgtgtttgatcccaagttcaacatcgtttcccctggtgctgatatgagcatctacttcccttacacagaagagaagcgtagattgactaaattccatcccgagatcgaggagctcctctacagcgatgttgaaaacgaagagcacttatgtgtgctcaaggacaagaagaagccgatcctcttcacgatggctaggctcgaccgtgtcaagaacttgtcaggtcttgttgagtggtacggaaaaaacacacgcctgcgtgagctggttaacttggttgttgtgggaggagacaggaggaaagagtcaaaggacaacgaagagaaggctgagatgaagaaaatgtatgatctcattgaggaatacaagctcaacggtcagttcaggtggatttcttcccagatgaaccgggttaggaacggtgagctctaccgttacatttgtgacaccaagggtgcgtttgtgcaacccgcactgtatgaagcctttggtttgactgttgtggaggccatgacctgtggtttaccgactttcgccacttgcaaaggtggtccagctgagatcatagtgcacggtaaatcgggattccacattgacccttaccatggtgatcaggctgctgaaactcttgctgatttcttcaccaagtgtaaggaagatccatctcactgggaccagatctcaaagggagggcttcagaggatagaggagaaatacacctggcagatttactcacagaggctcctcacattgaccggtgtgtatggattctggaagcatgtctcgaaccttgaccgtcttgagagccgccgttaccttgagatgttctatgcattgaagtaccgcccactggtatgcattctctcatccttggtgccttgttaatcacttgattggtctcgaaagaatgaaacttggtttgtctctgatgggtttctctactgttcttttgcgtcttataggctcaggctgttcctctagctgaggaggaatgaagatgagagaaaagatgcggaaccatcaaagagcttgaaaagaaaggttcctctgtttaaagaataaaacaaaaatctcttgtgattcttaatatcatttagattgaaggagcgcttgtgtgttcctctgcttctttgttaattcactccttttgtctttgttttttcctttgcctctccggcaatgccttgtattctgattgttgagggatatccctaattggcaatgaaatttcgatt

SEQ ID NO: 2489 - DNA, 2659 bp, Brassica napus
gtttccaaaaacactttctgttgtctcttttggatcaatggtgaacggtgtgttaacgcgcgtccacagccaacgtgagcgtttgaatgaaacgctcgttgctcaaagaaacgaagtccttgccttgctttccagggttgaagccaaaggtaaaggcatcctgcaacaaaaccagatcattgctgaattcgaggctttgcctgaagaaacccagaagaagattgaaggtggtgctttcttcgaccttctcaaaacaactcaggaagcaatagtgttgccaccatgggtagctcttgccgtgaggccaaggcctggtgtgtgggaatacataagagtcaatctccatgctcttgtggttgaggagcttcaacctgctgagtttcttcatttcaaagaagaacttgttgatggagttaagaatggtgatttcacactagagcttgattttgagccattcaacgcgtctgtccctcgcccaacgctccccaagtacattggagacggtgttgagttccttaaccgtcacctctcagctaagctcttccatgaaaaagacagtttgcttcccttgcttaagttccttcaacttcacagccaccagggaaagaccctcatgctgaacgagaaaattcaaaacctcaacactcttcaacacatcttgaggaaagctgaggagtatctagccgagctttcacccgaaacaccgtacgaagactttgaggccaagtttgaggagattggtcttgagaggggatggggaaacaacgccgagcgtgtccttgacatgctccgtcttcttttagaccttcttgaggcccctgacccttgcactctcgagacctttctcggaagaatcccaatggtgttcaacgttgtgatcctctctccacatggctactttgctcaggacaatgtccttggttaccctgacactggcggtcaggttgtttacattctggatcaagtccgtgccttggagacagagatgctgcaacgtattaagcagcaaggactcaacattactccaagaatcctcattctcactagacttctccctgatgcggtgggaaccacatgtggtgagcgtcttgagagagtagatggatctgagtactgtgatattctccgtgtgcctttcagaacagagaagggtatagttcgcaaatggatctcaagatttgaagtctggccatatcttgagacttacaccgaggatgctgccgttgagcttgccaaagagttgaaagggaagcctgaccttatcattgggaactacagtgatggaaaccttgttgcctctttgttggcacacaaacttggtgtcactcagtgtaccattgctcacgctctggagaaaacaaagtaccctgattcagacatctactggaagaagcttgacgacaagtaccatttctcatgccagttcactgctgatttgtttgcaatgaaccacactgatttcatcatcaccagcactctccaagaaattgctggaagcaaggacactgttggacagtacgagagccacacggccttcactcttccaggactgtaccgtgttgttcacggaatcgatgtgtttgatcctaagttcaacattgtctcccctggtgctgatatgagcatctacttcccttacacagaggagaagcggaggttgactaagttccaccctgagatcgaggagctactctacagcgatgttgaaaaccaagagcacttatgtgtgctcaaggacaagaagaagcccatcctcttcacgatggctagactcgaccgcgtcaagaacctatcaggtctcgttgagtggtacgggaagaacaaacgcctccgcgagcttgttaacttggtggttgtcggaggagacaggaggaaagaatccaaagacaacgaagagaaggccgagatgaagagaatgtatgacctcattgatgaatacaagctgaacggtcagttcaggtggatctcctctcagatgaacagggttaggaacggtgagctctaccgttacatctgtgacaccaagggagcctttgtgcagcctgcgttgtatgaagcctttggtctgactgttgtggaggctatgacctgtgggttaccgactttcgccacttgcaaaggtggtccagctgagatcattgtgcacggcaagtcaggcttccacattgacccgtaccatggtgatcaggctgctgatactcttgctgacttcttcacaaagtgtaaggaagatccgtctcactgggatgagatctctaagggagggcttcagaggattgaggagaagtacacgtggcagatatactcacagaggcttctgacattgactggtgtgtatggattctggaagcatgtttctaaccttgaccgtcttgagagccgccgttaccttgagatgttctatgcattgaagtatcgcccactggctaaggctgttcctcttgctgaggaggaatgaagaagatgtgtgaagaattaaagagcttgaagagagaaagaggttgcagtgtgtgaagaataacaaaaaatctcttttgattcttactgtcattttgattttaggagcgctttttgtgttcctttgcttctttgttattttcaatccttttgtctttgttttatcattggcctctgcggcaatgcgttgtattctgattgt

SEQ ID NO: 2490 - DNA, 2440 bp, Eutrema parvulum
ttgattgtgttgaaaatggcaaacgcggaacgtgtgctaacgcgtgtccagagccaaagagatcgtttggatgagacgcttgttgctcaaagaaacgaagtccttgctttgctctcaaggattgaagccagaggtaaaggcattctgcaacatcaccagatcattgctgaatttgaggcaatgcctaaagaaatacaaagtaagcttgaaggtggagctttcttcgaacttcttcgatcaactcaagaagcaattgtgttgcttccatgggttgctttagctgttaggccaagacctggagtttgggaatacataagagtaaacctccatgctctggttgttgacgagcttcaagcttctgagtatcttcacttcaaggaagagctcgttgatggaactaacaatggtaactttactctcgagcttgactttgagccattcaacgctacattccctcgtcctacgctctccaaatacattggagatggtgttgagttcctcaatcgccatctctcagctaagctcttccacgacaaggagagcttgcatcctctactcaagtttctccgtctccatagccatgagggcaagactctgatgcttaacgacaggatccagaacctaaacacattgcaacgcattctgaggaaagcagaggagtatctcatggagctcaaacccgagacattgtactcggagtttgaacacaagttccaggagattggtctggagagaggttggggagataccgcggagcgtgtcctggacatgatccgtcttcttcttgatcttctcgaggcacctgacccttgcactcttgagaatttccttggaaggatcccaatggtttttaacgttgtgatcctctctccgcatggctattttgctcaggacaatgttcttggttaccctgacactggtggtcaggttgtttacattcttgatcaagttcgtgctcttgaaacagagatgctccaacgcataaaacaacaaggactcaacatcactccaagaatcctcattatcactcggctgcttcctgatgcaacaggaaccacatgtggtcaacgtctagagaaagtgtatggttctcagtattgtgatatcctccgtgtacctttcagaacagagaagggtatcgttcgaaaatggatttcgaggttcgaggtctggccttatctagagattttcactgaggatgttgcaactgagatctccagagagttgcaggggaagcctgaccttatcattggaaattacagtgatggtaaccttgttgcttctttgttggcacacaaacttggtgtcactcagtgcaccattgctcatgctctagagaagaccaagtacccggattctgatatctattggaagaagcttgacgagaagtaccacttctcttgccagttcacggctgatcttatagccatgaaccacacagatttcatcatcacaagtactttccaagaaattgcgggaagcaaggacactattggtcaatatgagagccacacagccttcacactccccggactgtaccgtgtagttcatggtattgatgtgtttgatcccaagttcaacattgtttctcctggcgcggatatgagcatctacttcgcttacacagaggagaatcgtagattaacctcgttccatcaagagctcgaggagcttctttatagcgatgttgagaacgaggagcatctatgtgtgctcaaggacaagaacaagccaatcatcttcaccatggctaggcttgaccgtgttaagaatttgtcaggtcttgttgagtggtacgggaagaactctcgcctgcgtgaactagtcaacttggtggttgtgggtggagacagaaggaaagagtcacaagacaatgaagagaaggccgagatgaagaaaatgtatgacctgattgaggagtacaaacttaatggacaattcagatggatttcctcacaaatgaacagagtgagaaacggtgagctttaccgttacatatgtgacactaaaggtgcatttgtgcagcctgctctgtatgaagcctttggattgactgttgttgaggctatgacctgcgggttaccgactttcgccacttgtaatggtggccctgctgagatcattgtccatggaaaatctggtttccacattgatccataccacggtgaccaggcggctgagactcttgctgatttcttcaccaaatgtaagcaagacccatcacattgggaccagatctcaatgggagggcttcagaggattcaggagaaatatacttggcaaatatattcacagcggctccttacattgactggtgtctacggcttctggaagcatgtctcgaaccttgaccgtcttgagagccgtcggtaccttgagatgttctacgcactcaagtatcgcccactggtacgcactgaccacacttcattcgacactt

SEQ ID NO: 2491 - DNA, 3207 bp, Brassica napus
aataaaaaaatgtcaaggcaataatgcttagatacaagataggccttgacaacgagaaacagcatcatattctcttacattattagttctttctttacattaaaaaaaagcatataataaaagttcaccagccgaaaaagacagaagcccaaagtgttgatcaaatcttcaaacgttaaaacgtcagatgcaacctcccaacattatggattcgatttccttgtcggaaacaggagtgcgtttcggctggagtgatgctttccctccatcagcaatgttcttcggcgccgccgggacatctgaactcgccgtcacgttcctcttgccgccggcaccagatccctgcgctggtccagaacctgatgaagtagaaggagaggaagatgaagaatgtctctgaggaaatttgatacgaggaattctcttcatcttctgcttcctattgattcttgagttgagagatactgtgcctcttgatcttaattttctctctgcagtttccaaaaacactttctgttgtctcttttggatcaatggtgaacggtgtgttaacgcgcgtccacagccagcgtgagcgtttgaatgaaacgctcgttgctcaaagaaacgaagtccttgccttgctttccagggttgaagccaaaggtaaaggcatcctgcaacaaaaccagatcattgctgaattcgaggctttgcctgaagaaacccagaagaagattgaaggtggtgctttcttcgaccttctcaaaaccactcaggaagcaatagtgttgccaccatgggtagctcttgctgtgaggccaaggcctggtgtgtgggaatacataagagtcaatctccatgctcttgttgttgaggagcttcaacctgctgagtttcttcatttcaaagaagaacttgttgatggagttaagaatggaaatttcacactagagcttgattttgagccattcaacgcgtctgtccctcgcccaacgctccccaagtacattggagacggtgttgagttccttaaccgtcacctctctgctaagctcttccatgaaaaagacagtttgcttccattgcttaagttccttcaacttcacagccaccagggaaagaccctcatgttgaacgagaaaattcaaaacctcaacactcttcaacacatcttgaggaaagctgaggagtatctagccgagctttcacccgaaacgccttacgaagactttgaggccaagtttgaggagattggtcttgagaggggatggggaaacaacgccgagcgtgtccttgacatgctccgtcttcttttggaccttcttgaggcccctgacccttgcactcttgagacctttctcggaagaatcccaatggtgttcaacgttgtgatcctctctccgcatggctactttgctcaggacaatgtccttggttaccctgacactggtggtcaggttgtttacattctggatcaagtccgtgccttggagacagagatgctgcaacgtattaagcagcaaggactcaactttactccaagaatcctcattctcactagacttctccctgatgcggtgggaaccacatgtggtgagcgtcttgagagagttgatggatctgagtattgtgatattctccgtgtgcccttcagaacagagaagggtatagttcgcaaatggatctcgagattcgaagtctggccatatcttgagacttacaccgaggatgctgccgttgagcttgccaaagagttgaaggggaagcctgaccttatcattgggaactacagtgatggaaacctcgttgcctctttgttggcacacaaacttggtgtcactcagtgcaccattgctcacgctctggagaagacaaagtaccctgattcagatatctactggaagaagcttgacgacaagtaccatttctcatgccagttcactgcggatttatttgcaatgaaccacactgacttcatcatcaccagtactctccaagaaattgctggaagcaaggacactgttggacagtacgagagccacacagccttcactcttccaggattgtaccgtgttgttcacggaatcgatgtgtttgatcccaagttcaacattgtctcccctggtgctgatatgagcatctacttcccttacacagaggagaagcgaaggttgactaagttccaccctgagatcgaggagctactctacagcgatgttgagaaccaagagcacttatgtgtgctcaaggacaagaagaagcccatcctcttcacgatggctagactagaccgcgtcaagaacctatcaggtctggttgagtggtacgggaagaacaaacgcctccgcgagcttgttaacttggtggttgttggaggagacaggaggaaagaatccaaagacaacgaagagaaggctgagatgaagaaaatatatgacctcattgatgagtacaagctgaatggtcagttcaggtggatctcttcccagatgaacagggttaggaacggtgagctctaccgttacatctgcgacaccaagggagcctttgtgcagcctgcgttgtatgaagcctttggtctgactgttgtggaggctatgacctgtggtttaccgactttcgccacttgcaaaggtggtccagctgagatcattgtgcacggcaagtcaggcttccacattgacccgtaccatggtgagcaggctgctgatactcttgctgacttcttcactaagtgtaaggaggatccgtctcactgggatgagatctctaagggagggcttcagaggattgaggagaagtatacatggcagatttactcacagaggcttctgacgttgactggtgtgtatgggttctggaagcatgtttcgaaccttgaccgtcttgagagccgccgctaccttgagatgttctatgcgctgaagtatcgcccactggctaaggctgttcctcttgctgaggaggaatgaagaagatgtgtgaagaattaaagagcttgaagagagaaagaggttgcagtgtgtgaagaataacaaaaaatctctttttgattcttactgtcattttgattttaggagcgctttttgtgttcctttgctttgttattttcaatccttttgcctctccggcaatgcgttgtattctgattgttgagggaatgaaatttcgatttttctttctttgaaatttgtctttgcattgtctttcacaatactgtatttc

SEQ ID NO: 2492 - DNA, 2687 bp, Brassica napus
aaacgctcgttgctcaaagaaacgaagtccttgccttactttccagggttgaagccaaaggtaaaggcatcctgcaacaaaaccagatcgttgctgaattcgaggctttgcctgaagaaacccagaagaagattgaaggtggtgctttcttcgaccttctcaaaaccactcaggaagcaatagtgttgccaccatgggtagctcttgctgtgaggccaaggcctggtgtttgggagtacataagagttaatctccatgctcttgttgttgaggagcttacacctgctgagtttcttcatttcaaggaagagcttgttgatggagttaagaatggtgatttcacgcttgagcttgactttgagccatttaatgcctctgtccctcgcccaactctccccaagtacattggagacggtgttgagttccttaaccgtcacctctcggctaagctcttccatgacaaggagagtttgcttcctttgcttaagttccttcgactacacagccaccaggggaagaccttgatgttgaacgagagagttcaaaacctcaacagtctgcaacacatcttgaggaaggcagaggagtatctggcaggtcttgcacctgaaacgccttatgaagattttgaggccaagtttgaggagattggtcttgagaggggatggggaaacaatgccgaacgtgtccttgacatgatccgtcttcttttggacctccttgaggcgcctgatccttgcactcttgagaactttcttggaagagtccctatggtgttcaacgttgtcatcctctctccacatggttacttcgctcaggacaatgttcttggttaccctgacactggtggtcaggttgtttacattctggatcaagtccgtgccatggagacagagatgctccaacgaattcagcagcaaggactcaacattactccaaggattctcattctcactagactgctccctgatgcggtaggaaccacatgtggcgagcgtctcgagagagttgatggatctgagtactgtgatattctccgtgtgcccttcagaacagagaagggtatagttcgcaaatggatatcaagattcgaagtctggccatatctagagacttacaccgaggatgctgccgtcgagcttgccaaggagttgaagggcaagcctgaccttatcattggtaactacagtgatggcaacctcgttgcctctttgttggctcacaaacttggtgtcactcagtgtactattgctcacgctctggagaagacaaagtaccctgactctgatatctactggaagaagcttgacgataagtaccatttctcatgccagttcactgcggatctatttgcaatgaaccatactgatttcatcatcaccagtactctccaagaaattgctggaagcaaggacaccgttgggcaatatgagagccacacggcctttactcttcctggactgtaccgagttgttcatgggatcgatgtttttgatcccaagttcaacattgtctcccctggtgctgacatgagcatctacttcccttacactgaggagaagcgtagattgactaagttccaccctgagattgaggagcttctctacagcaatgttgaaaacgaagagcacttatgtgtgcttaaggacaagaagaagccaatcctcttcacgatggctaggctcgaccgtgtcaagaacttgtcaggtcttgttgagtggtacgggaagaacaaacgcctgcgtgagcttgttaacttggtggttgttggaggagacaggaggaaagagtcaaaggacaatgaagagaaggctgagatgaagaaaatgtatgacctcattgatgaatacaagctcaacggccagttcaggtggatctcatcccagatgaacagggttaggaacggtgagctctacaggtacatctgtgacaccaagggtgcttttgtgcaaccagcattgtatgaagccttcggtctgactgttgtggaggctatgacctgtgggttaccaacattcgccacttgcaaaggtggtccagctgagatcattgtccacggcaaatcaggtttccacattgacccttaccatggtgatcaggcggctgatactcttgctgatttcttcaccaagtgtaaggaagatccatctcactgggaccagatctcaaagggagggcttcagaggattgaggagaaatacacgtggcagatttactcacagaggctcttgacattgactggtgtgtatggattctggaagcatgtgtcgaaccttgaccgtcttgagagccgtcgttaccttgagatgttctatgccttgaagtatcgcccactggctcaggctgttcctcttgctcaagagtaatgaagaaaagagagaaaaaatgtggaaccattgaagagcttgagataaaggttccagtgtttgaagaataacaaaattctcttttgattcttattatcatttggatttaggagcgcttttgtgttcctcttgcttactttgttgtttcaatccttttgtctttgtgtattttcttttccttgtctttccggcaatggtttgtactctgattgttgagggatctcccttatgattgcaatgagaataatacgagcgtgtttgagaaggggaggagagaacggccgcgaagaataagggagtaaccacagactatacaatatc

SEQ ID NO: 2493 - DNA, 2971 bp, Chelidonium majus
tttccatccaaagttcaattctctcatcaccttgttctacaatctgattttacttcattttgtctgatttaagactagatttccagggattttttgtgatttttgagtattcaagtgaaccaagtcatgccggaacgtgttcttactcgtgttcatagtcaccgagagcgattcgacgaggctcttacatcttaccggaacgaattgttagctctcctagcaaggcttgaaagccaggggaaaggaattttacaaccccatcatctcttagctgaggttgaagcaatattccaaggggataagaataaactatccgaaggtgtgtttggcgaagttttacgatccactcaggaagcaatagttttaccaccatggatcgcgcttgctgttcgtcctaggcccggtgtttgggaatatattcgtgtgaatctgaatgcactggtcactgatgagttgactgcttctgagtatttgcaattcaaagaagagcttgtcaatggaaggtctaatgataactttacgcttgaattggactttgagcccttcaatgcttcttttccccgccccacactttcaaaatccatcggcaatggcgttcagtttctcaaccgccatctttctgcgaaaatgtttcatgacaaagacagcttgcagccactgcttgattttctcagacaacacaattataagggaatgacaatgatgctgaatgacagagtacaaaacctggatggccttcaatcgattttgagaaaagctgacgaatatctctcactattatctccaagcaccccatattcagaatttgatcacaagtttcaagagattggtttggagaagggttggggtgatactgctgagcgtgtactggagatgattcaactactacttgaccttcttgaggcacccgatccatgtactctagagaattttctcgggagaatcccaatggttttcaatgttgttattctttctccccatggctactttgcccagaatgatgtcttgggctatcctgacactggtggtcagattgtttatattttggatcaagtcaaagccttggagattgagatgcttaaacgtattaagcagcaaggacttgatatcacacccaaaattatcattgtgactcgactgctacctgatgccgtagggactacttgtggtcagcgtaacgagaaagtctttggaacagagtatgcaagcattcttcgagttcccttcagaactgagaagggaattcttcgtaaatggatctctaggtttgaagtatggccttacttggagacattcgcagaggatgtcgcacatgaaattgctggggagttgcagggtaagccagatctggtaattgggaactacagtgatggaaatcttgttgcatctttgttggcacacaaattaaaagtcacacagtgcaccattgcacatgctctggagaaaacaaagtacccagattccgatatatactggaaaaagtttgacgacaagtaccacttctcgtgccagttcacagctgatttatatgccatgaaccatactgattttatcatcactagtaccttccaagagattgctggaagcaaggacaccgttggacaatatgaaagtcacactgcttttactttacctgggctctaccgagttgtccatggaattgatgtttttgatcccaagttcaacattgtctcacccggagctgatatggatgtctacttcccatatacagaggagcagaagcgactcaccgctttccacccagaaattgaggagcttctttacagttcaactcaaaatgaagaacacataggtgtgttgaaggaccgttcgaagccaataatattctcgatggcaaggcttgaccgtgtgaagaacataactggattggttgagtggtatggtaagaattcacgactaagagagttggttaaccttgttgtggtggctggtgaccgaagaaaggaatcaaaggacttggaagagaaagaggagatgaagaagatgtatgcactcattgagacttacaacttaaatggtgatttccggtggatttcctcccagatgaacagggttagaaatggtgagctttaccgttacatagcagacacaaagggtgcctttgtgcagcctgccttttatgaggcgtttgggctcacagttgttgaagccatgacttgtggtctgcccacatttgcaacttctcatggaggtccagcggagatcatagttcatgggaaatctggcttccatattgatccctacctaggtgacaaggctgctgaacttctcgtcggtttcttcgataattgtaagagtgacccgtcacactgggacgaaatctctgcagaaggcctcaagcgcatttacgagaagtatacatggcagatctactctgagaggttgatgacattgtctggagtttatggcttctggaagtttgtttccaaccttgagcgccgtgagactcgtcgttatcttgagatgttttatgctctcaagtaccgtaagttggcactttcagttcccctagctgtcgatgagtagatgaaagattgcgagttccttgggttgaaagcaaagaaagctgtctttatattgaataactttcattgtttgagattgattgcaacttcagatacttaatattgttttgatatgatatttgaattgggtttgatcccctatttttcattcgacgaactggttattgtttttgtctttgtttttttagagtcaagatagaatgttaatgccctaattttctgaattaataaagctcaagttctacttgttcttttttctctacacttatatgcttttccaagttccaaccacattcttttggcaattcacatctttgacctaattggtttaatgtaacctggtgactggtctacaaattacgacatctacggtgacgaccatctctttacttcgtttttttaggagaaccgaattaaagatccaa

SEQ ID NO: 2494 - DNA, 2731 bp, Silene vulgaris
gattttaaggttggctaagaaatggcaggtcgtttaaccagagttcccagtcttaaggagcgcttagatgaaactctaactgctcaacgcaatgaaattctccccttcctttccagaatttcgagtcatgggaagggaattttgcaagctcatgaggtggcggctgagtttgaagcgacatcaggcacgaacaagcttgctgatggcccctttggagatattttgaggcacacccaggaagcaattgttatggctccatggatcactcttgctgttcgaccacgtcctggtgtgtgggagtacatccgtatcaatactgatgctcttgctgttcaggaattaactccctctgaattccttcacatgaaggaagaattggtggacggaaacttgaatggaaactttgtgcttgagcttgattttgagccattcactgcttccgtccctcgcccaactctttccaagtccataggtaatggtgtcgagttccttaacaggcacctctctgctaagatgttccatgacaaagagagcatgcgccctttgctcgacttccttaggatgcaccactacaagggcaagacaatgatgttgaatgacagaatccagaacctggattcccttcagtcagttctccggaaggcagaagattatttgtccgccttacccgctgacacaccctactccgagttcgatcacaaatttcaggaaattggcctggaaagaggatggggagacactgctgagagagtgctcgacatgattcagcttcttctagaccttttggaggctcctgattcttgcaccctcgagaaatttcttggtcagatcccgatggtatttaatgttgtcatcctctcaccgcatggttactttgctcaggctaatgtgctgggttaccctgacactggtggccaggttgtctatatcctagatcaagtccgtgctttggagaatgagatgcttcagcgcatcaagcaacaagggcttgacattgtccctcgcatccttatcataactcgtctactccctgatgcagttggaaccacctgtggccagcgcctcgagaaggtttatggaactgagcattcacacattcttcgtgtacccttcagaaccgagaaaggcattgtcaggagatggatttctcgtttcgaagtttggccttacctagagactttcactgaggatgttgcaaatgaaatcagtggagagctgcaagcgaagcctgatttgatcatcggaaactacagtgacgggaacattgttgcctctcagttagcccacaagctcggagttacgcagtgtacaattgctcatgcattggagaaaaccaagtatccaaactcagacatctactggaagtcattcgaggagaaataccacttttcctgccaattcactgctgatcttattgccatgaaccacactgactttattattaccagtacattccaagagattgctggaaacaaggacactattgggcaatatgaaagtcacatggctttcactcttcctggactctaccgagttgttcatggaatcgatgtatttgaccctaaattcaacattgtctcacctggagccgatttgtctgtctacttcccttacacagaagagaagagaagactcacagccctccatcccgaaattgaagagctgctttatagtgatgtcgagaacgaggagcacacatgtgtgctaaaggcccgaaacaagccaatcatattctcgatggcaagactcgacagggtcaaaaacatgaccggcctcgtcgaatggtatggtaagaacgataagctcagagagcttgttaacctcgtggttgtcgccggtgaccgtaggaaagagtccaaggacacagaagagaaagaagagatgaagaaaatgtgggacctaatcgatcaatataaattaaatggtcagttccggtggatctcagcccaaatgaacagggtcaggaacggtgagctgtacaggtacattgcagacaccaaaggtgcatttgtccagcccgcttactacgaggccttcggtttgaccgtagttgaagccatgacttgtggtctaccaacatttgcgacttgccatggtggaccagccgagatcatagtcaacgggaaatcaggctttcatatcgatccataccatggagaaaaggcgggtgagcttctcgttgatttcttccagaagagcaaggctgatccttctcactgggatgctatatcattggggggactaaagagaattgaagagaaatatacatggaaaatttactctgatagactgctcacccttgctggtgtttacggtttctggaaatatgtctcaaatcttgaccgtcgtgaggctcgtcgttacattgaaatgttccatgccctcaagtaccgcaagcttgcggaggctgtgccattggccgttgaagagtgaaggagagaagacgagggagtgttggcttggtgggactcatggaaaagcggttctctgcttgtcgaaaataactcaaattctttgagattgttgtaatttggaattatttccgtagggtttattgaactctttgttcgtttagtattgcatttagtggcattatctttgtttgtgacggaaaagcttatgctccagtatgtaatgataagaaagaagactgttctctcagtttgagtacttgattcatccctgtaaattcgtcttaggtacaaattcgttgcgaaagcaaaaacatccc

SEQ ID NO: 2495 - DNA, 1127 bp, Sorghum bicolor
gactctgcttcgtttccacgcgcacgaaaccctagactagataaaaattcccctcccctcgtcgcaatccctccttgccgcctccggagccaccgtgagatctgcccggttccgccgcccggaccctaggggactccctcccctccttgatccgttcgggcggccggccggccctccttcaaaaccggggatggtgttctacttcaaggtgcggcccgaggccggcgattacaccatcttcatgggccttgacaagtacgagaacgaggacctcatcaaatacggcttccccgaggacatctggtttcatgtagataagatgtcctctgcacatgtatatgtgagattgaataaaggtcaaacaatggatgacatgagtgagggtttgctggaagactgtgcacagcttgtcaaagctaattccattcaaggtaataaagtcaataacattgatgtagtttatactccatggtacaatttaaagaagaccccttcaatggatgtgggtcaagttggttttcacaaccctaaattggttcgcactattaaagtagaaaagaggatcaatgagattgtgaaccgcctgaataagacaaaggtggaacggaaacctgacttgaaggccgaaagagaggctgttagtgctgctgaaaaggcagaaagaaaggcacagcttagagacaagaaacgtagggaagagatggaaaggcttgagaaagagaagcaggctgatatcaggagctacaagggtctaatggtccaagagaagatgacttccaacaagcaaattgcttctggtagcaagaccctgcaagaacttgaagaagactttatgtgagagggcagacatgataaatgtcacgctgaagatttccttgaactgcttttgtcgaagacagaaggggtatcacaggcttgcgagatactggatctaaacgactcatggggcaggccatggcctgttattgtctcttgctgttgtggtctatgtaaacctgtttacttgctgaaaaaacaacagtgcatgctctaactgtggctgatgtagtggtctgttgttcatcaagttgaaatggtaatggagttctgctttcctggattttttgaacaataaatacatggcagca

SEQ ID NO: 2496 - DNA, 1168 bp, Setaria italica
gaagtcaaaagcttcaaaataaataaaaacagaataagaaaaagccccatcgcttgctctgcttcgtttccacgcgcacggaaccctagataagaatccctctccgattccccagctctcctcgccgcaatccctcctcgccgcctccggagccccggccggttcccgccccgagatcggcccggttccgccgcccggaccccgggggaccctctcccctcctcgatccgttcgggcggccggcgtgagtagtcgggatggtgttctacttcaaggcgcggcccgaggccggcgactacaccatcttcatgggcctcgacaagtacgagaacgaggaccttatcaagtacggattccccgaggacatctggttccatgtagataagatgtcctctgcacatgtatatgtgagactgaataaaggtcagacaatggatgacatgagtgaaggtctgctggaagactgtgcacaacttgtcaaagctaattccattcaaggtaataaggtcaataacattgatgtagtttatactccatggtacaatttgaagaagaccccttcaatggatgtgggtcaagttggttttcacaaccctaaattggttcggactattaaagtagaaaagcggatcaatgagattgtgaaccgcttgaacaagacaaaggtggagcggaagcctgacttgaaggctgaaagagaggctgtgagtgctgctgaaaaggcagaaagaaaggcacagcttagagacaagaaacgtagggaagaaatggagagacttgagaaggagaagcaggctgaaatcaggagctataaggggctgatggtccaagagaagatgacttccaacaagcaaatcgcgtctggcagcaagaccctgcaagagctcgaagaagacttcatgtgaggacaccgacaatgtgtcatgctgaagagagctatctgaagtctgaactgaactgcctctgtcgaagacaggacaggtgtctccggctcggttgcgggccgctgtatgtgatggctcatgggtgggccatgacatgatatgactgttgtccttatggtctctgtagacctgtttgattggtgaaacaacgagaatgcatgcttgaactgtggtgatataatgatcagtttttcatcaatctgaaatggtaatgaaactagggg

SEQ ID NO: 2497 - DNA, 1132 bp, Setaria italica
cagaataagaaaaagccccatcgcttgctctgcttcgtttccacgcgcacggaaccctagataagaatccctctccgattccccagctctcctcgccgcaatccctcctcgccgcctccggagccccggccggttcccgccccgagatcggcccggttccgccgcccggaccccgggggaccctctcccctcctcgatccgttcgggcggccggcgtgagtagtcgggatggtgttctacttcaaggcgcggcccgaggccggcgactacaccatcttcatgggcctcgacaagtacgagaacgaggaccttatcaagtacggattccccgaggacatctggttccatgtagataagatgtcctctgcacatgtatatgtgagactgaataaaggtcagacaatggatgacatgagtgaaggtctgctggaagactgtgcacaacttgtcaaagctaattccattcaaggtaataaggtcaataacattgatgtagtttatactccatggtacaatttgaagaagaccccttcaatggatgtgggtcaagttggttttcacaaccctaaattggttcggactattaaagtagaaaagcggatcaatgagattgtgaaccgcttgaacaagacaaaggtggagcggaagcctgacttgaaggctgaaagagaggctgtgagtgctgctgaaaaggcagaaagaaaggcacagcttagagacaagaaacgtagggaagaaatggagagacttgagaaggagaagcaggctgaaatcaggagctataaggggctgatggtccaagagaagatgacttccaacaagcaaatcgcgtctggcagcaagaccctgcaagagctcgaagaagacttcatgtgaggacaccgacaatgtgtcatgctgaagagagctatctgaagtctgaactgaactgcctctgtcgaagacaggacaggtgtctccggctcggttgcgggccgctgtatgtgatggctcatgggtgggccatgacatgatatgactgttgtccttatggtctctgtagacctgtttgattggtgaaacaacgagaatgcatgcttgaactgtggtgatataatgatcagtttttcatcaatctgaaatggtaatgaaa

SEQ ID NO: 2498 - DNA, 1322 bp, Sorghum bicolor
caaaaaagcgaagaaatatatttaaaaataaatttaatgtcgcccaacaccccgactctgcttcgtttccacgcgcacgaaaccctagactagataaaaattcccctcccctcgtcgcaatccctcgtcgccgcctccggagccaccgtgagatctgcccggttccgccgcccggaccctaggggactccctcccctccttgatccgttcgggcggccggccggccctccttcaaaaccggggatggtgttctacttcaaggtgcggcccgaggccggcgattacaccatcttcatgggccttgacaagtacgagaacgaggacctcatcaaatacggcttccctgaggacatctggtttcatgtagataagatgtcctctgcacatgtatatgtgagattgaataaaggtcaaacaatggatgacatgagtgagggtttgctggaagactgtgcacagcttgtcaaagctaattccattcaaggtaataaagtcaataacattgatgtagtttatactccatggtacaatttaaagaagaccccttcaatggatgtgggtcaagttggttttcacaaccctaaattggttcgcactattaaagtagaaaagaggatcaatgagattgtgaaccgcctgaataagacaaaggtggaacggaaacctgacttgaaggccgaaagagaggctgttagtgctgctgaaaaggcagaaagaaaggcacagcttagagacaagaaacgtagggaagagatggaaaggcttgagaaagagaagcaggctgatatcaggagctacaagggtctaatggtccaagagaagatgacttccaacaagcaaattgcttctggtagcaagaccctgcaagaacttgaagaagactttatgtgatagggcagacatgataaatgtcacgctgaagatttccttgaactgcttttgtcgaagacagaaggggtatcacaggcttgcgagatactggatctaaacgactcatggggcaggccatggcctgttattgtctcttgctgttgtggtctatgtaaacctgtttacttgctgaaaaaacaacagtgcatgctctaactgtggctgatgtagtggtctgttgttcatcaagttgaaatggtaatggagttctgctttcctggattttttgaacaataaatacatggcagcagttatcgtggatattccattctttgcttggagaacggattagggactttcactgttacatatatgctttctgctacgaattttgtcgcaggagtgatagaaatgtaccacatttagcttatatttggagattcttagaattg

SEQ ID NO: 2499 - DNA, 1311 bp, Saccharum officinarum
aaatttaaagccgcccaacaccccgactctgcttcgtttccacgcgcacgaaaccctagactagataaaaattcccctcccctcgattccccaactcccctcgtcgcaatccctcctcgccgcctccggagctaccgtgagatctgcccggttccgccgcccggaccctaggggactctctcccctcctcgatccgttcgggcggccggccggccggccggccttccttcaaaagcgggaatggtgttctacttcaaggtgcggcccgaggccggcgactacaccatcttcatgggccttgacaagtacgagaacgaggacctcatcaaatacggcttccccgaggacatctggtttcatgtagataagatgtcctctgcacatgtatatgtgagattgaataaaggtcaaacaatggatgacatgagtgagggtttgctggaagactgtgcacagcttgtcaaagctaattccattcaaggtaataaagtcaataacattgatgtagtttatactccatggtacaatttgaagaagaccccttcaatggatgtgggtcaagttggttttcacaaccctaaattggttcgcactattaaagtagaaaagaggatcaatgagattgtgaaccgcttgaataagacaaaggtggaacggaaacctgacttgaaggctgaaagagaggctgttagtgctgctgaaaaggcagaaagaaaggcgcagcttagagacaagaaacgtagggaagagatggaaaggcttgagaaagagaagcaggctgatatcaggagctacaagggtctaatggtccaagagaagatgacttccaacaagcaaattgcttctggcagcaagaccctgcaagaacttgaagaagactttatgtgagagggcggacatgataaatgtcatgctggagatttccttgaactgcttctgtcgaagacagaaggggtatcacaggcttgcgagatactggatctaaatgactcatgggcaggccatggcctgttattatctcctcttgctgttgttgtctatgtaaacctgtttacttgctgaaaaaacaacagtgcatgctctaactgtggttgatatagtggtctgttgttcatcaagttgaaatggtaatggagttccgctttcctggatttttcaaacaataaatacatggcagcagttatcgtagatattccattctttgcttggagcatggtttcactgttacatatatgctctctgctacgaattttgttgtaagagtgatagaaatgtaccacatttggcatatatttggtgactcttgaactg

SEQ ID NO: 2500 - DNA, 1250 bp, Panicum virgatum
aagtcaaatgcagaagtaaatttaaataaaataagaaaaataaccccatcgctcctcctgctctgcttcgtttccacgcgcacgaaaccctatataagaatcctctcgattccccggttctcctcgccgcaattccccactctcgccgcccccggttcctccccgagatcggcccggttccgccgcccggaccccgggggactccctcccctcctcgatccgttcgggcggccggccggccggcgtgagtggccgggatggtgttctacttcaaggcgcggcccgaggccggcgactacaccatcttcatgggcctcgacaagtacgagaacgaggacctcatcaagtacggcttccccgaggacatctggttccatgtagataagatgtcctctgcgcatgtatatgtgagactaaataaaggccagacaatggatgacatgagtgaaggtctgctggaagactgtgcacagcttgtcaaagctaattccattcaaggaaataaagtcaataacattgatgtagtttatactccatggtataatttgaagaagaccccttcaatggatgtgggtcaagttggttttcacaaccctaaattggttcggaccatcaaagtcgaaaagaggatcaatgagattgtgaaccgcttgaacaagacaaaggtggagcagaagcctgacttgaaggctgaaagagaggctgtgagtgctgctgaaaaggcagaaagaaaggtgcagcttagagacaagaaacgtagggaagaaatggaaaggcttgagaaggagaagcaagcggaaatcaggagctacaaggggctgatggtccaagagaagatgacttctaacaagcaagtcgcatctggcagcaagaccctccaagagctcgaagaagacttcatgtgagatcatggcaatttgtcatgctgaagctctctgaactgcctctgtcaaagacaggacaggtgtccccagcttgcttgctagccagtgtccgtgatggctcatgggttgggctatgacacgatgtgatgatgttgttgtccttatggtctctgtagacctgtttgattggtgaaacaacgagaatgcatgctcaaaccgtggttgatataatgatcagtttttcatcaatcgtaaatggtaatggtagtgaaacttaattctgtttaatttttctatgataatagtaacagtaatggtaatgcttgagccacggttgaagtcacaaatgagtaatggtattacact

SEQ ID NO: 2501 - DNA, 1138 bp, Pennisetum glaucum
acgcgcacgaaaccctagataagaatcctcccccgattccccaccccacctctcctcgctcgctcgccgcaatccctcctcgccgcctccggagccccggccggctcccgccccgagatcggcccggttccgccgcccggaccccgggggaccccctcccctcctcgatccgttcgggcggccgggcgcgagtgagtagtagtcgggatggtgttctacttcaaggcgcggcccgaggtcggcgactacaccatcttcatgggcctcgacaagcacgagaacgaggaccttatcaagtacggattccccgaggacatctggttccatgtagataagatgtcctctgcacatgtatatgtgagactgaataaaggtcagacaatggatgacatgagtgaaggtctgctggaagactgtgcacaacttgtcaaagctaattccattcaaggaaataaggtcaataacattgatgtagtttatactccatggtacaatttgaagaagaccccttcaatggatgtgggtcaagttggttttcacaactctaaaatggttcggactattaaagtagaaaagcggatcaatgagatagtgaaccgcttgaataagacaaaggtggagcggaagcctgacttcaaggctgaaagagaggctgtgagtgctgctgaaaaggcagaaagaaaggcacagcttagagacaagaaacgtagggaagaaatggaaaggcttgagaaggagaagcaggccgaaatcaggagctacaaggggctgatggttcaagagaagatgacttccaacaagcaaatcgcatctggcagcaagaccctgcaagagctcgaagaagacttcatgtgaggacacagataatgtgtcatgctgaagagctatctgaagtctgaactgtctctgtcaaagacaggacagttgtctccggctcggtcgcgagtcacactgtatgtgatgtttcatgggtgggccatgagatgatatgattgtgttgtccttatggtctctgtagacctgtttgattggtgaaacaacgagaatgcatgcttgaactggtgatataatgatcagttttccatcaatcagaaatggtaatgaaactaagattctgtttgctttttatacgataatg

SEQ ID NO: 2502 - DNA, 1180 bp, Panicum virgatum
tattcaaatagaagtgttaataggataggatgactcaaaaaatgagcacatccacacatgcgctaaatctttttgtttgttactacagggactcacaaatgaatataccttgtgtatacggacacgggacaccgcagaaagtcaaaagcagaaataaataaaacaaaataagaaaaatctccccattgctcctcctgctctgcttcgtttccacgcgcacgaaaccctagataagaatcctctcgattcctcggttctcctcgccgcaattcccccctctcgccgcccccggttccgccccaagatcggcccggttccgccgcccggaccccgggggaccccctctcctcctcgatccgttcgggcggccggccggccagcgtgagtggcagggatggtgttctacttcaaggcgcggcccgaggccggcgactacaccatcttcatgggcctcgacaagtacgagaacgaggacctcatcatgtacggcttccccgaggacatctggttccatgtagataagatgtcctctgcgcatgtatatgtgagactgaataaaggccagacaatggatgacatgagtgaaggtctgctggaagactgtgcacagcttgtcaaagctaattccattcaaggcaataaagtcaataacattgatgtagtttatactccatggtacaatttgaagaagagcccttcaatggatgtgggtcaagttggttttcacaaccctaaattggttcggaccattaaagtagaaaagaggatcaatgagattgtgaaccgcttgaataagacaaaggtggagcggaagcctgacttgaaggctgaaagagaggctgtgagtgctgctgaaaagacagaaagaaaggtacagcttagagacaagaaacgtagggaagaaatggaaaggcttgagaaggagaagcaagcggaaataaggagctacaaggggcttatggtccaagagaagatgacttctaacaggcaaatcgcatctggcagcaagaccctccaagagctcgaagaagactttttttgaacaacatacctgtattatggttaaggaaacgtacacataccagtacaagtatgtataaggatacagagtacagctgtcccccctaactttacaaaaaggacctcgagagaaaagaaaattgcaactaagtccttggtc

SEQ ID NO: 2503 - DNA, 1015 bp, Brachypodium distachyon
ccccacctccccctcgcaggagccgcaaccccccaatcgcccaagtccgccacccgagcccgcgaattctgcgcctttcttctacccgttcgggcggccgtccggcgagcgattagggatggtgttctacttcaaggcacggcccgaggcaggcgactacaccatcttcatggggctcgacaagcacgagaacgaggacctcatcaagtacgggttccccgaggacatctggtttcatgtagataagatgtcctctgcacatgtgtatttgagattgaataaaggtcagacaatggatgacataagtgaaggtgtgctggaagattgtgcccagcttgttaaagccaattccattcaaggtaataaggtgaataacgttgatgttgtttatacaccatggtacaatctgaagaagacaccatccatggatgttggtcaagttggctttcacaactctaaattggtccgcactgttcaagtggaaaagcggatcaatgaggttgtgaaccggttgaacaagacaaaggtggagcggacgcctgacttgaaggctgaaagagaagctgtgagtgctgctgaaaaggcagaaaggaagctgcagcttagagacaaaaaacgtagggaagagatggagaggcttgagaaggagaagcaggctgaaataagaagctacaagggcctgatggtgcaagataagatgacttccaacaaacaggtcgcttctggtagcaagaccttgcaagaactagaagaggacttcatgtgaggcaacaatgcaaagaattcaatcataccgcaagagctctgtaagaactgctgcttctgtcaaagacaggacaggctccgccagctttcaagactcttgacctgatgattccaggcgggatcttgacctgttatgcttcgtactgtaatggcctccgtagatctgtttgatgtgttgagacaaaacagctatctgtgatctaactgcagccgatatgttggtcggtcaattatcaacctgatgtggtaa

SEQ ID NO: 2504 - DNA, 1187 bp, Brachypodium distachyon
gattttatttcaaacaaaaaagtaaagcgaaatcgcttactctgcttcgtttctacgcgcacgaaaccctagaaatcccccgattcccttctccaggtttcccccacctccccctcgcaggagccgcaaccccccaatcgcccaagtccgccacccgagcccgcgaattctgcgcctttcttctacccgttcgggcggccgtccggcgagcgattagggatggtgttctacttcaaggcacggcccgaggcaggcgactacaccatcttcatggggctcgacaagcacgagaacgaggacctcatcaagtacgggttccccgaggacatctggtttcatgtagataagatgtcctctgcacatgtgtatttgagattgaataaaggtcagacaatggatgacataagtgaaggtgtgctggaagattgtgcccagcttgttaaagccaattccattcaaggtaataaggtgaataacgttgatgttgtttatacaccatggtacaatctgaagaagacaccatccatggatgttggtcaagttggctttcacaactctaaattggtccgcactgttcaagtggaaaagcggatcaatgaggttgtgaaccggttgaacaagacaaaggtggagcggacgcctgacttgaaggctgaaagagaagctgtgagtgctgctgaaaaggcagaaaggaagctgcagcttagagacaaaaaacgtagggaagagatggagaggcttgagaaggagaagcaggctgaaataagaagctacaagggcctgatggtgcaagataagatgacttccaacaaacaggtcgcttctggtagcaagaccttgcaagaactagaagaggacttcatgtgaggcaacaatgcaaagaattcaatcataccgcaagagctctgtaagaactgctgcttctgtcaaagacaggacaggctccgccagctttcaagactcttgacctgatgattccaggcgggatcttgacctgttatgcttcgtactgtaatggcctccgtagatctgtttgatgtgttgagacaaaacagctatctgtgatctaactgcagccgatatgttggtcggtcaattatcaacctgatgtggtaataaaacttattttcaatgatttctctcaatgattccattccttgcctggagtacactctcaaacctaaact

SEQ ID NO: 2505 - DNA, 1349 bp, Secale cereale
ctgggctttttttatccgtcttcgttctttttcttcgttcgacacagtagaattaggacaggtggatagcacgaggagtcgctccttacacgactcttattgtcgtgtttaataataaaatagtaaaacgaaatcttctactcagcttcgtttccacgcgcaggaaaccctagaaatccccccacccgattcctctcgccaggatcccccaacacttcctcgtccccggaggcctgagccgtagttcccgacccccaatcgcccaatttcgccgcccgatccccggagtcccacgcccttcttctatccatttgggcgggccgccggaaagcgactcgggatggtgttctacttcaaggcgcggcccgacgccggtgactacaccatcttcatggggctcgacaagcatgagaacgaggacctcatcaagtacggcttccccgaggacatctggttccatgtagataagatgtcctctgctcatgtatatgtgagactgaataaaggtcaaacaatggatgacataagtgaaggtttgctggaagattgtgcccagcttgttaaagcgaactccattcaaggtaataaggtgaataatgttgatgtggtttatacaccatggtacaatctgaagaagacaccatccatggatgtgggtcaagttggctttcacaactctaaattggttaggactgttcaggtagaaaagcgaatcaatgaggttgtcaatcggttgaacaagacaaaggtggagaggacgcctgacttaaaggctgaaagagaagctgtgagtgctgccgaaaaggctgaaagaaagttgcagcttagagacaaaaaacgtaaagaagagatggagaggctcgagaaggagaagcaggctgaaataaggagttacaagggcctgatggtccaagacaagatgacttcgaacaagcaggttgcgtctggcagcaagaccctgcaggaactagaggaggacttcatgtgaggcagcagtgtgacgaattcgatcatactgcaaaagctctctaagaactgattctgtcgaagacaggacaggcattgcccagctttcaagactcttgacctgatgattccaggcggaaccgacctgttactattatgcttcgtattttaatggcatctgtagacctgtttgatctgttgagacaacagctatgtgtgatctagccgtgggtctggtacatggataggttaatcgtgaacccgacatggtaataaaacttattttcaatgatttctctgcaacattggcttgaatattttcattccttaattggagcacggtttgtgaagcctttaactgacctctcgcggaagtgagggcg

SEQ ID NO: 2506 - DNA, 1350 bp, Triticum aestivum
aatcttctactcagcttcgtttccacgcgcaggaaaccctagaaatccccccacccgattcctctcgccaggatcccccaacccttcctcgcctccggaggcccgagccgtagttcccgaccccccagtcgcccaatttcgccgcagcccgatccccggagtcccgctcccttcttctatccatttgggcgggccgccggaaagcgactcgggatggtgttctacttcaaggcgcggcccgacgccggtgactacaccatcttcatggggctcgacaagcatgagaacgaggacctcatcaagtacggcttccccgaggacatctggttccatgtagataagatgtcctctgctcatgtatatgtgagactgaataaaggtcaaacaatggatgacataagcgaaggtttgctggaagattgtgcccagcttgttaaagcgaactccattcaaggtaataaggtgaataatgttgatgtggtttatacaccatggtacaatctgaagaagacaccatccatggatgtgggtcaagttggctttcacaactctaaattggttcggactgttcaagtagaaaagcgaatcaatgaggttgtcaatcggttgaacaagacaaaggtggagaggacgcctgacttaaaggctgaaagagaagctgtgagtgctgccgaaaaggctgaaagaaagttgcagcttagagacaaaaaacgtaaagaagagatggagaggctcgagaaggagaagcaggctgaaataaggagttacaagggcctgatggtccaagacaagatgacttcgaacaagcaggttgcgtctggtagcaagaccctgcaggaactagaggaggacttcatgtgaggcaacagtgtgacgaattcgatcatactgcaaaagctctctaagaactgattctgtcgaagacaggacaggcatcgcccagctttcaagactcttgacctgatgattccaggcggaaccttgacctgttactgttatgcttcgtactttaatggcatctgtagacctgtttgatgtgttgagacaacagctatgtgtgatctagccgtgggtccgatacatggatcggttaatcgtgaacccgacatggtaataaaacttattttcaatgatttctctgcaacattggcttgaatattttcattccttaactggagcacggtttgggaagcctttaattgacctgtcacggaagtgaggccgaaggtctcttttttgttagacattaacgtcaagacccacctgtttgaatttggttattccaacatctggcagcagaacttgttactttcatatgcttcagccttcagtgttcccctttggattttg

SEQ ID NO: 2507 - DNA, 1503 bp, Oryza sativa
caacaagtcaaaaaagaaaagaaaaagaaaacaacaactctgcttcgtttccacgcgcagggagggagagggaagacggaaccctatacttgcgattgagtccaactgacctgtatttttgcgattttccgttaacatcgtattatttcccaaaaaaaattccaccgcttgcagccgcgcgtgcacaaccatccctcctctcctcctcatttgttcgaaaccagtggaaatctagggtttcgacggctcgcgagtggaggtcgccaggctcgtcgccccgtcctcgccggcgggagggccggtctcatcctccctctctttcgctcgtagccatcgctctcttccactggttcgctctctccgtcaaaccgtttggtttcgccgcctctctccgttgagctctctgatttttccccgtgcactactcgatctgctccgggcgggcgagcgacttgggggaggatatggtgttctacttcaaggtgcggcccgaggccggcgactacaccatcttcatgggtctcgacaagttcgagaacgaggacctcatcaagtacggcttccccgaggacatctggttccatgtagataagatgtcctctgcacacgtgtatttgagattaaataaaggtcagacaatggatgacataagtgaaggtgtgcttgaagattgtgcccagcttgtgaaagctaattccattcaaggtaataagactaataacattgatgtggtttatacaccatggtataatctaaagaagactccatccatggatgtgggtcaagttggttttcacaactctaaattggttcggattgtcaaagtagaaaaacggattaatgagattgtgaaccggctgaataagacaaaagtggagcgcaagcctgacttaaaggctgaaagagaagctgtgagtgcagcagaaaaggcagagagaaaggtgcagcttagagataaaaaacgtagggaagagatggagagggttgagaaggagaagcaggctgaaatcaggagctacaagaacctgatggtccaagagaagatgacttccaacaagcaggttgcatctggtagcaagaccttggaagaactagaggatgacttcatgtgagaagacaaaataacaaattcatactgccagggttctctaaactgtgtttctgtcaaagacaggacaagcatcgccgggttgcaagcttggacaagatgatttctgggcagggccgccttgacctgttatgctacatactctaattggcctgcattgaccttgtttgatgtgttgaaacaaagcattgtgtgatctaactgtggttgatgtattattgattagttaatcatcaacctgatacaagataataaaactcgctttccttgatttttcgacaatgatgaaacgtaagaattttacctaaggtattccattctttccctgtagcaaactttgggaatacagtactgacccatgtgaaatataacggattttgactttttgcttgcac

SEQ ID NO: 2508 - DNA, 1456 bp, Oryza sativa
gtttccacgcgcagggagggagagggaagacggaaccctatacttgcgattgagtccaactgacctgtatttttgcgattttccgttaacatcgtattatttcccaaaaaaaattccaccgcttgcagccgcgcgtgcacaaccatccctcctctcctcctcatttgttcgaaaccagtggaaatctagggtttcgacggctcgcgagtggaggtcgccaggctcgtcgccccgtcctcgccggcgggagggccggtctcatcctccctctctttcgctcgtagccatcgctctcttccactggttcgctctctccgtcaaaccgtttggtttcgccgcctctctccgttgagctctctgatttttccccgtgcactactcgatctgctccgggcgggcgagcgacttgggggaggatatggtgttctacttcaaggtgcggcccgaggccggcgactacaccatcttcatgggtctcgacaagttcgagaacgaggacctcatcaagtacggcttccccgaggacatctggttccatgtagataagatgtcctctgcacacgtgtatttgagattaaataaaggtcagacaatggatgacataagtgaaggtgtgcttgaagattgtgcccagcttgtgaaagctaattccattcaaggtaataagactaataacattgatgtggtttatacaccatggtataatctaaagaagactccatccatggatgtgggtcaagttggttttcacaactctaaattggttcggattgtcaaagtagaaaaacggattaatgagattgtgaaccggctgaataagacaaaagtggagcgcaagcctgacttaaaggctgaaagagaagctgtgagtgcagcagaaaaggcagagagaaaggtgcagcttagagataaaaaacgtagggaagagatggagagggttgagaaggagaagcaggctgaaatcaggagctacaagaacctgatggtccaagagaagatgacttccaacaagcaggttgcatctggtagcaagaccttggaagaactagaggatgacttcatgtgagaagacaaaataacaaattcatactgccagggttctctaaactgtgtttctgtcaaagacaggacaagcatcgccgggttgcaagcttggacaagatgatttctgggcagggccgccttgacctgttatgctacatactctaattggcctgcattgaccttgtttgatgtgttgaaacaaagcattgtgtgatctaactgtggttgatgtattattgattagttaatcatcaacctgatacaagataataaaactcgctttccttgatttttcgacaatgatgaaacgtaagaattttacctaaggtattccattctttccctgtagcacactttgggaatacagtactgacccatgtgaaatataacggattttgactttttgcttgca

SEQ ID NO: 2509 - DNA, 1318 bp, Festuca arundinacea
aaccaaaatccgctactctgcttcgtttccacgcgcacgaaaccctagaaatcccccattatctgtccccaggatccccacctctctcgcgccggaagccgcagttctcgaccgcccctcccaatcgctcaattccgccgcccgaacccgggacttccacgcccttctcctatcggttcaggcggccggccggcgagcgactcaggatggtgttctacttcaaagcgcggcccgacgccggcgactacaccatcttcatggggctcgacaagcatgagaacgaggatctcatcaagtacggcttccccgaggacatctggttccatgtagataagatgtcctctgctcatgtatatttgagactgaataaaggtcagacaatggatagcataagtgaaggtgtgctggaagattgtgcccagcttgttaaagcgaattctattcaaggtaataaggtgaataacgttgatgtggtttatacaccatggtacaatctgaagaagacaccatccatggatgtgggtcaagttgggtttcacaactctaaactggttcggactgttcaagtagaaaagcggctcaatgaggtggtgaaccggttgaacaagacaaaggtggagcggacgcccgacctgaaggctgaaagagaagctgtgagtgctgctgagaaggcagaaagaaaggtgcagcttagagacaaaaaacgcaaggaagagatggagaggatggagaaggagaagcaggctgagataaggagctacaagggcctgatggtccaggacaagatgacttcaaacaagcagattgcgtctggtagcaagaccttgcaggaactagaagaggacttcatgtgagacaacgatgcgacaaattcaattataccgcaagagctctctaagaagtgcttctgtcaaatacaggatagacatgcgctggctttcaagaagacccttgacctgatgattccaggcgggaccttgacctgttgtgcttcgtactttaatgacatctgtaaacctgtttgatgtgtttgagacaacagttgtgtttgatctagccgcagctgatatattggttggttaatcgtggacctgacattgtaataaaacttgttttcggtgatttatctgcgatgagtagaacaggacaacattccattccttacctggagcacactttggggatctttactgatctgccacagaagtggggcgaccaccagcttgtattactttggttgttccaagcttgcattgtgattcctaatcaaatttattctaagtttcttacaaaaaaaaacaaaaaaaaaaaaaaaaaa

SEQ ID NO: 2510 - DNA, 1051 bp, Lolium multiflorum
cccctcccaatcgctcaattccgccgcccgaacccgggacttccacgcccttctcctatcggttcaggcggccggccggcgagcgactcaggatggtgttctacttcaaagcgcggcccgacgccggcgactacaccatcttcatggggctcgacaagcatgagaacgaggatctcatcaagtacggcttccccgaggacatctggttccatgtagataagatgtcctctgctcatgtatatttgagactgaataaaggtcagacaatggatagcataagtgaaggtgtgctggaagattgtgcccagcttgttaaagcgaattctattcaaggtaataaggtgaataacgttgatgtggtttatacaccatggtacaatctgaagaagacaccatccatggatgtgggtcaagttgggtttcacaactctaaactggttcggactgttcaagtagaaaagcggctcaatgaggtggtgaaccggttgaacaagacaaaggtggagcggacgcctgacctgaaggctgaaagagaagctgtgagtgctgctgaaaaggcagaaagaaaggtgcagcttagagacaaaaaacgcaaggaagagatggagaggatggagaaggagaagcaggctgagataaggagctacaagggcctgatggtccaggacaagatgacttcaaacaagcagattgcgtctggtagcaagaccttgcaggaactagaagaggacttcatgtgagacaagacaatgatgcgacaaattcaattataccgcaagagctctctaagaagtgcttctgtcaaagacaggataggcatcgctggctttcaagaagacccttgacctgatgattccaggcgggaccttgacctgttgtgcttggtactttaatgacctctgtaaaccctgtttgatgtgtttgagacaacagttatgtgtgatctagctgcagccgatatattgatcggttaatcgtggacctgacattttaataaaacttgttttacgaaaaaaagtaaaaaacgttaaccgtccggccgaccgaacca

SEQ ID NO: 2511 - DNA, 1511 bp, Amborella trichopoda
agtgtggctgtgcaggctcatataagctttatcaggatccatccctctttgctctttttctctgcttcccttcacctgctaaacctctctctctcttctctctctgctgcaacaacctctctctctctaacttctctctctactgcaacaacctctctgtctctctacttctctctctgctgcaacaacctctctttctctctaacttctctctctactctctgctgcaacaacttctctctctactgcaacaacttctctctctactgcaacaacttctctctctgctgcaacaacctctttttcatccctctgctgcaagtatctttatctatcaacccgttgattatctctctttttctcaaattgtgtctatctcacactgagaatctctgtctccatctatctatctcgggtcttttccattgagaaagtatctatctctctctgtctctgtgcaattcaatcttttggtttgcttgattattaatccgggataaatctgattcgtgaagagactagagagaagatggttttctatttcaaggcaaggccagaggctggggactacacaatattcatgggtttggacaagcacgagaatgaggagcttatcaaatatgggttccctgaagatatatggttccatgttgataagatgtcatctgctcatgtttacgtaagattgaacaagggtcagacaattgatgatattagtgaaggtttactggaagattgtgctcagcttgttaaggcaaattccattcaaggtaataaggtaaacaacgtagatgttgtgtataccccatggtacaacttgaagaaaactccttctatggatgttgggcaagttggttttcacaatcccaaaatggttcgtacagtgagggtggagaagcgcataaatgagattgtaaatagattgaacaagacaaaggttgaaaggaagccagatctgaaagccgaacgggaagctgttaatgctgcagaaagagcagagaggaaacttcaactgagagacaagaaacgacgtgaagagatggagagacttgaaaaggagaaacaggtggagatacggagctacaagggtctcatggtttcagacaagatgacttccaacaagcagattgcttcaacaaacaaatctctgcaggagctcgaagaagacttcatgtgaggtactcatgcatgattatcaccatgaacggggtgactataatcgacacatgagctggaccatgaatctggtaaatgtaatccattattgattgctgtttccattggtctcttttcacctgattttcaattgtgagttttactgagacttgtgaattatgggtaagtaatgtataatccccaccattgggcataatgaacattaatttgggctcatttggtggctctaaatggtactttaccagagctaactggtaattttcttatctctattttactaaactgcttttctcctttttcttgacttggataatactaacagtggatattggtgt

SEQ ID NO: 2512 - DNA, 1035 bp, Avena sativa
ctctctcgccccggaagccgcaggtccctaaccccagtcgctcaatttcgccgcccgaacccgggacttccgcgcccttctcctatccgttcgggcggcccgccggcgagcgactcgggatggttttctacttcaaagcgcggcccgacgccggcgactacaccatcttcatggggctcgacaagcatgagaacgaggacctcatcaagtacgggttccccgaggacatctggttccatgtagataagatgtcctctgctcatgtatatttgagactgaataaaggtcagacaatggatgacataagtgaaggggtgctggaagattgtgcccagcttgttaaagcgaattccattcaaggtaataaggtgaataacgttgatgtggtttatacaccatggttcaatctgaagaagacaccatccatggatgtgggtcaagttggttttcacaactctaaactggttcggactgttcaagtagaaaagcggctcaatgaggtggtgaaccgtttgaacaagacaaaggtggagcggacgcctgacctgaaggctgaaagagaagccgtgagtgctgctgagaaggcagaaagaaagttgcagcttagagacaaaaaacgcaaggaagagatggagaggctcgagaaggagaagcaggctgaaataaggagctacaagggcctgatggtccaggacaagatgacctccaacaagcaggttgcgtctggtagcaagaccttgcaggaactagaagaggacttcatgtgagacgacaaattcaatcaccccacaagagctctctaagaagtgcttctgtcaaagacaggacaggcatcgccgactttcaagaagacccttgacctgatgattccaggcggggccttgacctgttgtgcttcgtactttaatggcctctgtaaacctgtttgatgtgtcgagtcaacagctatgtgtgatatagcagccgccgatatattggttggttaatcgtggacctgacatggtaataaaacttgttttcaatgatttatctgac

SEQ ID NO: 2513 - DNA, 1023 bp, Avena sativa
gccccggaagccgcagttccctaaccccagtcgctcaatttcgccgcccgaacccgggacttccgcgcccttctgctatccgttcgggcggcccgccggcgagcgactcgggatggttttctacttcaaagcgcggcccgacgccggcgactacaccatcttcatggggctcgacaagcatgagaacgaggacctcatcaagtacgggttcccggaggacatctggttccatgtagataagatgtcctctgctcatgtatatttgagactgaataaaggtcagacaatggatgacataagtgaaggcgtgctggaagattgtgcccagcttgttaaagcgaattccattcaaggtaataaggtgaataacgttgatgtggtttatacaccatggttcaatctgaagaagacaccatccatggatgtgggtcaagttggttttcacaactctaaactggttcggactgttcaagtagaaaagcggctcaatgaggtggtgaaccgtttgaacaagacaaaggtggagaggacgcctgacctgaaggctgaaagagaagccgtgagtgctgctgagaaggcagaaagaaagttgcagcttagagacaaaaaacgcaaggaagagatggagaggcttgagaaggagaagcaggctgaaataaggagctacaagggcctgatggtccaggacaagatgacctccaacaagcaggttgcgtctggtagcaagaccttgcaggaactagaagaggacttcatgtgagacaacgatgcgacaaattcaatcaccccgcaagagctctctaagaagtgcttctgtcaaagacaggcaggcatcgctggctttcaaggagacccttgacctgatgattccaggcgggaccttgacctgttgtgcttcgtactttaatggcctctgtaaacctgtttgatgtgtcaagacaacagctgtgtgtgatctagccgcagccaatatattggtcggttaattgtggaccagacatggtaataaaacttgttttcaat

SEQ ID NO: 2514 - DNA, 1091 bp, Avena sativa
gggcgcacgaaaccctagaaatccccggttcctctcgtcaggttcccctctctctcgccccggaagccgcagttccctaacccaagtcgctcaatttcgccgcccgaacccgggactaccgcacccttctcttatccgttcgggcggccccgccggcgagcgactcgggatggttttctacttcaaagcgcggcccgacgccggcgactacaccatcttcatggggctcgacaagcatgagaacgaggacctcatcaagtacgggttccccgaggacatctggttccatgtagataagatgtcctctgcccatgtatatttgagactgaataaaggtcagacaatggatgacataagtgaaggcgtgctggaagattgtgcccagcttgttaaagcgaattccattcaaggtaataaggtgaataatgttgatgtggtttatacaccatggttcaatttgaagaagacaccatccatggatgtgggtcaagttggttttcacaactctaaactggttcggactgttcaagtagaaaagcggctcaatgaggtggtgaaccggttgaacaagacaaaggtggagcggacgcctgacctgaaggctgaaagagaagctgttagtgctgctgagaaggcagaaagaaagttgcagcttagagacaaaaaacgcaaggaagagatggagaggctcgagaaggagaagcaggctgagataaggagctacaagggcctgatggtccaggacaagatgacctccaacaaacaggttgcttctggtagcaagaccttgcaggaactagaagaggacttcatgtgagacaagcgatgcgacgaattcaatcaccccgaaagagctctctaaaaagtgcttctgtcaaagacaggcaggcatcgccggctttcaaggagacccttgacctgatgattccaggcgggaccttgacctgttgtgctttgtactttaatggcctctgtaaacctgtttgatgtgtcgagtctacagctatgtgtgatctagccgtagccaatatcttggttggttaatcgttaacctgacatggtaataaaacttgttttcagtgatgaaaaaa

SEQ ID NO: 2515 - DNA, 1289 bp, Aristolochia fimbriata
gaagacgaagcgagagcagacgcaacgcaagtacgcagcaacaataaagcagagtcctcaatttctggtggtgtgggtttattaaatttttattgtcacggtaggcggtctcaggccgaccttccgcttttcctttactcctgttcattggtctgtccgtctctctcccccggctgggttttctgtgcggagtatttgctggggaaggggatttgtgtagaggatctctccgtttcgatctctggggcctgattgctgaatagggtttgggcggagaaaggaggaggagacgccatggttttctacttcaaggctcggcccgaggcaggagattacacgattttcatgggcttggacaagcacgagaacgaggagctgatcagatacgggtttccggaagatatttggttccacgttgataaaatgtcatctgcccatgtttatgtaagactgaacaaaggtcagactattgatgatataagtgaaggattgctcgaagattgtgctcagcttgtcaaagcaaattccatacaaggcaacaaggtaaacaatgttgatgtggtatacaccccttggtacaatttgaaaaagactccgtccatggatgttggacaagttggtttccacaatcctaagatggttcggactgtaagagtagagaagcgcataaatgaggtcgttaataggctgaacaagacaaaagtggaaagaaagccagatctgaaagctgagcgagaagcggttaatgccgctgagagagctgaacgaaagatgctgctgagagataaaaaaaggagagaagagatggagaggcttgaaaaggagaagcaggcagagattcggagttacaagggtctaatggtgtcggagaagatgacctctaacaaacagatcgcttctgcaaacaaatctttgcaggaacttgaagaagatttcatgtgacatgtgattgtctatattcaacaaaattccctcactgtgttcttgcccgaagtgcactccactttcaataatatgaagtcggaaggactgggacgcaggtgttctcaaggagccatagtgcaaaaacagtgtcgtatttatgaagtgactatctaccttgaatttagggtagccaaatgtcaaccagggacccaacctgtaccagtccctgtttgatattttagtttcttatacttggaagagcaaaatgacttcctcagtgtttcgataccagcggtttgtgcttgtattgatttctttaaattgtaacttgcatcaaagaatttgccattgtgtttctagtgtgt

SEQ ID NO: 2516 - DNA, 1522 bp, Citrus clementina
atattttggaagccaaaaacaaattaaacggcgttgtgaataagctaacagtcatgagggaaaaaggatatctcgtaaccaaacaacaaaacctaaaaaactgaaaccgcatttatgattacataatttttcagcgatctgcagtaagaaagagggagaagaaaaacgcaaggagtctgtggtctcaagagcgacgacgaaagatggtgttttacttcaaagcccgaccagaggccggcgattacacaattttcatgggtctcgacaagtacgagaacgaggaactgatcaaatacggcttccccgaagacatttggtttcatgtggataaaatgtcttctgctcatgtgtatttgagattacacaaaggccaaactattgatgatattagtgaaggcgtattggaagattgtgctcagcttgtcaaagctaattccattcaaggcaataaggtgaataacattgatgttgtttatacaccttgggccaatttgaagaaaactgcttccatggatgttggccaagttggtttccacaatccgaagatggttcggacagtgaaagtggagaaaagaataaatgagatagttaatagattgaacaaaacaaaagtggagaggaaacctgatttgaaagcggaaagagaggctgcaaatgctgcagaaagagctgagagaaagcttcagctgagagataaaaaacggcgggaggaaatggaaaggcttgagaaggagagacaagctgaggtaaggagctacaagggactgatggttgccgaaaagatgacatctaacaaacaaattgcatcagagagcaagtccttacaggaactggaagaggactttatgtaagcacataactattacccgttgagttaagagcatctagatttgctgccttagaaaaatgtgagagtttggcattcagtttttgtaagttatcatccctctgtagtaataaatcaccttaatcctaatctgtcacccgaggatttagtaacaaatataaatatgcaaccttggggagggagatgggggagtttagagggaagatgaacttcattatatcgcccatccatatgctgtactttgataatgacgaaacatgatctgaatctgtatgtgtgattgatggatgatgaacctgtgcttttgtcgtcagattttagtagcaaattgatcacatatttattgcagttattttatttgttgatgcgaccagttgtggacatgagctgaatggtaaattttgattgaatatattgtttaatggaaatcagtggaatatggtttgtaagcattgggaacttaggaactcaatagtttgtgttttcagtctgatggatgaactcgtcttaagaaatgctggtcggttattgcaataatctggcatctcaatttgacttgtttggctttttatttgattttggtttactaatttcactccttaaaagcgtattcttacgttgaatgtctattagaaaatggataaaatataaataaatttatatttcaaagcaatt

SEQ ID NO: 2517 - DNA, 1518 bp, Citrus sinensis
atattttggaagccaaaaacaaattaaacggcgttgtgaataagctaacagtcatgagggaaaaaggatatctcgtaaccaaacaacaaaacctaaaaaactgaaaccgcatttatgattacataatttttcagcgatctgcagtaagaaagagggagaagaaaaacgcaaggagtctgtggtctcaagagcgacgacgaaagatggtgttttacttcaaagcccgaccagaggccggcgattacacaattttcatgggtctcgacaagtacgagaacgaggaactgatcaaatacggcttccccgaagacatttggtttcatgtggataaaatgtcttctgctcatgtgtatttgagattacacaaaggccaaactattgatgatattagtgaaggcgtattggaagattgtgctcagcttgtcaaagctaattccattcaaggcaataaggtgaataacattgatgttgtttatacaccttgggccaatttgaagaaaactgcttccatggatgttggccaagttggtttccacaatccgaagatggttcggacagtgaaagtggagaaaagaataaatgagatagttaatagattgaacaaaacaaaagtggagaggaaacctgatttgaaagcggaaagagaggctgcaaatgctgcagaaagagctgagagaaagcttcagctgagagataaaaaacggcgggaggaaatggaaaggcttgagaaggagagacaagctgaggtaaggagctacaagggactgatggttgccgaaaagatgacatctaacaaacaaattgcatcagagagcaagtccttacaggaactggaagaggactttatgtaagcacataactattacccgttgagttaagagcatctagatttgctgccttagaaaaatgtgagagtttggcattcagtttttgtaagttatcatccctctgtagtaataaatcaccttaatcctaatctgtcacccgaggatttagtaacaaatataaatatgcaaccttggggagggagatgggggagtttagagggaagatgaacttcattatatcgcccatccatatgctgtactttgataatgacgaaacatgatctgaatctgtatgtgtgattgatggatgatgaacctgtgcttttgtcgtcagattttagtagcagattgatcgtatatttattgcagttattttatttgttgatgcgaccagttgtggacatgagctgaatggtaaattttgattgaatatattgtttaatggaaatcagtggaatatggtttgtaagcattgggaacttaggaactcaatagtttgtgttttcagtctgatggatgaactcgtcttaagaaatgctggtcggttattgcaataatctggcatctcaatttgacttgtttggctttttatttgattttggttaactaatttcactcaaagcgtattcttacgttgaatgtctattagaaaatggataaaatataaataaatttatatttcaaagcaatt

SEQ ID NO: 2518 - DNA, 1030 bp, Platanus occidentalis
ttttttgttactggttttgggagaagaacgatggttttctactttaaagccagaccggaggcgggcgattacaccattttcatgggcttggacaagcacgagaacgaagagctcatcaaatacggatttcccgaagatatctggttccatgtggataaaatgtcttctgcccatgtttatgtaagattgaacaagggtcagacaattgatgatataagtgaaggtttattggaagactgtgctcagctcgtcaaagcaaattctatccaagggaataaagtgaataatattgatgttgtctacacaccttggtacaatttgaagaagacgccttccatggatgtcggacaagttggttttcacaatcctaagatggtccgaactgttcgagttgagaagcgcataaatgagatggttaatagactgaataagacaaaagttgaaaggaagccagacttaaaagccgaacgagaagcagttaattctgcagaaagagcggagagaaaacttcagctgagagataaaaaacggcgagaggagatggagaggcttgaaaaggagcgacaggcagagataaggagctacaagggcctgatggtctcggaaaagatgacttctaacaaacagattgcatcaacgaacaagtccatgcaagaactggaagaggacttcatgtgaggtcagcacatatagaaagccagtttcagaagtggaaaaagaaaagaggtcttgattttcttcctttgcttgtttctggaagagagaaatatatcataaaagagaaatctgagatgtaggctgtgattgagttcctttcctggtttgttccttcgtaattgaatgtacgatttccaccttaggttgcagatctttttctctagttggacatcagtgagaatatggatttgtcatatcaaccagaagatgaagcttatatattaggttgatttatgtttttattatactcaaataattgtgataaacattatagaaatctcggtctactttcatgcaactgttgattaataaa

SEQ ID NO: 2519 - DNA, 1038 bp, Eschscholzia californica
ttctttgtttcatctcaaaaccctagtttctcttttctggtttcgggcaagagtagaagaaaaataatggtgttctactacaaagcccgaccagaaaccggtgactataccatcttcatgggtctggataagcacgaaaatgaagaacttatcaaatatggattccctgaagatatctggttccatgtcgacaaaatgtcatcagctcatgtttatgtcagactgaacaaggggcagacgatagacgacattagtgaaggtttactagaagattgtgctcagcttgtaaaagcaaattccatccaaggtaacaaggtgaataacatcgatgttgtttataccccttggttcaatttgaagaaaactccttccatggatgttggacaagttgggtttcacaattccaagatggttcgcactgtaagagtagaaaaacgcataaatgaggtggttaataggttgaacaagaccaaggtggaaaggaagcccgatttgaaagctgagcgagaggcagttaatgctgcagaaagggcagagagaaaggtccacctgagggacaagaagcgcagggaagaaatggagaggcttgaaaaggagaagcaggcagagataagaagctacaaaggtctgatggtttccgagaaaatgacttctaacaagcagatagcatcagcaagcaaatccttgcaggaactagaagaggatttcatgtgagagcagcaaaagcgcgaaggaaaacaccattgggtgattatatcattaatcttcaatatttcactatctcataattgagataattatcaaaaaaagggttaattacaaaagatagaaatccaattaagtcaggtgaagtaatttgggttgtcagtgttgcatttgatctttgatcatttcacgagtgatgtgaactcggtatttggcatgtctactgtggtgatttagatgttggtttgatgaagaaagtgaagttgcgaatgcaaaaaaatgggtagtgttgtgacaatgatttgcaagtttatttgtttcttcagtcatcac

SEQ ID NO: 2520 - DNA, 1133 bp, Elaeis guineensis
taatttcgtccgattcttgaccgcagacaagaaatttccctcgaaatctcctccagtccaaggaagccctagtgtcgaatcaattcagaatcccaacctccacttcatgaatttgatcgattgcacgcaataagtatactccgtcgtcgcctcaagccctagtttccaattcgagatcttctcgttgcatctgaagggagcgccgaaaccctaaatctccgcgtcctggttaggggtaggaggagatggttttctacttcaaggcgcggcctgaagtgggtgattataccatcttcatggggttggacaagtacgagaacgaggagctcatcaagtacgggtttcctgaggatatatggtttcatgtggataaaatgtcctctgctcatgtttatctcagattgaaaaaaggtcagactattgatgatataagtgaaggtctgctggaagattgtgcccagctcgttaaagccaattcgattcaaggcaataaagtgaacaacgttgatgttgtttatactccgtggtataatttgaagaaaactccttcaatggatgttggtcaagttggtttccacaatcctaagatggtccgtactgtaaaggtagataaacgcataaatgagattgttaacaggttgaacaagacgaaggtggagagaaagccagacttgaaagctgagcgagaagctgttaatgcagctgaaaaggcagaaagaaagcttcagttaagagagaaaaaacggagagaggagatggagaggcttgagaaggagagacaggcagaggtaaggagctacaagggcctgatggtgtcagaaaagatgacatctaacaaacagattgcatcgaccaacaaatccctgcaagaactggaagaagacttcatgtaactgcggcaagttacttgtggctggcagaaagctcaaactttggaagctccacatgatcagtgcagcaaatttgaggattcaggtcacttggacacagaactaatgttctgatgacttagttaagccgacagcttcagacctgttttttatcacaagttgtcaacaaggaatgggatcatttatcagttgtggttgatacaggtatatttgttacacagatgatgaaagactaatggttta

SEQ ID NO: 2521 - DNA, 1353 bp, Amorphophallus konjac
cggccgggggcgaagggtcggggtttgttcgtttcggtttcggttagccggtgggcagctcgaagggaaagaagaggagcacaggttaggtagcagagatcgagctcggcgattccgtgctccgcaatccagatcgctctcaagtccccttcttggaagcctttcgatcagggaaccctaactttgttcccggtgggagctcttgttcctctgatcattaggcgtcgcggtgggagctagcggaggaaggaagcacagatggttttctacttcaaggcccggccggaggccggggattacaccatctacatgggggtggacaagcacgagaacgaggagctcatcaagtacgggttcccggaggatatctggtttcatgtggacaagatgtcctcagcccatgtttatctgagattgaacaaaggtcagacaattgatgatataagtgaaggattgctggaggactgtgtgcagcttgtcaaagccaattcaatccaaggcaacaaggttaacaacatcgatgtagtttatactccatggtacaacttaaagaagactccttctatggatgttggacaagttggctttcataatcctaagatggttcgcaccgtgagagtagaaaagcgaataaatgaaatagtgaacaggctgaataagacaaaagttgaaaggaaacctgacttgaaagctgagcgagaatctgtcaatgctgcagagagagcagaaagaaagcttcaattaagagacaagaaacggcgagaggaaatggaaaagctagaaaaggagagacaggcggagattcgaagctacaagggtctcatggtttcagagaagatgacttctaacaaacagattgcttccaccaccaagtccctgcaggagctagaggaagactttatgtgagctatatatatatatctacggagactctttgggacgctgctgctgcttccaggggttttctgctgatcgttgcttcaagctcaaaactgtgatcaaacttcagagttcagagagctcaaacttccgactccacgatgcgctgcaggcccattgatctttcacaaggcttggatctgacagaattggaacaaaatttaaactatgtttctggtttatgtggcaggatagaagaacgatgagacaagaagtctattgtttgctatattcagattacattcgtatcttggtgtgcgcaccttccaaagaacaaacaaaaaaaagagagaagaaaagttggtatctcggtctgctagtcccatgattttccttcttgactcaatatttctgtctgtgatgttatcggacccaatttccaggcgaaatcatatacttacagtagcgttgtag

SEQ ID NO: 2522 - DNA, 1130 bp, Ricinus communis
aacgcattgtcgtttaaatggaaacggcaacttgactcaaacacagcgtttagattacgcccgcaattccgattcttcgattcttcagaaataaaacaatacgaaaccctaaccattaaccacaccagacgaaaaataaacgcagaggtctctctgtgtgtgtgtaatatttaaaaaataataataataataataaaagaatggtgttctacttcaaagccagaccagaggtaggagattacaccatttttatgggtctcgataagtacgagaatgaagagctcatcagatatggtttccctgaagatatttggtttcatgtggacaaaatgtcttctgctcatgtttatttaagactgaacaaaggccagacaattgatgatataagtgaaggtttactggaggattgtgctcagcttgtcaaagctaattcaatccaaggcaacaaagtgaacaacattgatgttgtttacactccatgggccaatttaaagaaaactgcttccatggatgttggccaagttggcttccacaattcaaagatggttcgaactgtaagagtggagaagcggattaatgaaatagttaatagattgaatagaacaaaagtcgaaagaaagcctgatttgaaagccgaaagagaagcagtcaatgcagcagaaagagcagagagaaagcttcagctgagagataaaaaacgtcgagaggaaatggaaaggcttgaaaaagagagacaagcagagattaggagctacaaagggttgatggtgtctgaaaagatgacatctaacaagcagattgcatctgaaaacaagtccttgcaggagctggaagaggatttcatgtaagcccaaatgttatgccgaatttgctgcccttgaagaagagggttctcattcaatttgtaactctagacaagaagttgtttccccttgtacaaataaatcacctcagtttcatgcctgcggtgtttcgatattggtaaggaaaattcagaagagagatgtctaacgccagtataaggcagggagtggggggttggggttgaataactttttttacggtgaccgtaagttgtaattggatgatgatgatgattatgaaaatgattgagacgtcattggtattgt

SEQ ID NO: 2523 - DNA, 1811 bp, Cajanus cajan
ttgtttgcattttattaaaacctaaaaattgcgaagcaggttttgtatttgtaccccacgaaaaggcgtatttggctttaataaatgagcagagggaagattcggtgtccgtgattatgatttacgcagcgattcggatagcaaaagcaatcccccaattttgattgtgtcgaagaaaggacaggtcctagaaccctagccccctttcttctcctctgcgttaagcccacgcaacgccatggtgttctacttcaaagcgcgccctgaagccggcgattacaccatcttcatgggcctcgacaagttcgagaacgaggaactcatcaaatacggttttcccgaagacatctggttccatgttgataaaatgtcctcagcccatgtctatgtcaggctgcacaggggccagactattgatggcatgagtgagggtttactggaagattgtgctcagcttgtcaaagcaaattcaattcaaggaaataaagtgaacaatattgatgttgtttacactccctggtctaacttaaagaaaacagcttcaatggacgttggtcaagttggttttcacaacccaaaaatggttcgaactgtgagagttgagaagcggataaatgagattgttaacaggctaaacaagacaaaagtggaaaggaaacctgatttgaaagctgagcgagaagcagttaatgcagctgaaagagccgagagaaaacaacaactgagagaaaagaaacgccgtgaggaaatggaaagacttgaaaaggaaagacaagcggaacttaggagctacaagggtttgatggtcgcagaaaacatgacatccaacaaagatattgcatcaggaagcaaatccttgcaggaactggaggaagatttcatgtaatcatttgatcattgggttataggcagatgactggtggccaacttgctacctggaagatttatatcgattaaataaccctactactggaatttgaagctgcattatcttggttgaggaaaccaagtagtgtgtacacaattatgattgagggatggggggaaaagaggggggtgggggggagatgtagtgattggaccgtgttcctggtaaggccaatgtaccttatcgatgacattgtttgagactttttttccattttaatgttctcagtcgagtcaaaaactgaaatgacttggtatatctgtcatggtaggttacgcttgtcctgttttgaatgaattttgttgcacttttttgtttgatgttcactggttgagaaattattggggacatcatgtagtgtttatggtactggcagactgataagactcttgggcccaaaatcagataagagcagcaaatggataaagtgctggacttgagtccaaaaaggcccataatatggagggtatactcccgaaggaagaaaatagggtcaggggagagttactgacccacagggtgagattctgttaagcagcagggttttagaagcagctgggaaggaagagaatatttagtttttggacatttcttattgtgatggttaggggagtatctctgtagagtcctaggctctggtttacgcattcctttgttgtgagaactctagtagctccttttacaatgaataatactacctgattggaactatttccgagtctctataacaaacttgttgatattaagactaatgatggaacacctatttggtgaaaccatatattgtaagatttgcatataaacaaacgtgcaagcgctgtaatatctgctaccgtctgtaagcttcttcatggtacgataaactcgtgaaacagcacgatga

SEQ ID NO: 2524 - DNA, 885 bp, Arachis hypogaea
cgttgagatagcgtgagaagaaagcaggttccgttccgatggttttctacttcaaggcacgccctgaagctggcgattacaccatcttcatgggtctcgacaagtacgagaacgaagaactcatcaaatatggtttccctgaagatatctggttccatgttgataagatgtcttcagcacatgtatatgtaagactgcacaaaggtcagactattgatgacattagtgaaggtttactggaggactgtgctcagcttgttaaagcaaattcgattcaaggaaataaggtgaacaatattgatgttgtttatactccctgggccaatttaaagaaaactgcttcaatggatgttggtcaagttggtttccacaaccccaaaatggtccgaactgtgagagtggagaagcggatcaatgagattgtcaacaggctaaacaaaacaaaagtggaaaggaaacctgatttgagagctgagcgtgaagcagttaatgcagctgaaagagctgagagaaagcaacaaatgagagacaagaaacgccgtgaggaattggaaagacttgaaaaggagagacaagccgagctgaggagctacaagggtttgatggttgcagagaatatgacatccaataagcacattgcatcaggaagcaaaacactgcaagaaatggaggatgatttcatgtaagcttttagctattggattatatgcagatggctggtggccaacaatgctacctggtgaattaaattgactaaataacccaagtcctggaatttgaaatttcagtgtcttcattaagaaaccaagtagtgtgtacaattgtgtttgggggataattttaatcgagagctggaacagaagacagaagagagtggaaaaaagg

SEQ ID NO: 2525 - DNA, 868 bp, Glycyrrhiza uralensis
gacgaaagggaaaaagttccgtgattatgttttatgcagcgattcggatagcaatttccccaaattggaactgtgataggagagaacagacaagcaggtctcaaactcaagaaccctaaaacactccctttctcatcgcctcgtgtgcgtgaaggctaagcaaactcaaatggtgttctacttcaaagcacgcccagaagccggcgattacaccatcttcatgggcctcgacaagttcgagaacgaggaactcatcaaatacggtttccccgaagacatctggttccatgttgataaaatgtcttcagcccatgtctatgttaggctgcacaaaggtcagactattgataacatgagtgaaggattactggaagactgtgctcagcttgtcaaagcaaattcaattcaagggaataaagtgaacaatattgatgttgtttacactccctggtctaatttaaagaaaactgcttcgatggacgttggccaagttggttttcacaacccgaaaatggtacgaactgtgagagtggagaagaggataaatgagattgttaacaggctaaacaagacaaaggtggaaagaaaacccgatttgaaagctgagcgagaagcagtgaatgcagctgaaagagctgagagaaaacaacagctgagagaaaaaaaacgccgcgaggaattggaaagacttgaaaaggagaaacaagcagagcttaggagctacaagggtttgatggttgcagaaaatatgacatccaacaaagaaattgcatcaggaagcaaatcattccaagaagtggaggaggatttcatgtaagcattgattattggattatagacagatgactggtggcaaacttgctacctg

SEQ ID NO: 2526 - DNA, 1685 bp, Arachis hypogaea
ggggagaacggccccaaacgcatatgattgcgtttagagaaaaaagacaaaggagccaaagaaagagggacgaaaggtttcttactttttaattcatgcagcgattcgtatagaaaactctgaaagattcagagaaccctagcacgcaataaaaaccatcgagactttccctcttctctctctttctctggtgtgtgcgttgcgttgagatagcgtgagaagaaagcaggttccgttccgatggttttctacttcaaggcacgccctgaagctggcgattacaccatcttcatgggtctcgacaagtacgagaacgaagaactcatcaaatatggtttccctgaagatatctggttccatgttgataagatgtcttcagcacatgtatatgtaagactgcacaaaggtcagactattgatgacattagtgaaggtttactggaggactgtgctcagcttgttaaagcaaattcgattcaaggaaataaggtgaacaatattgatgttgtttatactccctgggccaatttaaagaaaactgcttcaatggatgttggtcaagttggtttccacaaccccaaaatggtccgaactgtgagagtggagaagcggatcaatgagattgtcaacaggctaaacaaaacaaaagtggaaaggaaacctgatttgagagctgagcgtgaagcagttaatgcagctgaaagagctgagagaaagcaacaaatgagagacaagaaacgccgtgaggaattggaaagacttgaaaaggagagacaagccgagctgaggagctacaagggtttgatggttgcagagaatatgacatccaataagcacattgcatcaggaagcaaaacactgcaagaaatggaggatgatttcatgtaagcttttagctattggattatatgcagatggctggtggccaacaatgctacctggtgaattaaattgactaaataacccaagtcctggaatttgaaatttcagtgtcttcattaagaaaccaagtagtgtgtacaattgtgtttgggggataattttaatcgagagctggaacagaagacagaagagagtggaaaaaagggagaaagaaaaagaagagaagtgggggactgggggagggggtttcttatagtgatgattggtttttgtacttggtaatggaaatatacttactttatagcattgcttgatagttgagacaatggttttcaaactaatgttctcacagttgagtcaaaaggggaaattcattgctataactagttttattttccatgccaagtttacaatttgcttccttttctgagaggggcctacacttcgtgccaaattacttggacatgtatcctccttctatagaactgccggaaaagcttcttagttcttgttgatatctgagattaatgagggacaataattctgccaggccaaatgtaagatttgaacataccctgctgataaacttccttttataatttgtaaagcgacactagatagcagcaaaggttattttaacaattaatatcttgattcgccattataataagagcaaagttattaaactaaaaatctccttccatagtgggtagccaagcagcaattaataaggtaaggaagacctttaatagaagcaaaagaacgtcttgttttctttaagtcggttcgaattcgctctatca

SEQ ID NO: 2527 - DNA, 1545 bp, Glycine max
tggatattccactttgttgcattttattattagaagctgaaaattctaaagcaggtattattgtatttgtacttgtacacgccacaaaggtgtagggaaggttccgtgattatgattttcgcagcgattcggatagcgaaagcaatcccccacccctaattttgatttgtgtcgaggaaaggacaggtcttggaaccctaaccgcacctctctctttcttcccgtgtgcgtcaaagcgaagcaacgcgacacgatggtgttctacttcaaagcgcgccccgaagccggcgatttcaccatcttcatgggccttgacaagtacgagaacgaggaactcatcaaatacggttttcccgaagacatctggttccatgtcgataaaatgtcttcagcccatgtctatgtcaggttgcacaaaggccagaccatcgatgacatgagtgagggtttactggaagactgtgctcagcttgtcaaagcaaattcaattcaaggaaataaagtgaacaatgtcgatgttgtttacacaccctggtctaatttaaagaaaactgcttcaatggatgttggccaagttggttttcacaactcaaaaatggttcgaactgtaagagttgagaagaggataaatgagattgttaacaggctaaacaagacaaaagtggaaaggaaacctgatttgaaagctgagcgagaagcagttaatgcagctgagagagctgagagaaaacaacaactgagagaaaaaaaacgtcgggaggaattgggaaggcttgaaaaggagaaacaaacagagcttaggagctacaagggtttgatggttgcagaaaatatgacatccaacaaacaaattgcatcaggaagcaaatcattacaggaactggaggaggatttcatgtaatcatttattgggttatggacagatgactggtggtcaacttactacctggcagatttatgtttttgattaaccaaccctactttggattttgaagctgcattatcttggttggttgaggaaaccaagtagtgtgtacacaaattgtgattgagggatgccgggtggggaggtgaatcctgataaggtcaatataccttatctacaactataaccttgcttgagacaatggtttttgttatttaatgttctcacagtcgagtcaaaaactggaatttcgtgctatttttatcgtggtcgtttacgctagtcgggttttgaaatttgtttccctctttgaattggtgttcactgcttgcgaaattattggggacattatgtagtgtttatgctacatgcaatgataatactcttgttgggaacattatgtagtgttccctgtttggaatataggatacatactaatattgttaccctgtatttaggagtgaaaattgggcaaatcacttctcgagggtgaagagttaggtaatgtttgttattagttgagggaccttcaatatttgttcaaaaagtgaaatggaaaaaaaattgtttgatttttaattagatccgattgtaaactgaagtttgcctcctcaactata

SEQ ID NO: 2528 - DNA, 925 bp, Tripterygium wilfordii
ggtggtccttggttggtgcggaggagagaaaagagaagatggtgttctacttcaaagcccgaccagaggtaggcgattacaccatctttatgggcctcgacaagttcgagaacgaggagctcatcaaatatggcttccctgaagatatctggttccatgtggataaaatgtcttctgcccatgtttatgtaagactgcacaagggtcagactatagattatataagtgaaggtttactcgaggattgtgctcagctcgtcaaagcgaattccattcaaggcaacaaggtaaataatgttgacgttgtttatacaccttgggccaatctaaagaaaactgcttccatggatgttggccaagttggtttccacaatccaaagaatgttcggactgtgagagtagagaagcggataaatgagattgttaatagattaaacaagacaaaagttgaaagaaagcctgatttgaaagccgagcgagaagcagtcggcgcagctgaaagagcagagagaaagcttcaacagagagataaaaaacgaccgtgaagaaatggaaaggcttgaaaaggagaggcaagcagagataagaagttacaagggtttaatggtctcggagaaaatgacatcaaacaaagatattgcttcaataaacaagtccttgcaggaattggaagaggacttcatgtgaggcactttgtggttctcgtcatctcatgttcattaaaatactccatggcgtccctcttacggaaggggcttgtcattcattttacatgacttttggccttttgaagtcattgatcctcttgaataaatgaccttattcaaagctgtaatttatgttactgtgatgtgggtgattgaaaatctgtttgcagtgtttggaaagacactggaggctgttatttttttaattaattttggtt

SEQ ID NO: 2529 - DNA, 1167 bp, Gossypium raimondii
gttggaaaataattttttcatgaggtaaacgctgtcaatttggaaaaacgcaagcgcaaacagagatcgcattaggttatcttcttctttttctttttttttttttttgcaatttccttcaactgaaaggggaaaataaccctaattttgtctctggattggtctcccaagtgaggaaagggagaaaaagaaagaaactttgaagaaaaaaaatggtgttttacttcaaagcccgaccagaggttggcgattacacaattttcatgggtctcgacaagtacgagaacgaggaactcattaaatacggctttcccgaagacatttggttccatgttgataaaatgtcttctgctcatgtttatgtaagacttcataaaggtcaaaccattgatgatataagcgaaggtttgcttgaagattgtgctcagcttgttaaagctaattccatccaagggaacaaagtgaacaatgttgatgttgtttacactccatggtccaatttgaagaaaactccttccatggacgttggccaagttggctttcacaattccaagatggttcggacagtgagagtggagaagcgtataaatgagatagttaacaggttgaacaagactaaagtggaaaggaaacctgatttgaaagctgagagagaagctgttaatgccgcagaaagggcagagagaaagcaacagctaagggaaaaaaaacgacatgaggaactacaaaggcttgaaaaggaaagacaagcagagataagaagctacaagggtctcatggtctctgaaaagatgacctcaaacaaacaaattgctacaacaagcaaatctttgcaggaacttgaagaggattttatgtgaacatattggtatttcaatgccaatgagcagccaaaaacatactgcctgtaaaaggaaaacggcggtttgatgttacttttattattgttattattactattgcaagcttgaagttgtttgcctcaataataagctaccaaaaaataggctacaagaattggaacaaacttactaggttgagggtgaggggaatgaacttctgttgtaattggcaatatattctactaaacgtgattgttaactcaattgctggtttacttcaatttaacacataattctgattgcaaatctgcaaatcatcatgcca

SEQ ID NO: 2530 - DNA, 1219 bp, Musa acuminata
aacattaatcttttcctttcccccccaattctcgtccactacggttggtatcgacatcatattatttcttgcgccgtcgcgttggatcgatcggatcaatcgatagcgaagaacaaattcccctcaaattccgcctcatccgttcgcctccaagaaaccctaatctcgcatcgattccgataccgtgtcagaattcgattcgtcgtcggagcatcggaagacagccgcgcccggagccctaggttccgcgactgccgggttggtttttgcggtgaggaaggtcgaggcggagatggttttctacttcaaggccctgccggaggcgggcgattacaccatcttcatggggttggacaagcacgagaatgaggagctcatcaagtatgggttcccggaagacatctggtttcatgtggacaaaatgtcctctgcgcatgtttatttaagattgaacaagggtcaaactattgatgatataaatgaaggtttgttggaagactgtgctcagctcgtcaaagctaattcaattcaaggcaataaggtaaacaatgtggatgttgtttatactccatggtttaatttgaagaagaccccttctatggatgtcggtcaagttggtttccacaatcctaagatggtacggactgtgaaggtagaaaagcgcataaatgagattgttaacaggttgaacaagaccaaagtggagaggaagccagacttgaaagctgagagagaagctgtcaacgcagtagaaagagcagaaaggaaagcccagttaagagataaaaaaaagagggaagaattggagaggctggagaaggagaaacagtcagagatacggagctacaagagcctgatggtctcagagaagatgacatccaacaaacaaattgcatctgctaataaatccttgcaagaactcgaagacgacttcatgtgatcatcgcacaagtcgattgatggttggtgatgaagttcaaggtttcaagtatctgcttgatcaccatggaaagatggacggattcactgcaggatcctcattcgatcacaaatgatgctctggtttgtcatttcgttgtgcttccagtgtagaccataatgtgtgtgatatggacacaaggaatgtgactatttaatcagttgtcgacatctattttccgtgatatgaatgtcatgtactgcaatctaatctcagtttgtctcttaattcattgttcgg

SEQ ID NO: 2531 - DNA, 1219 bp, Gossypium raimondii
tttggccattaagaattgacttttatatcgatataatatattagaatttgagaaaagttggaaaataattttttcatgaggtaaacgctgtcaatttggaaaaacgcaagcgcaaacagagatcgcattaggttatcttcttctttttctttttttttttttttgcaatttccttcaactgaaaggggaaaataaccctaattttgtctctggattggtctcccaagtgaggaaagggagaaaaagaaagaaactttgaagaaaaaaaatggtgttttacttcaaagcccgaccagaggttggcgattacacaattttcatgggtctcgacaagtacgagaacgaggaactcattaaatacggctttcccgaagacatttggttccatgttgataaaatgtcttctgctcatgtttatgtaagacttcataaaggtcaaaccattgatgatataagcgaaggtttgcttgaagattgtgctcagcttgttaaagctaattccatccaagggaacaaagtgaacaatgttgatgttgtttacactccatggtccaatttgaagaaaactccttccatggacgttggccaagttggctttcacaattccaagatggttcggacagtgagagtggagaagcgtataaatgagatagttaacaggttgaacaagactaaagtggaaaggaaacctgatttgaaagctgagagagaagctgttaatgccgcagaaagggcagagagaaagcaacagctaagggaaaaaaaacgacatgaggaactacaaaggcttgaaaaggaaagacaagcagagataagaagctacaagggtctcatggtctctgaaaagatgacctcaaacaaacaaattgctacaacaagcaaatctttgcaggaacttgaagaggattttatgtgaacatattggtatttcaatgccaattagcagccaaaaacatactgcctgtaaaaggaaaacggcggtttgatgttacttttattattgttattattactattgcaagcttgaagttgtttgcctcaataataagttaccaaaaaataggctacaagaattggaacaaacttactaggttgagggtgaggggaatgaacttctgttgtaattggcaatatattctactaaacgtgattgttaactcaattgctggtttacttcaatttaacacataattctgattgcaaatctgcaaatcatcat

SEQ ID NO: 2532 - DNA, 1113 bp, Elaeis guineensis
ctccgcccatctttttatcatcgcaccgcccgtccaaccctaatcctcaatctattcgcgagcaccgacttcggaacctttggtcggtcgatcgcggaacttatatagcggaaccatttcttggcattccgaaaccctagtttcgacccttccaggtagcgccccgttctccggctattgaaaccctaaattcctgagagggagcccaaaggcgatggttttctacttcaaggcccggccggaggccggcggttacaccatcttcatgggcttggacaagtacgagaacgaggagctgatcaaatacgggtttcccgaggacatctggtttcatgtggataagatatcttctgctcatgtctatctaaggttgaacaaaggacagacaattgatgatataagtgaaggcttgttggaggattgcgctcagctcgtcaaagctaattcaattcaaggaaataagatgaatagtattgatgttgtttataccccatggtataatttgaagaagactccttccatggatgttgggcaagtaggctttcacaatcctaaaatggttcgcaccgtaagagtggaaaagcgcataaatgagattgttaacaggttgaataagacaaaagtagaacggaagccagacttaaaagctgaacgagaagcagtcagtgcggcagaaagagctgaaaagaaacttcagcaacgagagaaaaaacgtcgggaagagatggagaggctccagaaggagaagcaggcagaaataaggagctacaagggcttgatggttgcagacaagatgacatctaacaaacaaattgcatccaacgataaatccctgcaagaacttgaagaggaattcatgtgatcccagctccaaacatcagtcgataactaagtttcaagatgcggtccacgtgacaggttgaaagctgtggcatgcgatatcaaaaaggttttctagccaactgtatttgtgtgattccataatttcattgttacaaactgtaagcttgtatcatatcatgaaatatcagtggggaaattgttgttctaatcaacaacttgtgcaactatttgtataacagtatttatgaaatgaaagttatctatgcttca

SEQ ID NO: 2533 - DNA, 1309 bp, Gossypium raimondii
atttatcccaactttaccctactttttaaaccatggtatgagaaaggctggtctcccaatatttccttaacagaagggaggagaaccctaattttgtctctcccaagagacgaaaggaagggaaaaatggtgttttacttcaaagcccggccagaagctggcgattacaccattttcatgggtcttgacaagtacgagaacgaggagctcatcaaatatggcttcatcgaagatatctggttccatgtggataagatgtcttctgcccatgtttatttaagacttaaaaagggtcaaaccattgatgatataagcgaaggtgttctcgaagattgtgctcagcttgttaaagctaattccatccaaggcaacaaggtgaataatattgatgttgtttacactccatggtccaatttgaagaaaactccttcaatggatgttggccaagttggctttcacaattccaagatggttcggactgtgagagtggagaagcggataaatgagatagttaacaggttgaacaagactaaagtggaaaggaaacctgatttgaaagctgagaaagaagcagtttatgcagcggaaaaagccgagagaaagcaacagttgagggaaaaaaaacgccgagaggagatgcaaaggcttgaaaaggaaagacaagcagaaataagaagctacaagggtctgatggtctctgaaaagatgacatcaaacaaacaaattgcagcgacgagcaagtctttccaggaagtagaagaggattttatgtgaaatatactggtatttcatcgctaattacgattcttctagctgccagaaacttgctgtccgtcaaagaagggtggtttctttttacttctttttcattgcaagcttaagttatttgcctcgattaagtcggctcacttaggatttttacctccattttgggtgagatgaacttctgctataggtgccatagattctatgaaacacgattcagatttccattgttgattaaggtgttatttctctttcaatttatatttattctgatcccaaatgtgcaaatgatcatgccgtatggtaggatggtttttatggtattgcagttgagtgcgtgttcaaacaaatgactagtttaattttctagttgactcttggttctgctcattgggtgtgtactttaaacttcggaagacgttatgcatttaagttcttaaattgtttactttacgaggtctggtggatacatgtaatttgagttaatatttagttggctggatgagattgttgtgattctttttcgtcttgtttctaattgatt

SEQ ID NO: 2534 - DNA, 911 bp, Vitis vinifera
ccaaaccctaaaagcgctctctctctcatccacaaacgctaaaactcaaaccttttgggcagtttggcgttgaggagagcctaagaagcgaatcaacgatggttttctacttcaaagcccgaccagaggctggtgattacaccattttcatgggtctcgataagcacgagaacgaagagttgatcaaatatggtttccccgaagacatctggtttcatgtggataagatgtcctcagcccatgtttatgtaagattgcacaagggtcagacaattgatgatataagtgaaggtttactggaggattgtgctcagcttgtcaaagcaaactccatccaaggcaacaaggtgaacaatgttgacgtcgtatacactccatggcacaatctaaagaaaagtgcttctatggatgttggccaagttggtttttacaattcaaaaatggtacgcactgtgagagtggagaagcgaataaatgagatagttaatagattgaacaggacaaaagtagaaaggaaaccagatttaaaagctgagcgagaagcagttaatgcagcagaaagagctgagagaaaacttcagctgagagataaaaaacgtagggaagaaatggaaaggcttgaaaaagagagacaagcagagataaggagctacaagggtttgatggtctctgaaaagatgacttctaacaaacagattgcatcagcaaacaagtcgttgcaagaactggaagacgacttcatgtaaacgcatggtatggtgttgttccattggttgcaaaaactttgctgcccaaaccaaagttggaaatttggaatttcttctttttatgattcttaattgctccccttcaaatgaatcgcctcagtcctaaaactagttattaatatcaaatgagaaaagataaaaaag

SEQ ID NO: 2535 - DNA, 1115 bp, Lupinus angustifolius
cagcgaatgggtatagaaagcaatttcggaattttgtaattgaaagagatttttgaggtgtgaaagtgagagaaccctaacgcatttcgcaccctctttggttcgagatttgaatcgaagatggtgttctacttcaaagcgcgtccagaagctggcgatttcaccatcttcatgggtcttgacaagtacgagaacgaggaactcatcagatacggttttccagaagatatttggtttcatgttgataagatgtcttcagcccatgtttatgtcagactgcataaaggtcagggcattgatgacataagtgaaggtttgctggaagactgtgttcagcttgtcaaagcaaattcaattcaaggaaataaggtgaacaatattgatgttgtttacactccctggtctaatttgaagaaaactccttcgatggatgttggtcaagttggttttcacaactcaaaaatggttcgaactgtgagagtggagaagcggatcaatgagattgttaacaggctaaacaagacaaaagtggaaagaaaacccgatttgaaagctgagcgagaagcagttaatgcagctgaaagagctgagcgaaaactgcatctgagagaaaagaaacgccgtgaggaattggaacggctcgaaaaggagagacaagcagagatgaggagctacaagggtttgatggtctcggaaaatatggtttccaataaacaaattgcatcaggaagcaaatcactgcaggaactggaggaggatttcatgtaagcattgatatgatggctgggtggccaactttctaccttgcagatttgcattgattaaataaccagcacctggaatttgaaactgtaatgttttcattaagaaaaccaagtagtgtgtacaaactgtgattgaagggttggggaggggatgtaatgattggtttttgacatggtgatgccaacatacttcaactatagccttgcttgacacaatggttttaagtgaagtttctttttatgattattattaggatttttttaacctcagccctaaggactgagaataaagaatcaaaagagatgttttattgggaaattaagtacataaatcttttaactccttcaatc

SEQ ID NO: 2536 - DNA, 1169 bp, Gossypium hirsutum
ttccttaaccgaagggaggaaaaccctaattttgtctctcccaagagacgaaaggaagggaaaaatggtgttttacttcaaagcccggccagaagctggcgattacaccattttcatgggtcttgacaagtacgagaacgaggagctcatcaaatatggcttcatcgaagatatctggttccatgtggataagatgtcttctgcccatgtttatttaagacttaaaaagggtcaaaccattgatgatataagcgaaggtgttctcgaagattgtgctcagcttgttaaagctaattccatccaaggcaacaaggtgaataatattgatgttgtttacactccatggtccaatttgaagaaaactccttcaatggatgttggccaagttggctttcacaattccaagatggttcggactgtgagagtggagaagcggataaatgagatagttaacaggttgaacaagactaaagtggaaaggaaacctgatttgaaagctgagaaagaagcagtttatgcagcggaaaaagccgagagaaagcaacagttgagggaaaaaaaacgccgagaggagatgcaaaggcttgagaaggaaagacaagcagaaataagaagctacaagggtctgatggtctctgaaaagatgacatcaaacaaacaaattgcagcgacgagcaagtctttccaggaagtagaagaggattttatgtgaaatatactggtatttcatcgctaattacgattcttctagctgccagaaacttgctgtccgtcaaagaagggtggtttctttttacttctttttcattgcaagcttaagttatttgcctcgattaagtcggctcacttaggatttttacctccattttgcgtgagatgaacttctgctataggtgccatagattctatgaaacacgattcagatttccattgttgattaaggtgttatttctctttcaatttatatttattctgattccaaatgtgcaaatgatcatgccgtatggtaggatggtttttatggtattgcagttgagtgcgtgttcaaagaaaaatgactagtttaattttctagttgactcttggttctgctcattgggtgtgtactttaaacttcggaagacgtcatgcatttaagttcttaaattgttaactttacgaggtctggt

SEQ ID NO: 2537 - DNA, 773 bp, Flaveria ramosissima
cgaatggggaaaggaaacgaaggaaaccgtacgtggcgagagagaaagggggaggtggagtaataggaagatggtgttctacttcaaagcccgacctgaagccggagactacaccatcttcatgggtcttgacaagtttgagaacgaagagctcatcaaatacggcttcccagaagacatatggttccatgtggataaaatgtcttctgcccatgtttatgtgaggctgcacaagggccagacaattgatgacatatctgaaggacttcttgaagattgtgctcaacttgtcaaagcaaattccatccaaggaaataaggttaataacattgatgttgtttatactccttggcaaaacttgaagaagactccatccatggatgttggtcaagttggtttccacaacaataaagctgtgcgcactgtgagagtggagaagcgaataaatgagattgttaataggctcaaccgcacaaaagttgaaagaaaacctgatctgaaagctgagcgtgaagcggttaatgcagcagaaagggcagagaggaagcagctgctgcgagacaaaaaacgacgagaggaaatggagagactggaaaaggagagacaagcagaggtaaggagctacaaaaacctgatggtcgctgacaaaatgacttccaataaagagattgcatcaacccacaagtccctgcaggaacttgaagaggacttcatgtaaatcatcttcacaatacaacttaactgttttatgctccccgtttcttggtttgttg

SEQ ID NO: 2538 - DNA, 1563 bp, Gossypium raimondii
ggggattaaagtatttttatgggtaatttatcccaactttaccctactttttaaaccatggtatgagaaaggctggtctcccaatatttccttaaccgaagggaggaaaaccctaattttgtctctcccaagagacgaaaggaagggaaaaatggtgttttacttcaaagcccggccagaagctggcgattacaccattttcatgggtcttgacaagtacgagaacgaggagctcatcaaatatggcttcatcgaagatatctggttccatgtggataagatgtcttctgcccatgtttatttaagacttaaaaagggtcaaaccattgatgatataagcgaaggtgttctcgaagattgtgctcagcttgttaaagctaattccatccaaggcaacaaggtgaataatattgatgttgtttacactccatggtccaatttgaagaaaactccttcaatggatgttggccaagttggctttcacaattccaagatggttcggactgtgagagtggagaagcggataaatgagatagttaacaggttgaacaagactaaagtggaaaggaaacctgatttgaaagctgagaaagaagcagtttatgcagcggaaaaagccgagagaaagcaacagttgagggaaaaaaaacgccgagaggagatgcaaaggcttgagaaggaaagacaagcagaaataagaagctacaagggtctgatggtctctgaaaagatgacatcaaacaaacaaattgcagcgacaagcaagtctttccaggaagtagaagaggattttatgtgaaatgtactggtatttcatcgctaattacgattcttctagctgccagaaacttgctgtctgtcaaagaagggtggtttctttttacttctttttcattgcaagcttaagttatttgccttgattaagtcggctcacttaggatttttacctccatcattttgggtgagatgaacttctgctataggtgccatagattctatgaaacacgattcagatttccattgttgattaaggtgttatttctctttcaatttatatttattctgattccaaatgtgcaaatgatcatgccgtatggtaggatggtttttatggtattgcagttgagtgcgtgttcaaacaaatgactagtttaattttctagttgactcttggttctgctcattgggtgtgtactttaaacttcggaagacgttatgcatttaagttcttaaattgttaactttacgaggtctggtggatacatgtaatttgagttaatatttagttggctggatgagattgttgtgattctttttcgtcttgtttctaatttattctcaatgagaatgaaaattgtagaattttccaaattcctgctattgaaatattcctgaagttgttaaataaatgtttgttaaccttagttaattatttgtcgaaacaagtatgagtatctgaaacttctcaggaaaaaaaaatttattaggaatataaagctcttcttataaacggtgaaaatcaatattatttttacctgaaaaacaatgggtacaaaaagaaaa

SEQ ID NO: 2539 - DNA, 1401 bp, Gossypium raimondii
aggcgaaaaagaaaaaaaaaatgtgttaggcggtgataggcacgtagcttggttaaaacgctttcatttggtaaaacggaagcatcaaacaacagggaatttcttcacatcaagtttcaacgctatccacactttcaattattttcttggaagagggcaaaaaccctaattttgtctctgatctcccaaggaaggaaaagaaaaccaagaaataacgaaatttcgaaaggaaaaaaggatggtgttttacttcaaagctcgaccagaggctggcgattacaccattttcatgggtctcgacaagtacgagaacgaggaactcatcaaatatggcttccccgaagacatttggttccatgtggataaaatgtcttctgcccatgtttatttaagacttcaaaaaggtcaaaccatcgatgatataagcgaaggcttgctcgaagattgtgctcagcttgttaaagctaactccattcaaggcaacaaggtgaacaatattgacgttgtttacactccatggtccaatttgaagaaaaccccttctatggatgttggtcaagttggctttcacaattctaagatggtccggaccctgagagtggagaagcgaataaatgagatagttaacaggctgaacagaactaaagtagaacggacgcctgatttgaaagctgagagagaagcagtcaatgcagcggaaagagctgagagaaagcaacatatgagggaaaaaaaacgacgtgaggaactagaaaggcttgaaaaggaaagacaagcggagataagaagctacaagggtctcatggtatctgaaaagatgacatccaacaaacaaattgctgagacgagcaaatctttgcaggaacttgaagaggattttatgtagaagatactggtattcatatggcaattaacgatgatgatgggtgccaaaaacctgctgcccttcaaagaaggtggtttgttgttggtttacgattgatgttatgtgccttgtgaataagtcacctcggttttgaatatcttactttcgaggatttggataagaaaagagacaacatggaatggaaactgacatattatgagaaatctatgtaattgtttgtcatttgcaggcttcaaggagtagaatgaagtcaaagattgaggatgagtgagatgaacttctgttatggtcttagtacctgataataaaacataattcatatctctatttctgattaataaaatcgtcgtttttcgatttaacatcataaatttggattgcaaatttacatatgccatattaccatggttttgattgcaaattttgcttatgttttaccacgtaaacccatccattggtgctatgcggtccagggatgacaaggattggttgtcccaaaaaaaaaaaaaaagaga

SEQ ID NO: 2540 - DNA, 1248 bp, Vitis vinifera
gcttcgttaacttatctacgaatctccaaagtccaaaccctaaaagcgctctctctctcatccacaaacgctaaaactcaaaccttttgggcagtttggcgttgaggagagcctaagaagcgaatcaacgatggttttctacttcaaagcccgaccagaggctgctgattacaccattttcatgggtctcgataagcacgagaacgaagagttgatcaaatatggtttccccgaagacatctggtttcatgtggataagatgtcctcagcccatgtttatgtaagattgcacaagggtcagacaattgatgatataagtgaaggtttactggaggattgtgctcagcttgtcaaagcaaactccatccaaggcaacaaggtgaacaatgttgacgtcgtatacactccatggcacaatctgaagaaaactgcttctatggatgttggccaagttggtttttacaattcaaaaatggtacgcactgtgagagtggagaagcgaataaatgagatagttaatagattgaacaggacaaaagtagaaaggaaaccagatttaaaagctgagcgagaagcagttaatgcagcagaaagagctgagagaaaacttcagctgagagataaaaaacgtagggaagaaatggaaaggcttgaaaaagagagacaagcagagataaggagctacaagggtttgatggtctctgaaaagatgacttctaacaaacagattgcatcagcaaacaagtcgttgcaagaactggaagacgacttcatgtaaacgcatggtatggtgttgttccattggttgcaaaaactttgctgcccaaaccaaagttggaaatttggaatttcttctctttatgattcttaattgctccccttcaaatgaatcgcctcagtcctaaaactagttattaatatcaaatgagaaaagataaaaaagaaaaagggatttgcaactagtaactatatgtactgtaagataataaatctaaattttcattgatggtctattaatactttttgtattctgatctataaaacaaaatgtgtttgttattttggtttggtgattggttttagcttttcaatttgtttgattctttttctttttagtgaggcagttcctattgagtttgatctggtgtatgtaatttcaaagtgccattatcaatttgattaaatatgtttattttacgaagtttttttgctgtgagaatgatatacagtgtgcatgtctgtttctgc

SEQ ID NO: 2541 - DNA, 1149 bp, Sarracenia psittacina
tgggagaagaatgaggttggcttcgatttcctagattataaaaattccaaatactcatgccagttgtacggggaatgttatgagatagattgagactaattattctataaaaggacatttctttttgtacatctggtattagaatcgtttacccatcctcgcctcgaaaccctagaccagggagaacatcatcgtccagtcacacaaagacaatggtgttctacttcaaagcacgacctgaggccggtgactacaccatcttcatgggcctcgacaagcacgagaacgaggagctgatcaagtacggtttccctgaagacatttggtttcatatagataaaatgtcgtcagcccatgtttatgtgagactgcacaaaaatcaaacaattgatgatctatcggaaggccttttggaagattgtgctcaactagtcaaagcaaattctattcaagggaacaaggttaataatgttgatgttgtttacacaccatggcacaacctgaagaagactgcttctatggatgtgggccaagttggcttccacaattcaaaaatggtccgcactgtgagggtggagaagcgaataaatgaaatagttaatagattgaaccggacaaaagtggaaaggaaaccagacttgaaagctgagcgagaagcagttaatgcagcagaaagagcggagagaaaacagcagctgagagataaaaaacggcgagaggagatggagaggcttgaaaaggagaagcaggcagagataaggagctacaagaatttgatggtggctgaaaagatgacgtctaacaaagagatagcatcagccaacaaatccttacaagaacttgaagaagacttcatgtaagcatggtataatttcaactgttgaacaattgaacaaatttcaccaccttattgcaagaatcaagaaatctgttcacagtgggaatgtaatgggatgtggaggtttctttattgttctgttgtgcgactataagcacaaataaactttctggtgagatgaacttgatttagtcctgaatctcttgatgactgttatgttactaataagaggaaccatcttgttatttaaaagagagaaaatttgattggatgaacagattggttcttagataatgatgataaatattagc

SEQ ID NO: 2542 - DNA, 1187 bp, Gossypium raimondii
aaaacggaagcatcaaacaacggggaatttcttcacatcaagtttcaacgctatccacactttcaattattttcttggaagagggcaaaaaccctaattttgtctctgatctcccaaggaaggaaaagaaaaccaagaaataacgaaatttcgaaaggaaaaaaggatggtgttttacttcaaagctcgaccagaggctggcgattacaccattttcatgggtctcgacaagtacgagaacgaggaactcatcaaatatggcttccctgaagacatttggttccatgtggacaaaatgtcttctgcccatgtttatttaagacttcaaaaaggtcaaaccatcgatgatataagcgaaggcttgctcgaagattgtgctcagcttgttaaagctaactccattcaaggcaacaaggtgaacaatattgacgttgtttacactccatggtccaatttgaagaaaaccccttctatggatgttggtcaagttggctttcacaattctaagatggtccggaccctgagcgtggagaagcgaataaatgagatagttaacaggctgaacagaactaaagtagaacggacgcctgatttgaaagctgagagagaagcagtcaatgcagcggaaagagctgagagaaagcaacatatgagggaaaaaaaacgacgtgaggaactagaaaggcttgaaaaggaaagacaagcggagataagaagctacaagggtctcatggtatctgaaaagatgacatccaacaaacaaattgctgagacgagcaaatctttgcaggaacttgaagacgattttatgtagaagatactggtattcatatggcaattaaagatgatgatgggtgccaaaaacctgctgcccttcaaagaaggtggtttgttgttggtttacgattgatgttatgtgccttgtgaataagtcacctcggttttgaatatcttactttcgacgatttggataaggaaagagacaacatggaatggaaactgacatattatgagaatctatgtaattgtttgtcatttgcaggcttcaaggagtagaaggaagtcaaagattgaggatgagtgagatgaacttctgttatggtcttagtacctgataataaaacataattcatatctctatttctgattaataaaatcgtcgtttttcgatttaacatcataaattt

SEQ ID NO: 2543 - DNA, 1007 bp, Aquilegia formosa
gaattatagagaaatcaatatggttttttacttcaaagctcgtcctgatgttggcgattacaccatttttatgggtttagataagcatgagaatgaagagcttatcagatatggattccctgaagatatttggttccatgtagataagatgtcatctgctcatgtttatgtgcgattgaacaagggtcaaaccattgatgacataagtgagggtttactagaagactgtgctcaacttgtaaaagcaaattccattcaaggcaacaaggtgaacaatgttgatgttgtttataccccttggtacaatttgaaaaagactgcttccatggatgtcgggcaagttggattccacaatcctaagatggtccgcactgtaaaggtagagaaacgcttaaatgaggtagttaatagattgaacaaaacgaaggtggaaagaactccggacttgaaagctgagagagaagcaattggtgcagcagaaagatcagagaaaaaagttcagatgagagataaaaaaaggcgtgaggagatggagaggcttgagaaggagaaactggcagatattaggagctacaaaggcttgatggtatcggagaaaatgacctccaataaacaaatagcatcagaaaacaggtccttgcaggagatggaagaggattttatgtaaactagcatcattgcagattgaaacttcctttaaaagctcttaatctgccaaaacttcgactccattccaggggaagagaattttcaaagaaatacatatgtacgaagttgccctctcccattcaaatccggtcgattgtgcatctatgtcctatatattttatatatgatgatattttcttgcaatactatttattcacgtacattcaaatctttatgtacggaacttggtctatatattggcatttacaaacatgaaaatgtcacagctatagcctaccttgattttgtgggttcatttgatgtttttactgcaacatgcatttcatattttcatatgc

SEQ ID NO: 2544 - DNA, 864 bp, Arnica chamissonis
agagcagaaagatcgaagatggtgttctacttcaaagcccgaccagaagccggagactacaccatcttcatgggtctggacaagtttgagaacgaagaactcatcaaatacggattccccgaagacatatggttccatgtggataaaatgtcttctgcccacgtttatgtgaggctgcgcaagggtcagacaattgatgacatatctgaaggacttcttgaagattgcactcaacttgtcaaagcaaattccatccaaggaaataaagtgaataacattgacgttgtttatactccttggcaaaacttgaagaagactccatccatggatgttggtcaagttggtttccacaacaataaagctgtgcgcactgtgagagtggagaagcgaataaatgagattgttaataggctcaaccgcacaaaagttgaaagaaagcctgatctaaaagctgagcgtgaagcggttaatgcagcagaaagggcagagaggaagcagctgctgcgagacaaaaaacgacgagaggaaatggagagactggaaaaggagagacaagcagaggtaaggagctacaaaaatctgatggttgctgacaaaatgacgtccaataaagagattgcatcgacccacaagtccttgcaggaacttgaagaggacttcatgtgaaccgtcttcacgatacaaccaaaagccctcaatatcttggtttgctgatgttttaataaagcctggaaatcgcaattgtatgaatttgctctttgatttgatgataaatgcacaatgattggtttgttttgcatgtttattttcaaactcctttttataatcactaagctttagcaatgaaaaagtctcatttatggc

SEQ ID NO: 2545 - DNA, 1097 bp, Beta vulgaris
gtatatttgtaccatattcgcgaggagagagagagacaacttcaaacagaagaagaagatggtgttttacttcaaggctcgacccgaagctggggatttcactattttcatgggtcttgataaatacgaaaatgaagaactcatcaaatacggctttcctgaagacatttggttccatgtggacaaaatgtcttcggcccatgtctatgtaagattgcataaaggtcaatctttggatgacatatctgaagctttgttggaggattgtgcacagttagtgaaagcaaattccatccaaggcaataaagtgaataacattgatgttgtgtacactccttgggccaatttgaagaaaactgcttccatggatgttggtcaagttggtttccacaattcaaaaatggtccgcactgttcgagtagaaaagagaataaacgagattgttaataggctgaatcggacaaaggtggaaaggacaccagattttaaagctgagcgtgaagcatatagtgctgccgaaaaggcagaaagaaaagctcatctgagggaaaagaaacgtcgagaggaaatggataggcttgagaaagagaggcaagcagaaacgcgcagctacaaaaatttgatggtatctgacaagatgacatctaacaaacagatagcttcagctgagaaatccctgcaagagctagaagaggatttcatgtgaagtgaatccgatttcttttttcttctttgagaatgtgatttccatctaattgcaagcttgtacacaattgtcacgggcgtgctgttacttgatgatgtgggttggtttaatcacaaccaccattatctaatctgtccgttgaagactccgaatcatgtaactctatgatgatgatcaagaaaagggctgcgttgtatagggtggatagagagatcaatgtggtaattgtacgttgagagtctcaccctttgttcatgacagcaaaaatctggtgtgaaaagattatgatttttgtttgcggattatatgaaattgctttattaagcatgaacgagggttattttgtggcctagtagctttaagacttgagttggatttaatagggttgggg

SEQ ID NO: 2546 - DNA, 1028 bp, Vaccinium corymbosum
catcgtcgtctgctcgcgtgaagagacaatggtgttctacttcaaagcccgacccgaggccggcgactacacaatcttcatgggcctcgacaagttcgagaacgaggagctcatcaaatacggtttccctgaagacatctggtttcatgtggataaaatgtcttcggctcatgtttatgtgagactgcacaagggtcagacaattgatgatatgtccgaaggtcttttggaagattgtgctcaattagtcaaagcgaactctatccaaggaaacaaggtgaataatgttgatgttgtttacacgccatggcataacttaaagaagacagcttcaatggatgttggccaagttggttttcacaactcaaaaatggttcgcactgtgagagtggagaagcgaataaatgaaatagttaatagattgaatcggacaaaggttgaaaggaaaccagacttgaaagctgagcgagaagcagttaatgcagcagaaagagcggagagaaagcaacatctgagagataaaaaacgacgggaagagatggagaagcttgaaaaggagaggcaagcagaagttagaagctacaagaacctgatggtagctgaaaagatgacatctaacaaagagatagcttcagccaataagtccttacaagaactggaagaggacttcatgtaggcatggtttaatttcaactctcaaccacctttaaccttattgcaggaatcaagaaatcttgctgcagcaaatgtactggtatgggaatgtatcttcattattttctgtggtcttgcgcaaaattgtactctatggtgagatgaatttgatatagaaagaacccctttgattaataagatggaaaagacttgtaatttatgatggagatgtactttgttttgtatcaacagattggttcaattgatgatgatgataaaaatgagcgacattttgttgtggtctgtgggcctcaaagtgtaaagcttgggcttttattgagaaaactatatacctggttgacattgttttgttt

SEQ ID NO: 2547 - DNA, 1088 bp, Castanea mollissima
gaaaaatcagagaagaagccctaatctaaaacgcgtcgatctctggtggcctaggttgttcctcatcggaaaagccatggtgttctacttcaaagctcgaccagaggctggcgattacactattttcatgggcctcgacaagttcgagaacgaggagctcatcaaatacggcttccccgaagacatttggttccatgtggataaaatgtcttcagcccatgtttatataagactgcacaaaggtcagactattgatgatattagtgaaggtgtattggaggattgtgttcagcttgtcaaagcaaattccatccaaggcaacaaggtgaataacattgatgttgtttacacaccctggtccaatttgaagaaaactgcttctatggacgttggtcaagttggttttcacaacccaaaaatggttcgaactgtgagagtggagaagcggattaatgagatagttaataggttgaacaggacaaaagtggaaaggaaacctgatttgaaagctgagcgagaagcagttaatgcagcggaacgagcagagagaaaactacagctgagagacaaaaaacggcgcgaggagatggaaaggcttgaaaaggagagacaatcagagctaagaagctacaagggtttgatggtttctgaaaacatgacatctaataaacagattgcaacaacaagcaagtccttgcaggaactggaagaagacttcatgtaagagcatcatttgttaaaatgttcaatagatgctagctgccaaagttactgggcctataaagaaggctgtcatatagtttgtgattctaggcctcaagtaatttcatcatgcctgaataacacattccctagtctgtttcctgtggatgttaaataagaaaatggtgtctgcaatgttaacagaggaggaaggaggtggggggaagaaatctccttttacctaccatatatgtactttgatggtgatgaaaaacattatttgtatctgcattgggatagtgggtgataaagctgtgttttcttgcccaactttataaacaaaacgtatgtctattttatttaaggtttcatccggttcagattgt

SEQ ID NO: 2548 - DNA, 1300 bp, Cicer arietinum
ctaaccccaatgcgtgtttgccatttgaaaaagacgaaacggagacttgcgtgattttatgcagcaatttggatacatatttacccaaattggaattttgagtcccaaactcagaaccctaacgcactctctttcttctatcgtctcgcgtgcgtgcgtgaaagctaagcaattcaatggtgttctacttcaaagcacgccctgaagccggcgattacaccatcttcatgggacttgacaagttcgaaaatgaggagctcatcaaatacggttttatcgaagatatctggttccatgtcgataagatgtcttcagcccatgtttatgtcagattgcacaaaggacagactattgatgacatgagtgaaggtttactggaagactgtgctcaacttgtcaaagcaaattccattcaaggaaacaaagtaaacaatgttgatgttgtttacactccctggtctaatttaaagaaaactgcttcaatggacgttggtcaagttggttttcacaaccctaaaatggtgcgaactgtgagagtggagaagaagataaatgagattgttaacaggctgaacaagacaaaggtggaaagaaaacctgatttgaaagctgagcgagaagcagttaatgcagctgaaagagctgagagaaaacaccaactgagagaaaagaaacgccgtgaggaattggaaagactggaaaaggagaaacaatcagagcttaggagctacaagggtttgatggttgccgaaaatatgacatcaaacaaagatattgcatcaggaagcaaatcattccaggaagtggaggaggatttcatgtaagcattgattattggattatagacagatgaccgatgttcaacttgctgccattgattaaatagcccaaccggaatctgaaactgcatcactgttttggttaaggaaaccaagtggtgtgtagccaactgtgatttagggataaaggggaaaagagaaaaaaatagggacgggataatgcattgtgttagtctgttcgacacaatgattggtttttgtaccttgtgatggtaatttacttgatttataactttgcttgagacaatggtttttacattaatgttctcacattcgagtaaaaaattgaagtctcttgctctatttatcacaaaagtcttgctaggattgttcagttataattttgtttccctctttgaaattgttgttaactgtgtgagaaattattggggctttttgtagcattcatgcatggtaatggcttacaacacatggcctataactaatagagatcacgggga

SEQ ID NO: 2549 - DNA, 1518 bp, Gossypium hirsutum
ccctactttttaaaccatggtatgagaaacgctggtctcccaatatttccttaacagaagggaggagaaccctaattttgtctctcccaagagacgaaaggaagggaaaaatggtgttttacttcaaagcccggccagaagctggcgattacaccattttcatgggtcttgacaagtacgagaacgaggagctcatcaaatatggcttcatcgaagatatctggttccatgtggataagatgtcttctgcccatgtttatttaagacttaaaaagggtcaaaccattgatgatataagcgaaggcgttctcgaagattgtgttcagcttgttaaagctaattccatccaaggcaacaaggtgaataatattgatgttgtttacactccatggtccaatttgaagaaaactccttcaatggatgttggtcaagttggctttcacaattccaagatggttcggactgtgagagtggagaagcggataaatgagatagttaacaggttgaacaagactaaagtggaaaggaaacctgatttgaaagctgagaaagaagcagtttatgcagcggaaaaagccgagagaaagcaacagttgagggaaaaaaaacgccgagaggagatgcaaaggcttgaaaaggaaagacaagcagaaataagaagctacaagggtctgatggtctctgaaaagatgacatcaaacaaacaaattgcagcaacaagcaagtctttccaggaagtagaagaggattttatgtgaaatgtactggtatttcatcgctaattacgattcttctagctgccagaaacttgctttctgtcaaagaagggtggtttctttttacttctttttcattgcaagcttaagttatttgccttgattaagtcggctcacttaggatttttacctccatcattttgggtgagatgaacttctgctataggtgccatagattctataagacacgattcagatctccattgttgattaaggtgttatttctctttcaatttatatttattctgatcccaaatgtgcaaatgatcatgccgtatggtaggatggtttttatggtattgcagttgagtgcgtgctcaaacaaatgactagtttaattttctagttgactcttggttctgctcattgggtgtgtactttaaacttcgggagacgttatgcatttaagttcttaaattgtttactttacgaggtctggtggatacatgtaatttgagttaatatttagttggctggatgagattgttgtgattccttttcgtcttgtttctaatttattctcaatgagaatgaaaattgtagaattttccaaattcctgctattgaaatattcctgaagttgttaaatgcatgtttgttaaccttagttaattatttgtcgaaacaagtatgagtatctgaaacttctcaggaaaaaaaattattaggaatataaagctcttcttataaacggtgaaaatcgatactatttttacctgaaaaacaatgggtacaaaaagaa

SEQ ID NO: 2550 - DNA, 1078 bp, Gossypium hirsutum
gcgaagaagaaaaaaaatagtgttaggcggtgataggcacgtagcttggttaaaacgccttcatttggtaaaacggaagcatcaaacaacagggaatttcttcacatcaagtttcaacgctatccacactttcaattattttcttggaagagggcaaaaaccctaattttgtctctgatctcccaaggaaggaaaagaaaaccaagaaataacgaaatttcgaaggaaaaaaggatggtgttttacttcaaagctcgaccagaggctggcgattacaccattttcatgggtctcgacaagtacgagaacgaggaactcatcaaatatggcttccctgaagacatttggttccatgtggacaaaatgtcttctgcccatgtttatttaagacttcaaaaaggtcaaaccatcgatgatataagcgaaggcttgctcgaagattgtgctcagcttgttaaagctaactccattcaaggcaacaaggtgaacaatattgacgttgtttacactccatggtccaatttgaagaaaaccccttctatggatgttggtcaagttggctttcacaattctaagatggtccggaccctgagagtggagaagcgaataaatgagatagttaacaggctgaacagaactaaagtagaacggacgcctgatttgaaagctgagagagaagcagtcaatgcagcggaaagagctgagagaaagcaacatatgagggaaaaaaaacgacgtgaggaactagaaaggcttgaaaaggaaagacaagcggagataagaagctacaagggtctcatggtatctgaaaagatgacatccaacaaacaaattgctgagacgagcaaatctttgcaggaacttgaagacgattttatgtagaagatactggtattcatatggcaattaaagatgatgatgggtgccaaaaacctgctgcccttcaaagaaggtggtttgttgttggtttaggattgatgttatgtgccttgtgaataagtcacctcggttttgaatatcttactttcgacgatttggataaggaaagagacaacatggaatggaaactgacatatta

SEQ ID NO: 2551 - DNA, 1129 bp, Cucumis sativus
gaatattattctacgctatcctggagggtggtatatcagcgtcctgttaaaagattcaaaatcacacgcaactcgctagagggctaatctctctctatttttccccaaattgaaaaccctaattcattccattctctccatttctgagagttgagcaaacgaaatcgaagcaccatggtcttctatttcaaagcccggcctgacgtcggcgattacaccattttcatggggcttgacaagtacgagaacgaggagctcatcaaatacggcttcatcgaggatatttggttccatgtggacaagatgtcatctgctcatgtatatgtgagactgcaaaaagggcagaccattgatgatattagtgaagggttgctggaggattgtgcccagcttgtaaaagcaaattctattcaaggaaacaaggtgaacaacatcgatgttgtgtatacaccttggtccaatttgaagaaaactgcttcgatggatgttggccaagttggttttcataaccccaagatggtccgaactgtgagggtggaaaaacggatcaatgacattgtcaatagattgaacagaactaaagtggaaaggaagcctgatttgaaagccgaacgtgaagcagtgaatgcagctgaaagagcagagaggaagcaacacttgagagataagaaacgccgcgaggaaatggaaaggttagaaaaagagaggcaagcagagttaaggagctacaagggtttaatggtgtctgaaaagatgacatctaacaaacagattgcagcaacaagcaaatcactacaagagctggaggatgatttcatgtgatcgaattgatccgcggttcaaatgctgcaaaaactagcagcagctaaacctgctcgtccgtagagatggccatctgcccaatccagtttgtggttcttggcccaaagttgttctctcgtgagtgagtgatcaaattgtctttagcctcgatgatattcaactctattgtgtctagacacttgatgactatacaaatggaaaattgctgtgcctttcaagatagcggagaaatggtgttctgtaagttgtaattactgttactcttgtttaatgatgataaattcagctcgttttggcctactttttt

SEQ ID NO: 2552 - DNA, 911 bp, Flaveria ramosissima
ggaaaggaaagcaaaccctagagagaaagagaagggaggaggtggtgaggattaggaagatggtgttctacttcaaagcccgagcagaagccggagactacaccatcttcatgggtcttgacaagtttgagaacgaggagctcatcaaatacggcttcccagaagacatatggttccatgtggataaaatgtcttctgcccatgtttatgtgaggctgcacaagggacagacaattgatgacatctctgaagggcttcttgaagattgtgctcaacttgtcaaagcaaattctatccaaggaaacaaggttaataacattgatgttgtttatactccttggcaaaacttgaagaagactccatccatggatgttggtcaagttggtttccacaacaataaagctgtgcgcactgtcagagtggagaagcgaattaatgagattgttaataggctcaaccgcacaaaagttgaaagaaaacctgatctaaaagctgagcgtgaagcggttaatgcagcagaaagggcagagaggaagcaactgctgcgagacaagaaacgacgagaggaaatggagagactggaaaaggagagacaagcagaggtaaggagctacaaaaacctgatggtcgctgacaaaatgacttccaataaagagattgcatcaacccacaagtccctgcaggaacttgaagaggacttcatgtaaatcatcttcacaatacaacttaaactgttttatgctctccccatttcttggtttgttgatgtttaataaaagctaaaatggccaactttccaagagtagggggaagctcgctttgtttaaatttgctcttaaatactttgatatgaggataaatttatcagcacaatgattggtttgtttgcatatcaaaatctgaatcttata

SEQ ID NO: 2553 - DNA, 835 bp, Plantago ovata
agctgaattcaattttcatctctctcacttgaatcgatttgaaaccctagagaggcgattggaatttggaaagatggtgttctacttcaaggctagacctgaggctggagattacaccatcttcatggggctcgacaagttcgagaacgaggaactcatcaaatacggctttcctgaagatatttggttccacgtagataaaatgtcatctgcacatgtttatgtgaggttgcacaagggtcaatcaattgatgacatatctgagggtctactggaagattgtgtgcagcttgttaaagcaaattctattcaaggaaacaaagtaaacaatattgatgtggtttatactccttggcaaaatcttaagaagaccccttccatggatgttgggcaagttggtttttacaactccaaaatggttcgcactgtgagagtggagaagcgcatcaatgagatagttaatcgcttaaataggacaaaggttgaaaggaagccagatctgaaagctgaaagagaagcagttaatgcagctgagagggcggagaggaagcagcagctgagagacaaaaaacgacgggaagagttagataggcttgaaaaagagagacaggctgagatgagaagctacaaaaacctgatggtggctgagaagatgacatctaacaaggacatagcttcagcaaacaagtcccttcaagaactggaagaggactttatgtaaaatccgaaatgctacaacttgtcgaagcttggctattaatgaagaatgaatgagagacatcgcccgttagggtaaagaggaggacgtgggtaatttaaaacatacaatgtacgg

SEQ ID NO: 2554 - DNA, 1492 bp, Populus trichocarpa
cagaataaaaatttcaaacagcgtttggaagaaagacgcccagttagcaacgaatcctaccacagcaaaagcaaacctccgtcaaaacaaaaacacaaagcaaagcaaagccatagaaaaaccacccacaaaacatacacgatcaaaaccacataaattattctgaattgttttttattgtttgaaataaaaaagagagatggtgttctacttcaaagccagaccagaggcaggagattacactatttttatgggtcttgacaagtacgagaacgaggagcttatcaaatatggtttccctgaagacatctggtttcacgtggacaaaatgtcttctgcccatgtgtatgtaaggctgcataaaggtcagaccattgatgatataagtgaaggtgtacttgaggattgtgtgcagcttgttaaagcaaattcgattcaaggcaacaaggtgaacaacattgatgttgtttacactccttgggccaatttgaagaaaactgcttccatggatgttggtcaagttggcttccacaattcaaagatggttcgaactgtgagagtggagaagcggctaaatgaggtagttaatagattgaacaaaacaaaggtagaaagaaaacctgatttgaaagctgagagagaagcagtcaatgcagcagaaagagcagagagaaagcttcttctgagagataaaaaacgacgtgaggaaatggaaaggcttgaaaaggagagacagacagagataaggagctacaagggtttgatggtggctgaaaagatgacatccaataaacaaatagcatctgaaaacaagtccttgcaggagctggaagacgactttatgtaaagcaatggtattcaggggttctgctgaacctgctgccccttgaagatgcgggtttgtcattcagtttgtgacttcaagcattatatgaataaacttagaaaatttggaaaggtacatgtaatgccaggcgaagggggaggagatcagggttggggaattacttgtctgctataagttatactctggtgacaatgacaatgacaaacaaacatggttaaaattgaattgtggttaatgtgtgatagacatcgtttatcatagacgatagtttatcaatcttgctatttagtttttgcaacaaggtttattgaagcttgtttggtcacgcccatatgcaagtgcaaatatgaaaatttggttttagtcctgatcctttatagtttcagtattctgatttttaggattgcttgatcaaatttcatgtcaatcatctcttcaaggatttcataaatgacctgttgggcttcacaatcttaaccacctgatttggtggcaaatactttctacaggtggttcccttctcatgcttgatttgttggtttcagtcgatcttcgagtcttcacatttgtggtttgtctcaggtcagccattttctgacagattcactcagaatgctcgactgtctggcgcgcaatattcaggtc

SEQ ID NO: 2555 - DNA, 1254 bp, Glycine max
ggtgctaatggatcatggtagaaaaaaaaattgtttgcatttgatgagaagctgaaaattccaaagcaggtattattatattatttgtactagtagccagtagccgccacaaaggcgtattcttgggctttagtaaaaggtgaaagggaaggttccgtgattttgatttacgcagcgattcggataacgaaagcaattttgatttgtgtcgaggaaaggacaggtcttagaacccttcttttcttcctcgtgtgcgtgaaaacgaagcaacgccacacgatggtgttctacttcaaagcgcgccctgaagccggcgatttcaccatcttcatgggcctcgacaagttcgagaacgaggaactcatcaaatacggttttcccgaagacatctggttccatgttgataaaatgtcttcagcccatgtctatgtcaggctgcacaaaggccagactctcgatgacctgagtgaggctttactggaagattgtgctcagcttgtcaaagcaaattcaattcaaggaaataaagtgaacaatgttgatgttgtttacactccctggtctaatttaaagaaaactgcttcaatggatgttgggcaagttggttttcacaactcaaaaatggttcgaactgtgagagttgagaagcggataaatgagattgttaacaggctaaacaagacaaaagtggaaaggaaacctgatttgaaaggtgagcgagaagcagtcggtgcagctgagagagctgagaggaaacaacaactgagagaaaaaaaacgccgtgaggaattggaaaggcttgaaaaggagaaacaaacagagcttaggagctacaagggtttgatggttgcagaaaatatgacatccaacaaacaaattgcatcaggaagcaaatcattgcaggaactggaggaggatttcatgtaatcaatcattttattgttgggttataggcagatgactggtggccaacttaccacctggcagatttatgttgattaaacaaccctactttggattctgaagctgcattatcttgtttgaggaaaccaagtagtgtgtacacaaattgtgattgagggataaaggaaaaggatgggggcaatgtaatgaatggactatgttcctggtaagggcaatataccttatctataactataactttgcttaagacaatggtttttgttattgatattctcacagtcgattaaaaaactgaaatttcttgctatttttatcatggtcgtttacgcc

SEQ ID NO: 2556 - DNA, 1219 bp, Glycine max
tactagtagccagtagccgccacaaaggcgtattcttgggctttagtaaaaggtgaaagggaaggttccgtgattttgatttacgcagcgattcggataacgaaagcaattttgatttgtgtcgaggaaaggacaggtcttagaacccttcttttcttcctcgtgtgcgtgaaaacgaagcaacgccacacgatggtgttctacttcaaagcgcgccctgaagccggcgatttcaccatcttcatgggcctcgacaagttcgagaacgaggaactcatcaaatacggttttcccgaagacatctggttccatgttgataaaatgtcttcagcccatgtctatgtcaggctgcacaaaggccagactctcgatgacctgagtgaggctttactggaagattgtgctcagcttgtcaaagcaaattcaattcaaggaaataaagtgaacaatgttgatgttgtttacactccctggtctaatttaaagaaaactgcttcaatggatgttgggcaagttggttttcacaactcaaaaatggttcgaactgtgagagttgagaagcggataaatgagattgttaacaggctaaacaagacaaaagtggaaaggaaacctgatttgaaaggtgagcgagaagcagtcggtgcagctgagagagctgagaggaaacaacaactgagagaaaaaaaacgccgtgaggaattggaaaggcttgaaaaggagaaacaaacagagcttaggagctacaagggtttgatggttgcagaaaatatgacatccaacaaacaaattgcatcaggaagcaaatcattgcaggaactggaggaggatttcatgtaatcaatcattttattgttgggttataggcagatgactggtggccaacttaccacctggcagatttatgttgattaaacaaccctactttggattctgaagctgcattatcttgtttgaggaaaccaagtagtgtgtacacaaattgtgattgagggataaaggaaaaggatgggggcaatgtaatgaatggactatgttcctggtaagggcaatataccttatctataactataactttgcttaagacaatggtttttgttattgatattctcacagtcgattaaaaaactgaaatttcttgctatttttatcatggtcgtttacgcctgtccggttttgaaatttgtttccctctttgaattgatgttcactgcttgcg

SEQ ID NO: 2557 - DNA, 869 bp, Helianthus annuus
ctctcgtcttattcttgtcaacggaaagcaaaccctagagagagagagagagagagagatcgaagatggtgttctacttcaaagcccgacctgaagctggagactacaccatcttcatgggtcttgacaagtttgagaacgaagagctcatcaaatacggcttccccgaagacatctggttccatgtggataaaatgtcttctgcccatgtttatgtgaggcttcggaagggtcagacaattgatgacatatccgaagggcttcttgaagactgtgctcaacttgtcaaagcaaattctatccaaggaaataaagtgaataacattgatgttgtttatactccttggcaaaacttaaagaagactccatctatggatgttggtcaagttggtttccacaacaataaatccgtgcgcactgtaagagtggagaagcgaataaacgaggttgttaataggctcaaccgcacaaaggttgaaaggaaacctgatctgaaagctgagcgtgaagcggttaatgcagcagaaagggcagagaggaagcagctgctgcgagacaaaaaacgaagagaagaaatggagagactggaaaaggagagacaggcagaggtgaggagctacaaaaatctgatggttgctgacaaaatgacttccaacaaagagattgcatcaacccagaaatccttgcaggaacttgaagaggacttcatgtaaaacaacatccatctatcttcacagtacaaccaaactaaactgttccataaaatgacactagcccccaagtctcttggtttgctgattcttatttaataaagctaaatcaaatgcgcaactccaaggagagggggaatcttgctttgtatgaattta

SEQ ID NO: 2558 - DNA, 991 bp, Helianthus annuus
cgggggatgactctcgtctttttcttgtcaacggaaagcaaaccctagagagagagagagagatcgaagatggtgttctacttcaaagcccgacctgaagctggagactacaccatcttcatgggtcttgacaagtttgagaacgaagagctcatcaaatacggcttccccgaagacatctggttccatgtggataaaatgtcttctgcccatgtttatgtgaggcttcggaagggtcagacaattgatgacatatccgaagggcttcttgaagactgtgctcaacttgtcaaagcaaattctatccaaggaaataaagtgaataacattgatgttgtttatactccttggcaaaacttaaagaagactccatctatggatgttggtcaagttggtttccacaacaataaatccgtgcgcactgtaagagtggagaagcgaataaacgaggttgttaataggctcaaccgcacaaaggttgaaaggaaacctgatctgaaagctgagcgtgaagcggttaatgcagcagaaagggcagagaggaagcagctgctgcgagacaaaaaacgaagagaagaaatggagagactggaaaaggagagacaggcagaggtgaggagctacaaaaatctgatggttgctgacaaaatgacttccaacaaagagattgcatcaacccagaaatccttgcaggaacttgaagaggacttcatgtaaaacaacatccatctatcttcacagtacaaccaaactaaactgttccataaaatgacactagcccccaagtctcttggtttgctgattcttatttaataaagctaaattaaatgcgcaactccaaggagagggggaatcttgctttgtatgaatttacccttttataaatgattggtttgtttgaatcttagattggtcattgaattctctacatagcgactctccatgacgtcacacaaattaagcggtcagcaggtcctatttgagagatgga

SEQ ID NO: 2559 - DNA, 1231 bp, Trigonella foenum-graecum
aaaagacgaaacggaaagttgcgcgtgattatgttttatgcagcaattcggatatcaattccccaaattgaaattgaagtaccaaactcagaaccctaacctaacgcactctctttcctctcgcgtgcgtgaaaccaaagcaactcaataatggtgttctacttcaaggctcgtcctgaagctggcgattacaccatcttcatgggtcttgacaagttcgagaacgaagagctcatcaaatacggtttcatcgaagacatatggttccatgttgataagatgtcttcagcccatgtttatgtcaggctgcacaaaggtcagactattgatggcatgagtgaaggtttattggaagactgtgctcagcttgtcaaagcaaattcaattcaagggaataaagtaaacaatgttgacgttgtttacactccctggtccaatttaaagaaaactgcttcgatggacgttggtcaagttggttttcacaacccaaaaatggtgagaactgtgagagtggaaaagaagataaatgagattgttaacaggctaaacaagaccaaggtggaaagaaaacctgatttgaaagctgagcgagaagcagttgctgcagctgaaagagctgagagaaaacatcaactaagagaaaaaaaacgccgtgaggaaatggaaagacttgaaaaggagaaacaatcagagcttaggagctacaagggtttgatggtcgcagaaaacatgacatccaacaaagatattgcatcaggaagtaaatcattccaggaagtggaggaggatttcatgtaaacattacagatgccataattaaataacccaactggaatctgaaactgaatcattgtcttggttaaggaaaccaagtagtgtgtacccaactgtgatttagggataaaggagaagataaaaaaaaaaagggaggggggaatgcaatgattgattttcgtaccttgtgatggttatattcctgatttatatttgcttgtgacaatggttttttacttttttgctctcacagtcgagtcaaaaactgaggtttcttgctataattattatctggagtcttgttaggcttgtaaggtttaaatttttgctttttggaaactgttgaatgcgcgataaattattggggcattttgaagtatatttatggtactggtagagaagctattttattttttgacatcacaagactaatggtagaaatagaatagtattaatt

SEQ ID NO: 2560 - DNA, 927 bp, Linum usitatissimum
accatggtattctacttcaaagcccgaccagaggtcggagattacacaatttcatgggtctcgacaagtatgaaaacgaggagctcatcaaatacggcttccccgaagatatctggtttcatgtggacaaaatgtcttcagctcatgtttatgttcggctgcacaagggtcagactctggacaacataagtgaaggattgcttgaagattgtgcacagcttgttaaagcaaattcaatccaagggaacaaagttaacaacattgatgttgtttacactccctggtcaaatttaaagaagactgcttcaatggatgttggtcaagttgggtttcataattcaaagatggtccgtactgtgaaagtggagaagcggatcaatgagatagtcaataggctgaacaaaacaaaagtggaaaggacgcccgatttgagagctgagagagaagctgtaaatgcagcagaaagggctgagaggaagcttcatttgagagataagaaacgacgggaggaaatggacaggcttgaaaaggagaggcaggcagagatgaggagctacaagggactgatggtggcagaaaagatgacttccaacaaacagatcgcatcagaaagcaagtccctgcaggagcttgaagacgatttcatgtgaacaaatgaaggctcccggaattatttgtacgatcagccaaaatggttccaacaaccaaattgtgattctggcttgttactcttaaagagtgagctctcctttgtatttctctcctctccctggtaactagaaaaggaagtaaaaagagagtactggtgggtgagaaagggtggagagtggagactaatcattcctaatttgcattttgcagttggaaacatgaaatgtttcgaaaagggtatttgatggtttttggataacatctcatgtccttggt

SEQ ID NO: 2561 - DNA, 892 bp, Ambrosia trifida
gaaggaaggaaggaagatggtgttctacttcaaagcccgacctgaagccggagactacaccatcttcatgggccttgacaagttcgagaacgaagaactcatcaaatacggcttccccgaagacatttggttccatgtggataaaatgtcgtctgcccatgtttatgtgaggctgcacaagggtcagacaattgatgacatatccgaagggcttcttgaagattgtgctcaacttgtcaaagcaaattccatccaaggaataaagtgaataacattgatgttgtttatactccttggcaaaacttaaagaagactccatctatggatgttggtcaagttggtttccataacaacaaagctgtgcgcactgtgagagtggagaagcgaataaatgaggttgttaataggctcaaccgcacaaaagttgaaagaaaacctgatctgaaagctgagcgtgaggcggttaatgcagcagaaagggcagaaaggaagcagctgctgcgagacaaaaaacgacgagaggaaatggagagactggaaaaagagagacaagcagaggtcaggagctacaaaaatctgatggttgctgacaaaatgacatccaacaaagagattgcatcaacccagaaatctttgcaggaacttgaagaggatttcatgtaaaacatccctatatcctcacaatacaaccaaaccaaaccaaaccaaactgttttaaaaaaaaaaaaaaagtttcataaagggacactagccctcgatctcttggtttgttgatctttaattaataaaactaaattaattgggcaactcttaaagaggagagggaagtttgctttgtatgaatttgctttttgctacttttataaatgattggtttgtttgaatcttaaaa

SEQ ID NO: 2562 - DNA, 1385 bp, Theobroma cacao
gcttaattgaaacgctgttatgtggaaaaaggcaaagcaccaaacaccgatctccttagtcctgaggtaatcattattctcaacaaatccctaattgaagggggaaaagaaaacctaatttcctttctggtctcacaagagagaaaagggttaaaggaagaacttttttttttttcccaaaaaaaatggtgttttacttcaaagcccgaccagaagctggcgattacaccattttcatgggacttgacaagtacgagaacgaggaactcatcagatacggattccccgaagacatttggttccatgtggataaaatgtcatctgctcatgtttatttacgacttcagaaaggtcaaaccatcgatgatataagcgaaggtgtgctcgaagattgcgctcagcttgttaaagctaattccatccaaggcaacaaagtgaacaatattgatgttgtttacactccatggtccaatttgaagaaaagtgcttccatggatgttggacaagttggctttcacaatcccaagatggtacggactgtgagagtggagaagcggataaatgagatagttaacaggttgaacaggactaaagtggaaaggaaacctgatttaaaagctgagagagaagctgttaatgcagcggaaagagcagagagaaagcaacagctgagggaaaaaaaacgatgtgaggagctggaaaagcttgagaaggaaaggcaagcagagataagaagctataagggtctcatggtctctgaaaagatgacatcaaacaaacaaattgcagagacaagcaagtcattgcaggaacttgaagaggattttatgtgaagcatatttcaatgccaattaagctgttgctagctgctgagcaaaaaaaaaaaaaaagatgctagctgccaaaaacctgctggctttcaaagaagggtggtttgttgttacttttctattgcaggcttgaagttatttccctcataaataagtcaccaaagtcctgaatatttacttctatcgggtttgatcagaaaaaaagacaaacatggaatggaaactaacttcgaagagtaaatggagtcaaggttgagggtgggggagatgaacttctgttatggttgctatatattgtactaaacatattcaaatctccattgctggtttacgtgtggtcgtttttcattttcatatttattctgatggcaaatttgcaaatgattatgccatattaccatggttttgattttgttttgtcaatgtttaccacaaaatcttaacagtgccatcacaggatgcacaagggttgagaatgtggaaatgtctaactgcagatgaattgttgataaagttatatggttgtgcctattgcactttcaagaagatgactac

SEQ ID NO: 2563 - DNA, 1138 bp, Chenopodium quinoa
agaaagagagagagaatcatccatcgaagaagatggtgttctactttaaggcccgacccgaagctggggattacactatcttcatgggtcttgataagttcgagaatgaagaactcatcaaatacggctttcctgaagatatttggttccatgtggacaaaatgtcttctgcccatgtctatgttagattgaatagagggcagacaatggatagcatatcagaaggtctgttggaggactgtgctcagcttgtgaaagcaaattccatccaaggcaacaaggtgaataacattgatgttgtttacactccctgggccaacttgaagaaaactgcttccatggatgttggccaagttggtttccacaactcaaaaatggtccgcactgttcgtgtagaaaagagaataaatgaggtcgttaataggctgaaccgaacaaaggtggaaaggacaccagattttaaagctgagcgtgaagcatatggtgctgctgaaaaggcagaaagaaaggctcagctgagagaaaagaaacgtcgagaggaaatggataggctagagaaagagagggtagcagaaatgcgaagctacaagaatttgatggtatctgacaagatgacttctaacaaacagatagcttcaggtgagaaatccttgcaagagctagaggaggatttcatgtgaagtgatccaaaattcttctgttctatgaaaatatggcggcgaagttctgcattttaattgtgagcttgtacacatgtcacttggtctcgctgcttctcaattgtgtggattggtcgaatcacatctacctttgtctgatcagtctattgaagactcctaatcatgtaactctattgtgatgatcatgaaaaggctgcattgtataggaggatagaacgattgatgttgtaccttgagagtctcatcatggtttccctcttgttcgtgacagcattaatcttgttaaaagattatatgtgatggatttgattttggtttgtgtgttatttggaaatgctttattaagctcattaactagggtatttgatagcctttgtatcttgagacttgactcatgtttaactgggttggggtccttggtgttttttcttaatgctgggattgatagagcaacagtc

SEQ ID NO: 2564 - DNA, 1290 bp, Phaseolus vulgaris
acagttgaagtttattagaacctggaaattccgacgcagatatcgtattttgttacacccaccacaacacaaaggcgcgtttgggtgtagtaaaagaagaaaggttcggtgtttatgattcacgcagagattcctagagcgacgcaattccccaattttgatttgttttgaggaaaagaacacgtcccatccagaaccctaacctaaccgcataccctttcttctatctacgtctgcgtccaaacaacgccacaagcatacacgcgatggtgttctacttcaaagcgcgtcctgaatccggcgattacactatcttcatgggcctcgacaagttcgagaacgaggagcttatcaaatacggttttcccgaagatatctggttccatgttgataaaatgtcttcagcccatgtctatgtcaggctgcacagaggccagactattgatggcatgagtgaaggtttactggaagactgtgctcagcttgttaaagcaaattcaattcaggggaataaagtgaacaatattgatgttgtttacactccatggtctaatttaaagaaaacagcttcaatggatgttggtcaagttggttttcacaattcaaaaatggttcgaacagtgagagttgagaagaggataaatgagattgttaacaggctaaacaagacaaaagtggaaaggaaacctgatttgaaagctgagcgagaagcagttaatgcagctgaaagagccgagagaaaacaacaattgagagaaaagaaacgccgtgaggaattggaaagacttgacaaggagagacaagcagagcttaggagctacaagggtttgatggttgcagaaaatatgacatcaaacaaacatgttgcatctggaagcaaatcattgcaggaactggaggaggatttcatgtaatcatttgattatttggttttagacagatgagtggtgatcaacttgctacctggcagatctatatattctggaatttgaagctgcattatgttatcttctttgaggaaacaaagtaatgtgtttacccaactgtaatcagatagagaagagagagggggggagggaatgattggagtatgttcttggtaaaggcaatttataccttaccttatctataaccttgcttgagacaatggtttttatattattgttctcacagtccagtcaaaaactgaaatttgtcttgctatatttagtggcagtttacgcttgtctgatttagaattcaatttcccctttttaattgagtttccccgtttgtgaaattgttgcaaaa

SEQ ID NO: 2565 - DNA, 1310 bp, Phaseolus vulgaris
gtgttctgttatttgtgtgaaatttgttaccacagttgaagtttattagaacctggaaattccgacgcagatatcgtattttgttacacccaccacaacacaaaggcgcgtttgggtgtagtaaaagaagaaaggttcggtgtttatgattcacgcagagattcctagagcgacgcaattccccaattttgatttgttttgaggaaaagaacacgtcccatccagaaccctaacctaaccgcataccctttcttctatctacgtctgcgtccaaacaacgccacaagcatacacgcgatggtgttctacttcaaagcgcgtcctgaatccggcgattacactatcttcatgggcctcgacaagttcgagaacgaggagcttatcaaatacggttttcccgaagatatctggttccatgttgataaaatgtcttcagcccatgtctatgtcaggctgcacagaggccagactattgatggcatgagtgaaggtttactggaagactgtgctcagcttgttaaagcaaattcaattcaggggaataaagtgaacaatattgatgttgtttacactccatggtctaatttaaagaaaacagcttcaatggatgttggtcaagttggttttcacaattcaaaaatggttcgaacagtgagagttgagaagaggataaatgagattgttaacaggctaaacaagacaaaagtggaaaggaaacctgatttgaaagctgagcgagaagcagttaatgcagctgaaagagccgagagaaaacaacaattgagagaaaagaaacgccgtgaggaattggaaagacttgacaaggagagacaagcagagcttaggagctacaagggtttgatggttgcagaaaatatgacatcaaacaaacatgttgcatctggaagcaaatcattgcaggaactggaggaggatttcatgtaatcatttgattatttggttttagacagatgagtggtgatcaacttgctacctggcagatctatatattctggaatttgaagctgcattatgttatcttctttgaggaaacaaagtaatgtgtttacccaactgtaatcagatagagaagagagagggggggagggaatgattggagtatgttcttggtaaaggcaatttataccttaccttatctataaccttgcttgagacaatggtttttatattattgttctcacagtccagtcaaaaactgaaatttgtcttgctatatttagtggcagtttacgcttgtctgatttagaattcaatttcccctttttaattgagtttccccgtttgtgaaa

SEQ ID NO: 2566 - DNA, 1067 bp, Cichorium intybus
cggggatcttttcactttgatcgacaaaataaagcaataaggagtcgtcttctctcctcttttcccaaacgcaaaccctagagagagggacagagagaaaagagtctcctttgtggagagcaaagagagcgaagatggtgttctacttcaaagcccgaccagaagccggagactacaccatcttcatgggtcttgacaaattcgagaacgaagaactcatcaaatacgggttcccagaggacatttggttccatgtggacaaaatgtcttctgcccatgtttatttgaggatgcgaaaaggtcaaacaattgatgacatttctgaaggccttctagaagattgtgctcaacttgtcaaagctaattccatccaaggaaataaagtgaacaacattgatgttgtgtatactccttggcaaaacttaaagaagactccatcaatggatgttggtcaagttggtttccacaacaataaagctgtgcgcactgtgagggtggaaaagcgaataaatgaggtagttaatagactcaacaggacaaaagtggaaagaaaacctgatctcaaagctgaacgtgaagcagttaatgcagcagaaagggcagagaggaaacagcagctgagagacaaaaaacgacgagaggaaatggagaggctggaaaaggagagacaagcggaggttcgaagttacaaaaatctgatggttgctgacaaaatgacttccaacaaagaaattgcatccactcacaagtccttacaggaactcgaagaggacttcatgtaaaacatctttcacaatacaacaacaaccaacaaactgttttctttttgaccagtttgacttttggttttgagtccaaagttattgattgatgtagacttgtgaatttcaagcgtttatgatgccccgagtctcttggtttttgtggaaaataaaagctaaaaaatggccccgaattcgcaattccaagagggagggaaggttggtttgtatgaatttgttgtttggtactttgagattgttgatgataaggttattttgaattgttggtatgatgtttatttatat

SEQ ID NO: 2567 - DNA, 1159 bp, Cirsium arvense
caattaagtcatcattctctccttttccctaaacgcaaaccctagagagagaaagagagagaaagagagagaagagtctcctccgtggagagcaggggaagcagggaagaagtcagagagagcgaagatggtgttctacttcaaagcccgaccagaagccggagactacaccatcttcatgggtcttgacaaattcgagaacgaagaactcatcaaatacggattccccgaagacatatggttccatgtggataaaatgtcttctgcccatgtttatctgaggatgcgcaagggtcagacaattgatgacatatctgaaggacttcttgaagattgtgctcaacttgtcaaagcaaattctattcaaggaaataaggtgaacaacattgacgttgtttatactccttggcaaaacctaaagaagactccatccatggatgttggtcaagttggtttccacaacaataaatctgtgcgtactgtgagagtggagaagcgaataaatgaggtagttaatagactaaacaggacaaaggtggaaagaaaacctgatctgaaagctgagcgtgaagcagtcaatgcagccgaaagggcagagaggaaacagcagctgagagacaaaaaacgacgagaggagatggaaaggctggaaaaggagcgacaagcagaggtaaggagctacaaaaatctgatggttgccgataaaatgacatctaataaagatattgcgtcaacccacaagtccttacaagaactcgaagaagacttcatgtaagaccaaccaaccaacgatcttcacaatgcaaacatgtctgtttttttgaccaccttatgccaatgttccataaggaaaaaaaaagtggtgtgtcaaaaagtattaatctcttggtttgtggatgttaaataaaaaagaagctaaaatggcaactcccttgctttgtatgaatatgctctactctgatatgaacataaatttgtctttaaattctcattataatacagttattggacttttgcaaaaaagagtccactttattgtttcgataaattacatagaatgaagacaatctgtacaaatttttgattgaatgattgaaatggggatatatatatatatagtagacaatgccatataaatcttacaaataaataaagtgat

SEQ ID NO: 2568 - DNA, 1057 bp, Cleome spinosa
aaaacgatgttattcctgagtggttccaaattcttcttctccgtgatcgagagagaaagggaaaccctagatttgctctccgttcgatttggttccttctcgaaccgcaacgatggtgttctacttcaaggcccgaccggaggccggtgactacaccatcttcatgggtcttgacaagtacgagaacgaggaactcatcaaatatggcttccctgaagacatctggttccatgtggacaagatgtcgtctgctcatgtttacgtaaggcttcacaaaggtcagactattgatgacatcagtgaaggtgtacttgaggattgtgctcagcttgtgaaagctaactccatccaaggtaacaaggtgaacaatgtcgatgttgtttacactccgtgggccaacttgaagaaaacggcctccatggatgttggccaagttggtttccacaattcaaagatggtccggacaaccagagtggagaagcggatcaatgaaatagttaacaggttgaacaaaactaaagttgaaaggaagcctgatttgaaagctgagagagaggcagtgaatgctgcagagagggctgagaggaaacaacatctgagagagaagaaaaagcgtgaagacatggataggcttgagaaggagaggcaggccgagataaggagttacaaagggttgatggtatcggagaaaatgacatcaaacaaagacattgcttcaagcaacaaatcgcttcaagaactcgaagaagacttcatgtaaggggaaggagcgaagaaaaaaaagacaagagagaacaaaaaagacgacccgtcattgacgttttaccagaggttagttatcatccaagctattgcctttcaaagaaggggtgttgttctcttgcttaaattaatatgattgcccggtttgatgtttgtttcatagtgtttaagacaaaaccctaatctggtattagggattccggccatggaaatgtttcatatgattaaatcttgtgggaaaaaaaggagcgtgaatataaacataagctcgccagtgatttggtgcttggtgttc

SEQ ID NO: 2569 - DNA, 1160 bp, Gossypium hirsutum
tcaaacaacagggaatttctcacatcaagtttccacgctatccatactttcaattattttcttggaagagggcaaaaaccctaattttgtctctgatctcccaaggaaggaaagaaaccaagaaataacgaaatttcgaaggaaaaaaggatggtgttttacttcaaagctcgaccagaggctggcgattacaccattttcatgggtctcgacaagtacgagaacgaggaactcatcaaatatggcttccccgaagacatttggttccatgtggataaaatgtcttctgcccatgtttatttaagacttcaaaaaggtcaaaccatcgatgatataagcgaaggcttgctcgaagattgtgctcagcttgttaaagctaactccattcaaggcaacaaggtgaacaatattgacgttgtttacactccatggtccaatttgaagaaaacctcttctatggatgttggtcaagttggctttcacaattctaagatggtccggaccctgagagtggagaagcgaataaatgagatagttaacaggctgaacagaactaaagtagaacggacacctgatttgaaagctgagagagaagcagtcaatgcagcggaaagagctgagagaaagcaacatatgagggaaaaaaaacgacgtgaggagctagaaaggcttgaaaaggaaagacaagcggagataagaagctacaagggtctcatggtatctgaaaagatgacatccaacaaacaaattgctgagacgagcagatctttgcaggaacttgaagaggattttatgtagaagatactggtattcatgtgggaattaacgatgatgatgggtgccaaaaacctgctgcccttcaaagaaggtggtttgttgttggtttacgattgatgttatgtgccttgtgaataagtcacctcggttttgaatatcttactttcgaggatttggataagaaaagagacaacatggaatggaaactgacatattatgagaaatctatgtaattgtttgtcatttgcaggcttcaaggagtagaatgaatcaaagattgaggatgagtgagatgaacttctgttatggtcttagtacatgataataaagcataattcatatctctattgctgattaataaaatcgtcgtttttcgtatttaa

SEQ ID NO: 2570 - DNA, 1017 bp, Euonymus alatus
cttgctttccgcgcgtcaaaactacgcaacattttctcaagaatccactgccatgccagactcgatttagataaactgaaccctaaaacgcagaggttgttcttggttgggcggagggagaaaagagaagatggtgttctacttcaaagcccgatcagaggcaggcgactataccatctttatgggcctcgacaagttcgagaacgaggagctcatcaaatatggcttccctgaagatatctggttccatgttgataaaatgtcttctgctcatgtttatgtaagactgcacaagggtcagactatagatggtataagtgaaggcttgcttgaggattgcgctcagctcgttaaagcaaattccattcaaggcaacaaggtaaataatgttgatgttgtttatacaccttgggccaatttaaagaaaactgcttccatggatgttggccaagttggtttccacaatccaaaaaatgttcggactgtgagagtagagaagcgggtcaatgagattgttaatagattaaacaagacaaaagttgaaagaaagcctgatttgaaagctgagcgagaagcagttggttcagctgaaagagcagagagaaagcttcaacagagagataaaaaacgccgtgaagaaatggcaaggcttgaaaaggagaagcaagcagagataagaagttacaagggtttaatggtatctgagaatatgacatcaaacaaagatattgcttcggtaaacaagtccttgcaggaattggaagaggacttcatgtgagtcactctgtggttctcatcatctcatgttcagtaaaatactccatggcgtccctcttatggaaggggcttgtcattcatttgacatcacttttggccttttgaagtcattttcttcttgaataaattaccttattcaaagctgtatttttatgttattgtgatgtgggtgatggaaaatctgtatgcagtgtttagaaacacacttcgaggatgtttctcttctttaagtattggtta

SEQ ID NO: 2571 - DNA, 1014 bp, Euonymus alatus
taatcaattatacgttcatttcgatttggataaagagagccctaataaacgcagaggaggctgttcttgccttcttggttggtgcgaaggggagaaaagagaagatggtgttctacttcaaagcccggccagaggcaggcgattacaccatctttatgggcctcgacaagttcgagaacgaggaactcatcaaatatggatttcccgaagacatctggttccatgtggataaaatgtcttctgcccatgtttatctaagagtgcacaagggtcagactatagataatataagtgaaggtttacttgaggattgcgttcagcttgtcaaagcaaattcgattcaaggcaacaaggtaaataatgttgatgttgtatatacaccttgggccaatttaaagaaaactgcttcgatggacgttggccaagttggtttccataatccaaagatggttcggactgtgagagtagagaagcggatcaatgagattgtcaatagattaaacaagactaaagttgaaagaaagcctgatttgaaagccgagcgagaagcagtaggtgcagctgaacgagccgagagaaagcttcagcagagagataaaaaacgccgtgaagaaatggaaaggcttgaaaaggagaggcaagcagaggttcgtagttacaagggcttaatggtatctgagaagatgacatcaaacaaagagattgcttcgggaaacaagtcattgcaggaattggaagatgacttcatgtgagtgactgtgtcggtgtggttcccattatctcatgttcagtaaaatactccatggctcccctctgatggaaggtgcttgtcattcattttacatgacttttgactttttaagccattttcctcttgaacaaattaccttattcaaagctgtagtttatatgtgtactgtgatgtggcatgtgagtgacagagagaagttctgcatccaatgtttagaaactagaaaaaaaaaagaaactagaaagagacttgggagttgtttt

SEQ ID NO: 2572 - DNA, 1237 bp, Fagopyrum esculentum
cttagccgaaagcttacgcagcggcgtcaagaaaaaggcaatagagaaaggttagggaaattgcgagcctctcgttctccttcgaccttctcttctctctccaaagccacgaagagaatacaagagaatcgaagagagaagattcagagagacaaaatggttttctacttcaaagcgaggcccgaggcaggcgactacaccattttcatggggctcgacaagtatgagaacgaagagctcatcaaatatggcttccccgaagacatctggtttcatgtagacaagatgtcgtctgctcatgtttatctaagattgcaaaaatatcagtcgatggatgatatacctgaaggagtgttggaggattgtgttcaactggtgaaagcaaattctattcaaggaaacaaggtgaacaacattgatgttgtttacactccatggtcaaatctaaagaaaaccccatctatggatgttggccaagttgggttctacaattcgaaaatggtgcgtaccgtgagagtagaaaagagaataaatgagatcgttaatagattaaaccgcactaaggtggaaaggaagccagacttgaaagcggagcgagaagcttatggcaatgctgagaaggctgaaagaaaagctcagctgagagacaagaaacgccgagaggatatggatagacttgaaaaggagcggcaggctgaaatgaggagctataagaatttgatggtatctgataagatgacttcaaacaaacagattgcttctgagaacaagtcgctgcaagagcttgaagaagacttcatgtaagccttacccatgcatgcttgcattcctccaccagacacctgactagcttcacgttcagtctataaagactgtgatgaagcaagttattgtggtgattgtgtgattctataacttaaatctattgaggatgagcttcagagaagtaagctgaagagtcttagtagtatgtgatgatgatgatgatgtgttgtttgcaatctccgggtaagtcgcaatctgtgtcgaatgcatcaattacttggaaaaagacaatctttcctttatttaattggcagtgtaaaatgaattagtttgtgagtcatcttctttgttgattgtggtcttcatgtttattctaggggtaggggtgtgtttggtggcatatttagttatttagtagcggtttgttattttgaaaaactatgagcacaaataatgacttaaattgaactca

SEQ ID NO: 2573 - DNA, 1102 bp, Quercus alba
gtactacttatttatcgcaagttaaaaaagtttttaaaaaaagaaaaagaaaaaaacagagaagaagccctaatctaaaacgagtcgatctctggtggcctaggttttcctcatcggaaaagccatggtgttctacttcaaagctcgaccagaggctggcgattacactattttcatgggcctcgacaagttcgagaacgaggagctcatcaaatacggcttccccgaagatatttggttccatgtggataaaatgtcttcagcccatgtttatataagactgcacaaaggtcagactattgatgatattagtgaaggtgtattggaggattgtgttcagcttgtcaaagcaaattccatccaaggcaacaaggtgaataacattgatgttgtttacacaccctggtccaatttgaagaaaactgcttctatggatgttggtcaaattggttttcacaacccaaaaatggttcgaactgtgagagtggagaagcggattaatgagatagttaataggttgaacaggacaaaagtggaaaggaaacctgatttgaaagctgagcgagaagcggttaatgcagcggaacgagcagagagaaaactacagctgagagacaaaaaacgacgcgaggagatggaaaggcttgaaaaggagagacaatcagagctaagaagctacaagggtttgatggtttctgaaaacatgacatctaataaacagattgcaacaacgagcaagtccttgcaggaactggaagaagacttcatgtaagagcatcatttgtttaaatgttcaatagatgctagctgccaaagttactgggcctataaagaagggtgacatatagtttgtgattctaggcctcaagaaatttcatcatgcctgaataacacattccctagtctgtttcctgtggatgttaaataagaaaatggtgtctgcaatgttaacagaggaggaaggaggtggggggaagaaatctccttttacctaccatgaatgtactttgatggtgatgaaaaacattatttgtatctgcattgggatagtgggtgataaaactgtgttttcttgcccaactttataaacaaaacttatgtc

SEQ ID NO: 2574 - DNA, 1026 bp, Orobanche aegyptiaca
cgacgagaatcgaaaccctagagagagaaagagggcgaaaaaatggtgttctacttcaaggcgcgacctgaggccggggactacaccatattcatgggccttgataagcatgagaacgaggagctcatcaaatatggcttccccgaagatatttggttccatgtggataaaatgtcttcagcccatgtttatgtgagattgcacaagggtcaatctattgatgacatgtccgaaggtttactggaggattgtgttcaactagttaaagcaaattctattcaaggaaataaagtaaacaatgttgatgtcgtttacacgccttggcaaaatcttaagaagactgcttccatggatgtcgggcaagttggtttccataattctaaaatggttcgtactgtgagggtggaaaaacgcataaatgagatagttaaccggttaaacaagacaaaggttgaaagaacaccagatttaaaagccgaacgggaggcagttaatgcagctgaaagagcagagaggaaactgcagctccgcgataagaaacgtcgggaggatatcgaaaggatcgaaaaggagagacaggccgaactaaggagctacaaaaatttgatggtagccgagaagatgacatccaataaggacatagcttcaaccaacaagtccttgcaagaacttgaggaagatttcatgtgaatcccataacaaagaatagtttgacatttttttatctcaaaaaataattgaaaaaaagataaagaacgagattgagagaaagtggacggtgtgttggggcttaatcgtggtttatcattgttgttgtgtttcttcttttaaaacctaattaggtaccttagctttgtgaaattgttggtcttttggagctctcaagttgtggttataaaaatatccagggagctaagatttgtgagagaggttggtcgattaaattgtattgaactttgatgatgacgacaatggtgataagactatggtttcagttttttatgtcattgtgttaagttcatgttc

SEQ ID NO: 2575 - DNA, 742 bp, Parthenium argentatum
taacgatccatccatccactttgatctcctcttttttattcctaaacgcaaaaagcaaaccctagagagagaaggagaagggatggtgttctacttcaaagcccgagcggaagcaggagactacaccatcttcatgggtcttgacaagtttgagaacgaagaactcatcaaatacggcttccccgaagacatctggttccatgtggataaaatgtcttctgcccatgtttatgtgaggcttcaaaagggtcagacaattgatgacatatccgaagggcttcttgaagattgtgctcaacttgtcaaagcaaattccattcaaggaaataaagtgaataacattgatgttgtttatactccttggcaaaacttaaagaagactccatctatggatgttggtcaagttggtttccacaacaataaagcggtgcgcactgtgagagtggagaagcgaataaatgaggttgttaataggctcaaccgcacaaaggttgaaagaaaacctgatctgaaagctgagcgtgaggcggttaatgcagcagaaagggcagagaggaagcagctgctgcgagacaaaaaacgccgagaggaaatggagagacttgaaaaggagagacaagcagaggtcaggagctacaaaaatctgatggttgctgacaaaatgacctccaacaaagagattgcatcaacccagaaatccttgcaggaacttgaagaggactttatgtaaaacgtctatcta

SEQ ID NO: 2576 - DNA, 2141 bp, Populus trichocarpa
acgcccaggttatttccacgttatcccagaaccaaccaaaagcagcgaacctccgtcaaaccaaaaaagaaagcacaaacacaaagcagccttgagggaaaaaaaaacacaaagcagccttgaaactattccgattttgtttggttgtttgaaaaaaaaaagagcaaaaaagatggtgttctacttcaaagccagaccagaggcaggagattacactatttttatgggtcttgacaagcacgagaacgaggagcttatcaaatatggtttccctgaagacatctggtttcacgtggacaaaatgtcttctgcccatgtttatttaaggctgcataaaggtcagaccatcgatggtataagtgaaggtgtacttgaggattgtgtgcagcttgtcaaagcaaattcgattcaaggcaacaaggtgaacaacatcgatgttgtttacactccatgggccaatttgaagaaaactgcttccatggatgttggccaagtcggcttccacaattcaaagatggttcgaactgtgagagtggaaaagcggataaatgagatagttaatagattgaacaaaacaaaggtggaaagaaagcctgatttgaaagccgagagagaagcagtcaatgcagcagaaagagcagagagaaagcttcatctgagagataaaaaacgacgtgaggaaatggaaaggcttgaaaaggagagacaggcagagatgaggagctacaagggtttgatggtggctgaaaagatgacatctaataaacaaatagcatctgaaaacaagtccttgcaggagctggaagatgactttatgtgaaacaacagtatctaaaggttctgccatactgctgccccttaaagaagcgggcttgtcattcagtttgtaacttcaagcattttatgaataaacttataaattttgggaagggaatgtttaatgccgagcagagggaggagagtggtgggttgaggttgatggatggggaattacctgtctgatgtaagttgtacttcgatgatgatgacgaagacaaacatggttgagacttaattgtggttaatgtgtgatagacatcatttttcacagttaatagtttttaatcttgccgtttagtctgtgcaacaaggtttattgaattttgtttctcttaggtcacacacacatgcatgcacactgatctgaatatgtggaataagtcttgatcctttgaagtttcagtattctgatttttagcaatgcttatcaaatttcatgtcaataaacttttgaaagtagttcaagaaatgaacgactattggttgtcacaatcttaatcacctgatttgttggcaatttctttctactggtaattcccttctcatggttgatttgttggttttcaggtcatcatcaagccttcagatttttggtttttttcaggtcagccatttgctgactgattcacacagaatgctccacggtctgatgtggtgtattcaggtcatgggcatatcctttccgtttcacaaattgaaaagtggatattgaattagatggattctttgtgacttgcttaccagtgcatcttagaaaactactaactatgaagttatggaaagtttgacgagcaagaaaacgagggttatcacgccatatttttcaattgctagacatgagtaatcaattcttttggaaaatctgtatgcatagtttcctgtgatctggagggttgttttatcatcatgagagctgaccatgtctgcagagttaccaggtgcatcatggctaaccccatccgtccccgtgagaactgagtctatctcgagatccatgcaattagtgaaatgcaaagcttagttcataaattttcaatacaggcataagcaatgagattccttctatctgtaccttcggtattttcagaaggagagcgcaggtagaaaaggacacttccagttgctgctgtttcgacttcaaattcagacacaagaaagaaaccgtacactctgcaacctgatctggatttcccttgtgacaggagatggaatttttgttagggaaagtactagattggtaaaatatttatgtgttgcaattgctttttttttaagaaaaaaaacttaataattgaggttatagtgtcgataaactaaataaa

SEQ ID NO: 2577 - DNA, 890 bp, Helianthus annuus
ctctcgtctttttcttgtcaacggaaagcaaaccctagagagagagagagagagagagagagatcgaagatggtgttctacttcaaagcccgacctgaagctggagactacaccatcttcatgggtcttgacaagtttgagaacgaagagctcatcaaatacggcttccccgaagacatctggttccatgtggataaaatgtcttctgcccatgtttatgtgaggcttcggaagggtcagacaattgatgacatatccgaagggcttcttgaagactgtgctcaacttgtcaaagcaaattctatccaaggaaataaagtgaataacattgatgttgtttatacttcttggcaaaacttaaagaagactccatctatggatgttggccaagttggtttccacaacaataaagccgtgcgcactgtaagagtggagaagcgaataaacgaggttgttaataggctcaaccgcacaaaggttgaaaggaaacctgatctgaaagctgagcgtgaagcggttaatgcagcagaaagggcagagaggaagcaactgctgcgagacaaaaaacgaagagaagaaatggagagactggaaaaggagagacaggcggaggtgaggagctacaaaaatctgatggttgctgacaaaatgacttccaacaaagagattgcatcaacccagaaatccttgcaggaacttgaagaggacttcatgtaaaacaacatccatctatcttcacagtacaaccaaactaaactgcttaaaaaatgttccataaaatgacactagtccccaactctcttggtttgctgattcttatttaataaagctaaattaaatgcgcaactcccaggagagggggaatcatgctttgtatgaatttacccttt

SEQ ID NO: 2578 - DNA, 1205 bp, Citrullus lanatus
aatttaactaaacattattctacgctatcctggaatatcattaccgattaaagattcaaaatcgcacgcaactggctgagggctaatctctctctttttcccaaattgaaaaccctaattcattctgttctccccattttcgagagttgagcgaacgaaatcgaagcaccatggttttctatttcaaagcacggcccgatgttggtgattacaccattttcatggggctcgacaagtacgagaacgaggagctcatcaaatacggcttcatcgaggatatttggttccacgtagacaagatgtcatccgcccatgtttatgtgagactgcataaagggcagaccattgatgatattagtgaagggttgctggaggattgtgctcagcttgtcaaagcaaattcaattcaagggaacaaggtaaacaacattgatgttgtgtatacaccttggtccaatttgaagaaaactgcttccatggatgttggccaagttggttttcataaccccaagatggtccgaactgtaagggtggaaaaacggatcaatgacattgtcaatagattgaacaggactaaagtggaaaggaagcctgatttgaaagccgaacgtgaagcagtgaatgcagctgaaagagctgagaggaagcaacacctgagagaaaagaaacgccgcgaggaaatggagaggttagaaaaagagaggcaagcagagttaaggagctacaagggtttgatggtctctgaaaagatgacatcaaacaaacagattgcagcaacaagcaaatcactacaagagctggaggatgattttatgtgatcgaattgatccggtacgaacgctgcaaaaagtagcagcagctaaacctgctcttctgtagagaaggccatctgcccatcattcagtttgtggttcttggcccaaagttgttctctcgtgagtgatcaaaattgtctttagcctcgatgatattcaacttgttatgtctacttgatgactatacaaatagaaaattgctgtgcctttcaagagagcggagaattggtgttatgtaagttgtaattactgtcactcttgtttaatgatgataagtttagctcgtttggcgtaccttttttttttttcaaagtaagagagaggaagacattttttttgggtataaatttttttttctctagttttataatgagtggcgattttcatttt

SEQ ID NO: 2579 - DNA, 1091 bp, Fagopyrum esculentum
aatagagaaaggttagggaaattgcgagcctctcgttctctttcgccccttctcttctctcctctccccaaagccacaaagaggatacaagagaatcgaagaaagaagattcagagagacaaaatggttttctacttcaaagcgaggcctgaggcaggcgactacaccattttcatggggctcgacaagtatgagaacgaagagctcatcaaatatggcttcccgaagacatctggtttcatgtagacaagatgtcttctgctcatgtttatctaagattgcaaaaatatcagtcgatggatgatatacctgaaggagtgttggaggattgcgttcaactggtgaaagcaaattctattcaaggaaacaaggtgaacaacattgatgttgtttacactccatggtcaaatctaaagaaaaccccatctatggatgttggccaagttgggttctacaattcgaaaatggtgcgtaccgtgagagtagaaaagagaataaatgagattgttaatagattaaaccgcactaaggtggaaaggaagccagacttgaaagcggagcgagaagcttatggcaatgctgaaaaggcagaaagaaaggctcagctgagagacaagaaacgccgagaggatatggatagactggaaaaggagcggcaggctgaaatgaggagctacaagaatttgatggtatctgataaaatgacttcaaacaaacagattgcttctgaaaacaaatcgctgcaagagctcgaggaagacttcatgtaagccttgcccatacatggttgcattcctccaccagacacctggctagcttcacgttctgtctataaagatgatgatgaagcgagttaatgtggtgattgtgtgtgattctataacttaaatctattgatgatgagcttcagagaagtaagctgaagagtcttagtagtatgtgatgatgatgtgttgtttgaagacttgcaatctccaggtgagtcgcaatctgtgtcgaaaatgcatcaattactggaaaaaacaatctttcctttattcaattggcagtgtaaaatgaatcagtttgtgagttccacctctttgattgtg

SEQ ID NO: 2580 - DNA, 1102 bp, Centaurea maculosa
gacaatcaacccactcgtctctctctctctctctttccctaaacgacaacaaaaccaaacctaaccctagagagagaaggaagggagagagagagagagggagagtctccttggtggagaagaagaagaagaagaagaagatggtgttctacttcaaagccagacctgaatccggagactacaccatcttcatgggtcttgataaattcgagaacgaagaactcatcaaatacggattcccagaagacatttggttccatgtggataaaatgtcttctgcccatgtttatctgaggatgcgcaagggtcagacaattgatgacatatctgaaggacttcttgaagattgtgctcaacttgtcaaagcaaattccatccaaggaaataaagtgaacaacattgatgttgtttatactccttggcaaaacctaaagaagactccatccatggatgttggtcaagtgggtttccacaacaataaagctgtgcgcactgtgagagtggagaagcgaataaatgaggtagttaatagactaaacaggacaaaggtggaaagaaaacctgatctgaaagctgagcgtgaagcagtcaatgcggccgaaagggctgagaggaaacagcagctgagagacaaaaaacgacgagaagagatggaaaggctggaaaaggagcgacaagcagaggttaggagctataaaaatctgatggttgctgacaaaatgacatccaataaagacatcgcgtcaacccacaagtccttgcaagaactcgaagaggacttcatgtagaccaaccatcgtgtcaaaatgaaagtatgcctgttcttcctttgagcgccttatgccaattttcgacaaggaaaaatatgggcaagtcgaaagtggtgagtcaaaaagtaagaaatctcttggtttgtggatgttaaataaaaagctaaaatggccaatgaattaacaactcccttgctttgtatgaatttgctctttgctttgctactctgatatgaacatgaatttatcttcatattctcattacaaatacaatatttgacttggcaatgaaaaaaagaaaagtaacgaactagcgactctgtcgttgtagt

SEQ ID NO: 2581 - DNA, 1020 bp, Echinacea purpurea
cggccgggggattttggagtggactataaaagttggaagtgtattggtacgccagaggcggtgtaaacgcaaagaaaccctagaaaaacagagatctaaggaagatggtgttctactttaaagcccgaccggaagtcggagactacaccatcttcatgggcctcgacaaatttgagaatgaagaactcatcagatacggcttccccgaagacatatggttccatgtggataaaatgtcttctgcccatgtttatgtgaggctacacaagggtcagacaattgatgatatatccgaagggcttcttgaagattgtgctcaacttgtcaaagcaaattccatccaaggcaataaagtgaataacattgatgtcgtttataccccttggcaaaacttaaagaagacaccatctatggatgttggtcaagttggttttcacaacaataaagctgtccgcactgtgagagtggagaagcgaattaatgaggttgttaataggctcaaccgcacaaaagttgaaagaaaacctgatctaaaagccgagcgtgaagcggttaatgcagctgaaagggaagagagaaagcagctgctgcgagacaaaaaacgacgagaggaaatggagagactggaaaaggagagacaagcagagataagaagctacaaaaatctgatggttgctgataaaatgacttccaacaaagagattgcatcaactcacaaatctttgcaggaacttgaagaggacttcatgtaaaacatccatctatcatcgcaatacgaccaaaccaaaccatgttttttctaaatgtttcataaatgacactagccctcgttctcttggtttgttgatcattaattaataatgctgaattaatgggcaacttcaagagaggaaagcttgctttgtatgaatctgctctttgttacttctataaatgattggtttgtctgaatcttagcgttgaccattgatttctatacgttgtgaatctcccatatatctgcatcggtcattgattacc

SEQ ID NO: 2582 - DNA, 1067 bp, Chenopodium quinoa
ctgagaaagagaggagagagaaagagagagagagaatcatccatcgaagaagatggtgttctactttaaggcccgacccgaagctggggattacactatcttcatgggtcttgataagttcgagaatgaagaactcatcaaatacggctttcctgaagacatttggttccatgtggacaaaatgtcttcggcccatgtctatgttagattgcatagaggtcagtcaatggatagcatatcggaaggtctgttagaggactgtgctcagcttgtgaaagcaaattccatccaaggcaataaggtgaataacattgatgttgtttacactccctgggccaacttgaagaaaactgcttccatggatgttggccaagttggtttccataactcaaaaatggtccgcactgttcgtgtagaaaagagaataaatgaggtcgttaataggctgaaccgaacaaaggtggaaaggacaccagattttaaagctgagcgtgaagcatatggtgctgctgaaaaggcagaaagaaaggctctgctgagagaaaagaaacgtcgagaggaaatggataggctagagaaagagagggtagcagagatgcgaagctacaagaatttgatggtatctgacaagatgacgtctaacaaacagatagcttcaggtgagaaatccttgcaagagctagaggaggatttcatgtgaagtgatccaagattcttctgttctatgaaaatatagcggcaaagttctgcattttaattgtgagcttgtacacatgtcacttggtcttgctgcttctcaattgtgtgggttggtcgaatcgcatctacctttttctgatcacagtctattgaagacctaatcatgtaactctattgtgatgatcatgaaaaggctgcattgtataggaggatagaaagaatgatgatgtaccttgagagtctcatcatggtttccctcttgttcatgacagcattaatcttgctaaaagattatatgtgatgcatttgattttggtttgtgtgttatttggaaatgctttattaagctcattaactagggtatttga

SEQ ID NO: 2583 - DNA, 993 bp, Fagus grandifolia
agttaagaagccctaactccctaatcctcaatctctgtctctctctctcgctctcgcccacactctggtttctttcccatacggaaaaaaccatggtgttctacttcaaagcccgtccagaggctggagatttcaccatattcatgggcctcgacaagcacgagaatgaggagctcatcaaattcggcttccccgaagacatttggttccatgtggataaaatgtcttctgcccatgtttatgtaagactgcacagaggtcagactattgatgatattagtgaaggtttattggaggattgtgttcagcttgtcaaagcaaattccatccaaggcaacaaggtgaataatatcgatgttgtttacactccctggtccaatttgaagaaaactgcttctatggatgttggtcaagttggttttcacaatccaaaaatggttcgaactgtgagagtggagaagcggattaatgagatagtcaataggttgaacagaacaaaagtggaaaggaaagctgatttgaaagctgagcgagaagcggttaatgcagcagaacgagcagaaagaaagcaacagctgagagataaaaaacggcgggaggagatggacaggcttgaaaaggagagacaagcagagctaaggagctacaagggtttgatggtttctgaaaatatgacatccaataaacagattgcagcaacaagcaagtccttgcaggaactggaagaagacttcatgtaagcatcattatttaaatgttcagttgatgctagctgccaaagttaccaggcctataaagaagtgtctttgtcattctgtttggattctaggcctcaagtaatttccttatgcctgaataactcattccctaatctgttttactgtggatgttaataagaaaattgtgtctgcaatgttaacagaggaggaagggggtggggggatgaaatgtccttttacttaccatatatgtacttggatgatgatgagaaac

SEQ ID NO: 2584 - DNA, 1513 bp, Cannabis sativa
ctaaaatgtcaagtcaaggtctctgtcgcactctctctctctcgtctcgactcaacccttccctttacccttccaattggcaaggtttctctctctctctcggtctcgctggttcagaaacgcgatggttttctacttcaaagccagaccagaggccggagactatacgattttcatgggtctcgacaagcacgagaacgaagagctcatcaagtacggtttccccgaagacatttggttccatgtcgataaaatgtcttctgcccatgtttatgttcgactgcataaagggcaaaccattgatgatataagtgaaggattactggaagactgtgctcagctcgtcaaagcaaattccatacaaggtaacaaagtgaacaatattgaggttgtttacaccccatggtccaatttgaagaaaacagcatccatggatgttggccaagttggtttctacaattcgaagatggttcgaactgtgcgtgtggagaagcggattaatgagatagttaatagattgaacaggactaaagtggaaaggacacctgatctgaaagctgagcgagaagcagtgaatgctgcagaaagagctgagaggaagctgcatctgagggagaaaaagcgacgagaggagatagaaagacttgaaaaggagagacaagcagaaatgagaagttacaaaggattgatggtttctgaaaatatgacatctaacaaacagattgcatctgcgagcaaatccttgcaggaactggaagaggacttcatgtgagcattcttaaactttgagttgcttaagaagatatcctagaggttcccacattgagtgtctgtttttaagtttgtgattcatggctaaacccctccccgacctgttgtacctgtcaacctgttaagcaggaaaagggtatgcaaattgaaacaggacgggggtgaaaatcgtaaggggaaaagctgtttcgtgtattggagacagataattggggatgtttatcttatctgtgtaattggatcatgatgatcagttattagttatatggatcatcacttgtgctttaatggtcaaatttactaacagttactatggtaggttgaaaatcttgattttttttttttttactgtcaactcccttgtccttgacaaaagtaaaaagccctccttgatgtgcactgtgcacatttattcagctggttctctagtctcaacccttcttttcaagcttttggcatagaattcagggtattctttttgtgatgtttggttccattgtgaatggaatttataataaaatagaataagaataggaatggtattttattttgagaggagattgaagttgtttaataatggaatcagaataaatcactagtgtgtattgactaacaatgcaaaaaagaaagatgggtttacaaagtaatgctaaacttgtgtatccacgtcacttttgtgattatttacagctataatccttactttttaatgaaaaatattggctgaaaagttgaattgtaa

SEQ ID NO: 2585 - DNA, 1066 bp, Centaurea maculosa
  misc_feature (1052)..(1052): n is a, c, g, or t
  misc_feature (1065)..(1065): n is a, c, g, or t
tctctctctctccttttccctaaacgcaaccaaaaaccaaaccctaaccctagagagagaaagggagagagagagggagagtctccttcgtggagaagagcagcaggcagccaggggaagaagaagaagaagaagaagaagaagaagaagatggtgttctacttcaaagccagacctgaatccggagactacaccatcttcatgggtcttgacaaattcgagaacgaagagctcatcaaatacggattcccagaagacatttggttccatgtggataaaatgtcttctgcccatgtttatctgaggatgcgcaagggtcagacaattgatgacatatctgaaggacttcttgaagattgtgctcaacttgtcaaagcaaattccatccaaggaaataaagtgaacaacattgatgttgtttatactccttggcaaaacctaaagaagactccatccatggatgttggtcaagtgggtttccacaacaataaagctgtgcgcactgtgagagtggagaagcgaataaatgaggtagttaatagactaaacaggacaaaggtggaaagaaaacctgatctgaaagctgagcgtgaagcagtcaatgcggccgaaagggctgagaggaaacagcagctgagagacaaaaaacgacgagaagagatggaaaggctggaaaaggagcgacaagcagaggttaggagctataaaaatctgatggttgctgacaaaatgacatccaataaagacatcgcgtcaacccacaagtccttgcaagaactcgaagaggacttcatgtagaccaaccatcgtgtcaaaatgaaagtatgcctgttcttcctttgagcgccttatgccaattttcgacaaggaaaaatatgggcaagtcgaaagtggtgagtcaaaaagtaagaaatctcttggtttgtggatgttaaataaaaagctaaaatggccaatgaattaacaactcccttgctttgtatgaatttgctctttgctttgctactctgatatgaacatgaatttatcttcatattctcattacaaatacnatatttgacttanc

SEQ ID NO: 2586 - DNA, 915 bp, Centaurea maculosa
  misc_feature (22)..(22): n is a, c, g, or t
  misc_feature (875)..(875): n is a, c, g, or t
gcgggggggtttattctttganctcctcctccctcgatcaccaaagcaatcatctctctctctctccttttcctaaacgcaaccaaaaccaaaccctagagagagaaagagggaggaagagagagagagagggtctcctccgtggagagcagcagcagccaggggaagaagaagaaagagaaggagaagaagaagatggtgttctacttcaaagcccgacctgaatccggagactacaccatcttcatgggtcttgacaaattcgagaacgaagaactcatcaaatacggattcccagaagacatttggttccatgtggataaaatgtcttctgcccatgtttatctgaggatgcgtaagggtcagacaattgatgacatatctgaaggacttcttgaagactgtgctcaacttgttaaagcaaattccatccaaggaaataaagtgaacaacattgatgttgtttataccccttggcaaaacctaaagaagactccatccatggatgttggtcaagttggtttccacaacaataaagctgtgcgcactgtgagagtggagaagcgaataaatgaggtagttaatagactaaacaggacaaaggtggaaagaaaacctgatctgaaagctgagcgtgaagcggtcaacgccgccgaaagggcagagaggaaacagcagctgagagacaagaaacgacgagaagagatggaaaggcttgaaaaggagcgacaagcagaggttaggagctataaaaatctgatggttgctgacaaaatgacatccaataaagatatcgcgtcaacccacaagtccttgcaagaactcgaagaggacttcatgtagaccaacgatcgtcaaaatgcaagtatgcctgntcttttttgaccgccttatgccaattttcgacaaggaaaa

SEQ ID NO: 2587 - DNA, 1023 bp, Cirsium arvense
gtttaattctttgtaacctcctccctccgatcaccaaaccaaagcaatcatctctctctctctctcctttccctaacgacaacaaaaaccaacctagagagagaagagggaggaagagagagagagagagagggtctcctccgtggagagcagcagcagccaggggaagaagagaaagagaaggagaagaagaagatggtgttctacttcaaagcccgacctgaatccggagactacaccatcttcatgggtcttgataaattcgagaacgaagaactcatcaaatacggattcccagaagacatttggttccatgtggataaaatgtcttctgcccatgtttatctgaggatgcgtaagggtcagacaattgatgacatatctgaaggacttcttgaagactgtgctcaacttgttaaagcaaattccattcaaggaaataaagtgaacaacattgatgttgtttatactccttggcaaaacctaaagaagactccatccatggatgttggtcaagttggtttccacaacaataaagctgtgcgcactgtgagagtggagaagcgaataaatgaggtagttaatagactaaacaggacaaaggtggaaagaaaacctgatctgaaagctgagcgtgaagcggtcaacgctgccgaaagggcagagaggaaacaacagctgagagacaagaaacgacgagaagagatggaaaggctggaaaaggagcgacaagcagaggttaggagctataaaaatctgatggttgctgacaaaatgacatccaataaagatatcgcgtcaacccacaagtccttgcaagaactcgaagaggacttcatgtagaccaacgatcgtcaaaatgcaagtatgcctgttcttttttgaccgccttatgccaattttcgacaaggaaaagtatgggcaagtcgaaagtggtgagtcaaaaagtaagaaatctcttggtttgtggatgttaaaataaaaagctaaaatggccagaattaacaactcccttgctttgta

SEQ ID NO: 2588 - DNA, 1003 bp, Taraxacum officinale
gctcggcggggatcttttcactttgatcgacaaaataaaagcaataaggattcatcgtctctcgtcttttcccaaacgcaaaccctagagagagggatagagaagaaaagagtctcctttgtggagagccgagagagcgaagatggtgttctacttcaaagcccgaccagaagccggagactacaccatcttcatgggtcttgacaaattcgagaacgaagaactcatcaaatacgggttccccgaagatatatggtttcatgtggacaaaatgtcatctgcccatgtttatctgaggatgcgtaagggtcagacaattgatgacatttctgaaggacttcttgaagattgtgttcaacttgtcaaagctaattccattcaaggaaataaggtgaacaacattgatgttgtttatactccttggcaaaacttgaagaagactccatccatggatgttggtcaagttggtttccacaacaataaatctgtgcgcactgtgagggtggagaagcgaatcaatgaggtggttaatagactgaacaggacaaaagtggaaagaaaacctgacctcaaagctgagcgtgaagcagttaatgcagcagaaagggcagagaggaagctgcagctgagagacaaaaaaaggagggaggagatggaaaggctggaaaaagagaggcaagcagaagtaaggagctacaagaatctgatggttgctgacaaaatgacttccaataaagagattgcatccacccacaagtccttgcaagaactggaagaggacttcatgtaaaacattcacaaaaagaatactactacaactgttttctgacaccaacgaaaaagggtaaaagttattgattcatgtctcttggtttgtggatgtttaataaaaagctaaaatggcctgagagggagggaaggttggtttctttggaatttgttgttttgtttgctaattctatatcaatatgataaaacttatcttatattcttccgatctaat

SEQ ID NO: 2589 - DNA, 922 bp, Guizotia abyssinica
agatatggccgggaattcggccattacggcgggggggaagccgtgaagtcctgcgtttgagaaccgtccactttgatcatgtggtttgcttcctcgctaaccaaatactagagagagagagagagaaagagagatcgaagatggtgttctacttcaaagcccgaccagaagccggagactacaccatcttcatgggccttgacaagtttgagaacgaagaactcatcaaatacggattcccagaagacatatggttccatgtggataaaatgtcttctgcccatgtttatgtgaggctgcgcaagggtcagacaattgatgacatatccgaaggacttcttgaagattgtgctcaacttgtcaaagcaaattctatccaaggaaataaagtgaataacattgatgttgtttatacttcttggcaaaacttaaagaagactccatccatggatgttggtcaagttggtttccacaacaataaagctgtgcgcactgtgagagtggagaagcgaataaatgaggttgttaataggcttaatcgcacaaaagtcgaaagaaaacctgatctgaaagctgagcgtgaagcggttaatgcagcagaaagggcagagagaaagcagctgctgcgagacaagaaacgacgagaggaaatggagagactggaaaaggagagacaagcagaggtaaggagctacaaaaatctgatggttgctgacaaaatgacttccaacaaagagattgcagcaacccacaagtccttgcaggaacttgaagaggacttcatgtaaaacgtcttcacaatacaaccaaactgttttttttatgcccctaaatctcctggtttgttgatgtttttaataaagctaaaatggccagaattcccatttgtatgaatttgcaccttgatatcatgataaattat

SEQ ID NO: 2590 - DNA, 945 bp, Humulus lupulus
ggttcagaaacgcgatggtgttctacttcaaagccagaccagaggccggggactatacgattttcatgggtctcgataagtacgagaacgaagagctcatcaagtacggcttccctgaagacatttggttccatgtggataaaatgtcttctgcccatgtttatgttcgactgcataaagggcaaaccattgatgatataagcgaaggcttactggaggattgtgctcagctcgtcaaagcgaattcgatacaaggtaataaagtgaataatattgaggttgtttacaccccatggtccaatttgaaaaaaacaccctccatggatattggccaagttggtttctacaattcaaagatggttcgaagtgtgcgtgtggagaagcgaattaatgagatagttaatagattgaacaggactaaagtggaaaggacacctgatctgaaagctgagcgagaagcagtcaatgctgcagaaagagcagagaggaaactgcatctgagggagaaaaagcgacgggaggagatggatagacttgaaaaggagagacaagcagaaatgaggagttacaagggattgatggtttctgaaaatatgacatctaacaaacagattgcatctgcaagcaagtccttgcaggaactggaagaggacttcatgtgagcattctgaagctgtgttgcttaagatatcctagaggttcccacattgagcgtctgtttttaagtttgtgattcatggctaaacccctccccaacctgttgtacccattaacctgttaagcaggaaaagggtatgcaaattgaaacagttaggggatcaaaatctttaggggaaaagctgtttcgtgttttggagacagataattggggatttttattttatctgtgcaattggatcttgatgaatgatgaccagtgattagttatatagatcatcacttgtg

SEQ ID NO: 2591 - DNA, 1114 bp, Lactuca sativa
gttttgattcttttcaatttttgatcgacaaaataaagcaataaggagtcatcgtctctcctcttttcccaaacgcaaaccctagaaagaggaaaagagaaaagagtctcctttgtggagagccgagagagcgaagatggtgttctacttcaaagcccgaccagaagccggagactacaccatcttcatgggtcttgacaaattcgagaacgaagaactcatcaaatacgggtttccggaagatatatggttccatgtggacaaaatgtcttctgcccatgtttatctaaggatgcgtaaaggtcaaacaattgatgacatttctgaaggacttcttgaagattgtgttcaacttgtcaaagcaaattccatccaaggaaataaagtgaacaacattgatgttgtttatactccttggcaaaacttaaagaagactccatccatggatgtaggtcaagttggcttccataacaataaagctgtgcgcactgtgagggtggagaagcgaataaatgaggtagttaatagattgaacaggacaaaagtggaaagaaaacctgatctgaaagctgagcgtgaagcagttaatgctgcagaaagggcagagaggaagcagcagctgagagacaaaaaaaggagagaggagatggaaaggcttgaaaaagagagacaagcggaggtgaggagctacaaaaatctaatggtggctgacaaaatgacttccaataaagagattgcatcaacccacaagtccttacaagaactcgaagaggatttcatgtaaaacatatctttcaaaaatacaacaacaaccaaactgttttctgaccattttgaccaatggttttggttttggttttggttttattgattgatgtagacttgtggatttcaagtgttatgattatgatgatgatgccctgagtctcttggtttttgtggatgtttaataaaaaggtaaaatggccggaattccacaattccaagagggagggaagcttggtttgtatgaatttgttgtttgctacttttttttttttatgatatcatgatgataaagttatcttaaattcttggtatgatgtttgtgtatttgcattaagttatcttgata

SEQ ID NO: 2592 - DNA, 1178 bp, Cucumis melo
aaccgaatattattctacgctatcctggaggctggaatatcagcgtcctattaaaagattcaaaaaaagattcaaaatcgcacgcaactcgctagagggctaatctctctctctctatttttccccaaatcgaaaaccctaattcattccgttctctccatttttgagagttgagcgaacgcaatcgaagcaccatggtcttctatttcaaagcccggcccgacgtcggcgattacaccattttcatgggactcgacaagtacgagaacgaggagctcatcaaatacggcttcatcgaggatatttggttccatgtggacaagatgtcatctgcccatgtatatgtgagactgcaaaaagggcagaccattgatgatattagtgaagggttgctggaggattgtgctcagcttgtaaaagcaaattctattcaaggaaacaaggtgaacaacattgatgttgtgtatacaccttggtccaatttgaagaaaactgcttcgatggatgttggccaagttggttttcataaccccaagatggtccgaactgtaagggtggaaaaacggatcaatgacattgtcaatagattgaacagaactaaagtggaaaggaagcctgatttgaaagccgaacgagaagcagtgaatgcagctgaaagagcagagaggaagcaacacttgagagaaaagaaacgccgcgaggaactggaaaggttagaaaaagagaggcaagcagagttaaggagctacaagggattgatggtttctgaaaagatgacatctaacaaacagattgcagcaacaagcaaatcactacaagagctggaggatgatttcatgtgatctaattgatccgcggttcaaatgctgccaaaaactagcagcagctaaacctactcgtccgtagagatggccatctgcgaatccagtttgtggttcttggcccaaagttgttctctcgtgagtgagtgatcaaattgtctttagcctcgatgatattcaactttgttgtgtctacttgatgactatacaaatggaaaattgctgtgcctttcaagagagcggataaatggtgttctgtaagttgtaattactcttactcttgtttaatgatgataaattcagctcgttttggcctaacttttttcttttcatagtaagaaaaagatgtcttttttt

SEQ ID NO: 2593 - DNA, 1105 bp, Momordica charantia
cggccggggattccacgctatctgagaatatcagggtccgatcaaaatcgcacgcaacataacacagaaggcttaatctctctcattttcccccaaattgaaaaccctaattctttctgttctctccaatttcgttttcgcgaggagggttgtgtaaacgcaatcgaagcacaatggttttctatttcaaagcccgccccgacgttggcgattacaccattttcatgggtctcgacaagtacgagaacgaggagctcatcaaatacggcttccccgaggatatttggttccacgtggacaaaatgtcgtctgcccatgtttatgtgagactgcaaaaaggtcagaccattgatgatataagtgaagggttgctggaggattgtgctcagcttgtcaaagcaaattccattcaaggaaacaaggtaaacaacattgatgttgtttatacgccttggtccaatttgaagaaaactgcttccatggatgttggtcaagttggttttcataaccccaagatggtccgaactgtaagggttgaaaaacggatcaatgacattgtcaatagattgaacaggactaaagtggaaagaaagcctgatttgaaagccgaacgtgaagcagtgaatgcagctgaaagagctgagagaaagcaacacctgagagaaaagaagcggcgcgaggaactggataggttagaaaaagagaggcaagcggagctaaggagctacaagggtttgatggtgtcggagaagatgacatctaacaaacagattgcagcaacaagcaaatcactacaagagctggaggacgatttcatgtgatcgaacatttaatcagtacaaatgctgctaaaaaagagccagctaaaacttgctcttctgtagagaaggccatcatctgccattcaagttagtggttcttggcccaaaagttgtcctctcgtgagtgattaaattgtcttagtctgaatattcaacttgtttatgtctacttgttgatgactatacaaaaaggaaattgctgtgccttttcaagagagcggagaaatggtgttctctaacttgtaattacttgttaaatgatgataagttagctcattttggcc

SEQ ID NO: 2594 - DNA, 1121 bp, Tropaeolum majus
gtgcccaatttagcgtaaaattattttccgcatcgttatctgggaatcttcgtactacaatttccacaaattaattgaattaagcaacaaaattgcggagaagaaggaaccctaggaacccgtctctgttctctggtcgtcttccgcatccaaagaagaaagaatggttttctacttcaaagcccgaccagaggcaggcgattacaccatcttcatgggtctcgacaagcacgagaacgaggagctcataaaatacggtttcccggaagacatatggtttcatgttgacaaaatgtcttctgcccacgtttatgtgagacttaacaaaggtcagagtatcgatggcatcagtgaaggcttactagaggactgtgtccagcttgtgaaagcgaattccattcaaggaaataaggtgaacaacattgatgttgtttacactccctggtccaacttgaagaagaccgcatccatggatgttggccaagttggattttacaatactaagatggttcggactgtgagggtagagaagcggataaatgagatagttaatagattaaaccgaaccaaagttgagaggaagcctgatttgaaagccgagagagaagctgtaaatgcagcagaaagagcagaaagaaaacaactgcagagagagaaaaaacgtcgtgaggaaatggaaaggcttgaaaaggagagacaagcggaggtaaggagctacaagggtttgatggtctctgagaagatgacatcaaacaaagacatagcatcaacaaacaaatctttgcaggaacttgaagatgactttatgtaaagccctccatctgttttcgtcttctatgacatgtatttcaggtaaaagtaagaggttagccaaacaacatgtgattctatttttgaatacctctggaataataagtgactgcaatcgtaaggaagagaagcaaaaaaatgtataaacctaaaaggagaaagccgtatgaggtgggagggaaaatacttcttacatatatcacatgttgcatttgggtaataactgaaaacattgttcaaatcttctttttattgctgtttattaaatttgtgtgtgttgccttgactatgcaataaaaaaaaaaaaagac

SEQ ID NO: 2595 - DNA, 960 bp, Pinus taeda
gatcgacgaaataaagcaataaggagtcatcgtctctcctctttttcccaaacgcaaaccctagagagaggaagagagaaaagagtctcctctgtggagagccgagagagcgaagatggtgttctacttcaaagcccgacctgaagccggagactacaccatcttcatgggtcttgacaaattcgagaacgaagaactcatcaaatacgggttccccgaagatatatggttccatgtggacaaaatgtcatctgcccatgtttatttgaggatgcgtaagggtcagacaattgatgacatttctgaaggacttcttgaagattgtgctcaacttgtcaaagctaattccattcaaggaaataaagtgaacaacattgatgttgtttatactccttggcaaaacttaaagaagactccatcaatggatgttggtcaagttggcttccacaacaataaagctgtgcgcactgtgagggtggagaagcgaataaatgaggtagttaatagactcaatcgcacaaaagtcgaaagaaaacctgatctcaaagctgagcgtgaagcagttaatgcagcagaaagggcagagaggaagcagctgctgagagacaaaaaacgaagagaggagatggaaaggcttgagaaagagaggcaagcggaggtgaggagctacaagaacttaatggttgcagacaaaatgacttccaataaagagattgcatccacccacaaatccctacaagaactcgaagaggacttcatgtaatcaaatcaaattaaaagaagaagaaaaaaaagcatctttctttcacaagacaaaatacaacaatttgaccaagaaaaaaggtatcgttttgttgactgaatcgatgtagactttgtgagtttcaagtgttatgagtctctcttggtttaataaaagctaaaatggcggaattcgcaattccaaaaaaaaaaaaaaaa

SEQ ID NO: 2596 - DNA, 1180 bp, Papaver somniferum
gttagtaacccaagtctgtgcgtgtattttattattcctggttaaattcctcctcccattctctttgattctcacacacactttatatgagagaacctgatcaaagaccaaatctttctttcccccattgaaacttttgttcttcatcctcaaaaccctagtttattttttttggttttgtagaggagaaaagaagatggtgttttacttcaaagctcgaccagatgttggtgatttcaccatctttatgggcttagataagcacgaaaacgaagagctcatcaaatatggattccctgaagatatttggttccatgtggataaaatgtcatcagcccatgtttacgtcagaatgaagaagggtcagacaatagacgatataagtgaaggtttacttgaggactgtgctcagcttgtaaaagcaaattccatccaaggcaacaaggtgaataatgtggatgttgtgtacaccccctggtacaatttgaagaaaactgcgtccatggatgttggccaaattggttttcataattctaagatggttcgcactgtaagagtagaaaagcgcataaatgaggtagttaatagattgaacaagaccaaggtggaaaggaccccagatttaaaagctgagcgagaagcagttaatgcagctgaaagggcagagaggaagctacagctgagagacaagaaacgccgtgaggaaatggaaaggctcgataaggagaggcaagcagagataaggagctacaagggtctcatggtgtcggaaaagatgacatctaacaaacaaattgcgtcagcaagcaagtccctgcaagagcttgaagacgatttcatgtgaagtgagcagcagaaacttaactggaaaacaccacattggtgattaatccaaaaaaatggcactgccgtataattgagggaaggaaatgaatcagaaagtgaaaaggaaatgaatcagaaaagcgtaacttaggaagtaatttgaaagcaatgctcaaacttgttcatcactagacggattgagtttttttatttttttcctttctttcatgttgatggcgacgatgataagatgttttctgatgacatgttttgctactgcaaaatgcaaaagttttttgccatagcaagcgtgatccatttatccgagtctcaatgaataatcattctagtaaaa

SEQ ID NO: 2597 - DNA, 991 bp, Rhizophora mangle
agaaaagcagcaaggaattgtcgattgtgggatttgtcgggaaagaatcatccaaagaagaggaaaattgtcagttgttacctcgaagaagaagaagaagaaaaaaaagatggtgttctactttaaggcccgaccagaggctggggattacacaattttcatgggtatcgacaagtacgagaatgaggagctcatcaaatacggcttccccgaagacatctggtttcatgtggacaaaatgtcttctgcacatgtttatgtaagactgcataagggtcagacgcttgatgatataagtgaaggattgctggaggattgtgctcaactcgtcaaagcaaactcaatccaaggcaacaaggtgaataatgtagatgttgtctatactccctggtctaatttgaagaaaactgcttctatggacgtaggtcaagttggtttccacaatccaaagatggttcaaactgtgggagtggagaagcgcataaatgagattgtcaacagattgaacaaaacgaaatttgaaagaaatcctgatttgaaagctgagagagaagcagtgaatgcagcagagaaagccaagaggaagcttcaattaagagaaaaaaagcggcaagaggaaatggaagggcttgaaaaggagaaacagacagaaataaggagctataagggtttgatggtgtcggagaagatgacaactaacaaacagattgcatcagcaaacaagtccttgcaggagctagaagacgactttatgtaaacccaatggtataggactgtgctgccagttaaatttgttggccttcaaagaaccaagcttgacatcctctttataacttcaaggctgaagtcattttccctgttagtggattgggacttgagggagtgactccagcctatgcaaaactttgagggttttatgtcaagcacaagttggcacacgtcattttaagtcatgaactctcagctaccatatatataacttgcttatccg

SEQ ID NO: 2598 - DNA, 1056 bp, Carthamus tinctorius
cgggggcgggttaattctttcacaaatcaccaccatctctccttttcctaaaccaaccctagagagagaagagaaagagaagaggagagagagagggagagagtctcctccgtggagagcagcaggggaagaagaagaagttagatagagagagaaagcgaagatggtgttctacttcaaagcccgaccagaatccggagactacaccatcttcatgggtcttgacaaattcgagaacgaagaactcatcaaatacggattccccgaagacatttggttccatgtggataaaatgtcttctgcccatgtttatctgaggatgcgcaagggtcagacaattgatgacatatctgaaggacttctcgaagattgtgctcaacttgtcaaagcaaattccatccaaggaaataaagtgaacaacattgatgttgtttatactccttggcaaaacctaaagaagactccatccatggatgttggtcaagttggtttccacaacaataaagctgtgcgcactgtgagagtggagaagcgaataaatgaggtagttaatagactaaacaggacaaaggtggaaagaaaacctgatctgaaagctgagcgtgaagcagtcaatgctgccgaaagggcagagaggaaacagcagctgagagacaagaaacgacgagaagagatggaaaggctggaaaaggagcgacaagcagaggttaggagctataaaaatctgatggttgccgataaaatgacatccaataaagatattgcgtcaacccacaagtccttgcaagaactcgaagaggacttcatgtagaccgaccatcgtcaaaatgcaagtatgcctgcctgttctttgaccgccttatgccaattttcgacaaggaaaagtatgggcaagtcgaaagtggtgagtcaaaaagtaagaaatctcttggtttgtggatgttaaataaaaagctaaaaaatggccagaattgacaactcccttgctttgtatgaatttgctctttgctttgctactctgatttgaacataaatttatcttcatattctcattgc

SEQ ID NO: 2599 - DNA, 1104 bp, Sesamum indicum
ggaaaggtcaaaagcttgccgaattcttatactattgtcgcctcaatcgtgaattcggagaagaaaattggagaatcgaaaccctagagagagaaagaggaaacgaagatggttttctacttcaaggcgcgaccggaggcgggagactacaccattttcatgggcctcgacaagtatgagaacgaggagctcatcaaatacggctttcccgaagacgtttggttccatgtagataagatgtcttcagcccatgtttatctgagactgaacaagggtcaaacaattgatgatatacctgaaggtgtattggaagattgtgctcaattagtgaaagcaaattctatccaaggtaataaagtaaataatgttgatgttgtttacaccccttggcaaaaccttaagaagactgcttccatggatgttgggcaagttggtttccacaattcaaaaatggttcgtactgtgagagtggaaaaacgaataaatgagatagttaatcgattaaacaggacaaaggtggaaagaaagccagatttaaaagctgaacgggaggcagttaatgcagctgaaagagctgagaggaaacagcagctccgtgataaaaaacgacgggaagaattagaaaggcttgagaaagagagacaggctgaattaaggagctacaaaaatttgatggtagctgaaaagatgacatccaacaaggatatagcatctgcaaacaagtccctgcaagaacttgaggaagatttcatgtgaatccaaaatccttaaaacataaacaatttgtcaaagtttggcaattaatccataatatgagagttgtaaccctaaggaggacaggatagaagatcaagaaagagaagtcactgactgcggcattcttgaacggtgataccgtactatgttgtgtccgactgtccataaacataaatagtcacctgagcttagtatattcagtggtcttgaagctctcaaagtgtgttaatagaatctggggagcaagggtccagcgtttgagagcaggcagaagacaattgaatgtattaaacatggatgacgacgacggtggtgataacattgttttcgtatgtgagtaaaatgatc

SEQ ID NO: 2600 - DNA, 866 bp, Tripterygium wilfordii
aaaaatagaaagatggtgttctacttcaaagcccacccagatgctggcgattactccatctttatgggcctcgacaagttcgagaacgaggagctcatcaaatatggatttcccgaagatatctggttccatgtggataaaatgtcttctgcccatgtttatgtaagactgcacaagggtcagactatagatgatataagtgaaggtttacttgaggattgcgcccagcttgtcaaagcaaattccattcaaggcaacaaggtaaataatgttgatattgtatatacaccttgggccaatttaaagaaaactgcttccatggacgtcggccaagttggcttccacaatccaaagatggttcggactgtgagagtagagaagcggataaatgagattgtcaatagattaaacaagacaaaagttgaaagaaagcctgatttgaaagccgagcgagaagcagtgggcgcagctgaaagagcagagcgaaaggttcagcagagagataaaaaacgccgtgaagaaatggacaggcttgcaaaggagaggcaagcagagatacgaagttacaagggtttaatggtatctgagaatatgacatcaaacaaagagattgcttcgggaaacaagtccttgcaggaattggaggaggacttcatgtgagtgactgggtgtctgtctgtctgtctgtctgtgtggttctcattatctcatgttcagtaaaatactccatggcgcccctcttatggaaggggcttgtcgttcatttacatggcgtttcaagtcattttcctcttgaacaaattaccttattcaaagctgtgacttatgtttattgtgatgtgggtgattgaaagaaaatctgtacc

SEQ ID NO: 2601 - DNA, 1229 bp, Centaurea maculosa
ctcctcctccctcgatcaccaaagcaatcatctctctctctctccttttcctaaacgacaaccaaaaccaaaccctagagagagaagagggaggaagagagagagagagagagggtctcctccgtggagaagagcagaagcagcaggggaagaagaaagagaaggagaagaagaagatggtgttctacttcaaagcccgacctgaatccggagactacaccatcttcatgggtcttgataaattcgagaacgaagaactcatcaaatacggattcccagaagacatttggttccatgtggataaaatgtcttctgcccatgtttatctgaggatgcgtaagggtcagacaattgatgacatatctgaaggacttcttgaagactgtgctcaacttgttaaagcaaattccatccaaggaaataaagtgaacaacattgatgttgtttatactccttggcaaaacctaaagaagactccatccatggatgttggtcaagttggtttccacaacaataaagctgtgcgcactgtgagagtggagaagcgaataaatgaggtagttaatagactaaacaggacaaaggtggaaagaaaacctgatctgaaagctgagcgtgaagcggtcaacgccgccgaaagggcagagaggaaacagcagctgagagacaagaaacgacgagaagagatggaaaggcttgaaaaggagcgacaagcagaggttaggagctataaaaatctgatggttgctgacaaaatgacatccaataaagatatcgcgtcaacccacaagtccttgcaagaactcgaagaggacttcatgtagaccaacgatcgtcaaaatgcaagtatgcctgttcttttttgaccgccttatgccaattttcgacaaggaaaagtatgggcaagtcgaaagtggtgagtcaaaaagtaagaaatctcttggtttgtggatgttaaaataaaaagctaaaatggccagaattaacaactcccttgctttgtatgaatttgctctttgctttgctactctgatatgaacatgaattttatcttcatattctcattacaaaaagaaaaaagtgatctatagaaccacaattggttactaagcaaggtcaggtgcaatttaatttgttgatacatacagacatagatacatatatacatgccgatcaagtggtcaaaattctcttccttctttgaacatgcacttccatgagagcaactc

SEQ ID NO: 2602 - DNA, 887 bp, Panax ginseng
tgccaatcagagcatagtaagacgcggaaagtacggttttaatttttaacagaaattgaaaaccctaatttgcatttcttcttcttcatctactttgtgtgtggttgggatttgggagggcgtgaaaaatggtgttctacttcaaagcccgcccggaagcaggagactacaccattttcatgggcctcgacaagcacgagaacgaagagctcatcaaatacggcttccccgaagacatttggttccatgttgataaaatgtcttcggcccatgtttatgtgagattacacaagggtcagactgttgatgatatatcagaaggtctactggaagattgtgctcagctagtcaaagcaaattccatacaaggaaacaaggtgaacaatatcgatgttgtatacactccctggcaaaatttgaagaagactgcttctatggatgttggccaagttggttttcacaatccaaaaatggtccgcactgtcagagtacagaaacggattaatgaggtagttaatagattaaacaagacaaaagtggaaaggacacctgatttgaaagctgagcgcgagtcagttaatgcagcagaacgagcggaaaggaaacaactgctgagagataaaaaacgaagggaggagttagagaggctggaaaaggagagacaagcggagcttaggagctacaagaatttaatggtagccgacaagatgacatctaataaagacatagcttcgacccagaagtccttgcaagaactggaagaggatttcatgtgaaaaaaaaaatttaaatttgaatatttcccatactttaccccttgttgccaaatttgggaaaccgccaaaaatgggaaggaagaaagacaaaaaaagagatttttattttta

SEQ ID NO: 2603 - DNA, 1044 bp, Amsonia hubrichtii
cagaaaggaaaattcgaaaccctagaattttctctcgttctccgtgagaagaagatggtgttctacttcaaagcccgacctgaggccggagattacacaatcttcatgggccttgacaagttcgagaatgaagagctgatcagatatggtttccctgaagacatttggttccatgtggacaaaatgtcatcagcccatgtttatctcagattgcataagggtcagaccattgatgacatatcagaaggtgtactagaggattgtgcacaattagtcaaagcaaattccatccaaggaaacaaggtgaacaatgtagatgttgtttatactccctggcataatcttaagaagacagcttcgatggatgttggccaagttggtttccacaacccaaaaatggtccgtacggtgaaagtggagaagcggataaatgagatagttaatagattaaaccggacaaaggtggaaagaaaacctgatctgaaagctgaacgagaagcagttaatgcagcagatagagctgagaggaaacagcatctcagagacaaaaaacgacgtgaagagatggagaggcttgaaaaggagagacaggctgagttaagaagctacaaaaatttgatggtagcagataagatgacatctaacaaggatattgcatcaaccaacaagtcccttcaagaattggaagaggacttcatgtgaatgttggcaattcaagaatttcttaaatttgccaccaagatatattttagcctggataaggtgtactaagaagaaaatgtcaaagagttcagtagcgggttgtagcggtgtttcattattgtaatttggtgagacattaataagctccttgatgaaatggggccaaggttctaataggagcttgtaatggttaaagccataattgtattcctttaagaggccaaggttctaataggagcttgtaacgtatttacagcttgtatacattgataatgatgaaagaacatcattcaaatttgtaatcagttgtttactctctccatggtatggtacattcgccta

SEQ ID NO: 2604 - DNA, 1040 bp, Artemisia annua
cccctttttcacatacggaggagagaatttcttcgtatcattcattttaatctaaccctaaaatcaaagtgtttgtggcggtattagcagttatttgatcacttcctgcactttcttttttgtaaaacacaagaagcaactctaaagaaagaagagatcgaagatggtgttttactttaaagctagaccagaagccggagactacaccatcttcatgggtcttgacaagtttgagaacgaagaacttatcaaatacggtttccctgaagacatctggttccatgtggataaaatgtcttctgcccacgtctatctgaggatgcgcaagggccagacaattgatgacatatcggaaggggttcttgaagattgtgttcaacttgtcaaagcaaattccatccaaggaaacaaagtgaacaacatagatgttgtttatactccttggcaaaacttgaagaaaactccagccatggatgttggtcaagttggtttccacaacaataaagcagtgcgcactgtgagagtggagaagcgaattaatgaggttgttaataggctgaaccgtaccaaagtggaaagaaaacctgatctcaaagctgagcgtgaatcagtcaatgcagcagaaagggcagagaggaagctgcagctgagagacaaaaaacgacgagaggaaatggagaggcttgagaaggagaaacaagctgaggtaaggagctacaaaaatctcatggttgctgacaaaatgacttccaacaaggagattgcttcaacccacaagaccttacaggaactcgaagaggacttcatgtaaaacatccatcagattgttttctttttcgcttgttccgtcactttatgcgccacccatgtttgacaaaaaagtctcaagtggagtgtatgtgtatcaaaatcattctcttgctttgtggatgtttaataaaagcttaaatggccacaattcccaattccatggggagagagaagagtgctttgtatgaatttgctctttgctacttctatatcatcttaaatctatctta

SEQ ID NO: 2605 - DNA, 1026 bp, Cucurbita pepo
gggtaatatcagcgtccgatcaaagattcaaaatcacacgcaacccagacgaccaatctctcttctttcctcgaattgaaaaccctaattcattctgttctctccattttcgagggttgagcgaacgaaatcgaagcaccatggttttctatttcaaagcccggcccgacgtcggtgattactccattttcatggggctcgacaagtacgagaacgaggagcttatcaaatacggctttcccgaggatatttggttccacgtagacaagatgtcatctgctcatgtttatgtgagactgcaaaaagggcagaccattgatgatattagtgaagggttgctggaggattgtgctcagcttgtcaaggcaaattccattcaaggaaacaaggtaaacaacattgatgtggtgtatacaccttggtccaatttgaagaaaactgcttccatggatgttggccaagttggtttttataaccccaagatggtccgaactgtaagagtggaaaaacggatcaacgacatcgtaaatagattgaacaggactaaagtggaaaggaagcctgatttaaaagccgaacgtgaagcagtgaatgcagctgaaagagcggagaggaagcaacacctgagagaaaagaaacgacgtgaggaactggaaaggttagaaaaagagaggcaagcagagttaaggagctacaagggtttgatggtctctgagaaaatgacatctaacaaacagattgctgcaacaagcaaatcgctacaagagctggaggacgattttatgtgatcgaattgattgttcggtacgaacgatgcaagaaatagaaatttgctgttcttggcccgaagttgttctctcgtacgtgatcaaattattgtgtttaggctcgatgacgttcaacttgttgtgtctacctgatgagacgactatacaaatagaaatttgctgtggctttgaagagagcggatttatggtgtttatgtaagttgtaattactgttactcttgtttaatgattataaggt

SEQ ID NO: 2606 - DNA, 1115 bp, Papaver somniferum
cacacactttatatgagagaacctgatcaaagaccaaatctttcttccccccattgaaacttttgttcttcattctcaaaaccctagttattttttttggttttgagaggagagaaaaagatggtgttttacttcaaagctcgaccagatgttggtgatttcaccatctttatgggcttagataagcacgaaaacgaagagctcatcaaatatggattccctgaagatatttggttccatgtggataaaatgtcatcagcccatgtttacgtcagaatgaagaggggtcagacaatagacgatataagtgaaggtttacttgaggactgtgctcagcttgtaaaagcaaattccatccaaggcaacaaggtgaataatgtggatgttgtgtacaccccctggtacaatttgaagaaaactgcatccatggatgttggccaaattggttttcataattctaagatggttcgcactgtaagagtagaaaaacgcataaatgaggtagttaatagattgaacaagaccaaggtggaaaggaccccagacttaaaagctgagcgagaagcagttaatgcagctgaaagggcagagaggaaactacagctgagagacaagaaacgccgtgaggaaatggaaaggctcgataaggagaggcaagcagagataaggagctacaagggtctcatggtgtcggaaaagatgacatctaacaaacaaattgcgtcggcaagcaagtccttgcaggagcttgaagacgatttcatgtgaagtgagcagcagaaacataactggaaaacaccacattggtgattaatccaaaaaaaaaatggcactgccatgtaattgagggaaggaaatgaatcagaaagtgaaaaggaagacaaatgtcttcagaaaaaaggagagaaaaatgcacaacctaggaagtaatttgaaagcaaggcgcaaacttgttcatcactagaccgaatgagttgtttttttttcttttctttttcttcatgttgatggcgactattagatgttttctgatgatattgcacaagtttttttgccatagcatgcgtgatccatttattgagtctgaatgaaaagtcattctaagaaaaaaaaaa

SEQ ID NO: 2607 - DNA, 1148 bp, Sequoia sempervirens
gtagcaaagtcaatcacgatggtgttctatttcaaggccaggcctgaggcaggggattacaccatttacatgggtcttgacaaacatgaaaacgaagagctcatcaaatatggcattcccgaggatatttggttccatgtggataagttatcttcagcacacgtgtatgtgagaatgcacaagggtcagacaatagatgatattacagaaccacttctggaagattgtgcacaactagtgaaggcaaactccatccaaggaaataaaaccaacaatcttgatgttgtgtatactccttggtccaatttacggaaaactgcatccatggatgttggacaagttggcttccataaccccaagaatgtcagaactgtcagagttgagaagcgtatcaatgaaattgtgaatcgtttgaacaaaacaaaagttgagcggaagcctgacttgaaagctgaacgagaagctatgaatgctgcagaaagagcagagagaaaagttcagcttagggaaaagaaacggcgtgaggagctggatcgtcttgagaaagagaagcaggcagaaataagaagctacaaaggactaatggttgcagagaaaatgacttccaataaggatattgcatcagggagtaagtctcttcaggagttggaagaagatttcatgtgatggtactctaaggaaggagcatatataatgacatatggctgagtttatattactttgtttgttctgaaaaattgtctccatgcgaggaaacatctgaggtagatcatatccagttttgttgtcatccactaagtgagatcaagccagtaagagctggttgcaggttcttctgcaaatagctaaatggagctaaaacctagttctgagtgtcgtagctgccatttgcaaattctgaagcaaatagaggcatgttttctccatacatggtaaatttgctgttggtggttgtaggcgacagatgttctaggcaaattagcaatgagaggggttctgcttggtcttttagaatgtgctttactatttctgtttcattagcactcttatggattatttattaaaatgctcccatggtgaattctggtcaagaaaaagtgatttctttgattcagtagcattcatcgtcattccactttattcaagtt

SEQ ID NO: 2608 - DNA, 1050 bp, Allium cepa
ggggcctctcctttgatcgataattcaatcggtcccaacttgttccttgtctggaaactacaattcagaattcaagtaattatcttcctttctgaaaattgtaagggtcaattaatgaaattagcctgcctctgatctcagtgttggctagaagtagaaaataaaaataaaagaagaatacataaagggaaaatggtattctacttcaaagcccgacctgaagttggagattacacaatttttatgggtttggataagcacgagaacgaggagcttatcaaatatggatttcaagaagatatttggtttcatgttgataagatgtcctctgctcatgtctacttaagaatgaataaaggtcaaacaattgatgatataagcgagggtttattagaagattgtgctcagctcgtcaaagctaattcaatccaaggcaacaaggtgaacaatgtagatgttgtgtatacaccatggtataacttgaagaaaaccccttcgatggaagttgggcaggttgggtttcacaactccaaaatggttcgaacggtaagggtggagaagcgcataaatgagattgttaacaggctgaacaagacaaaggtggaaaggacaccggacttgaaagcggagaaggaagctgtgtttgcagcagagaaagcagtacgaaagcagcagctaagagagaaaaaaaaagggaagagatggacaggattgaaaaggagaaacaagcagaaatgaggagttacaaaggtcttatggtttctgagaagatgacatccaacaaacaaatcgcatctgccaacaaatcacttcaggaactcgaagaggatttcatgtgatgtggtgcttatcagattttgcacagcaaaatgaattcgttttgctgtcgcgattgccaattttagactactatctttgcgttttggtattgacaataattcagagctgagttgttgaaacattacatctctcaacttaaaactgtaatattattatgtgttgattgttctcgacagtacgatttgatatttcatgtattatgcattatgg

SEQ ID NO: 2609 - DNA, 1099 bp, Panax ginseng
aagtctagtggtatcaacgcagagtacatggggatgccagccaaacagagcctagtaagatgcggaaagtacggttattaactgtcctagcttgaaattgatctcgccaatttgaaaccctagctactttttcttcctgttctgcgttgttgggagggcgtgaagagagagaaatggtgttctacttcaaaggccgacccgaagccggtgattacaccatcttcatgggtctcgacaagcacgagaacgaagaactcatcaaatatggcttccccgaagacatttggttccatgtggataaaatgtcttcagcccatgtttatgtgagattacacaagggtcagacggttgatgatatatctgaaggtctactggaagattgtgctcaactagtcaaagcaaattccatccaaggtaacaaggtgaacaatattgatgttgtttacactccttggcaaaatttgaagaagactgcttccatggatgttggccaagttggttttcacaatccaaaaatggttcgcactgtgagagtggagaaacggattaatgaggtagttaatagattaaacaagacaaaagcggaaaggacacctgatttgaaggctgagcgggaggcagttaatgcagcagaacgagcacaaaggaaacagcagctgagagataaaaaacgacgagaggagatagagaggctggaaaaggagagacaagcagagttgaggagctacaagaatttgatggtagctgacaagatgacatctaataaagacatagctgcgacccagaagtccttgcaagaactagaagaggacttcatgtaaacacactaaaacttgaatatatcccaaatctataaccttgttgcaagatttgggaactgccaaatagaaagaagggaaaggtagagggaataaagtataaacgggaaggattggttggggggtgagtttcttttttactggtaatatgttgtgtgatatgaaattgtttgcgttaaacctcctcttaataagctcaggcaccaatgtgcagtttgagagggagaggaggtttgtttgtatggacagtatgatgaggatgaggatgatgataaatgact

SEQ ID NO: 2610 - DNA, 1165 bp, Panax ginseng
ccccccctatcccctcgtgtgccttgcctccctacgactcggaaagtacggttattaactgtcctagcttgaaattgatcacgccaatttgaaaccctagccacttctttttcctgttctgcgtggttgggagggcgtgaagagagagaaatggtgttctacttcaaaggccgacccgaagccggtgattacaccatcttcatgggtctcgacaagcacgagaacgaagaactcatcaaatatggctttcccgaagacatttggttccatgtggataaaatgtcttcagcccatgtttatgtgagattacacaagggtcagacagttgatgatatatctgaaggtctactggaagattgtgctcaactagtcaaagcaaattccatccaaggtaacaaggtgaacaatattgatgttgtttacactccttggcaaaatttgaagaagactgcttccatggatgttggccaagttggttttcacaatccaaaaatggttcgcactgtgagagtggagaaacggattaatgaggtagttaatagattaaacaagacaaaagtggaaaggacacctgatttgaaggctgagctggaggcagttaatgcagcagaacgagcacaaaggaaacagcagctgagagataaaaaacgacgagaggagatagagaggctggaaaaggagagacaagcagagttgaggagctacaagaatttgatggtagctgacaagatgacatctaataaagacatagctgcgacccagaagtccttgcaagaactagaagaggacttcatgtaaacacactaaaacttgaatatatcccaaatctataaccttgttgcaagatttgggaactgccaaaaagaaagaagggaaaggtagagggattaaagtataaacgggaaggattggttggggggtgagtttcttttttactggtattatgttgtgtggtatgaaattgtttgcgttgaatctcctcttaataagctcaggcaccaatgtgcagtttgagagggagaggaagtttgtttgtatggacaggatgcacatttagatgatgaggatgatgataaatgacttgaaatatttgtcggatactgcaaggtagattgttctataatatgatcttgcccttggttggtttgtttgtatggacagtatg

SEQ ID NO: 2611 - DNA, 1203 bp, Medicago truncatula
ttcgaaaaagacgaaacagaaagttgcgcgtgattatgttttatgcagcgattcggatatcaattccccaaattgaaattcaactcccaaacacagaacccaacgcactttctctcctctcgtgttcgtgcgtgcgtgaaatctaagcaactcaataatggtgttctacttcaaagcacgccctgaagctggcgattacaccatcttcatgggtcttgacaagttcgagaacgaagagctcatcaaatacggtttcatcgaagacatctggttccatgttgataagatgtcttcagcccatgtttatgtcaggctgcacaaaggtcagactattgatgacatgagtgaaggtttattggaagactgtgctcaacttgtcaaagcaaattcaattcaagggaataaagtaaacaacgttgatgttgtttacactccctggtccaatttaaagaaaactgcttcgatggacgttggtcaagttggttttcacagctcaaaaatggtgcgaactgtgagagtggagaagaagataaatgagattgttaacaggctaaacaaaacgaaggtggaaagaaaacctgatttgaaagctgagcgagaagcagttgctgctgctgaaagagctgagaggaaacatcaactgagagaaaaaaagcgccgtgaggaaatagacagactagaaaaggagaaacaatcagagcttaggagctacaagggtttgatggtcgcagaaaatatgacatccaacaaagacattgcttcaggaagcagatcattccaggaagtggaggaggatttcatgtaaacattggttattggcttatagacaaatgactggtggtcaacttgctgccatgattaaataacccaactggaatctgaaactgcatcattgtcttggttaaggaaaccaagtggtgtgtgtacccaactgtgatttagggataaaggagaatataaaatagggaggggagaatgcaatgattggttttcataccttgtgatggttatatacctgatttataactttgcttgtgacaatggtttttattttattttctcacagtcgagtcaaaaactgatgtttcttgctataattttgagtcttgttaggcttgtcaggtttaaacttttgcttttaggaaattgttaactatgcgataaattatcagggcattttgaagtattcatggtactggcaga

SEQ ID NO: 2612 - DNA, 1126 bp, Medicago truncatula
tatgttttatgcagcgattcggatatcaattccccaaattgaaattcaactcccaaacacagaacccaacgcactttctctcctctcgtgttcgtgcgtgcgtgaaatctaagcaactcaataatggtgttctacttcaaagcacgccctgaagctggcgattacaccatcttcatgggtcttgacaagttcgagaacgaagagctcatcaaatacggtttcatcgaagacatctggttccatgttgataagatgtcttcagcccatgtttatgtcaggctgcacaaaggtcagactattgatgacatgagtgaaggtttattggaagactgtgctcaacttgtcaaagcaaattcaattcaagggaataaagtaaacaacgttgatgttgtttacactccctggtccaatttaaagaaaactgcttcgatggacgttggtcaagttggttttcacagctcaaaaatggtgcgaactgtgagagtggagaagaagataaatgagattgttaacaggctaaacaaaacgaaggtggaaagaaaacctgatttgaaagctgagcgagaagcagttgctgctgctgaaagagctgagaggaaacatcaactgagagaaaaaaagcgccgtgaggaaatagacagactagaaaaggagaaacaatcagagcttaggagctacaagggtttgatggtcgcagaaaatatgacatccaacaaagacattgcttcaggaagcagatcattccaggaagtggaggaggatttcatgtaaacattggttattggcttatagacaaatgactggtggtcaacttgctgccatgattaaataacccaactggaatctgaaactgcatcattgtcttggttaaggaaaccaagtggtgtgtgtacccaactgtgatttagggataaaggagaatataaaatagggaggggagaatgcaatgattggttttcataccttgtgatggttatatacctgatttataactttgcttgtgacaatggtttttattttattttctcacagtcgagtcaaaaactgatgtttcttgctataattttgagtcttgttaggcttgtcaggtttaaacttttgcttttaggaaattgttaactatgcg

SEQ ID NO: 2613 - DNA, 1064 bp, Carica papaya
aataaagctttcggtctctgttcgtctgataacagaatcaggatcgaaggagagcagaatggttttctacttcaaagcccgaccggaagctggggattataccgtcttcatgggccttgacaagtacgagaacgaggagctcatcaaatacggtttccctgaagacatttggttccatgtggataaaatgtcttctgcccatgtatatctgagacttcataagggtcagactattgatgatataagtgaaggtgtgctggaggattgtgctcagctcgtcaaagccaattccatccaaggaaataaggtgaacaatattgatgttgtttacactccctggtccaacttgaagaaaacagctgccatggatgtcggccaagttggttttcacaattcaaagatggttcggactgtgagggtggagaaacggataaatgaggtagttaatagattgaacaggacaaaagtagaaagaaagcctgatctaaaagcggaacgagaagcagtcaacgcagcagaaagagcagagagaaaacagcacctgagggagaaaaaacgtcgggaagagatggaaaggatggaaaaggagagacaagcagagattaggagctacaagggcttaatggttgctgaaaagatgacatcgaacaaagagattgcatcggcaaacaagtctttgcaggaactggaagatgactttatgtaagcagctgtcacggttatcaatggatttaatgttgtttaagatgttgccagctgccaaatttgcttccctgtaaagagggatttccgtcagcttatgattctatattcaaagtcattttccgtcttgaatatgttcctgatccatcgcaagaaggaaaatgagcagcgatggaagaggagagaggacagtggagttgagagggaatgaactttgcagcaaacgtatgttctacttgtctgctaaactttgtgtctatacggctatgtctacgatgcaatttttatggtatattttttaaagaaggatatctaaccacacccatgaacgggggtgcctgtatgtatctgaaatatgggat

SEQ ID NO: 2614 - DNA, 1449 bp, Prunus mume
atagcaaaatcaaaacaaaaacaaaaacgaaaataaaaataaaaatgaaaaagtttccagtgcccaaaatcccaattggaaagctggaaggtggaacttggaagccctagctcctcaaaggttctcgttttctgtggcatcgaattccaaagggccgaacgaacaagatggtcttctacttcaaagctcgatccgaagttggcgattacaccattttcatggggctcgacaagttcgagaacgaggagctcatcaaatatggcttccccgaagacatttggttccatgtggataaaatgtcttctgcccatgtttatgttagactgcacaaaggacagaccattgatggtataagtgaaggtttactggaggattgcgcacagcttgtcaaagcaaattccatccaaggcaacaaggtgaacaatgtcgatgttgtttacactccctggtccaatttgaagaaaactgcctccatggatgttggtcaagttggtttctacaattcaaagatggttcgaactgtgagagtggagaagcggattaatgaggtagttaatagattgaacaggacaaaagtggaaaggaagcctgatttaaaagctgagcgagaagcggtcaatgcagcagaaagagctgagagaaagcagctgctgagggacaagaaacgacgtgaggagatggaaaggcttgagaaggagagacaagcagagctaaggagctacaaaggcttgatggtttctgaaaatatgacatctaacaaacaaattgcatcggcaaacaagtcattgcaggaactggaagaggacttcatgtaaggatatcattgtctatgagttgggtgagatgctcctacctgccgcccattaagattgcagtttatcattcagtttgtgagttagttctaaaagttacttcccttcatgaatataatatgtcataaaccttgtaatttgttgctgttgataagaaaaagagaaaatgcaaaaaatggaggtagaaaaagaaaagggttttatgggtgaagtttggttgggggaagtctctttcttgtcactgcatgttgtatgtggttcataatgatgataccacacaaatcaaacttcattcaggatgatgggagataaacttgttattttgctgtcaaatttcttgcaaatgtattttactgcattttgaaacccgtatttatatttagacatttgtgaatgataaatcatctataagtgtgtatttgaaaaaaagaaaaaaaaaagagaaaaaaaggaggggaccttgtgaaccatttgatttgtacaatattagaaattaatattgcaagattgagggagcaaaaggaatgatagtggacattaatattcttatgcttggggttgaatctctgtatgcatgtatcagattgtcttccaatcttattgtgatgtggtaattgccatatcaaacggttcttaa

SEQ ID NO: 2615 - DNA, 1140 bp, Prunus persica
atagcaaaatcaaaacaaaaacaaaaacaaaaataaaaataaaaatgaaaaagtttccagtgcccaaaatcccaattggaaagctggaaggaacttggaagccctagctcctcagaggttctcgttttctgtggcatcgaattccaaagggccgaacgaacaagatggtcttctacttcaaagctcgatccgaggttggcgattacaccattttcatggggctcgacaagttcgagaacgaggagctcatcaaatatggcttccccgaagacatttggttccatgtggataaaatgtcttctgcccatgtttatgttagactgcacaaaggacagaccattgatggtataagtgaaggtttactggaggactgcgcacagcttgtcaaagcaaattccatccaaggcaacaaggtgaacaatgtcgatgttgtttacactccctggtccaatttgaagaaaactgcctccatggatgttggtcaagttggtttctacaattcaaagatggttcgaactgtgagagtggagaagcggattaatgaggtagttaatagattgaacaggacaaaagtggaaaggaagcctgatttaaaagctgagcgagaagcggtcaatgcagcagaaagagctgagagaaagcagctgctgagggacaagaaacgacgtgaggagatggaaaggcttgagaaggagagacaagcagagctaaggagctacaaaggtttgatggtttctgaaaatatgacatctaacaaacaaattgcatcggcaaacaagtcattgcaggaactggaagaggacttcatgtaaggatatcattgtctatgagttgggtgagatgctgctacctgccgcccattaagattgcagtttatcattcagtttgtgagttagtcctaaaagttacttcccttcatgaatataatatgtcataaaccttgtaatttgttgctgtcgataagaaaaagagaaaatgcaaaaaatgggggtagaaaaagaaaagggttttatgggtgaagtttggttgggggaagtctctttcttgtcactgcatgttgtatgtggttcataatgatgataccacacaaatcaaacttcattcaggatgatgggagataaacttgttattttgctgtca

SEQ ID NO: 2616 - DNA, 1180 bp, Sciadopitys verticillata
gttctttgtaaaaccagtcaagatggtgttttacttcaaggccaggccagaggcaggggattacaccatttacatgggccttgacaagcatgagaatgaagagctcataaaatatggcattccggaggatatctggttccatgtgtataagctgtcttcagcacacgtttatttgaggctgcacaagggtcagacaatagatgccataacagaacccctcttggaagattgtgcacaacttgtgaaggcaaactctattcaaggaaataaagtcaacaatcttgatgttgtgtacaccccctggtccaatttaagaaaaactgcagctatggatgttggacaagttggattccataactccaagcttgttagaactgtaagagtggagaagcgtatcaatgaagttgtgaatcgcttgaacaaaaccaaagttgagcggaagcctgacttgaaagctgaacgtgaagctattaatgctgcagaaagagcagaaagaaaaactcaacttcgggaaaagaaacggcgcgaggaattggagcgtcttgaaaaggagaagcaggcagaaataagaagttataaaggccttatggtttcagagaaaatgacatctaataaggacattgcatcaggcagtaagacttttcaggagttggaagaagatttcatgtgatggtgctagaaggaagctgcattaatagtgcatattgctgaatttatattactttgttccttgttctgaaaatttgtgtcgatgtcagtgaacaagtgaggtagctcatatcctgtttttcttttcatctccaagtgcaataatgccagtggagcaggtttccagttcttcagcaaatagattagctcaaatccatttatgagagtcattgctcttggttgcaaatttttaagtgaatagatgcgtgcattctccattgatggtgaatttgctgacagtggttgtaggttatgaatgttctaggaaaagttactatgagaggtttgcttggtccgttggaatgtgccttactatgtctacttcactagcaatcttatgagttaatttattgaagcactctatggggcaatttggacacgaaacatgatgatatttctctgtgattcagtggcattccaatacatttcttgaaagtgaagtcggcctatttattctaaattttggctgcct

SEQ ID NO: 2617 - DNA, 1064 bp, Tabernaemontana elegans
cactagtaaattagaaaccctagagctctctcttccgctaagaagaagatggtgttctacctcaaagcccgacctgaggccggagattacacaatttttatgggcctagacaagtacgagaatgaagaattgatcaaatatggtttccctgaagacatttggttccatgtggacaaaatgtcttcagcccatgtttatctcagattgcacaagggtcagactattgatgacataccagaaggtgtactagaagattgtgcgcaactagtcaaagcaaattccatccaagggaacaaggtgaacaacatagatgttgtttatactccttggcataatcttaagaagactgcttcaatggatgttggccaagttggtttccacaactcaaaaatggttcgtaccgtgagagttgagaagcggataaatgagatagttaatagattaaacaggacaaaggtggaaagaaatcctgatttgaaagctgaacgagaagcagttaatgcggcagaaagagctgagaggaagcagcagctgagagacaaaaaacgacgtgaagagatggagaggcttgacaaagagagacaagctgagttaagaagctacaagaatttgatggtagcagataagatgacatctaacaaggatattgcttcagccaacaagtcccttcaagagttggaagaggatttcatgtgaatgttggcagtccaagaatttcttaagtttgccaccttattgcaggatgcaagttgtatgtcagtggataaggtgtactgagaagaaaaaaatcaaacaggaacgtggatgaggttgcgattgggtacgataatttattattgtaatttgctgaggcattaataagctcctcgatgaaaacgaggtagctttggctttgtattggttgaagccataattctatcccataataaggccaaagttgtaattggagcttgtaatgtttttacagcttgtatacaatgataatgatgaagaacatcatctaaaatttgtatcagttgtttactctctccaggatataaatacatttgttctattttcttacg

SEQ ID NO: 2618 - DNA, 1115 bp, Tragopogon dubius
cggggcttttcaattttgatcgacaaaatcaagcaataaggagtcatcgtctttcctccttttcctaaacgcaaaccctagagagagagaaaacaaaaaaaggtctcctttgtggagagcagagagatcgaagatggtgttctacttcaaagcccgaccagaatccggagactacaccatcttcatgggtcttgacaaattcgagaacgaagaactcatcaaatacggattccccgaagacatatggttccatgtggacaaaatgtcttctgcccatgtttatctgaggatgcgcaagggtcaaacaattgatgacatatccgaaggacttcttgaagattgtgctcaacttgtcaaagcaaattccattcaaggaaataaagtgaacaacattgatgttgtttatactccttggcaaaacttaaagaagactccatcaatggatgttggtcaagttggtttccacaacaataaagctgtgcgcactgtgagggtggagaagcgaataaatgaggtagttaatagactcaacaggacaaaagtggaaagaaagcctgatctgaaagctgagcgtgaagcggttaatgctgcagaaagggcagagagaaagcagctgctgagagacaaaaaacgacgagaggagatggagaggatggaaaaggagaggcaagcggaggtaaggagctacaaaaatctgatggttgctgacaaaatgacttccaataaagagattgcgtccacccaaaagtctttacaggaactcgaagaggatttcatgtaaaacaatacaccaatcaaactctgatctgacttttgagtcgatttaaagtgttatgatgatgccctaagtctcttggtttgtggatgttcaataaaaaccagaaattcgcaactccgagaggagggagggaagcttaatttgtatgaattttatctttgctactttgatatgatgatgaaattgtcttcaaattcttgcaatgcttgatgttgtattggataaacttatcttcaatgcttggtaagctaaatcacaaggtctcacttgggttttagttttcaatcaaaccttaacatgtttctttattagttattaatttacttgggggttgtct

SEQ ID NO: 2619 - DNA, 1348 bp, Panax ginseng
tggtatcaacgcagagtacatggggacgccaatttgaaaccctagccacttctttttcctgttctgcgtggttgggagggcgtgaagagagagaaatggtgttctacttcaaaggccgacccgaagccagtgattacaccatcttcatgggtctcgacaagcacgagaacgaagaactcatcaaatatggctttcccgaagacatttggttccatgtggataaaatgtcttcagcccatgtttatgtgagattacacaagggtcagacagttgatgatatatctgaaggtctactggaagattgtgctcaactagtcaaagcaaattccatccaaggtaacaaggtgaacaatattgatgttgtttacactccttggcaaaatttgaagaagactgcttccatggatgttggccaagttggttttcacaatccaaaaatggttcgcactgtgagagtggagaaacggattaatgaggtagttaatagattaaacaagacaaaagtggaaaggacacctgatttgaaggctgagctggaggcagttaatgcagcagaacgagcacaaaggaaacagcagctgagagataaaaaacgacgagaggagatagagaggctggaaaaggagagacaagcagagttgaggagctacaagaatttgatggtagctgacaagatgacatctaataaagacatagctgcgacccagaagtccttgcaagaactagaagaggacttcatgtaaacacactaaaacttgaatatatcccaaatttataaccttgttgcaagatttgggaactgccaaaaagaaagaagggaaaggtagaggagggactaaagtataaatgggaaggattggttggggggtgagtttcttttttactagtaatatgttgtgtgatatgaaattgttttcgttaaacctcctcttaataagctcagacaccaatgtgcagtttgagagggagaggaggtttgtttgtatggacagtatgatgaggatgaggatgatgataaatgacttgaaatatttgtcggatactgcaaggtagattgttctataatatgatcttgcccttggttggtttgtttagttaaaaaaaaccaaaaaaccaaaaaaaccaaaaaaccaaaaaaaccaaaaaaccaaaaaacaaaaacaaaaacaaaaacaaaaaacaaaaacaaaacaaaaacaaaacaaaacaaaacaaaacaaaacaaaacaaacaaacgaaacaaacaacaagaacagacacagacaccacacacaccacaccccacacccccccccccccccccccccccccccccccccccccccccccccccccccccccccccccc

SEQ ID NO: 2620 - DNA, 816 bp, Bupleurum chinense
tctaatttgggggcgaagatggtgttttacttcaaagcccgacccgaagttggagattacaccatcttcatgggtctcgataagcacgaaaacgaagagctcatcaaatatggctttcccgaagacatctggttccatgtggataaaatgtcttcagcccatgtttatgtaagactacacaaaggtcagggaattgatgatatatctgaaggtctactggaagattgtgtacagttagtcaaagcaaattccatccaaggaaacaaggtgaacaatattgatgtggtttacactccatggcaaaacttgaagaagactgcatccatggatgttggacaagttggttttcacaattcaaaaatggttcgcactgtgagagtggagaagcgaattaatgaggttgtcaatagattgaacaagacaaaagttgaaaggacgcctgatttgaaagctgagcgcgaggcagttaatgcagcagaacgagcagaaaggaaacagcaactcagagataagaaacgaagggaggagatcgcgaggatggaaaaggagagacaagcagagcttaggagctacaagaatttgatggtagctgacaagatgacatctaacaaagagattgcttcgacccagaagtccttgcaagaattggaagaggatttcatgtaaacccaatgaacttggatatatcctatatttatggaagatgattttatgtaaacccaatgaacttgatatatctaataaatgacaaatgacattctaagtgtgttgattacttgtgttgtcagtttataattctatatcatgattggttcg

SEQ ID NO: 2621 - DNA, 914 bp, Manihot esculenta
agacagagattgtgaattttgatttcgcaaaaggagagaaagcgaacgagcgagagaggggggagagatagagaggaggtacagcaggagaagaagaaagaaagaaagaaataaagaaatatggtgttctatttcaaagcccgtccagaggtaggagattacaccatttttatgggtctcgacaagtacgagaacgaggagcttatcaaatacggtttccctgaagacatttggttccacgtggacaaaatgtcttctgctcatgtttatcttagactgcacaaaggacagacaattgatgatataagtgaaggtttactggaggattgtgctcagcttgtgaaagcaaattcaatccaaggcaaaatttctgaaaaaaatcttcacattgtgaataacattgatgttgtttacacgccctggtccaatttaaagaaaactgcttccatggatgttggccaagttggcttccacaatccaaagatggttcgaactgtgagagtcgagaagcggataaatgagatagttaatagactcaacagaacaaaggttgaaagaaggcctgatttgaaagctgagaaagaagcaatccatgcagcagaaagagcagagagaaagcttcaactaagggataaaaaacgaagagaggaagtggaaaggcttgaaaaagagagacaggcagaaataaggagctacaaaggtttgatggtttctgagaagatgacatctaacaagcagattgcagctgaaaacaagtcgttgcaggaactggaagaggacttcatgtaagcacaatggcatttaactgttatgtcaaacttgctgcctcttgaagaagtgggtttgtcattcagttgtaactctagacagaagttgtttcccctcctacaaataaatcatatcagcttcatgcc

SEQ ID NO: 2622 - DNA, 1167 bp, Nicotiana benthamiana
aattctgaaaatcaaaagaaacaaaaggaagagaaaattaactttgttactacgcgagaagtgcgggttcaatagtttggtggaggccatccaaaccgagtcagaaaaactatcaaatctgctgttaacgaattagggtttcgaaaaccctagctcttttttctttttttttttcggagaagacaagaaaaaatggtgttctacttcaaggcccgacccgaatccggtgactacaccatcttcatgggtcttgataagtacgaaaatgaagaacttatcaaatatggcttccctgaagacatctggttccatgtggataaaatgtcatcggcccatgtttacttgagattgaacaaaggtcagacgtttgatgatatacctgaaagtgtattggaagattgcgctcaacttgtcaaggctaattctatccaaggaaataaggtaaacaatgttgatgttgtttatactccatggcaaaaccttaagaagacggcttcgatggatgttgggcaagttagtttccacaacccaaaaatggttcgtactgtgaaggttgagaagcgaataaatgaaatagtcaatagattaaaccgtacaaaagtggagaggaagcccgatttaaaagctgagcgggaggccgtcaatgcagctgaaagggcagagaggaagcagcagcttagagagaaaaaacgacgagaggatatggacaggcttgaaaaggagagacaggccgagatgaggagctacaaaaatttgatggttgctgataagatgacgtctaacaaagatattgcatcaacaaacaaatccctgcaagagctggaggaagacttcatgtgaacgcaaaatcaaatggacttgttcctttcaatcgatgccttgtttagaaaaaattgctaaatgagaagctgcttaagattgcagagagagggtaggagaaaaaggaagaaggggatggggcatggggtgaggtaatattttatattgttgtgtgttctttagaaagagttgtgctccttattaaaagttgatcatattgatctttccaaggcctgaacttctttgttaataaggtataagagactatgggttggagttccatgagaagcttactttgtaaaaccaacgtcaaattttaacgatgatgaaaagaatgacttgatatga

SEQ ID NO: 2623 - DNA, 1179 bp, Phalaenopsis aphrodite
cgaccttttcgtttcgtgcgaggccgacttcctctcgttctcagctgcgtcatttccatctcatcctgatcgatttgtgttattcgatcgcgatttcgcgatcacgtcttttcttctccttccaggttcctcctggaaatctctgattgcgcttggggaagttcggatttctaagatctgattcaacaggaaagagatggttttatacttcaaggcccggccggaggttggggattacacgatctacatggggctggacaaacacgagaacgaggagctgatcaaatacggatttcccgaggacatatggtttcatgttgataagatgtcctcagctcatgtttacttaaggttgaacaaaagtcaaacaattgatgatattagtgaaggtttactggaagactgtgctcagcttgtcaaggccaattccattcaaggaaataaggctaataatgtagatgtcgtctatactccatggtataatttgaagaagactccttcaatggatgttgggcaggttgggtttcacaattctaaaatggtccgaaccgtgagagttgagaaacgtgtaaatgagattgtcaacaggctgaataagacaaaagtggagaggaatccagatctaaaagctgagcgtgaagctgtcaatgcagcagaaagagctgaaaagaagcagctgttaagagaaaagaagcgccgagaagaaatggaaaggcttgaaaaggagaggcagacagaactgaggagctacaaaggactcatggtttctgagaagatgacttccaacaagcaaattgcatccaccaataaatccctgcaagagcttgaagaagacttcatgtagcttcaccaaacttaagcatcaaatttacagcagggatgggatttcagtcgatcgcgcatgagcttcaactgattactggataaaaaaaaaaaaaaaattaccaatttgtgagtttctgttgatatgccctgaagtttgaattgtgttgtgaaacaatcaatggaatgaaagaaatggagctatcaacccataagattatattgttacttggcattggctagttgtgcttgttattgtaaaacttacattattcttggagaattagtgtgtttaagacttgagagttttataactcaatatgtgatgttttgctttaagaaaataaatgttaatca

SEQ ID NO: 2624 - DNA, 1006 bp, Lippia dulcis
agagagagagaggaaaaaatggtgttctacttcaaggcccggcccgaggcgggagactacaccatatacatgggcttggacaagtatgaaaacgaggagcttatcaaatacggcttccccgaagatgtctggtttcacgtggataaaatgtcgtcagcccacgtttatctgagattgcacaaggggcaaacctttgatgatatacctgaaggtgtattggaagactgtgtgcaactggttaaagcaaattccattcaaggaaataaagtaaataatatcgatgttgtttacacaccgtggcaaaaccttaagaagactgcttctatggatgtcgggcaagtcggtttccacaactcgaaaatggttcgtactgtgagagttgaaaagcgaattaacgaaatagttaaccggttaaacaaaacaaaagtggaaagaacgccagacctaaaagctgaacgagaggcagtaaatgcagctgaaagagctgagagaaaacagcagctgagagacaaaaaacgtcgtgaagagctagaaaggcttgaaaaagagagacaaactgagttaagaagctacaagaatttgatggtcacggagaagatgacatctaacaaggacattgcatcgggcaccaaatctgttcaggaacttgaagaagatttcatgtgaatcaaaaatacataaatttgtcaattttcagccatatatcagagtatatgaagattaagcaagcaaggtaggaaacgaagatacaacgaggcggggttgtgctggagaggtaactctgaatatgtatgttagtttcttcaaatcaacagccttgatgctctcgaaaattgtcataaagatctgcaatttgagaaaagatttgagcctgttgtacttaaatttgatgttgatgacgatgttgatgagagtcgctcttgagaagaatgaacttttaatggattataatgcgaattgttgtgctcgttttgtatattttttagaatgatatcacttctattgc

SEQ ID NO: 2625 - DNA, 709 bp, Platanus occidentalis
caaactgatcaaaccaaagaaactatttttctccctcagatcgttctctccaatcaaaaaaccatatttttctggtttcgggaggagaagaaacgatggttttctacttcaaagcccgaccagatgccggcgattacaccattttcatggggttggacaaggacgagaatgaagagctcatcaaatacggattccccgaagatatctggttccatgtggataaaatgtcttctgctcatgtttatctaagactgaacaagggtcaaactattgacgatataagtgaaggtttattggaagattgtgctcagcttgtcaaagctaattctatccaaggaaacaaggtgaataatattgatgttgtttacactccttggtacaatttgaagaagacagcttccatggatgttgggcaagttgggtttcacaatcctaagatggttaaaactgtgagagttgagaagcgcataaatgagattgttaatagattgaacaagacaaaagttgaaaggaagcctgacttgaaagctgagcgagaagctattaatgttgcagaaagagcggagagaaaacttcatctgagagataaaaaacggcgagaagagatggagaggcttgagaaggaaaaacaggcagagataaggagctacaagggcctgctagtctcagaaaagatgacctctaacaaacagattgcagcaacaagtaa

SEQ ID NO: 2626 - DNA, 1181 bp, Lupinus angustifolius
aagaagattcagagaatcgaatattattgaaatggtaagagagagagagagagagagagaaccctagcgaacactgtttgattcgataattcaattgattgaagagaagatggtgttctacttcaaagcacgctctgaagctggcgattacaccatcttcatgggccttgacaagcacgagaacgaagaactcatcagatacgcttttcctgaagatatttggtttcatgtcgataagatgtcttcagcccatgtttatgtcagactgcataaaggtcagaccattgatgacataagtgaaggtttactggaagactgtgttcagcttgtcaaagcaaattcaattcaaggaaataaggtgaacaatattgatgttgtttacactccctggtctaatttgaagaaaactccttcaatggatgttggtcaagttggttttcacaactcaaaaatggttcgaactgtgagggtggaaaagcggctcaatgagattgttaacaggctaaacaagactaaagtggaaagaaaacccgatttgaaagctgagcgggaagcagttaatgcaactgaaagaactgagaagaagctacacctgagagagaaaaaacgccgtgaggatttggaagtacttgaaaaggagaaacaagcagagatgaggagctacaagggtttgatggtctcagaaaatatgatatccaataaacaaattgcatcaggaagcaaatcactgcaagaactagaggaggatttcatgtaagcattgacatttaatgccgagaagatagctgggtggccaactcgctacctagcagacttacattgattacataacccagctcctggaatttgaaactgcaatgttttcattaagaaaaccaagtagtgtgtataagacaacagtttttaaacctgattggttgctcttatggtattaggttcttaataagaaaactattttatcatataattctttcctaacaatgcaggatctgtttcattttttcatagttgcaaatgatctcatttatttgattcctttagtgcatgatctgctgttagtttgagattgctttgtataactattatggactaatataaatcgaggaagatattggaaatataatatcattccatcttcctattatgaaatggtattttttcctaaaacaaaaaaaaaaaaa

SEQ ID NO: 2627 - DNA, 1442 bp, Cephalotaxus harringtonia
attccctcggaatcgagcaggttggaataaggcgtaggtgtattagtttccgaagaccttcgagcgagagaggacctggacctcttatccggatagagctttatgaatcagaatattttttgaggccaaatccctatcaacccacaaattgtttaggccaggatccgcttgttggcatccaattctcttctgggtgttctataaataccagggaaggggaaccatttgggtgcaagcaagtttttgaatacatttgtagtgggtttttttcttccgcagaatcaatcaagatggtgttttacttcaaggccaggccagaggcaggggactacaccatttacatgggtctcgacaagcacgaaaatgaagaacttatcaaatatggcattcctgaggacatctggttccatgtggataagttgtcttcagcacacgtatatttgagaatgcgaaagggtcagacaatagatgatattacagaaccactcttggaagattgtgcacaactagtgaaggcaaactctattcaaggaaataaagtcaacaatcttgatgttgtgtacactccttggtccaatttacgaaaaactgcatccatggatgttgggcaagttggtttccataaccagaagaatgttagaactgtcagagtcgagaagcgaatcaacgaagttgtaaatcgcctgaataaaacaaaagttgaacggaagcctgacttaaaagctgaacgagaagctatgaatgctgcagaaagagcagaaagaaaagttcatctcagggaaaagaaacggcgtgaggagttggagcgtcttgaaaaagagaagcaggcagaagtaagaagctataaaggtcttatggttgcagagaaaatgacttccaataaagatattgcatcaggaagtaagtcccttcaggaattggaagaagatttcatgtgatggtgccaaggaaggagcatatatagtaatgtatggctgagtttatattattttgtccattgttctgaaacgttgtctcgatgtaaggaacatctgaggtagttcatgtccggttttgttgtcatccacaagtgtattcaagtcattggagcttgttgcaggttcctcagcaaatagatgaatgtagctaaaacctatttcccagtgtcattgctactggttgcaaattcttaagcaaatagatgctgacagtggttgtaggttacggatgttctaggaaaacttgcaatgagagggttcttctaggtctgttggaatgtgctttaatatctctactttattattaatcttatcggttctttatcaaaatactcttgtagggctttctggacaagaaacagtgatttctttgcttcactggcattccttgtcattcccctttattgacgttgggcctacttttcttaagtgtctgccttgttattcaactgatatgcattaaga

SEQ ID NO: 2628 - DNA, 1205 bp, Curcuma longa
gcacgaggtctcgtgccgaattcggcacgaggccaattcctcctcatccccgagactccacgaaaccctatccctgactgattgcgttgccctggtccacccttggtcgaattcgattcgcctacacggccccggaggtaaagacgatcgggagctagaggcaaagatggttttctacttcaaggcccggccggatgtgggcgactacaccatcttcatgggattggacaagcacgagaacgaggagctcatcaagtacgggttccccgaagatatatggtttcacgtggacaaaatgtcttctgcacatgtttatttgagattgaacaaggcccaaactattgatgatataagtgaaggtttgttggaagactgtatccagcttgttaaagctaattcaatccaaggcaataagatgaataatgtcgatgttgtttatactccatggtataatttgaagaaaaccccttccatggatgttggtcaagttggttttcacaatcctaagatggttaagacggtgagggtagaaaaacgcatgaatgagattgtcaataggttgaacaagaccaaggtggaaaggacgccagatttgaaagctgagagagaatctgtcaatgcagcagaaagagcagaaaggaaggcccagtcaagggacaaaaaaaagagggaagaattggagaggcttgagaaggagaaacaagctgaggtaaggagctacaagagtctaatggtctccgagaagatgacatccaacaagcagattgcatctgctaataaatccttggaagaactcgaagacgacttcatgtgagcatttgagagtcaattgattggttgctagagaagttgttgaagctttcaaagatccattctatcgcgatgatgaaatttgtgattccaatctactccaagaccttcattcgcactgatcattcatcaagcctttaactgtaccctctggtctcacggaatgtgaacaaaagttgaactatttatcagttctcctgtctctgtttatcctgattgcggcatgtagccattagagtttgcaaaagtatcatgcactgtacttatttttctactgagctgtcctatatcattctcttttatgtcgggagaaactatgcttcatactcgaaatcgagctatgtcgtttcattctgcccgatcaatggcaaagcaatccctattgatacatcagt

SEQ ID NO: 2629 - DNA, 1037 bp, Euphorbia peplus
acgacgctcgctcatagttcatccccaattcacaaaattaaacgaaaccctaatctccctcattctaaattctgcgcgatcgagaaaaaccagagaaagcagagcagaagaagaagaacaagtatttaaaaatggttttttacttcaaagcccgacctgaagttggagattacaccatctttatgggtctcgataagttcgagaacgaagagctcatcaaatatggcttccccgaagacatatggttccatgtggacaaaatgtcttccgctcatgtttatcttagactgaacaaaggccaaacaattgatgatattagtgaaagtttactagaggattgtgctcagcttgttaaagcaaattcaatcacaggcaacaaggtgaataacattgatgttgtttatacaccgtggaacaatttaaagaaaactgcttccatggatgttggccaagttggcttctacaatccgaagatggttcgaacagtcagggtggagaagcggcttaatgatgtagttaacaggttgaacagaacaaaagttgaaagaaagcctgatctgaaagctgaaaaagaagctgtacatgcagcagaaagagcagagagaaagcttctgctgagagacaagaagagacgagaggacatggaaagaatggaaaaggaaagacaagcagagataagaagctacaaaggtttaatggtgtctgaaaagatgacatccaacaaggatattgcatctggaacaaagtccttgcaggaactggaagatgactttatgtaagcgcgatcatatatttcaatattcggtttctcttcggtttgtgaccgaagttgtttctcctcggttcctacaaataaagcaatgttaaaggggttgatttatgcatttgcttttgtgaaggaaatatgtggtgccattgtggggggaattgtttccttttactctggccttagagttgtaattcgatgattatgatgactgccaattgattatgatgaaaaattctagattgatctccgactaattttcttgtatgaa

SEQ ID NO: 2630 - DNA, 1166 bp, Nicotiana benthamiana
tctgaaaatcaaaagaaacaaaaggaagagaaaattagctttgttagtacgcgagaagtgcgggttcaaaagtttggtggaggccagaaaaactcatcaaatctgctgttaacgaattagggcttcgaaaaccctagctcttttacctttctttcggagaaagacaagaaaaaaatggtgttctacttcaaggcccgatcagaatccggtgactacaccatctttatgggtcttgataagtacgaaaatgaagaactcatcaaatatggcttccctgaagacatctggttccatgtggataaaatgtcatcagcccatgtttacttgagattgaacaaaggtcagacgtttgatgatatacctgaaggtgtattggaagattgcgctcaacttgtcaaggctaattctatccaaggaaataaggtaaacaatgttgatattgtttatactccatggcaaaaccttaagaaaacggcttcgatggatgttgggcaagttagtttccacaacccaaaaatggttcgtaccgtgaaggttgagaagcgaataaatgaaatagtcaatagattaaaccgtacaaaagtggagaagaagcctgatttaaaagctgagcgggaggccgtcaatgcagctgaaagggcagagaggaagcagcagcttagagagaaaaaacgacgagaggagatggacaggcttgaaaaggagagacaggctgagatgaggagctacaaaaatttgatggttgccgataagatgacatcaaacaaagatattgcatcaacaaacaaatccctgcaagagctggaggaagacttcatgtgaatgcaaaatcaagtggacttattcgtttcaatctatgccttgtttagaaaaaattgctaaatgagaagctgcttatgaatgcagagaaagggtaggagaaaaaggaaggaggggatggggcatggggtgaggtaatcttttatgttgttgtgtgttctttagaaagagttaagctccttattaaaagttgatcatattgatctttgcaaggcctgaacctctttgttaataaggtataggaaactatgggttggagttccatgagaagcttactttgtaaagccaatgtcaaattttaatgatgaagaaaaagatgacttgttatgatgaggagctttttgttt

SEQ ID NO: 2631 - DNA, 1099 bp, Capsicum annuum
tcagcatagtagtgatgtaaagaaagggaagaaagattagcttggttgcacgcgacaagtgcggtttgaatagggctatccgagtcgaatctaattagggctttgaaaccctaaaaagagagctcgacctcggtagttttccttttccatcgtcgaagagcaatggtgttctacttcaaggctcggccagaagcgggtgactacaccatatttatgggtcttgataagtatgagaacgaagaactcatcaaatatggcttccctgaagacatctggttccatgtggataaaatgtcatcagcccatgtttatttgagattgaacaagggtcaaacatttgatgatatacctgaaggtgtattggaagattgtgctcaacttgtcaaggcaaattctatccaaggaaacaaggtaaacaatgtcgatattgtttatactccctggcaaaaccttaagaagactgcttcaatggatgttgggcaagttagtttccacaacccaaaaatggttcgtactgtgagggttgagaagcgaataaatgagatagtcaatagattaaaccgtacaaaggtggaaaggaagcccgacttaaaagctgagcgggaggccgtcaatgcagctgaaagggcagaaaggaagcagcagcttagagaaaaaaaacgacgagaggatatggataggcttgaaaaggaaagacaggccgaaatgaggagctacaaaaatttgatggttgctgataagatgacatctaacaaagatgttgcatcagctaacaagtccctgcaagagctggaggaagacttcatgtgaatgcaaaatcaactggatttaattgtttcaattgctgtcttgtttagaagatactaaatgagaagctgctcaagaacacagagaaaaaggaagaacggggcaggggcatgggggtgaggtggtcttttatattgtgtttcttgaaacagttatggtccttgttaaaacatgatcatattgatctttgtaggcctgaacctgtttgttaataagcggtataggagaatagtgtttgagatctgaaggagcttattttgtaaaaccgtgttaaatttaatgatgataactt

SEQ ID NO: 2632 - DNA, 1092 bp, Rosa hybrid cultivar
aaagcttgaaggtggaacgaagccctagctcctcgcagcgctctctgtggttgcgtcggtttccaaagccccaaagcgaacaagaagaagaagatggtgttctacttcaaagcccgccccgaggtcggcgatttcaccatcttcatgggcctcgacaagttcgagaacgaggagctcatcaaatatggcttccccgaagacatttggttccatgtggataaaatgtcgtcggcccatgtttatgttagactgcacaaaggacagaccattgatgatataagtgaaggtttactggaggattgcgttcagcttgtcaaagcaaattccatccaaggcaacaaggtgaacaatatcgatgtggtttatactccttggtccaatttgaagaagactgcgtccatggatgttggtcaagttggtttctacagttcaaagatggtccgaactgtgagagtggagaagaggattaatgagattgttaatagactgaacaggacaaaagtggaaaggaaacctgatttaaaagctgagcgagaagctgttaactccgcagaaagagatgagagaaagcggtttctgagggagaagaaacggcgtgaggagttggaaaggcttgaaaaggagaaacaagcagagctgaggagctataaaggcctgatggttcatgaaaatatgacatccaacaaacaaattgcatccgcaaacaagtcattgcaggaattggaagaggactttatgtaatcatagcattgtctgtgttgggcaagaggttgctacctctgctgccgcccatggagaatacagtttatcattgagtttgtgagttgtcctcacagttctcttcttgagtaaaatatgtcgtaaaccttttatttctgttggtattgataagaaaaagagaaaatagaaaaaaccaaggagaaaaaaattgttttatgggttagtgttggttagggtgaaatctctttcttgtcaccgcatgttgtatgtggatcatgatgataatgatacacaaaattaaaacatcaccctggataatgggagatacatttgttgttttgctgtcaaatttacttgcaaaaggctttgaat

SEQ ID NO: 2633 - DNA, 730 bp, Euphorbia esula
  misc_feature (10)..(12): n is a, c, g, or t
  misc_feature (624)..(626): n is a, c, g, or t
gtgaaaactnnnagaaagcagagcagaagacgaagaacaagtatataaaatggttttctacttcaaagcccgacccgaagttggagattacaccatctttatgggtctcgacaagttcgagaacgaggagctcatcaaatatggtttccccgaagacatatggttccatgtggacaaaatgtcttctgctcatgtttatcttagactgaacaaaggccaaacaattgatgatattagtgaaggtttactagaggattgtgctcagcttgtcaaagcaaattcaatccaagggaacaaggtgaataacattgatgtggtttatacaccgtggaacaatttaaagaaaactgcttccatggatgttggccaagttggcttctacaatccaaagatggttcgaacagtcagagtggagaaacggcttaatgatgtagttaacaggttgaaccgaacaaaagttgaaagaaagcctgatctgaaagctgaaaaagaagctgtacatgcagcagaaagagcagagagaaagcttcttcttagagacaagaagagaagagaggacatggaaaggatggaaaaggagagacaagcagagataagaagctacaaaggtttgatggtgtctgnnnagatgacatccaacaaggacattgcatctggaactaagtccttgcaggaactcgaagatgactttatgtaagctccatcatatgttttaaatgttcggtttctc

SEQ ID NO: 2634 - DNA, 1245 bp, Fragaria vesca
aatcaataattcgtaacaataaaaaatggaaaagaaatcgtgttcccaaattcccgattggaaagcttgaaggtggaacgaagccctagctcctcacaggcgctctctctgtggttgcgtcggtttccaaagccctcaaagcgaaccagaagaagaagatggtgttctacttcaaagcccgccccgaggtcggcgatttcaccatcttcatgggcctcgacaagttcgagaacgaggagctcatcaaatacggcttccccgaagacatttggtttcatgtggacaaaatgtcgtcggcccatgtttatgttaggctgcacaaagggcagaccattgatgatataagtgaaggtttactggaggattgcgtgcagcttgtcaaagcaaattccatccaaggtaacaaggtgaataatattgatgttgtttacactccttggtccaacttgaagaagactgcatccatggatgttggtcaagttggtttctacagttcaaagatggttcggactgtgagagtggagaagaggattaatgagatcgttaatagactgaacaggacaaaagtggaaaggaaacccgatttaaaagctgagagagaagcggttaactctgcagaaagagatgagagaaagcggtttctgagagagaagaaacgtcgtgaggagttggaaaggcttgaaaaggaaaaacaagcagagctgaggagctataaaggcttgatggttcatgaaaatatgacatccaacaaacaaattgcatctgcaaacaagtcattgcaggaattggaagaggactttatgtaagcatggcattgtttatgtgctgggccagaggtacctacctgccgccgccccttggagaatatggtttatcattgagttcgtgagttagtcctcacagttacttcccttctcaagtataatatgtcgtaaaccttttatttctattagtattgataagaaaaagagaagatgcaaaaattgagggaggaaaaactgttttatgggttagtgtctgttggggtgaaatgtctttcttgtcgctgcatgttgtacgtggatcatgatgatgatgatacacagtaaaacaccaccctgtataaggggagatacatttgttgttttgtccatcaaattcacttgcaaaagtatttgattatgttttaacacccttggttatataatacacagctgcaagctttttcttaaatggtacatatatggagatgatcagttaaaagtc

SEQ ID NO: 2635 - DNA, 1125 bp, Lippia dulcis
aacttcgtattactgttcttgtggaattgtcattggaagttggaaccctagatagagaaagaggaagggaaaaaagatggtgttctacttcaaggcgcgaccggaggccgcagattacaccatattcatggggcttgacaagtacgagaacgaggagctcatcaaatacggcttccccgaagatatttggtttcatgttgataaaatgtcttctgcccatgtttatctgagattgcagaaaggtcaaaccatagatgatatacctgaaggggtattggaagattgtgctcaactagttaaagcaaattctatccaaggaaataaagtgaacaatgtcgatgttgtttacactccttggcaaaatcttaagaagactgcttccatggatgttggtcaagttggtttccatagttcaaaagcggtccgtactattagagtggaaaagcgaattaatgagatagttaaccggttgaacaggacaaaagtggaaaggacgccggatctaaaagctgaacgggaggcagttaatgctgctgaaagagcagagaggaagcaacagctccgtagaaaaaaaacgacgagaagatttagaaaggctggagaaagagaggcaagctgagttaaggagctacaaacatttgatggtagctgagaagatgacctcaaacaaggacatagcatctaccaataagtcccttcaagaacttgaggaagatttcatgtgagtcccaaatgcttcaactaattttcaagattcagctgttaatccacaatataacacattgacagttatgcccgtaagggtaaaactagaagaaatatcaagagaaagagagagagagttctgtggttggacagggagcagagattgattttttcttgtgccgtttactttggcataaacatgcaccgtagtgaaattaaaggtcttgaaacgctcaatctgtgttcaaagatctacagcccgagagaggaaattaggacaaaaatcaattttattggagttgaactgtgatgtaacattgttatagatacatttaatggatgttccacctaagccagggtgatttttgcttgattacaattcatagcttcgactgccggtggcttctgcttaaaaaagaa

SEQ ID NO: 2636 - DNA, 989 bp, Antirrhinum majus
  misc_feature (28)..(28): n is a, c, g, or t
  misc_feature (95)..(95): n is a, c, g, or t
  misc_feature (98)..(98): n is a, c, g, or t
  misc_feature (467)..(467): n is a, c, g, or t
tcaaaatcagaaaccctagagagagaangtgtgtgaaaatggtgttctacttcaaggcgcgacctgaggccggggattacaccattttcatgggnctngataagtacgagaacgaagagctcatcaaatatggattcgtcgaagacatttggttccatgtggataaaatgtcttcagcccatgtttatcttagattgcacaagggtcaaaccattgataatataccagaagatgtattggaagattgtgcccaactggttaaggcaaattctatccaagggaacaaagtaaacaacgttgatgttgtttacaccccctggcaaaatcttaagaaaactgcttccatggatgttggacaagttggtttttataattcgaaaatggttcgcactgtaagggtggagaagcggataaatgagataattaatcggctaaacaagacaaaggttgaaagaacaccagatctnaaagctgaacgtgaggcagttaatgcagctgaaagagcagagaggaagcagctgctgagagacaaaaaacggcgcgaagagttggacaggcttgagaaagagaaacaggctgatttaaggagctacaagaatctgatggtagctgagaagatgacctctaacaaggacatagcatctactaacaagtcccttcaagaacttgaggaagattttatgtgaacttaaaatacttaaaaccaattcttgtcatcgtttgcccattaatctggaatatgagacgtgtgcccctatatggaaaaggaggacatgaaggaagagatcaagatagagaaagacattgatcgagtggttcataatttagtgggtgggcgtttatgttcttgaatctgtcaaattgtgttaataaattctcaggatcaaagatctgcagtttgagagtgagggtactgacagtactagaattggattacaatgaaaattgttttgttgtaattgtgttactaatataattatcgttggtat

SEQ ID NO: 2637 - DNA, 644 bp, Aquilegia formosa
atggttttctacttcaaagcacgacctgaagttggagattatacaattttcatgggaatagataagcatgagaacgaagatcttatcaaatatggttttcctgaagatatctggttccatgtggacaaaatgtcctccgcccatgtttatgttaggctaaacaagggccaggcaatcgacaatataagtgagggtttactggaggattgtgctcagctttacctggcaggcaacaaggtgaataatgttgacgttgtctataccccttggtataatttgaagaagactgcttcaatggatgttgggcaagttggttttcacaactctaagatggtccgcactgtcagagttgagaaacgcataaatgagatagtcaatagattgaacaagaccaaggtggaaaggaagcctgatttgaaagctgagcgagaggcagttaatgcggcagagagagcagagaaaaagctcctgatgagagataaaaaacggcgtgaggagatggagaggcttgaaagggagaggcaggcagagataagaagctacaagggcctgatggttgcagaaaagatgacatctaacaaacaggttgcatcagcaaacaagtcgttgcaggaactggaagatgatttcatgtgaggccagct

SEQ ID NO: 2638 - DNA, 1021 bp, Cucurbita pepo
aaatcgcacacagaagaccaatctctctctattccccgaattgaaaaccctaattcgttcttttctctccatttcgttcttgcgagcgtcgagcataacgaaatcgaagcgccatggttttctatttcaaagctcggtccgacgtcggcgattacaccattttcatggggctcgataagcacgagaacgaggagctcatcaaatacggcttccccgaggatatctggttccacgtggacaagatgtcgtctgcccatgtttatgtgagactgcgaagagggcagaccattgatgatataagtgaagggttgctggaggattgtgttcagcttgtcaaagcaaattctattcaaggaaacaaggtaaacaacattgatgtcgtgtatacgccttgggctaatttgaagaaaactgcttccatggatgttggccaagttggttttcataaccccaagatggtccgaactgtaagggtggaaaaacggatcaatgacattgtcaatagattgaacaggactaaagtggaaaggaagcctgatttgaaagctgaacgcgaagctgtgaatgcagctgaaagagcagagaggaagcaacacctgagagaaaagaaacgccgcgaggaaatggacaggttagaaaaagagaggcaagctgagctaaggagctacagtggtttgatggtctctgagaagatgacatctaacaaacaaattgcagcggcaaacaaatcgctacaagagctggaggacgatttcatgtgatcgaattgatcagtacaaatgctgcaaaaaatagcagcagctaaacttactcttcttagatcatttgcccattgagtttatggttcttggctcaaagttgtcctctcacgagttatcaaatcgtctttagcctcgatgatattcaacttggcgtctacttgatgactatacaaatagaaatcgagagcggaaaatggtcttctttaagttgtaattactgtcacactcttgtttacgagacgataagttggctcgtttcg

SEQ ID NO: 2639 - DNA, 1447 bp, Eucalyptus grandis
aagagaaagagaggtaagagggagtggtcagaatccccagcgactcccacctccgccttccttcctacgctaacctgctgactctctctctctacccctctctctctctactccgctctctctctctctctctctctacccgcctcctcctccgcggaaaaccctaggcgatcggacggcgatggtgttctacttcaaggcccgtccggaggcgggggactacaccatcttcatgggcctcgacaagtacgagaacgaggagctcatcaagtacggcttccccgaggacatctggttccatgttgacaaaatgtcctcagctcatgtatatctgagaatgcacaaatgtcagacaattgatgatattagtgaaggtgtgctggaggactgcgctcagcttgtcaaagcaaattctatccaaggcaacaaggtgaacaatgtcgatgtcgtttatactccttgggcaaatctgaagaaaacagcatccatggatgttggtcaagttggtttccacagttcaaaaatggttcgcactgtgagagttgagaaacggcttaatgacgttgtcaatagactgaatcggacaaaagtggaaaggaaacctgacttaaaagctgagcgtgaggcagtcaatgcagctgaaagagcggaaagaaagctacagctaagagataaaaaacgacgggaggaaatggataggatggaaaaagagaggcaggcagaactaaggagctacaagggtttgatggttgctgaaaatatgacatctaataagcaaattgcctctgcaagcaagtctttacaggaactggaggacgacttcatgtgagaatgttttactgcattgtggtcagctgttgtttgctctcaacaagggaatttagtcgttcagctatgatcctaggccagaaggagtctttcttcaaagatgaatgatctccatcctttaaccattcatttccctaccatatggaactagctactgtggatgatagtaaaatgctgggtgcactcgggacagagaggaagtgtttggattcagaaaggcttaagtgattttatgagatgtgtcctatggagattctaacagatacaactttgtcgatcttttgtggattgaatatttaagttgtagaacttgatgagacatcatcttgtgctgtgtcgtcctgcaagttgtatggaaagagtctttgttgaatcgtaattttttcatattcttcttttagtccttaaactgtcttatatcagctgtaggtgttacaagcttgcaatttgtaggcaccttctgccccctgttatttgattttattggttgtcacgttagtgctgtttctagagttggccatactagtttggtgtttgtttttgggtttgcggcagtgtttttcttggttacatccgttttactgtcagtacaccacagaatccgttatgtgttggtttg

SEQ ID NO: 2640 - DNA, 1189 bp, Solanum phureja
ccaaattgggaaaatctaaagaaaggtaaggaagatttagctttgtttgtacgcgaaaagtgcggtttcaatagtttgcctatatccacctgcctatctgactcaggaaaaactcgtcgaatctgctataacaaattagggcttcgaaaaccctaaaacagagagctcgttttttcctttccaatcggagaagagaaaaatggtgttctacttcaaggctcgaccggaagccggtgactacaccatctttatgggtcttgataagtatgagaatgaagaactcatcaaatttggcttccctgaagacatctggttccatgtggataaaatgtcatcagcccatgtttatttgagattgaacaagggtcaaacatttgatgatatacctgaaggtgtattggaagattgtgctcaacttgtcaaggcgaattctatccaaggaaataaggtaaacaatgtcgatgttgtttatactccatggcaaaaccttaagaagactgcctcaatggatgttgggcaagttagtttccacaacccaaaaatggttcgtaccgtgagggttgagaagcgaataaatgagatagtgaatagattaaaccgtacaaaggtggaaaggaagcctgacttgaaagctgagcgggaggccgtcaatgcagctgaaagggcggagaggaagcagcagcttagagagaagaaacgacgagaggatatggataggcttgaaaaggaaagacaggctgaaatgaggagctacaaaaatttgatggttgctgataagatgacatctaacaaagacgttgcgtcagcgaacaagtccctgcaagagatggaggaagacttcatgtgaatgcaaaatcaaatggatttaattgtttcaatcgctgccttcgtttacaaaatactaaatgagaagctgcttaagaagaatgcagagaagaaaaaggaagaatagggggctggggcgtgggggggtgaggtgatcttttgaaatgttgtgtgttcttttgaaacaattatggtccttattcaaacatgatcaaattgatctttgtaggcccgaacctgtttgttaataaggggtatatgagcatatgggttggagttcaagcagaagcttacttgtaaaaccagtgttttgattttaatggtgaagatgacttgttatgattaggaggagcacttgattgtt

SEQ ID NO: 2641 - DNA, 1298 bp, Solanum lycopersicum
attgacaagtttgcggaaatattatgttttcctttttttattttattttatgggtgaaaattttttaaaataatcgtagaacaactttttttttttctttcaaaatctaatcaatgtccaaatttgtaaggaagatttagctttgtttgtacgcgaaaagtgcggtttcaatagtttgcaggctaccgctatatccacctgcctatctgactcgggaaaaactcgtcgaatctgctttaacaaattagggcttcgaaaaccctaaaacagagagctcgttttttcctttttcaatcggagaagagaaaaatggtgttctacttcaaggctcgaccggaaactggtgactacaccatctttatgggtctggataaatatgagaatgaagaactcatcaaatttggcttccctgaagacatttggttccatgtggataaaatgtcatcagcccatgtttatttgagattgaacaagggtcaaacatttgatgatatacctgaaggtgtattggaagattgtgctcaacttgtcaaggcgaattctatccaaggaaacaaggtaaacaatgtcgatgttgtttatactccatggcaaaaccttaagaagactgcctcaatggatgttgggcaagttagcttccacaacccaaaaatggttcgtaccgtgagggttgagaagcgaataaatgagatagtcaatagattaaaccgtacaaaggtggaaaggaagcccgacttgaaagctgagcgggaggccgtcaatgcagctgaaagggcggagaggaagcagcagcttagggagaagaaacgaagagaggatatggataggcttgaaaaggaaagacaggctgaaatgaggagctacaaaaatttgatggttgctgataagatgacatctaacaaagacattgcgtcagctaacaagtccctgcaagagatggaggaagacttcatgtgaatgcaaaatcaaatggatttaattgtttcaatcgctgtcatgtttacagaatactgaatgagaagctgcttaagaagaatgcagagaagaaaaaggaagatagggggctggggcatcggggtgaggtgatcttttgaaatgttgtgtgttcttttgaaacaattatgatccttattgaacatgatcaaattgatctttgtaggcctgaacctgtttgttaataaggggggtataggagccatatgggttggagttcaaggagaagcttacttgtaaaaccagtgtttttgaatttaatggtgaagatgacttgttatgattaggaggagcacttaattgtt

SEQ ID NO: 2642 - DNA, 1176 bp, Solanum lycopersicum
caaatttgtaaggaagatttagctttgtttgtacgcgaaaagtgcggtttcaatagtttgcaggctaccgctatatccacctgcctatctgactcaggaaaaactcgtcgaatctgctttaacaaattagggcttcgaaaaccctaaaacagagagctcgttttttccttttcaatcggagaagagaaaaatggtgttctacttcaaggctcgaccggaaactggtgactacaccatctttatgggtctggataagtatgagaatgaagaactcatcaaatttggcttccctgaagacatttggttccatgtggataaaatgtcatcagcccatgtttatttgagattgaacaagggtcaaacatttgatgatatacctgaaggtgtattggaagattgtgctcaacttgtcaaggcgaattctatccaaggaaacaaggtaaacaatgtcgatgttgtttatactccatggcaaaaccttaagaagactgcctcaatggatgttgggcaagttagcttccacaacccaaaaatggttcgtaccgtgagggttgagaagcgaataaatgagatagtcaatagattaaaccgtacaaaggtggaaaggaagcccgacttgaaagctgagcgggaggccgtcaatgcagctgaaagggcggagaggaagcagcagcttagggagaagaaacgaagagaggatatggataggcttgaaaaggaaagacaggctgaaatgaggagctacaaaaatttgatggttgctgataagatgacatctaacaaagacattgcgtcagctaacaagtccctgcaagagatggaggaagacttcatgtgaatgcaaaatcaaatggatttaattgtttcaatcgctgccatgtttacaaaatactgaatgagaagctgcttaagaagaatgcagagaagaaaaaggaagatagggggctggggcatcggggtgaggtgatcttttgaaatgttgtgtgttcttttgaaacaattatgatccttattgaacatgatcaaattgatctttgtaggcctgaacctgtttgttaataaggggggtataggagccatatgggttggagttcaaggagaagcttacttgtaaaaccagtgtttttgaatttaatggtgaagatgacttgttatgattaggaggagcacttaatt

SEQ ID NO: 2643 - DNA, 1103 bp, Triphysaria pusilla
agagaataggtttcatattattctctctcaatcggaaattcagggaggaaaaggacgaaaatcgaaaccctagagatagaaagagaaagaaggtagagagagagaggatggttttctacttcaaggcccgacctgatgccggtgattacaccatttacatgggcctcgacaagcatgagaacgaggagctaatcagatacggctttcccgaagatatttggttccatgtggataaaatgtcatcagctcacgtttatgtgagattgcacaagggccaaactattgatgatatatccgaaggcttactggaagattgtgttcagctagttaaagcaaattctatccaaggaaataaagttaacaatattgacgttgtgtacaccccttggcaaaatcttaagaagaccgcatccatggatgttggccaagttggtttccataattcaaaaatggttcgtactgtgagggtggaaaagcgagtaaatgagatagttaaccggttgaacaagacaaaggttgaaagaacgcctgatttgaaagccgaacgggaggcagttaatgctgccgaaagagcacagaggaaacagctgctccgtgataaaaaacgacgtgaagagttagatcgactcgaaaaagagagacaggctgaagtaaggagctacaaaaatttgatggtagctgagaaaatgacatctaataaggacatagcatctgccaacaagtccctgcaagaactcgaagaggatttcatgtgagtccaaagaatgcttcgaaaatttgtcaaagttcagctgttattaggggaatatatgagataatattctcttaaggggaaaaccataaacgagagattggtagaggagttggtgctgtcggctgggatggaacatgatttcttattgtatttttgttatgttgtggttttttcatttaaacataattatgcacctttgtgtaattgtttctcaaataaaattttggggaatgggactaccttatttgtattgaactccgatgatgacgacaatgtcggttagagatttatgtgatcgatcttaaatgtttgcttcttgatattcattctgactgtggggtgattatgt

SEQ ID NO: 2644 - DNA, 1047 bp, Triphysaria pusilla
tctctcaatcggaaattcagggaggaaaaggacgaaaatcgaaaccctagagatagaaagagaaagaaggtagagagagaggatggttttctacttcaaggcccgacctgatgccggtgattacaccatttacatgggcctcgacaagcatgagaacgaggagctaatcagatacggctttcccgaagatatttggttccatgtggataaaatgtcatcagctcacgtttatgtgagattgcacaagggccaaactattgatgatatatccgaaggcttactggaagattgtgttcagctagttaaagcaaattctatccaaggaaataaagttaacaatattgacgttgtgtacaccccttggcaaaatcttaagaagaccgcatccatggatgttggccaagttggtttccataattcaaaaatggttcgtactgtgagggtggaaaagcgagtaaatgagatagttaaccggttgaacaagacaaaggttgaaagaacgcctgatttgaaagccgaacgggaggcagttaatgctgccgaaagagcacagaggaaacagctgctccgtgataaaaaacgacgtgaagagttagatcgactcgaaaaagagagacaggctgaagtaaggagctacaaaaatttgatggtagctgagaaaatgacatctaataaggacatagcatctgccaacaagtccctgcaagaactcgaagaggatttcatgtgagtccaaagaatgcttcgaaaatttgtcaaagttcagctgttattaggggaatatatgagataatattctctaaggggaaaaccataaacgagagattggtagaggagttggtgctgtcggctgggatggaacatgatttcttattgtatttttgttatgttgtggttttttcatttaaacataattatgcacctttgtgtaattgtttctcaaataaaattttggggaatgggactaccttatttgtattgaactccgatgatgacgacaatgtcggttagagatttatgtgatcgatcttaaatgtttgcttcttg

SEQ ID NO: 2645 - DNA, 1011 bp, Eutrema parvulum
ttttttgcgtttttatattgtctcgagtggttacgatttcttcattggcgtaacatctagggaagagaggggagatagggaagtgagagggggaaaccctagattcgatttggttcgtttctcgaatcgaagcgatggtgttctacttcaaggcccgaccagatgctggcgactacaccatcttcatggggcttgataagttcgagaacgaggaactcatcaagtacggcttccccgaagacgtctggtttcacgttgataaaatgtcgtcagctcatgtttacttgaggcttcacaaaggccaaagttttgatgacattagtgaaggtgtgctggaggattgtgctcagcttgtgaaagctaactccattcaaggcaacaaggtgaacaatgttgatgttgtgtacactccatggtgcaacttgaagaaaaccgcctccatggatgttggtcaagttggtttccacaattcaaagatggtccggaccatcagagtggagaagcgagtcaatgaaatagtcaacagattgaacaaaacaaaagtcgaaagaacacctgatctgagagccgagagagaagcagtgaatgctgcagaaagagcagagaggaaacaacatctgagggagaagaagaaacgtgaggagatagagaggcttgagaaagagaggcaagcagagatgaggagttacaagggattaatggtaactgataaaatgacatccaacaaagacattgcttcaagcaacaaatcgcttcaggaactcgaagacgatttcatgtaagagcccagtaacattctgccagaagtggttatctggtgctgtccttcaaagaaggcttatcatgttctgttagccctagattataatgatgatgaattgcccggtttcatcttttttttttttcaaatgtctttgaagacttaaaccctaatttggttcttagactctttcgtccattgaaatgtttcagaggattgaatctgagttgtgagaaaaacagagagcttat

SEQ ID NO: 2646 - DNA, 1068 bp, Malus domestica
ccagtgatcaaaattccaattggaaagctggaaggtggaactcggaagccctagctcctcctcaaagtttgtcgctttcttctgcggcgatcgaattctaaggggcgaaacatggtgttctacttcaaagcgcgatcggacgtgggcgatttcaccattttcatgggcctcgacaagttcgagaacgaggagctcatcaaatatggcttccccgaagacatttggttccatgtggacaaaatgtcttccgcccatgtttatgttaggctgcacaaaggacagaccatcgatgatataagtgaaggtttactggaggattgcgctcagcttgtcaaagcaaattccatccaaggcaacaaggtaaacaatgttgatgttgtttacactccctggtccaatttgaagaaaagtgcctccatggatgttggtcaagttggtttctacaattcgaagaatgttcggactgtgagggtggagaagcggatcaatgaggtagttaatagattgaacaggacaaaagtagaaaggaagcctgatttgaaagctgagcgagaagctgttaatgcagccgaaagagctgagagaaagcagttcctgagggacaagaaacgacgggaggagatggaaaggcttgagaaggagagacaattggaactaaggagctacaaaggtttgatgaattctgaaaatatgacatctaacaaacaaattgcatcgacaaacaagtcattgcaggaactggaagaggacttcatgtaaggatatcattctctatgggttgggtgagacgctgctgcccgctgcccgctgcccatgaagaatagagtttatcattcagtttgtgagttagtcctaaaccttttattttgttgatgtcgataagaaaaagagaaaacacaacaaatggagggaggaaagaaaatgggtgaatgggtgagggttggttcgtggttatctctttcttgtcatggtgatgcacaaaaatcaaacttcattgaggatgatgatgaatgatttatttgcaaaaatatttgcaacattttaaaacccttaatttatatttgccta

SEQ ID NO: 2647 - DNA, 1160 bp, Gnetum gnemon
ttgcgataattgcttctatttccaccatcggtgccagctctgtgcctctgcttgaaacgttcactttgtgtgcgggaagagttcatttttaacgccggttgccgttgcttgtttgcattttttctgggttttgtggctttcgttttaagggcacaaattcggcacaaaaagcagaaccggaagcagaatcagaagccaaagcatagtcacgatggtgttctacttcaagaccaggcctgatgcaggagactacatcatctacatgggccttgataagcacgagaacgaagagcttatcaaatatggcctccctgaagatatctggtttcatgtggataagatgtcctcagcacatgtgtatttaaggatgcataagggccaaacaatggatgatatttctccagaactcttagaagattgtgctcaacttgttaaggcaaattctatccagggaaacaaaatgaataacattgatgttgtttacactccatggtccaatttacgtaagacagcatcgatggatgttgggcaagttggcttccataattctaagcttgttcggactgtaaaggtggagaaacgaatcaatgaaatcgttaatcgattgaacaaaactaaaattgaaaaaaagcctgatttgaaagcggagcgagaagctataaatgctgcagaaagggctgagagaaaagcacagcttcgagaacagaaacgacgtgaagaactggaacgtcttgagaaagaaaggcaggcagagattcgaagctacaaaggcttcatggttgctgacaaaatgacttccaacaaggacattgcatctggaagcaagacatttcaagagattgaggatgacttcatgtgatagcattcctaaagaactacccttcacctttttcttttcatggaaattttatcttccattgatcatttctaaagcgagtgctccccacaaaatgcgcttattcccatgtaggcttgaacgacccaagatcatgaatccctggaattgaagaaataagtgctgcatcttatcgttattgttaaggttcgatttcaatgttaattttgaaaacgtattcttatgctataatcacattcgtgtattgccacagtttcttcagcatatcatttaatcctatttgattgactgtgtctgaaatttt

SEQ ID NO: 2648 - DNA, 1219 bp, Mimulus guttatus
ggtgcgcaaaggagaggcgttcggaaatttcaattcaatttataacataattcaatctcaataattccacagaagataatcgaaaccctagagagagaaagaaggaagagaaacgaaaatggtgttctacttcaaggcgcgaccggaggccggggactacaccattttcatgggactcgacaagtatgagaacgaggagctcatcaaatacggctttcccgaagacatttggttccatgtggacaaaatgtcttcagcccatgtttatctgagattgcacaagggtcaaaccattgatgatatatctgaaggggtattggaagattgtgtccaactggttaaagcaaattccatccaaggaaataaagtgaacaatgtcgacgttgtttacaccccttggcagaatcttaagaagactccatccatggatgttggacaagtcggtttctatagttcaaaaatggttcgtactgtgagagtggaaaagcgagtaaatgagattgttaaccgtttaaacaggacaaaggtggaaagaactccagatctgaaagctgaacgagaggcagttaatgcagctgaaagagcagagagaaaacagcagcttcgcgataaaaaacgacgagaagatttagacaaactcgaaaaggagagacaggctgaattaaggagctacaaaaacttgatggtagctgagaagatgacctctaacaaggacatagcatctgcgaacaagtccctgcaagaactcgaggaagatttcatgtgacacccaaaaaaattcaataaatctgtcaaaagttcacttgttaatcgagaatatgtggcttatttcatacggggagagaccggaaagaagatcgagagagagagaagttgatagttgggtcggggcagagggtgattttttgttgtattgtgtccttaagacataactatgcacttatcgttgtgaaatcaaatcattggtcttaaaaaagctttcaaattgtattaataatagctcgagagcatagatctatggtttgagagccggcgaacgagcttagcgcaattcaattttcgaaatttctttttttgaggaatatttctctataatctttcccacaaggatatatgtatattaatatgaattgacatcaaatgattaatgttcaacatgttaaatataaagaaaaacttggtctgcaaaaagtagcagaaagtaattagttccacctaa

SEQ ID NO: 2649 - DNA, 1166 bp, Solanum tuberosum
gaccaaattggggaaaatctaaagaaaggtaaggaagatttagctttgtttgtacgcgaaaaatgcggtttcaatagtttgcctatatccacctgcctatctgactcaggaaaaactcgtcgaatctgctataacaaattagggcttcgaaaaccctaaaacagagagctcgttttttcctttccaatcggagaagagaaaaatggtgttctacttcaaggctcgaccggaagccggtgactacaccatctttatgggtcttgataagtatgagaatgaagaactcatcaaatttggcttccctgaagacatctggttccatgtggataaaatgtcatcagcccatgtttatttgagattgaacaagggtcaaacatttgatgatatacctgaaggtgtattggaagattgtgctcaacttgtcaaggcgaattctatccaaggaaataaggtaaacaatgtcgatgttgtttatactccatggcaaaaccttaagaagactgcctcaatggatgttgggcaagttagtttccacaacccaaaaatggttcgtaccgtgagggttgagaagcgaataaatgagatagtgaatagattaaaccgtacaaaggtggaaaggaagcctgacttgaaagctgagcgggaggccgtcaatgcagctgaaagggcggagaggaagcagcagcttagagagaagaaacgacgagaggatatggataagcttgaaaaggaaagacaggctgaaatgaggagctacaaaaatttgatggttgctgataagatgacatctaacaaagacgttgcgtcagcgaacaagtccctgcaagagatggaggaagacttcatgtgaatgcaaaatcaaatggatttaattgtttcaatcgctgccttgtttacaaaatactaaatgagaagctgcttaagaagaatgcagagaagaaaaaggaagaataggggggtggggcatgggggggtgaggtgatcttttgaaatgttgtgtgttcttttgaaacaattatggtccttattcaaacatgatcaaattgatctttgtaggcccgaacctgtttgttaataaggggtatatgagcatatgggttggagttcaagcagaagcttacttgtaaaaccagtgttttgattttaatggtgaagatgacttgtta

SEQ ID NO: 2650 - DNA, 897 bp, Zostera marina
ccgtacgatttccctcccattcccctcttcggcttctgcccaattcctgttcttattcttcgtctcaaaccctaaattggaactgcctctctttttgggtttcgttgtcgtcgtcttctttgttatttaattatggtcttctacttcaaggcactccctactcttggagactataccatcttcatgggtctagacaaacacgagaacgaagatctcatcaagtatggcttcccagaggacatctggtttcatgttgacaaaatgtcgtctgcccatgtttacttgagattgcacaaatgccagacgattgatgatataagtgagggtttattggatgattgtgctcagcttgtcaaagccaattcgattcaaggcaacaaggtgaacaatatcgacgtggtttatactccatggttcaacttgaagaagactacttccatggatgttgggcaagttggctttcacaattccaaaatggttcgcactgttagagttgtaaagcgtttaaatgacacagtaaacagattgaacaagacaaaagtggagaggaaaccagacttgaaagctgaaagagaggctgttaatgctgccgagaaagctgaaagaaacttcaattgagagataaaaaagacgcgaagagatggggaggctcgagaaggagagacaattagagatgaggagttacaaaggactgatggtttcagagaaaatgacttctaacaaacagattgcgtccagtgcaaaaagtcttgaagaactggaggaggatttcatgtgagtaagataaaaaatataaaatatggagtgattaattattcactaatggaatgcaagcagcgttgaaatgagtagcaatatcgaaggctggaagttttagacatgaagaccagacaaggt

SEQ ID NO: 2651 - DNA, 1153 bp, Brassica rapa
tgtttctttttttcttgcggttttatattatctcgagtggttacgattctttcattctcgaatcttgtagggggagataaggaagtgagagaaggggaaacccaaaccctattttcgatctctagtcgtgtctcaatcgaagcgatggtgttctacttcaaggcacgaccagatgctggggactacaccatcttcatggggctcgataagttcgagaacgaggagctcatcaagtacggcttccccgaagacgtctggtttcacgttgataagatgtcgtcagctcacgtttacttgaggcttcataaaggccaaggctttgatgacattagtgaaggtgtgctcgaggactgtgctcagcttgtcaaagctaattccattcaaggcaacaaggtgaacaacgtcgatgttgtgtacactccgtggtccaacttgaagaagactgcctccatggatgttggtcaagttggcttccacaattcaaagatggtccggactatcagagtggagaagcgagttaatgacatagttaacagattgaacaaaacaaaagttgaaagaacccctgatctgagagctgagagggaagcagtgaatgctgctgaaagagctgagaggaaagaacacctgagggagaagaagaaacgtgaagatatagagaggctggagaaggagaagcaagcagacatgaggagttacaagggattaatggtaactgacaaaatgacatccaacaaagacattgcttcaagcaacaagtctcttcaagagctcgaagatgatttcatgtaaaagagccctgaagaaatgagagaaaacaagtcggtaacgttctgctggtgctgtccttcaaagaaggtttatcaagttcttctattagccttaagagttataatgatgatgaattgcccttttgtttcaaaaagtcttcagaggattgaatctgagttgtgagaaaaacagagagcattatgatatatataacgcaggtgagccagtgagctggtgcgaccatggtttactctacctaaccttgctgtgtttgttgaaaatcattttaccaccctaatagtttttactttttattcttttgatcccaaaattaatttacacaggtataagcacctgcttttcatattaatcaacaaattgc

SEQ ID NO: 2652 - DNA, 974 bp, Distylium racemosum
agcaaaagcagaagcagccaagatggtgttctatttccaggccaggccagaggcaggggattacaccatttacatgggccttgacaagcatgaaaatgaagagcttatcaaatatggctttcctgaggatgtctggttccatgtggataagctgtcttcagcacacgtttatttgagaatgcacaagggtcagacaatagatgatattacagaaccgctcttggaagattgtgcacaactggtgaaggcaaactctattcaagggaataaagtcaacaatattgatattgtgtacactccttggtccaatttaagaaagactccagctatggatgttgggcaagttggtttctataacgccaagcttgttaaaactgcaagagttgagaagcgcataaatgaagttgtgaatcgcttgaataaaactaaagttgagcggaagcctgactttaaagctgaaaaggaagctattgctgctgcagaaagagcagaaagaaaggctcaagttagggaaaagaaacgacgcgaggaattggagcgtcttgaaaaagagaaacagtcagaaataagaagctacaaaggccttatggttgcagacaagatgacttctaataaggagattgcatcaggaagcaagtctcttcaggagttggaagaagatttcatgtgatatttgccaaaagaaagcagcataaacagtgacatatggctaattatatgttactttgttatgttttgcaaaattgtctccttctaagcgaacctctgaggtagctcatatccattttttgttgtcattcgacagtgcaattaagttaagtgtagctggttgcaaatttgtcagtgaattgtgcatctcaaatctgatttcaagtgtcattgctgcttctttcaaaatcctcagaagagatgcacgtattttccataaatggtgaattgtgcctacagtgcctagtgattatctaggcaacctt

SEQ ID NO: 2653 - DNA, 1181 bp, Silene vulgaris
aataacatccaaaaatggtgttctacttcaaagcaagacctgaagccggcgactacaccatcttcatgggccttgataagcacgaaaacgaagagcttatcaaatatggtgttcctgaagacatttggttccatgtggataaaatgtcttcagcccatgtgtatgtgagactgcacaagggtcagacgatggatgccatttctgaagggttgttggaggattgtgtacagctggtgaaagcaaattccatccaaggcaacaaattgaacaatattgacattgtttacactccctgggctaatttgaagaaaactccttccatggatgtgggccaagttggttttcacaattcaaagatggtccgaactgtccgggtagagaagaggataaatgaggttgtgaataaactgaatcgctcaaaagtggagaggacagttgactttaaagccgagcgtgaagcatacaacaatgctgaaaaagcagaaagaaaagctgtactgagagaaaagaaacgtcgagaggaaatggagagacttgagaaagagaggcaagcagaacagagaagctacaaaaatttgatggtatctgacaaaatgacatctaataaagacattgcttcagctaacaaatccttgcaagagctggaagaagatttcatgtgagcgtgttgtctaaacttcttcgattaaagtggcaaatgtcccaacacctaatgctaaattgtacgacacatatcaccaaaacatgtttctgcttgatgacggaattgattgaaatcttaatcgttggattgtttcgttgaagatcctaagcgtgtagcttgataatgatgatgaagaaagaggccgcattgtataggggaagattaagaccggtgttgttaccccttgtacatgacgccactatttggtattttaagtactcgcattttgttggagtggttttggttttggtttatgaagaatgaaaaaaaatgtttggttaaccatatcgtatagcctttcaaatgacctagaaattataggtgaatcttccttttagtagagaggcggctggctcggactggccgaatctcttatcggatttttaacatgtagagcgtacaatttagtacgtaactagcattttgcccccttgctcagtgatttaggattggctatttgggaaacggattgtatatt

SEQ ID NO: 2654 - DNA, 1169 bp, Eutrema halophilum
cagttttgcttcttcttttttttttttttaatggtttttatattgtctcgagtggttacgatttcttcattggcgtaacatctagggaagagaggggagatagggaagtgagagggggaaaccctagattcgatttggttcgtttctcgaatcgaagcgatggtgttctacttcaaggcccgaccagatgctggcgactacaccatcttcatggggcttgataagttcgagaacgaggaactcatcaagtacggcttccccgaagacgtctggtttcacgttgataaaatgtcgtcagctcatgtttacttgaggcttcacaaaggccaaagttttgatgacattagtgaaggtgtgctggaggattgtgctcagcttgtgaaagctaactccattcaaggcaacaaggtgaacaatgttgatgttgtgtacactccatggtgcaacttgaagaaaaccgcctccatggatgttggtcaagttggtttccacaattcaaagatggtccggaccatcagagtggagaagcgagtcaatgaaatagttaacagattgaacaaaacaaaagtcgaaagaacacctgatctgagagccgagagagaagcagtgaatgctgcagaaagagctgagaggaagcaacatctgagggagaagaagaaacgtgaagagatagataggcttgagaaggagaggcaagcagagatgaggagttacaagggattaatggtaactgataaaatgacatccaacaaagacattgcttcaagcaacaaatcgcttcaagaactcgaagacgatttcatgtaaaaggctaaaagcctcttgaagaattgaccaaaacaaaccgagtctgtaacattctgccagagcttatctggtgctgtccttcaaagatggcttagggtactgttctactagcctgtttccatcttttgttttaaaaatgtcttgaagacctaaaaccctaatttggttcttggattccttggtccattaatatgtttcagaagataacaaaagaagagcctattatatctaatacacaggtgaaccagtgatctggtacgatcatggttgactctgccttgctgtgtttgctgaaaatctttttataacccctatagattttactttttgctctaaaagtcccaaattaatttacacaaggt

SEQ ID NO: 2655 - DNA, 1070 bp, Eutrema halophilum
tttttttaatggtttttatattgtctcgagtggttacgatttcttcattggcgtaacatctagggaagagaggggagatagggaagtgagagggggaaaccctagattcgatttggttcgtttctcgaatcgaagcgatggtgttctacttcaaggcccgaccagatgctggcgactacaccatcttcatggggcttgataagttcgagaacgaggaactcatcaagtacggcttccccgaagacgtctggtttcacgttgataaaatgtcgtcagctcatgtttacttgaggcttcacaaaggccaaagttttgatgacattagtgaaggtgtgctggaggattgtgctcagcttgtgaaagctaactccattcaaggcaacaaggtgaacaatgttgatgttgtgtacactccatggtgcaacttgaagaaaaccgcctccatggatgttggtcaagttggtttccacaattcaaagatggtccggaccatcagagtggagaagcgagtcaatgaaatagttaacagattgaacaaaacaaaagtcgaaagaacacctgatctgagagccgagagagaagcagtgaatgctgcagaaagagctgagaggaagcaacatctgagggagaagaagaaacgtgaagagatagataggcttgagaaggagaggcaagcagagatgaggagttacaagggattaatggtaactgataaaatgacatccaacaaagacattgcttcaagcaacaaatcgcttcaagaactcgaagacgatttcatgtaaaaggctaaaagcctcttgaagaattgaccaaaacaaaccgagtctgtaacattctgccagagcttatctggtgctgtccttcaaagatggcttagggtactgttctactagcctgtttccatcttttgttttaaaaatgtcttgaagacctaaaaccctaatttggttcttggattccttggtccattaatatgtttcagaagataacaaaagaagagcctattatatctaatacacaggtgaaccagtgatctggtacgatcatggttgactctgccttgctgt

SEQ ID NO: 2656 - DNA, 733 bp, Panax ginseng
ggtgttctacttcaaagcccgcccggaagccggagactacaccattttcatgggtctcgacaagcacgagaacgaagagctcatcaaatacggcttccccgaagacatttggatttcttctaccgcaggttccatgttgataaaatgtcttcggcccatgtttatgtgagattacacaagggtcagactgttgatgatatatcagaaggtctactggaagattgtgctcagctagtcaaagcaaattccatacaaggaaacaaggtgaacaatatcgatgttgtatacactccctggcaaaatttgaagaagactgcttctatggatgttggccaagttggttttcacaatccaaaaatggtccgcactgtcagagtagagaaacggattaatgaggtagttaatagattaaacaagacaaaagtggaaaggtcacctgatttgaaagctgagcgcgagtcagttaatgcagcagaacgagcagaaaggaaacaactgctgagagataaaaaacgaagggaggagttagagaggctggaaaaggagagacaagcggagcttaggagctacaagaatttaatgttagctgacaagatgacatctaataaagacatagcttcgacccagaagtccttgcaagaactggaagaggatttcatgtgaaaaaaataaattaaatttgaatatttcccatactttatcccttgttgccaaatttgggaaaccgccaaaa

SEQ ID NO: 2657 - DNA, 841 bp, Valeriana officinalis
tagatttttcttcttctctatcatagaatggtgttttacttcaaggcaagaccagattgcggcgactataccatatttatggggcttgacaagtttgagaatgaagaactcattaaatacggcttcgtcgaagatatctggttccacgttgataaaatgtcgtcagcccatgtttatgtgcgactgcacaagggccaaacaattgacgatatatctgaaggtctattagaagattgtgctcaactagttaaagcaaattctatccaaggaaacaaggtgaacaatgtggacgttgtttatactccttggcaaaatttgaagaaatctgcttccatggatgtcggtcaagttggttttcacaattcaaagatggtccacaccgttagagtggagaaacgaataaatgaagtagttaatcgattaaacaaaaccaaagtagaaaggacgccagatctacaagccgaacgtgaggcagttactgcagcagagagagccgataggaaactacaactgagagataagaaaaggagagaggatgtagagaggatggagaaagaaaaacaaagccgatatgagaagttacaaaaacttgatggtggctgacaaaatgacatcgaacaaagatatcgcttccacaaataaatctatgcaagaacttgaagaagatttcatgtaaacattactatcttttcattcttgtgttgtgtgatcttgattcttgaatatgtatgtatactaccaaagattaagatgtaaaaataatgagtttcttggtaatcatcaagaattgctatgttttcgatctcggattttggagaaatcaatgaattattatggattt

SEQ ID NO: 2658 - DNA, 706 bp, Gossypium raimondii
taattttgtctctcatgaaggggagggaaaaatggtattttacttcaaatcccagccaaaagctgatgattacaccaatttcatgggtcttgacaagtacgagaatgaggagctcatcaaatatggcttcatcgaagatatctggttccatgtggataagatgtcttctgcccatgtttatttaagacttaaaaagggtcaaaccattgatgatataagcgaaggtgttctcgaagattgtgctcagcttgttaaagctaattccatccaaggcaacaaggtgaataatattgatgttgtttacactccatggtccaatttgaagaaaactccttcaatggatgttggccaagttggctttcacaattccaagatggttcggactgtgagagtggagaagcggataaatgagatagttaacaggttgaacaagactaaagtggaaaggaaacctgatttgaaagctgagaaagaagcagtttatgcagcggaaaaagccgagagaaagcaacagttgagggaaaaaaaacgccgagaggagatgcaaaggcttgaaaagaaaagagaagtagaaataagaagctatgaggatctgatggtctctgaaaagatgacatcaaacaaacaaattgcagccacgagcaagtctttccaggaagtagaacaggattttatgtgaatatttcattgccaattagattcttct

SEQ ID NO: 2659 - DNA, 1057 bp, Brassica juncea
agtggtgacggtttcttcattgtcgtaacttgtagggaagagagagagagagaggggggaaccctagattcgatttggttcgcttctcgaatcgaaggcgatggtgttctacttcaaggcacgaccagatgctggggactacaccatcttcatggggctcgataagttcgagaacgaggagctcatcaagtacggcttcccagaagacgtctggtttcacgttgataagatgtcgtcagctcacgtttacttgaggcttcataaaggccaaggctttgatgacattagtgaaggtgtgctcgaggactgtgctcagcttgtgaaagctaattccattcaaggcaacaaggtgaacaacgtcgatgttgtgtacactccgtggtctaacttgaagaagactgcctccatggatgttggtcaagttggcttccacaattcaaagatggttcggaccatcagagtggagaagcgagtcaatgaaataattaacagattgaacaaaacgaaagttgagagaacccctgatctgagagctgagagagaagcagtgaatgctgcagaacgagctgagaggaaacaacacctgagggagaagaagaaacgtgaagatatagagaggcttgagaaggagaggcaggcagatatgaggagttacaagggactaatggtaactgataaaatgacatccaacaaagacattgcgtcaagcaacaagtcgcttcaagaactcgaagatgatttcatgtaaaagagccctgaagaaatgagtttgaaaaaacaaaccaagtcgttatcattcttctggtgctgtcaaaatttggttcttaagtctttctctcggccggtgaatccgagttgtgagaaaaacagagagcattatatgatatatgatgtagtataacacaggtgatccgctgcgatcatgatttactctgccttgcttgaaaatcattttgccacccttatagttttcactttttactcttttcttattaacctgctaagttgttttggatttgactcgagccttcgactgtattaaacagtatctaattac

SEQ ID NO: 2660 - DNA, 967 bp, Brassica juncea
gtgttttctttttatattctctagagtggttacgatttcttcattgtttgcaacttgtggggaagagaggaggggagatagggaagtgagagggggaaaccctagattccatttgctccgtctctcgaatcgaaggcgatggttttctacttcaaggcccgaccagatgctggagactacaccatcttcatggggcttgataagttcgagaacgaggagctcatcaagtacggcttccccgaagacgtctggtttcacgttgacaaaatgtcctcagctcatgtttacctgaggcttcataaaggccagggttttgatgacatcaatgaaggtgtgctggaggactgtgctcaacttgttaaagctaactccattcaaggcaacaaggtgaacaacgtcgacgttgtgtacactccgtggtccaacttgaagaaaaccgcctccatggatgttggtcaagttggtttccacaatccaaagatggtccggactatcagagtggagaaacgagtcaatgatatagttaacaggttgaacaaaacaaaggttgagagaacccctgatctgagagccgagcgagaagcagtgaatgctgcagaaagagctgagaggaagcaacatctaagggagaagaagaaacgtgaagagatagagaggctggagaaggagaggcaagcagagatgaggagctacaagggattgatggtaactgataaaatgacatccaacaaagacattgcttcaagcaacaaatcgcttcaagaactcgaagacgatttcatgtaatgagagagaaagcaaagaaacctctggtgctgctgcccttcaaagaaggcttatgatgttctattaatcatttgattataatgatgatcggtttcatcttttgtttcaaaaagtctttgaagacctaaaactctgatttggttcttacactctttcgtccattgaaatgtttcagaggatt

SEQ ID NO: 2661 - DNA, 940 bp, Panax ginseng
attgatttcgccaatttgaaaacctacctaatttttcttcctgttctgcgttgttgggagggggtgaagagagagaaatggtgttctacttcaaaggccggcccgaagccggtgattacaccatcttcatgggtctccacaagcaccagaacgaagaaatcatcaaatatggcttcccccaagacatttggttccatgtggataaaatgtcttcaccccatgtttatgtgagattacacaagggtcacacggctgatgatatatctgaaggtctaatggaagattgtgcccaactagtcaaagcaaattccatccaaggtaacaaggtgaacaatattgatgttgtttacactccttggcaaaatttgaagaagactgcttccatggatgttgggcaagttggttttcacaatccaaaaatggttcgcactgtgagagtggagaaacggattaatgaggtagttaatagattaaacaagacaaaagtggaaaggacacctgatttgaaggctgagcgggaggcagttaatgcagcagaacgagcacaaaggaaacagcagctgagagataaaaaacgacgagaggagatagagaggctggaaaaggagagacaagcagagttgaggagctacaagaatttgatggtagctgacaagatgacatctaataaagacatagctgcgacccagaagtccttgcaagaactagaagaggacttcatgtaaacacactaaaacttgaatatatcacaaatttataaccttgttgcaagatttgggaactgccaaaaagaaagaagggaaaggtacagggactaaagtataaacgggaaggattggttggggggtgagtttcttttttactggtaatatgttgtgtgatatgaaattgtttgcgttaaacctcgtcttagtaagctcaggcaccaatgtgcagtttg

SEQ ID NO: 2662 - DNA, 1187 bp, Eutrema parvulum
atcggtttcgcttttttgcgtttttatattcccttgagtggttacgatttcttcattgttgtaacttgtagggaagagagatagggaagtgagagggggaaaccctagattcgatctttggttcgttcctcgaatcgaagccatggtgttctacttcaaggcccgaccagatgctggcgactacaccatcttcatggggcttgataagttcgagaacgaggagctcatcaagtacggcttccccgaagacgtctggtttcacgttgataaaatgtcgtcagctcatgtttacttgaggcttcataaaggccaaggttttgatgacattagtgaaggtgtgctggaggattgtgctcagcttgtgaaagctaactccattcaaggcaacaaggtgaacaacgtcgatgttgtgtacactccgtggtccaacttgaagaaaaccgcctccatggatgttggtcaagttggtttccacaattcaaagatggtccggactatcagagtggagaagcgagtcaatgatatagtcaacagattgaacaaaacaaaagttgagagaacccctgatctgagagccgagagagaagcagtgaatgctgcagaaagagcagagaggaaacaacatctgagggagaagaagaaacgtgaggagatagagaggcttgagaaagagaggcaagcagagatgaggagttacaagggattaatggtaactgataaaatgacatccaacaaagacattgcttcaagcaacaaatcgcttcaggaactcgaagacgatttcatgtaagagcccagtaacattctgccagaagtggttatctggtgctgtccttcaaagaaggcttatcatgttctgttagccctagattataatgatgatgaattgcccggtttcatcttttttttttttcaaatgtctttgaagacttaaaccctaatttggttcttagactctttcgtccattgaaatgtttcagaggattgaatctgagttgtgagaaaaacagagagcttatgatatatatataacacatgtgagccaagtgatctggtgcgatcatggtttactctgccttgatgtgcttgttgaaaatcatcttactacccttgtagttttttacatttttactttttggtcccaaaattaatttagctatatctataacctcccgcttcatattagt

SEQ ID NO: 2663 - DNA, 854 bp, Vinca minor
tttcggtgagattgattgaagaagatggtgttctacttcaaagcccggcccgatgccggagattacacaatctttatgggtctcgacaagcacgagaatgaagaattaatcaaatatggtttccctgaagacgtttggttccatgtggacaaaatgtcttcagcccatgtttatctcagattgaacaagggtcagacaattgatgacataccagaaggtgtattggaagattgtgtacaattagtcaaagcgaattccatccaaggaaacaaggtgaataatgtagatgttgtttatactccttggaataatcttaagaagacagcttcgatggatgttggccaagttggtttctacaattcaaaaatggtccgtactgtgagagtggagaaacggataaatgagatagttaatagattaaaccgcacaaaggtggaaagaacacccgatctgaaagctgaacgagaagcagtaaatgcagcagaaagagctgagaggaaacagcatctcagagacaaaaaacgacgtgaagagatggaaaggcttgagaaggaaagacaagctgagttaagaagctacaaaaacttgatgaaagcagataagatgacatctaacaaggatattgcggcggccaacaagtcccttcaggaactggaagaggatttcatgtgaatgcagtagtcaattcaagaatttcttaaattcgccaccttgttgcagaatacaaagtatatgtcggcgtggttaaggagtacgagaagaaaacatctaacaggaactgggatgaaattggaattcttcatggtatttatatatcttgtattatgctaagatattccttgatgaaatgaggt

SEQ ID NO: 2664 - DNA, 820 bp, Vinca minor
gtgttctacttcaaagcccaacctgatgccggagactacactatctttatgggtctcgataaacacgagaatgaagaattaatcaaatatggattccccgaagacgtgtggttccatgtggacaaaatgtcttcagcccatgtttatctcagactgaacaagggtcagacaattgatgacataccagaaggtgttttggaagattgtgtacaattagtcaaagcaaattctattcaaggaaacaaggtgaataatgtagatgttgtttatactccttggaataatcttaagaagacagcttccatggatgttggtcaagttggtttctacaattcaaaaatggtccgtactgtgagagtggagaagcggataaatgaaatagttaatagattaaaccggacaaaggtggaaagaacacctgatctgaaagctgaacgagaagcagtaaatgcagcagaaagagctgaaagaaaacagcagctgagagacaaaaaacgacgtgaagatatggaaaggcttgagaaggaaagacaagctgagttaagaagctacaaaaatttgatggtagtagataagatgacatctaacaaggatattgcgtctgccaacaagtcccttcaagaactggaagaggatttcatgtgaatgtcgtcaattcaagaatttcttaaattcgccaccttcttggagaacacaaagtacatctcagcctggataaggtgtactaagaagaaaatatctaacaggaacttctgggatgagattggaatcctacatggtaggtatttatgtattgtaatatgctaaactattccttgat

SEQ ID NO: 2665 - DNA, 749 bp, Antirrhinum majus
  misc_feature (75)..(75): n is a, c, g, or t
  misc_feature (258)..(258): n is a, c, g, or t
  misc_feature (474)..(474): n is a, c, g, or t
  misc_feature (478)..(478): n is a, c, g, or t
  misc_feature (541)..(541): n is a, c, g, or t
  misc_feature (552)..(552): n is a, c, g, or t
  misc_feature (576)..(576): n is a, c, g, or t
  misc_feature (589)..(589): n is a, c, g, or t
  misc_feature (616)..(616): n is a, c, g, or t
  misc_feature (634)..(634): n is a, c, g, or t
  misc_feature (643)..(643): n is a, c, g, or t
  misc_feature (658)..(658): n is a, c, g, or t
  misc_feature (678)..(678): n is a, c, g, or t
  misc_feature (690)..(691): n is a, c, g, or t
gggcgatgcgaaatacctgaaatatcaacaacatttgaagccctagagagagagagagagcgagagaagatggtnttctacttcaagcgaggcctgagcctgaggcaggagatacaccatattcatgggcctcgacaagtttgagaacgaggagctcatcaaattcggcttccctgaagatatatggttccatgtggataaaatgtcttcagcccatgtttatgtgagattgcacaaaggtcaaaccattgatgatangtctgaaggtctgttagaagattgtgcccaacttgttaaagcaaattcaatccaaggaaacaaggtaaacaatgttgatgtcgtttacactccctggcagaatcttaagaaaactgcttccatggacgttgggcaagttggtttttacaactcaaaaatggtgcgcactgttagggtggagaagcgaataaatgagatagttaatcgattaaacangacnaaggttgaaagaaagccagacttaaaagccgaaagggaggcagttaatgcagctgaaagagcncagaggaaggngctgcttagagacaaaaaacgccncgaagatctaganaggctggaaaaagagagacaggctganatgaggagctacaaaaanctgatggtngctgagaagatgacntctaacaaggacatagcatnaacaaacaagtnncttcaagaactcgaggaagatttcatgtgaatccaaatgcatcaaattatggccattt

SEQ ID NO: 2666 - DNA, 1006 bp, Arabidopsis thaliana
aatttcgtaaacttctaggggagaaacaagggagatagagaagtgagagagggggaaaccctagattcgatctccattcgatttgattcgtttctcgaatcgaagcgatggttttctacttcaaggcccgtcctgatgctggcgactacaccatcttcatggggcttgataagttcgagaacgaggagctcatcaagtacggcttccctgaagatgtctggtttcacgtggataaaatgtcgtcagctcatgtttacttgaggcttcatagaggccaaagttttgatgacattagtgaaggtgtgctggaggactgtgctcagcttgtgaaagctaactccattcaaggcaacaaggtgaacaacgttgatgttgtgtacactccgtggtccaacttgaagaaaactgcctccatggatgttggtcaagttggtttccacaattcaaagatggtccggactatcagagtggagaagcgagtcaatgaaatagttaacagactgaacaaaacaaaagttgaaagaacccctgatctgagagccgagagagaagcagtgaatgccgcagaaagggcagagaggaaacaacatctgagggagaagaagaaacgtgaagagatagataggcttgagaaggagaggcaatcagagatgaggagttacaagggactaatggtaactgataaaatgacatccaacaaagacattgcttcaagcaacaaatcgcttcaagaacttgaagacgatttcatgtaaaagctctgaagaaatgagaaacaaaacaaaccaagtcggtaacattctgccagagatgatctggtaccgtccttcaaagaaggcttatgatgttctactcgccttaactatgatgttgatggttgtccggttctatgttttctttaaaaaaatcttgaatacctaaaaccctaatctggttcttggactccttggtccattgaaatgtttcaaaaggattgaatctgatctgtgggaaaaaggagagcatt

SEQ ID NO: 2667 - DNA, 755 bp, Acacia harpophylla
gatatttgttaacagaagcctagggtgcattggtgattcccccaaactcagaaccctagcgcgccctatcgctcgctcgatcaatcaatcgttcgctccttcctcgtccgattgcgtaaaagcgaagaaataccatggtgttctacttcaaagcacggccagaagctggcgattacaccatcttcatgggtcttgacaaacacgagaacgaggagcttatcaagtacggtttcatcgaagacatctggttccatgtggataaaatgtcttctgcccatgtctatcttagactgcataaaggtcagactattgatgatataagcgaaggtgtgctggaagactgtgcccagcttgtcaaagcaaattcaattcaaggaaacaaggtgaacaatgttgacgttgtttacactccctggtccaatttaaagaaaactgcttcaatggatgtgggtcaagttggttttcacaacccaaaaatggttcgaactgtgagagtggagaagcggatcaatgagattgtgaacaggttgaacaagacaaaagtggaaagaacacctgattttaaagctgagcgggaagcagttaatgccgctgaaagagcggaaaggaaacaacaactgagggaaaagaaacggcgtgaagaattggagaggatggaaaaggagaggcaggcagaactaaggagctacaagggtctgatggtgtctgaaaatatgacatccaataaacaaatagcttcagccagtaaatcattg

SEQ ID NO: 2668 - DNA, 1161 bp, Arabidopsis lyrata
acagctttggtttttttttgttttgttatgtttttaattgtcgtgagtggttacgatttcttcaatttcgtaaacttctagggaaagaagaagggaagtgagagaggggaaaccctagattcgatctccattcgatttggttcgtttgtcgaatcgaagcgatggtgttctacttcaaggcccgacctgatgctggcgactacaccatcttcatggggcttgataagttcgagaacgaggagctcatcaagtacggcttccctgaagatgtctggtttcacgtggataaaatgtcgtcagctcatgtttacctgaggcttcacagaggccaaagttttgatgacattagtgaaggtgtgctggaggactgtgctcagcttgtgaaagctaactccattcaaggcaacaaggtgaacaacgttgatgttgtgtacactccgtggtctaacttgaagaaaactgcctccatggatgttggtcaagttggtttccacaattcaaagatggtccggactatcagagtggagaagcgagtcaatgaaatagttaacagattgaacaaaacaaaagttgaaagaacgcctgatctgagggccgagagagaagcagtgaatgccgcagaaagggcagagaggaaacaacatctgagggagaagaagaaacgtgaagagatagataggcttgagaaggagaggcaatcagagatgaggagttacaagggactaatggtaactgataaaatgacatcgaacaaagacattgcttcaagcaacaaatcgcttcaagaactggaagacgatttcatgtaaaagctctgaagaaatgagaaaaaacaaaccaagtcggtaacattctgccagaggtgatctggtaccgtccttcaaagaaggcttatgatgttctactcgccttaattatgatgttgatggttgtccggttttatgttttctttcaaaaaatcttgaagacctaaaagttaaaaccataatctggttcttggactccttggtccattgaaatgtttcaataggcttgaatctgatctgtgagataaaggagagcattatattctatatatataacacagtgatctggtgcaatcatggtttactttgcattgctgtgttacctgattgtttttttactacccctacagtttca

SEQ ID NO: 2669 - DNA, 1067 bp, Arabidopsis lyrata
agtggttacgatttcttcaatttcgtaaacttctagggaaagaagaagggaagtgagagaggggaaaccctagattcgatctccattcgatttggttcgtttgtcgaatcgaagcgatggtgttctacttcaaggcccgacctgatgctggcgactacaccatcttcatggggcttgataagttcgagaacgaggagctcatcaagtacggcttccctgaagatgtctggtttcacgtggataaaatgtcgtcagctcatgtttacctgaggcttcacagaggccaaagttttgatgacattagtgaaggtgtgctggaggactgtgctcagcttgtgaaagctaactccattcaaggcaacaaggtgaacaacgttgatgttgtgtacactccgtggtctaacttgaagaaaactgcctccatggatgttggtcaagttggtttccacaattcaaagatggtccggactatcagagtggagaagcgagtcaatgaaatagttaacagattgaacaaaacaaaagttgaaagaacgcctgatctgagggccgagagagaagcagtgaatgccgcagaaagggcagagaggaaacaacatctgagggagaagaagaaacgtgaagagatagataggcttgagaaggagaggcaatcagagatgaggagttacaagggactaatggtaactgataaaatgacatcgaacaaagacattgcttcaagcaacaaatcgcttcaagaactggaagacgatttcatgtaaaagctctgaagaaatgagaaaaaacaaaccaagtcggtaacattctgccagaggtgatctggtaccgtccttcaaagaaggcttatgatgttctactcgccttaattatgatgttgatggttgtccggttttatgttttctttcaaaaaatcttgaagacctaaaagttaaaaccataatctggttcttggactccttggtccattgaaatgtttcaataggcttgaatctgatctgtgagataaaggagagcattatattctatatatataacacagtgatctggtgcaatcatggtttact

SEQ ID NO: 2670 - DNA, 1222 bp, Arabidopsis thaliana
acagctttgctttttttgttttgttatgtttttaattgtcgtgagtggttacgatttcttcaatttcgtaaacttctaggggagaaacaagggagatagagaagtgagagagggggaaaccctagattcgatctccattcgatttgattcgtttctcgaatcgaagcgatggttttctacttcaaggcccgtcctgatgctggcgactacaccatcttcatggggcttgataagttcgagaacgaggagctcatcaagtacggcttccctgaagatgtctggtttcacgtggataaaatgtcgtcagctcatgtttacttgaggcttcatagaggccaaagttttgatgacattagtgaaggtgtgctggaggactgtgctcagcttgtgaaagctaactccattcaaggcaacaaggtgaacaacgttgatgttgtgtacactccgtggtccaacttgaagaaaactgcctccatggatgttggtcaagttggtttccacaattcaaagatggtccggactatcagagtggagaagcgagtcaatgaaatagttaacagactgaacaaaacaaaagttgaaagaacccctgatctgagagccgagagagaagcagtgaatgccgcagaaagggcagagaggaaacaacatctgagggagaagaagaaacgtgaagagatagataggcttgagaaggagaggcaatcagagatgaggagttacaagggactaatggtaactgataaaatgacatccaacaaagacattgcttcaagcaacaaatcgcttcaagaacttgaagacgatttcatgtaaaagctctgaagaaatgagaaacaaaacaaaccaagtcggtaacattctgccagagatgatctggtaccgtccttcaaagaaggcttatgatgttctactcgccttaactatgatgttgatggttgtccggttctatgttttctttaaaaaaatcttgaatacctaaaaccctaatctggttcttggactccttggtccattgaaatgtttcaaaaggattgaatctgatctgtgggaaaaaggagagcattatattctatatatgacacaggtgaaccagtgatctggtgcaattatggtttactctgcattgctgtgtaacctgaaatttgtttactaccccataaagcttcatgtgttactctgcattgggttgggttttggaatcactttattcttgaccata

SEQ ID NO: 2671 - DNA, 1155 bp, Brassica rapa
atcggtcttatttgcgtgttttctttttatattctctagagtggttacgatttcttcattgttgcaacttgtcgggaagagagggggagatagggaagagagaggggaaaccctagattccatttgctccgtctctcgaatcgaaggcgatggtgttctacttcaaggctcgtccagatgctggggactacaccatcttcatggggcttgataagtttgagaacgaggagctcatcaagtacggcttccccgaagacgtctggtttcacgttgacaaaatgtcctcagctcacgtttacctaaggcttcataaaggccagggttttgatgacattaacgaaggtgtgctggaggactgtgctcagcttgtgaaagccaactccattcaaggcaacaaggtgaacaacgtcgatgttgtgtacactccctggtccaacttgaagaaaaccgcctccatggatgttggtcaagttggtttccacaactcaaagatggtccggactatcagagtggagaaacgagtcaatgatatagttaacaggttgaacaaaacaaaagttgagagaacccctgatctgagagccgagagagaagcagtgaacgctgcagagagagctgagaggaagcaacacctgagggagaagaagaaacgtgaagagatagagaggctggagaaggagaggcaagcagagatgaggagctacaaggggttgatggtaactgataaaatgacatccaacaaagacattgcttcgagcaacaaatcgcttcaagaactcgaagacgatttcatgtaaaactctgattttcccattgaaatgtttcagaggattgagtctgagttgtgaggaaaacagagagcattacctcaggtgagccagtgatcttgtgcgatcatggtttactctaccttgctgtgtttgttgaatatcattttactacccttatatttttacctttttaacgttttatcccaaaactaatttacataggataaataacctcctgttgacaaaaaaaaaataataataataacctcccgcttcagattaaatttgttcttatcatctctatcatctcctctaagtcagtgtacggttttggatttgcctaacattattaaattacgatgattttaagccacgataaccaata

SEQ ID NO: 2672 - DNA, 766 bp, Brassica napus
gttgcaacttgtcgggaagagagggggagatagggaagagagaggggaaaccctagattccatttgctccgtctctcgaatcgaaggcgatggtgttctacttcaaggctcgtccagatgctggggactacaccatcttcatggggcttgataagtttgagaacgaggagctcatcaagtacggcttccccgaagacgtctggtttcacgttgacaaaatgtcctcagctcacgtttacctaaggcttcataaaggccagggttttgatgacattaacgaaggtgtgctggaggactgtgctcagcttgtgaaagccaactccattcaaggcaacaaggtgaacaacgtcgatgttgtgtacactccctggtccaacttgaagaaaaccgcctccatggatgttggtcaagttggtttccacaactcaaagatggtccggactatcagagtggagaaacgagtcaatgatatagttaacaggttgaacaaaacaaaagttgagagaacccctgatctgagagccgagagggaagccgtgaatgctgcagagagagctgagaggaagcaacatctgagggagaagaagaaacgtgaagagatagagaggctggagaaggagaggcaagcagagatgaggagctacaaggggttgatggtaactgataaaatgacatccaacaaagacattgcttcgagcaacaaatcgcttcaagaactcgaagacgatttcatgtaaaactctgattttcccattgaaatgtttca

SEQ ID NO: 2673 - DNA, 993 bp, Brassica napus
gatcggtcttatttgcgtgttttctttttatattctctagagtggttacgatttcttcattgtttgcaacttgtagggaagagaggggagacagggaagagagaggggaaaccctagattccatttgctccgtctctcgaatcgaagacgatggtgttctacttcaaggcccgaccagatgctggcgactacaccatcttcatggggcttgataagttcgagaacgaggagctcatcaagtacggcttccccgaagacgtctggtttcacgttgacaaaatgtcctcagctcacgtttacctacggcttcataaaggccagggttttgatgacattaatgaaggtgtgctggaggactgtgctcagcttgtgaaagccaactccattcaaggcaacaaggtgaacaacgtcgatgttgtgtacactccgtggtccaacttgaagaaaaccgcctccatggatgttggtcaagttggtttccacaattcaaagatggtccggactatcagagtggagaaacgagtcaacgatatagttaacaggttgaacaaaacaaaggttgagagaacccctgatctgagagccgagagggaagcagtgaatgctgcagagagagctgagaggaagcaacatctgagggagaagaagaaacgtgaagagatagagaggctggagaaggagaggcaagcagagatgaggagctacaagggattgatggtaactgataaaatgacatccaacaaagacattgcttcaagcaacaaatctcttcaagaactcgaagacgatttcatgtaaaactctgatttggttctttgactcttttcgccccattgaaatgtttcagaggattgaatctgagttggtgagaaaaaacagagagcatttgcacaggtgagccagtgatcttgtgcgatcatggtttactctgccttgctgtgtttgttgaaaatcattttactaccctttatattttaactttttacattttga

SEQ ID NO: 2674 - DNA, 1048 bp, Lippia dulcis
tttagagttgaaataaaaagcggagaaacagaggaagggaggcgaaaatgagacagtcctcaccgcgaagcttcgtattctaattccatcgtcaaattcaccagaattcaaaaccctagtggaggaggaagagaaaatggttttctacttcaaggcgcgcccggaggctggggatttcaccatattcatgggcctcgacaagtatgagaacgaggagctcatcaaatacggatttcctgaagatatttggttccacgtggataaaatgtcttcagctcacgtttatctaagattgcacaagggtcaaactattgatgatatatctgaagatgtattggaagattgtgttcaactagtcaaagcaaattctatccaaggaaataaagtaaacaatgtcgatgttgtctacactccttggcaaaatcttaagaagactgcatcaatggatgttgggcaagttggtttttataattcaaaaatggttcgtaccgtgagagtcgaaaagcgaataaatgagatagtcaaccgattaaacaggacaaaagtggaaagaactcctgatctgaaagctgaacgggaggctgtaaatgcagcagaaagagcagaaaggaagcagcaacttcgtgataaaaaacggcgggaggatttggacaaacttgagaaagacaggcaggctgaattaaggagctacaaaaacttgatggtagctgagaagatgacatctaacaaggacatagcatctaccaacaagtctcttgaagaactcgaggaagatttcatgtgaacataaaaaatgcttctacaatccctcaacattcagccgtcaatcaagtatttgagttctttggccacaagtggcctgaggaccacaatgaagttcaagagagaagaaagtgatgacgtcatccaataggtatttattagatttggtcatgtccttgagacacattgatatgaaatcttgagatattgaagcgctcccaaattatagtaataatacgtgggagcaaagatttatatagagggaaccggcccaattacgatctgt

SEQ ID NO: 2675 - DNA, 1058 bp, Raphanus sativus
ggaccatttctttcttcattgtcgaatcgaaacttgtagggaagagagagatagagaagtgagagaggggggaaaccctagattcgatttggttcgcttctcgaatcgaaggcgatggtgttctacttcaaggcacgaccagatgctggggactacaccatcttcatggggctcgataagttcgagaacgaggagctcatcaagtacggcttccccgaagacgtctggtttcacgttgataaaatgtcctcagctcacgtttacttgaggcttcacaaaggccaaggctttgatgacattagtgaaggtgtgctggaggattgtgctcagcttgtgaaagctaactccattcaaggcaataaggtgaacaacgttgatgttgtgtacactccgtggtccaacttgaagaagactgcctccatggatgttggtcaagttggcttccacaattcaaagatggtccggactatcagagtggagaagcgagtcaatgaaataattaacagattgaacaaaacaaaagttgagagaacccctgatctgagagccgagagagaagcagtgaatgctgcagaaagagctgagaggaaacaacacctgagggagaagaagaaacgtgaagatattgagaggcttgagaaggagaggcaagcagatatgaggagttacaaggggttaatggtaactgataaaatgacatccaacaaagacattgcttcaagcaacaagtctattcaagaactcgaagatgatttcatgtaagaaatgcgggcaaaaaaaaccccaagttggtaacattctggtggtgctgtccttcaaagaaggtttatcatgttgtttctactagccttggatatataatgatgattgatttcatttttgtttcaaagtctttgatgaaacctaaaaccctagttttgttcttatactctctccagtccgatgaaatgtttcagaggattgaagctgagttgggagaaaaacagagagcattatatatgatatatgatgtataacacaggcgagccagtgatctggtgcgatcatggtttactcca

SEQ ID NO: 2676 - DNA, 1039 bp, Raphanus sativus
  misc_feature (830)..(830): n is a, c, g, or t
tttcttcattgtcgaatcgaaacttgtagggaagagagggagagaagtgagagagggggaaaccctagattcgatttggttcgcttctcgaatcgaaggcgatggtgttctacttcaaggcacgaccagatgctggggactacaccatcttcatggggctcgataagttcgagaacgaggagctcatcaagtacggcttccccgaagacgtctggtttcacgttgataaaatgtcctcagctcacgtttacttgaggcttcacaaaggccaaggctttgatgacattagtgaaggtgtgctggaggattgtgctcagcttgtgaaagctaactccattcaaggcaataaggtgaacaacgttgatgttgtgtacactccgtggtccaacttgaagaagactgcctctatggatgttggtcaagttggcttccacaattcaaagatggtccggactatcagagtggagaagcgagtcaatgaaataattaacagattgaacaaaacaaaagttgagagaacccctgatctgagagccgagagagaagcagtgaatgctgcagaaagagctgagaggaaacaacacctgagggagaagaagaaacgtgaagatattgagaggcttgagaaggagaggcaagcagatatgaggagttacaaggggttaatggtaactgataaaatgacatccaacaaagacattgcttcaagcaacaagtctattcaagaactcgaagatgatttcatgtaagaaatgcgggcaaaaacaaaccccaagttggtaaacattctggtggtgctgtccttcaaagaaggtttatcatgttgtttntactagccttggatataatgatgattgatttcatcttttgtttcaaagtctttgatgaacctaaacccctagttttgttcttagactatgaaacagagcattatatgatatatgtgatgtataacacaggcgagccagtgatctggtgcgatcatggggggtttactctatctttactgtgtttatctaaaataattttaccaccgcca

SEQ ID NO: 2677 - DNA, 734 bp, Lotus japonicus
aaattggaattgacaaacgcggaaccctaacgcaccctcctttgttccttcttgtcattgtgtgcgtgaaggcaacgcagcaactccatggtgttctacttcaaagctcgccctgaagctggcgatttcaccatcttcatgggtcttgacaagtatgagaatgaagagctcatcaaatacggttttcctgaagacatctggttccatgttgataagatgtcttcggcccatgtctatgttaggctgcacaaaggtcagactatcgatgacatgagcgaaggtttactggaagactgtgctcagcttgtcaaagcaaattcaattcaaggaaataaagtgaacaatgttgatgttgtttacactccttggtctaatttgaagaagactgcttcaatggatgttggtcaagttggtttttataactcaaaaatggttcgaactgttagagtggagaagaggataaatgagattgttaacaggctaaacaagacaaaggtggaaagaactcctgatttgaaggctgaacgagaagcagttaatgcagctgaaagagcagagagaaagcaacacctgagagaaaaaaagcgccgtgaggaaatggaaagacttgaaaaggagagacaatcagagcttaggagctacaagggcttgatggttgcagaaaatatgacatccaacaaagacattgcatcctggaccaaatactggcggaccataggaggtttattgtaacg

SEQ ID NO: 2678 - DNA, 1034 bp, Eschscholzia californica
aaaaaaatggtttttacttccaagctcgaccagaagctggtgatttcactattttcatgggacttgataagcatgagaacgaagacctcatcaaatatgggttcccagaagacatctggtttcatgtggataaaatgtcatctgcccatgtttatctaaggttgaataaagggcaaacaatggatgatataagtgaaggtgtacttgaagattgtgttcaacttgtgaaagctaattccattcaaggcaacaagttgaataatattgatgtcgtttataccccctggcaaaatttgaagaagactgcttccatggatgttggacaagttgggttccacaatcataagacggtccggactgtgagagtagagaagcgcataaacgatgtcattaacagattgaacaagaccaaggtggaaagaaagacggacttaaaagctgagtgggaggatgttaatgcagctgaaaggatggagaaaaaagtcgtattgagagataaaaaacggcgagaggaaatggagaggctagaaaaggagcggcaggcagagatgcggagctacaagggtttgatggtctcggaaaacatgacttcgaacaaacaaaatgcatctacaagcaagtctctccaagaaatggaggaagattttatgtgagtcaagtctacattaatacaggttaataccaagttaggttttgttttctaacatcagattgacaaaacccacgagactctgattagtacttttgactcgaaaaacacaatctagggtcttcattaattcatgttaagagtgggatgaaaataatagggcttggttaactcgtacgcctacgctgaaaaacctagcttgagctaagattcatttttatacatgaatagaagtaaatctcggatttgttgggggcattaaacatggaaactggtatcttcataatctatatgaatgtattctcttgtgtatttcataattaatcgaaatgattctactaaaagattagagatttatgttttttgcacttcatgttaaaatttc

SEQ ID NO: 2679 - DNA, 1016 bp, Triphysaria pusilla
gcaaaatcggagagaagagaaattaggggaaaattaaaatcgaaaccctagagagagagagaacaaagtagagagaagatggtgttctacttcaaggcgaggcctgaggcgggtgactacactattttcatgggcctagacaagtatgaaaacgaggagctcatcaaatatggcttccccgaagatatttggtttcatgtggataaaatgtcttcggcccatgtttatgtgagattgcacaagggtcaaaccattgatgatatatctgaagatgtattggaagactgtgcacaacttgttaaagcaaattctatccaaggaaacaaagcaaacaatgtagacattgtttacacaccctggcaaaacctgaagaaaaccgcttctatggatgttgggcaagttggtttctacagctcaaaagcggttcgtactgtgagagtggaaaagcgaataaatgagatagttaaccggctaaacaagacaaaggttgagagacagccagatctaaaagctgaacgtgaggcagttaatgcagctgaaaaggcagaaaagaagcagcaaatgagagttaaaaaacggcatgaagatttggaaaagctcgaaaaagataaacaggctgagttaaggagctacaaaaacttgatggtggcggataagatgacgtctaacaaggacattgcttcaacccacaagtctttgcaggaaatggaagaggacttcatgtgaatcgaaaataattcaaagaagtcgtcaaggttcagccatagcccagagtatgaaaattatgcgttcctctaggaaaagaagagggtcgaaaatgaagataacaaattgatttcgtgaagctataaatatgtcggccagcttagaattgtcaaattgtcactcttgaagctatcgagtttgttaataaatatcgtgatcacttgaaatatgttttgtatttaaattggatgatgacgataaacatttgtctctgctttatttgtgtcgatttgcgatttagatcaacattt

SEQ ID NO: 2680 - DNA, 938 bp, Brassica napus
gtcgaatcttgtaggggaggataaggaagtgagagagagagggggaaacccaaaccctattttcgatatctattcgtgtctcaatcgaagcgatggtgttctacttcaaggcacgaccagatgctggggactacaccatcttcatggggctcgataagttcgagaacgaggagctcatcaagtacggcttccccgaagacgtctggtttcacgttgataagatgtcgtcagctcacgtttacttgaggctgcataaaggccaaggctttgatgacattagtgaaggtgtgctggaggattgtgctcagcttgtgaaagctaattccattcaaggcaataaggtgaacaacgtcgatgttgtgtacactccgtggtccaacttgaagaagactgcctccatggatgttggtcaagttggcttccacaattcaaagatggtccggactatcagagtggagaagcgagttaatgacataattaacaggttgaacaaaacaaaagttgagagaacccctgatctgagagccgagagggaagcagtgaatgctgctgaaagagctgagaggaaagaacacctgagggagaagaagaaacgtgaagatatagagaggctggagaaggagaggcaagcagacatgaggagttacaagggattaatggtaactgacaagatgacatccaacaaagacattgcttcaagcaacaagtctattcaagagctcgaagatgatttcatgtaaaagatccctgaagaaatgagagaaaacaagtcggtaacgttctgctggtgctgtccttcaaagaaggtttatcaagttcttctattagccttaagagttataatgatgatgaattgcccttttgtttcaaaaagtcttcagaggattgaatctgagttgtgagaaaaacagagagcattatgatatatataacgcagg

SEQ ID NO: 2681 - DNA, 1092 bp, Brassica napus
gatctcgagtggttacgattctttcattgtcgaatcttgcaggggagatagggaagtgagagagggggaaaccctgccctattttcgatctctattcgtttctcaatcgaagcgatggtgttctacttcaaggcacgaccagatgccggggactacaccatcttcatggggctcgataagttcgagaacgaggagctcatcaagtacggcttccccgaagacgtctggtttcacgttgataagatgtcgtcagctcacgtttacttgaggctgcataaaggccaaggctttgatgacattagtgaaggtgtgctcgaggactgtgctcagcttgtgaaagctaattccattcaaggcaacaaggtgaacaacgtcgatgttgtttacactccttggtccaacttgaagaagaccgcctccatggatgttggtcaagttggcttccacaattcaaagatggtccggactatccgagtggagaagcgagtcaatgacataattaacaggctgaacaaaacaaaagttgagaaaacccctgatctgagagctgagagggaagcagtgaatgctgctgaaagagctgagaggaaacaacacctgagggagaagaagaaacgtgaagatatagagaggctggagaaggagaggcaagcagacatgaggagttacaagggattaatggtaactgataaaatgacatccaacaaagacattgcttcaagcaacaagtctcttcaagaactcgaagatgatttcatgtaaaagagccctgaagaaatgagaagaaaaaaacccaagtcagtaacattctgccggtgctgtccttcagagaaggtttatcatgttcttctattagccttaagagttataatgatgatgaattgcccttttgtttcaaaaagtttttataagagttgaaatgtttcagaggattgaatcttgagttgtgagaaaaacagagagcataatgatatatgtaacacaggtgagctagcgagctggtgcgatcatggtttactctacctaacctgctgtgtgtttgtggaaaatcattttaccaccctaatagtttttactttttattcttttgat

SEQ ID NO: 2682 - DNA, 963 bp, Raphanus sativus
  misc_feature (790)..(790): n is a, c, g, or t
ggatattctctagagtggttacgttttcttcattgtttgcaacttgtcagggaagagaggaggggagagagagggggaaaccctagattccgtttgctccgtctctctctgaatcgaaggcgatggtgttctacttcaaggcacgaccagatgctggagactacaccatcttcatggggcttgacaagttcgagaacgaggagctcatcaagtacggcttccccgaagacgtctggtttcacgttgacaaaatgtcctcagctcatgtttacttaaggcttcataaaggccaaggttttgataacattaacgaaggtgtgctggaggactgtgctcagcttgtgaaagctaactccattcaaggcaacaaggtgaacaacgttgatgttgtgtacaccccgtggtccaacttgaagaaaaccgcctccatggatgttggtcaagttggtttccacaattcaaagatggtccggactatcagagtggagaaacgagtcaatgatattgttaacaggttgaacaaaacaaaggttgagagaacccctgatctgagagccgagagagaagcagtgaacgctgcagaaagagctgagaggaagcagcatctcagggagaagaagaaacgtgaagagatagagaggctggagaaggagaggcaagcagagatgaggagttacaagggactgatggtaactgataaaatgacatccaacaaagacattgcttcaagcaacaaatcgcttcaagaactcgaagacgatttcatgtaaaactctgatttggttcttanagactctttcgtcccattgaaatgtttcagaggattgagtctttgagttgtgagaaaaaaacaagagagcatttactcaggtgagagccattgatttgtttgcgatcatggtttactctgccttgctgtgtttgttgaaaatcattttaccactcttatattttacattttac

SEQ ID NO: 2683 - DNA, 1026 bp, Triphysaria pusilla
attctatttcgtgcaaaataagagagaagagaaattaggggaaaattaaaatcgaaaccctagagagagagaacaaagtagagagaagatggtgttctacttcaaggcgagacctgaggcgggtgactacactattttcatgggcctagacaagtatgaaaacgaggagcttatcaaatatggcttccccgaagatatttggtttcatgtggataaaatgtcttcggcccatgtttatgtgagattgcacaagggtcaaaccattgatgatatatctgaagatgtattggaagattgtgcacaacttgttaaagcaaattctatccaaggaaacaaagcaaataatgtagatattgtttacacaccctggcaaaacctgaagaaaaccgcttctatggatgttgggcaagttggtttctacagctcaaaagcggttcgtactgtgagagtggaaaagcgaataaatgagatagttaaccggctaaacaagacaaaggttgagagacagccagatctaaaagctgaacgtgaggcagttaatgcagctgaaaaggcagaaaagaagcagcagatgagagttaaaaaacgccatgaagatttggaaaagctcgagaaagataaacaggccgagttaaggagctacaaaaacttgatggtggcggataagatgacgtctaacaaggacattgcttcaacccacaaatctttgcaggaaatggaagaggacttcatgtgaatccaaaataattcaagaaagtggtcaagtttcagccgcagcccagagtatgaaaattatgcttgcctctaggaaaagaaaagagggtcgaaaatgaagataacaaattgatttcactgcgttgtgaagctataaatatgtcggccagcttagaattgtcaaattgtcagtcttgaagctctcaaaattattaataaatatcgtgatcacttgaaatatgttttgtattgaaattggatgatgactttgtgatttgtctctgctttgtttgtttggtttgatttgattac

SEQ ID NO: 2684 - DNA, 1018 bp, Triphysaria pusilla
gtgcaaaataggagagaagagaaattaggggaaaattaaaatcgaaaccctagagagatagagagcagagtatggagaagatggtgttctacttcaaggcgagacctgaggctggtgactacactattttcatgggcctagacaagtatgaaaacgaggagcttatcaaatatggcttccccgaagatatttggtttcatgtggataaaatgtcttcggcccatgtttatgtgagattgcacaagggtcaaaccattgatgatatatctgaagatgtattggaagattgtgcacaacttgttaaagcaaattctatccaaggaaacaaagcaaataatgtagatattgtttacacaccctggcaaaatctgaagaaaactgcttctatggatgttgggcaagttggtttctacagctcaaaagcggtccgtactgtgagagtggaaaagagaataaatgagatagttaaccggctaaacaagacaaaggttgagaggcagccagatctaaaagctgaacgtgaggcagttaatgcagctgaaaaggcagaaaagaagcagcagatgagagttaaaaaacgccatgaagatttggaaaagctcgagaaagataaacaggccgagttaaggagctacaaaaacttgatggtggcggataagatgacgtctaacaaggacattgcttcaacccacaaatctttgcaggaaatggaagaggacttcatgtgaatccaaaataattcaagaaagtggtcaagtttcagccgcagcccagagtatgaaaattatgcttgcctctaggaaaagaaaagagggtcgaaaatgaagataacaaattgatttcactgcgttgtgaagctataaatatgtcggccagcttagaattgtcaaattgtcagtcttgaagctctcaaaattattaataaatatcgtgatcacttgaaatatgttttgtattgaaattggatgatgactttgtgatttgtctctgctttgtttgtttggtttgatttgattac

SEQ ID NO: 2685 - DNA, 1248 bp, Manihot esculenta
gtcgtgagcgctccgaattccaaaagtgttgtcgttttgacggagacggtcggctgtagctcgaccgaacagcctctggattacgcttagggttgtccaattcggctttacttcgactcttgaaaagagaaaatccaacgaaacagcaaacagagattgtgaatattgattttgaagaggaatcagaggaagaagaggtatagaaggtgaagaaattcaaaatggttttctatttcaaagcccgtccagaagtaggagattacaccatttttatgggtcttgacaagtacgagaacgaggagcttatcaaatacggtttccctgaagatatttggttccatgtggacaaaatgtcttctgctcatgtttatctacgattgcgcaaaggacagactattgacgatataactgaaggtttactggaggactgtgctcagcttgtcaaggcaaattcaattcaaggcaaaatttcgaaatttttttatcatttttatggcaacaaggtgaataatatcgaggttgtttacactccttggtccaatttaaagaaaactgcttccatggatgttggccaagtcagcttccacaatccaaagatggttcgaactgtgagagtggagaagcggataaatgaggtagttaatagattgaataaaacaaaagtggaaagaaacactgatttgaaagctgagaaggaagcagtcaatgcagcagaaagagcagagagaaaacttcaactaagggataaaaaacgacaggaggaaatggaaaggcttgagaaggagagacaagcagagataaggagctacaaaggtttgatggtttccgaaaagatgacatctaataagcagattgcagctgacaacaagtccttacaggaactggaagatgacttcatgtaagcacagttttatttaactgttaataccaagcttgctgcctctcaagacaagaagtttccctcctccaaataaatcgcctcagtttcatgcatgttcattctatgatattgttaaggaaagatccgaaagatatgtcgaacaccgagcattaggcagaggatgaggtagagggattaactttctttatagtgaccttaaattgtaattgggtgatgatgatgaagaaaattgtaattgcatgatgatgataaagatgatcaagacttgcattgatgattatgtgatcattgtttttggcggaaataacctttttacctaatgtttatacatatttgcattttaattc

SEQ ID NO: 2686 - DNA, 1367 bp, Panax ginseng
aagcagtggtatcaacgcagagtacatggggcaaacagagcatagtaagatgcggaaagtacggttttaatttttaacagaaattgaaaaccctaatttgtatttcttcttcttctactactttgtgtgtgtggttgggatttgggagggcgtgaaaaatggtgttctacttcaaagcccgcccggaagccggagactacaccattttcatgggtctcgacaagcacgagaacgaagagctcatcaaatacggctttcccgaagacatttggttccatgttgataaaatgtcttcggcccatgtttatgtgagattacacaagggtcagactgttgatgatatatcagaaggtctactggaagattgtgctcagctagtcaaagcaaattccatacaaggaaacaaggtgaacaatatcgatgttgtatacactccctggcaaaatttgaagaagactgcttctatggatgttggccaagttggttttcacaatccaaaaatggtccgcactgtcagagtagagaaacggattaatgaggtagttaatagattaaacaagacaaaagtggaaaggacacctgatttgaaagctgagcgcgagtcagttaatgcagcagaacgagcagaaaggaaacaactgctgagagataaaaaacgaagggaggagttagagaggctggaaaaggagagacaagcggagcttaggagctacaagaatttaatggtagctgacaagaactggaagaggatttcatgtagaaaaaaataaattaaattgaatatttcccatactttatcccttgttgccaaatttgggaaaccgccaaaaaatggaaaggaagaaagacaaaaaaagataaattttttttggtttttggggggttttggggtttgggtttggttacgttagttagtagtagttagttagtttaagttagttagtaagttaagtacgtagttacttactttactttaacttaattacgtactaacgactaacgaaccctaacctaaaccgtaacgttaaccgtttacggttaacggtacggtaaacggtaaacgggtaaacggtaaccggtttaacggtttaccggtttttaccggtttaaccggttttttaacggtttttaaaggtttaaacggttaaagggtttaaaggtttaagggttaagtttaaccggtaaggtttaaggttaaggtttaagggtaagtttaaggttaagttaaagtttaagtttaaggtttaacccggtttaaaggttttaaaacgttttaacgtttttagggtttttacgggtacgtttaacgtaacggttaggttacgtagtagttattaagttaagtaagtagtattcgttagttaacg

SEQ ID NO: 2687 - DNA, 847 bp, Lippia dulcis
ataatctgtaactcagagagagagagaatggtgttctacttcaaggcgcgaccggaggcaggagaatatactatcttcatgggtttagacaaatatgagaacgaggaccttatcaaatttggcttgcccgaagatatttggttccatgtggacaagatgtcttcggcccatgtttatctcagactaccaaaaggtcagaccattgatgacatacccgagagtgtactggaagattgtgcgcagctagttaaagcaaattccatccagggaaataaagtaaacaatattagcattgtctacaccccctggcaaaaccttaagaagactgcttctatggaagtcggccaagttggtttctacaatcaaacaatggttcgaaccatgaaagtggagaaacgaatcaatgagatagttaacaggttaaacaaaacaaaggttgaaagaaagccagatctaaaagctgaacgagaggctgtcaatgcatccgaaatagcagaaaggaagcatcagctgagagataaaaaacgtacgagatgagcttgaaaagctcgagaaagagagacaggctgagctgagaagctacaagaatttgatggttgcggagaagatgacatccaacaaggacacagcatcagccagcaaatccgtacaggaaatcgaagacgatttcatgtgatattgataacgtttttgcaatgtaaatacccaagtcatatatactatttatcttcttctaggcccaactttgctaaataaatgtatactatgaaactatcatcgattatgttgatatgtaagtatagagaacatgtattaactctagaaattgcttttgctacaaaaagaa

SEQ ID NO: 2688 - DNA, 1330 bp, Abies balsamea
ttgtcccctccacaccgaaaggtaaattctctccgtaatgagagcccctacgaaatcaacaaccataatcggtagaaggcaaggatgcccctcggttattactgttccggaacacatttgggtggtgagggtagccatcttttcatctcctatatcttgaggaatactccgatccttcagtaaacgattattttgaggagaggttaaggcatccggcctctgtccctcctttgggtgttcccaaatttctccgggtgaggaagagaggtctttggattcaggctggttgattgtatccgtgggcagttgggctttcggcaggcaggatggtgttctacttcaaggccacgccggaggctggagattacaccatctacatgggccttgataagttcgaaaacgaagaacttatcagatatggtattcctgaggatatctggtttcatgtggataagttgtcttcagcacacgtttatttgagaatgcgcaagggtcagacaatagacgatatcagtcaaccagtcttggatgattgtgcacaactagtgaaggcaaactctattcaaggaaacaaactcaataacgttgacgttgtgtacaccccttggtcaaatttaagaaagacttcttctatggatgttgggcaagttggcttccataaccccaagcttgttcgaactgtaagagtagagaagcgaatcaatgaaattgtgaatcgcttgaataaaacaaaagttgagcggaaacctgatttgaaagctgagcgagaagcaatgaatgctgccgagagagcacaaataaaggctcaaggaagggaaaagaaacgacgtgaggaactagagcgccttgagaaagagaggcaggcagaaataagaagctacaaaggtttcatggttgcagaaaaaatgacttctaataaggatattgcatcaggtagcaaatctgctcaagaaattgaggatgatttcatgtgatgatgctaaagaggaagaagcataagctacataggatgatgctacatgtagctcattttatggtagtctgcgcatggtattctggataattgtaccaagtgattagagatttgatagctcatatccatttttgagtgccatccacaaagcatctatagtagtctctgctggttgcaattcttccccgcagagatgcatggttgcagtttatgaatgttctggagaatctgttttggagatccttcataattttctcttggcatgtcctttatatgttatagtttactagtaatctcatgaatgatgaactacaaaaatttgcctggggcgatctccacaggaacatgatccagagc

SEQ ID NO: 2689 - DNA, 1116 bp, Cedrus atlantica
ttcggcccctatccctcatttgggtgtttctaaaattctccggggaaggaagagaggtctttggatccaggcttcttgattgtatctgtgggcagttgggctttcagcaggcgacatggtattctacttcaaggccacaccagaggctggagattacactatctacatgggcattgataagtttgaaaatgaagaacttatcagatacggtattcctgaggacatctggtttcatgtggataagttatcttcagcacacgtttatttgagaatgcacaagggtcagacaatagacgatattagtccagcagtcttggatgattgtgcacaactagtgaaggcgaactctattcaaggaaacaaactcaataatattgacgttgtgtacaccccttggtcaaatttaagaaagacttcttccatggatgttgggcaagttggctttcataaccccaagcttgttcgaactataagagtagagaagagaatcaatgaaattgtgaatcgtttgaataaaacaaaagttgagcggaaacctgatttgaaagctgagcgagaagcaataaatgctgcagagagagcacaaataaaagctcaagggagggaaaagaaacgacgtgaggaattggagcgccttgagaaagagaggcaggcagaaataagaagctacaaaggcttcatggttgcagaaaaaaagacttctaacaaggatgttgcatcaggtagcaagtctgctcaagaaatcgaggatgatttcatgtgatgatgccaaagaggaagaagcataaacagttacacgtagctcattttatggtagtctgcacatggtattctgcaaaattgtctcaagtaattacagatctgatatagctcatatccattttgagtgccatccacaaggcatcttatagtagtctctgctggttgcaattcttccccacaggggcgcagggttgcagtttatgaatgttctagagaatctgtgaaggagatccttgataatttttgcttggcaggtcctttatatgttctagtttactagtaatctcatgaatgatgaactacaaaaatttgcctggggcaatctccacaggaacatgatccagagccttcttt

SEQ ID NO: 2690 - DNA, 1112 bp, Pseudotsuga menziesii
ttttccgggggtggaagagagatctttgtatccaggctgcttgattgtatccgttggtagtgttgggatttcggcaggcaagatggtattctacttcaaggccacgccagaggctggcgattacaccatctatatgggcattgataagttcgaaaatgaagaacttatcagatacggtattcctgaggatatctggtttcatgtggataagcactcttcagcacacgtttatttgagaatgcacaagggtcagacaatagatgatattaatccgccagtcctggatgattgtgcacagctagtgaaggcgaactctattcaaggaaacaaactcaataacattgacgttgtgtataccccttggtcaaatttaagaaagacttcttctatggatgttgggcaagttggcttccataaccccaagcttgttcgaactataagagtagagaagcgagtcaatgaaattgtgaatcgcctgaataaaacaaaagttgagcggaaacctgatttgaaagctgagcgagaagctataaatgctgcagagagagcacaaataaaagctcaagggagggaaaagaaacgccgtgaggaactggagcgccttgagaaagagaggcaggcagaaataagaagctataaaggcttcatggtcgcagaaaaaatgacttctaataaggatattgcatcgggtagcaagtctgctcaagaaattgaggatgatttcatgtgatgatgccagaaggaagaagcataaacagttacatgtagctcattttatggtagtctgtgcatggtattctagataattttctccaagtaattagagatttgatatagctcatatccatttttgagtgccatccacagggcatctatctatagtagtctctgctggttgcaattcttgcctgcagagatgcatcgttgcagtttatgaatgttctagagaatctgtcaaggagatccctaattttttttctcttggcaggtcctttataagttctagtttactagtaatctcatgaatgatgaactacaaaaatttgcctggggtagttttcacaggaacatgatccagagacttctttctttgtttcagtggcattcttttt

SEQ ID NO: 2691 - DNA, 1031 bp, Lotus japonicus
gcagcactccatggtgtctactcaaagctcgcctgaagctggcgatttcaccatcttcatgggtctgacaagtatgagaatgaagagctcatcaaatacggttttctgaagacatctggttccatgttgataagatgtcttcggcccatgtctatgttaggctgcacaaaggtcagactatcgatgacatgagcgaaggtttactggaagactgtgctcagcttgtcaaagcaaattcaattcaaggaaataaagtgaacaatgttgatgttgtttacactccttggtctaatttgaagaagactgcttcaatggatgttggtcaagttggtttttataactcaaaaatggttcgaactgttagagtggagaagaggataaatgagattgttaacaggctaaacaagacaaaggtggaaagaactcctgatttgaaggctgaacgagaagcagttaatgcagctgaaagagcagagagaaagcaacacctgagagaaaaaagctctgtgcagaagcgccgtgaggaaatggaaagacttgaaaaggagagacaatcagagcttaggagctacaagggcttgatggttgcagaaaatatgacatccaacaaagacattgcatctggaagcaaatcactgcaggaactagaggaggattttatgtaagcactgatcattggattacaggcagatgactgagttcagcttgctgccatgcggatttatgatgatgaaactgcatttgtcttggttaaggatgaaggagtgtgtgcacaactgtgattgagggatgaaggagaagggaagaaaaccctggggggtataatattgtttttgtacctgatgatagaaatgagaccatgagttttacattaatgttctcactgttgagtgttgagtcaaaaactcaagtttcttgctatgattatcacaaaagtcctgttaaccttgttcggtttatagttttattttccttttggaattcgatgttaactgcatttgattactggggaattatgaggtgttcttggt

SEQ ID NO: 2692 - DNA, 1152 bp, Arachis hypogaea
ggtatcaacgcagagtacggggggtgaaagattcagagaaccctagcacgcaataaaaaccatcgagactttccctcttctctctctttctctggtgtgtgcgttgcgttgagatagcgtgagaagaaagcaggttccgttccgatggttttctacttcaaggcacacgccctgaagctggcgattacaccatcttcatgggtctcgacaagtacgagaacgaagaactcatcaaatatggtttccctgaagatatctggttccatgttgataagatgtcttcagcacatgtttatgtaagactgcacaaaggtcagactattgatgacattagtgaaggtttactggaggactgtgctcagcttgttaaagcaaattcgattcaaggaaataaggtgaacaatattgatgttgtttatactccctgggccaatttaaagaaaactgcttcaatggatgttggtcaagttggtttccacaaccccaaaatggtccgaactgtgagagtggagaagcggatcaatgagattgtcaacaggctaaacaaaacaaaagtggaaaggaaacctgatttgagagctgagcgtgaagcagttaatgcagctgaaagagctgagagaaagcaacaaatgagagacaagaaacgccgtgaggaattggaaagacttgaaaaggagagacaagccgaactgaggagctacaagggtttgatggttgcagagaatatgacatccaataagaacattgcatcaggaagcaaaacactgcaagaaatggaggatgatttcatgtaagctttagctattggattatatgcaagatggttggtggccaacaatgctacctggtgaattaaattgactaaataacccaagtcctggaatttgaaatttcagtgtcttcattaagaaaccaagtagtgtgtacaattgtgtttgggggataatttaaatcgagagctggaacagaagacagaagagagtggaaaaaagggagaaagaaaaagaagagaagtgggggactgggggagggggtttcttatagtgatgattggtttttgtacttggtaatggaaatatacttactttatagcattgcttgatagttgagacaatggttttcaaactaatgttctcacagttgagtcaaaag

SEQ ID NO: 2693 - DNA, 1479 bp, Pinus pinaster
acttttggtggtgacaggagccatcttctcatctcctatatcttgaggaatgctctgctcgttcaacaaacgattatctatcgtttctccatatttcgaggagcggtgaaggcactccgcttctgttccagcgtaccctcaaaattatcagcgggaggaaaaaaggcctttgattcaggctgcttgattgtatcttgtgggcagttgggctttcggcaggcaagatggtactctatttcaaggccacgccagaggctggtgattacaccatctacatgggcattgataagttcgaaaatgaagaactcatcagatacggtattcctgaggatatctggtttcacgtggataagctatcctcagcacacgtttatttgagaatgcacaagggtcagacaatagacaatattagtcaaccagtcttggatgattgtgcacagctagtgaaggcaaactctattcaaggaaacaaactcaataacattgacattgtgtacaccccttggtcaaatttaagaaagacttcttctatggatgttgggcaagttggcttccataaccccaagcttgttcgaactataagagtagagaagcgaatcaatgaaattgtgaatcgcttgaacaaaacaaaagttgagcgaaaacctgatttgaaagctgaacgagaagctataaatgccgcagagagagcacaaataaaagctcaagggagggaaaagaaacggcgcgaggaactcgagcgccttgagaaagagaggcaagcagaaataagaagctataaaggctttatggttgcagaaaaaatgacttctaacaaggatattgcatctggtagcaagtccgctcaagaagtcgaggatgatttcatgtgatgatgcaagaaggaagacacataaacagtttacatgtagctttctattatggtagtctgcacatggtattctagatatgtgtctccaagtaattagagatctgatatagttcatatcaatttttgagtgccatcgacagggcatctatagtcgtttctgctggttgcaattcttgactgcagtgatgcatagttgcagtttatgaatgttcaagagaaactgttaaggagatccctaaatgttttctcttggcaggttgatgaactacaaaaatttgcctgggacaatctccagaggaatatgttccagagacttgtttctttgattcagtggcattcttttttctttgaaagtgattcattagtatgcacaaaggtaatactaactgaatgggtagataaactgtgttatcttgtgatattgtctgtgttataagatcccttctcaagttaaagacaggatcttgttttggttgttccgttgctccctaggtacaagcgctcaagttatttatttgttatttgtgaatgacaaataattgatgtgtttaagataactggctccaaagataataatgtggaggctaaaatttcctaatttacgatac

SEQ ID NO: 2694 - DNA, 1649 bp, Picea glauca
cgggggatcgtaggttagtccttcaaaccccctcctttttttaaattgcacgatatgtacaatgttgtgatgtttttttctgaagctaccatgattctaaatccgactttaagttgacctatcttattctcgaatatattcatcccaatctttcgagaaattgatcatacgatcttgtggtttgtcccctccacaccgaaaggtaaattctctccgtaatgagagcccctacgaaatcaaccaccagggagaaggctaggatgcccatgagggattactgttcctaaaagacttttgggtggtgaaaggagccatctcttcatcctctatatcaatactccgatcctgtgagcaaaaccattatctatcgtctctccatattttgagcggcgaaggcgttccgcctctgttcctcacttgggtgcccccaaaattctctggcggaggaagagaggtctcttattcaggctgcttgattgtatctgtgggcagttgggctttcgacaggcaagatggtattctacttcaaggccacgccggaggttggtgattacaccatctacatgggcattgataagttcgaaaatgaagaacttatcagatacggtattcctgaggatatctggtttcacgtggataagttgtcttcagcacacgtttatttgagaatgcataagggtcagacaatagacaatattagtcaaccagtcttggatgattgtgcacagctagtgaaggcgaattctattcaaggaaacaaaatcaataacattgacgttgtgtacaccccttggtcaaatttaagaaagacctcttctatggatgttgggcaagttggcttccataaccccaagcttgttcgaactataagagtagagaagcgaatcaatgaagttgtgaatcgcttgaacaaaacaaaagttgagcggaaacctgatttgaaagctgagcgagaagctataaatgctgcagagagagcacaaataaaagctcaagggagggaaaagaaacgacgcgaggaactggagcgccttgagaaagagaggcaggcagaaataagaagctataaaggatttatggttgcagaaaaaatgacttctaataaggatattgcatcgggtagcaagtctgctcaagaaatagaggatgatttcatgtgatgatgtcagaaggaagaagcataaacagttacatgtagctcattttatggtagtctgcacatagtattctggataattgtctccaagttattagagatctgatatagctcatatccatttttgagtgccatccacagggcatctgtagtagtttctgctggttgcaattcttgcttgcagagatgcatggtttcagtttataaatgttctagagaagctgtcaaggagatccctaagaattttctcttggcaggtcgatgaactataaaactttgcctggggcaatctccacaggaacatgatccagagacttatttctttgattcagtggcattcttttttctttgaaagtgattcactaatatgcacaaaggtgataatagtaactgaatgggtagataaactgcatgttatgttgtgatattgtctgtgttataagatcctctctcaagttaaaggcaggatctcgttttggttccttcctttgct

SEQ ID NO: 2695 - DNA, 636 bp, Chelidonium majus
ctcgaccagaggtaggagatttcaccatctttatgggtttggacaagcacgaaaatgaagagctcatcaaatatggattccctgaagatatctggtttcatgtggataaaatgtcatcagctcatgtttatgtcagactgaacaaggggcagactatagatgatataagtgaaggcttactagaagattgtgctcagcttgtaaaagcaaattctatccaaggcaacaaggtgaataatgtggatgttgtttataccccctggtacaatttgaagaaaactgcttctatggatgttggccaagttggttttcacaatcctaagatggttcgcactgtaagagtcgaaagacgaataaatgaagtagttaatagattgaacaagtccaaggtggaaaggaagccagatttaaaagctgagcgagaggcggttaatgcggctgaaagggcagagagaaaactccagctgagagacaagaaacgacgcgaggaaatggagaggcttgacaaggagagacaggcagagataaggagctacaaaggtctcatggtctcggagaagatgacctctaacaagcagattgcatcaggcaaacaaatccttgcaggaactggaagaggatttcatgtgaggcagc

SEQ ID NO: 2696 - DNA, 788 bp, Heritiera littoralis
cactaattttgtctctggtcacccaagagaggaacgggcaaaaaaaaaataggtgttttactttcaaagacccgacccagaggttggcgattacaccatcttcatgggtctcgacaagtacgagaacgaggagcttattaaatacggcttcctcgaagacatttggttccatgtggataaaatgtcttctgcgcatgtttatttaagacttcagaaaggtcaaaccatcgatgatataagcgaaggtttacttgaagattgtgctcagcttgttaaagctaattccatccaaggcaacaaagtgaacaatattgatgttgtatacactccatggtccaatttgaagaaaactccttccatggatgttggccaagtcggctttcacaattccaagatggtccggactgtgagagtggagaagcggataaatgagacagtcaacaggttgaacaggactaaagtggaaaggaaacctgatttgaaagctgagagagaagcagttaatgcagcagaaagagctgagagaaagcaacagctgagggaaaaaaaacgacgtgaggaactggaaaggcttgaaaaggaaagacaagcagagataagaagctacaagggtctcatggtctctgaaaagatgacatctaacaaacaaattgcaacgacaagcaagtctttgcaggaacttgaagaggattttatgtgaaacatattggtatttcaatgccaattaagatgctgctagctgccaaaaacctgctgcccgtcaaggaagggtgtttattgttactttt

SEQ ID NO: 2697 - DNA, 1602 bp, Pinus taeda
gatatgatcctgtggtttgtcccctccccaccgaaaggtaaattcttcccgtaatgagagcccctacgaaatcaaccatcataatcggtcgaagggtgggatgcctatgaggtctaactgttcctaaaataccttttgggtggtgacaggagccatcttctgatcccctatatcttgaggaatgctctgctcgttgaacaaacgattatctatcgtttctccatatttcgaggagcggtgaaggcactccgcttctgtcccagcgcaccctcaaaattatccgcgggaggaaaaaaggtctttcattcaggctgcttgattgtatcttgtgggcagttgggctttcggcaggcaagatggtactctatttcaaggccacgccagaggctggtgattacaccatctacatgggcattgataagttcgaaaacgaagaactcatcagatacggtattcctgaggatatctggtttcacgtggataagctatcctcggcacacgtttatttgagaatgcacaagggtcagacaatagacgctattagtcaaccagtcttggatgattgtgcacagctagtgaaggcgaactctattcaaggaaacaaactcaataacgttgacattgtgtacaccccttggtcaaatttaagaaagacttcttctatggatgttgggcaagttggcttccataaccccaagcttgttcgaactataagagtagagaagcgaatcaatgaaattgtgaatcgcttgaacaaaacaaaagttgagcggaaacctgatttgaaagctgagcgagaagctataaatgctgcagagagagcacaaataaaagctcaagggagggaaaagaaacggcgcgaagaactcgagcgccttgagaaagagaggcaagcagaaataagaagctataaaggctttatggttgcagaaaaaatgacttctaacaaggatattgcatctggtagcaagtccgctcaagaagtcgaggatgatttcatgtgatgatgcaagaaggaagacacataaacagtttacatgtagctttttattatggtagtctgcacatggtattctagatatgtgtctccaagtaattagagatctgatatagttcatatccatttttgagtgccatcgacagggcatctatagtcgtttctgctggttgcaattcttgactgcagtgatgcgtggttgcagtttatgaatgttcaagagaaactgttaaggagatccctaaatgttttctcttggcaggttgatgaactacaaaaatttgcctgggacaatctccagaggaatatgttccagagacttgtttctttgattcagtggcattcttttttctttgaaagtgattcattagtatgcgcaaaggtattagtaactgaatgggtagataaactgtgtcatcttgtgatattgtctgtgttataagatcccttctcaagttaaagacaggatcttgttttcgttgtttcctttgctccctaggaacaagtgctcaagttatttatttgttatttgtgaatgacaaataattgatgtgtttaagataactggctccaaagataataacgtgcagactaaaatgtcctaa

SEQ ID NO: 2698 - DNA, 1084 bp, Pteridium aquilinum
tatatacaggaaatctgcattagtgggctgttagtataaatcgattgtgtgtggatttctgtcaccgttgttgttgtagatcacctctctctgtgtgtgggtgttgtttgtgtgcgaaggtgcttttcttctgcggtgttgggcacagagaggcgtcccagaatggtgtactacttcaaggctcgacctgaggtgggcgattatgtgatctacatgggcctggacaagtacgagaacgaggatctcatcaagtacggcatccccgaagatgtctggttccatgtggacaagttatcatcagcacatgtctacgtgaggctgcacaagggccaatcaatagagaacatcagtccagagcttttagaggactgtgtgcagctcgttaaagccaactcaattcaaggtaacaaattgaacaatttggatgttgtttatacaccttggtcaaacctgcggaagactgctgctatggatgttggccaagttggttttcacaatcccaaaaatgtgaaaactgtgagggttgagaagcgcataaatgaagtagtcaacaggctcaacaaaacgaaggtggaacggacacctgatttgaaagctgagagagagtcatacaacgctgcagagagggctgaaagaaaagccttcttaagggacaagaagcggagagaagagatggcacgaatagagaaggataagcaggctgaaataagaagctataaaggactgatggtatcagaaaagatgacttcaaacaaggatttggcttcgaaaggaaaatccctacaggaattggaggatgacttcatgtgactggtatctagatagaaagaaaatttaagagcatatggcagtcatgaaattaagcattctctacgtgttatgagcttcataagatggtgggctcagctaggtgcatagaggctcaagaggcaatatcattttattaaagttccagaggattctggcttaactttttgagtcatggctgattgctttgtatgaatgcattctttgctattttcaatattatttatgtattgttgagaagttgcatgccgtaaatacaaaagtagtaccatgctta

SEQ ID NO: 2699 - DNA, 737 bp, Sorghum bicolor
cggcacctccgcgatcgcgtataaattggacggggccgggttcggcacggaaagcacacagcagccgtctagctttttctggaaacaacatacctttccccatctagctccgcgctcggacaacttctgcaagcagagccatggctctcgagaaggccaaggagatcgtcgcttcctcccccgtcgtcgtcttcagcaaaacttactgtcctttctgcgcccgagtgaagcaattgttagcacagctgggtgcaagttacaaggccattgagttggatgtggaaagtgatggcgctgatctgcaatcagctctcgctgaatggaccggtcagaaaactgttcccaatgtctttgtgaaaggggagcgtattggtggctgcgacgcaaccatggcaatgcacgacggtgggaagctggtgcctctgctgaccgaggctggagcaattgtcactgccagtgccactgcaactaccactccgtctttgtagacatgttttacagtgtcattccgtttgcttcgtggctaatatatatatgttgtacggagtactaaactcatagatacagtaataaagatgaatacaacatttcttcatgttgactgtattttaagctgttcatttttttttctttctgttgagcctctctgtaactctgtatacacttcttcatcctctggactgcgagctcaatgtgtatgcctctcaatttcgtgtcagtgaattgtgccgtgtgag

SEQ ID NO: 2700 - DNA, 1017 bp, Sorghum bicolor
atcgtgtatgtgtatctagaatggtccatccgtcgcgacttggacgagaggaaaagaagacgagccacaatttgaccttctggtcgtgcgttagtgcgctcgtggcatggcttagccatagcgtgcacggtgcgtcaacgcggcagccggctgccgggcaaaagaaaagaaaattctccagttgccgtccggttcccacggcaaatcggcacctccgcgatcgcgtataaattggacggggccgggttcggcacggaaagcacacagcagccgtctagctttttctggaaacaacatacctttccccatctagctccgcgctcggacaacttctgcaagcagagccatggctctcgagaaggccaaggagatcgtcgcttcctcccccgtcgtcgtcttcagcaaaacttactgtcctttctgcgcccgagtgaagcaattgttagcacagctgggtgcaagttacaaggccattgagttggatgtggaaagtgatggcgctgatctgcaatcagctctcgctgaatggaccggtcagaaaactgttcccaatgtctttgtgaaaggggagcgtattggtggctgcgacgcaaccatggcaatgcacgacggtgggaagctggtgcctctgctgaccgaggctggagcaattgtcactgccagtgccactgcaactaccactccgtctttgtagacatgttttacagtgtcattccgtttgcttcgtggctaatatatatatgttgtacggagtactaaactcatagatacagtaataaagatgaatacaacatttcttcatgttgactgtattttaagctgttcatttttttttctttctgttgagcctctctgtaactctgtatacacttcttcatcctctggactgcgagctcaatgtgtatgcctctcaatttcgtgtcagtgaattgtgccgtgtgaggccttgtttacttccacccaaaaatccaaaatttttcattggttgaaattgatgagacaaatattttgagccta

SEQ ID NO: 2701 - DNA, 1947 bp, Sorghum bicolor
accccccacgccagccggacccacttcccgatggcgggccccagatgtcatgcgctgtacgggcgagcaactcgccccacctcttctccaaaggcaaaacccaacgcgtcccccaacaactcacacagtcacacactgccccaacctctccccacctccctccaccctgtcagtttcccgtcgtcgtcgccgccaccgccgccgcctctcctcctagtcctagtcccgcagcctcctccgtggggagctcccccctaccatacccgcagccattggaatttccgctccatgcgtggatcctcgtagatccccacccgcgtgcactcgaatcccgaggcggcggcggtctccgtcgcgaggctaggccagcgggccgcacccatggcgtccgtggcggagctcaaggagaagcacgccgccgcgacggcgtcggtcaactccctgcgcgagcgcctccgccagcgccgggagacgctcctcgacacggacgtggcgaggtactccaagtcgcaggggaggctgccggtgagcttcaacccgacggatctggtctgctgccgcacgctgcagggccatagcggaaaggtatattctctggattggacccctgaaaagaattggatagtcagtgcctctcaagatggaaggttaattgtgtggaatgcattgacaagccagaaaacgcatgccataaagctgcattgcccatgggtgatgacgtgtgcttttgcacccaatggacaatctgttgcctgtggtggtcttgatagcgcgtgctctattttcaatctcaactctcaagcagacagagatgggaacatgccagtatcaagaattcttactggacacaagggctatgtttcgtcatgccaatatgtcccagatcaggaaactcgccttattactagctccggtgatcagacatgtgttctttgggatgttactactggacagaggatctcaatatttggaggtgaatttccatcaggccatacagctgatgttcaaagtgtgtccatcaactcatcaaatacgaatatgtttgtctctggctcatgtgatacaactgtgaggctgtgggatatcagaattgcaagtcgagctgttcgaacctaccatggacatgagggcgacgttaacagtgtgaagttttttcctgatggccataggtttggtactggctcagatgatggcacatgtagattatttgatatgagaacagggcaccaacttcaggtgtacagtagggtgcctgatagaaatgatgatgaactacctactgttacatctattgcattttcgatatcaggaaggctactttttgctggttactccaatggtgactgttatgtgtgggacacacttcttgccgaggtggtacttaatttggggaatctgcaaaactcccatgatggtcgtataagttgccttgggatgtcatctgatgggagtgcattgtgtacagggagttgggacaaaaatttgaagatttgggccttcagtggacaccggaaaatagtttgaaggacaacttttctcccccatgttgtatgttccttgtcatgccttaacaatggacaatggtgatcagtgatcgactcagacttgttcctgggaatccccttcttgtttttgtagtatagaatcttgtgcactacgccctatgtttaatggaaaaaagtgcaatttgtcttggcgctacatcttgttgagttagtaactgtttatactgttattacaagaatatcagtaacgtgtgatctgccctttctttgtacaaccattttacttttcagatttagataagtagcatgtatattctggaatcagtttatcatatcagtttgcccatttgctgaattaggaacattagcttcccgtgacgtactatgcgttttgtgttagtaatgttgctttcttttcttaataagttaaagtcattatttg

SEQ ID NO: 2702 - DNA, 2067 bp, Sorghum bicolor
caacaactcacacagtcacacactgccccaacctctccccacctccctccaccctgtcagtttcccgtcgtcgtcgccgccaccgccgccgcctctcctcctagtcctagtcccgcagcctcctccgtggggagctcccccctaccatacccgcagccattggaatttccgctccatgcgtggatcctcgtagatccccacccgcgtgcactcgaatcccgaggcggcggcggtctccgtcgcgaggctaggccagcgggccgcacccatggcgtccgtggcggagctcaaggagaagcacgccgccgcgacggcgtcggtcaactccctgcgcgagcgcctccgccagcgccgggagacgctcctcgacacggacgtggcgaggtactccaagtcgcaggggaggctgccggtgagcttcaacccgacggatctggtctgctgccgcacgctgcagggccatagcggaaaggtatattctctggattggacccctgaaaagaattggatagtcagtgcctctcaagatggaaggttaattgtgtggaatgcattgacaagccagaaaacgcatgccataaagctgcattgcccatgggtgatgacgtgtgcttttgcacccaatggacaatctgttgcctgtggtggtcttgatagcgcgtgctctattttcaatctcaactctcaagcagacagagatgggaacatgccagtatcaagaattcttactggacacaagggctatgtttcgtcatgccaatatgtcccagatcaggaaactcgccttattactagctccggtgatcagacatgtgttctttgggatgttactactggacagaggatctcaatatttggaggtgaatttccatcaggccatacagctgatgttcaaagtgtgtccatcaactcatcaaatacgaatatgtttgtctctggctcatgtgatacaactgtgaggctgtgggatatcagaattgcaagtcgagctgttcgaacctaccatggacatgagggcgacgttaacagtgtgaagttttttcctgatggccataggtttggtactggctcagatgatggcacatgtagattatttgatatgagaacagggcaccaacttcaggtgtacagtagggtgcctgatagaaatgatgatgaactacctactgttacatctattgcattttcgatatcaggaaggctactttttgctggttactccaatggtgactgttatgtgtgggacacacttcttgccgaggtggtacttaatttggggaatctgcaaaactcccatgatggtcgtataagttgccttgggatgtcatctgatgggagtgcattgtgtacagggagttgggacaaaaatttgaagatttgggccttcagtggacaccggaaaatagtttgaaggacaacttttctcccccatgttgtatgttccttgtcatgccttaacaatggacaatggtgatcagtgatcgactcagacttgttcctgggaatccccttcttgtttttgtagtatagaatcttgtgcactacgccctatgtttaatggaaaaaagtgcaatttgtcttggcgctacatcttgttgagttagtaactgtttatactgttattacaagaatatcagtaacgtgtgatctgccctttctttgtacaaccattttacttttcagatttagataagtagcatgtatattctggaatcagtttatcatatcagtttgcccatttgctgaattaggaacattagcttcccgtgacgtactatgcgttttgtgttagtaatgttgctttcttttcttaataagttaaagtcattatttgtggattgggtcgagtcacatttttcatccatttattactatttgatatatccatttctaaggttacgtgtattcatttcttttggatattcttatttaaccagaatgtgtaggtatttgaacaaatagctggattcaaacattcaaattcatgtcctttattcggcggtgttcatatttgtattctgatccaacttgacagtatggataccagatgtgattaagtgcgccatc

SEQ ID NO: 2703 - DNA, 1735 bp, Setaria italica
tgaccccaccgccgccgcctcctcttcccttctcggcttctccccctgggagctcccggagctctgccttagccattggaaccgcgcccccgctctccatgcgcgcgtcctggtagatccccccacccccggccgtcgctcgagtccccggcgcaaacaggctagcgggcggcaccgatggcgtccgtggcggagctcaaggagaagcacgccgcggcgacggcgtcggtcaactccctccgcgagcgccttcgccagcgccgggagatgctcctcgacaccgacgtggcgaggtactccaaggcgcaggggaggacgccggtgagcttcaacccgacggatctggtctgctgccgcacgctgcagggccacagcggaaaggtatattctctggattggactcccgaaaagaattggatagtcagtgcctcacaagatggaaggctgattgtgtggaatgcgttaacaagccagaaaacacatgccataaagctgcactgcccatgggtgatgacatgcgcttttgcacccaatggccagtctgttgcctgtggtggtctagatagtgcatgctctattttcaatcttaactcgcaagcagacagagacgggaatatgccagtatcaagaattcttactggacacaagggctatgtttcgtcatgccaatatgtcccagatcaggaaagtcgccttattacaagctcaggtgatcagacatgtgttctgtgggatgttactactggccagaggatatcaatatttggaggtgaatttccatcagggcatacagctgatgttcaaagtgtatccatcaactcatcgaatacgaatatgtttgtctctggctcatgtgatgcaactgtgaggctgtgggatatcagaattgcaagtcgggctgttcgaacctatcatggacatgaggctgacgttaacagtgtgaagtttttccctgatggccataggtttggtactggctcagatgatggtacttgtagattatttgacatgagaactgggcatcaacttcaggtgtacagtagggagcctaatagagatgataatgaactacctactgttacatctatcgcattctcgatatcaggaaggctactatttgctgggtactccaatggtgactgttacgtgtgggacacacttcttgccgaggtggtacttaatttgggaaacctccaaaactcccatgatggtcgtataagttgccttggaatgtcatctgatgggagtgcattgtgtacaggaagttgggacaaaaatttgaagatttgggccttcagtggacaccggaaaatagtttgaagaccaacatttcttccttgtgttgtatgttccccatcgcaccttaaggatggtgattgttgatcatcttgacttgttcctgggaatcgctttgttgtttttgtagtatagaatcttctgtaccatgcgtccatgtccaatgtttaatgagggaaaaaagggcaatttctcggcgagacatcatgtgttgtatcttgttgagttagtgtctgttgatacagttattaccagaatatcctcaacgtcaacgtgtgatcttccctttcttttgtacaacccttttcctttccagctagagaagtagaatgtatattccggaaccaattgatcagtttgtccattcgccgaaagaggaacattaggttccttcacgtatgcattatttgcatctttagtaatgttgttttcttacctg

SEQ ID NO: 2704 - DNA, 1890 bp, Setaria italica
cacaccccaacctttctctcgctcgactcgactctccccatcgcgcaccttgtcagtttctcctcgtcgccgccaacgccgccgccgattcgccctcctgttcctgaccccaccgccgccgcctcctcttcccttctcggcttctccccctgggagctcccggagctctgccttagccattggaaccgcggccccgctctccatgcgcgcgtcctggtagatccccccacccccggccgtcgctcgagtccccggcgcaaacaggctagcgggcggcaccgatggcgtccgtggcggagctcaaggagaagcacgccgcggcgacggcgtcggtcaactccctccgcgagcgccttcgccagcgccgggagatgctcctcgacaccgacgtggcgaggtactccaaggcgcaggggaggacgccggtgagcttcaacccgacggatctggtctgctgccgcacgctgcagggccacagcggaaaggtatattctctggattggactcccgaaaagaattggatagtcagtgcctcacaagatggaaggctgattgtgtggaatgcgttaacaagccagaaaacacatgccataaagctgcactgcccatgggtgatgacatgcgcttttgcacccaatggccagtctgttgcctgtggtggtctagatagtgcatgctctattttcaatcttaactcgcaagcagacagagacgggaatatgccagtatcaagaattcttactggacacaagggctatgtttcgtcatgccaatatgtcccagatcaggaaagtcgccttattacaagctcaggtgatcagacatgtgttctgtgggatgttactactggccagaggatatcaatatttggaggtgaatttccatcagggcatacagctgatgttcaaagtgtatccatcaactcatcgaatacgaatatgtttgtctctggctcatgtgatgcaactgtgaggctgtgggatatcagaattgcaagtcgggctgttcgaacctatcatggacatgaggctgacgttaacagtgtgaagtttttccctgatggccataggtttggtactggctcagatgatggtacttgtagattatttgacatgagaactgggcatcaacttcaggtgtacagtagggagcctaatagagatgataatgaactacctactgttacatctatcgcattctcgatatcaggaaggctactatttgctgggtactccaatggtgactgttacgtgtgggacacacttcttgccgaggtggtacttaatttgggaaacctccaaaactcccatgatggtcgtataagttgccttggaatgtcatctgatgggagtgcattgtgtacaggaagttgggacaaaaatttgaagatttgggccttcagtggacaccggaaaatagtttgaagaccaacatttcttccttgtgttgtatgttccccatcgcaccttaaggatggtgattgttgatcatcttgacttgttcctgggaatcgctttgttgtttttgtagtatagaatcttctgtaccatgcgtccatgtccaatgtttaatgagggaaaaaagggcaatttctcggcgagacatcatgtgttgtatcttgttgagttagtgtctgttgatacagttattaccagaatatcctcaacgtcaacgtgtgatcttccctttcttttgtacaacccttttcctttccagctagagaagtagaatgtatattccggaaccaattgatcagtttgtccattcgccgaaagaggaacattaggttccttcacgtatgcattatttgcatctttagtaatgttgttttcttacctggtacgagttgttatttgtgtgtatggttgaggcacatctggtgtccccatt

SEQ ID NO: 2705 - DNA, 1379 bp, Saccharum officinarum
catacactgccccaacctctccccacctccctccactttgtcagtttcccgtcgtcgccgccaccgccgccgcctctcctcctcctagtcccgcagccgcctccgtagggagctccccgtaccatacccgcagccattggaatttccgctccatgcgtggatcctcgtagatccccacccccgcgtgcactcgaatcccgaggcggcggcggcctccggcgcgaggctagcagcgggcggcacccatggcgtccgtggcggagctcaaggagaagcacgccgccgcgaccgcgtcggtcaactccctgcgcgagcgcctccgccagcgccgggagacgctcctcgacacggacgtggcgaggtactccaagtcgcaggggagggcgccggtgagcttcaacccgacggatctggtgtgctgccgcacgctgcagggccatagcggaaaggtatattctctggattggacccctgaaaagaattggatagtcagtgcctctcaagatggaaggttaattgtgtggaatgcattgacaagccagaaaacgcatgccataaagctgcattgcccatgggtgatgacgtgtgcttttgcacccaatggccaatctgttgcctgtgtggtcttgatagcgcatgctctattttcaatctcaactctcaagcagacagagatgggaacatgccggtatcaagaattcttactggacacaagggctatgtttcgtcatgccaatatgtcccagatcaggaaactcgtcttattactagctccggtgatcagacatgtgttctttgggatgttactactggacagaggatatcaatatttggcggtgaatttccatcagggcatacagctgatgttcaaagtgtgtccatcaactcatcaaatacgaatatgtttgtctctggctcatgtgatacaactgtgaggctgtgggatatcagaattgcaagtcgagctgttcgaacctaccacggacatgagggtgacgttaacagtgtgaagttttttcctgatggacataggtttggtactggctcagatgatggcacatgtagattatttgatatgagaacagggcatcaacttcaggtgtacagtagggagcctgatagaaatgataatgaactacctactgttacatctattgcattttcgatatcaggaaggctactttttgctggttactccaatggtgactgttatgtgtgggacacacttcttgccgaggtggtacttaatttggggaacctgcaaaactcccatgatggtcgtataagttgccttgggatgtcatctgatgggaaggcattgggtacaggaaggtgggacaaaaatttgaagatttgggcattcaatggacaccggaaga

SEQ ID NO: 2706 - DNA, 2047 bp, Oryza sativa
cccggtggtccctttacccccacttctccccagtctgccataaaaccaaccctactaccgcgggccccacgttcaggtgggccccacatgtcatccacataaaaacagcctagtcggacacctcctcctctttcctcctcctaaacccaacgcaacgcgtcccccaacaactcgcccccccccccctctcttcctccaccccatttcggcgtccgtttctcgccgccgccgccgtggtagtatcctcctcctcctcgcgagctccggaaagctccagccgaggccattgcgttcctcgcctccatgcccggatcccagtagatcccccctccctcaaccagcgcgaggtcgcggggggcgtgcgggcggcggcggcatggcgtccgtggcggagctcaaggagaagcacgcggcggccacggcgtcggtgaactccctgcgggagcggctccgtcagaggcggcagatgctgctcgacaccgacgtggagaggtactcgaggacgcaggggcggacgccggtgagcttcaacccgacggatctggtgtgctgccgcacgcttcaaggccacagcggaaaggtatattctctggattggacccctgaaaagaattggatagtcagtgcctcacaagatggaaggctaattgtatggaatgcattaacaagtcaaaaaacacatgccataaagttacattgcccatgggtgatgacatgtgcatttgcacccaatggccaatctgttgcctgtggtggtcttgacagcgcatgctctatcttcaatcttaactcacaagcagacagagatgggaatataccagtatcaagaatacttaccggacacaaaggctatgtttcatcctgtcagtatgtcccagatcaggaaacccgcctaattactagctctggtgatcaaacatgtgtcctgtgggatgttactactggccaaaggatatcaatatttggcggtgaattcccatcagggcatacggcagatgttttgagcttgtccataaactcatcaaattcgaatatgtttgtttcgggttcatgtgatgcaactgtaaggctgtgggatatcagaattgcaagccgggcagttagaacatatcatggtcatgagggtgacattaacagtgtcaagtttttccctgatggccagaggtttggtactggttcagatgatggaacgtgtagattatttgacgtgagaacagggcaccaacttcaagtatacagtcgggaacctgatagaaatgataatgaactcccaactgttacatctattgcattttcgatatcaggaaggcttctttttgctggatactccaatggtgactgttatgtgtgggacacacttctcgctgaggtggtacttaatttgggaaacctccaaaactctcatgaggggcgtataagctgccttggtctttcttctgatgggagtgcattgtgtacaggaagttgggacaagaatttgaagatttgggccttcagcggacaccggaaaatagtttgaaggacagttttcttcctgtgttgttgtaagttccttgtgttaagaattacgaccaactcgatgggctatggaaatcagtttgttggtcttgtagcatagaatcaggcaatcagctgtatcatatcctaatgtccagtggaaaaatgcaatctgttgtcttggcaagacgtgtgctctgactcaccgtgttaagttgatgtagtgtttatattaccagaaagcatcatccattcggatcggtctcttcttgttgtataacttctttttgtagtagaaagctaccaacttttgcatttgtatttcacaactgattatgaatttgtccctttccaagtcaggcatatcagctgtccattgtactgtgctgcttgtgcacatgtttagtgtatttcctactctctttttagtattgtccacattcatatactccctccgtattttaatagatggcaccattgacattttctcatatgtttgaccactcgtcttattcaaaaattttatgcaaatgtataagatatgaatcac

SEQ ID NO: 2707 - DNA, 1761 bp, Oryza sativa
gcccccccccccctctcttcctccaccccatttcggcgtccgtttctcgccgccgccgccgtggtagtatcctcctcctcctcgcgagctccggaaagctccagccgaggccattgcgttcctcgcctccatgcccggatcccagtagatcccccctccctcaaccagcgcgaggtcgcggggggcgtgcgggcggcggcggcatggcgtccgtggcggagctcaaggagaagcacgcggcggccacggcgtcggtgaactccctgcgggagcggctccgtcagaggcggcagatgctgctcgacaccgacgtggagaggtactcgaggacgcaggggcggacgccggtgagcttcaacccgacggatctggtgtgctgccgcacgcttcaaggccacagcggaaaggtatattctctggattggacccctgaaaagaattggatagtcagtgcctcacaagatggaaggctaattgtatggaatgcattaacaagtcaaaaaacacatgccataaagttacattgcccatgggtgatgacatgtgcatttgcacccaatggccaatctgttgcctgtggtggtcttgacagcgcatgctctatcttcaatcttaactcacaagcagacagagatgggaatataccagtatcaagaatacttaccggacacaaaggctatgtttcatcctgtcagtatgtcccagatcaggaaacccgcctaattactagctctggtgatcaaacatgtgtcctgtgggatgttactactggccaaaggatatcaatatttggcggtgaattcccatcagggcatacggcagatgttttgagcttgtccataaactcatcaatttcgaatatgtttgtttcgggttcatgtgatgcaactgtaaggctgtgggatatcagaattgcaagccgggcagttagaacatatcatggtcatgagggtgacattaacagtgtcaagtttttccctgatggccagaggtttggtactggttcagatgatggaacgtgtagattatttgacgtgagaacagggcaccaacttcaagtatacagtcgggaacctgatagaaatgataatgaactcccaactgttacatctattgcattttcgatatcaggaaggcttctttttgctggatactccaatggtgactgttatgtgtgggacacacttctcgctgaggtggtacttaatttgggaaacctccaaaactctcatgaggggcgtataagctgccttggtctttcttctgatgggagtgcattgtgtacaggaagttgggacaagaatttgaagatttgggccttcagcggacaccggaaaatagtttgaaggacagttttcttcctgtgttgttgtaagttccttgtgttaagaattacgaccaactcgatgggctatggaaatcagtttgttggtcttgtagcatagaatcaggcaatcagctgtatcatatcctaatgtccagtggaaaaatgcaatctgttgtcttggcaagacgtgtgctctgactcaccgtgttaagttgatgtagtgtttatattaccagaaagcatcatccattcggatcggtctcttcttgttgtataacttctttttgtagtagaaagctaccaacttttgcatttgtatttcacaactgattatgaatttgtccctttccaagtcaggcatatcagctgtccattgtactgtgctgcttgtgcacatgtttagtgtatttcctgctctctttttagtattgtcc

SEQ ID NO: 2708 - DNA, 1424 bp, Pennisetum glaucum
cagcggcgacggcgtcggtcaactccctgcgcgagcgcctccgccagcgccgtgagatgctcctcgacaccgacgtggcgaggtactccaaggctcaggggagggcgccggtgaacttcaacccgacggatctggtctgctgccgcacgctgcagggccacagcggaaaggtatattctctggattggactcctgaaaagaattggatagtcagtgcctcacaagatggaaggctaattgtatggaatgcgttaacaagccagaaaacacatgccataaagctgcactgcccatgggtgatgacatgtgcttttgcacccaatggccaatctgttgcctgtggtggtctagatagtgcatgctctatttttaatctcaactctcaagcagacagagacggtaatatgccagtatcaagaattcttactggacataagggctatgtttcgtcatgccaatatgtccccgatcaggaaactcgccttattacaagctcaggtgatcagacatgcgttctgtgggatgttactactggccagaggatatcaatatttggaggtgaatttccatcaggacatacagctgatgttcaaagtgtatccatcaactcatcgaatacgaatatgtttgtctctggctcatgtgatgcaactgtgaggctgtgggatatcagaattgcaagtcgggctgttcgaacctatcatggacatgaggctgacgttaacagtgtgaagtttttccctgatggccataggtttggtactggctcagatgatggcacttgcagattatttgacatgagaactgggcatcaacttcaggtgtacagtagggagcctaatagagatgataatgaactacctacagttacatctattgcattctcgatatcaggaaggctactttttgctgggtactccaatggtgactgttacgtgtgggacacacttctcgctgaggtggtacttaatttgggaaacctccaaaattcccatgatggtcgtataagttgccttggaatgtcatctgatgggagtgcattgtgtacaggaagttgggacaaaaatttgaagatttgggccttcagtggacaccggaaaatagtttgaagaccaacatttcttccctgtgttgtatgttcctcatcgcaccttaaggatggtgattgttgatcatgttgacttgttcctgggaatcactttgttgtttttgtagtatagaatcttctgtaccatgcccaatgtttaatgagggagaaaagggcaatttctcggcgagacatcatgtgttgtatgttgttgagttggtgtctgttgatactgttattaccagaatatcatcaacgtcaacgtgtgatcttccctttcttttgcacaacccttttcccttccatctagagaagtataatgtatattccggactaa

SEQ ID NO: 2709 - DNA, 1762 bp, Brachypodium distachyon
cggccctcccgttcctaaacccaacgcgtcccccaacaactcaccccgacccgaccagttcgtcagtttctcgtcgtcggccacttcgtctccttccgccgccgccgcttccatttcctctccctccagagctccagagtcctttcagactctgacctcagtcattcgatttctccctacatgcccagagccaagtagatccccaccagcgcacgaatcccgagacagaccctggtgcgcggccggccatggcgtccgtggcggacctcaaggagaagcacgcggcggcgacggcctcggtgaactctctgagagagaggctccgtcagcggcggcagctgctcctcgacactgacgttgagaggtactcgaaggcgcaggggcggacagcggtgagcttcaaccagacggatctggtgtgctgccgcacgctgcagggccacagcgggaaggtatattctcttgattggactcctgaaaagaactggatagtcagcgcctcgcaagatggaagattaattgtatggaatgctttaacaagccagaaaacacatgccataaaactgcactgtccatgggtgatgacatgtgcttttgcacccaacggtcaatctgttgcctgtggtggtcttgatagtgcatgttctatattcaatcttaactcacaagtagacagagatgggaacatgccggtgtcaagaatacttactggacacaaaggctatgtttcatcctgtcagtatgtcccagatcaggaaacccggctaattaccggttcaggtgaccaaacgtgtgtcctgtgggatgttactactggccaaaggatatcaatatttggaggtgaatttccatcagggcatacagctgatgtgctgagtttgtccatcaacccgttaaacacaaatatgtttgtctctggttcatgtgatacgactgtaagactttgggatctcagaattgcaagccgggcagttcgaacatatcatggacatgagggtgacattaacagtgtcaaatttttccctgatgggcagaggtttggtactggttcagatgatggtacatgcagactatttgacatgagaacagggcatcaacttcaagtgtacaacagggagccagatagaaatgataatgagctccctattgttacttcaattgcattttctatatccgggaggcttctttttgctggatactctaatggtgactgttacgtgtgggatacacttcttgctgaggtggtgcttaatttgggaacccttcagaactctcatgatggccgtataagctgccttgggctgtcatctgatgggagcgcattgtgtacaggaagttgggacaaaaatttgaagatttgggctttcagtggacaccgcaaaatagtttgaatggcagttttctcccagggttgtgtgttcctcattgtgtgttgagaactcaacaggatccggaagatgtaagttgtttgttttgtagtatagaatcttctgtatcataccttgtccaactgaaaatgcagtctgttgcccgaggcttacctggttaagtcagcgttctgttcatagagttaccagaaatcagcatccacgtcatcttttctgccccttctctgtacaattattttagctgtagagaagtactaccttaattggcttgtgtaaactatcatcagtttgttcgttcctcgagcaaggattatcatccgcattttctctgtgcattgttatttgctattttggttgccatgttgaaatgttat

SEQ ID NO: 2710 - DNA, 1679 bp, Brachypodium distachyon
cccaacaactcaccccgacccgaccagttcgtcagtttctcgtcgtcggccacttcgtctccttccgccgccgccgcttccatttcctctccctccagagctccagagtcctttcagactctgacctcagtcattcgatttctccctacatgcccagagccaagtagatccccaccagcgcacgaatcccgagacagaccctggtgcgcggccggccatggcgtccgtggcggacctcaaggagaagcacgcggcggcgacggcctcggtgaactctctgagagagaggctccgtcagcggcggcagctgctcctcgacactgacgttgagaggtactcgaaggcgcaggggcggacagcggtgagcttcaaccagacggatctggtgtgctgccgcacgctgcagggccacagcgggaaggtatattctcttgattggactcctgaaaagaactggatagtcagcgcctcgcaagatggaagattaattgtatggaatgctttaacaagccagaaaacacatgccataaaactgcactgtccatgggtgatgacatgtgcttttgcacccaacggtcaatctgttgcctgtggtggtcttgatagtgcatgttctatattcaatcttaactcacaagtagacagagatgggaacatgccggtgtcaagaatacttactggacacaaaggctatgtttcatcctgtcagtatgtcccagatcaggaaacccggctaattaccggttcaggtgaccaaacgtgtgtcctgtgggatgttactactggccaaaggatatcaatatttggaggtgaatttccatcagggcatacagctgatgtgctgagtttgtccatcaacccgttaaacacaaatatgtttgtctctggttcatgtgatacgactgtaagactttgggatctcagaattgcaagccgggcagttcgaacatatcatggacatgagggtgacattaacagtgtcaaatttttccctgatgggcagaggtttggtactggttcagatgatggtacatgcagactatttgacatgagaacagggcatcaacttcaagtgtacaacagggagccagatagaaatgataatgagctccctattgttacttcaattgcattttctatatccgggaggcttctttttgctggatactctaatggtgactgttacgtgtgggatacacttcttgctgaggtggtgcttaatttgggaacccttcagaactctcatgatggccgtataagctgccttgggctgtcatctgatgggagcgcattgtgtacaggaagttgggacaaaaatttgaagatttgggctttcagtggacaccgcaaaatagtttgaatggcagttttctcccagggttgtgtgttcctcattgtgtgttgagaactcaacaggatccggaagatgtaagttgtttgttttgtagtatagaatcttctgtatcataccttgtccaactgaaaatgcagtctgttgcccgaggcttacctggttaagtcagcgttctgttcatagagttaccagaaatcagcatccacgtcatcttttctgccccttctctgtacaattattttagctgtagagaagtactaccttaattggcttgtgtaaactatcatcagtttgttcgttcctcgagcaaggattatcatccgca

SEQ ID NO: 2711 - DNA, 1841 bp, Hordeum vulgare
gacagcatacaactccaaaacccaacgcgtccccaacagctccacccccacccatcccacctcccgtcagttcgtcgtcgccggccacttcgcctctcccgccgccgccgccgccgccagcgacggccagctcggctcagccattggatctccccctccatgcccagagccaagtagagagcagatccccaccgccgcacgaacctcgagcccaggcggcgcggccggccacctgatggcgtccgtggcggagctcaaggagaagcacgcggcggcgacggcctcggtgaactccctccgggagcggctccgccagcgccggcagacgctcctcgacaccgacgttgagaagtactccaaggcgcaggggcggacggcggtcagcttcaaccccacggatctggtgtgctgccgcacgctgcagggccacagcgggaaggtatattctctggattggactcctgagaagaactggatagttagtgcctcacaagatggacgactaattgtatggaatgctttaacgagtcagaaaacacatgccataaagctacactgtccatgggtgatgacatgtgcctttgcacccaatggtcaatctgttgcttgtggcggtcttgatagtgcatgctctatattcaaccttagctcacaagtagacagagatgggaacatgccagtatcaagagtactgactggacacaaaggctatgtttcatcatgtcagtatgtcccggatcaggaaacccgcttgattacaggctcaggtgaccaaacgtgtgtcctgtgggatgttactactggccagaggatatcaatctttggaggcgaatttccatcagggcatacagctgatgtgttaagtctgtccatcaactcgttaaacacgaatatgtttgtctcgggttcatgtgatacaactgtaaggctatgggatctcaggattgcaagccgcgcagttcggacatatcatggacatgagggagacattaacagcgtcaagtttttccctgatggtcagaggtttggtactggttcagatgatggtacatgcagattatttgacatgagaacagggcatcaacttcaagtgtacaatcgggagcccgacagaaatgataatgaactccccattgttacatccgtcgccttttccatatcagggaggcttctttttgctggatactctaatggtgactgttatgtgtgggacacgcttcttgccgaggtggtgcttaacttgggaactctccaaaactctcatgaaggccgtataagctgccttgggctgtcatccgatgggagtgcattgtgtacaggaagttgggacaaaaatttgaagatctgggctttcagcggacaccgcaagatagtctgaagcccccgcgtgtgtgatctctccttgttgtgccttcctcgttgcgtgttgagaatggttggccaactcagacaggttgctggggatgaaagtcgtcgcccgttttgtagcatagaatcatgcctttgtgttgaatggaaaatgccgtctgtcgaagagactgagtgcgccttgtgatgatgtttctgtgcctggtcaagtgagcgtactgtttatagagttaccagaaatcaagcagcgcacatgtgatatttttctgcccttgttgtgtacaactattttattttagctgtagagaaggactagcttgacaagccgaattgttcgaaccaacaatcaatttgttcgtttgtggagtaagaaatgagagcttcatttcctgtgcgctcatgtgtagtaagctttgctgtgatgattgtgaccatttactatcgtgttgcctcttatatttttttaccttgtg

SEQ ID NO: 2712 - DNA, 1681 bp, Leymus cinereus x Leymus triticoides
cgcgtccccaacagctccaccccccaccccatcccctcccctcctgtcagtttgtcgtcgccggccagttcggctctcccgccgccgccgccttcctagccccctccaaactcccagctcagccattggatctcgccctccatgcccaaactcaagtagatccccaccggcgcacgaaccttaaggcagacaaccagaccccggtgcgcggccggccatggcgtccgtggcggagctcaaggagaagcacgcggcggcgacggcctcggtgaactccctccgagagcggcttcgtcagcgccggcagacgctcctcgacactgacgtggagaagtactccaaggcgcaggggcggacggcggtgagcttcaacccgacggatctggtgtgctgccgcacgctgcagggccacagcggaaaggtatattctctggattggactcctgaaaagaactggatagttagtgcctcacaagatggaagactaattgtatggaatgctttaacgagtcagaaaacacatgccataaagctacactgtccatgggtgatgacatgtgcctttgcacccaatggtcaatctgttgcttgtggcggtcttgatagtgcatgctctatattcaaccttagctcacaagtggacagagatgggaacatgccagtatcaagggtacttactggacacaaaggctatgtttcatcctgtcagtatgtcccggatcaggaaacccgcttgattacaggctcaggtgaccaaacgtgtgtcctgtgggatgttactactggccagaggatatcaatctttggaggcgaatttccatcagggcatacagctgatgtgttaagtctgtccatcaactcactaaacacgaatatgtttgtctcgggttcatgtgatacaactgtaaggctatgggatctcaggattgcaagccgggcagttcggacatatcatggacatgagggtgacattaacagtgtcaagtttttccctgatggtcagaggtttggtactggttcagatgatggtacatgcagattatttgacatgagaacagggcaccaacttcaagtgtacaatcgggagccagatagaaatgataatgaactccctattgttacatctgtcgccttttccatatcaggaaggcttctttttgctggatactctaatggtgactgttatgtatgggacacgcttcttgccgaggtagtgcttaatttgggaactctccaaaactctcatgaaggccgtataagctgccttgggctgtcatccgatgggagtgcattgtgtacaggaagttgggacaaaaatttgaagatttgggctttcagtggacaccgcaaaatagtctgaagccccagcgtatggttggccaactcaagaggttgctggagatgaaggcgtcgtccgttttgtagcatagaatctttctctgtatcatgccttgtgtccaaaggaaaatgcagtttgtcgagacgagtgtgctgtgtgtgatgttcttgtacctggttaagtcagcgtactgttgtttatagagttaccagaaggcagcacatgtgatactttgtgtacaactattttattttagatgtagaaaagaactaccttaatttagaaccaattatcaatttgttcgtttctgaagcaagaaatgtgagcttcattttctgtgta

SEQ ID NO: 2713 - DNA, 1637 bp, Triticum aestivum
agctcccagctcagccattggatctccccctccatgcccagaggcaagtagatagaccccccaccggcgcacgaacctcaaggcaggcaggcagcgcggccggccggccacccgatggcgtccgtggcggagctcaaggagaagcacgcggcggcgacggcctcggtcaactccctccgggagcggctccgccagcgccggcagacgctcctcgacaccgacgtggagaagtactccaaggcgcaggggcggacggcggtgagcttcaaccccacggatctggtctgctgccgcacgctgcagggccacagcgggaaggtatattctctggattggactcctgagaagaactggatagttagtgcctcacaagatggaagactaattgtatggaatgctttaacgagtcagaaaacacatgccataaagctacactgtccatgggtgatgacatgtgcttttgcacccaatggtcaatctgttgcttgtggcggtcttgatagtgcatgctctatattcaaccttagctcgcaagcagacagagatgggaacatgccagtatcaagagtacttactggacacaaaggctatgtttcatcctgtcagtatgtcccagaccaggaaacccgcttgattacaggctcaggtgaccaaacgtgtgtcctgtgggatgttactactggccagaggatatcaatctttggaggtgaatttccatcagggcatacagctgatgtgttaagtctgtccatcaactcgttaaacacgaatatgtttatctcgggttcatgtgatacaactgtaaggctatgggatctcaggattgcaagtcgggcagttcggacatatcatggacatgagggcgacattaacagtgtcaagtttttccctgatggtcagaggttcggtactggttcagatgatggtacatgcagattatttgacatgagaacaggccatcaacttcaagtgtacaatcgggagcctgatagaaatgataatgagctccctattgttacatctgtcgctttttccatatcaggaaggcttctttttgctggatactctaatggtgactgttatgtgtgggacacgcttcttgccgaggtagtgcttaatttgggaactctccaaaactctcatgaaggccgtataagctgccttgggctgtcatccgatgggagtgcattgtgtacaggaagctgggacaaaaatttgaagatctgggctttcagtggacaccgcaagatagtctgaagccccggcgcgtgttctccccgtgtcgtgcgttcctcatcgcgtgttgggggtggttggccaactcgaaaggttgctggagatgaagtcgtcgtctgttttgtagcataggatcttgtatgcatcatgccttatgtccaatggaaaatgcagtttgtccagacgagtgtgctgtgatgatgttcttgtacctggttaagtcagcgtactgttgtttatagagtcgccagaaagcaagcagcgcacatgtgatattttctgcccttgttgtgtacaaccatatatttttagctgtagaaaagcactagcttggcaagccgaattgttagaaccaagaatcaatttgttcgtttctggagtaaggtaagaaatgcgagctt

SEQ ID NO: 2714 - DNA, 1601 bp, Lolium multiflorum
cgccgccgccgcctctttctcctgttcaccccctcaagctccgagctttaacattggatctctcccccacatgcccagagccaagtagatccccaccagcgcgcgaaccccgaggcagaccccccgccatggcgtccgtggcggagctcaaggagcggcacgcggcggcgacggcctcggtgaactccctgcgggagaggctccgtcagcggcggcagacgctcctcgacactgacgtggagaagtactccaaggcgcaggggcggacggcggtgagcttcaaccagacggatctggtctgctgccgcacgctgcagggacacagcggaaaggtatattctctggactggactcctgaaaagaactggatagtcagtgcctcacaagatggaagactaattgtatggaatgctttaacaagtcagaaaacacatgccataaagctacactgtccatgggtgatgacatgtgcttttgcacccaatggtcaatctgttgcctgtggtggtcttgatagtgcatgctctatatttaatcttaactcacaagtggacagggatgggaacatgccagtatcaagagtacttactggacacaaaggctatgtttcgtcctgtcagtatgtcccggatcaggaaacccgcatgattacaggctccggtgaccaaacgtgtgtcctgtgggatgttactactggccaaaggatatccatttttggaggtgaatttccatcaggccatacagctgatgtgttgagtctgtccatcaactcgttaaacacaaatatgtttgtctcgggttcatgtgatacaactgtaaggctatgggatctcagaattgcaagccgggcagttcgaacatatcatggacacgagggtgacattaacagtgtaaagtttttccctgatggtcaaaggtttggtactggttcagatgatggtacgtgcagattatttgacatgagaacagggcatcaacttcaagtgtacagtcggtctccagatagaaatgataatgaaccccctacagttacatctatcgcgttctccatatcaggaagacttctctttgctggttactctaatggtgactgttatgtgtgggacacacttcttgctgaggtagtgcttaatttgggaactctccagaactcccatgaaggtcgtataagctgccttgggctgtcatctgatggtagtgcattgtgtacaggaagttgggacaaaaatttgaagatttgggctttcagtggacaccgcaaaatagtctgaagcccactgttcttctctccatgttgtgtggtcaactcagcaggttcctgaagatgaagttgttggttttgtagcatagaatctttctgtatcataccttatgtccaatggaaaatacagtttatcggctgagactgcacgctgtcatgtgttgttacctggtgaagtcagcgtgctgtttatagagttactagaaaccagcacccatgtgatctttttctgccctttttctctgtacaattttcagctgtagaaaaacactaccttggcgtgtctaatttaaaactcagttgtcaaattctttcgtttcagagtaaggaatacgtttcc

SEQ ID NO: 2715 - DNA, 1823 bp, Triticum aestivum
ggatctccccctccatgcccagagccaagtagatagaccccccaccggcgcacgaaccttgaggcaggcagcgcggccggccggccacctgatggcgtccgtggcggagctcaaggagaagcacgcggcggcgacggcctcggtcaactccctccgggagcggctccgccagcgccgccagacgctcctcgacaccgacgtggagaagtactccaaggcgcaggggcggacggcggtgagcttcaaccccacggatctggtgtgctgccgcacgctgcagggccacagcggaaaggtatattctctggattggactcctgagaagaactggatagttagtgcctcacaagatggaagactaattgtatggaatgctttaacgagtcagaaaacacatgccataaagctacactgtccatgggtgatgacatgtgcttttgcacccaatggtcaatccgttgcttgcggcggtcttgatagtgcatgctctatattcaaccttagctcacaagcagacagagatgggaacatgccagtatcaagagtacttactggacacaaaggctatgtttcatcctgtcagtatgtcccagaccaggaaacccgcttgattacaggctcaggtgaccaaacgtgtgtcctgtgggatgttactactggccagaggatatcaatctttggaggtgaatttccatcagggcatacagctgatgtcttaagtctgtccatcaactcgttaaacacgaatatgtttatctcgggttcatgtgatacaactgtaaggttatgggatctcaggattgcaagtcgggcagttcggacatatcatggacatgagggcgacattaacagtgtcaagtttttccctgatggtcagaggttcggtactggttcagatgatggtacatgcagattatttgacatgagaacagggcatcaacttcaagtgtacaatcgggagcccgatagaaatgataatgagctccccatcgttacatctgtcgctttctccatatcaggaaggcttctttttgctggatactctaatggtgactgttatgtgtgggacacgcttcttgccgagatggtgcttaatttgggaactctccaaaactctcacgaaggccgtataagctgccttgggctgtcatccgatgggagtgcattgtgtacaggaagctgggacaaaaatttgaagatctgggctttcagtggacaccgcaagatagtctgaagccccagcgcgtgttctccccgtgctgtacgttcctcgtcgcgagttgggggggtggttggccaactcgaaaggttcctgaagatgaagccgtccgttttgtagcatggaatccatgaatctcctgttgtttccaatggaaatcgcagtttgccgagacagagtgtgctgtgcgatgttgttgcgcctggtcaagtcagcgtactgttgtttatagagttgccagaaagcaagcagcgcacatgtgatattttctgcccttgttgtgtacaactatatatttttagctgtagaaaatgaagccgaattgttagaaccaagaatcaatttgttcgtttctggagtaagatgagaaatgcgagcttcatttcctgtgtgctgtgatggttgacaggaccgttcagtgagccatccactatcgtgttgtgtacaatacaatccagtggcccacgtatttcactgcctggctgtctgtatacttcaacaccatactaccttgtgaaaagaagaatcctttatttcctattctacgatgcagtcaaacaaaccaaaattcttagaattccaatgggcatggcatggcattgca

SEQ ID NO: 2716 - DNA, 1611 bp, Avena sativa
ccgccgccgcctctttctcatactcattccgagccacctcaaactccgagcttaaacattggatctcccccacatgcccagagccaagtaaatccccaccagcgcacgaatcccgaggcagaccctggtgcgcggccggccatggcgtccgtggcggagctcaaggagaggcacgcggcggcgacggcctcggtgaactctctgcgagagaggctccgtcagcggcggcagacgctcctcgacactgacgtggagaaatactccaaggcgcaggggcggacggcggtgagcttcaaccagacggatctggtgtgctgccgcacgctgcagggccacagcggaaaggtatattctctggattggactcctgaaaagaactggatagtcagcgcctcacaagatggaagactaattgtatggaatgctttaacgagtcagaaaacacatgccataaagctacactgtccatgggtgatgacatgtgcttttgcacccaatggtcaatctgttgcctgtggtggtcttgatagtgcatgctctatatttaatcttaactcacaagtggacagagatggaaacatgccagtatcaaaagtacttactggacaaaaaggctatgtttcgtcctgtcagtatgtccctgatcaggaaacccgcatgattacaggctcaggtgacccaacgtgtgtcctatgggatgttactactggccaaagaatatccatctttggaggtgaattcccatcaggccatacagctgacgtgttaagtctgtccatcaactcgttaaacacaaatatgtttgtctcgggttcatgtgatacaactgtaaggctatgggatctcagaatagcaagccgggcagtccgaacatatcatggacatgaaggcgatattaacagtgtcaagtttttccctgatggtcataggtttggtactggttcagatgatggtacatgcagattatttgacatgagaatcaggcatcaacttcaagtgtacagtcgggagccagatagaaatgataatgagctccctagcgttacatctattgcattctccatatcaggaaggcttctctttgctggttactctaatggtgactgttatgcgtgggacacgcttctcgccgaggtagtgctcaatttgggaactctccaaaactcccacgaaggtcgtataagctgccttgggttgtcatctgatgggagtgcattgtgtacaggaagttgggacaaaaatttgaagatttgggccttcagtggacaccgcaaaatagtctgaagccgcccagcggtcttctctccatgttgtatgttcctcctcctcgcttgttgaagaatggtggccaactcaacaggttcctgaagatgaagttgttggttttgtagcatagaaatcttcctgtatcataccttatgtccagtggaaaaatacagtttatcggcggagactgtgccgtgatgttcttgtacctggtcaagtcagcgtactgttaatagagagttattactataaatcagcacccatgtgatctttttctgttctttctatgtgcaattatttcagctgtagaaaagcactaccttgtgatgtcttaaaaaaaaaaaa

SEQ ID NO: 2717 - DNA, 1530 bp, Secale cereale
gagccaggtagatccccaccggcgcacgaagctcaaggcaggcaggcagcgcggccggcccacctgatggcgtccgtggcggagctcaaggagaagcacgcggcggcgacggcctcggtcaactcactccgggagcggctccgcagcgccggcagacgctcctcgacaccgacgtggagaagtactccaaggcgcgggggcggacggcggtgagcttcaaccccacggatctggtgtgctgccgcacgctgcagggccacagcggaaaggtatattctctggattggactcctgagaagaactggatagttagtgcctcccaagatggaagctaattgtatggaatgctttaacgagtcagaaaacacgatgccataaagctacactgtccatgggtgatgacatgtgcttttgcacccaatggtcaatctgttgcttgtggcggtcttgatagtgcatgctctatattcaaccttagcacacaagcagacagagatgggaacatgccagcatcaagagtacttactggacacaaaggctatgtttcatcctgtcagtatgtcccggatcaggaaacccgcttgattacaggctcgggtgaccaaacgtgtgtcctgtgggatgttactactggccagaggatatcaatctttggaggcgaatttccatcagggcatacagctgatgtgttaagtctgtccatcaactcgttaaacacgaatatgtttatctcgggatcatgtgatacaactgtaaggctatgggatctcaggattgcaagccgcgcagttcggacatatcatggacatgatggcgacattaacagtgtcaagtttttccctgatggtcagaggttcggtactggttcagatgatggtacatgcagattatttgacatgagaacggggcatcaacttcaagtgtacaatcgggagcccgatagaaatgataatgagctccctattgttacatctgtcgccttttccatatcaggaaggctcctttttgctggatactctaatggtgactgttatgtgtgggacacgcttcttgccgaggtggtgctcaatttgggaactctccaaaactcccatgaaggccgtataagctgccttgggctgtcatccgatgggagtgcactgtgtacaggaagttgggacaagaatttgaagatctgggctttcagcggacaccgcaagatagtctgaagccccagcgccgcgtgttctacgttcatcaccgtgtgttggggggtggttggccagctcaaaaggttcctgaagatgaagccgtccgttttgtagcatacactctcctgtcgtgtccaatggaaaacgcagtctgtatgtgctgtgtcatgttgttgcacctggtcaagtttagcgtaagtactgttgtttatagagttgccggaaagcaggcagcgcacatgtgatattttcctttctaccctttgttgtgcacaactatatgttttcagctgtagaaaacgaagccggattgttagaaccaagaatcaatttgttcgtt

SEQ ID NO: 2718 - DNA, 1513 bp, Secale cereale
ccacctgatggcgtccgtggcggagctcaaggcgaagcacgcgcggcgacggcctcggtcaactcactccgggagcggctccgccagcgccggcagacgctcctcgacaccgacgtggagaagtactccaaggcgcaggggcggacggcggtgagcttcaaccccacggatctggtgtgctgccgcacgctgcagggccacagcggaaaggtatattctttggattggactcctgagaagaactggatagttagtgcctcccaagatggaagactaattgtatggaatgctttaacgagtcagaaaacacatgccataaagctacactgtccatgggtgatgacatgtgcttttgcacccaatggtcaatctgttgcttgtggcggtcttgatagtgcatgctctatattcaaccttagcacacaagcagacagagatgggaacatgccagcatcaagagtacttactggacacaaaggctatgtttcatcctgtcagtatgtcccggatcaggaaacccgcttgattacaggctcgggtgaccaaacttgtgtcctgtgggatgttactactggccagaggatatcaatctttggaggcgaatttccatcagggcatacagctgatgtgttaagtctgtccatcaactcgttaaacacgaatatgtttatctcgggttcatgtgatacgactgtaaggctatgggatctcaggattgcaagccgggcagttcggacatatcatggacatgagggcgacattaacagtgtcaagtttttccctgatggtcagaggttcggtactggttcagatgatggtacatgcagattatttgacatgagaacagggcatcaacttcaagtctacaatcgggagcctgatagaaatgataatgagctccctattgttacatctgtcgccttttccatatcaggaaggcttctttttgctggatactctaatggtgactgttatgtgtgggacacgcttcttgccgaggtggtgcttaatttgggaactctccaaaactctcatgaaggccgtataagctgccttggactgtcatccgatgggagcgcactgtgtacaggaagttgggacaaaaatttgaagatctgggctttcagcggacaccgcaagatagtctgaagcccgagcgccgcgtgttctccccgtgttgtacgttcctcgtcgcgtgttggggggtggttggccagctcaaaaggttcctgaagatgaagccgtccgttttgtagcatagactcacctgtcgtgtccaatggaaaacgcagtctgtatgtgctgtgtgatgttgttgcacctggtcaagtttagcgtaagtactgttgtttatagagttgccggaaagcaggcagcgcacatgtgatattttcctttctgccctttgttgtgcacaactatattgtttttagctgtagaaaaacgaagccggattgttagaaccaacaatcaatttgttcgtttctggagtaagataaggaatgtgagcttc

SEQ ID NO: 2719 - DNA, 1881 bp, Elaeis guineensis
gtcccctggtctcgccccactcgtcttcgctctgattcgccccctccactgcgaaccctaaccctagatcggtttctccctccgttctgcttcgagacgggttctcggggcaggaatggaggattagggctcggatcgagatctacggaggccggtcatggccggagaacgctgatcttttcaagtagcgtgtttggggttggggtttataaatgtctgttgctgagctgaaggagcggcatatcgccgcgacggcgaacgtcaacgctctgcgagagcggttgaagcagaggaggcaggagcttctcgacaccgatgttgctggatatgctaagagccatgggaaaaccgcaattggctttggctccacggatctggtttgctgtaggaccttgcagggtcatacggggaaggtctattcattggattggactcctgaaaggaatcggatagttagcgcttctcaagatgggagattaattgtatggaatgccttaacaagccagaaaacacatgccataaagcttcattgtgcatgggtcatgacatgtgcctttgcccccaatggtcagtctgttgcatgtggtggtcttgatagcgcatgctctattttcaatctcaattctcaagttgatagagatgggaacataccaatatcaagagtacttacggggcacaagggctatgtatcatcatgtcagtttgttccagatcaggaaactcgactaattaccggctcaggtgatcagacatgtgttttgtgggatgttactactggtcagaggatttctgtctttggaggtgaatttccatcaggacacacagctgatgtattcagtgtctcaatcaactcttcaaattcaaatatgtttgtctctggatcatgtgatgctactgctcggctgtgggatactcgaattgctagtcgagcagttcgaacatatcatggtcatgagggggatgttaatgctgtcaagttctttcctgatggacaaagatttgggactggctctgatgatggcacatgccggttatttgatatgaggacaggacatcaacttcaaatttatagtcaacagcttgacaataatgataatgaggttcccactgtaacatccattgccttctcaatatcgggtagactcctctttgctggatactccaatggcaattgttatgtgtgggatacactggtagctgaggtagtcctgaatttgggagctctacaaaactctcatgagggccgcataagctgcctaggtttgtcagctgatgggagtgccttgtgcacgggaagctgggacaaaaatctaaagatttgggcctttggaggacacaggagggtgatctgaatatttttgcattggtgtttgttatggattgtctcagtttggtgcccaacttggacaatgttttgcaaataatgtctggcttgtgtataacatgttctgttgtatctcaccctcttaagctgaaagtcctgattccatgaagctcaagcatcctgaaatatcaatttttggatgggacacgtgccatgaggtgaagaaaaggtcgcagaaaaacatatcaggactacgccttcggacatctagaatttttggtgtcatttgtattatcagatccctgtaactccttttcttcatactgtgcacaaaatgtgacgtcttttgttggtattcttagactcttagtctagaggatgttatttatccagcctgtactctctgattggtatgtacacctccttgagttgtaatcttgacttaatgtttcgtttgttatttgaactaggagataatttgaactttggtgggcaaatgataagttaacacgttccaggtaattaaatgttataaattttttcatatggcttatcaa

SEQ ID NO: 2720 - DNA, 1649 bp, Musa acuminata
gtccaacgtaagcacgcactcgtcttctcttctcttcgccttcccccacacctctcccgtggtcgtccttctgtcctcgcattcatcctcaagcccccgcgcttgttcgatttctgctattttctgctccaagggtttgggttcgtcgatgtcggttgcggagctgaaggagcggcacatagccgcgacggctacggtcaattctctgagggagcggttgaagcagaggaggcagttgcttcttgatactgatgtggcggcgtttgctaagagccaagggagatcggcgatcagttttaactccacggatctgatttgctgcaggaccttgcagggccacactggcaaggtttattcattggactggacacctgaaaggaatcggatagttagtgcttcacaagatgggagactgattgtatggaatgctttaacgagtcagaaaacacatgctataaaacttcagtgcccctgggtcatgacctgtgcatttgcgccgaatgggcagtctgttgcatgtggaggacttgacagtgcctgctctattttcaatctcaattctcaagttgacagagatggcaacattccagtttcaaggatacttaccgggcacaagggctatgtgtattcttgtcagtatgttccagatcaagaaactcgcttgattaccagttcaggcgatcaaacatgtgttctgtgggatgtcacaactggccaaaggatttctgtttttggtggtgaatttccttcaggacacacagctgatgtattgagtgtctcaattaacagttcaaactcgaacatgtttgtctctggttcatgtgatatgactgctcgattatgggatactcgaattgctagtcgggcagttgggacataccatggtcaccagggtgatgttaacactgtcaagttcttccctgatgggcagagatttgggactggctctgatgacagtacatgcaggttatatgacatgagaactgggcaccagcttcaggtgtacagtcaacagcatgaaggtgatgacaatgatgttccaattgtcacatccattgcgttctctatatcaggaagacttctattcgctggatactccagtggtgactgttatgtgtgggatacactaatggctgaggtggttctgaatttgggaacatctcagaattctcatgaggcccgcataagctgcttaggtttgtcttctgatggtagtgctttatgcacaggaagctgggacaagaacttaaagatttgggcgtttggagggcataggaaggttatctgagtctcgtcattggtattgatgatgcgagcctttgaggatatcaatgtgaagcttaacttgcactacttgcaaagaacaaacgttgcacgcacgttggagtcagtttgttgtatcctcgactcaagtaggaaatctcctcatatctttccccctcatattttctgcttgttgtggtgcattctgtaattctgttgttattactcggaaggaattgtgattcaaactttgttgttctttctgatgtctttgtgctctttctggtgtttatcatggataagcactaatctaaatttgtttacatctcttgtgctaaagacttttcgggatttaggatgcatacattctttatttcttttcctca

SEQ ID NO: 2721 - DNA, 1488 bp, Secale cereale
cgacaccgacgtggagaagtactccaaggcgcaggggcggacggcggtgagcttcaaccccacggatctggtgtgctgccgcacgctgcagggccacagcggaaaggtatattctttggattggactcctgagaagaactggatagttagtgcctcccaagatggaagactaattgtatggaatgctttaacgagtcagaaaacacatgccataaagctacactgtccatgggtgatgacatgtgcttttgcacccaatggtcaatctgttgcttgtggcggtcttgatagtgcatgctctatattcaaccttagcacacaagcagacagagatgggaacatgccagcatcaagagtacttactggacacaaaggctatgtttcatcctgtcagtatgtcccggatcaggaaacccgcttgattacaggctcgggtgaccaaacttgtgtcctgtgggatgttactactggccagaggatatcaatctttggaggcgaatttccatcagggcatacagctgatgtgttaagtctgtccatcaactcgttaaacacgaatatgtttatctcgggttcatgtgatacaactgtaaggctatgggatctcaggattgcaagccgggcagttcggacatatcatggacatgagggcgacattaacagtgtcaagtttttccctgatggtcagaggttcggtactggttcagatgatggtacatgcagattatttgacatgagaacagggcatcaacttcaagtctacaatcgggagcccgatagaaatgataatgagctccctattgttacatctgtcgccttttccatatcaggaaggcttctttttgctggatactctaatggtgactgttatgtgtgggacacgcttcttgccgaggtggtgcttaatttgggaactctccaaaactctcatgaaggccgtataagctgccttgggctgtcatctgatgggagcgcactgtgtacaggaagttgggacaagaatttgaagatctgggctttcagcggacaccgcaagatagtctgaagccccagcgccgcgtgttctccccgtgttgtacgttcctcgtcgcgtgttggggggtggttggccagctcaaaaggttcctgaagatgaagccgtccgttttgtagcatagactctcctgtcgtgtccaatggaaaacgcagtctgtatgtgctgtgtgatgttgttgcacctggtcaagtttagcgtaagtactgttgtttatagagttgccggaaagcaggcagcgcacatgtgatattttcctttctgccctttgttgtgcacaactatatgtttttagctgtagaaaaacgaagccggattgttagaaccaacaatcaatttgttcgtttctggagtaagataaggaatgtgagcttcatttcctgtgtgcgtgtatgctgcctggggtaagaattgttagaaccaagaatcaatttatagcagtatttttttactga

SEQ ID NO: 2722 - DNA, 2069 bp, Musa acuminata
ggattcgtcgtctaattcctgcgctcgatcgatttctggtcaatttttgctctaaggtatgcattcgtggtctggaaatgacggatcagggcgccaatggagctcagacgatgttggtcatggctggagagggttgattcatttgtcttggatttggtggagctaggtttaggggtacgtcgatgtcggttgcggagctgaaggagcggcacatagccgcgacggctacggttaattctctgagggagcggttgaagcaaaggcagcagctgcttgttgatactgatatggctgcatatggtaggagccaagggagatcggctattagttttggctccacggatctggtttgctgcaggactttacagggtcatactggcaaggtttattcattggactggacgcctgaaaggaacaggatagttagtgcttctcaggacgggagattaattgtgtggaatgctttaacaagtcagaaaacacatgctataaagcttcagtgcccctgggtcgtgacctgtgcttttgcaccaaatggccaatctgttgcatgtggaggtctcaacagtgcctgctctattttcaatctcaattctcaagttgacagagatggcaatattcctgtttcgcagatacttactgggcacaagggctatgtgtattcatgtcagtatgttccagatcaagaaactcgcttgattacgagttcaggcgatcaaacatgcattctgtgggatgtcaccactggccaaaggatctctgtttttggtggtgaatttccttcagggcacacagctgatgttttgagcgtctcgatcaacagttcaaactcaaacatgtttgtttctggttcctgtgatacaactgctcgactatgggacactcgaattgctagtcgggcagttcgaacatatcacggtcaccagggagatgtaaacaccgtcaagtttttccctgatggacaaagatttgggactggctccaatgacagcacatgcaggctatatgatatgagaactgggcatcagcttcaagtatacagtcaacagcatgacggtgatgacaatgatatcccaactgtcacatctattgccttctctatatcaggaagactgctctttgctggatactccagtggtgcttgttatgtgtgggatacactgttggctgaggtggttctgaacctgggagaacttcagaattctcatgagggatgcataagctgcttagatttgtcttctgatggtagtgctttatgcacaggtagctgggacaagaagctaaagatttgggcatttggaggacagaggagggttatctgaatcacgttattggttgatggtgcctgcgatctcaatttgaggctgagggtcagcttgcaaaaatcaagtctgttatatccttttctcaaatgggaagttctatgaagtttattgctctctcaaatgtgatgctagcaaccggatgcaagaggggactgaaccatcaagattgcctccctcatcaactcagcctactatgatttgtacccttaagtttctgcatcctaattatattttctgcttgcttagttacattctattgatatttattagaagaagatcgtggtttagacacaagttcttcctgatggtaacgacttctgggcgctatatatatgtcattacttgatcaacttgcattgcttggatttatgttcatctaggtgttgacttcacttgttatatggtatgcaagtagaacaagttcagtcaacatgaatttggggctaaataaagtagaaattacatgaagcattctatcagatgtaacttatttttattgatgttattgattatagtcaaacattcattagtgtaggatttatctcaactattagtcgtctacatgcgtcttgcttttttgtatgggtcattttggtttcaatataaatatagccatgtaacaagaaagatcaagagatcgatttgatctctgtagtgatgattggcattaccattttgttaaacttatttattttcagttgttatcaataataaatctaatttaactccaatatagcattaaac

SEQ ID NO: 2723 - DNA, 1671 bp, Musa acuminata
ctcgtcttccttttcgccgccctctcctcctctctgttacctctctgagccctaacgctcgatcggttgcccctcccccttctcttctccaatcgcattctcctcagtgtggggacgaagggctaggggtccggatcgagctccccgcagggcggtgtcggcggaataccgtcaaatttcctctcatcttttggaatttcaggaagagtttcttatttttgggtattgggtctggttgatgtcgttctcggagctcaaggaccggcacgtggccgcgacggcgacggtgaacactttgagggatcggctgaatcagaagcggcagcagcttcttgatacggacgtggctggatacgcgaagagccaggggagaacggcagtcaactttagctcgacggatctggtttgctgtaggacattgcagggtcatacaggaaaggtctattcactggattggacgcctgaaaaaaatcgcatagttagtgcatcccaggatgggaggttaattatatggaatgctttgacaagccagaaaacacatgctattaagcttccttgtgcttgggtcatgacctgtgcctttgctccaaatggacattctgttgcatgtggtggccttgatagtgaatgctccattttcaatcttaattctcaagttgacagagatggtaacataccagtttcaagggttcttactggacacaagggctatgtatcttcttgtgagtttgtccgtgatcaggatactcgcttaattaccggctcaggtgatcagacatgtgtattatgggatgtgactactggacagaggatctctgtttttggtggtgaatttccttcaggacacacatctgatgtattgagcatctcaatcaacagttcgaattcaaatatgtttgtctctggttcttgcgacgcaactgctcggttatgggatactcgaattgctagtcgggccattcgaacatatcatggtcaccatggtgatgttaactctgtcaagttcttcccagatggacaaaggtttggaactgggtcagatgatggaacatgcaggttgtttgatatgagaacagggcatcagcttcaagtatactctcaacagcaagccaacaatgaccaagatatcccaattgtcacatccatagcattctctatatctggaagactcctctttgctgggtactccaatggtgattgctatgtgtgggatactctcttagctgaggtagttgttaatctgggaaagctacagaattctcacgagggccgcataagctgcttaggtttgtctgctgatgggagtgctttatgcacaggaagttgggacaagaacctgaagatctgggcttttggaggacacaggaaggtgatctaatctttggctttattgtgttaaagcggacaactttagtttgtggctgaactgggactcctgtcgaattaactactatatctataagagactgaacatcaagatgtaaaccatgaacattaagttctcagatgcatcactccaaccaggtcagtctaaaggctctgagaagcagcattaaagtttgccagcgcttttcttagttcctttgctatgcatcatatgttgcaactgttttgtcatcggactgtttcccaagcctggttcattatactgattcatcatgcatctccctg

SEQ ID NO: 2724 - DNA, 2216 bp, Amborella trichopoda
accatttttcctctggtttttcctttgctctctctctcttcaccaaattttatcttcttctcctttgttctctttcttcatcgttttctactttattttctctccctctctctcttcattttcccctatttcccttctctctccctctctcatttttcttcacattttctcagctctctttatttttttcccatttttctgttctctcacattttctttcacatttttcccttctctcgtactcgaccatctctccttaactctctctctctctctctctctctctctctcacactcctcccccggcgggggataaaccatagaaaatcgcctgtcttagaaatcgcaggaagatgtggaattagggtttccatcgagctcataagaagcatcgatcaagtggggacatttgtattaagtttcatagatagtgcggtatcaggttttgatcagagtgataaatgaagaaaaaacgtgtttcagagagtgtggagaattagtgtgtcaattgaactcggaaagaggcttttgaggaggtagcatagctggattgagcttgtattaggatttgcaggggattcgagagcggtttggatccagctcgagaaggagctgtaatgaagtagagggagcattggttgatctaaattaggtctaaaatgtcagttgcagagttgaaggaaaaacatcttgctgctactgcaacagtaaatagcttaagggaaagattgaagcaaaaacgcctgcagctcttggatactgatgttgctggctatgcaaaatctatcgggaaaacacctgtcagttttggaccaacagatctagtttgttgcaggactttgcaagggcacactggaagggtttattcattggactggacttcagaaaagaaccgcattgtgagtgcatctcaagatggcaggcttattgtatggaatgctctaactagccagaaaacacatgcaattaagttaccatgtgcatgggttatgacatgcgccttttcccccactggccagtcggttgcttgtggcggtcttgacagtgcgtgctccattttcaacctcaattctcaaactgacaaggatgggaatctaccagtatcaagaattctaagtggacacaagggttatgtgtcctgttgccaatatgttcctgatggggacacacatctaataactagttctggagaccaaacctgcattttatgggatgttaccacaggtcagaggctatctgttttcggaggtgaatttccatcaggccatactgcagatgtgttgagcgtctcgattaattcatcaaacacaaagatgtttgtctctggttcttgtgatgcaactgcccgattatgggatactcgcatagccagccgagcagtccggacctatcatgggcatgagggagacgtcaacactgtgaagttcttccctgatgggcagagatttgggactggctcagatgatggcacttgcaggctatttgatatgaggacagggcaccagcttcaagtttattaccagtcacatggtgagaatgaggtcccaatggtgacctccattgccttctcaatatcaggcaggcttttatttgtgggatactcgaatggcgattgttatgtatgggacaccatagtagccaaggttgttctgaatcttggatctctgcaaacctcacatgagagtcgaataacttgtctgggtatgtcagctgatggaagtgccctatgtacaggaagttgggacaggaacctcaagatttgggcctttggaggatacaggacagtgatttgatcgccatgaatagaatctctctccattcttgacctcaggtttctctcttctgcaagtgtttttaataagattgtattttgcattttatccactgcaagagagagaataagcaggatttgaatcggatacggtttctccactggaaaccagtgtatcgtagttttatcgtctttgtttgaagtggccctcttgaatctgtttgctttttgacactttttaacagtttcatagaaagttcctagtcttggaaaatgcgtgtatattatgtctttgcttactgttgtttctatttgattcatgtttgtgtaatttcatggtccctttttttctttctaatacttttgaaatgacattgcattaatgaaaataaatccaattaaaaaaggaaaatagtttgatagggctgcagccctatcgaaataa

SEQ ID NO: 2725 - DNA, 1753 bp, Amorphophallus konjac
ccgttgtctactccatctgcatcccgtggtcggatctgcagtgcggggtcgatggggaattagggcttcaaatcgaggtcggtaggtgctccgatggtaggggactgttgatcgtggaagcctcggcggctctagtggctggtgttcttggctggatgtccatgacggaggtcaaggagcggcacgtggctgcgacggcggccgtgaacaacctgagggagcggttgcgacagcggcggcagctccttcttgatacagacatcgctggttattcgaggacgcacgggaaagctgcggtcagctttaactccacagatctggtctgctgcaggactctgcagggccatactgggaaggtgtattctttggattggtcccctgaaaggaatcgaatagtcagtgcctctcaagacgggaggctaattgtctggaatgctttaacaagccagaaaacacatgcaataaaactaccttgtgcgtgggttatgacatgtgccttttctcccaatggtcaatctgttgcatctggtggccttgatagtgcatgctctatattcaacctaaattcacaggtcgacagagatggaaacctcccagttgctagaatcctcactggccacaagggctatgtgtcttcatgccaatatgtcccagatgaggaaagtcatctaattactagctctggcgatcagacatgtgtcttatgggatgtcactactggtcagaggctttctgtttttggaggtgaatttccttctggacatactgcagatgtatcgagcatctcaatcaacagtgcaaatacaaaaatgtttgtctcgggttcttgtgattcaactgctcggctatgggatacccgaattgccagtcgggctgttcggacataccatggccatgaaggagacgtgaacactgtaaaattctttcccgatgggcatagattcgggactggatcagatgatggtacatgcaggttatttgacatgaggactgggcatcaacttcaagtttacaaccaacaacgcggtgagaattgtagtgatcttcctatcgtcaccagtattgcgttctcaatatccggcagactactatttactggatattcaaatggggattgctatgtctgggacaccttagtagccaaggtggttctaaacttgggaaccgttcagaactcccatgagggccgaatatcttgtctgggcttgtcgactgatggaagtgccatatgcacaggaagttgggatagaaatctcaagatctgggcttttagcgggcacaggagggtgatatagagaatccacgtaacaactccttccaggaaatctactgcaactttaacgcacttgggctttctaaatgtttgtctccgaaagaacttgtacgggcatccttccccaaggccaaacattcaagccgtacatatgggctaccacctcagcatgcagataatatcactcagaccaggagccagagctgcagaatgccatgattcacctcagatttctaggttgggggccctttgtatcgattgtaattttattttgcagttttgatactgatgccgatcgcttgtagctaaaccaggtcgtgcgattagaatagactctgcccagtcctcgttctttttttgcttccccccccccccgctcttatctccgttcattgagtcgacccttcgctttgattatgtaagttctctacggatcagcttgagatgtctttgttcgcgtattatattcaaataaaaaaa

SEQ ID NO: 2726 - DNA, 1322 bp, Festuca arundinacea
cagacggatctggtctgctgccgcacgctgcagggacacagcggaaaggtatattctctggattggactcctgaaaagaactggatagtcagtgcctcacaagatggaagactaattgtatggaatgctttaacaagtcagaaaacacatgccataaagctacactgtccgtgggtgatgacatgtgcttttgcacccaatggtcaatctgttgcgtgtggtggtcttgatagtgcatgctctatatttaatctcaactcacaagtggacagggatgggaacatgccagtatcaagagtacttactggacacaaaggcaatgtttcgtcctgccagtatgttccagatcaagaaacccacatgattacaggctcaggtgaccaaacgtgtgtcctgtgggatgttactactggccaaaggatatccatctttggaggtgaatttccatcaggccatacagctgatgtgttgagtctgtccatcaactcgttaaacacaaatatgtttgtctcgggttcatgtgatacaactgtaaggctatgggatctcagaattgcaagccgggcagttcgaacataccatggacacgagggtgacattaacagtgtcaagtttttccctgatggtcaaaggtttggtactggttcagatgatggtacatgcagattatttgacatgagaacagggcatcaacttcaagtgtacagtcgggagccagatagaaatgataatgaactccctacagttacatctatcgcattctccatatcaggaaggcttctctttgccggttactctaatggtgactgttatgtgtgggacacacttcttgctgaggtagtgcttaatttgggaactctccagaactcccatgaaggtcgtataagctgccttgggctgtcatctgatgggagtgcattgtgtacaggaagttgggacaaaaatttgaagatttgggcattcagtggacaccgcaaaatagtctgaagcccagtgttttttctctccatgttgtatgttcctggccgcgtgttgagaatggtgggcactctcagtaggttcctgaagttgaagttgtttgttttgtagcatagaatctttctgtatcataccttatgtccaatggaaaatacagtatcggctgagactgcaccttgtgatgttgttacctaagtcagcgtactgtttatagagttactagaaatcagcacccatgtaatctttttctgccctttctctgtacaattatttcagctgtaggaaagtactccctcagcatgtctaactacaatctcactgtcaatctgttcgtttctgagtaa

SEQ ID NO: 2727 - DNA, 1629 bp, Aquilegia formosa
aatcatccaaacttttctttctttttcttcatcttcaaacgatataataccacataaaaatggaaattagggttttgatcaagttagaactgaagtaacgaataaaattctatcatagtttagggtttaaaaaaatgtcagttgcagaactaaaagaacgacactcagctgctacagctactgttaatggtttaagagatcgattaaagcaaaaacgattacttcttcttgatactgatgttgctggttatgcgaagtcattaggacgaccagctgtaagttttggtcaaacggatctggtttgttgtagaacgttgcaaggacatacagggaaggtgtattctttggattggactcctgacaagaatagaattgtcagtgcatctcaagacggtagattaattgtttggaatgctttaacaagccagaaaacacatgccataaagctgccttgtgcatgggtcatgacatgtgctttctcacctagcggccagtcggttgcgagtggtgggcttgatagtgtatgcactatcttcaatctaaattctccaatagacaaagatgggaatctaccagtatctagattgctcaatgggcacaaagggtatgtatcgtcatgtcagtatgtaccagatgaggatacacatttaatcacaagctccggtgatcagacatgtgttctgtgggatgttactacagggcaaagaatttctgtctttggaggtgaatttccatccgggcatactgcggatgtattgagtgtatcaatcaataaatcaaatccaaagatgtttgtatctggttcatgtgatgcaacggcacgactgtgggacactcgcattgcaagccgagccgttcgcacatttcatggccatgagggagatgttaacactgtaaagttcttcccagacgggcagagatttgggactggatcagatgatggtacttgccgattatttgacatgaggactggacatcagcttcaagtgtactatcagcaacatggcaataatgatgtccctatagcgacttccattgacttctcaatatcaggcaggcttttgtttgttggctactccaatggtgactgctacgtgtgggacacattagtggcagaggtagtcttaaatctgggatctctgcagaactcccacgagggacgaatcacctgtttgggtttgtcaactgacgggagtgccttatgtacaggaagctgggacaaaaacctgaagatttgggcttttggagggcacaggagtgtcgtttgatattttcaagcggagtggcttcagtctacctaattgcatgtcaggtttgttatatggagcagcgaaccttttgtgtgcatctcactcctgacttgcctttcatctcttaaaaagctgttagagctgatccttagttcatagctgagacaccaaaaaactggagacctcggacgaagagagaagagaagggcaatctatttcaagagcctggccgggggtggttctgtctgtatatttgtggcgagttgtgtttttaacatggtgtattgttaccgacgaattgtgaatgtacttgaaaactaaacacaactattattaagatatgaatttgtaataatggtttccttcttaacaatgttca

SEQ ID NO: 2728 - DNA, 1784 bp, Coffea canephora
cggccggggggggggcctaacatctgaacaacggctagccctgaaccggtgactggtgatctgaatagtgaataccccactactacaaaagccccactctttggcactattagtctcaaaaaaatttggcatttgggtctctaacccggagtctccgtttcagctgtcgcccgtaaccggtaacaaatttcagctgtcggccgtggctgtctctactccgtgcttctccgccgctatatctctcctactcctgtattatcaaaattctttagctcctaaaacccttaatttttattagtaattacccagaagaccaaatttaaggaagagttttcttgatttgtcctgattatatacgtgtagcaaccttagaatgaatcccacttgacccaagagaattaggctatggaagatgtaggaggagtccagaggacttgaatttgtgtcgagtttggggaggaaacggggagggaaaaatgtcagttgccgagctgaaggagaggcacttagccgccacccagactgtcagtgctctcagggaccgattgaaacagaagcgtcttctccttcttgataccgacgtggcgggatactctaggtcgcagggtagaactccggtgagcttcggcccaacggatctggtttgctgtcggactctgcagggccataacggcaaggtgtattcgcttgactggactccagaaaagaatcgcattgttagtgcatcccaggatggtcgattaatagtatggaacgctctcacaagccaaaagacacatgctattaagctaccctgtgcatgggtcatgacttgtgccttctcaccgactgggcagtctgttgcctgtggtggactcgacagcgtttgctccatctttaacctaaattctccaactgacagagatggtaatctaccagtgtcgaaaatgcttagtgggcataagggctatgtgtcatcatgtcagtatgttcctgatgaagatgcacacttaatcactagctctggagatcaaacatgtggcttgtgggatataactacaggtcttaggacatctgtctttggaggtgaatttcaatctggccacactgctgatgtgctaagtgtctccattaatggatcaaattcaagaatgtttgtgtctgggtcttgtgattcaactgcccgtctttgggacactcgggttgccagtcgggctgtccggacctttcatggtcatgaaggagatgttaatgctgtaaaatttttcccagatggaaatagatttggaactggttcggatgatggaacttgcagattattcgatattaggactgggcatcagctgcaagtgtactatcagcaacatggggataacgaggtgccgcctgttacttcaattgcattttcaatttctggcagacttctttttgctgggtattcaaatggtgattgctatgtatgggataccttattgggacaggtcgttttgaatctaggaactcttcaaaattctcatgagggtcgcattagttgtttgggattgtcagctgatggcagtgctttatgtacaggaagttgggattcaaacttgaagatctgggcttttggagggcatagaaaagtgatctaaagattcaacttttgatttccctaacgaataggctcctgattcaccgtccgtgtgtacggttcttgtacaccagtaagctactgtgtgccagggattataattttgtcctacatttaaccttctgcattgtgacttgtttattgcagaaataatacacacacacatatatatata

SEQ ID NO: 2729 - DNA, 1641 bp, Triphysaria pusilla
aaatattattatttgtcacgccaatgatttaattacgcgtatgtaattccacgtcagcaaaatgagtgtgtgccgcccccattacccaacttccccgacgaagctcatttttcactatctgaatcccttctttaactgtaattattgtagatttatgcctgaaattcttgggactaccaaaaattagggctcagatgaagctgaagagctagattttcttagtttcatcatatttctgctctcgagctttatcggaaaaggagatgtcagttgctgaacttaaagagcggcacatggccgccacggaaacagttaacacgctcagggatagattgaagcagaagcgtcttcttcttctagacaccgatgttgctgggtacgcgcgttcgcaggggaaaactccggtgacttttggcccgactgatctggtttgttgccggactctgcaagggcacacaggcaaggtgtattcactggattggactcccgaaaagaatcgaattgtcagtgcgtctcaagatggcagattaattgtatggaacgcgctcacgagccagaaaactcatgcaataaagctaccatgtgcatgggtcatgacatgtgcattctctcccaatggccaatctgtggcctgtggtggcctcgacagtatgtgctctatctttaacctcaactctcaaaccgacaaggatgggaatctgcccgtctccagaacgctaagtgggcataagggttacgtttcgtcatgtcagtatgtcccggatgaagatacacacctgataactgcttctggtgaccaaacatgcgttctatgggatataaccactggacttaggacatctgtatttggaggcgagtttcagtcgggtcattctgctgacgttctaagtgtgtcgataaacgggtccaactccagaatgtttgtgtccggctcatgtgattcgactgctcgtctgtgggacactcgtgttgctagtcgagccgttcgtacttttcatggtcacgagggagatgtgaacaccgtaaagtttttcccagatgggaatagatttggtacgggttcagatgatggaacttgcaagttatttgacattagaactgggcaccagctacaagagtacagtcaaccaagcaatgataatgaggcccgtcatgtcacttcgattgcattttccaattcgggccggctcctatttgcaggttacacgaacggagattgctatgtttgggacactcttttggcacaagtggttttgaacttgggttctcttcaaaattctcatgatggtcggattagctgtcttggactgtctgccgatggcagcgccttatgtacaggaagttgggacacaaacctgaagatttgggcttttggtggctacagaaaagtgatctgagtagtcgagaccatggatcagggcacttcaggatgacctccaaaattttctatgtcgtagttgtatgttgtggttctataactgtgttgtatttctttatctaatcattgtgatcttggacagacaactccagtagataaaaattgtgttgtatttctttattagtgatcttggacagacaacttaagtagatagaaatgaaaattactatattcattcgataaattgttgaaacttgaaaggc

SEQ ID NO: 2730 - DNA, 1666 bp, Aristolochia fimbriata
gttttccgctctgcatttcttctgcgttttcccctttctcgtgaccctagcgtcaacttactccgatcgccctcgggcactggtgtagtgccttgtcgacggagcccgttccgatcggcggcgaaatggccgaatgtgtgtgagagcgcgggagagttgaaaattcgaggttgatgtctgtggcggagctgaaagagcggcacgccgccgccaccaccgccgtgaatgctctcagagaacgcttgaagcagagacgccttcaccttctcgataccgatgtggctggctatgcgagagcgcaagggagaacgccggtgactttcggtctcactgatcttgtctgttgccgtactttacagggacacactggaaaggtgtattcactggattggacctctgagaagaatcgcattgttagtgcatcccaagatggaagattgatcgtatggaatgctcttacaagccagaaaacacatgcgataaaactcccttgtgcgtgggtgatgacttgtgcattttcacccagtggtcagtctgttgcatgtggtggccttgatagtgtatgctctatcttcaatcttagttctcaaactgtcagggacggcaatttaccaatatccagaactcttactgggcacaaaggctatgtatcttcatgtcagtatgttccagatgaggacactcatctaatcactggctccggtgatcaaacatgtgttttgtgggatatcaccactggccaaagaatttctgtttttggaggggagtttccatcagggcatacatctgatgtttcaagtgtctcaatcaatggatccaactcaaagatgtttgtctctggatcatgcgatacaactgctcgactatgggatactcggatagcaagtcgagcagttcgaacgtttcatggacatgcaggagatgtcaacactgtgaagttcttccctgatggaatgagatttggaacaggatcaaatgatggtacatgccgactatttgatatgaggactggtcatcaactccaagtctactatcagccacatggtgatagtgataatgatgttccctatgttacttccattgccttctcaatatcaggcaggcttttgtttgttggatattcaaatggtgactgttatgtatgggacactctcgtggctaaggttgtcctgaatttgggatctttgcaaaattcgcatgaaagccgaataacctgtttgggtttatctgccgatggtagtgctttatgtacaggaagttgggacagaaacctgaagatatgggcattcggaggacacagaaaggttatctgaacgttcttaacgagctttctgatctgtatcatgagtttcagtgcttgtattcatcgattgtggtcatccagtaatggatatgttcaagctgtaaaatgtgtaccactttgtatggcatatattttcttcccttcttccatttttctccttgtatgttttctctaccccaaaagccttgtggagtgtgttatctacgtgtcataaatggactgttagtggttacatgaaaagaaagtgtaaaaaacttgggaggcaacttttgctttctgagacttggaatgggtttgtgtgaaacggccatgcagtcaatagttatgcaatgaagtgaacataaatgagataaaaatattaac

SEQ ID NO: 2731 - DNA, 2103 bp, Cannabis sativa
aaattagatttgtacgttaaatttgatcaattattttataaacaccgtcacaaaccaaaattttggacaacgtgtctagcaatatactggagcagaagtagccgttaaagagcacgtggacaagggacctaattttgtcagtgaaaaaatacaccaattcactctaatcatcacacgctccatagccacgcgcctaagttttttgagtttgagaagtgaccggctcaatctgtctctttctttttctttgtatctctcccatctgaggagagcgagggagagcagtgcttccgctgtaggaggagacaccggcgcagctcacacctgcaaagtgcaatctcttcagtttctgacctctctttcaatcacttgcatacacactatttccttctcagtcttctttctagacaccaactgggaaaaacaattatataaaattcgccggaaaggaggcgaacggaaaaccctaatctgacgctctgaagttatggatggcggggtggtctgagcttttttcctgaagaatcattcatgttactatagcatctggtttgactttttttttttcttttaccttcgtctatggcagtcttctaatttcaattttcgacgagaaaggtttttgtaaggaaggaaaaaatgtctgtggccgagctgaaagagcgccacgtagcggcgaacgagacggtcaactctctcagagagcgattgaagcagaggcgacttgctttgctcgatactgatgttgcagggtatgcgaggtctcagggaagaactccggtccgctttggacctacggatctggtatgctgtagaacgttgcagggtcacgcagggaaggtgtattcattagattggactcctgaaaagaaccgaattgtgagtgcatctcaggatggaagattaattgtctggaatgcactaacaagccaaaaaacccatgctataaagttaccttgtgcgtgggtcatgacttgtgctttttcaccaactggtcagtccgttgcatgtggtggtcttgacagtgtttgctctatctttaatcttagttcacaaacggataaagatgggaatcttcctgtggcaaaaatgcttagtgggcacaagggttacgtttcttcctgccaatacgttccagaggaggatgcacacttaattacgagttctggagatcagacatgtgtcttgtgggacattactacaggccttagaacttcagtttttggaggtgaatttcaatctggacatactgcagatgtgctgagtgtctccattaatggatccaacccaagaatgtttgtatctggttcatgtgatacaacagcacgattatgggacactcgtgttgctagtcgagcagtgcggacatttcatggccacgagggagatgttaattctgtaaaattctttccagatggcaatagatttggaactggctcagatgatggaacctgcaggttatttgatattagaacaggacatcaacttcaagtataccaccagcggcacggtgataatgataacccacatgtgacttcaattgcattctccacgtcaggaaggcttctctttgttggatacacaaatggtgattgctatgtatgggatactttattggctgaggtggttttgaacttaggatctctccagaactcacacgagggcagaattagctgcttgggtttgtcagctgatgggagtgccttgtgtacaggaagttgggatacgaatctaaagatatgggcatttggagggcatagaagggtactatgatcgatggggtaataataattgagctaccttagttgtcttgaggggttctcatctcaaatccatgaccatggggtcctaactgccttcacacagaattccttattttgggtttgagaaaaacgatattctgtaatgccatccctgtattcctcattggaaaagtaagaaatttcaatattgaaaagaatatatatcttatcttatttcctattattataactctatgttaatatttgagtactaatattataaaaataatgtcttacttttataaaaacctcttattctggtgtgaacccgactattttaccagtgtggctgatttttttt

SEQ ID NO: 2732 - DNA, 2331 bp, Populus trichocarpa
gtaaccatataagaaaatctaaaaaataaataaataaaaaagataaaactcaattcagctctcaatttattattttagtactaattaagttttaataatattatttttatatattctattttattttcgtccttccactacagcgattaaaacatatattcaatttatacaccaagtggtaattttattcaagatatcataataaatttaatttgctccaaaggacaattccaacattaaaggttttcaatattatatttaagataaaatataaaaatcacctgaaaatataatgataaattaaagttttcctaaaaaaaaaaaaacagcacgacacgtaagataataataataataataataataataataaaagaaagtgcacccggcggctgcagtaaaaaaaataagcctcacttcccttctctcctgtctctgttaacctctgcaaaaaacacgaattgcagtatcagtccattaccacctgcacagcctcaacctcctctaaaactaatcaaaactatatatcccactctctctctctctcttaaattattgaatttttaaaacctttctttcttcctcaatccttttcgagtcatgatttatgatcacaactaggactttaagaagaaatatataattacaaaagcttaaaactttgatggccagtgctttttagttcacttttttctttttggaaaaattgaagatagtaatgtctgtttcggagctaaaggagcgccatgtggcggcgacagagacggtgaattctttgagagaacgattgaagcagaaacgccttcttttacttgatacagatatggcgagatacgcgagggcgcaagagaggagtccggtgagttttgggcccaccgatctggtttgttgcaggactcttcaaggacacactggcaaggtatattcgttggattggacccctgaaaggaatagaatagtaagtgcttctcaagatgggcgattaatagtgtggaatgctctaacaagtcagaaaactcatgccataaagctaccttgtgcgtgggtgatgacatgtgctttctctcctaccggacaatctgttgcttgtggcggtcttgatagtgtttgctcaatttttaacctgaattcaccaactgataaggatgggaatctacctgtatcgagaatgcttagcgggcataagggctatgtatcatcctgtcagtatgttccagatgaggatacccacctgataacaagttctggcgaccagacatgtgttttgtgggatattacaacgggcattagaacttccgtgttcggaggagaatttcagtctggacatactgctgatgtgctaagtgtctcaattaatggatcaaactctagaatgtttgtatctggttcctgtgattcaactgcccggttatgggacacccgagttgcaagtagagcagtgcgcacatttcatgggcatgaaggagatgtcaatgctgtaaagttctttcctgatggtaatagatttggaacaggctcggatgatggtacttgcaggttatttgatatcaggactgggcaccagctccaagtttactatcaccagcatggtgatactgagatcccacatgtaacctccattgcattttcaatatcaggaagactcctctttgcgggatactcaaatggtgactgttatgtttgggacactttattggcagaggctgttttgaacttgggatctttgcagaactcacacgagggccggataagctgtttgggtttgtcagctgatggaagtgccttgtgtacaggaagttgggatacaaatctaaagatttgggcttttggagggcacaggcaggtaatctgattcgagcagaaggatcgaatcacatgtctcgtttcctctcaggttcatgcttctcaaagccttttcagatgcactgtgctgttggtagattccttcacattctcgtcaagtttatgtgaaccatatctctgtgctgccgcctgtaattctcatgtgaaaattgatgagaaaatggaaaaatgcatgatcttacttggtgaaattggctattcatgttatatctggctacagtatcaaagttgcctgtttaatttgtacgtaccaattactgtatcctgtacctttatttaatgaaaaatcttcgttttctttaatcaatcctccacctccccatactaaccctctttttttcctgtatcatacctcaaaactaatgccctggatcacccattaccttgttagatgttagataacaaaaggaagtgactgcatgctgtttctattttgctaaagttcaatccatggaatcttttcacgaa

SEQ ID NO: 2733 - DNA, 1625 bp, Catharanthus roseus
tcttccgtttcttcttctcacgggaaacatctccctcctcccatcctccacctctaaaaatcccctccgctgtccgcaggaatctgttgaagctattccaatgtcttaattatccaattccatcattccaatagtcccactgtcaatcgaattttatgaaatgaagctaggcaactgaagcttcaatgcgacttcatagttgattttttttgtccttttcgttttctgttgaaatataggtaaaaatgtcggtagctgagctcaaagagcggcatgcaacagccacgcagaccgtcaatactctgcgtgagcgattgaggcagaggcgtcaacttctcctcgacaccgatgtggctggatatgcgaggtctcaagggaaaactccggtgacctttggtccgacggatctcgtttgctgtaggaccttgcagggacacacaggcaaggtgtactcacttgactggaccccagaaaggaatcggattgttagtgcatcccaagatggaagattaatagtctggaatgccctcacaagccaaaaaacacacgcaataaagcttccttgtgcatgggtcatgacttgtgccttctcacctagtgggcagtctgttgcttgtggtggtcttgacagtgtatgctctatcttcaatctcaattgtccaacagataaggatggaaatcttcctgtctcaagaatgcttagtgggcataagggttatgtttcgtcatgtcaatatgttcccgatgaagacactcacttaataacaagttctggcgatcagacgtgtgtcttgtgggatatcactacagggctcagaacatctgtctttgggggtgaatttcagtctggtcacactgctgatgtgctgagcatctcaatcaatggttcaaactcaagaatgtttgtctctggatcttgtgattcaactgctcgtctgtgggatacacgtgttgctagtcgggctgtccgaacatttcatggtcatgaaggagatgttaatgctgtcaagttctttccagatgggaatagattcggaaccggttctgatgatggaacatgcagattatttgatattaggactggacaccagttacaagtgtattatcagcaacatggtgataatgaggtgcctcacgttacttcaattgcattttccgtttcaggcaggcttctttttgctggatattcaaatggtgattgttttgtatgggacactttattggctcagatggtcttgaatttgggatctcttcaaaactctcatgagggtcgcataagttgcttgggattatctgctgatggaagtgccctgtgtacgggaagttgggattccaatctgaagatttgggcatttggaggacacaggagagtggtttaagtttgccaacacttctggatttccctgacaaataggctcctgattcaaattgtaggtttgatgcttactttgtatatctctcttctcttaaagagtgctaagccacctgtaatatctgagaaactgtaatcttggtggtgcttcttcctgtagcccttgtgtatcctgtgttatatgtatgtactttataaacactgatatacttacattctttctatataagcaatgtcgatttattgtctcaaa

SEQ ID NO: 2734 - DNA, 1707 bp, Citrus clementina
agaaattaaatttaagaaaaagaaaaatcaagtttacaagttgtaacatcaccaccatcaacttcaattcacgttaccttaaaacactttgtcagctctctctctctctccaaatcatcgaatcaagattatcaacgactttaattttaataacttctcacatttctatctcaagacaacattttttttttctttttcgatttatttatttttttaaattttacgaaataacatgccactctagggctcgaatggaggaagctcacttgatactttcgagcttaaagttgaagcaaacatgtgatgtagaaatttaaattttatctactctttttttttttttccttgtaagttcgattgattgataaaacatgtcgtcgtcggtctcggagctgaaagagagacacgcggcggccattgagacggttaacagtctcagagaacggctcaagcagaagagacagcagttgctcgacgtagacgttgctgggtactcgaggtcgcagggtcgggctccggtcagctttggtccgaccgatctagtttgttgtaggaccttgcaaggccacgctggcaaggtatattcattggactggacttccgaaaggaatcgaattgtcagtgcatctcaagatggaaggttaatagtgtggaatgctcttacaagccagaaaactcatgctataaaactgccttgtgcttgggtaatgacttgtgccttctctccaactggtcaatctgttgcctgtggtggtcttgatagtgtttgctccattttcaacctgaattctcctactgacaaggacgggaatttaccagtatcaagaatgcttagtgggcacaagggttatgtgtcctgctgtcagtatgttcctgatgaggacactcacctaattaccagttcaggtgaccaaacctgtgttttgtgggatattactacaggccttagaacttctgtttttggaggagaatttcagtctgggcacactgctgatgtgttaagtgtctcaattagtggttcaaactcaaggatgtttgtgtctggttcctgtgattctactgcccgattgtgggatactcgtgttgcaagtcgagcagtgcgcacatttcatgggcatgagggagatgttaacactgtgaagttctttccagatggcaataggtttggaactggctcagacgatggaacttgcagattatttgatatcaggactgggcaccaactccaagtgtattatcagcagcacggtgagaatgagatcccacatgtgacgtccattgcattctccatatcgggaaggcttctttttgccggatactcaaatggtgattgttatgtatgggacacattattagcaaaggttgtattgaacttgggatctctccagaactcacatgagggccggatcacctgtttgggtttgtcagccgatggaagtgccttatgtacaggaagttgggatacaaacctaaagatttgggcttttggagggcacaggagggtgctctgagtccttggggagtgaaaggcttgtgaatcttctcttaaatctcaggttctggcttacgtcattttgctgcttcttgcttccttgatagattcctttgtatttttaactagttaatgtggtttgagaaattgtaatcatttgctgtggcttcttgtaatctccatgtgaaatactgaccgtttgactaggtgaaaaa

SEQ ID NO: 2735 - DNA, 1727 bp, Quercus alba
tctctctctctctctcttaagcaggagaggagcccccacaggccacagctctcttcacctttcacaaacaaaagccccaaaattttgttttttttgtttttatattctctttactaatctcttacacgcagttcctctctcatacccaaatcgaaaccctaaagcccattccattcctaaacattcaaacaaaaatggtcgtttttagttagttaagaagttagttaattgtgggtggtggtggtggtgggagaagaatgtcggttgcggagctcaaagagcgccacgcggcggccacggagactgttaacactctcagagagcggcttaaacagagacgccgttcgctgctcgacacggacgttgccgggtacgctaggtcgcagaatcggactccggtcactttcggaccaacggatctggtttgctgtagaacacttcagggtcatacaggcaaggtgtattcattggattggactcctgaaaggaaccgacttgttagtgcatctcaagatggccgattgatagtgtggaatgctttaacaagccagaagactcatgctataaagcttccttgtgcatgggtcatgacttgtgccttttcaccaacaggccagtctgttgcctgcggtggtcttgatagtgtatgctccatcttcaacctgaattcccccactgacaaggatgggaatttaccagtttcaagaatgcttagtgggcataagggctatgtttcgtcctgtcaatatgttccggatgaggatactcacctgatcaccagttctggtgatcaaacatgtgttttgtgggatattactacaggcctcagaacttctgtttttggaggtgaatttcagtccggtcacactgcagatgtactaagtgtctcaattaatggaacaaattcaagattgttcgtctctggttcctgtgatgggactgctcgtttgtgggacactcgtgttgcaagtcgagcagtgaagacgtttcatggacacgagggagatgttaatactgtgaagttctttccagatggaaatagatttgggactggttcagatgatggaacttgcaggttatttgatatcagaactgggcaccaactccaagtatactatcagcagcatggtgataatgacgtcccacatgtgacctccattgcattctctatatcaggaagacttctctttgctgggtactcaaatggcgattgctatgtgtgggacacgttattggcaaaggtcgtcttgaacttgggatctctccaaaattcacatgataaccggattagctgtttgggtttgtcagctgatggaagtgccttatgtacaggaagttgggatacaaacctaaagatatgggcttttggagggcataggaaggtaatctgatgtattgaaggagaaaaatctaacttctgagtttctctttcccgggtccacagttctcattttcttctcataccattgtatcctggtcctggtaaaatgtttgagtctactattttactagggtttgagaaaccataatcctgtaatgtttgttgtaatttagaaaaacaatctgtcgagaaagaaaaattattcggttgagaacttgagctggagggaccagtattttttatctgcatgctgtgtgtatgtctctgatcgttgtttgccctcctattcaccgatcaatgcggcaccctatatatatatattcaatctttaaaattttctctctct

SEQ ID NO: 2736 - DNA, 1499 bp, Papaver somniferum
gagagatgtcagttgcagaacttaaagagcggcatgtagctgcagcagcaactgtaaattcacttagagaacgattgaagcagaaaagacttcttctacttgatacagatgttgctgggtattcgagattacaaggaagaagtgcgattagctttggacctactgatctggtgtgttgcagaacattgcaaggacacactgggaaggtttattcattggattggactcctgagaagaacagaattgtcagtgcatctcaagatggaaggttaatcgtatggaatgctctaacaagccagaaaatacatgcaataaagctaccctgtgcatgggtcatggcatgcgccttctcgtccagcggccagactgttgcgagtggtggccttgatagtgtctgcactatcttcaatcttaattcaccaattgacaaggatgggaatcttccggtatcaagaatacttagtggacacaagggttatgtatcatcatgtcagtatgttccggatgatgacacacacttaataacaagctctggtgatcagacatgtgttttgtgggatgttactacaggacagagaatttccgtctttggaggtgaattcccatccgggcacactggtgacgtattgagtgtttcgattaatggatcaaactcaaagatgtttgtctctggttcatgtgatgcaactgctcgattgtgggacacacgtattgcaagtcgagcagtacggacatatcatggtcacgatggagatgtgaatactgttaaatttttcccggatgggcagagatttggaactggctcggacgatggtacatgcaggttgtttgacatgaggaccggacaccagctccaggtttatcaacaacctggaggtattgatgttcctactgtgacttctattgcgttctcatcatcaggcaggctcttgtttgctggatattccaatggggattgcttcgtgtgggatactttgttagcaaaggttgttcataacttgggttctctgcaaacctcacacgagggtcggataacctgtttggggttgtcagctgatgggagtgcgttgtgtacaggaggttgggataggaatctcaagatttgggcttttggagggctgcgaaaggtgacttaaattgccaaataggaaacaagtgctatgctcataaccaaccggcaagcaggtctcgcactcccccacaattaattatcttaacttgtagaaggatcctccatttgtttattgggagtgtgattgaaagtatttgttgagtttatgtaacaattccccatattggtaggggaagcgttttgagagaggaaaaagcagagaagttcctcttgctattgttgtatcagcacgggggtttgtttatgttaaactgtgttcctttactagctacaaatgttatccgattagtgagacaaatccatgtgaaaatgttcagcacaaagcatcctggtacgaaaataagtacaagtgggctaaaaaaaaaaa

SEQ ID NO: 2737 - DNA, 2432 bp, Pseudotsuga menziesii
tttgcagaccaaacatctctggttttgcttattttgccggtgctaatcagggttcaatgcattctccataagagtaacccacccgttcctgtaaattatcgagctatgtcggtggcagagcttagggagcgtcatgtagcggcaacggcaaaggttaacgctctcagagaacggataaaagacaagcgccttcagctgttggatacggacgttgcaacgtatgctaagaataatggaaggaccccgatcagcttcagcttcacggatctggtttgctgtagaacacttcaagggcatacaggaaaagtttattcattggactggacatctgagaaaaatcgcattgtgagtgcatctcaagatggacggctgatagtttggaatgctttgacaagccagaaaacacatgcaattaagctcccctgtgcctgggtgatgacctgtgcattttctcctagtggacaggcagttgcatgtggggggcttgatagcgcctgctccattttccagcttaactctcagtttgacagagatgggcatctacctgtttctagaattcttagtggtcataagggctatgtctcttcttgtcaatatgttccagatggagatacacatgtaataactggttctggtgatcggacatgcgttcagtgggatgtaacaacaggacaaaggattgctatctttggaggtgaatttccattgggtcacactgctgatgtcatgagtgtatccatcagttcaacaaaccccaaggaatttgtttcaggctcttgtgatacaactacgcggttatgggacacacgtattgctagcagggcaattcgaacgtttcatggacacgaggcagatgtgaatactgtgaaattttttcctgatggactgagatttggaactggctccgatgatggtacctgtaggttatttgacatacggacagggcaccaactacaagtctataggcaacctccccgggatattgagatgccaactgtgacatctattgcattctcattttctggtaggcttctatttgcaggatattctaatggggactgctttgtgtgggacacaatactggataaggtagttctaaacttgggagaactacaaaatacacataatggccggataagctgtcttggattgtcggctgatgggagtgctttatgtacggggagctgggacaagaatctaaagatctgggcatttggaggccaccgaaaaatagtttgattggcgagaaattataaaaaaaattcacttaaatgcttaccttgagcaaatgcaatctttataaagtgagatgggatgtatgtttccttcaaattggctaatctgatttccgcctgcagttccaattattaactgctatcttgcaacagtcatcgttctatgggcctaagctgtattgatattctcttgatcgttggagaaggaagatcatttgtaactttgtaatatgtattgatattttattcgtgttttctcattgcatttgggctgtgctacatttatatgatccttgcctctatgattcccaaaagcttcaattcaaatacctgtgaaggatctggagcttacagtcgcatttacatgttcaattatatatgaaggcttgtggatttgaatgaaaaccaatgtaattgtttttatagtgtgttacaggtttaggattacagggtcccaacatacaaattacaaataggtggcaccgtggcatataacaacccgccataaagccgatatataaaggcggtaggcctgatttacttaaatttttcacctatttcactttattttattaatattcatagccaccaaaattatataaacggttgaactcccaatggccgaaactaatcgttgtaagcaggctgccattcgagcctgatttccaagagaccagatttaacacgaaagagcttgacgacaacgtcctgaactattcgaccatgattgtgctggacgatccaactatctttaacaaggtagctattactgttttgaggcactaatttcttcccagttgccatgggatatgattcttcaagaagaggctttagatctatttcagcttctcccaggaaatccttccgtttgaatttcgggaagtgatcttcatccgacacctccagattgagtatggtatcaccaggatagaaaacatcagtgaacttaagctcctcgtcccaaactggattaagggtcttttttttcacactagttttcgctgtttgttcacccaacgtgacaacaacgtaaggatcactactctttacgaagcgatcaccaacaaccaaattggagccctttaacacgcgcacatacagaacgccagacaccgccatctctgctctgcaacacacaaaacacgaaagaaaagataggaagtaagagcgctcaatctgtcaatccttactatgtct

SEQ ID NO: 2738 - DNA, 1320 bp, Brachypodium distachyon
ccccactcccgcctctcccctcccacaaaatcctagggtttctcgatccccttctctcgccgccgccgccgacgagtaatacccgcccgcttccgccatgttggagctacggctggtgcaggggagccttctgaagaaggtcctggaggcgatccgtgacctagtcactgacgccaacttcgactgctccgggacggggttctcgctgcaggccatggactcctcccacgtcgcgctcgtggcgctgctcctccgctccgagggcttcgagcactaccgctgcgaccgcaacctctccatggggatgaacctcaacaacatggccaagatgctccggtgcgccgggaacgacgacatcatcaccatcaaggccgacgacggctccgacaccgtcaccttcatgttcgagtcccccaatcaggataagattgcggatttcgagatgaagctgatggacatcgacagcgagcacctcggaatccctgactccgagtaccaggccattgtacgcatgccgtcttctgaattctccaggatctgcaaggaccttagcagcatcggagacactgttgtcatctcggtcaccaaggagggtgtcaagttctccactgctggagacattggaactgcaaacatagtttgcagacagaacaagactgttgacaagccagaggaggctactatcattgagatgcaagaaccagtatcattaacctttgccctaaggtacatgaactccttcaccaaggcaagcccactctcggaccaagtgaccatcagtctttcatctgaactaccagtggtggttgaatacaagattgcagagatgggctacattagattctatcttgcaccaaagattgaagaagatgaggaaatgaagtcatgattgcatctcaaggatatgcttatgctgcttgcttttccaggtcttacgaccactgtttgcttaactattgtttgtaagcaaaatggatgttatgcttgctttagctactcttctgtacctgactgctctgtggatctttggacctcagggtatcaatgttgttagcttagtgatgttcatttcgtttcctgaattttacttcattggcggaactgtagtgtgctgcttctggttttgcttagctgactacgctaggttgagcatgaaaatacctcgtttgtgctttagaggcagcattctgaggaacaaaactatgcaaccattgccaaaatttaggctagatcatcattttatcgtagagttagtttttagcacattgagcaatagagctgtacgttttgagatttgcatttctggcttggcaagttggc

SEQ ID NO: 2739 - DNA, 2465 bp, Brachypodium distachyon
aatttctccctcccattttcccctcggcgcccccaaaggcccaaatcgttccctattaattccccaccccatctgctaacccccactcccgcctctcccctcccacaaaatcctagggtttctcgatccccttctctcgccgccgccgccgacgagtaatacccgcccgcttccgccatgttggagctacggctggtgcaggggagccttctgaagaaggtcctggaggcgatccgtgacctagtcactgacgccaacttcgactgctccgggacggggttctcgctgcaggccatggactcctcccacgtcgcgctcgtggcgctgctcctccgctccgagggcttcgagcactaccgctgcgaccgcaacctctccatggggatgaacctcaacaacatggccaagatgctccggtgcgccgggaacgacgacatcatcaccatcaaggccgacgacggctccgacaccgtcaccttcatgttcgagtcccccaatcaggataagattgcggatttcgagatgaagctgatggacatcgacagcgagcacctcggaatccctgactccgagtaccaggccattgtacgcatgccgtcttctgaattctccaggatctgcaaggaccttagcagcatcggagacactgttgtcatctcggtcaccaaggagggtgtcaagttctccactgctggagacattggaactgcaaacatagtttgcagacagaacaagactgttgacaagccagaggaggctactatcattgagatgcaagaaccagtatcattaacctttgccctaaggtacatgaactccttcaccaaggcaagcccactctcggaccaagtgaccatcagtctttcatctgaactaccagtggtggttgaatacaagattgcagagatgggctacattagattctatcttgcaccaaagattgaagaagatgaggaaatgaagtcatgattgcatctcaaggatatgcttatgctgcttgcttttccaggtcttacgaccactgtttgcttaactattgtttgtaagcaaaatggatgttatgcttgctttagctactcttctgtacctgactgctctgtggatctttggacctcagggtatcaatgttgttagcttagtgatgttcatttcgtttcctgaattttacttcattggcggaactgtagtgtgctgcttctggttttgcttagctgactacgctaggttgagcatgaaaatacctcgtttgtgctttagaggcagcattctgaggaacaaaactatgcaaccattgccaaaatttaggctagatcatcattttatcgtagagttagtttttagcacattgagcaatagagctgtacgttttgagatttgcatttctggcttggcaagttggcaggactgagaaattcagcaacggtgtatctctgaagtctgaattagagagttcattgtggaatcggagatggactccttatgatccagtcttccgattcatattggtgacatacgggtctatggccttacaacactggagtacttaatatgaatcatattcacatgacatgattaaacagttcacattgagaatgttaatcagttgctagctactacagtctgcattagacaagctgcttctgatgaccaccattacttcagtcatttgtgacaagttactttgatcctgacctcagacctctgtcagcgtcactgctctgaaatctgcacaggattgtgaagagaagagctgagtatttttaatcagtatatctgaagagctaacatatctacctgccgaaaagaacagaagacatcaaagtcatgaaagatgctgcattatagctgaaatagtaaatacttgggtaactgctgataccaagtactccacccgtcccaagtgtcgtgcgtatctagacaaagtaaggagtaggaatgtagacttctgtgagaagtgttgactcgacagttgctgcggatcagctgaattgatttcgcttaaaagaacacaagctgaaattatagtctaataaacattagcagtttatcagcaacagtaacttcaacctaagcttctgggagctcaccaaacaggtgtagtgccttttctgagtttttcagaatatgataagtttgaatcaagaaacctttgctgttactgaagcacaagttacaggcttacatcaagcaggcagtgatatacttcaattcaacaaatgctaacttctaaaagttgcatacaacaaaaagggctgtatgactaacatgaaaagaaagtctccccactgtaaacgcattcattccaggaagaaaaatacctatgcaagtgtggcataaacagaaagctttctgtagtttttggcatcatctcttgtgattgccttttccagatcgaacatccaccaggatggtcaggccgtggcacgggtgtttcctgcctaacaagcttcatgtcatgccctatt

SEQ ID NO: 2740 - DNA, 1173 bp, Secale cereale
cccgcactcccgcctctccccaaatcctagggtttctcgatccaccccgccgccgccgccgtccgccgcacccccgagggtttctcgatccacccctcccctcacacccccccgccgccgccggcccccgcccgcccgcccgcccgcccgcccgcgaagatgttggagctgaggctggtgcaggggagcctgctgaagaaggtgctggaggcgatcaaggagctggtgacggacgccaacttcgactgctccgggacgggcttctcgctgcaggccatggactcatcccacgtcgcgctcgtcgccctgctcctccgctccgagggcttcgagcactaccgctgtgaccgcaacctctccatgggcatgaaccttggcaacatggccaagatgctccgctgcgcaggcaacgacgacatcatcaccatcaaggccgacgacggctccgacaccgtcaccttcatgttcgagtcacccaatcaggataaaattgcagactttgagatgaagctcatggacatcgacagcgagcacctcgggatccccgactccgagtaccaggccatcgttcgcatgccctcctcggagttctccaggatctgcaaggatcttagcagcatcggcgacactgttattatctctgtcaccaaggagggtgtcaagttctccactgctggagatattggaactgcaaacatcgtttgcaggcagaacaagactgttgacaagcctgaggaatctaccattatagaaatgcaagagccggtttcacttacctttgctctgaggtacatgaactcctttaccaaggcaagcccactgtcagaccaagtcaccatcagcctctcatctgaattgcccgtggttgttgagtacaagattggtgagatgggctacattaggttttatctggcacctaagattgaagaggatgaggaaatgaaggcatgattgtgtttcaaggatatgctgatcttgcctacattaagttttatctggcacccaagatcaaagaagacaaggaaatgaaggcatgattgtgttcaaggatatgcttatgttgcctacattccctagttgttaaaccaacctccatttgcttaatgattgtttgtaagcaaaatgatgttatgcttgttttagctacttgtatctgtgactggtggtggttca

SEQ ID NO: 2741 - DNA, 1170 bp, Triticum aestivum
ccgccgccgccggcccccgcccgcccgcgaagatgttggagctgaggctggtgcaggggagcctgctgaagaaggtgctggaggcgatcaaggagctggtgacggacgccaacttcgactgctccgggacgggcttctcgctgcaggccatggactcctcccacgtcgcgctcgtcgccctgctcctccgctccgagggcttcgagcactaccgctgcgaccgcaacctctccatgggcatgaacctcggcaacatggccaagatgctccgctgcgccggcaacgacgacatcatcaccatcaaggccgacgacggctccgacaccgtcaccttcatgttcgagtcacccaatcaggataagattgccgacttcgagatgaagctcatggacatcgacagcgagcacctcgggatccccgactccgagtaccaggccatcgtccgcatgccctcctcggagttctccaggatctgcaaggatcttagcagcatcggcgacactgttattatttctgtcaccaaggagggtgtcaagttctccactgctggagatattggaaccgcaaacattgtttgcaggcagaataagactgttgacaagcctgaggaatctaccattatagaaatgcaagagccggtgtcacttacctttgctctgaggtacatgaattccttcaccaaggcaagcccactgtcggaccaagtcaccatcagcctctcatctgaactgccggtggttgttgagtacaagattggcgagatgggctacattaggttttatctggcacccaagattgaagaggacgaggaaatgaaggcatgattgtgtttcaaggatatgctgatcttgcctacaataggtgttatctggcacccaagattgaagaagacaaggaagtgaaggcatggttgtgtttcaaggatattcttacgttgcctacattcccctagttgttagtcgttaaaccgacctccatttgcttaacaattgttttgtaagcaaaaatggtgttatgcttgttttagctatttagctacttgtatctgtgactgttggtccatggattttccattgctgaatgttggtcttttaactacttgtatctgtgactgttggtccatgctacaccagtgctgttattgttaggcaatgacttggattgattgaa

SEQ ID NO: 2742 - DNA, 1422 bp, Triticum aestivum
aaatcctagggtttctcgatccacccctccctcacaccccgccgccgccgccgccgccgtcgccgtccgccgcactcccgagggtttctcgatccacccccgcccccttcgcgccccgccgccgccggcccccgcccgcccgcgaagatgttggagctgaggctggtgcaggggagcctgctgaagaaggtgctggaggcgatcaaggagctggtgacggacgccaacttcgactgctccgggacgggcttctcgctgcaggccatggactcctcccacgtcgcgctcgtcgccctgctcctccgctccgagggattcgagcactaccgctgcgaccgcaacctctccatgggcatgaacctcggcaacatggccaagatgctccgctgcgcgggcaacgacgacatcatcaccatcaaggccgacgacggctccgacaccgtcaccttcatgttcgagtcacccaaccaggataagattgccgacttcgagatgaagctcatggacatcgacagcgagcacctcgggatccccgactccgagtaccaggccatcgttcgcatgccctcctcggagttctccaggatctgcaaggatcttagcagcatcggtgacactgttattatctctgtcaccaaggagggtgtcaagttctccactgctggagatattggaaccgcaaacattgtttgcaggcagaacaagaccgttgacaagcctgaggaatctaccattatagaaatgcaagagccggtgtcacttacctttgctctgaggtacatgaactccttcaccaaggcaagcccactgtcagaccaagtcaccatcagcctctcatctgaactgccagttgttgttgagtacaagattggtgagatgggctacattaggttttacttggcacccaagattgaagaggacgaggaaatgaaggcatgattgtgtttcaaggatctgctgatcttgcctacaatagctgttatctggcacccaagatcgaagacaaggaaatgaaggcatggttgtgtttcaaggatattcttatgttgcctacattcccctagttgttagtcgttaaaccaacctccatttgcttaacgattgtttgtaagcaaaaatggtgttatgcttgttttagctatttagctacttgtatctgtgactgttggtccatggatttccattgatgaatgttggtcttttagctacttgtatctgactgttggtccatgttacaccagtgctgttattggtaggcaatgacttggattgattgaatgcatttctaggtatcgcagagtgttttgcatcaggtagatgctgcaatgattgcaacttgcaaaaactgtcaaataatgttacctccattgctggaggcattgcaagaactcaaaatgtctgaagatgtaggttcccttacaa

SEQ ID NO: 2743 - DNA, 962 bp, Lolium multiflorum
ccgccgccgccgcgaagatgctggaactccggctggtgcaggggagcctgctgaagaaggtgctggaggcgatcaaggacctggtcaacgacgccaacttcgactgctccggcaccggcttctcgctgcaggccatggactcctcccacgtcgcgctcgtcgcgctcctcctccgctccgagggcttcgagcactaccgctgcgaccgcaacctctccatgggcatgaacctcaccaacatggccaagatgctccgatgcgccggcaacgacgacatcatcaccatcaaggccgacgacggatcagacaccgtcaccttcatgttcgagtcgcccaaccaggacaagatcgccgacttcgagatgaagctcatggacatcgacagcgagcacctgggcatccccgactccgagtaccaggccatcgtccgcatgccctcctccgagttctcccggatctgcaaggacctcagcagcatcggggacaccgttatcatctctgtcaccaaggagggcgtcaagttctccactgctggagacattgggactgctaacatcgtctgcaggcagaacaagactgttgacaagccagaggaatctaccattatagagatgcaggagccagtgtcacttacctttgctctgaggtacatgaactccttcaccaaggcaagcccactgtcggaccaggtcaccatcagcctctcatctgagctaccagtggtggttgagtacaagattggtgagatgggctacattagattctatcttgcaccaaagattgaagaggatgaggaaatgaaggcgtgattgcagcactaagggtgtgcttatgttgcattacttttccaggtcttcggaccactttgcttggtgcttttatgtaaggaaaattatgttatgctagctttagcatttctgtatctgtgactgttcgtcgttgctggattaccaggggttaat

SEQ ID NO: 2744 - DNA, 1213 bp, Avena sativa
gctcccactcccgtctcccaaatcctagggtttctcctcccaatctcccctctcccccatcaccacaagccccgcccgccgccgccgagatgttggaactccggttggtgcaggggagcctcctcaagaaggtgctggaggcgatcaaggatctggtgaacgacgccaacttcgactgctccggcaccgggttctcgctgcaggccatggactcctcccacgtcgccctcgtcgccctcctcctccgctccgagggattcgagcactaccgctgcgaccgcaacctctccatggggatgaacctcggcaacatgtccaagatgctccgctgcgcgggcaacgacgacatcatcaccatcaaggccgacgacggctccgacaccgtcaccttcatgttcgagtcccccaatcaggataagattgccgatttcgagatgaagctcatggacatcgacagcgagcacctcgggatccccgactccgagtaccaggccatcgtccgcatgccctcctccgagttctccaggatctgcaaggaccttagcagcatcggagacactgttattatctctgtcaccaaggagggtgtcaagttctccactgctggagacattggaaccgcaaacatcgtctgcaggcagaacaagactgtggacaagcctgaggaatctaccattatagagatgcaagagccagtgtcactgacctttgctctgaggtacatgaactctttcaccaaggcaagcccactgtcagaccaagtgaccatcagcctctcttctgagcttccagtggtggttgagtacaagattgctgagatggggtacattagattctatctagcacccaagattgaagaggatgaggagatgaaggcatgattgcagcacaaggacttgatatatttatgttgcctactttcccaggtctttatcccttttgcttaatgtttatgcataagcaaactgattttatgctcctttagctacccttgtatcggtgactgttagtgaatccatggattgtcagtgatgaatgttagatcagtgaattgtgcttttccatgtcactcctgccgttagattagttttcttaatgatggaaaaattgagggtgcaagtaaggaagaatgcgtaatttgtagctgcttttgcttgtactaatgtgatttcaaggaagtatcaatccattttttatggaattggtttggtcc

SEQ ID NO: 2745 - DNA, 961 bp, Secale cereale
gacgcgaagatgctggagctgcggctggtgcaggggagcctgctgaagaaggtgctggaggcgatcaaggacctggtgacggacgccaacttcgactgctccggcaccggcttctcgctgcaggccatggactcctcccacgtcgcgctcgtcgccctcctcctccgctccgagggcttcgagcactaccgctgcgaccgcaacctctccatgggcatgaacctcggcaacatggccaagatgctccgctgcgccggcaacgacgacatcatcaccatcaaggccgacgacggctccgacaccgtcaccttcatgttcgagtcgcccaatcaggataagatcgcggacttcgagatgaaactcatggacatcgacagcgagcacctcggcatccccgactccgagtaccaggccatcgtccgtatgccgtcctccgagttctccaggatctgcaaggatcttagcagcatcggcgacactgttattatctctgtcaccaaggagggtgtcaagttctccactgctggagacattggaactgcaaacatcgtctgcaggcagaacaatactgttgacaagcctgagcaatcgaccattatagagatgcaagagccggtgtcactcacatttgctctgaggtacatgaactccttcaccaaggcaagcccactgtcggaccaagtcaccatcagcctctcatctgagctgccggtggttgtcgagtacaagattggtgagatgggatacattaggttttatctggcgcccaagatcgaagacgatgaggaaatgaaggcatgatcgtgttccaaggatatgcttatcttgcctactttccctacctagtttaaactgccgtttgcttaactattgtttgtaagcaaaaatgatgtcatgcttgttttagctactcttgtgtctggatttccagtgatgaatgttagattagtgaattatgctt

SEQ ID NO: 2746 - DNA, 1075 bp, Cenchrus ciliaris
cgacgaggagagcgccgccaccatgttggagctgaggttggtgcaggggagcctcctcaagaaggtcctcgaggcgatccgcgagctggtcaccgacgccaacttcgactgctccgggaccgggttctcgctccaggccatggactccagccacgtcgcgctcgtcgccctgctcctccgcgccgaggggttcgagcactaccgctgtgaccgcaacctctccatgggcatgaacctgaacaacatggccaagatgctgcgctgcgccggcaacgatgacatcatcaccatcaaggccgacgacgggtccgacactgtcaccttcatgttcgagtcgcccaagcaagataaaattgctgatttcgagatgaagctgatggacatcgacagtgagcaccttggcatcccagattccgagtaccaggccatcgtccgcatgccatcggctgagtttatgaggatctgcaaggacctcagcagcattggggacactgttatcatctcggtgactaaggagggtgtcaagttctcaacctcaggagaaattgggagcgcaaacattgtctgcaggcagaaccaaactgttgacaagccagaggaagctaccattatagagatgcaggaaccagtttccttgacctttgccctgaggtacatgaactccttcaccaaggcatcctccctgtctgatcaagtgactatcagcctttcatctgagctgccagtggtggtcgagtacaagatagctgagatgggttacattagattttacctggctcctaagattgaggaggatgaggagatgaagccctgatgaacaatgtcgtgctgatgttacctaattttttcttgtcttccaactgttatttgcttacctattgcttggaagcagaaaaggacgttatgcattatctcttaggctagactgcaagctacctgtatttgtgactgcactgtgatctgttaggccaggctcctttagctacctgtataactgcactgtgaatccatggatttacagtgtatctagatttgtgggtttgcgcttcgtgcattttacagctatatgcgattt

SEQ ID NO: 2747 - DNA, 1270 bp, Pennisetum glaucum
cgctctcgccctcccaaatcccgcgcgccccgatcctacatagggttccccgagctcctgcccttcccactccgccgacgaggagagcgccgcccgccacgatgttggagctgaggttggtgcaggggagcctcctcaagaaggtccttgaggcgatccgcgagcttgtcaccgacgccaacttcgactgctccgggaccgggttctcgctgcaggccatggactccagccacgtcgcgctcgtcgccctgctcctccgcgccgaggggttcgagcactaccgctgcgaccgcaacctctccatgggcatgaacctcaacaacatggccaagatgctgcggtgcgccggcaacgacgacatcatcaccatcaaggccgacgacggctccgacaccgtcaccttcatgttcgagtcgcccaagcaagataaaattgccgatttcgagatgaagctgatggacatcgacagtgagcacctcggcatcccggattccgagtaccaggccatcgtccgcatgccgtcggctgagtttatgaggatctgcaaggacctcagcagcatcggggacactgttgtcatctcggtgactaaggagggcgtcaagttctcaacctcaggagaaattgggagcgcaaacattgtctgcaggcagaaccaaactgttgacaagccagaggaagctaccattatagagatgcaggaaccagtttccttgacctttgccctgaggtacatgaactccttcaccaaggcatcgaccctgtctgagcaagtgactatcagcctttcatctgagctgccagtggtggtcgagtacaagatagctgagatgggttacattagattttacctggctcctaagattgaggaagatgaggagatgaagccctgatgaacaatgtcgtgctgatgttacctaattttttcttgtcttccaactgttatttgcttacctattgcttggaagcagaaaaggacgttatgcattatctcttaggctagactgcaagctacctgtatttgtgactgcactgtgatctgttaggccaggctcctttagctacctgtataactgcactgtgaatccatggatttacagtgtatctagatttgtgggtttgcgcttcgtgcattttacagctatatgcgattttcaaatttcaacttcgtcatcaaattctgtttggagagcgaaatgtgctttctggtgtatcaggggcatggtcactaaagcggtagcccttgtaaacgaaatggatgagaagggct

SEQ ID NO: 2748 - DNA, 929 bp, Festuca arundinacea
ggcaaggggaactccggctcgtgcaggggagcctcctgaagaaggtgctagaggcgatcaaggacctggtcaacgacgccaacttcgactgctccggcaccgggttctcgctgcaggccatggactcttcccacgtcgccctcgtggccctgctcctccgctccgagggcttcgagcactaccgctgcgaccgcaacctctccatggggatgaacctcaccaacatgtccaagatgctccgctgcgcgggcaacgacgacatcatcaccatcaaggccgacgacggctccgacaccgtcaccttcatgttcgagtcccccaatcaggataagatcgccgacttcgagatgaagctcatggacatcgacagcgagcacctcggtatcccggactccgagtaccaggccatcgtccgcatgccctcctccgagttctccaggatctgcaaggaccttagcagcatcggagacaccgttgtcatctccgtcaccaaggagggtgtcaagttctccactgctggagatattggaactgcaaacatcgtctgcaggcagaacaagactgctgacaagccagaggattctaccattatagagatgcaggagccagtgtcacttacctttgctctgaggtacatgaactccttcaccaaagcaagcccactgtcggaccaggtcaccatcagcctctcatctgagctaccagtggtggttgaatacaagattggtgagatgggctacattagattctatttagcaccgaagattgaagaggacgaggaaatgaaggcatgattgtggcacttagggcgtgcttatgttgcattacttttccaggtcttcggaccagtttgcttagcgcttgtctgtaaccaaaaatgatgtcatgctagctttagcatttctatatctgtgactgctcgtcgttgc

SEQ ID NO: 2749 - DNA, 1263 bp, Setaria italica
cccctccctccctccgccgctatccccctcccaaaccccgcgcgcccagatcctacctagggtttcccgatctcctacccctcccgcttccaccgccgggccgccgacgaggagagcgccgccacgatgttggagctgaggttggtgcaggggagcctcctcaagaaggtcctcgaggcgatccgcgagctggtcaccgacgccaacttcgactgctccggcaccgggttctcgctgcaggccatggactccagccacgtcgcgctcgtcgccctgctcctccgcgccgaggggttcgagcactaccgctgcgaccgcaacctctccatgggcatgaacctaaacaacatggccaagatgctccgatgcgccggcaacgacgacatcatcaccatcaaggccgacgacgggtccgacaccgtcaccttcatgttcgagtcgcccaagcaagataaaattgccgatttcgagatgaagctgatggacatcgacagtgagcacctcggcatcccggattccgagtaccaggccatcgtccgcatgccgtcggctgagtttatgaggatctgcaaggacctcagcagcatcggggacactgttatcatctcggtgactaaggagggcgtcaagttctcaacctcaggagaaattgggagcgctaacatcgtctgcaggcagaaccaaactgttgacaagccagaggaagctaccgttatagagatgcaggaaccagtttccttgacctttgccctgaggtacatgaactccttcaccaaggcatcgtccctgtctgaccaagtgactatcagcctttcatctgagctgccagtggtggtcgagtacaagatagcagagatgggttacattagattttacctggctcctaagattgaggaagatgaggagatgaagccctgatgaacaatatagtgctgatgttacctacttttcttgtcttccaaccatcgtttgcttacctattgcttggaagcgaaaaaagatgttatgcgttatctcttaggccagactgctttagctacctgtatttgtgactgttctgtgaatccatggatttacagtgaatctagattagtgggtttgtgcttttgtgcatgttggcaaaatgagctttctggtgcttgtagcttgatgatttatgatccatcagttgcagagtctgttgcatcaagggatcgttcaaactaggaggcaatcagcatcccccgttgagctatgcagcatcaatgcagggcttgttcgctt

SEQ ID NO: 2750 - DNA, 1275 bp, Sorghum bicolor
gcctccctattaattccccccgttcccctcaagtccgtcccgccgccgttctcccctcccgcccagatccccgctagggtttccccgatccccctcagccaccgggccgccgccgacgaggagaccgccgccacgatgttggagctgcggcttgtgcaggggagcctcctcaagaaggtcctggaggcgatccgcgagctggtcaccgacgctaacttcgactgctccgggaccgggttctcgctgcaggccatggactcgagccacgtcgcgctcgtcgcgttgctcctccgcgccgaggggttcgagcactaccgctgcgaccgcaacctctccatgggcatgaacctcaacaacatggccaagatgctccgctgcgccggcaacgacgacatcatcaccatcaaggccgatgacggctctgataccgtcaccttcatgttcgagtcgcccaagcaagataagattgctgattttgagatgaagcttatggacatcgacagtgagcaccttggaatcccggattccgagtaccaggccatcgtccgcatgccgtctgctgagtttatgaggatctgcaaggaccttagcagcatcggggatactgtcgtaatctcggtgactaaggagggcgtgaagttctccacctctggagaaattgggagcgcaaacattgtttgcaggcagaaccaaactattgacaagccagaagaggctaccattatagagatgcaagagccggtttccctgacctttgccctgaggtacatgaactccttcaccaaggcatcttcattgtccgagcaagtgactatcagcctgtcgtctgagctaccagtggtggtcgagtacaagattgctgagatgggttacattagattttacctggcccccaagatcgaggaggatgaggagatgaaggcctgatggcttgtaatgacataatgctcgtgttgcctacttttcattgttgtccaaccatggtttgcttagctagtgtttgcaagcaaaaagggatgttatgtgttatctaggccagactgctttagctacttgtgtctatttgtgactgccctctgaatccatggatttacagtgagcctattagattagtgggcttatgctttgttcatgtggcttctatctgcccatttctactcagacatgaagttatatgttgggagagcataacatggcgatggttgtgaacttgaactgcacatgataggaactaagaagcctatcttaaatcttgattgataagaagctaggcat

SEQ ID NO: 2751 - DNA, 1493 bp, Setaria italica
tggagggaagcacgaactagtgcaggcagcgagatggcgggaaatgccgggaaaggaattcccatctcccgcctcagctcccgatagcccgcccttctcaatcacaagcacggggaccagcgccacccgtgtttccctaccgacaggtgggtccgatcccgagccacgtaacaagaccccacctgtcaggtgaatcttccggggcaaggagcgggaaacatttcgcggcagcggcggcggttcccccaaatttctccctcccttttttcgctccgcgtcccctcaatggttccctattaaaatctccccattccccttcccccctccctccctccgccgctatccccctcccaaaccccgcgcgcccagatcctacctagggtttcccgatctcctacccctcccgcttccaccgccgggccgccgacgaggagagcgccgccacgatgttggagctgaggttggtgcaggggagcctcctcaagaaggtcctcgaggcgatccgcgagctggtcaccgacgccaacttcgactgctccggcaccgggttctcgctgcaggccatggactccagccacgtcgcgctcgtcgccctgctcctccgcgccgaggggttcgagcactaccgctgcgaccgcaacctctccatgggcatgaacctaaacaacatggccaagatgctccgatgcgccggcaacgacgacatcatcaccatcaaggccgacgacgggtccgacaccgtcaccttcatgttcgagtcgcccaagcaagataaaattgccgatttcgagatgaagctgatggacatcgacagtgagcacctcggcatcccggattccgagtaccaggccatcgtccgcatgccgtcggctgagtttatgaggatctgcaaggacctcagcagcatcggggacactgttatcatctcggtgactaaggagggcgtcaagttctcaacctcaggagaaattgggagcgctaacatcgtctgcaggcagaaccaaactgttgacaagccagaggaagctaccgttatagagatgcaggaaccagtttccttgacctttgccctgaggtacatgaactccttcaccaaggcatcgtccctgtctgaccaagtgactatcagcctttcatctgagctgccagtggtggtcgagtacaagatagcagagatgggttacattagattttacctggctcctaagattgaggaagatgaggagatgaagccctgatgaacaatatagtgctgatgttacctacttttcttgtcttccaaccatcgtttgcttacctattgcttggaagcgaaaaaagatgttatgcgttatctcttaggccagactgctttagctacctgtatttgtgactgttctgtgaatccatggatttacagtgaatctagattagtgggtttgtgcttttgtgcatgttggcaaaatgagctttctggtgcttgtagcttgatgatttatgatccatcagttgca

SEQ ID NO: 2752 - DNA, 1739 bp, Sorghum bicolor
tggaggaaacgcacgagctagtgcgcgcagcagagatggcgggaaatgccggcgggaaagcaatgcgtctcccgcctcagttcccggatccccccggcctttttccaaaccagcccgccacccgtgtttcctaccgacaagtggggccgattcggaaaccacgcggacggagaccccacctgtcaggttaatcttccggggcaaggagcggccgggcgcgaaaatgtttcgcggcagcggcggttccccaaatttctccctccatttttccgctacgcgtccccaaacgcctccctattaattccccccgttcccctcaagtccgtcccgccgccgttctcccctcccgcccagatccccgctagggtttccccgatccccctcagccaccgggccgccgccgacgaggagaccgccgccacgatgttggagctgcggcttgtgcaggggagcctcctcaagaaggtcctggaggcgatccgcgagctggtcaccgacgctaacttcgactgctccgggaccgggttctcgctgcaggccatggactcgagccacgtcgcgctcgtcgcgttgctcctccgcgccgaggggttcgagcactaccgctgcgaccgcaacctctccatgggcatgaacctcaacaacatggccaagatgctccgctgcgccggcaacgacgacatcatcaccatcaaggccgatgacggctctgataccgtcaccttcatgttcgagtcgcccaagcaagataagattgctgattttgagatgaagcttatggacatcgacagtgagcaccttggaatcccggattccgagtaccaggccatcgtccgcatgccgtctgctgagtttatgaggatctgcaaggaccttagcagcatcggggatactgtcgtaatctcggtgactaaggagggcgtgaagttctccacctctggagaaattgggagcgcaaacattgtttgcaggcagaaccaaactattgacaagccagaagaggctaccattatagagatgcaagagccggtttccctgacctttgccctgaggtacatgaactccttcaccaaggcatcttcattgtccgagcaagtgactatcagcctgtcgtctgagctaccagtggtggtcgagtacaagattgctgagatgggttacattagattttacctggcccccaagatcgaggaggatgaggagatgaaggcctgatggcttgtaatgacataatgctcgtgttgcctacttttcattgttgtccaaccatggtttgcttagctagtgtttgcaagcaaaaagggatgttatgtgttatctaggccagactgctttagctacttgtgtctatttgtgactgccctctgaatccatggatttacagtgagcctattagattagtgggcttatgctttgttcatgtggcttctatctgcccatttctactcagacatgaagttatatgttgggagagcataacatggcgatggttgtgaacttgaactgcacatgataggaactaagaagcctatcttaaatcttgattgataagaagctaggcatatctacagatccatagtttgtcagtcttatcttgatttaagaacagcctctgaaagaaattggctacagcttaataacttggtatatgtgcagatggttttctgaaatgttgcaaaactgagagccctctggcacaagatgaccaacatcgaacttggatgttctatagactagct

SEQ ID NO: 2753 - DNA, 1227 bp, Saccharum officinarum
aaccaggccgccgctcgcccctcccaaaaccccttgctcccgcccagatcccagctagggtttccccgatctcccctccccctccgccgccgggccgccgacgaggagaccgccgccacgatgttggagctgcggcttgtgcaggggagcctcctcaagaaggtcctggaggcgatccgcgagctggtcaccgacgccaacttcgactgctctgggaccgggttctcgctgcaggccatggactcgagccacgtcgcgctcgtcgcgcttctcctccgcgccgaggggttcgagcactaccgctgtgaccgcaacctctccatgggcatgaacctcaacaacatggccaagatgctccgctgcgccggcaacgacgacatcatcaccatcaaggccgatgacggctctgacaccgtcaccttcatgttcgagtcgcccaagcaagataagattgctgattttgagatgaagcttatggacatcgacagtgagcacctcggaatcccggattctgaataccaggccatcgtccgcatgccttctgctgagtttatgaggatctgcaaggaccttagcagcatcggggacactgtcgttatctcggtgactaaggagggcgtgaagttctccacctctggagaaattgggagtgcaaacattgtttgcaggcagaaccaaactattgacaagccagaagaggctaccattatagagatgcaagagccggtttccctgacctttgccctgaggtacatgaactccttcaccaaggcatcttcactgtctgaacaagtgactatcagcctgtcgtctgagctaccagtggtggtcgagtacaagatcgctgagatgggttacattagattttacctggcccccaagatcgaggaggacgaggagatgaagccctgatggcttgtaagacataatgctcgtgttgcctacttttccttgtcttccaaccatggtttgcttagctagtgtttgcaagcaaaaagggatgttatgtattatctaggccagactgctttagctacttgtctatttgtgactgctctgtgaatccatggatttacagtgagcctattagattagtgggcttatgctttgttcatgtggcttctatctgcccatttctactcaggcatgaaattctttgttcggagagcataatggcgatggttgtgaacttgtgcttcacaggataagagcataggccatgtttag

SEQ ID NO: 2754 - DNA, 1160 bp, Zea mays
cacgcccctctcaaacctccgcgctcccgcccagctagggtttccccgatctcccctccttctcaaccgccgccgtcgccgagagcgccgccacgatgttggagctgcggcttgtgcaggggagcctcctcaagaaggtcctggaggcgatccgcgagctggtcaacgacgccaacttcgactgctctggcaccgggttctcgctgcaggccatggactcgagccacgtcgccctcgtcgcgctgctcctccgcgccgaggggttcgagcactaccgctgcgaccgcaacctctccatgggcatgaacctcaacaacatggccaagatgctccggtgcgccggtaacgacgacatcatcaccataaaggccgatgacggttccgacaccgtcaccttcatgttcgagtcgcccaagcaagataagattgcggatttcgagatgaaactgatggatattgatagcgagcacctcggaatcccggattccgagtaccaggccatcgtccgcatgccttcttctgagtttatgaggatctgcaaggaccttagcagcatcggagacactgtcgttatctcggtaaccaaggagggcgtgaagttctccacatctggagaaattgggagtgcgaacattgtttgcaggcagaaccaaactattgacaagccagaagaggctaccattatagagatgcaagagccggtttccctgacttttgccctaaggtacatgaactcgttcacgaaggcgtcttcactgtccgaacaagtcacgatcagcctgtcgtccgagctaccagtggtggtcgagtataagatcgctgagatgggttacattagattttacctggcgccaaagattgaggacgatgaggagatgaagccatgattgccatcagtgctcatgctgccgacttttcgtcgtcttccatccatggtttgcttattagctattgtttgcactcaaagggaaaaaaggatgttatgttttatctcttaggccagactgctttagctacttatttgtgactgctgtgtgtccatggatttatagtgaatctagattagtgggcttgtgctttgtgcatgccgctgctgtctgcccataagctacttatttctattcagacatgaaattctttgttgggaacttgataagctg

SEQ ID NO: 2755 - DNA, 1152 bp, Festuca arundinacea
  misc_feature (565)..(565): n is a, c, g, or t
  misc_feature (581)..(581): n is a, c, g, or t
  misc_feature (653)..(653): n is a, c, g, or t
  misc_feature (662)..(662): n is a, c, g, or t
  misc_feature (809)..(809): n is a, c, g, or t
  misc_feature (842)..(842): n is a, c, g, or t
  misc_feature (969)..(969): n is a, c, g, or t
  misc_feature (989)..(989): n is a, c, g, or t
ggcaaggggaactccggctcgtgcaggggagcctcctgaagaaggtgctagaggcgatcaaggacctggtcaacgacgccaacttcgactgctccggcaccgggttctcgctgcaggccatggactcttcccacgtcgccctcgtggccctgctcctccgctccgagggcttcgagcactaccgctgcgaccgcaacctctccatggggatgaacctcaccaacatgtccaagatgctccgctgcgcgggcaacgacgacatcatcaccatcaaggccgacgacggctccgacaccgtcaccttcatgttcgagtcccccaatcaggataagatcgccgacttcgagatgaagctcatggacatcgacagcgagcacctcggtatcccggactccgagtaccaggccatcgtccgcatgccctcctccgagttctccaggatctgcaaggaccttagcagcatcggagacaccgttgtcatctccgtcaccaaggagggtgtcaagttctccactgctggagatattggaactgcaaacatcgtctgcaggcagaacaagactgntgacaagccagaggantctaccattatagagatgcaggagccagtgtcacttacctttgctctgaggtacatgaactccttcaccaangcaagcccnctgtcggaccaggtcaccatcagcctctcatctgagctaccagtggtggttgagtacaagattggtgagatgggctacattagattctatctagcaccaaagattgaagaggacgaggaaatgaaggcgtgattgcagcactaaggncgtgcttatgttgcattacttttccaggtcttnggaaccagtttgcttagcgcttgtctgtaagccaaaaatgatgttatgctagctttagcatttctgtatctgttgactgttcgtcgttgctggattaccaggggttaatgttagattagtgaattgngcttgtccatgttatttctnttatctgttagaatagtattattcatgacacactcagggtgcactccagcctccagggcatgaatgtagccattattcctagcaacttttgcttgtcatgtcacgtacatagaatcagcagtccatccttttatcagtctagttcagttaatttataatcttc

SEQ ID NO: 2756 - DNA, 1447 bp, Zea mays
gaaatttctccctcccttttacgctccgcttcccccaaacgactccctattaatcccccacgttccccttccctttctctcccgccgccgcacgcccctctcaaacctccgcgctcccgcccagctagggtttccccgatctcccctccttctcaaccgccgccgtcgccgagagcgccgccacgatgttggagctgcggcttgtgcaggggagcctcctcaagaaggtcctggaggcgatccgcgagctggtcaacgacgccaacttcgactgctccggcaccgggttctcgctgcaggccatggactcgagccacgtcgccctcgtcgcgctgctcctacgcgccgaggggttcgagcactaccgctgcgaccgcaacctctccatgggcatgaacctcaacaacatggccaagatgctccggtgcgccggtaacgacgacatcatcaccataaaggccgatgacggttccgacaccgtcaccttcatgttcgagtcgcccaagcaagataagattgcggatttcgagatgaaactgatggatattgatagcgagcacctcggaatcccggattccgagtaccaggccatcgtccgcatgccttcttctgagtttatgaggatctgcaaggatcttagcagcatcggagacactgtcgttatctcggtaaccaaggagggcgtgaagttctccacatctggagaaattgggagtgcgaacattgtttgcaggcagaaccaaactattgacaagccagaagaggctaccattatagagatgcaagagccggtttccctgacttttgccctaaggtacatgaactcgttcacgaaggcgtcttcactgtccgaacaagtcacgatcagcctgtcgtccgagctaccagtggtggtcgagtataagatcgctgagatgggttacattagattttacctggcgccaaagattgaggacgatgaggagatgaagccatgattgccatcagtgctcatgctgccgacttttcgtcgtcttccatccatggtttgcttattagctattgtttgcactcaaagggaaaaaaggatgttatgttttatctcttaggccagactgctttagctacttatttgtgactgctgtgtgtccatggatttatagtgaatctagattagtgggcttgtgctttgtgcatgccgctgctgtctgcccataagctacttatttctattcagacatgaaattctttgttgggaacttgataagctgcatgataagaagccctttttaagtattgactagttagatattcttttggttatgtgatgtgaagttagaaccagcaactaagttctgtagacaattttacttttttttttgcataaagtgaaaagagtgatgtataagagtatctcgactagctaaataacttgccaaaccaaattttgactactcaatagtaaaat

SEQ ID NO: 2757 - DNA, 1113 bp, Zea mays
cccctcccaaagctcgccccgctcccagctagggtttcctcttcccatccacagccgccggggcgccgccgacgaggacagcgccgccacgatgttggagttgcgtctggtgcaggggagcctcctcaagaaggtcttggaggcgatccgcgagctggtcacggacgccaacttcgactgctccgggaccgggttctcgctgcaggccatggactcgagccacgtcgcgctcgtcgcgctgctccttcgcgccgagggcttcgagcactaccgctgcgaccgcaacctctccatgggcatgaacctcaacaacatggccaagatgctccgctgcgctggcaacgaggacatcatcaccatcaaggccgacgacggctccgacaccgtcactttcatgttcgagtcgcccaagcaagataagatcgcggatttcgagatgaaactgatggacattgatagcgagcacctcggaatcccggattccgagtaccaggccatcgtccgcatgccttctgctgagtttatgaggatctgcaaagatcttagcagcatcggagacacagtcgtcatctcggtgactaaggagggcgtgaagttctccacatctggagaaattgggagtgcaaacattgtctgcaggcagaaccaaactattgacaagccagaagaggctaccattatagagatgcaggagccggtttccctgacctttgccctgcggtacatgaactccttcaccaaggcgtcttcactgtctgagcaagtcactatcagcctgtcgtccgagcttccagtggtggtcgagtacaagatcgctgagatgggttacattagattttacctggcccccaagatcgacgatgacgaggagatgaagccctgatggcctgtgacgacataatgctcgtgttgcctgctcttccttccagccgttgtttgcttagctactctttgcaagcgaagaagggatgtgatgtgtatctcttaggctagactgcttcagctagttttctgtgactgctacatgaatccatggattactgatttactgggcttgtgctttgtgtatgatgctgccatctggtctcccaacaaagaagggatgtggtgtgt

SEQ ID NO: 2758 - DNA, 1100 bp, Musa acuminata
tcccgccaaaattgccctatttcctcttcctcccgtccccggcctcgccccatcactcgcaaccctctccacccggaaacggaacccctctatcctcggccagcgacatcgcctgaagaaggagaagatgttggagttgcggttggttcaaggcagcctcctgaagaaggtgctggaatcaatcagggagttggtcaccgatgccaacttcgattgctccgccaccggcttctccctccaggccatggactccagccacgtcgccctcgtcgctctcctcctccgatccgagggcttcgaacactaccgctgcgatcgcaacctctccatgggcatgaacctcaacaacgtgtccaagatgctccgctgcgccggcaacgacgacatcatcaccgtcaaggccgatgacggcagcgacaccgtcactttcatgtttgaaagccccaatcaagacaagatcgccgatttcgagatgaagctaatggacatcgacagcgagcatcttggcattccggacgcagagtaccaagctattgttcggatgccgtcttcagaatttgcaaggatatgcaaggatctgagcagcattggggacactgtgatcatttcagtgaccaaggaaggtgtgaagttttcgaccgcaggagacattggaactgcaaacatcgtttgcaggcagaacaagactgtggacaagcctgaggaagccaccatcatagagatgcaagagcccgtttcattaacctttgctctgaggtacttgaactccttcaccaaggcaacgccactctccgagactgtggccatcagtctctcgtctgatctgcctgtggtggtcgagtacaagattgcagagatgggatacattaggttttacctggcacccaagatcgaggaggatgatgacatgaagccatgagctaacccccacttttttgttatgatcatgatgtgtttcatgtctgcagaccaaagattatttggtctatttctttttactgtaagcagtctatgaatgctcagaggcagatggacaagttgattgctctttctttatatctgtagcttttgattgaagaaagattgaggatccatgcaac

SEQ ID NO: 2759 - DNA, 1168 bp, Cenchrus ciliaris
  misc_feature (458)..(458): n is a, c, g, or t
  misc_feature (467)..(467): n is a, c, g, or t
  misc_feature (542)..(542): n is a, c, g, or t
  misc_feature (552)..(552): n is a, c, g, or t
  misc_feature (554)..(555): n is a, c, g, or t
  misc_feature (578)..(578): n is a, c, g, or t
  misc_feature (581)..(581): n is a, c, g, or t
  misc_feature (611)..(611): n is a, c, g, or t
  misc_feature (615)..(615): n is a, c, g, or t
aaaccccgcgcgcccagatttcccgccggtctctcctacccttcccacactccgccgccgacgaggagagcgccgccaccatgttggagctgaggttggtgcaggggagcctcctcaagaaggtcctcgaggcgatccgcgagctggtcaccgacgccaacttcgactgctccgggaccgggttctcgctccaggccatggactccagccacgtcgccctcgtcgccctgctcctccgcgccgaggggttcgagcactaccgctgtgaccgcaacctctccatgggcatgaacctgaacaacatggccaagatgctgcgctgcgccggcaacgatgacatcatcaccatcaaggccgacgacgggtccgacactgtcaccttcatgttcgagtcgcccaagcaagataaaattgctgatttcgagatgaagctgatggacatcgacagtgagcacctnggcatcccngattccgagtaccaggccatcgtccgcatgccgtcggctgagtttatgaggatctgcaaggacctcagcagcatnggggacactntnntcatctcggtgactaaggagggngtnaagttctcaacctcaggagaaattgggagngcanacattgtctgcaggcagaaccaaactgttgacaagccagaggaagctaccattatagagatgcaggaaccagtttccttgacctttgccctgaggtacatgaactccttcaccaaggcatcgtccctgtctgaccaagtgaccatcagcctttcatctgagctgccagtggtggttgagtacaagatagctgagatgggttatgttagattttacctggctcctaagattgaggaagatgaggagatgaagccctgatgaacaatgtagtgctgatgttacctacttttttcttgtcttccaaccatcttttgcttacctattgcttggaagcagaaaagatgtcatgtgttatctcttaggccagactgatttagctacctgtatttgcgatgcaactgcactgtgatctcttaggccagactgctttagctacctgtatttgcgatgcaactgcactgtgatctcttaggccagactgctttagctacctatatttgttactgcactgtgaatctagtttatgggtttgtgctttgtgcatgttgcagcta

SEQ ID NO: 2760 - DNA, 1445 bp, Zea mays
gactggagggaccgagcttgtgctgagcagcagagatggcgggaaatgctgcgtctcccgcctcagtttcggatgccccgccctttcccaaaccggccaccgccgccgcccgtgtctccccaccgacaggtgggtccaatccttaaccacggaccagggcccccacctgtcaggtggaccttccgaagcaaggatcggccaggcgggaaaacatttcgcggcaggtggcggttgcgccaaatttctccctcccttttccgttcggcgtccccaaacgcctccctattaatctccccgcgttccccttccctcgcgccgccgctcccccctcccaaagctcgccccgctcccagctagggtttcctcttcccatccacagccgccggggcgccgccgacgaggacagcgccgccacgatgttggagttgcgtctggtgcaggggagcctcctcaagaaggtcttggaggcgatccgcgagctggtcacggacgccaacttcgactgctccgggaccgggttctcgctgcaggccatggactcgagccacgtcgcgctcgtcgcgctgctccttcgcgccgagggcttcgagcactaccgctgcgaccgcaacctctccatgggcatgaacctcaacaacatggccaagatgctccgctgcgctggcaacgaggacatcatcaccatcaaggccgacgacggctccgacaccgtcactttcatgttcgagtcgcccaagcaagataagatcgcggatttcgagatgaaactgatggacattgatagcgagcacctcggaatcccggattccgagtaccaggccatcgtccgcatgccttctgctgagtttatgaggatctgcaaagatcttagcagcatcggagacacagtcgtcatctcggtgactaaggagggcgtgaagttctccacatctggagaaattgggagtgcaaacattgtctgcaggcagaaccaaactattgacaagccagaagaggctaccattatagagatgcaggagccggtttccctgacctttgccctgcggtacatgaactccttcaccaaggcgtcttcactgtctgagcaagtcactatcagcctgtcgtccgagcttccagtggtggtcgagtacaagatcgctgagatgggttacattagattttacctggcccccaagatcgacgatgacgaggagatgaagccctgatggcctgtgacgacataatgctcgtgttgcctgctcttccttccagccgttgtttgcttagctactctttgcaagcgaagaagggatgtgatgtgtatctcttaggctagactgcttcagctagttttctgtgactgctacatgaatccatggattactgatttactgggcttgtgctttgtgtatgatgctgccatctggtctcccaacaaagaagggatgtggtgtgtatctctt

SEQ ID NO: 2761 - DNA, 1716 bp, Panicum virgatum
tggagggaagcacgaactagtgcgggcagcgagatggcgggaaatccagggaaacggaattcccgtctcccgcctctgctcccggatagcccgcctttctcaaatcacagacacagggaccaccgccgtccttgtttcccctactgacaggtgggtcctctagcaacctcgactctgagaccccacctgtcaggtgaatcttccagggcaaggagagggaaacatttcgcggcagcggcggcggttcccccaaatttccctccctttttcgctccgcgtcccccaaaatgcttccctattaaaatctatccattcccccacatccctccctccgccgctctcccctcccaaaccccgcgcgcccagatcctagggtttcccgatctcctcccccccccccttccgccgccgggccgccgacgtggagagcgccgccgcgatgttggagctacggttggtgcaggggagcctcctcaagaaggtcctggaggcgatccgcgacctggttaacgaggccaacttcgactgctccgggaccgggttctcgctgcaggccatggactccagccacgtcgcgctcgtcgccctgctcctccgcgccgaggggtttgagcactaccgctgcgaccgcaacctctccatgggcatgaacctcaacaacatggccaagatgctccgctgcgccggcaacgaagacatcatcactatcaaggctgacgatggatccgacaccgtcaccttcatgttcgagtcgcccaagcaagataagattgccgacttcgagatgaagctcatggacatcgatagcgagcaccttggcatcccggattccgagtaccaggccatcgtccgcatgccgtctgctgagtttatgaggatctgcaaggacctcagcagcatcggggacacagttgtcatctcggtgactaaagagggcgtcaagttctcaacctcaggagaaattgggagtgcaaacattgtctgcaggcagaaccaaactgttgacaagccagaagaagctaccattatagagatgcaagaaccagtttccctgacgtttgccctgaggtacatgaactccttcaccaaggcatctacactgtctgaccaagtgactatcagcctttcatccgagctaccggtggtggttgagtacaagatcgcagagatgggctacattagattctatctggcgccaaagattgaggaagatgaggagatgaagccttgatgacaacaatatgaatcttatgttgcctacgtttccttgtcttccaaccatcgtttgcttagctattgtttgcaagcaaaaaaggatgttatgtgttatctcttaggccagactgctagctacttgtatttgtgactgccctgtgaatccatggatttacagtgaatctagattagtgggctttgttttgcgcatgttgcatctatttgcccttttcaattcagtcattaaattttttactgagcacaatgtgcctttggtaatcaccctgatggttgctggataaacaagccttacctcgaatcttgacaagaatcaaggtccaggtagttgggattgtttcctcgtgctctgctctcgagtctcgagaaagtggcaatgtataatttctgtgttgtagccttactgcttcatttcgattcatcggaacagtgatgaaatgtattgtatcaattttcaattataaaattacaagttccgatgga

SEQ ID NO: 2762 - DNA, 1023 bp, Cenchrus ciliaris
aggggagcctcctcaagaaggtcctcgaggcgatccgggagctggtcaccgacgccaacttcgactgctccgggaccgggttctcgctgcaggccatggactccagccacgtcgcgctcgtcgccctgctcctccgcgccgaggggttcgagcactaccgctgcgaccgcaacctctccatgggcatgaacctcaacaacatggccaagatgctgcggtgcgccggcaacgatgacatcatcaccatcaaggccgacgacggctccgacaccgtcaccttcatgttcgagtcgcccaagcaagataaaatcgccgatttcgagatgaagctgatggacatcgacagtgagcacctcggcatcccggattccgagtaccaggccatcgtccgcatgccgtcggctgagtttatgaggatctgcaaggacctcagcagcatcggggacactgttgtcatctcggtgactaaggagggcgtcaagttctcaacctcaggagaaattgggagtgcaaacattgtctgcaggcaaaaccaaactgttgacaagccagaggaagctaccactatagagatgcaggaaccagtttccttgacctttgccctgaggtacatgaactccttcaccaaggcatcgaccctgtctgagcaagtgactatcagcctttcatctgagttgccagtggtggttgagtacaagatagcagagatgggttacattagattttacctggctcctaagattgaggaagatgaggagatgaagccctgatgaacaatgtggtgctgatgttacctactttttcttgtcttccaaccattgtttgcttgcctattgcttggaagccgaaaaagatgttatgcatatctcttaggccagactgctttagctacctgtatttgtgactgcactgtgaatccatggattttatgtgttatctcttaggccagactgctttgctacttgtatttgtgactgcgctgtttatcaatggatttacagtgaatatagatctgggtttgtg

SEQ ID NO: 2763 - DNA, 1020 bp, Orobanche aegyptiaca
atcaaagtccatataaaccctagcagccggcattcctccatttctgctccacattctcaattcgcaacctaagttcttgtaatctcatctccaaaacagcgaactcaattcagtaaaatgttggaactgagactcgtgcaggggagccttttgaagaaggttcttgaagcgattaaggatctggtgaacgatgccaattttgactgctcggccaccggattctcgctccaggcaatggattccagccacgtggccctggtggcgctgctgctcagatcggagggctttgagcactacagatgcgatcgcaacctctccatgggcatgaacctcaacaacatggccaagatgctcaagtgtgccggcaacgatgacatcatcactatcaaggcagatgacggcagcgacaccgtcacctttatgttcgagagccctactcaggataagattgcagattttgagatgaagctcatggatattgacagtgagcatcttggaattcctgaagccgaataccatgctatagttaggatgccatcttctgagtttgcaagaatttgtaaagatctgagcagcattggtgacacagttgtgatttctgtcactaaggaaggtgtaaaattctcaacaagaggtgatattggaactgcaaatgtcgtgtgcaggcagaataccactgtggataagcctgaagatgctacagttatagagatgaatgagccagtgtcgctgacctttgctcttaggtacttgaactctttcactaaggcaactcctttgtcgaacactgtcactataagtctgtcttctgagcttccagtggtggttgagtataagattgcggaaatgggatatattaggttctacttggcaccgaagattgaggaagatgatgaagaaaccaagccttaagttgttactcgggattcttgttcactagttgttaagagtagaagtgatattgatcttgttctgtttttaactttctcttaaatgaaatgttgttggacttctaaaaaa

SEQ ID NO: 2764 - DNA, 1226 bp, Vitis vinifera
ctctttttcctctctttcaaaaccctaaccctagaccgtagaaggcaaagcagaaggagaagaagatgctggagttgaggctggttcaggggagccttctaaagaaggttctagaggcgatcaaggacctggttaacgatgccaacttcgactgctccgccaccggattctctctccaggctatggattccagccacgtagcccttgttgctctgctcctcagatcggagggcttcgagcactaccgctgcgatcggaacatctccatgggaatgaatctcaataacatgtccaagatgctgaagtgcgccggaaatgatgacattatcaccatcaaggccgatgacggcagtgacactgtcaccttcatgtttgaaagccctacccaagataagattgctgattttgagatgaaactgatggacattgatagcgagcaccttggtattcccgaagcagaataccatgctattgtaaggatgccttcatctgagtttcaaaggatttgtaaagatcttagcagcattggtgacacagttgtcatctctgtgacaaaagagggtgtgaagttctcaacacgaggtgatattggaactgcaaatattgtttgcaggcagaatactaccgtggacaagccggaggaagcaacagtgatagagatgaatgagccggtttcattaacatttgcactgagatacatgaactccttcacaaaagcaaccccattatcaaacactgttacaattagcttatcatcagagttgcctgttgtggttgagtacaagattgcagagatgggttatatcaggttctacttggcacccaagatcgaagaggatgaggatgagaccaagccccaagcctaattcctcagcatttccagcaaattctacattcctatttctattcctcttttcctcaagacggacacttccctaaacttcatgttgagaggatgttgcttataaattttctggggatattatcaatgtaggcaagtgttatatttgcttttagaaaaagtgatgtggtggttagtttttgttttttcgcttgtgagtatgactattacaagagcttcatccccctgcttttttcattctgaactcaacttggatagaagcttttattgaatgttgcaggtttgattgatctgtttgaggtaaatttcattttcacttcaagctaatgatgaatgaaatttcaaactagtttagtgttagctc

SEQ ID NO: 2765 - DNA, 1004 bp, Artemisia annua
agacgcactcaaaccaggacacacaagatgttggaactccgtctagtccaaggcagcctcctgaaaaaagtaatggagtcaataaaagacctggtgaacgacgccaacttcgactgctcgtcaacagggttctccctccaggcgatggactcaagccacgtggcactggtgtcgctgctgctgaggtcagaagggtttgagcattacagatgtgataggaatataagtatggggatgaatttggggaatatgagtaagatgttgaagtgtgctggtaatgatgatattattactattaaggctgatgatggcagtgatactgttactttcatgtttgaatcccctactcaagataagattgctgattttgagatgaaactgatggacattgatagtgagcatcttggaattcctgaagcagagtaccatgccattgtgcggatgccttcagccgagtttgcaaggatttgtaaagatctcagtagtattggtgatacagttgtgatctctgttaccaaagaaggtgtgaagttctcaacaagaggtgatattggaactgcaaatattgtttgtaggcagaacactacagttgataagccagaagaggcaacaatcattgagatgaacgaaccagtatctttgacatttgcattaagatacatgaactcgtttacaaaggctagtccattgtcaagtactgtcacaatcagcctgtcttcagagcttcctgtagtggtggagtacaagatagctgagatggggtacatccggttttatctggcacctaagattgaagaagacgacgaggagaacaagtcttgaatcagttcgtaagctgagaattaattttttttagttgtttgccaaagttattggcatgtttctagtttaaggtacattgtgtaatctgtacttgcaagaacttagccaaatatgttttcctcagttttaatttctttatcattgtgttaagaattttcatccttgttttgaggtggttgttt

SEQ ID NO: 2766 - DNA, 1383 bp, Vitis vinifera
gtcacttccaaaccttcccgccaatcacaacctacacccattatataataactaattcctctgttttcctcactttcccactctttttcctctctttcaaaaccctaaccctagaccgtagaaggcaaagcagaaggagaataagatgctggagttgaggctggttcaggggagccttctaaagaaggttctagaggcgatcaaggacctggttaacgatgccaacttcgactgctccgccaccggattctctctccaggctatggattccagccacgtagcccttgttgctctgctcctcagatcggagggcttcgagcactaccgctgcgatcggaacatctccatgggaatgaatctcaataacatgtccaagatgctgaagtgcgccggaaatgatgacattatcaccatcaaggccgatgacggcagtgacactgtcaccttcatgtttgaaagccctacccaagataagattgctgattttgagatgaaactgatggacattgatagcgagcaccttggtattcccgaagcagaataccatgctattgtaaggatgccttcatctgagtttcaaaggatttgtaaagatcttagcagcattggtgacacagttgtcatctctgtgacaaaagagggtgtgaagttctcaacacgaggtgatattggaactgcaaatattgtttgcaggcagaatactaccgtggacaagccggaggaagcaacagtgatagagatgaatgagccggtttcattaacatttgcactgagatacatgaactccttcacaaaagcaaccccattatcaaacactgttacaattagcttatcatcagagttgcctgttgtggttgagtacaagattgcagagatgggttatatcaggttctacttggcacccaagatcgaagaggatgaggatgagaccaagccccaagcctaattcctcagcatttccagcaaattctacattcctatttctattcctcttttcctcaagacggacacttccctaaacttcatgttgagaggatgttgcttataaattttctggggatattatcaatgtaggcaagtgttatatttgcttttagaaaaagtgatgtggtggttagtttttgttttttcgcttgtgagtatgactattacaagagcttcatccccctgcttttttcattctgaactcaacttggatagaagcttttattgaatgttgcaggtttgattgatctgtttgaggtaaatttcattttcacttcaagctaatgatgaatgaaatttcaaactagtttagtgttagctcagaaaggtcagtgaaatttatccaaaaatcttgtatttagcttgtaacatttggggggtttcggatgtgggcctgcc

SEQ ID NO: 2767 - DNA, 1697 bp, Panax ginseng
tactgtaacattttaagaatggatctaataaaatttaattctcccatgcgctggtatctcaatgaaacataagaagcctcgactgtattaaggccaggcccaacttcgatccaataaagcccacccataagagtccataacttaactacctactgaaaaatttattggcgggaattaaattttccacgtttattcctcccgccaataaaaccctcgctagctttccttgtactcttcttccctcaagtctatctatctatcaattaatataataaaccccttaccgctctttcttctgttttcccactcttttcttttaaaccctaattttcccagaaattcagcccaaaactctggaaaaatgttggagctgaggctagtccaagggagtctgctgaagaaggtgatggattccatcaaagaccttgtaaacgacgccaatttcgactgctctgcaactgggttctctctccaagccatggactccagccacgtggcgctggtggcgcttctgcttagatcggagggttttgagcattatcgctgtgatcgtaacatttccatggggatgaatctgaataatatggctaagatgctaaaatgtgccggtaatgatgatattattaccattaaggccgatgatgggagtgatactgtcactttcatgtttgaaagccccacacaagataagattgctgattttgagatgaaactcatggatatcgatagtgagcatcttggaataccagaagcagagtatcaagctatagttcggatgccttcagctgagtttgcaaggatctgtaaagatctcagtagtattggtgacacagttgttatatctgtgaccaaagaaggtgtgaagtactcaacaagaggagatattggaactgcaaatgttgtttgccggcagaataccacagttgataagccagaggaggctacaattatagagatgaatgaaccggtatcattgacatttgcactgaggtacatgaattctttcacgaaggcaagtcctctgtcaagtacagttacaatcagcttatcatctgagcttcctgttgttgttgagtacaagattgctgagatgggttatataaggttctacttggcacccaagatagaagaggatgatgatgaaagcaagccttgaaaaggataacagtcatccaatggttaggtgtctgtatgctgaaaacaatttatgccttctcacacatttgctttgcaggtttcactggtgcaggatagcttcttattgctagaaccaagttcatccatcatatgttatgcattcttaatgtttggcaaagtgaaaccatgttgttcctcccatttgtattctttcttgttctttttctttatgatgtttgttgattattgttttcatgttcaggcctttaattacaatcttttccggtttattgtcaggatttataagttgacaaattttagctagttcagaaatgatttcttatcacagttatttttaataattgtctaatataatactacctttattccaagttagagatatatatgtgcctttctgccagttctaaaactagagattcatattttattttggattataagtaccagtaattaatcatgtttttatcatattacatagttattttaacaataatgtttgaccaattgaacttgtaaaaggttcttaatggcttcttcaa

SEQ ID NO: 2768 - DNA, 1100 bp, Vaccinium corymbosum
cccccgaaaaccgcccatatcatctcgctccttccctctctctccccttttcaaaccctaactccatttctcccccaaaacttccccggcaagccagacctctccaaaaaatgttggaactccggctggttcagggcagtctgttgaagaaggtcctcgagtcaatcaaggacctggtcaacgacgccaacttcgactgctccgccaccggtttctccctccaggccatggactctagccacgtcgctctggtcgcgctcctgctcagatctgaggggttcgagcactaccggtgcgaccggaacatatcgatgggcatgaatcttaataatatggctaagatgctgaagtgcgccggtaatgatgatattattacgctcaaggccgatgatggaagcgatactgtcaccttcatgtttgaaagtccaactcaagataaaattgctgattttgagatgaagttgatggacatcgatagtgagcatcttggaattccagaagcagagtaccatgctattgtccgcatgccctcatcagaatttgctcggatttgtaaagatcttagcagtattggtgacacagttgtgatatctgtgacaaaggaaggtgtcaggttctctacaagaggtgatattgggactgcaaatgttgtatgtcggcagaataccacagtagacaagcctgaggaagctacaatcatagagatgaatgagccagtatcacttacatttgctctgagatacatgaactccttcacaaaggcaaccccattgtcaagcacagtcacaataagcttatcttccgagctacccgttgtggttgagtacaagattgcggaaatgggctatatcaggttctacttggctcctaagatcgaagaggatgatgatgaggcaaagccttaaggttccttaccgggaaaaaaggccttaaggttaagctttccaaattttggactccaagctacagcttcttgttgcctgcctttaatcatcccgtgtgctaactaagaaaacgtttctcataaatttgtcgtgaaaattttgccattcgaggcaagtaggttatggttgagatggttctggaaaatgttagagctg

SEQ ID NO: 2769 - DNA, 986 bp, Flaveria ramosissima
aaacctccattgtttccgatcaattcaatctgaaacatgctggagctccggttagttcaggggagtctgttgaagaaggtgatggagtcgataaaggatctggtaactgatgctaatttcgactgttctgccactggattctcgcttcaggcgatggactcgagccacgtggcgctggtgtcgctgctgcttagatcggaggggtttgagcattaccgatgtgatcggaacatttcgatggggatgaatctgaataatatgtcgaagatgctgaagtgtgcggggaatgatgatattattacgcttaaggctgatgatgggagtgatactgttactttcatgttcgagagtcccactcaagataagattgctgattttgagatgaaactaatggacattgatagcgagcatcttggtattcctgaagctgagtatcatgccatagtaaggatgccttcatctgagtttgcaagaatttgtaaagacctcagcagtattggtgacacagttgtgatttctgtcaccaaagaaggtgtgaaattctcaacaagaggtgatattggaactgcaaatgttgtttgtagacagaatacaacagttgataagcctgaagaagctactgttattgagatgaatgagccagtgtctttgacatttgcattgcggtatatgaactccttcacaaaggcaaccccactatcaagtactgttacaatcagtttatcttctgagcttcctgtggttgttgagtacaaaattgctgaaatgggctacataaggttttacttggctcctaagattgaagaagatgatgaagagaacaaatcgtgaaaactcgaggtacctaacttcataaatggctagtttatgacttaagttacactttgatctaaaaaatctctagtttgtaacaattgtttgatgtttagttttcattatgtttatgttgggtggtgggttgctcatgtagttaattttgttataaa

SEQ ID NO: 2770 - DNA, 932 bp, Flaveria ramosissima
aaacctccattgtttccgatcactccaatctgaaacatgttggagctccggttagtgcaggggagtctgttgaagaaggtgatggagtcgataaaggatctggttaccgacgccaatttcgactgttctgccactggattctcgcttcaggcgatggactcgagccacgtggcgctggtgtcgctgctgcttagatcggaggggtttgagcattacagatgtgatcggaacatttcgatggggatgaatctgaataatatgtcgaagatgctgaagtgtgcggggaatgatgatattattacgcttaaggctgatgatgggagtgatactgttactttcatgttcgagagtcccactcaagataagattgctgattttgagatgaaactaatggacattgatagcgagcatcttggtattcctgaagccgagtatcatgccattgtaaggatgccttcatctgagttcgcaagaatttgcaaagatctcagcagtattggtgacacagttgtgatttctgtcaccaaggaaggtgtgaagttctcaacaagaggtgatattggcactgcaaatgttgtttgtagacagaacacaacagtcgataagcctgaagaagctactgttattgagatgaatgagccagtgtctttgacttttgcattgaggtatatgaactccttcacaaaggcaacccctttatcgagtactgtcacaatcagcttatcttctgagcttcctgtggtggttgagtacaaaattgctgaaatgggttacataaggttttacttggctcctaagatcgaagaagatgatgaagagaacaaatcgtaaaaacttgaggtacctaacttcataaatggctagtttataactaaagttatactttgatttcaaaatctctagtgtgtaacaattgtttgatgtttagtttt

SEQ ID NO: 2771 - DNA, 1104 bp, Actinidia deliciosa
  misc_feature (772)..(772): n is a, c, g, or t
  misc_feature (940)..(940): n is a, c, g, or t
  misc_feature (950)..(950): n is a, c, g, or t
  misc_feature (953)..(953): n is a, c, g, or t
  misc_feature (968)..(968): n is a, c, g, or t
  misc_feature (1013)..(1013): n is a, c, g, or t
  misc_feature (1018)..(1018): n is a, c, g, or t
  misc_feature (1020)..(1020): n is a, c, g, or t
  misc_feature (1035)..(1035): n is a, c, g, or t
  misc_feature (1046)..(1046): n is a, c, g, or t
  misc_feature (1060)..(1060): n is a, c, g, or t
  misc_feature (1066)..(1066): n is a, c, g, or t
  misc_feature (1070)..(1070): n is a, c, g, or t
  misc_feature (1073)..(1074): n is a, c, g, or t
  misc_feature (1078)..(1079): n is a, c, g, or t
  misc_feature (1083)..(1086): n is a, c, g, or t
  misc_feature (1089)..(1096): n is a, c, g, or t
  misc_feature (1098)..(1103): n is a, c, g, or t
cgtacctctctctttcaaaccctaaccctacttttctctgaagaccaaaaccaaaatgctggagctgaggcttgttcaggggagtctgctgaagaaggtcatggagtcgatcaaggacctcgtgaacgatgccaacttcgactgctccgccaccggcttctctctccaggccatggactccagccacgtcgccctcgtggcgcttcttctcagatccgagggcttcgagcactatcgctgcgaccgcaacatatccatgggcatgaacctcaacaacatggccaagatgctcaagtgcgccggtaacgacgatatcatcaccctcaaggccgatgacggcagtgataccgtcaccttcatgttcgaaagtccaactcaggataagattgctgattttgagatgaaactgatggacattgatagtgagcaccttgggattccagaagcagagtaccatgccattgttcgaatgccctcatcagaatttgctaggatttgtaaagatcttagcagtattggtgacactgttgtgatctctgtgacaaaggaaggtgtcaggttctccaccagaggtgatattggaactgcaaatgttgtttgcaggcaaaatacgacagtagacaagccggaggaagccacaatcatagagatgaatgaaccagtgtcattaacatttgctctccggtacatgaactccttcacaaaggcaaccccattgtccaacacggtcacaataagcttatcttcagagcttcctgttgtggttgagtanaagattgctgaaatgggttatatcaggttctacttggcgcctaaaatagaagaggatgatgaagagactaagccttaagcttaaactttccaaatcttcctctacggcttacagcttcatgtgatctgctttaaattgtcctttgtgtgaacaaggaaagtttctccngtatgtttcntgncacatgcaccactgntggaaagtagttataagtttaaactgattcttgaaaatgtatttnttttntnttttttttccacccntgttttcctgnttgtttgcagacanaatgcntttnagnntgtnncttnnnnttnnnnnnnnannnnnna

SEQ ID NO: 2772 - DNA, 1071 bp, Fagus grandifolia
gtgagaaccccaagaattcaaagactttcctaaactttatggcgggaatgaaattccatttccgatcccgccaatagattatacaacccttcctttcctaccaaattcaattcaaagactttgccaattcgcatcggtttttataaaacccgaaccgaaccattatccccttcactttttcacattctctgaacaaaaaaaaaccctagcactcctctccttcaagccccaaatgctggaactacggctagtccaaggctcgctactgaagaaggttctagagtccataaaggatctggttaacgatgccaacttcgactgctccgccactggcttttccctccaggccatggattccagccacgtggctctggtggctctgctccttagatccgagggcttcgaacactaccgctgtgaccgtaacatgtccatggggatgaacctcaacaacatgtccaaaatgctcaagtgcgccggcaacgatgacatcatcaccatcaaggctgacgatggcagcgacaccgtcaccttcatgttcgagacgccccacccaagataaaattgctgattttgagatgaaattaatggacatcgatagcgagcaccttgggattccggaggctgaataccatgctattgttaggatgccttcatctgagtttgctaggatttgcaaagatctcagcagcattggtgacactgttgtcatttctgtgacaaaggaaggtgtgaagttctccacaagaggtgatatcggaactgcaaatattgtttgcagacagaacaccacagtagacaagccagaagaagcaacaattgtagagatgaatgagccagtgtcattgacatttgcattgaggtacatgaactcctttacaaaggcaactccattgtcaagcacagttacaattagcttgtcttcagagctgcctgttgtggttgaatacaagattgcagagatgggatatattaggttctacttggctcctaagatagaagaggatgaagatgaaacaaagccccaagcttaggtgttgtgccagctcacaaccatttttcctgttcacg

SEQ ID NO: 2773 - DNA, 1089 bp, Carica papaya
atataaatcccgttttcttctctccggaactctctcctcctctctcaaacgagaccaaaccctaaccctaacgaatctcaatcgtcgagatctgatttccggctatccacaaaagaggaagaatgctagagctgaggctagtacagggttctctgttgaagaaggtgctagaggcgatcaaggacttggttaacgatgccaactttgactgctcggccactgggttctcgctgcaggctatggattccagccacgttgcgctggtggcgctgctgcttcgatccgaggggtttgagcactacaggtgcgataggaacatctccatgggaatgaaccttaacaacatgtctaagatgctcaagtgtgctggaaatgatgacatcatcaccatcaaggctgatgacgggagtgatactgtcacctttatgtttgagagcccaacacaagacaagatcgcagattttgaaatgaaactgatggacatcgatagtgagcaccttggaattcccgaggcagagtatcatgccatagttaggatgccttcatctgaatttgcaaggatttgtaaagaccttagcagtattggtgatacagttgttatctctgtgacaaaagaaggtgttaaattttctacaagaggtgatattggaactgcgaacattgtccttcggcagaataccactgtagataaacctgaagaggctacaattattgagatgaacgaacccgtgtctttgacatttgcactgaggtacatgaactccttcacaaaggcaactccattgtcgaacacagtaactatcagcttgtcttccgacctgccagttgtggttgagtacaaggttgcggagatgggttatattagattctacttggctcccaagattgaagaggaggaaggtgaagcgagctaggtgtgactctggtctgtaggcttaatgaacttcactgagatcattcttatgttgatgtgctgaatttgtgaagaatgtgttctaaattgactctcagtcttggatgtagtagcatttggatgttatagggattacaaaggcttgtattcatgtgcattattttgttaaatgttct

SEQ ID NO: 2774 - DNA, 1062 bp, Theobroma cacao
ctctctcaaagccctaatccttaacctcgcatctttctcccaagaatagcaaaagaaacccaaaaatgcttgagctgaggcttgttcaaggttcgcttctaaagaaagtcttggaagcgattaaggacttggtcaccgatgcgaacttcgactgttcggcgacggggttctcgttgcaggccatggattcgagccacgtggccctggtggctctgttgctcagatcggaagggttcgagcactatcgctgcgataggaacatttccatgggaatgaatctcaataacatgtccaagatgctgaaatgcgccggtaatgatgacatcatcactatcaaggctgacgacggcagtgatacagttactttcatgttcgagagccccacacaagacaagatatcagattttgagatgaagctgatggatattgatagtgagcaccttggaattccagaggcagagtaccatgctatagttaggatgccttcagctgagtttgcaaggatttgtaaagatcttgctagcattggtgatactgttgttatctctgttacgaaggaaggtgtgaagttttccacgagaggtgatattggaactgcaaatattgttctcaggcaaaataccactgtagataaaccagaagaagcaacaattatagagatgaacgaaccagtgtcattgacatttgcattgaggtacatgaactcatttacaaaggccactccgttgtcaaatacagtgacaatcagcttgtcttcagaactgcctgttgtggtcgagtacaagatagctgagatgggttatatcaggttctacttggcacccaagattgaagaggatgaggatgagactaagccacaagtgtaacttgattttggcatgggatcctgtttccttgttcagtagaatgtgtttgatgttgtcatcaatgttgccttgagggttctacttgaagctcaccatgtagccaaacgttaagtagttcaggtcagatggatgataaatttctttcatgtgcttggatatttttgatgttatgttataaatgatgatgcatctcttc

SEQ ID NO: 2775 - DNA, 1391 bp, Theobroma cacao
ctggattcaacctcaataggttggatccagctttggacatggctggatactgaacatatatgggcgggatttaacgttcaatgttgttccaccagaggatgttcctcttgcaagtttgtagaaatcttgggtgggctttcgtgggcctgaatggggcacttgacccaacttccaaattcagatgttgcatgacgatgtcaatatccttcccgctttgctaaactcattggcgggaaccaaacgcctcccaatcccgccaattgaacaccaacgattcaaagtaactttcctctttatataaacccctcaattccctcatttgtttcctttctctctcaaagccctaatccttaacctcgcatctttctcccaagaatagcaaaagaaacccaaaaatgcttgagctgaggcttgttcaaggttcgcttctaaagaaagtcttggaagcgattaaggacttggtcaccgatgcgaacttcgactgttcggcgacggggttctcgttgcaggccatggattcgagccacgtggccctggtggctctgttgctcagatcggaagggttcgagcactatcgctgcgataggaacatttccatgggaatgaatctcaataacatgtccaagatgctgaaatgcgccggtaatgatgacatcatcactatcaaggctgacgacggcagtgatacagttactttcatgttcgagagccccacacaagacaagatatcagattttgagatgaagctgatggatattgatagtgagcaccttggaattccagaggcagagtaccatgctatagttaggatgccttcagctgagtttgcaaggatttgtaaagatcttgctagcattggtgatactgttgttatctctgttacgaaggaaggtgtgaagttttccacgagaggtgatattggaactgcaaatattgttctcaggcaaaataccactgtagataaaccagaagaagcaacaattatagagatgaacgaaccagtgtcattgacatttgcattgaggtacatgaactcatttacaaaggccactccgttgtcaaatacagtgacaatcagcttgtcgtcagaactgcctgttgtggtcgagtacaagatagctgagatgggttatatcaggttctacttggcacccaagattgaagaggatgaggatgagactaagccacaagtctaacttgattttggcatgggatcctgtttccttgttcagtagaatgtgtttgatgttgtcatcaatgttgccttgagggttctacttgaagctcaccatgtagccaaacgttaagtagttcaggtcagatggatgataaatttctttcatgtgcttggatatttttgatgttatgttataaatgatgatgcatctctt

SEQ ID NO: 2776 - DNA, 1516 bp, Quercus alba
gaactagttaaaagttgaaattggagaaggcaaagccaaagacaaaagaacactagaatagaaccgaaccctaggaattcaaagagtttttcccaaagtcaatggcgggaacgaaattccatttccaatcccgccaatagagtcgtaccaattcatttcaattccaattcgtaaccgctacccgtttataaaagcgaaccggtcgaaccgcacccttcactttcccacacagacgctctctgaaatcaaaaaaaccctagccctagccaagaagcacacagagtcccaaaggaaaaaaaagcgaaaatgttggaactacggctagtccagggttcgctactgaagaaggttctggagtccgtaaaggaccttgtgaacgatgcaaacttcgactgctccgccactgggttctcgctccaggccatggattcaagccacgtggcgctggtcgcgttgctgcttagatctgagggctttgagcactaccgctgtgaccgtaacctttccatgggtatgaaccttaacaacatgtctaagatgctcaagtgtgctggcaacgatgacatcatcaccatcaaggctgacgatggcagtgacaccgtcactttcatgtttgagagccccacccaagataaaattgctgattttgagatgaaactgatggacatcgatagtgagcaccttgggattccagaggcagaataccatgctattgttaggatgccttcagctgagtttgccaggatttgcaaagatctcagcagcattggtgacactgttgtcatttctgtgactaaggaaggtgtgaagttctccacaaggggtgatattggaactgcaaatattgtttgcaggcagaataccacagtagacaagccagaagaagcaacaattgtagagatgaatgagccagtgtcattgacatttgcactgaggtacatgaactcctttacaaaggcaaccccattgtcaaacacagttacaattagcttgtcttcagagctccctgtggtggttgaatacaagattgcagagatgggttatattagattttacttggctcctaagatagaagaggatgaagatgagacaaagcctcaagcttaggtgttgtgcaagcacacaaccgattttccttgttcatgcaaattgctgtttgtttaagatcatgttgaggatttttcttatgcattatcctcggttttctttgtgttcaattgtttggtagtttagaagaatttgataattctggtaactgatgaatttattttgttgtgttttatagttaggatgaactttgtcagatgtatgttagtttatacaatttgtggtttctaaaaatcgaggaaaaaaaattcagagactttccacgaaaatgaactttaagactgaagtgagctgttaactatttggctgtagtgatttttaatgttcttttgtactacagtactcttcagtagaaatcctgcctgcatgtccgtagagtgcagtgttgaatgaaaggacaaagctttgg

SEQ ID NO: 2777 - DNA, 994 bp, Artemisia annua
accccgccaaacaaaatgttggaactaaggctagtccaaggcagtctcctaaagaaagtaatggaatcaatcaaggacctagtcaacgacgccaatttcgactgttcagccactggattctcactccaagcaatggattcaagccacgtggcgcttgtgtcattgctgttgagatctgaagggtttgagcattatagatgtgataggaatctaagtatggggatgaatttggggaatttgagtaagatgttgaagtgtgctggtaatgatgatattattacgctcaaggcggatgatgggagtgatactgttactttcatgtttgaatctcctactcaagataagattgctgattttgagatgaagctcatggacattgatagtgaacatcttggcattcccgaagcagagtatcatgccattgttcggatgccttcagctgaatttgcaagaatttgtaaagacctcagcagtattggtgacacagttgttatttctgtgaccaaggaaggtgtgaagttctcaaccagaggtgatattggaactgcaaatgttgtatgcagacagaacactacagttgacaagccagaggaagctactatcattgagatgaatgagccagtttctttgacatttgcattgaggtacatgaattcatttaccaaggccagcccactgtcgagcacggttacaatcagcttatcttcggagctacctgtggttgttgagtacaaaatagctgagatgggttacataaggttctacttagctcctaagatagaagaagatgatgaagaaaacaaatcttgagaagacaaggtaccaaacatatatatgatgtcttgaccgaagtcacttagaaatcaagaatttgtagtatgtaacaagattgcacaagcttattgcttctttttattatgttctgacagtggaacaatctgtagggttttattggtttcttgtaaactttattcaactagttatttcaatgttg

SEQ ID NO: 2778 - DNA, 1696 bp, Catharanthus roseus
ttcagccgcgaaggcgaagcactcttctttcatagctatataaaccctcccctcattttccctctcactctttcccactacctcctccatttcaaaacccctttcgcgctatttgaaaccctaaccctaacctttcgtgagttttttgctggaaaaatgttggaattgaggcttgttcagggaagtcttctgaagaaggttctcgaatctctgaaggacttggtgactgatgccaattttgattgctccgccagtggcttctctttgcaagctatggactccagccatgtggctctggttgctctgctcctcagatctgaaggcttcgagcactaccgctgtgaccggaatctttctatggggatgaatctcaataacatggctaagatgttgaagtgcgctggaaatgatgacatcatcacactcaaagctgacgatggcagtgacactgttactttcatgtttgaaagtcctacccaagataagatttcagattttgaaatgaagcttatggacattgatagtgagcatcttggaattcctgaagcagagtaccatgctattgttaggatgccctcagctgagtttgctagaatttgtaaagatcttagcagtataggcgacacagttgtgatatctgtcaccaaagaaggggtaaagttttccacaaggggtgatattggcactgcaaacatagtttgccgccaaaatacaactgtagataagcctgacgaagcaaccattatagagatgaatgagccggtgtcattaacctttgccctgaggtacttgaactcctttaccaaggcaaccccattatccaacactgttaccatcagcttgtcttcagagcttcctgttgttgtggaatataaaattgcagagatgggatacatcaggttctacttggcccctaagattgaagaggatgatgaagaggcaaagccttgaatatcaggcttaaaaattttccctcttctgattgtgttgtcctgttcttatgagataatgatgatgtgtatctgttagtcattgtgtttagccaagcattctgcaccatttagaagttttaggctcggttttgaaaagcaactaaaagagattctctgagtttcatttttctttctttcatctttcattttgtttcttgcatagttgttcggacatgtaagatcctttcttcctatgtgtctttgtgtttataaatagttttagattgcatgttagcttttaagtgctttcttgtagtaaaacaacgaagacatgctttatgatattctatggttgagatagcaccaaacaatgcctttgaatcccatgatgccagtttgttttggaaaaattctattctaaattaggttaatgttctcactcataattttttagtttgtattaaattagatcatgtctttaattatagaaacaaattttaaaattattaacaaatagggatgatttgttttagtgtgagtgaagatatgaatttggttcacagtatttttctgattgttgttcatactagtttttgttgaggatttttaaaattttcatctaatgctcctagtagcgtttctttttgaacaactggtaaaatagtcatagatgtgtaactagagactaggagggagtttcagttttgacgtcaaattggtactgccgttcatatgtatttttttcttaataaaaatgttattcc

SEQ ID NO: 2779 - DNA, 1209 bp, Tropaeolum majus
cgtgtctcagcggccggggcccgttcttttcatcttgtgcaagaaccctaaggtattaactttcatccatctagtagtactccaaactacatagtgtaaagatgttggaactgaggctagtgcaaggttctttgttgaagaaggtgttggaatcgattaaagatttggttaacgatgctaattttgactgctcggcgactgggttctcacttcaggcgatggactcaagtcatgtggcgttggtggcgttgttgctgagatctgaagggtttgagcactacaggtgcgataggaatctctccatggggatgaatcttggaaacatgtctaagatgctgaaatgtgctgggaatgatgacatcataaccatcaaagctgatgacggcagcgacactgtcacgttcatgtttgaaagcccaactcaagacaaaattgcggattttgagatgaagctgatggacattgatagcgagcaccttgggattccagaggccgaatatcatgctattgttaggatgccttcagcagagtttgcaagaatctgtaaagatctcagcagtattggagacactgttgtcatctccgtgaccaaagaaggcgtgaagttttccacacgaggtgatattggtactgctaacattgtcctcagacagaacaccactgtagacaagcccgaagaagcaaccattatagaaatgaaagagcctgtgtcactaacattcgctttgaggtatatgaactctttcacaaaggcaacccccttgtctaacactgttactatcagtttgtcttcggaactgcctgttgtcgtggagtacaaaatcgccgagatgggtcatgtcagattctacttggctcccaagatagaagaggacgaggatgaaacaaagccttgatgagccttaagtttaaacatgggtattggtcttcatacctcaccgagtttattaatgttctagatttgtgatgataatgtttttcttaggcttattgtgaattttgtagaatctggtattgggatatgttggttgtttccatgtaaacattaccattttcttttttaagttgaaacactttgtctcaattcttgtctgctttggtagcatcgtagtttatattaaccattaaatcacgctcaagttttgcattcagtctttcactcaattgagtagaattttgtgcaatgaagaatctgtatactctctgttg

SEQ ID NO: 2780 - DNA, 996 bp, Helianthus annuus
gggggcgcctattggcctaccacatctttaacggtttaacccaaaaactctgccacaatcccagtttcccacctcccccaaatcttggcgggaaatactttccctataaaacactcaaacccttatcttccctcgttattttgttctccctccctcccggcgactttcaaaccctaaccctagttttcttccatctttcatcattcgccggaataatgttggagctgaggctagttcagggtagtcttctgaagaaggtgatggagtcgctcaaagatctggtgaccgacgccaactttgactgctccgccaccggattctcgcttcaggccatggattccagccacgtggcactggtgtctctccttctcagatctgaagggtttgaacactacaggtgtgaccggaacttatccatgggcatgaatcttaataatatgtccaagatgctaaaatgcgccggaaatgatgatatcattactcttaaggctgatgatgggagtgatactgttactttcatgtttgaaagccctacccaagataagattgctgattttgagatgaagttaatggacatcgacagtgagcaccttggaattcctgaagccgagtatcatgccattgttcggatgccttcatctgaatttgctaggatctgtaaagatcttagtagtatcggcgatacagttgtgatttctgtgaccaaggagggcgttaagttctcgacaagaggtgatatcggaactgcaaatgttgtttgtaggcagaacactacagtagacaagcccgaggaagcaacagttatagagatgaacgaaccagtgtctttgacatttgcattaagatacatgaactcgtttacaaaggcgactccgttgtcaagtaccgtcacaatcagtttgtcgtcagagcttcctgtagtggtggagtacaagatagctgagatgggttatatcaggttctatttggctcctaagatagaagaagatgaagagg

SEQ ID NO: 2781 - DNA, 1170 bp, Nicotiana tabacum
tttccctcctccccatttcagaaccctaaccctaatttccccagatcttctcaaaacccctttttcatcgaaaatgttggaattacggcttgttcagggaagtctgctgaagaaggttctagaatcaattaaggatctggtgaacgatgcgaacttcgattgctctgccaccggattctctctgcaggccatggactccagccacgtggcgctggtggcgctgctgctccgatctgagggttttgagcactatcgctgtgaccgtaatatttcaatggggatgaaccttgctaacatggctaaaatgctcaaatgtgccgggaatgatgacatcattactctcaaggctgacgatggcagtgacaccgtcactttcatgtttgaaagccccacccaagacaagattgctgattttgagatgaagctgatggacattgacagtgagcatcttgggattccagaagcagagtaccatgctattgttagaatgccttctgcagagttttctagaatttgcaaagaccttagcagtattggtgatacagttgtaatttcggtgacaaaggaaggtgtaaaattctcaaccagaggtgacattggtactgcaaatatcgtttgcaggcagaatacaactgttgacaagcctgaagaagccacagtaatagagatgaatgagccagtgtctttgacttttgccctgagatacttgaactcctttacaaaagcaactccactatccaatactgtgaccatcagcttgtcttcagagctacctgttgtggttgaatacaagattgctgagatgggctatataaggttttacctggcgcctaagattgaagaggatgaagaggaaaccaaaccttaattttatgtttctgcgttcttttgagctttggtttgggggttaaattttctgtgatgaagctcatttgaggttttcaggcaagcaagagagcaagcaagatgtagtttagacttgctagataattttttaggtttgtgtttaattaatggaatcatgtgtttccctctttttaactcttttctattctcttgcctgcatgcgatgctagaatgttgtaaacctactcccattgaatttacagagtttcttggtttatttgatgctctgcattaaatacattgaaaagggattttggttctggc

SEQ ID NO: 2782 - DNA, 1072 bp, Guizotia abyssinica
acccgcgtccttcgaaaccctaaatcctatctttccaccggaaatcttatctttcgcctgagatatgttggagctacggctagttcaggggagtctcctcaaaaaggtgatggagtcgatcaaggacctcgtcaccgatgctaattttgactgctccgccaccgggttttcgcttcaggcgatggattcgagccacgtcgctctggtatcgctccttctcagatcggaagggttcgaacactacagatgtgatcggaacttatccatgggtatgaatctcaataacatgtccaaaatgctaaaatgcgctggaaatgatgacatcatcactatcaaggctgatgatggcagcgacaccgttactttcatgtttgaaagccctactcaggataagattgctgattttgaaatgaaactcatggacattgatagtgagcaccttgaattccggaagccgagtaccatgctattgttcggatgccttcatccgagtttgccaggatttgtaaagatctcagcagtattggtgacacagttgtgatttctgtcaccaaggagggcgttaaattctcaacaagaggtgatatcgggactgcaatgtgtttgtaggcagaacactacagtagacaagccagaggaagcaacaatcatagagatgaatgaaccagtgtctttaacatttgcattaagatacatgaactcgtttacaaaggcgactcctttatcaagtacagtcacaatcagtttgtcttctgagcttcctgtagtggtggaatacaagatagctgagatgggttatgtcagattctatttggctcctaagatagaagaagatgaagaagagaacaaatcttgaatcaagttataggctgagaattcaatgccttgttagttgtttcttaaagatattggcatgtcacaagaactttggctaaattgtttttttttaagttatcattttactaggatttttgtttttctatgtattgtatgagttgattgttagtttttctttcagaacaattatatccttgatcatttgcagcttagcaggcacactagtttttattac

SEQ ID NO: 2783 - DNA, 1361 bp, Quercus alba
atggggagactctcactctcactttcattctcacaatctcagagttgcattcaatttttctcaaaacacaaacagaaaagaaaaaaaaaaaaaccctaatttcaaatagaagaaaagccaaaatgctagagctaaggctagtccaagggagtctattgaagaaggttctggaatcggtcaaggacctcgtcaatgacgctaacttcgactgctccgccaccgggttctcgctccaggccatggattccagccacgtggcactcgtggctcttcttctcagatctgagggcttcgagcactaccgctgtgaccgtaacttgtccatggggatgaacctcaacaacatggccaagatgctcaagtgtgctggtaacgatgacattgttaccattaaggccgatgatggtggcgataccgtcactttcatgttcgaaagccctactcaagacaagattgctgactttgagatgaagctgatggacatagacagtgagcatcttggaatccctgaagcagagttccaagccatcgttaggatgccatcagctgaatttgcaaggatttgcaaggaccttagctccattggtgatactgttgtgatatctgtgacaaaggaaggtgtgaagttctctaccagaggtgatattgggactgccaatattgtttgcaggcagaatactactgtggacaagccagacgatgctaccataatagaaatgcaggagccagtctcgttgacctttgcgctaaggtacatgaactcattcacaaaggcaacccctttgtcaaaccaagtcacaatcagcctgtcttcagaactgcctgtggtagttgagtacaaagtagcagagatgggttacataaggttctacttggctcccaagctagaagaagatgacattgaaaatcaagcggaagccaggcctgaagtgaacaagaagcctaaagatgagcctatagtggatgccaagcctatatcggagattaagcctaaattggaggtcaaggctgaagatgagaataagcctcaaattgaaagcaccactgcagtgggatccaaggaggaaattgatcttatggatgatgagtagtttatggttgtaattcatctgtcctttcagttgaaagaatctgaagacttggcatgttagggctcattgagttttgtttacagataagccttagatggaatcatattaattcttccaattttagatgtattagattgggatctcgtgttgtatattgttaatttctgctgaaggctgttgacatatccctagccctttgcaatttttatgccttaaaggcctgaacctaactcagttagattctatggtttaaaatggttaggtgctgtt

SEQ ID NO: 2784 - DNA, 984 bp, Cyamopsis tetragonoloba
caagcgaaaccctaactctgaagagaaaccgccgaatccaccatcaagatgttggaactccgtctcgtccaaggttcgctgttgaagaaagtcctggaggcgattaaggagctcgtgaacgatgcgaacttcgactgctccgccaccgggttctccctccaagccatggactccagccacgtggcgctcgtggcgttgctgctccggtctgaggggttcgagcactatcgctgcgaccgcaacatctccatgggaatgaacctcaacaacatgtctaagatgctccgatgtgccggtaacgatgatatcatcaccatcaaggccgatgacggcagcgacactgtcacattcatgttcgaaagtccaacgcaagacaagatttctgattttgagatgaagctgatggacattgatagtgaacaccttggaatcccggacgcagagtaccatgccattgttaggatgccgtcggctgagtttgctaggatctgcaaagatctcagtagtattggtgatactgtggtcatttctgtaactaaggagggtgttaagttttctaccaaaggagatattggaactgcaaacatagtatgtaggcagaacacttctgtggacaagcctgaagaagctactgtcattgaaatgaatgagcctgtatcgttgacatttgcattgcgctacatgaactcttttacaaaggcaacacctctgtctaatacagttaccattagcctatcaaatgagcttccagttgtggttgagtacaagattgctgagatgggctatgtgcggttctatttggctcccaagattgaagaggatgaagaagagaccaagcctcaagtttaatgtgtattcagatattggattggcatgttaggttttaattttgcttgtatttgtaggatgccgctatacgtctgttgaaaatattttaaccttccggcaaatgaattggaattctatgaatttcttagtggtgta

SEQ ID NO: 2785 - DNA, 4511 bp, Cannabis sativa
atgtaagtaaatcaagtactagtttttatggttcttttcaatatgtttatttaaaattaatattggttaaatttctaaaaaaaatattatattttgaataatattttttttattttttatgtttaaacataaatttatttgatttaattattttatttatgcattagttcaaaaaactaatcataattcttatttcaacaattattcaagaaataaaaaataactcttacttaaaactctcattaactaaaaatttatggtatcttcattttataactcctattcatatttatattattaatgtgtcaaaaaatttatggtgacttcgcattttataatataactatcatgcataatatatattattatgtgtacaaaaatttatagtgttttcattttataactcttatttatatttataatacctatatattattaatgtgaacaaatttataatgtcttttcatttataatatctatatattattatatgtgtatattattattacatattgtaacattcttctgatattcttatatatatatacactagctatatattgtcatgagcaatattgtgaagccataaattttactatattaaaaaaaattggctagaaattaacaatttttctcatcttttacgggctctattgtgtgtacttatccaactcactcttcatgatgatcaaactaattagaaagttgaagtgtcttcctataaagatagtattatcttcattttattttgtagtggttttagattttttttaattatttttatactaatattaaattaaaaccaactaattaaaaataaattaataatcattatgacttatagtattctaacacaaaaataattcatatgaaaattgcaacattataacatatgtattaactatttgcataataccattaaaaaaactatttgtatttatttatgagactttttatcatcatcaaaactcttcatcattcttaccaaccttgctccatatcgcactaattatgctaatacgagtgatattagagctcacatagacaagcttcatgggttgctaccaaaaacttaaggccatgtggttagatctcagtgaagattacatggtgtagtttgtgattaaaatcattccttttcaatttgattcaatcagattaaattacaatactcaaaaggagcaatagactattcaagagatgactgatattattgccaaaaaaatatataaaaaaaaagaaggacaagaagtatcttcatggtgacaagccaaacaatccgcataagtgaaatattataagtgtgcatataaatttgcagtatatatatattaggtgtttaatttatattatgtgttttatcttaagtgtaaatttataagtattttttgtcctatatatatttatcatatatctccatctattcaactcatctataaatttgtatgattggtaatttattttatattttggtctgtggttataagtttggttttttttttttggtcatcaagttaatcatcttgtgataatttattgttcttacaatttatttagataattgttggactttaaaacccaaacaactaggatggatattcgaaaaatataaagagcacatattattaagaattaattaattttactatattacataaaatatcaaataaatatgagtactaaagtaatatgtatatttctttattgttgtattttttttttctcaattatgaattctaaagaattactatccttatatattattattattgtttattattttattatttgttttggtagtggtgtaaaacactacgataataatatcaataaattagaaggtaaaaattatttattctaaaatactattaattttctatacataaaataaattagttatattccgtagttaattttaggctaaagattttgtgtactatatatacttactattattgacagaaggaagtggaatacggccatctatccaaaaaccgttgtcttcagcgaaagagactgcattgcaagttttcccaacaactgcaatggaggcaaggcctagtgctacccttcttgttgtttgcatgctgtgttgttcttcacaatcatccttcttcttccctagatacccaactatttctactccttttttggccctttcgaggcttgcaaccctaatttgaatcctcgacagtgtttcgaagactccattcaagtttgccaaacgggccatggtggaagaattgagtgaaaagaatgcaattttgagaaaacactcactgagtgtggcactagaatttcagttatatccgtttgtaaaaagcttaggccacttgtgaccacaagaaacatatcccttataaagggtaatttggtcattttctatactttacatagttacagctgaagtggtctattcacactttccctccatttttttttttcattttaaaaccctaaccctaaaacttgagaaatactcccaatcgaagtaatcagtgaggtctgaagatgttggagttgcggttggttcagggttcgctactgaagaaggtgatggaggctctcaaggacctcgtcactgatgccaacttcgattgttcggcgaccgggttctctctccaggccatggattcgagccatgtggccttggtagcgctgctgctcagatcggagggcttcgagcactaccgatgcgataggaatctttccatgggtatgaacctcaacaacatgtccaagatgcttaagtgtgccggaaatgatgacatcatcactattaaggccgacgatggaagtgacactgtcacctttatgttcgaaagtcccactcaggacaaaattgctgactttgagatgaagttaatgagatgactgatattatgaacatcttgggattccagaagctgaataccatgctattgttaggatgccttcatcggagtttgctagaatttgtaaagatctcagcagcattggtgatactgttgttatctctgtcaccaaggagggtgtcaagttctccacgagaggagatattgggactgctaacatagtttgcaggcaaaattcaactgttgataagccagaagaagcaacagttatagagatgaatgagccagtttctttaacgtttgctctgaggtatatgaattcctttactaaggcaactccattgtctaacactgtaacaatcagcttgtcctctgaattgcctgttgtggttgagtacaagattgcagagatgggttatgttaggttctacttggctcctaagatagaagaggacgaagaagagacgaacccctgagtttagggcaagttttgctattaaccctggttgcactgtttaaagtttagcagaagtttttcttgtacaattcgtctagggtggctattcacttttttaactatagttaaatctgtagtttagatgattttccaaattcaacggttttttttcttcttttgttgtgtaaacaatgttattttaatgtttattgtttgcttatatactcatctaaattgacacccaaatgactaaaaagggtttaaaccaacaaaagtttttgtgcatatcttcacttgtaggaaaatttagtctcagcacaattggccttccagtgcgggaagacaggaaatgtccattcgaagacggttgatttgcttttagactaggagagttatggctacgttcggtaaccattttaaaaatggttttttattttttaatcaaaaatttggaaagacaaatagaaatggtgttcggtaaaatcaattttatttttgtttttaaaatttaaaatcaaaaggagtaaattttaaaaatagatttttgatgattttaaaaatagatttttgatgattttaaaattttttaaaaacacttttttttctcttgcttggctctcttaatcttcgtttttcctcaatgagtcttccatggcgtcagctattctagatttgaaaatgaaaaaaatgagaacaacatgacatgagaaaggaatcttagtgtgaaagatatctttgctattacagatcgtaatccttcaggaaaaatggagttgttcaattatcgacattagtctttgagaattgtcatgagtggtgctttagcgtattgaaggctcattttctcattttaaagcaaatgcctacgtatgatctgaaaatacagaagtacattgtgattcctcttgtgggattcacaattttataaggacgaatgcaagaagacatattttgatggagatgaaggcatttttgatgtataagatactactatacaaatgacccatgaaactttgaatgatagtgttgagtttaacatttcaagagattgaattcatgaaatagctaatgtttgtggtgaaattgctaatcgtatatagagagcaaattgacgatgaagataatgagtgaaggttattaacaagtagaacttttttaatatttttttttatcaagattggacaattattagttcatattttattatgattttgtcagtt

SEQ ID NO: 2786 - DNA, 903 bp, Abies balsamea
tctgtttcccttcattcaacaagggaaagagtcctcttctccctgtagttgtcttccccacaacaatgttggaattaaggcttgtgcaggggagtcttctcaagaaggtgctggaggccatcaaggacctcgtcaccgatgccaacttcgattgctcggccacgggcttctcccttcaggccatggactcgagccacgttgccctggtttctctgttgctcagatccgaaggcttcgagcactatcgctgcgatcggaacatgtctatggggatgaacctcaataacatggccaaaatgctcaagtgtgccggcaacgatgacattatcaccatcaaggccgacgacggaggcgacaccgttaccttcatgtttgaaagccccaaccaggacaagatttcggacttcgagatgaagttaatggacatcgacagcgagcacctaggcattccggagtcagagtaccatgctattgtgagaatgccatctcaagagtttgctcgtatttgcaaggatctcagctccattggggatacagttgtgatctccgtgagcaaggaaggagtaaagttctcaacaaggggagacattggtagtgctaatattgtctgtaggcaaaacccttctgttgataagccggacgaggcaacgattattgagatgcaggagcctgtatcactgacatttgcactgagatacatgaattcattcacgaaggcaactcctctgtctaacacagtgaccataagcatgtcatcggaattgccagtcgttgtcgaatacaaaattgcagagatgggttatattaggttttacttggctcctaagattgaggaagaaggtgaaacttaaactgccctctacgctctgcattgcattgggcagagaaaggctcttagttagt

SEQ ID NO: 2787 - DNA, 1322 bp, Abies balsamea
caagcccttcacaaaaacgcctacacccactgcctctctgaatccagaaccctctcatcgaacctccagactcactcacttcgccctccacaaatccctatttcatttcatatttgcagagcactctgctcactcttttcattttctttgatacccgtctaaccattttattttcgtcatgttggaactaaggctcgtgcaggggagcctgctgaaaaaggtgctcgaagcaattaaagatttagttacggatgccaattttgactgttcggcgacggggttttctctgcaggccatggattccagtcatgtggcccttgtggcccttttgctcaggtccgagggtttcgagcattacagatgcgatcgaaatatgtctatggggatgaatatcaacaacatgtccaagatgttgaaatgcgcggggaatgatgatattatcaccattaaagcagatgacggaggagatattgtcaccttcatgtttgaaagccccaaccaagataagatttcggatttcgaaatgaagttgatggatattgacactgagcatttgggtattcccgagtccgagtaccaagctattgtaaggatgccatcacacgagtttgctcgtatttgcaaagatctaagcactattggtgacacagttgtcatatcagtgaccaaagaaggagtaaaattttctactaggggcgatattggaagtgcaaatattgtctgcaggcaaaatacttctgttgacaagcctgaggaggcaacattgattgaaatgcaggagcctgtgtcattaacatttgctctacgatatatgaactcatttacaaaggcatcacctctatctaacatagtgacgataagcatgtcatccgatctgcctgttgttgttgaatacaaaattgcagaaatgggatatattaggttttatttggcccccaagattgaggaggaagaaggagaatcttagttttactatgcattgctggccctgttttccatgaaaagttttgggatacatgattgctcatttcgctgcagtcgactatatgatgggttttatgaattgaagcatcctatatacccatctctgctatgcttctggcatagtggggctacaacgtatccgtatctgtgtagttaatttgttctcctgaagaaataatgactttagctgtcatggccagggataaacagttcttagttgttgactatgcctgtttcctctttcatggtacacagattttttcatgaaagactgtgaacttcatatgtactatataaagttctggactcttgtcatgtacccgatgaaatttaatccg

SEQ ID NO: 2788 - DNA, 1345 bp, Amorphophallus konjac
cgttttctctctctctctacgttctctggaggtgctgtttcccttttggaggcggtggtggttgcggcgctgctgcgaaggggcgtgcgagggagagggaggaagagggaggagatcggagggtaaagctccgtttctatccgacgatgttggagctcaggttgttgcaggggagcctgctgaagaaggtgatggaggccattaaggatctggtcactgatgccaacttcgactgctccgccacgggcttctccctgcaggccatggactcgagccacgtggcgctggtggcgctgctgctccggtcggagggcttcgaccactaccgctgcgaccggaacctgtccatgggtatgaacctcaacaacatgtccaagatgctcaagtgcgctggcaacgacgacatcatcaccatcaaggccgacgacggcggcgacaccgtcaccttcatgttcgagagccccaatcaagataagatcgccgattttgagatgaagctgatggacatagacagcgagcatcttgggatccctgaagctgagtaccacgccattgtgcacatgccttcatccgagttttcccggatctgcaaggacctcagcagcattggtgacacggttgtaatttctgtgaccaaggaaggggtgaagttctctaccaggggtgacattggagctgcgaatattgtctgcaggcaaaacaccaccgtcgacaagccagaggaagcgaccatcatagagatgcatcaggctgtatccctgacgtttgccttgaggtacatgaactcttttaccaaggcgactccgttgtcaagcactgtgaccattagcctgtcctcagagttgcctgttgtcgtcgaatacaagattgcagaaatgggttatatcaggttttacttggcccccaagatcgaagatgaagaggaagatgtaaagccctaagcctggttacccgttaagtctccactctccattactttgcttactcctctgtacctttcctcttcaatttttctttcgtagaaagcagatgccttttacttctctgtagtaatttgctggattcttaagcctttggcatatcctttgtggaggttacattttctttcagttcaccggcacttgatgctacttaacactcaatctaacaaattttagaggtaccctttccaaggatgccgtcccaggcttgttgcctgcatgaagccactcatttatttgagggagtttttccattgaactccatcctcaacttgggttcctgttccaaaggggtggtggtgttagctggtgtttcttggtttcaattcgagcataccgctacgaccattccgtttaaaaagttt

SEQ ID NO: 2789 - DNA, 1107 bp, Amsonia hubrichtii
gtcatcaggaaccctaaccctagacctcgtgattttagccggaaagatgttggaattgaggctcgttcagggaagccttctgaagaaggttctggagtctataaaggacttggtgacggatgccaattttgattgctccgccagtggcttctctttgcaagccatggactcgagccatgtggcgctggtagctctgctgcttagatctgaggggtttgaacactaccgctgtgaccggaatatttctatggggatgaatcttaacaacatggctaagatgttgaagtgtgccggaaatgatgacatcatcaccctcaaagctgacgacggcagtgacactgttactttcatgtttgaaagccccacacaagataagatttctgattttgaaatgaagcttatggacatcgacagtgagcatcttggaattcccgaagcagagtaccatgcgatagttaggatgccctcagctgagtttgcaagaatttgtagagatctcagcagtataggtgacacagttgtgatatctgtcactaaagaaggtgtaaagttttccacaagaggtgatattgggactgcaaatatagtttgccgccaaaatacaacagtagataagccagatgaagcaaccattatagagatgaatgagccagtgtcattgacctttgccctgaggtacttgaactcctttaccaaggcaaccccgttatccaacacagtaaccatcagcttgtcttcagagcttcccgttgttgtggaatacaagattgcagagatgggatacattaggttctacctggcaccgaaaattgaagaggatgatgaagagacaaagccttgaacatcatgctccagcattttccatctcctgattgcgttgctctcttgttatgagccaatgatgtatcttttattcattgtttgaggatcctgcgcattcaaaagttttaggtttgatttgtttagtaactgaaagagtttgctttagttttcccctttttttctttcttccatctttttatcgctttttcttgctttaatgctctgacatgtaagattcttgccctctgcgtgtttctgtttataaatagtttttaatacttacgt

SEQ ID NO: 2790 - DNA, 1134 bp, Arabidopsis lyrata
atcaattcccgctacaattgcaatctcctctcagaaatttcaagaaccctaaaaaaccctaaccgttcaattcacactctaagctttcgataatttcccagaagatgttggagcttcgtttagttcaaggttctctactaaagaaggttctagaagcggtcaaagatcttgtgaacgatgcgaacttcgactgttcaagcacagggttctcgcttcaagctatggattcgagccacgtcgcgttggtgtctcttttgctgagatctgaaggttttgagcattatcggtgcgataggaatctttccatggggatgaatcttggtaatatgtccaagatgctgaaatgtgctggaaatgatgatatcatcaccatcaaggctgatgatggtagcgacactgtgacgttcatgtttgagagtcccacgcaagacaagattgctgactttgagatgaagctgatggatattgacagtgagcatttaggaatacctgatgctgagtaccactcaattgtgagaatgccttctggagaattttccaggatatgcaaagatctcagtagtattggtgatacagttgtgatctctgtgacaaaagaaggggtgaagttttcaacagcaggtgatatcgggacagcaaacattgtactcaggcagaatactactgtcgacaaacctgaagatgctattgtgatagagatgaacgagcctgtttcgctttcatttgcattgaggtacatgaactccttcacaaaggctactccattgtcggaaactgtgacgatcagtttgtcctctgagttaccggttgtggtggagtacaaggttgctgagatgggttacattcgatactatctggcgcctaagattgaagaagaagaagacactaagccctaataatgatgaatgttttttagttttcgtttaagtccttttgttgaaatgtctgtcttgattcagttgttttctggatttactatgttaaggcaacggtaaactagataatcaaatgtcagtttgtcttattgcaatttgaaaaagcttgttataactcttttcatctgtaatatttgaaattgaagaaaaagaagacacaaagccctaaaacacctttgtttgtggcttctgcaacctc

SEQ ID NO: 2791 - DNA, 1133 bp, Arabidopsis lyrata
atcaattcccgctacaattgcaatctcctctcagaaatttcaagaaccctaaaaaaccctaaccgttcaattcacactctaagctttcgataatttcccagaagatgttggagcttcgtttagttcaaggttctctactaaagaaggttctagaagcggtcaaagatcttgtgaacgatgcgaacttcgactgttcaagcacagggttctcgcttcaagctatggattcgagccacgtcgcgttggtgtctcttttgctgagatctgaaggttttgagcattatcggtgcgataggaatctttccatggggatgaatcttggtaatatgtccaagatgctgaaatgtgctggaaatgatgatatcatcaccatcaaggctgatgatggtagcgacactgtgacgttcatgtttgagagtcccacgcaagacaagattgctgactttgagatgaagctgatggatattgacagtgagcatttaggaatacctgatgctgagtaccactcaattgtgagaatgccttctggagaattttccaggatatgcaaagatctcagtagtattggtgatacagttgtgatctctgtgacaaaagaaggggtgaagttttcaacagcaggtgatatcgggacagcaaacattgtactcaggcagaatactactgtcgacaaacctgaagatgctattgtgatagagatgaacgagcctgtttcgctttcatttgcattgaggtacatgaactccttcacaaaggctactccattgtcggaaactgtgacgatcagtttgtcctctgagttaccggttgtggtggagtacaaggttgctgagatgggttacattcgatactatctggcgcctaagattgaagaagaagaagacactaagccctaataatgatgaatgttttttagttttcgtttaagtccttttgttgaaatgtctgtcttgattcagttgttttctggatttactatgttaaggcaacggtaaactagataatcaaatgtcagtttgtcttattgcaatttgaaaaagcttgttataactcttttcatctgtttgttaaagattgaagaaaaagaagacacaaagccctaaaacacctttgtttgtggcttctgcaacctc

SEQ ID NO: 2792 - DNA, 965 bp, Solanum tuberosum
tagtttcccgcagagaaaaaaatgttggaactacgtcttgttcagggaagtctgctgaagaaagttctagaatcgataaaggatctggtgaacgatgcgaactttgattgttccgccactggattctctctgcaagccatggactccagtcacgtggctctggtggcgctactgctccgatctgagggctttgagcactaccgctgtgaccggaacatttcaatgggcatgaaccttactaacatggcgaaaatgctcaaatgtgctggaaatgatgacatcatcaccatcaaggctgacgatggcagtgacaccgtcactttcatgtttgaaagccccacccaagacaagattgctgattttgagatgaagctaatggacattgacagtgagcatcttgggattcctgaagcagagtatcatgctattgttagaatgccttctgctgagtttggtagaatttgcaaagaccttagtagcattggagatacagttgttatttcggtgacaaaggaaggtgtaaaattctcaaccagaggtgacattggtactgcaaatattgtttgcaggcaaaatacaactgttgacaagcctgaagaagccactgttatagagatgaatgagccagtgtcattgacatttgccctaagatacttgaactcctttacaaaagcatctccattgtcgaacacagtgaccatcagcttgtcttcagagcttcctgttgttgttgagtacaagattgctgagatgggctatgtaaggtattacctggcacctaagatagaagaggatgaagaggaaaccaagccttgattttatgtttttgctttcttatggtgtaggctcatttgagtctttcaggcaagcaatatgtagctttagcttagactggcaagacaaattttcaaatttgtgtttaatgaaatcatgtattttcctctttttggggggttttccttctc

SEQ ID NO: 2793 - DNA, 1355 bp, Pseudotsuga menziesii
gtaattcgtatgcttgcactgacccaatttactgaacttggctaactgtaagaatacactcagcctccacaaattccaatcccatttcatatttgcagaacactctgcttagtgtttcatttttttcgatacccatctatcttttttctttttcgccatgttggaactaaggctcgtgcaggggagcctgctgaaaaaggtgctcgaagctattaaggatttagttactgatgccaattttgactgttcggcgacggggttttctctgcaggccatggattccagtcacgtggcgctcgttgcccttctgcttaggtccgagggtttcgagcattacaggtgcgatcgaaatatgtcaatggggatgaatatcaacaacatgtccaagatgttgaaatgcgcggggaatgacgatatcatcaccattaaagccgatgatggaggagatacagtcacatttatgtttgaaagccccaaccaggataagatttcggactttgaaatgaagttgatggatattgatactgagcatttgggtattcctgagtctgagtaccaagccattgtaaggatgccatcaaccgagtttgctcgtatttgcaaagatctaagcactattggtgacacagttgtcatttcagtgaccaaggaaggagtaaagttttctacaaggggtgatattggaagtgcaaatattgtctgcaggcaaaatacttctgttgacaagcctgaggaagcaacattgattgaaatgcaggagcctgtgtcattaacctttgctctacgatatatgaactcatttacaaaggcatcacctctatctaacatagtgacaataagcatgtcatctgatctgcctgttgttgttgaatacaaaattgcagaaatgggatatattaggtattatttggccccaaagatcgaggaagaagagggagaatcttaattttactatgcattgcaggcccaggtttttctggaaagttttgagatgcatgattgcttattttgctgcagtcaattgtatgatgggatagtatgaattgaagcattctatatatttatatctctgctatgcatctggcgtagtgggtctataaagtatccatatctaggtgtagttaattttgcatttcctgaagaaaataacgacttcatgctgtattggccagaaataaacagtttgtagttgttgagtatgcctgttgtctctttcgttggacataaatcttattgcgaaagcctggggcttcatatgtactataaaaaagttatcaactcttgcctatgtacccaacgaaatttaatctgttgaagacattgctggtgatggaggattcatatgaagaagtgga

SEQ ID NO: 2794 - DNA, 999 bp, Solanum phureja
tttcattcagacacctctgttttccctccttccccatttgaaaaccctaaccctagtttcccgcagagaacaaaatgttggaactacgtcttgttcagggaagtctgctgaagaaagttctagaatcgatcaaggatctggtgaacgatgcgaacttcgattgttccgccactggattctctctgcaagccatggactccagtcacgtggctttggtggcgctgctgctccgatctgagggttttgagcactaccgttgtgaccggaacatttcaatgggcatgaaccttactaacatggcgaaaatgctcaaatgtgctggaaatgatgacatcatcaccatcaaggctgacgatggcagtgacaccgtcactttcatgtttgaaagtcccacccaagacaagattgctgattttgagatgaagctaatggacattgacagtgagcatcttgggattcctgaagcagagtatcatgctattgttagaatgccttctgctgagtttggtagaatttgcaaagaccttagtagcattggagatacagttgttatttcggtgacaaaggaaggtgtaaaattctcaaccagaggtgacatcggtactgcaaatattgtttgcaggcaaaatacaactgttgacaagcctgaagaagccactgttatagagatgaatgagccagtgtcattgacatttgccctaagatacttgaactcctttacaaaagcatctccattgtcgaacacagtgaccatcagcttgtcttcagagcttcctgttgttgttgagtacaagattgctgagatgggctatgtaaggtattacctggcacctaagatagaagaggatgaagaggaaaccaagccttgattttatgtttttgctttcttatggtgtaggctcatttgagtctttcaggcaagcaatatgtagctttagcttagactggcaagacaaattttcaaatttgtgttcaatgaaatcatgtattttcctcttt

SEQ ID NO: 2795 - DNA, 1093 bp, Helianthus annuus
cccccttttttctctttcaaaaccctaaccctaatttcccccaaatcactcaaaaatgttggagctacggttagttcaggggagcctcttgaagaaggtgatggaatcgataaaggatctagtcaacgacgccaattttgactgctccgccaccggattctcgcttcaggcgatggactccagccacgtggcgctggtgtctctgcttctcagatcggaaggtttcgaacactaccggtgtgaccggaacatttctatggggatgaatctgaataatatgtcgaagatgttgaagtgtgctggaaatgatgatattatcactcttaaggctgatgatggcagtgatactgtcacttttatgtttgagagtcctactcaagataagattgctgattttgagatgaaactaatggacatcgatagcgagcatcttggcattccggaagctgagtatcatgccattgtaaggatgccctcagctgagtttgcaagaatctgtaaagatctcagcagtatcggtgacacagttgtgatctctgtaaccaaagaaggtgtgaagttctcaacaagaggtgatatcggaactgcaaatgttgtttgcagacagaacacaacagttgataagcctgaagaagctactgtcattgagatgaatgagccagtttctctaacatttgcattgaggtatatgaactctttcaccaaagccacaccattgtcgagtactgtcacaatcagcttatcttctgagcttccagtggttgttgagtacaaaatagctgaaatgggctacataaggttttacttggctcctaagattgaagaagatgatgaagaaaacaaatcatgaaaacttttgaggtatcagacttcataaatggctagtttatgactaaatttaccctttgatttcaaaagtctctagcatgtaacaagaatttgaagcttacttgtcattattgttatgttggatagtggaatgcttatgtagttttttttttgtttttatgaactttgaaattagttgtttcccatttcgttagttagatcatgagatatttgtgatggtaacgaagtttaaagtcatggttgt

SEQ ID NO: 2796 - DNA, 1013 bp, Solanum lycopersicum
attttcgctctatttttcattcagacacctctgttttccctccttccccatttcaaaaccctaaccctagtttcccgcagaggacaaaatgttggaactacgtcttgttcagggaagtctgctgaagaaagttctagaatcgattaaggatctggtgaacgatgcgaactttgattgttccgccactggattctctctgcaagccatggactccagtcacgtggctctggtggcgctgctgctccgatctgagggttttgagcactatcgttgtgaccggaacatttcaatgggcatgaaccttactaacatggcgaaaatgctcaaatgtgctggaaatgatgacatcatcaccatcaaggctgacgatggcagtgacaccgtcactttcatgtttgaaagccccacccaagacaagattgctgattttgagatgaagctaatggacattgacagtgagcatcttgggattcctgaagcagagtaccatgctattgttagaatgccttctgctgagtttggtagaatttgcaaagaccttagcagcattggagatacagttgttatttcggtgactaaggaaggtgtgaaattctcaaccagaggtgacattggtactgctaatattgtttgcaggcaaaatacaactgttgacaagcctgaagaagccactgttatagagatgaatgaaccagtgtcattgacatttgccctaagatacttgaactcctttacaaaagcatctccattgtcgaacacagtgaccatcagcttgtcttcagagcttcctgttgttgttgagtacaagattgctgagatgggttatgtaaggtattacctggcacctaagatagaagaggatgaagaggaaaccaagccttgattttatgtttttgttttcttatggtgtaagctcatttgagtctttcaggcaagcaatatgtagctttagcttagactggcaagacaaattttcaaatttgtgtctaatgaaatcatgtattttcctcttt

SEQ ID NO: 2797 - DNA, 1152 bp, Solanum lycopersicum
attttcgctctatttttcattcagacacctctgttttccctccttccccatttcaaaaccctaaccctagtttccggcagaggacaaaatgttggaactacgtcttgttcagggaagtctgctgaagaaagttctagaatcgattaaggatctggtgaacgatgcgaactttgattgttccgccactggattctctctgcaagccatggactccagtcacgtggctctggtggcgctgctgctccgatctgagggttttgagcactatcgttgtgaccggaacatttcaatgggcatgaaccttactaacatggcgaaaatgctcaaatgtgctggaaatgatgacatcatcaccatcaaggctgacgatggcagtgacaccgtcactttcatgtttgaaagccccacccaagacaagattgctgattttgagatgaagctaatggacattgacagtgagcatcttgggattcctgaagcagagtaccatgctatagttagaatgccttctgctgagtttggtagaatttgcaaagaccttagcagcattggagatacagttgttatttcggtgactaaggaaggtgtaaaattctcaaccagaggtgacattggtactgctaatattgtttgcaggcaaaatacaactgttgacaagcctgaagaagccactgttatagagatgaatgaaccagtgtcattgacatttgccctaagatacttgaactcctttacaaaagcatctccattgtcgaacacagtgaccatcagcttgtcttcagagcttcctgttgttgttgagtacaagattgctgagatgggttatgtaaggtattacctggcacctaagatagaagaggatgaagaggaaaccaagccttgattttatgtttttgctttcttatggtgtaagctcatttgagtctttcaggcaagcaatatgtagctttagcttagactggcaagacaaattttcaaatttgtgtttaatgaaatcatgtattttcctcttttgggggttttccttctcttatctgcatgtgatgttagaatgccttgtagttgaatttacataaagcattttgtatttttaatgctgctctgcaagagtggaggaattttggttatgcaattgtatacacgaaattggca

SEQ ID NO: 2798 - DNA, 1283 bp, Helianthus annuus
cacacacaaaatgttggaactcaggctagtgcagggaagcctgttaaaaaaagtgatggaatccataaaggatctggtgaacgacgctaacttcgactgttcagcgaccggattctcactgcaagccatggattcaagccacgtggcactggtatcacttcttctcagatctgagggtttcgagcactaccggtgcgatcgtaacctctcgatgggaatgaatctcggtaacatggctaaaatgctccggtgtgccggaaatgatgatattgtcaccattaaggctgatgacggcggtgattgcgtcactttcatgtttgaaagccctaatcaagacaagattgctgattttgagatgaagctgatggacattgacagtgagcatttagggattccagaagcagaatatgaagccattgtgagaatgccatcatctgagtttgcaagaatctgcaaagatcttagctctattggagacaccgttgtgatttctgttacaaaggaaggcgtaaagttttcgaccaaaggtgacattggtactgcaaacattgtgtgcagacaaaacacttctgttgacaagccagaagaagctacaataatcgaaatgcagacaccggtttctctaacatttgcactgaggtacatgaactcgttcacaaaggcgaccccgctagcgagccaagtgacggttagcttgtcttccgaactgccgattgtggtggaatacaagattgccgaaatgggttacctgaggttttacttggctccaaagatagaagaagatgaagagatgggtggtcagcaaccggagcctgtggagaccaagaaacaaccagaaaagaagcccaaaactgagcccaaatccaacggggaacccaaacgtcgggtcatgaagatcgaccttgatgatgaagaagaggaactgaagcctaaggttgaagctaaaagcgatgctgatggttatgttgaagttatcggttctaagccggggaatgggattgtgaaaccgaaggaagagattaacggtggagatgaggttatggatgtgaagcctaagattgagaatggcacaaatggtgaagtgcaagtaatggatgaagagtagagattgtttttgtgtttgtttataatctatgatgatgatggggttaattttcttgtgctagtagtgaaagcatatttgtaaacctcctaccctagcagtggatttcattaaacttaatcctagttttggttgaattaagttgtttgctttttaaaaattactaatgtttggtttggag

SEQ ID NO: 2799 - DNA, 1110 bp, Gossypium raimondii
aatacccatctctttttcgctcaaaaccctaggccttcgctccaattttcccatctctttcgcaagagaaccaaaagagaagaaaaaataactactaaaaaatgcttgagcttaggctagttcagggttcgcttctaaagaaagtcttggaagcgattaaggacttggtcaacgatgccaacttcgactgttcggcgacggggttttctttgcaggccatggattcgagtcacgtggcgctggtggccctgttgctgagatcggaagggttcgagcactatcgctgcgacaggaacatttccatggggatgaatctcggtaacatgtccaagatgctgaaatgtgccggaaatgatgacatcatcacaatcaaggctgatgatggcagcgatactgttactttcatgttcgagagccccacccaagacaagatatcagattttgagatgaagctgatggatattgatagtgaacaccttgggatcccagaagcggagtaccatgctattgttaggatgccttcagctgaatttgcaaggatttgcaaagatcttgcaagcattggtgacaccgttgttatctctgttaccaaggaaggtgtgaagttttccacaaggggtgatatcggaactgcaaatattgttcttaggcagaataccactgtagataaacctgaagaagcaacaattatagagatgaatgagccagtatcattgacatttgcattgaggtacatgaattcatttacaaaggctactccattgtcaaacacagtgacaatcagcttgtcatcagagctgcctgttgtggtcgagtataagatagctgagatgggttatattaggttctacttggcacccaagattgaagaagatgaggatgagactaagccacaagtttagctttgaatttgggatggattttgcttccttgttgactacaatatgtgtttgattgtcattaatgtttaaggctttcaacaagttgccaagcatattaagtttgtttagattaggtggatgattaacatttctcttttgcttggattttcccatattgttataaattatgtgttcctgtttcttatgcgtcttcactattgttgtaaat

SEQ ID NO: 2800 - DNA, 1320 bp, Cicer arietinum
ctagaacgagatattaaaaaacaaaaaacaaaagagttccctccatattacctaaaatatcatggcgggaaataaataatttcccccaatcccgctcaaagcttctagaatcttccactatataaacccttttccctccccattttcttttccctatttcaatttccccccatttctctcccaaaaccctaacccttcacagatccacaatcatcaccatgttggaacttcgtctagtccaaggttcacttctcaagaaggttctagaagcaatcaaggagctcgtcaacgatgctaacttcgattgttcctctactggattttccctccaagccatggattccagccacgtggctttggtcgctcttcttctccgatcggaaggatttgagcactatcgctgtgatcgtaacatctctatgggtatgaatcttaataacatggctaagatgctaaaatgcgctggaaatgatgatatcatcactatcaaggctgatgatggaagtgacactgttaccttcatgtttgaaagtcctactcaagacaagatttctgattttgagatgaagctgatggacattgatagtgagcaccttggaattcccgaggctgaatatcatgccattgttaggatgccatcgtctgagtttgctaggatttgtaaagatcttagtagcattggtgacactgttgtcatttcggttactaaggagggtgtgaagttttccaccaaaggagatattggaactgcaaatatagtttgcaggcagaatactactgttgacaagcctgaagaagctactgttgtagagatgaatgagcctgtgtccttgcaatttgcattacgatacatgaactctttcacaaaggcaacacctttgtccagtacagttaccataagtctgtcaaatgagctgccagttgttgttgagtacaagattgctgagatgggatatgttcggttctatttggctcccaaaattgaggaggatgaagaggaaacaaaacctcaagtttagtttgagatagatgttggattggcatcttaggttctgaatatggttgtagttgtaggtgcttttatacattatgtaagatgtttcatctgtttgacaatctatgaatttggaagaggtgtatttgttccttgtcacatttaccacctcgtttagaacaatgttaaacaatgggtgtgtattcttcacactagcctcatatttttatggtttttatgaatctgaacagctttcaaacaaaatgttaaatctaagcagaaatcttgaaatcaacacaaaccttagtctgtgtcctgtcaacaat

SEQ ID NO: 2801 - DNA, 1151 bp, Citrus clementina
ctcccttcttcaagctttccctttctatctttcaaaccctaaccctaatttcccaagaaactcgcagcaaaaatgcttgagctaaggctagttcaaggatcccttctcaagaaagtgctggaggccatcaaggagctggtcaacgatgccaactttgactgctcggccaccggtttctctcttcaagccatggactccagccacgtggcgctggtggccctgctgctcagatcggaaggcttcgagcactaccgctgtgaccggaatatctctatgggaatgaatctcaataacgtgtcgaagatgcttaagtgtgctggcaacgatgacatcatcactctcaaggccgacgacggcagcgataccgttactttcatgtttgaaagtcccactcaagataagattgctgattttgagatgaaactgatggacattgatagtgagcatcttggtataccggaggctgaataccatgccattgtaaggatgccttcagctgagtttgctagaatttgtaaagatcttgccagcattggtgacacagtcgtgatttctgtcacaaaggagggtgtgaagttctctaccagaggtgatattggaactgctaatattgtgctcaggcaaaatactacagtagacaagccagaagaagcaacaataattgaaatgcatgagccagtgtcattgacttttgctctgagatacatgaattcattcacaagggctactccactgtcgaatactgttactatcagcctatcctcagaattgccagttgtggtcgaatacaagattgctgagatgggttatattagattctacttggcacccaagatagaagaagatgaggatgagaccaagcctcaagtttaagtgtcatttggcacgtaggctatggcattttgttgaatcaagttactcctatattttaagtttgcttttagaatgtttctcgtaaatcttcatgttggaaaaccaagcatttgtagttcggtagattgttaaaaactcctttcatgtgcttggcttttttatcctactgttgtacatgtaatcaattcctttgtccttgttgctttgaagagtaggctttaattgacttgaaactttcagaaatttatcaagaatgaaccattctggttgtttgcgta

SEQ ID NO: 2802 - DNA, 1058 bp, Euonymus alatus
gatgctcaagttatctacctgaaccctaattccatatttgcaaaaagaaatctcgatcgagcgcgaaaccctaactctaatatcattcgaatcaaacgaaacttcaaagaaaggatgctagagcttcgtctagtgcaaggttcccttctcaagaaagtcttggagtcgattaaggacttggtgaatgatgccaacttcgactgctcggcgaccgggttctcgcttcaggccatggactccagccacgttgctctggtggctctgcttctcagatccgagggtttcgagcactaccgttgtgaccggaacctctccatgggcattaatctcaataacatgtccaagatgcttcggtgtgccggaaatgatgacatcatcacgattaaggccgacgatggcagcgacacagtcactttcatgttcgaaagtccaacacaagacaagatatcagactttgagatgaaactgatggacattgacagtgagcaccttgggattccggaggctgaataccatgctattgttagaatgccttctgcagagtttgctaggatttgtaaagatctcagcagcattggtgacactgttgtgatctctgttacaaaggaaggtgttaagttctccacaagaggtgacattggagctgcaaatatagtcctgaggcagaacacaacagtggacaagccagaagaagctacaattatcgagatgaatgagccagtgtctttgacatttgcactgaggtacatgaattcatttactaaggctactccactgtcaaacacggttacaataagcttgtcatcagaactgcctgttgtggttgagtacaagattgcagaaatgggttatatacggttttatttggctcctaaaattgaagaggatgacgatgagacaaagcctggaatttgaatgccttcttgcatacaactgtgcattagtttttcatttgtaaccatcaaaactcgtgaattttcaggattgttgctttgtaatataaatatgtgagttccactaggctaaatatggtagtaagaaaattttatattttctcc

SEQ ID NO: 2803 - DNA, 950 bp, Allium cepa
cttttcctcccactcttcatcaatccattaactccattcccgagaatatatattgaaaacttcctcccatcaggttccaaaatctaattccaagcaaacgaaaatgttggagttaaggcttgttcaaggtagtcttctaaagaaagttctggaagcgatcaaagatctagtgaccgacgccaacttcgactgctcatcatcaggtttttctctccaagccatggattcaagccacgttgcgctcgttgctctgcttctcagatctgaaggtttcgagcattacagatgcgatcgtaatatttcgatggggatgaatctgaataatatggcaaagatgcttaaatgcgctggaaatgatgatattattactcttaaggccgatgatggtggagatactgtcactttcatgtttgaaagtcctcgacaagacaagattgccgactttgagatgaagcttatggatattgatagtgagcatcttggcattccagaagctgaatatcaagctattgtaaggatgccatcttcagaattcgctaggatttgcaaagatctcagcagcataggagacactgttgttatttcagtgacaaaggaaggtgtcaaattttcaacaaggggtgacattggaagtgctaatattgtttgcaggcaaaacacaactgttgacaagcctgatgaagctatagtgatagagatgaacgaagctgtatccctaacttttgctcttcgatacatgaattcattcactaaagcgactccgttgtctgaaaccgtcactcttagtctttcatcagagctgcctgttgtggttgagtacaagatagcagacatgggatatattaggttttatttggcgccaaagattgaagatgatgaggaaatgaaagaaggatcttgaaatttgttatcatgaaatatcatatcatctttagctctgtttagttact

SEQ ID NO: 2804 - DNA, 1147 bp, Citrus sinensis
ctcccttctccaagctttccctttctatctttcaaaccctaaccctaatttcccaagaaactcgcagcgaaaatgcttgagctaaggctagttcaaggatcccttctcaagaaagtgctggaggccatcaaggagctggtcaacgatgccaactttgactgctcggccaccggtttctctcttcaagccatggactccagccacgtggcgctggtggccctgctgctcagatcggaaggcttcgagcactaccgctgtgaccggaatatctctatgggaatgaatctcaataacgtgtcgaagatgcttaagtgtgctggcaacgatgacatcatcactctcaaggccgacgacggcagcgataccgttactttcatgtttgaaagtcccactcaagataagattgctgattttgagatgaaactgatggacattgatagtgagcatcttggtataccggaggctgaataccatgccattgtaaggatgccttcagctgagtttgctagaatttgtaaagatcttgccagcattggtgacacagttgtgatttctgtcacaaaggaaggtgtgaagttctctaccagaggtgatattggaactgctaatattgtgctcagacaaaatactacagtagacaagccagaagaagcaacaataattgaaatgcatgagccagtgtcattgacttttgctctgagatacatgaattcattcacaagggctactccactgtcgaatactgttactatcagcctatcctcagaattgcccgttgtggtcgaatacaagattgctgagatgggttatattagattctacttggcacccaagatagaagaagatgaggatgagaccaagcctcaagtttaagtgtcatttggcacgtaggctatggcattttgttgaatcaagttactcctatattttaagtttgcttttagaatgtttctcgtaaatcttcatgttggaaaaccaagcatttgtagttcggtagattgttaaaaattcctttcatgtgcttggcttttttatcctactgttgtacatgtaatcaattcctttgtccttgttgctttgaagagtaggctttaattgacttgaaactttcagaaatttatcaaaaatgaaccattctgattgtttg

SEQ ID NO: 2805 - DNA, 1239 bp, Trigonella foenum-graecum
aaaaccgtcgaaaccctaattcttcagaaaccctaatttccagatctcgatcaaaatgttggaactccgtctagtccaaggttcacttctgaagaaggttttggaatcgatcaaggagctcgtgaacgatgcgaacttcgattgttcctctactggtttctctcttcaagctatggattccagccatgttgctcttgtggcgcttctgcttcgttctgaagggtttgagcattatcgctgtgaccgtaatctttctatgggtatgaatctgaacaatatggcgaagatgctgaaatgtgctggtaatgatgatatcattactattaaggctgatgatgggagtgatactgttactttcatgttcgaaagtcctacacaagacaagatttctgattttgagatgaagctgatggacattgatagtgagcaccttggtattccagaggctgaatatgatgccattgttaggatgccatctgctgagtttgctaggatttgcaaagatcttagtagcattggtgatactgttgtcatctcggttactaaggagggtgtgaagttttcaaccaagggagatatcggagctgcaaacatagtttgcaggcagaatactactgtggacaagcctgatgatgctactgtcatagagatgaaagagcctgtgtccttgcaatttgcattaagatacatgaattcttttaccaaggcaactcctttgtccagtacagttaccattagtctgtcaaatgagcttccagttgttgttgagtacaagattgctgagatgggttatgttcggttctatttggctcccaaaatagaggaagatgatgaagaaaccaagccccaagtttagttggatatagatgttggattggcatgttaggttttgaatttggttgtagttgtaggatgcgtttatacactatcaaggtatttcgtctgtttgcctatctatgaacttggaagaggtgcatgtcacattattttccacctcgtttaaaacaatgttaaacaatggatgtgcattctccactgtagggcctttttatgttttgttgcttttatgaatctaaacagctttcaaactaaatgttgaatcatagcagaaagcttgaaattaacacccaagtttgttctgtcaacgaattattatcttgtaattgttgatgtgtttgtttttctgttttcatgtcatgttattaaacattgcttaatggttgttatggaatgcaattg

SEQ ID NO: 2806 - DNA, 1139 bp, Triphysaria pusilla
tctgcaacctataactctcatttcccaccaaaactacagatcgtcactcggaaaatatgttggagctgaggctggtgcaggggagtttgttgaagaaggttctggatgcggttaaggatctagtgaacgatgccaattttgactgctcggcgaccgggttctcgctccaggccatggattccagccacgtggcgttggtggcgctgctgctcagatcggaagggttcgagcactacagatgcgaccgcaacctctctatgggcatgaacctcggcaacatggctaaaatgctcaagtgcgctggaaacgatgatatcatcactatcaaggctgatgacggcagcgacaccgtcaccttcatgttcgagagtcccactcaagataagattgccgattttgagatgaaactcatggatattgacagtgagcatcttggaatcccagaggcagagtaccatgctatagttcggatgccatcttctgagtttggaagaatttgtaaagatctgagcagtattggtgacacagttgttatatctgtcacaaaggaaggtgtgaaattctcaaccagaggtgatattggaactgcaaatgttgtctgcaggcaaaatactactgttgacaagcccgaagatgcgacggtgatagagatgaatgagccagtgtcattgacttttgccttgaggtatttgaactcgttcaccaaggcaagcccattgtcaaacacagtcactatcagcttgtcctcagagcttccagttgtggttgagtacaagattgcagagatgggctatgtcaggttttacctggcacccaagattgaggatgatgatgatgaaaccaagcctatgtcataatctgccaatagttagttgtcatagtaatgttatcttgttttgtttggaatttcttcaagaatttgaagtattgtttagatacttgtttgtttgattctactcctttgtctgcatcattttatgagcgattaacaaccatttttcctggttcatcttcatctgtgcttaatttgtattaatactttctggcaagctcattctaagttgaatggcatctaactagtaatttgtgttttttgaatggttagtaatagtgcagtttggcgtaaaaaaaaaaaaaaa

SEQ ID NO: 2807 - DNA, 1193 bp, Triphysaria pusilla
aatataaaccctagcagccagtttattcccatttccaggcctcaattatcgatctgcaacctataactctcatttctccaccaaaactacagatcgtcactcgaaaaatatgttggagctgaggctggtgcaggggagtttgttgaagaaggttctggatgcggttaaggatctagtgaacgatgccaattttgactgctcggcgaccgggttctcactccaggctatggattccagccacgtcgctttggtggcgctgctgctcagatcggaagggttcgagcactacagatgcgaccgcaatctctctatgggcatgaacctcggcaacatggcgaaaatgctaaagtgcgctggaaacgatgacatcatcactatcaaggctgatgacggcagcgacaccgtcaccttcatgttcgagagtcccactcaagataagattgccgattttgagatgaaactcatggatattgacagtgagcatcttggaatcccagaggcagagtaccatgctatagttcggatgccatcttctgagtttggaagaatttgtaaagatctgagcagtattggtgacacagttgttatatctgtcacaaaggaaggtgtgaaattctcaaccagaggtgatattggaactgcaaatgttgtctgcaggcaaaatactactgttgacaagcctgaggatgctacggtgatagagatgaatgagccagtgtcattgacttttgccttgaggtatttgaactcgttcaccaaggcaagtccattgtcaagcacagtcactatcagcttgtcctcagagcttccagttgtggttgagtacaagattgcagagatgggctatgtcaggttttacctggcacccaagattgaggatgatgatgatgaaaccaagcctatgtcataatctgccaatagttagttgtcatagtaatgtttgtcttgtttcgtttggaatttcttcaagaatttgaagtattgtttagatacttgtttgtttgattctactcctttgtctgcatcattttatgagcgattaacaaccatttttcctggttcatcttcatctgtgcttaatttgtattaatactttctggcaagctcattctaagttgaatggcatctaactagtaatttgtgttttttgaatggttagtaatagtgcagtttggcgtaaaaaaaaaaaaaaa

SEQ ID NO: 2808 - DNA, 1138 bp, Medicago truncatula
tttccccccaaatcccaaaaccgtcgaaaccctaatttcccaaaaaccctaattcccagatctcgttcaccatgttagaactccgtctagttcaaggttcacttctcaagaaggtcctagaatcgatcaaggaactcgtcaacgatgccaacttcgattgttcctctactggtttctctcttcaagccatggattctagccatgttgctcttgtcgcgcttcttcttcgttctgaagggtttgagcattatcgctgtgaccggaatctttctatgggtatgaatctgaacaatatggcgaagatgttgaagtgtgctggtaatgatgatatcattactattaaggctgatgatgggagtgatactgttaccttcatgtttgaaagccctacccaagacaagatttctgattttgagatgaagctgatggacattgatagtgagcaccttggaattccagaggctgaatatgatgccattgttaggatgccatctgctgagtttgctaggatttgcaaagatcttagtagcattggtgacactgttgtcatctcggttactaaggagggcgtgaagttttcaaccaagggtgacattggagctgcaaacattgtttgcaggcagaacactactgtggacaagcctgatgatgctactgtcatagagatgaaagagcccgtctccttgcaatttgcattaagatacatgaattcttttaccaaggcaactcctttgtccagcacagttaccatcagtctgtcaaatgaactaccagttgttgttgagtacaagattgctgagatgggttatgttaggttctatctagctcccaaaatagaggaagatgatgaagaaaccaagcccgaagtttagttggatatagatgttggattggcatcttaggttttgattttgattgtagttttaggacgcttttatacattatcaaggtattgcgtatgtttgcctatctctgaatttggaagaggtgtgcatgtcacattattttctacctcgtttaaatcaatgttaaacaatggatgtgcattctccactgtagggccttttattttattgcttttatgcatctgaacagctttcaaactaaatgtggaatcttggaagagtttgaaattaac

SEQ ID NO: 2809 - DNA, 1231 bp, Echinacea purpurea
taattgattgtaccatatgctgtgtcatttgtaaaactcttgaacacacacttatatctctctcctcctaaccccctcatttcatcacacaggcacacactttcccttttcttcctcactcttccaaaccctaaccctaatttctctcaccaaaatgttggaactacggttagttcagggtagtctgctaaagaaggtgatggaatccataaaggatctggtcaacgacgccaattttgactgctccgccactggtttttcgcttcaggctatggattccagccacgtggcgctggtgtctctgcttctcagatcggaaggcttcgaacattaccggtgtgaccggaacatttctatgggcatgaatcttaataatatgtcgaagatgctgaagtgtgctggaaatgatgatatcattactcttaaggctgatgatggcagtgatactgttactttcatgtttgagagtcccacacaggataagattgctgattttgagatgaaactaatggacatagatagcgagcatcttggtattcctgaagctgagtatcatgccattgtaagaatgccctcagctgagtttgcaagaatctgtaaagacctcagcagcattggtgacacagttgtgatttctgtctccaaagaaggtgtgaaattttcaacaagaggtgacattggaactgcaaatgttgtgtgcagacagaacacaacagttgataagcctgaagaagctactgttattgaaatgaatgagccagtttctctaacatttgcattgaggtatatgaactcgttcaccaaagcaacaccgttatccagtactgtcacaatcagcctatcttctgagcttccagtggttgttgagtacaaaatagctgaaatgggctacataaggttttacttggctcctaagattgaagaagatgatgaagaaaacaaatcatgaaaacttgcggtatcaatcttcatgtgttgggatgcttatgtaattcttatgtttggtagtggaatgcttatgtagttttttctgttttaatgagttttagaattaattgttttcattttgtttatttagataatgtgatatttcaagtgtcatgatcattgcctggattttaagggttctattgccctttgttttaacacttctatccaactctctttattctttttagtctctcatttcttaagagcactggatcagcttgctgaatcattgtctgttagt

SEQ ID NO: 2810 - DNA, 1133 bp, Arabidopsis thaliana
atcacttcccgctaacaattgcaatctcctcccagaaatttcaacagctctaaaaaccctaaccgtttcgattcacactctaacctttcgataatttcccagaagatgttggagcttcgtttagttcaaggttctctactgaagaaggttctagaagcggtcaaagatctggtgaacgatgcgaacttcgactgttcgaccacagggttctcgcttcaagctatggattcgagccatgtcgcgttggtgtctcttttgcttagatctgaaggtttcgagcactatagatgcgataggaacctctctatgggaatgaatcttggtaatatgtctaagatgctgaaatgtgctggaaatgatgatatcatcaccatcaaagctgatgatggtagcgacactgttactttcatgtttgagagtcccacacaagacaagattgcagattttgagatgaagctgatggatatcgacagtgagcatttaggaattcctgatgctgagtaccactcgattgtgagaatgccttctggtgaattttccaggatatgcaaagatctcagtagcattggtgacacagttgtgatctcggtaacaaaagaaggggtgaagttttcaacagcaggtgatatcgggacagcaaacattgtgctcaggcagaatactaccgtcgacaaacctgaagatgctattgtgatagagatgaacgagcctgtttcgctttcatttgcattgaggtacatgaactccttcacaaaggctactccattgtcggaaactgtgaccatcagtttgtcctctgagttaccggtcgtggtggagtacaaggtggctgagatgggttacattcgatactatctggcgcctaagattgaagaagaagaagacaccaaaccagaataatgatgaatgtttgatagtcttcgttcgagtcctttgttgaaatgtctgtcttgattcagttgttttctggatttactatcttaaggcaatgctaaactagataatcgtatgatgtttgtctttctgaaatttggaaaagcttgtttataacacttttcatctgtttgttaaacattgaagaaaaagaagacacgaagccctaaaacacgtttgtttgtggcttctgcaacctc

SEQ ID NO: 2811 - DNA, 1072 bp, Arabidopsis thaliana
cgctaacaattgcaatctcctcccagaaatttcaacagctctaaaaaccctaaccgtttcgattcacactctaacctttcgataatttcccagaagatgttggagcttcgtttagttcaaggttctctactgaagaaggttctagaagcggtcaaagatctggtgaacgatgcgaacttcgactgttcgaccacagggttctcgcttcaagctatggattcgagccatgtcgcgttggtgtctcttttgcttagatctgaaggtttcgagcactatagatgcgataggaacctctctatgggaatgaatcttggtaatatgtctaagatgctgaaatgtgctggaaatgatgatatcatcaccatcaaagctgatgatggtagcgacactgttactttcatgtttgagagtcccacacaagacaagattgcagattttgagatgaagctgatggatatcgacagtgagcatttaggaattcctgatgctgagtaccactcgattgtgagaatgccttctggtgaattttccaggatatgcaaagatctcagtagcattggtgacacagttgtgatctcggtaacaaaagaaggggtgaagttttcaacagcaggtgatatcgggacagcaaacattgtgctcaggcagaatactaccgtcgacaaacctgaagatgctattgtgatagagatgaacgagcctgtttcgctttcatttgcattgaggtacatgaactccttcacaaaggctactccattgtcggaaactgtgaccatcagtttgtcctctgagttaccggtcgtggtggagtacaaggtggctgagatgggttacattcgatactatctggcgcctaagattgaagaagaagaagacaccaaaccagaataatgatgaatgtttgatagtcttcgttcgagtcctttgttgaaatgtctgtcttgattcagttgttttctggatttactatcttaaggcaatgctaaactagataatcgtatgatgtttgtctttctgaaatttggaaaagcttgtttataacacttttcatctgtttgttaaacattgaaga

SEQ ID NO: 2812 - DNA, 1080 bp, Brassica rapa
aacaaccccagcttcttcactcttcttccccaaaaccctagaaaatcgattcgaattctaaagctctctgattaatccgaaaaatgttggagctacgtctagttcaaggctctctcttgaagaaggtgctcgaatcgatcaaggatctcgtcaacgacgctaacttcgactgctccaccaccggcttctccctccaagccatggactccagccacgtggcgctcgtctctctcctgctcagatccgagggcttcgagcactaccgctgcgaccgtaacctctccatggggatgaacctcggtaacatgtccaagatgctcaaatgcgccggaaacgacgacatcatcaccatcaaagctgatgacggcggcgacaccgtcaccttcatgttcgagagtcccaagcaagacaagattgcagattttgagatgaagctgatggatatagacagtgagcatttggggatacctgatgctgagtatcattcgatcgttaggatgccgtctaatgagttctctaggatttgcaaagatctcagtaccatcggtgacactgttgtgatatctgtgactaaagaaggggttaagttctctaccgctggtgacattgggacagccaacattgtgttgagacagaacacaactgttgacaagccggaagatgcgattgtgattgagatgaacgagccggtgtcgctctcgtttgccctgaggtacatgaactccttcacaaaggcaactcctttgtcggacacggtgacgatcagcttatcgtctgagctgccagttgtggtggagtataaggtggctgagatgggttacattcgttactacttggctcctaagattgaagaagatgaagaagacaaggcttaagacccttttgtatccagagcttcttctgttcttactaaaatgtccaagattcagtcatgacgattatgatgttttcccgtttaatttccctctagaatcagttgttttgtttgacttgttatgttctaaaatgttatgtttggtaaagttagtgctgtttgaaattcttaacgactcatctataaaaggcaaacgtggatacaaa

SEQ ID NO: 2813 - DNA, 1008 bp, Brassica napus
ccgtcccaaaaccctagaaaatcgattcgaattctaaagctctctgattaatccgaaaaatgttggagctacgtctagttcaaggctctctcttgaagaaggtgctagaatcgatcaaggatctcgtcaacgacgccaacttcgactgctccaccaccggcttctccctccaagccatggactccagccacgtggcgctcgtctccctcctgctcagatccgagggcttcgagcactaccgctgcgaccgtaacctctccatggggatgaacctcggaaacatgtccaagatgctcaaatgcgccggaaacgacgacatcatcaccatcaaagccgatgacggcggcgacaccgtcaccttcatgttcgagagtcccaagcaagacaagattgcagattttgagatgaagctgatggatatagatagtgagcatttgggtatacctgatgctgagtatcattcgatcgtgaggatgccgtctaatgagttctctaggatttgcaaagatctcagtaccatcggtgacactgttgtgatatctgtgactaaagaaggggttaagttttctaccgctggtgacattgggacagcgaacattgtgttgagacagaacacaactgttgacaagccggaagatgcaattgtgattgagatgaacgagccagtgtcactctcgtttgcgctgaggtacatgaactccttcacaaaggcaactcctttgtcggacacggtgacgatcagcttatcttctgagctgccagttgtggtggagtataaggtagctgagatgggttacattcgttactacttggctcctaagattgaagaagatgaagaagacaaggcctagaccccttttgtatccagagcttcttctgttcttactaaaatgtcgaagattcagtcatgatgattatgatgtttttccatttactttccctctagaatcagttgttttgtttgacttgttatgttctaaaatgttatgtttggtaaagttagtgctg

SEQ ID NO: 2814 - DNA, 955 bp, Manihot esculenta
gttcctccggaatcccgcccaatccaagacgcgctgctttttaaaccatttcaggcaattctcaaagcccacacactctatctccgtcgttcttttgcttctctgtagacaaaccccgtccgtacctaaccctaatctcacacctgtaagaggagagaggatgctagagctgaggctggttcaaggatcccttctgaagaaggtgcttgaggcaatcaaggacttggtaaacgatgccaacttcgattgttcttccacgggcttctctctccaggccatggattcaagccatgtcgctctggtcgctctcctcctcaggtcggagggctttgagcactatcgctgtgaccgtaacatttccatgggcatgaatctcaataacatgtccaagatgttgaagtgctctggaaatgatgacatcatcaccatcaaggctgacgatggcagcgacaccgtcactttcatgtttgaaagtcccacacaagacaagatttcagactttgagatgaaactgatggacattgatagcgagcacctgggaattcctgaagcagaatatcatgctattgtcaggatgccttcagctgagtttgcaaaaatatgtaaagatcttgcaagcattggtgatactgttgtgatctctgtgacgaaggaaggagtaaagttctccacaagaggtgatattggcactgcaaatattgttgttaggcagaatacaacagtagataagccggaagaagcaacaatagtagaaatgaatgagccagtttcattgacatttgcattgaggtacatgaactcgttcactaaggcgaccccattgtcaaacacagttacaattagcttgtcttcagagctgcctgttgtggttgagtacaagattgctgaaatgggttacatcaggttctacttggcgccaaagatagaagaagatgaggatgagactaagccctaa

SEQ ID NO: 2815 - DNA, 1112 bp, Cedrus atlantica
tgttcctgcaggtttaatggcggaaaccggtgatgggcgagtgaaattcagagtttggctctatgaacaagcttcgatggctaccttccctctaccttgcttgcatttcatgcagcacgcgattcatggcggctatcacttcacgcagtttgtctcactcgctgtggccccagatgcacacaacaattgcctgacccgccatgttggaactaaggctcgtgcaggggagcctgctgaaaaaggtgctggaagccatcaaggatttagttgtggatgccaattttgattgttcggcgacggggttttctctgcaggccatggattccagtcacgtcgccctcgtggcccttctgctcaggtccgagggtttcgagcattacagatgtgatcgaaatatgtcgatggggatgaatatcaacaatatgtccaagatgttgaaatgcgcggggaacgacgatattatcaccatcaaagcagacgatggaggagatactgtcaccttcatgtttgaaagccccaaccaggataagatttcggattttgaaatgaagttaatggatattgacactgagcatttgggtattcctgagtccgagtaccaagctattgtaaggatgccatcaccagagtttgctcgtatttgcaaagatctaagcactattggtgacacagttgtcatttcggtgaccaaggaaggagtaaagttttctaccaggggcgatattggaagtgcaaatattgtctgcaggcaaaatacttctgttgataagcctgaggaggcaacattgattgaaatgcaggagcccgtgtcattaacatttgctctacggtatatgaactcatttacaaaggcatcacctctatctaacatagtgacgataagcatgtctgccgatctgcctgttgttgttgaatacaaaattgcagaaatgggatatattaggttttatttggcccctaagatcgaggaagaagaaggagaatcttagttttactatgcattgctggccctgtttttcttgtaaagttttgggatgcatgattgctcattttgctgcagtcatctatatgacggggtcttatgaatcaaaggcttctatatttctatgtct

SEQ ID NO: 2816 - DNA, 1113 bp, Cryptomeria japonica
  misc_feature (1077)..(1077): n is a, c, g, or t
  misc_feature (1094)..(1094): n is a, c, g, or t
ggctaatttgcaatttttatcataaaagacctcaaaacccttgaaaccctcattcatactttcccgccccacaaaattatcgttgttcttggctttctccatactttgcagagcattctccagcgttctgttacgccgtcgttcacttatcttttcgttctttcctttttttggtgttttcctttgtatttttccctgtgttgagccatgttggaattaaggcttgtccaggggagtctcctgaagaaggtgctggaggccataaaggatttggtcacagatgcgaacttcgattgctcggcaactgggttttctctgcaggccatggattcgagccacgtggccctagtggctctgctgctgaggtcggagggcttcgagcatttcaggtgcgacaggaatatgtccatggggatgaatctgaacaacatggccaagatgttgaagtgcgctggtaacgatgatattatcaccatcaaggccgacgatgggggggatactgtcaccttcatgtttgaaagccccaaccaggataaaatctcagactttgaaatgaagttaatggatattgacactgaacatttgggtattcccgagtcggagtatcaatccattgtgaggatgccatcacaagagtttgctcgtatctgcaaagacttgagcaccattggtgacacagttgtcatctccgtgaccaaggaaggagtaaagttctctaccaagggtgatattggaagtgcaaatattgtttgtaggcaaaatacctcagttgacaagccagaagaggcaacagttattgaaatgcaggagcctgtgtcattgacctttgctttacgctacatgaattcattcaccaaggcaacacccttatcaaactccgtgacaatcagcatgtcctcggatctgcctgtggttgtagaatacaaaattgcagatatgggttatattaggttttatttggcccccaagattgaggaggaagaaggagaatcttagttttcttttgtatttgctttcccaccttttttcatgggagttttttggttaagatgcttatttcctcacggtagtataatntgacaacgatttatagngaattttttttttagctcc

SEQ ID NO: 2817 - DNA, 1049 bp, Cynara scolymus
  misc_feature (685)..(685): n is a, c, g, or t
  misc_feature (705)..(706): n is a, c, g, or t
  misc_feature (729)..(729): n is a, c, g, or t
  misc_feature (749)..(749): n is a, c, g, or t
tggtttcccgcgtattttgaccctaaccctagatcgtagatttagccacatacatacaggccaactttacagttcagccatccgttcatctgtcgccggagaaatgttggagctcgggctagttcaggggagtctcctgaagaaggtgatggagtcgatcaaggacctggtcaacgatgctaactttgactgctccgccactgggttttcgcttcaagcgatggactccagccacgtggcgctggtgtcgctccttcttagatcggaaggtttcgaacactaccgatgtgatcgtaacttatctatgggtatgaatctcggtaacatgaccaagatgctaaagtgcgccggaaatgatgacatcatcaccatcaaggctgacgatggtagcgacaccgttactttcatgtttgaaagtcccactcaagataagattgctgattttgagatgaaactcatggatattgatagcgagcaccttggaattcctgaagcagagtaccatgccattgtccggatgccttcatctgagtttgcaaggatttgcaaagatctcagcagtattggtgatacagttgtaatttctgtgaccaaagaaggtgtgaaattctcaacaagaggtgatatcggaactgcaaatgttgtttgtaggcagaacaccactgtagataagccagaggaagcnacaatcattgagatgaacgnnccagtatctttgacatttgcatngaggtacatgaactcatttncaaaggcaactccattgtcgagtacggtgacaatcagcttatcttccgagcttcctgtggtggtggagtacaagatagctgaaatggggtatatcagattctatttggctcctaagatagaagaagatgaagaggacaacaaatcttgatggatcttacaagatttgttagttgtttaccaaagacactttagtttaaggtacattgttgtagttgtcacaatttttcttctttccaaatctgtgatgcatcgtcattggtaaatggtaacatggcaaagactgataattgttcgggtct

SEQ ID NO: 2818 - DNA, 1432 bp, Eucalyptus grandis
cgtggcttcggggccggggaaccggaaccgaagaaccggaaaagagagagagagagagaaactccctctcaaattttccctcactttctcgtcactttcccgccgaaaccctagcgccgtccgtcgccgcaccgggaacgatgctggagctccggctagtgcagggctcgctcctgaagaaggtcatggagtcgctcaaggacctcgtgaacgacgccaacttcgactgctccgccacggggttctccctccaggccatggactcgagccacgtggccctggtggccctgctcctccggtcggaggggttcgagcactaccggtgcgaccgcaacatctccatggggatgaacctcaacaacatgtcgaagatgctcaagtgcgccgggaacgacgacatcatcaccatcaaggccgacgacgggagcgacacggtcaccttcatgttcgagagcccgacgcaggataaaattgctgatttcgagatgaaattgatggacattgacagtgagcaccttggaataccggaggcagagtaccatgcaattgttagaatgccatcatctgaatttgctaggatttgtaaagatctcagcagcattggtgatactgttgttatatccgtgacaaaggagggtgtgaaattctctactagaggtgatataggaactgcaaatattgtttgcaggcaaaatacaactgtcgacaagccagaggaagctacagttattgaaatgaatgagccagtgactttgacttttgcactgaggtacctgaactccttcacgaaggcaacccctttatccaacactgtgactatcagtttgtcttcagatcttcctgttgttgttgagtacaagattgccgagatgggttatatcaggttttacctggctcctaagatagaagaggatgaggacgagacaaagccataagttgctggggtcctgaattagttaaacctgtttgcagactgcagtaattcatgttcctgtctcaggaaattttttctactctatacaggttcttacccaggttggaaaatgtttgtagctttgaatcactgttgtcttccccagtgtatggtttactcgtgctactgacttcagggtaccctaatggattttaggtctttcttccaacttgtggcatgaagtttcaattacttgcaacttttgcaatctttgtggcttttttttttttttaaagagaatcatgggtacaatagaaccgtccaaatttgggaaatgttgaagatggtgctttcaccacatcatctgtgctactgagaggaagttcatgaagttgtagtcctggtttcgtgacttgaggttgtggataaaatcaatgtgtggaaattgtattgcagttgggttttttggtgggatcaaatgatgattaatcgacttaacacaagtctggtagcattaca

SEQ ID NO: 2819 - DNA, 1436 bp, Lactuca sativa
tgaaacaagttagttgggtaaatgagtacaaaaaaaacaatattacccatatgtgaacatttgaaatacttaattaccttaataagtcaaattcccttgtatattgtcgaatttaacaagtatattttttatagcacaatctcaatcaaattatatgaatgtataataataatatagtgcggtatttaatatttagcccaaaagcccaatattccataacccccccgccaacgatgaaaaaaattgtggcgggaatacattttactataaaaccccaaacccgtgctacccatcccgatattttggtttccccgcgtttttcgagccctaaccctagtttctcaaccggaaagttcatctgtcgccggaaaatgttggagctaaggctggttcaggggagtctcctgaagaaggtgatggagtcgatcaaggacctggtcaacgatgccaactttgactgctccgccaccgggttttcgcttcaggcgatggactcgagtcacgtagccctggtgtcgctccttcttagatccgaaggatttgaacactatcgatgtgatcgtaacctatctatgggcatgaacctcagcaacatgtccaagatgctcaagtgcgccggtaatgatgatatcatcaccctcaaggctgacgacggtagcgacaccgttactttcatgtttgaaagccctactcaagataagatcgctgattttgagatgaaactgatggacattgatagtgagcaccttggaattcctgaagcagagtaccatgccattgttcgaatgctttcagctgagtttgcaaggatctgtaaagatctcagtagtattggtgatacagttgtgatttctgtgacgaaagaaggcgtgaagttttcaacaagaggtgatattggaactgcaaatgttgtttgtaggcagaacactacagtagataagccagaagaggcgacagttattgagatgaatgagcctgtgtctttgacatttgcattaagatacatgaactcgtttacaaaggcaactccattatcgagtactgtgacaatcagtttgtcttcagagcttcctgtagtggtggagtacaagattgcagagatggggtacattaggttttatttggctcctaagattgaagaagatgatgaagagaacaaatcttgaatcaacaagaaacaagtgagctgtgagaactaaaatactaaatgctttgttagttgtttgctagttaaaagtatattgtgtactatgtactcgccagaacttagccaagttttttttatgctattttttttaatcattttgttaggatttttcaggcttatatgaggtgtatgttttgttttctataaaattgctacttggtactcttatttctagcaaatttaaatctgtttttgtaattgaagctgatttttgtattcattgtttggg

SEQ ID NO: 2820 - DNA, 1122 bp, Lactuca sativa
atctcatattcgtcaaaattccccaatttttcgtgtctttcaaaacctagctctaattttctttttagaatctctagatttccatccttttcagttgaaaaatgttggagctaaggttagttcaggggagtctcttgaagaaggtgatggaatcgatcaaagatctggtaaacgacgccaatttcgactgctcagccaccggattttcgctccaggcgatggactcgagtcacgtggcgttggtctctcttcttcttagatcggaaggcttcgaacattaccgttgtgaccggaacatttccatgggtatgaatctgagtaacatgtctaagatgctaaagtgcgctggaaacgatgatatcatcactctaaaggctgacgatggcagtgataccgttaccttcatgtttgaaagccccacccaggataagattgctgattttgagatgaagcttatggacattgatagtgagcatcttggcatacctgaagcagagtaccatgctattgttcggatgccttcatctgaatttgcaagaatttgtaaagatctcagcagtattggcgacacagttgtaatctccgtgactaaagaaggtgtcaagttctcaacaagaggtgatattggaactgcaaatgttgtatgcagacagaatacaacagtagataagccagaagaggctactgtgattgagatgaatgaaccagtgtccttgacatttgcattgcgatatatgaattcattcaccaaagctacaccactgtcaagcactgtcacactcagtctatcttcagagcttccggtggtggttgaatacaagattgctgagatgggctacataaggttttatttggctcctaagattgaagaagatgatgaagagaacaaatcttgatttaaagcttacaagttaatggtattgttttatcagtttcttttatgtaaacttttttttgtagttttgttctttgggtcatgatcatgatctttagtacctttgccttattgatgctttttagttaattattaatgatgattaaaatcgatggtgttgttgtcaagctgctttagtagaagtggataaatggttgaaacagtatctactattgtcagaaaatgcg

SEQ ID NO: 2821 - DNA, 1198 bp, Nicotiana benthamiana
attttctctacttctctctcagacactatcagtccttatccctcctccccatttccaagccctaaccctaatttccccagaccttctcaaagcccctttttcatagaaaatgttggaattacggcttgttcagggaagtctgctgaagaaggttctagaatcaattaaggatctggtgaacgatgcgaacttcgattgctctgccaccggattctctctgcaggccatggattccagccacgtagcgttggtggcgctgctgctccgatctgagggttttgagcactatcgttgtgaccgtaatatttcaatggggatgaaccttggtaacatggctaaaatgctcaaatgtgcggggaatgatgacatcatcaccctcaaggctgacgatggcagtgacaccgtcactttcatgtttgaaagccccacccaagacaagattgctgattttgagatgaagctgatggacattgacagtgaacatcttgggattccagaagcagagtaccatgctattgttagaatgccttctgcagagtttgctagaatttgcaaagaccttagcagtatcggtgacacagttgtaatttctgtgacaaaggaaggtgtaaaattctcaaccagaggtgacattggtactgcaaatgtcgtttgcaggcagaatacaactgttgacaagcctgaagaagccacagtaatagagatgaatgagccagtatctttgacatttgccctgagatacctgaactctttcacgaaagcgactcctttgtctaacacagtgaccatcagcttatcttcagagctgcctgttgttgttgagtacaagattgctgagatgggctatataaggttctacctggcacctaagattgaagaggatgaagaggaaaccaaaccttgattttatgtttctgctttcttttgagcctggagttgggggttaaattttctgtgatgaagctcatttgaggttttcaggcaagcagtatgtagtttagacttgctagacaaattttagctttgtgttgattaatgaaatcgtgtatttccctcttttttactctttttctattctcttgcctgcatctgaagcttgaatgttgtaaacctacaccattgagtttacacagtttcttgattcatttgatgcttctttaaatatagagttgcaacagtgaagggattttgggtctgg

SEQ ID NO: 2822 - DNA, 992 bp, Nicotiana benthamiana
cccccccccaatttccaaaccttaaccctaacttctacagaccttctcaaaaccctcttttcatcgaaaatgttggaattacggcttgttcagggaagtctgctgaagaaggttctagaatcaattaaggatctggttaacgatgcgaacttcgattgctctgccaccggattctctctgcaggccatggactccagccacgtggcgctggtggcgctgctgctccgatctgagggttttgagcactatcgctgtgaccgtaatatttcaatggggatgaaccttggtaacatggctaaaatgctcaaatgtgcggggaatgatgatatcatcaccctcaaggctgacgatggcagtgacaccgtcactttcatgtttgaaagccccacccaagacaagattgctgattttgagatgaagctgatggacattgacagtgaacatcttgggattcctgaagcagagtaccatgctattgttagaatgccttctgcagagtttgctagaatttgcaaagaccttagcagtattggtgatacagttgtaatttctgtgacaaaggaaggtgtaaaattctcaaccagaggtgacattggtactgcaaatattgtttgcaggcagaatacaactgttgacaagcctgaagaagccacagtaattgagatgaatgagccagtatctttgacttttgccctaagatacctgaactctttcacgaaagcaactcctttgtctaacacagtgaccatcagcttatcttcagagcttcctgttgttatagagtacaagattgctgagatgggctatataaggttttacctggcacctaagattgaagaggatgaagaggaaactaaaccttgattttatgtttctgctttcttgtggtgaagctcatttgaggttttcaggcaagcagtatgtagtttagacttggtagacaaatttttaggtttgtgttaattaatgaaatcttgtatttccctcttttt

SEQ ID NO: 2823 - DNA, 1076 bp, Phalaenopsis aphrodite
ccaaaagtcgcatttctacagctccgctcctttccataaaccccggcaaaccctacccaccctcgtttaggcgaaaaagaaagagccaaggaaacctgtcctcgaagcaaccatagcaaggagaagatgttggagcttaggctagtgcagggaagtcttctgaagaaggtcatcgaggcgatcaaggatctggtgaccgatgctaacttcgattgctcggcgacggggttctccctccaagcaatggactcgagccatgtcgcccttgttgctctcctcctccgatccgagggcttcgagcactaccgctgcgatcgaaacatctctatggggatgaacctcaacaacatgtctaagatgctgaaatgcgctggaaacgatgatatcatcaccatcaagggcgacgatggcagcgacactgtcactttcatgttcgagagccctaaacaagataagatttcagattttgagatgaagcttatggacattgacagcgaacatctaggcattccagaggcagaatatcatgcaattgtgaagatgccgtcttcagaatttgcaagaatttgtaaggatctcagcagcataggagatactgttgttatttcagttaccaaggagggagttaaattctctaccagaggggatattggaactgcgaacatagtctgtaggcagaataagactgttgataagccagaggaagccactatcattgagatgaatgagccggtaagcttaactttcgctctgagatatctgaattctttcaccaaagccacttcgctttccgaggctgttacaatgagcctttcttctgagctgccgcttgtcatcgagtacaaaattgcagatatgggttatattagattttatttggctccaaaaattgaagatgatgaagaggaaatgaagccttaattttttttctttttcacatcgatgatttttacctttctgttatttatttccttttggtagatctctctctttataagaaatgttaattgacaccttaagatgtggagtgattttatgttttcttctcttatttgtgccttttccctttgtaatga

SEQ ID NO: 2824 - DNA, 1702 bp, Pinus taeda
cggccggggatgcccactcgctgctcttcttcatagtataccctcgatattatgcagccctacatacagagtcctacctgcaccttaaaaaaaccctaagacctctcgaagtccagaaaaacgttcatatctactgccattaaaaaagccaataccctcgaacctccaaaatcactcgtttcgtccccacaatttcacatcctatttcataggtgcagaggactctgcagactctctcattttcttcgatacccgtttgttcattttcttcgatacacgtttgttcattttcttttcgccatgttggaactaaggcttgtgcaggggagcctgctgaaaaaagtgctcgaagccattaaggatttagttacggatgccaatttcgactgctcggcaacggggttttctctgcaggccatggattccagtcatgtggccctcgtggcccttctgctaaggtcggagggtttcgagcattacagatgcgatagaaatctgtcgatggggatgaatatcaacaacatgtccaagatgttgaaatgcgctgggaatgatgatattatcaccattaaagccgatgatggaggagatactgtcaccttcatgtttgaaagccccaaccaggataagatttcagattttgaaatgaagttgatggatattgacactgagcatttgggtattcccgagtctgagtaccaagccattgtaaggatgccatcaccagagtttgctcgtatttgcaaagatcttagcactattggtgacacagttgtcatttcggtcaccaaggaaggagtaaaattttctaccagaggcgatattggaagtgcaaacattgtctgtaggcaaaatacttctgttgacaagcctgaggaggcaacattgattgaaatgcaggagcctgtgtcattaacatttgctctacgatatatgaactcatttacaaaggcatcgcctctatctaacatagtgacgataagcatgtcatccgatctgcctgttgttgttgaatacaaaattgcagatatgggatacattcggtattatttggcccccaagattgaggaagaaggaggagaatcgtaagtttactatgcagggctggcccactttttcttgtaaggttttgggatgcatgattgctcagtttgctgcagtcatctatatgatggggttgtatgaattgaagcattccagatacttttatctatctctgctatacatttggcatagtggggctattaagtatccttgtctatgtgtagttagttttgcatttcccggagaaaataaggactttatgctgtatttcccaggaataaacagttcatggttgttgactatgcccgtttcctctttcgttggtacattggattttatcttgaaagcttgtgggcttcatatgtactttacaaagttatgaactcatgccaatttacccaacaaaatttaatctgttgaaggcattgttggtgacagagtagttaatatgaagaaatggatcaaaggattttgttaagtttcagcacaaaatgtttttatttctagaaatgtgattgataggtattgggtattggtaagaatcacgcctcacatggaagttttgtgaaaatgcgtgaagaatttaatcagttcgtgattctagagactatttgcttaatgagatggttagccgtatttgtgaaaaaaaaaaaaaaaa

SEQ ID NO: 2825 - DNA, 1147 bp, Pinus taeda
ctcgcgagctctgtcacaagggaaagggtcctcttctctcagagtttgttttcactgtaacaatgttggaactaaggcttgtgcaggggagtcttctgaagaaggtgctggagtccatcaaggacctcgtcaccgatgctaacttcgattgctcggccacgggcttctccctgcaggccatggactcgagccacgttgccctcgtttccctgttgctcagatctgagggcttcgagcactatcgctgcgaccgcaacatgtccatggggatgaacctcaataacatggccaagatgctcaagtgcgccggcaacgatgacatcatcaccatcaaggccgacgatgggggcgacaccgttaccttcatgttcgaaagccccaaccaggacaagatttccgacttcgaaatgaagttaatggacattgacagcgagcatttgggcattccagagtcagagtaccatgccattgtgaggatgccatctcaagaatttgctcgcatctgcaaggatctcagctccattggggacactgttgtgatctctgtgagcaaggaaggagtgaagttctcaaccaggggagatattggtagtgctaacattgtgtgtaggcaaaacccttctgttgataagccggatgaagcaacaattattgagatgcaagagcctgtgtcactcacatttgcactgaggtacatgaactcgttcaccaaggcaactccgctgtctaacacagtgaccattagcatgtcatcggagttgccagttgttgttgaatacaaaattgcagagatgggttatattaggttttacttggcccctaagattgaggaggaaggtgaaagctaactgctctttcctctgcgttgtctgcattgcattgagcattgagcagagaggctcttagttagttgcatgatcttcttttgcttgtattgttgagcatgtcatggagggatccaaaaaggtgcaatggctttatttgcccgtcatgtatcccttgaagggtttattctcatcttattttaagtcttatttccacagatcccatatacaggtttgtgtttgggtagtaagttcagaagatgattttgccaaaattaaatttcacttcttgtttgtcataacatcatttaataaaattgcca

SEQ ID NO: 2826 - DNA, 1078 bp, Sciadopitys verticillata
ccatatccccaactcgctgctgagcttctcgtaccttaactttaccatattcatttttctgtttttcgccatgttggaactaaggcttgttcaggggagtttactgaagaaggtcctagaagccatcaaggatttggtgaatgatgccaactttgattgttctgcaacggggttttctctgcaggccatggattccagccatgtggccttggtagccctgttgctcaggtccgagggtttcgagcatttcagatgcgacaggaatatgtcgatgggaatgaatctcaataatatggccaagatgttgaaatgtgcaggaaatgacgatattatcacccttaaggccgatgatggaggggacactgtcaccttcatgtttgaaagccctaaccaggataagatttcagactttgaaatgaagttaatggacattgacactgagcatttgggtattcctgagtccgagtaccaagccattgtaaggatgccatcacaagagtttgctcgtatttgcaaagatttgagcagtattggcgacacagttgttatatctgtgaccaaggaaggagtgaagttttctaccaggggtgacattggaagtgcaaatattgtttgtaggcaaaatacttctgttgacaagcctgaggaggcaactattattgaaatgcaggagcctgtttcattgacatttgctttacggtacatgaattcattttcaaaggcaacacctttatcaaacacagtgacaatcagcatgtcatcagatctgcctgtggttgtagaatacaagattgcggatatgggctatattaggttttatttggcccccaagattgaggaggaagaaggtgaatcttagttgtcccttgtatttgcctaacctctttttatatgggtagtttttggttctaagatgcttattttgtgttattgtgtaccaccaatatgatggagttctatggatggcaacattctataaacttttagctctggtgtgcttcttgtataagggcatttgacattatgtacagttgtgcagttaagtttttagtaattcttaagaggtcctttctgaggt

SEQ ID NO: 2827 - DNA, 813 bp, Sequoia sempervirens
ccatgttggaattaaggcttgttcagggtagtctcctgaagaaggtgttggaggccataaaggatttggtcacagatgccaacttcgattgctcggcaacggggttttctctgcaggctatggactcgagccacgtggctctggtggctttgctgttgaggtcggagggcttcgagcatttcaggtgcgacaggaatatgtccatggggatgaatctgaacaacatggccaagatgctgaagtgcgctggtaacgatgatattatcaccatcaaggcagacgatggaggggatactgttaccttcatgtttgaaagccccaaccaggataagatctctgactttgaaatgaagttaatggatattgacactgaacatttgggtattcctgagtcggagtaccaatcaattgtgaggatgccatcgcaagaatttgcacgtatctgcaaggacctgagcaccattggtgacacagttgttatttctgtgaccaaggaaggagtgaagttctctaccaagggtgatatcggaagtgcaaatattgtttgtaggcaaaatacctcagttgacaagccagaggaggcaacagttattgaaatgcaggagcctgtgtcattgacctttgctctacgctacatgaattcattcaccaaggcaacacccttatcaaattctgtgacaattagcatgtcctcagatctgcctgtggttgtagaatacaaaattgcagatatgggctatattagattttatttggcccccaagattgaggaggaagaaggagaatcttagtttgttctttgtctttgcgtac

SEQ ID NO: 2828 - DNA, 1609 bp, Picea glauca
ccaaaatcctgcagccctacacacacagtctcccctgcaccttaaaaaaaacccttaaagtccctcacaaaaacgctcaaagtacactatctgccaaaatccaatatcctctcatcgaatctccagaatcacccacttagcccccacaattttacatcccatttcatatctgcagagcactctggtgattctttcattttcttcgatacacgtctattcattttcttttcgccatgttggaactaaggctcgtgcaggggagcctgctgaaaaaagtgctggaggccattaaggatttagttacggatgccaatttcgactgttcggcgacggggttctctttacaggccatggattccagtcacgtggccctcgtggcccttctgctcaggtcggagggtttcgagcattacagatgcgataggaatctgtcgatggggatgaatatcaacaacatgtccaagatgttgaaatgcgctgggaatgacgatattatcaccattaaagccgatgatggaggagatactgttaccttcatgtttgaaagccccaaccaggataaaatttcggattttgaaatgaagttgatggatattgacactgagcatttgggtattcccgagtctgagtaccaagccattgtaaggatgccatcacacgagtttgctcgtatttgcaaagatctaagcactattggtgacacagttgtcatttcggtgaccaaggaaggcgtaaagttttctactagaggcgatattggaagtgcaaatattgtttgtaggcaaaatacttctgttgacaagcccgaggaggcaacattgattgaaatgcaggagcctgtgtcattaacatttgctctacgatatatgaactcatttacaaaggcatcacctctatctaacatagtgacgataagcatgtcagccgatctgcctgttgttgttgaatacaaaattgcagatatgggatatattcggtattatttggcccccaagattgaggaggaagaaggagaatcttagttttactatgcattgctggcccgctttttcttggaaagttttgggatgcatgattgctcattttgctgcagtcaactatatgatggggttgtattgaagcattctatatacttttatccatctctgctatgcttctggcatagtggggctataaagtatccatatctatgtgtagttaattttgcatttccggtagaaaataaggactctatgctgtattagccaggaataaacagttcatagttgttgaccatgcctgtttcctctttcgttgatacatagattttatcttgaaagcctgttgggcttcatgtgtactatacaaagttatggactcttgccagtgtacccaatgaaatttaatctgttgaaggcattgttggtgacagaggacttcacatgaagaagtgaatcaaagaattttgttaagttttagcacaaaatattttgctttctataaatgtgattgataggtattggatatggtaaggatcatgcttccacatggggattctgtgaggatgtgtgaagctttcaatctgtatgtgatatcaaggctatttacttaatgagatggttagctgtat

SEQ ID NO: 2829 - DNA, 1114 bp, Tabernaemontana elegans
ttcaaagcccctcttgttatcagaaaccctaaccctaaccgttgtaattttggcctgaaaaatgttggaattgaggcttgttcagggaagccttctgaagaaggttctggagtctgtaaaggacttggtgacggatgccaattttgattgttcagccagtggcttctctttgcaagccatggactcgagccatgtggcgctggttgctctgcttcttagatctgaagggtttgagcactaccgctgtgaccggaatatttctatggggatgaatcttaataacatggctaagatgttgaagtgtgccggaaatgatgatatcatcaccctcaaagctgacgacggcagtgacactgttactttcatgtttgaaagccccacccaagataagatctctgattttgaaatgaagcttatggacattgatagtgagcatcttggaattcctgaagcagagtaccatgctatagtgaagatgccctcagctgagtttgcaagaatttgtaaagatcttagcagcataggtgatacagttgtgatatctgtaaccaaagaaggtgtaaagttttctacaagaggtgatattggcactgcaaatatagtttgccggcaaaatacaacagtagataagccagaggaagcaactgttatagagatgaatgagccagtgtcattgacctttgcgctgaggtatttgaactcctttaccaaggcaaccccattatcaaacacagttaccatcagcttgtcttcagagcttcctgttgttgtggaatacaagattgcagaaatggggtacatcaggttctacttggcacctaagattgaagaggaggatgaagagacaaagccttgaatgccatgcttcagctttttccttctgctgatagtattgctttcttgttatgagctaatgatatgtcttttactcattgtgtttagctgaggatcctgcacattcagaagttctaggtttgatttgtttagtaattgaaagagatcctttttctatctttcatcttgtatgcttctcttgcttaatgccgtgacatgtaagatcttaggccccaatatggctttctgttcataaatagtttttagatggcatgttatc

SEQ ID NO: 2830 - DNA, 1063 bp, Nicotiana tabacum
ttctctctattgctctctcaacactgtcagtccttttccctcctccccatttccaaaccctaaccctaacatcctcagaccttctcaaaacccctttttcatcgaaaatgttggaattacggcttgttcagggaagtctgctgaagaaggttctagaatcaattaaggatctggtgaacgatgcgaacttcgattgctctgccaccggattctctctgcaggccatggactccagccacgtggcgctagtggcgctgctgctccgatctgagggttttgagcactatcgctgtgaccgtaatatttcaatggggatgaaccttggtaacatggctaaaatgctcaaatgtgcgggaaatgatgacatcatcaccctcaaggctgacgatggcagtgacaccgtcactttcatgtttgaaagccccacccaagacaagattgctgattttgagatgaagctgatggacattgacagtgagcatcttgggattccagaagcagagtaccatgctattgttagaatgccttctgcagagtttgctagaatttgcaaagaccttagcagtattggtgatacagttgtaatttctgtgacaaaggaaggtgtaaaattctcaaccagaggtgacattggtactgcaaatgtcgtttgcaggcagaatacaactgttgacaagcctgaagaagccacagtaatagagatgaacgagccagtatctttgacttttgccctgagatacctgaactctttcacaaaagcaactcctttgtctaacacagtgaccatcagcttatcttcagagcttcctgttgttgttgagtacaagattgctgagatgggctatataaggttttacctggcacctaagattgaagaggatgaagaggaaaccaagccttgattttatgtttctgctttcttttgagcttggattgttgggtggggggttaaattttatgtgatgaagctcatttgaggctttcaggcaagcagtatgtagtttagacttgctagacaaatttttaggtttgtgttaattaatgaaatcgtgtatttccctct

SEQ ID NO: 2831 - DNA, 1030 bp, Gossypium hirsutum
tagctagagcttaggctagttcaaggttcgcttctgaagaaagtattggaagcgattaaggacttggtcaacgatgctaacttcgactgttcggcgaccggattctcattgcaagccatggattcaagccacgttgctttggtggctctgctgctcagatcggaaggtttcgagcactatcgttgcgataggaacctttccatggggatgaatctcaataacatgtctaagatgatgaaatgtgccggtaatgatgatatcatcacaatcaaggctgatgatggcagtgatactgttactttcatgttcgaaagtcccacacaagacaagatatcggattttgagatgaagctgatggatatagatagtgagcatcttgggattccagaggcagagtatcaatctattgtgaggatgccttcagctgagtttgctaggatttgtaaagatcttgctagcattggtgatactgttgttatctctgtaaccaaggaaggtgtgaaattttccacaagaggtgatatcggaactgccaatatcgttctcaggcaaaataccaccgtagataaacctgaagaagcgacgatcatagagatgaacgagccggtttcattgacatttgcattgaggtacatgaattcatttacaaaagcaactccattgtcaagtacagtgacgattagcttatcttcggaattgccggttgtggttgagtacaagatagctgagatgggtcatattaggttttacttggcacccaagattgaagaggatgaagatgagacaaacccacaaggttaacttgattaaaaaatttttttttggggtggatttagttttcttggtaaactgaaaatgggtatttgatgtttatgccattaatggttttgattagggtttttctcctttagggtttcacgtttatagttgaacataaagtagtttaggtttttgatggatgttaagttatatttgttgcatttttttaattttgtttgtctttacttctattgcaacttaatagtttctc

SEQ ID NO: 2832 - DNA, 1024 bp, Gossypium hirsutum
tagctagagcttaggctagttcaaggttcgcttctgaagaaagtattggaagcgattaaggacttggtcaacgatgcgaactttgactgttcggcgaccggattctcattgcaagccatggattcaagccacgtggctttggtggctctgctgctcagatcggaaggtttcgagcactatcgttgcgataggaacctttccatggggatgaatctcaataacatgtctaagatgatgaaatgtgctggtaatgatgatatcatcacaatcaaggctgatgatggcagtgatactgttactttcatgttcgaaagtcccacacaagacaagatatcggattttgagatgaagctgatggatattgatagtgaacaccttgggattccagaggcagagtatcaatctattgtgaggatgccttcagctgagtttgctaggatttgtaaagatcttgctagcattggtgatactgttgttatctctgtaaccaaggaaggggtgaaattttccacaagaggtgatatcggaactgctaatatcgttctcaggcaaaataccacggtagacaaacctgaagaagcgactatcatagagatgaacgagcccgtttcattgacatttgcattgaggtacatgaattcatttacaaaagcaactccattgtcgagtacggtgacgattagcttatcttcggaattgccagttgtggttgagtacaagatagctgaaatgggtcatattaggttttacttggcacccaagattgaagaggatgaagatgagactaacccacaaggttaacttgattaaaaaaaattttgggggtggatttagttttcttggtacactgaaaatgggtatttgatgtttatgccattaatggttttcattggggtttttctactttagggtttcaagtttgtagctgaacataaagtagtttaggattttgatggatgataagttatttgttgcatttttttaatcttgtttgtctttacttctattgcaacttaatagtttc

SEQ ID NO: 2833 - DNA, 1338 bp, Panax ginseng
aggataattggagatggcaaagcgttgaaaagtcccaaatttattggcgggaataagaattatttccactgtttaactcgtcccgccaagtaaaccccccgctagcttttcccaattatctcctctcaaaagtttaatatataaaaacctcaccctcaatctctctcctgctctcccactctttttccttcaaaccctaaccctaatttccccagaaaaagtccaattctcacaaaaatgttggagctgaggctagtccaagggagtcttctcaagaaggtgatggattccatcaaagacctcgtcaatgacgccaatttcgactgctcggccaccggattttccctccaagccatggattcgagccacgtggcgctggtgtcgctgcttcttagatcggagggttttgagcattatcggtgtgacaggaacatttccatggggatgaatctgggtaatatgactaagatgctaaagtgcgccggtaatgatgatataattaccattaaggccgatgatggaagtgatactgtcaccttcatgtttgaaagccccacacaagataagattgctgactttgagatgaaactcatggacatcgatagtgagcatcttggtataccagaagcagagtaccatgctattgttcggatgccttcagctgagtttgcgaggatctgtaaagatctcagtagtattggtgacacagttgttatctctgtgaccaaggaaggtgtaaagttctctacaagaggtgatattggaactgcaaatattgtctgccggcaaaataccacagtagataagccagaggaggctacaattatagagatgaatgaaccggtctcgttgacatttgcactgaggtacatgaattctttcacgaaggcaagtcccttgtcaagtacagtcacaataagtttatcttccgagcttcctgttgtggttgagtacaagattgctgaaatgggttatataaggttctacttggcgcccaagatagaagaggatgatgatgaaaacaagccgtgaagttgatgtttgctggtgataacagttatccaattttaggtgttgtgtatgctacaatgtgcgtcttctcatgctttatttgaagatttcactgatgcaagatagcttctcactgtctagaaattggtagatctcaagattttcattcttaatgtttaggaagtgaaaccgtgttgaatttctctatccttttctttttctttttaaatccttaaccttttctttatgatgtatgctgatcattttctttatgttcacgccttcaacaacaatcttttctggtttaatatgccttttcccccctag

SEQ ID NO: 2834 - DNA, 1154 bp, Lupinus angustifolius
aattcacccaaaccaatctcgaaacaaattccagaaccttccaatatatagaaaaccttttttccctcccaaacccaaaacctaaatccctctctcattcaaaatgctggaactccgtttggtccaaggctctctcttgaagaaggttctagaatccattagagaactcgtcaacgatgcgaacttcgattgttcatccaccggtttctctctccaagccatggattcaagccacgtggcactcgtggctctgttgctccgatctgaagggtttgaacattatcgatgcgatcgtaacatgtctatgggtatgaaccttaataacatgtcgaagatgcttcgatgcgctgggaatgatgatattgttactattaaggctgatgatggaagcgacaccgttacgttcatgtttgaaagtccaactcaagacaagatctctgattttgagatgaagctaatggacattgacagtgagcacctaggaatccctgaggcagaataccatgctattgttaggatgccatcatccgagttcgctaggatctgcaaagatctcagcagtattggtgacactgttgtcatttctgtcaccaaggagggtgtgaagttttctaccaaaggagatattggtgctgcaaatatagtttgcaggcagaatactagtgtggataagcctgaagaagctaccgtgatagagatgactgagcctgtgtccttgacattcgctttgcgatacatgaactcgtttacaaaggcaacaccattgtcaagcacagttaccatcagtctttcaaatgagttgccagttgttgtcgagtacaagattgctgagatgggttatgtccggttctatttggctcccaagattgaagaggatgaagaagagacaaaacctcaagtttagatgttggattagtctattagaattcaattctgttgtaagtgtagtatgcctgccttgatagttgatacctcatccactcaagagttttactctttttttaaaacaaattggtaatgagtttcatatggttgatttggtttttgctcccttaatttccaccgttttattgtttagtacaatgttaagatatggatgtacatcattttcagtctaatgtctttagtagctttatgaatatgagcattctgtg

SEQ ID NO: 2835 - DNA, 1051 bp, Arachis hypogaea
ccccccccccccccccccctatccctcgtcgtggccttcgtcagtactcaggtggtagtcaacgcagatacgggggcgtctctcgttctatttatcccaccaattttccctagaaactcaaaaccctaaccctaccaagacaaagcaagaaaacctccaaacccccattttcaagatgctggaactccgtttagtgcaaggttctcttctgaagaaggttctagaagcaatcagggagctcgtgaacgatgcgaacttcgattgctccgcgactgggttctcactccaggccatggactcgagccacgttgctctcgtggccctcctactgcggtccgaagggttcgagcactaccggtgcgaccgtaacatctcgatggggatgaatctcaacaacatggccaagatgctacggtgcgccggaaatgatgacatcatcaccgtcaagggcgatgacggcagcgacaccgtcactttcatgttcgagagcccaacacaagataaaatttctgattttgagatgaagttgatggatatcgacagtgagcaccttggaattcctgaggcagagtaccatgccattgttagaatgccgtctgctgagtttgctaggatttgcaaagatcttagcagtattggtgacactgttgtcatttctgttactaaggaaggtgtaaagttttccacaaagggtgatattggaactgcaaacatagtctgcaggcagaactcttctgtggacaagcctgaagaagccactactgtagagatgaatgagcctgtatccttgacatttgcattgcggtacatgaactctttcacaaaggcaactccattgtctaaccaagttaccatcagtctttcaaatgagcttccagttgtggttgaatacaagattgctgagatgggttacgtccgcttctatttggctcccaagatagaagaggaagaagaggagacaaaacctgaagtttaggtgttggattgactctattgggtctttaattcggttgtagtatgccttgatgcatcttgttgaagatatttttac

SEQ ID NO: 2836 - DNA, 812 bp, Manihot esculenta
atgttggagcttagacttgtccaaggatcccttttgaagaaagtgcttgaggccatcaaggacttggtcaatgatgccaatttcgattgctcgtcgacgggcttctctctccaggccatggattcaagccacgttgctctggtggctctcctcctcagatccgagggttttgagcactatcgatgtgaccgtaacatttccatgggcatgaatctcaataacatgtccaagatgttgaaatgctctggaaatgatgatatcatcaccatcaaggctgacgatggcagtgatactgtcactttcatgtttgaaagtcctacacaagacaaaatttcagattttgagatgaaactaatggacattgatagtgagcacctaggcattcctgaggcagaatatcatgctattgtcaggatgccatcagctgagtttgcaaaaatttgtaaagatctttcaagcattggtgacactgttgtgatctctgtgacaaaggaaggtgtaaagttctccacgagaggcgatattggcactgcaaatattgttgtcaggcagaatactacagtagataagccagaagaagcgacagtcatagaaatgaatgaacctgtgtcattgacatttgcattgaggtacatgaactccttcactaaggcgacccctttgtcaaacactgttacaatcagcttgtcttcagagctgcctgttgtggtcgaatacaagattgctgagatgggttatatcaggttctacttggctccaaagatagaagaagatgaggatgagactaagccccacgtttaaatggatggaag

SEQ ID NO: 2837 - DNA, 838 bp, Cephalotaxus harringtonia
ctggaactaaggctggtgcaggggagcctgctgaagaaggtgctggaagccgttaaggaccttgttacagatgccaactttgactgttcaaccactggcttctctttacaggccatggactccagccacgtggcactggttgcattgctgctcagatccgaaggctttgagcatttccgatgcgatcgcaacatgtcgatgggcatgaacctgaacaatatggccaagatgctcaagtgtgccggcaatgatgatatcatcaccctcaaggctgatgatggcggggacactgttaccttcatgtttgagagccctaaccaagataagatttcagattttgaaatgaagttgatggacatagacagtgagcatctgggcattcccgagtcagagtaccatgcaattgtgagaatgccatcccaggagtttgctcgcatttgcaaagatctcagcagtattggggacactgttgtgatctctgtaacgaaggaaggggtgaagttctccacaaggggagacattggtagtgccaacattgtttgcaggcagaatacctctgttgacaagccagaggaggcaactgttattgagatgcaggagcctgtgtcgttaacatttgcactgagatacatgaattccttcacaaaggcaactcctctgtctaatactgtgactataagcatgtcatctgaattgcccgtggttgttgaatataagattgcagatatgggttacatcaggttttatttagctcccaagattgaggaggatgaagaaatgaccgccggtagttaatgttatgttttcatccctcgcttgtaattctagtacaagatga

SEQ ID NO: 2838 - DNA, 1280 bp, Gossypium hirsutum
cgggaaccaacgccacacaatcccgccacgttgaaccctcccgattcaaaatcaattccccatttatataaactctcaatacccatctctttttcgctcaaaaccctaggccttcgctccaattttcccatctctttcgcaagagaaccaaaagagaggaagaaaaaaaaactactaaaaaatgcttgagcttaggctagttcagggttcgcttctaaagaaagtcttggaagcgattaaggacttggtcaacgatgccaacttcgactgttcggcgacggggttttctttgcaggccatggattcgagtcatgttgcgctggtggccctgttgctgagatcggaagggttcgagcactatcgctgcgacaggaacatttccatggggatgaatctcggtaacatgtccaagatgctgaaatgtgccggaaatgatgacatcatcacaatcaaggctgatgatggcagcgacactgttactttcatgttcgagagccccacccaagacaagatatcagattttgagatgaagctgatggatattgatagtgaacaccttgggatcccagaagcggagtaccatgctattgttaggatgccttcagctgaatttgcaaggatttgcaaagatcttgcaagcattggtgacaccgttgttatctctgttaccaaggaaggtgtgaagttttccacaaggggtgatatcggaactgcaaatattgttcttaggcagaataccactgtagataaacctgaagaagcaacaattatagagatgaatgagccagtatcattgacatttgcattgaggtacatgaattcatttacaaaggctactccattgtcaaacacagtgacaatcagcttgtcatcagagctgcctgttgtggtcgagtataagatagctgagatgggttatgttaggttctacttggcacccaagattgaagaagatgaggatgagactaagccacaagtttaactttgaatttgggatggattttgtttccttgttgactacaatatgtgtttgattgtcattaatgtttaaggctttcaacaagttgccaagcatattaagtttgtttagattaggtggatgattaacatttctcttttgcttggattttcccatattgttataaattatgtgttcctgtttcttgtgcgtcttcattattgttgtaaattttgagacttgaaaacttgagcttgacttgaaatattatcaaactattcaagttaaactcaattacaaattaacaaatgcaatatttata

SEQ ID NO: 2839 - DNA, 1150 bp, Cucurbita pepo
gccagctcctgtttctgcaatttctcttagaaatgttggagcttcgtcttgttcagggttcgctcctcaagaaggtcttggaatcgatcaaggacttagtgaatgatgccaactttgactgttcggccactggattctctcttcaggccatggactcgagccatgtcgccctggtggctcttctccttcgggcggagggcttcgaacattatcgctgcgataggaacatgtccatgggaatgaacttgaacaacatgtcgaagatgctcaagtgtgccggcaatgatgatattattacaatcaaggccgatgacggcagtgatactgtcactttcatgttcgaaagccccactcaagataagatttccgattttgagatgaaattgatggacatcgacagtgagcatcttggtattccagatgcggagtaccatgctattgttaggatgccttctgctgagttcgctagaatatgcaaagatctcagcagcattggtgatactgttgtgatttctgtcacaaaggaaggtgtcaagttctcaacaagaggtgatattggatctgccaatgttgtttgcaggcagaataccactgtagacaagcctgaagaagcaacagtcatagagatgaacgagccagtttccttgacatttgctcttaggtatatgaactccttcactaaggcgacacctctttctaacacagtcaccatcagcttgtcttccgacctacccgtcgtcgttgagtacaaaatagcagagatgggatatgttaggttttacttagctcccaaaatagaagaagatgaggatgagaccaagccttaggtctaaatagtagagttaccatttgtttctaaatcattttaggatgtgtttgaactttttttttcttgtactatagcagctatgagttgtgatttaggagtttcttattgtccagtatctacttctctgtttatcagcttcaaattctgatttttcctcttatcttgtcatcattttgattttaaaggttataggatatttgagggactgagatcgagtgtttttgacgaaaataggtgtaggattgaaggtaattcatgaggaagcaatgaaaatatgagacatccaatggcttccagtgttactgtttctcatataattta

SEQ ID NO: 2840 - DNA, 1306 bp, Gossypium raimondii
tagcggaaacacaatggcgggaaccaacgccacacaatcccgccagttgaaccctcccgattcaaaatcaagtccccattttatataaactctcaatacccatctctttttcgctcaaaaccctaggccttcgctccaattttcccatctctttcgcaagagaaccaaaagagaagaaaaaataactactaaaaaatgcttgagcttaggctagttcagggttcgcttctaaagaaagtcttggaagcgattaaggacttggtcaacgatgccaacttcgactgttcggcgacggggttttctctgcaggccatggattcgagtcatgttgcgctggtggccctgttgctgagatcggaagggttcgagcactatcgctgcgacaggaacatttccatggggatgaatctcggtaacatgtccaagatgctgaaatgtgccggaaatgatgacatcatcacaatcaaggctgatgatggcagcgacactgttactttcatgttcgagagccccacccaagacaagatatcagattttgagatgaagctgatggatattgatagtgaacaccttgggatcccagaagcagagtaccatgctattgttaggatgccttcagctgaatttgcaaggatttgcaaagatcttgcaagcattggtgacaccgttgttatctctgttaccaaggaaggtgtgaagttttccacaaggggtgatatcggaactgcaaatattgttcttaggcagaataccactgtagataaacctgaagaagcaacaattatagagatgaatgagccagtatcattgacatttgcattgaggtacatgaattcatttacaaaggctactccattgtcaaacacagtgacaatcagcttgtcatcagagctgcctgttgtggtcgagtataagatagctgagatgggttatgttaggttctacttggcacccaagattgaagaagatgaggatgagactaagccacaagtttaactttgaatttgggatggattttgtttccttgttgactacaatatgtgtttgattgtcattaatgtttaaggctttcaacaagttgccaagcatattaagtttgtttagattaggtggatgattaacatttctcttttgcttggattttcccatattgttataaattatgtgttccattttcttgtgcgtcttcattattgttgtaaattttgagacttgaaaacttgagcttgacttgaaatattatcaaactattcaagttaaactcaattacaaattaacatatgcaatatttatattaattttttaa

SEQ ID NO: 2841 - DNA, 1157 bp, Medicago truncatula
ggatttttccccccaaatcccaaaaccgtcgagaccctaatttcccaaaaaccctaattcccagatctcgttcaccatgttagaactccgtctagttcaaggttcacttctcaagaaggtcctagaatcgatcaaggaactcgtcaacgatgccaacttcgattgttcctctactggtttctctcttcaagccatggattctagccatgttgctcttgtcgcgcttcttcttcgttctgaagggtttgagcattatcgctgtgaccggaatctttctatgggtatgaatctgaacaatatggcgaagatgttgaagtgtgctggtaatgatgatatcattactattaaggctgatgatgggagtgatactgttaccttcatgtttgaaagccctacccaagacaagatttctgattttgagatgaagctgatggacattgatagtgagcaccttggaattccagaggctgaatatgatgccattgttaggatgccatctgctgagtttgctaggatttgcaaagatcttagtagcattggtgacactgttgtcatctcggttactaaggagggcgtgaagttttcaaccaagggtgacattggagctgcaaacattgtttgcaggcagaacactactgtggacaagcctgatgatgctactgtcatagagatgaaagagcccgtctccttgcaatttgcattaagatacacgaattcttttaccaaggcaactcctttgtccagcacagttaccatcagtctgtcaaatgaactaccagttgttgttgagtacaagattgctgagatgggttatgttaggttctatctagctcccaaaatagaggaagatgatgaagaaaccaagcccgaagtttagttggatatagatgttggattggcatcttaggttttgattttgattgtagttttaggacgcttttatacattatcaaggtattgcgtatgcttgcctatctttgaatttggaagaggtgtgcatgtcacattattttttacctcgtttaaatcaatgttaaacaatggatgtgcattttccactgtagggccttttattttattgcttttatgcatctgaacagctttcaaactaaatgtggaatcttggaagagtttgaaattaacagtcaagtttgttg

SEQ ID NO: 2842 - DNA, 1268 bp, Arachis hypogaea
atctttcgttctatttatcccaccaattttccctagaaactcaaaaccctaaccctaccgagacaaagcaagaaaacctccaaaccctccattttcaagatgctggaactccgtttagtgcaaggttctctgctgaagaaggttctagaagcaatcagggagctcgtgaacgatgcgaacttcgattgctccgcgactgggttctcactccaggccatggactcgagccacgttgctctcgtggccctcctactgcggtccgaagggttcgagcactaccggtgcgaccgtaacatctcgatggggatgaatctcaacaacatggccaagatgctacggtgcgccggaaatgatgacatcatcaccgtcaagggcgatgacggcagcgacacggtcactttcatgtttgagagcccaacacaagataaaatttctgattttgagatgaagttgatggatatcgacagtgagcaccttggaattcctgaggcagagtaccatgccattgttagaatgccgtctgctgagtttgctaggatttgcaaagatcttagcagtattggtgacactgttgtcatttctgttactaaggaaggtgtaaagttttccacaaagggtgatattggaactgcaaacatagtctgcaggcagaactcttctgtggataagcctgaagaagccactactgtagagatgaatgagcctgtatccttgacatttgcattgcggtacatgaactcattcacaaaggcaactccattgtctaaccaagttaccatcagtctttcaaatgagcttccagttgtggttgaatacaagattgctgagatgggttatgtccgcttctatttggctcccaagatagaagaggaagaagaggagacaaaacctgaagtttaggtgttggattgactctattgggtctttaattcggttgtagtatgccttgatacatcttgttgaagatattgggtcttcaatttgatcaagaatagccttcttcttgttaccgttgacgttctctaagctaatcactgggatgagaaaggagagtgctatttaagtatttaggaattcttctaggtagttttgctatttaagtatttaggaattcttctaggtagttaaattagttttgtatggtgatgatatggctaaattttcataacgcatgcttttcaattaggcttgttgagacttatatggttatatcaaatatcatatcatatgctaagttgtgtcgttgaattttctgaggctgcctcaaa

SEQ ID NO: 2843 - DNA, 1293 bp, Arachis hypogaea
cccaccaattttccctagaaactcaaaaccctaaccctaccgagacaaagcaagaaaacctccaaaccctccattttcaagatgctggaactccgtttagtgcaaggttctctgctgaagaaggttctagaagcaatcagggagctcgtgaacgatgcgaacttcgattgctccgcgactgggttctcactccaggccatggactcgagccacgttgctctcgtggccctcctactgcggtccgaagggttcgagcactaccggtgcgaccgtaacatctcgatggggatgaatctcaacaacatggccaagatgctacggtgcgccggaaatgatgacatcatcaccgtcaagggcgatgacggcagcgacacggtcactttcatgtttgagagcccaacacaagataaaatttctgattttgagatgaagttgatggatatcgacagtgagcaccttggaattcctgaggcagagtaccatgccattgttagaatgccgtctgctgagtttgctaggatttgcaaagatcttagcagtattggtgacactgttgtcatttctgttactaaggaaggtgtaaagttttccacaaagggtgatattggaactgcaaacatagtctgcaggcagaactcttctgtggataagcctgaagaagccactactgtagagatgaatgagcctgtatccttgacatttgcattgcggtacatgaactcattcacaaaggcaactccattgtctaaccaagttaccatcagtctttcaaatgagcttccagttgtggttgaatacaagattgctgagatgggttatgtccgcttctatttggctcccaagatagaagaggaagaagaggagacaaaacctgaagtttaggtgttggattgactctattgggtctttaattcggttgtagtatgccttgatacatcttgttgaagatattgggtcttcaatttgatcaagaatagccttcttcttgttaccgttgacgttctctaagctaatcactgggatgagaaaggagagtgctatttaagtatttaggaattcttctaggtagttttgctatttaagtatttaggaattcttctaggtagttaaattagttttgtatggtgatgatatggctaaattttcataacgcatgcttttcaattaggcttgttgagacttatatggttatatcaaatatcatatcatatgctaagttgtgtcgttgaattttctgaggctgcctcaaagcaccaagttgcaatagtattaatgcattattatttcccctaa

SEQ ID NO: 2844 - DNA, 963 bp, Sequoia sempervirens
atttgatttatttagttggatctcaaacccaaccttagcattaggatctgcaggaggatatgtgattggaggaaatgttggagcttcggctggtgcaggggagcctcctgaagaaggtgctggaggccattaaggacctcgtctccgatgccaacttcgactgctcagccacgggcttctccctgcaggccatggactccagccacgtggcactcgtcgcccttctcctgcgatctgaaggcttcgagcacttccgctgcgatcgcaacatgtctgtgggcatgaatctcaacaacatggctaagatgctcaagtgtgctggcaatgacgatatcatcaccctcaaggctgacgatggcggcgacaccgttaccttcatgttcgagagcccaaatcaagataagatttcagattttgaaatgaagttgatggacatagacagtgagcatttgggcatcccagaatcagagtaccatgcaattgtgaggatgccatctcaggagtttgctcgcatttgtaaagatctcagcagtattggggacactgtggtgatttctgttaccaaggaaggggtgaagttcacaactaggggggatatcggcagtgctaacattgtttgcaggcagaacacctctgttgacaagccagaggaggcaactattattgagatgcaggagccggtgtcattaacatttgctctgagatatatgaattccttcacaaaggcaactcctctttctaatactgtaactataagcttgtcatctgaattgcctgtggttgttgaatataagattgcagatatgggttacatcaggttctatttggctcccaagattgaagaggaagatgaaatgactgggacttaagtttgtattacttataaggggttgtgtttgtagcccttgtaacttctgttgtttcaaaatttggtttaattgaaagatactttcacttttcaat

SEQ ID NO: 2845 - DNA, 926 bp, Fragaria vesca
cgtcgtggtcgccggaaacgatgttggagctccgattggtccagggctcgctcctgaagaaggttctggagtccatcaaggacctcgtcaccgacgccaacttcgactgctccgccaccgggttctccctccaggccatggactccagccacgtcgccctcgtcgctttgcttctcagatctgaaggcttcgagcactaccgctgcgatcggagcatctccatggggatgaacctcggcaacatgtccaagatgctcaagtgcgccggcaacgatgacatcatcaccctcaaggctgacgacggcagcgatactgtcaccttcatgtttgagagccccacacaagataaaatttctgattttgagatgaagctgatggacattgacagtgagcaccttggtattccagaggcagaataccatgctattgttaggatgccttctgctgaatttgccaggatttgcaaagacctcagcggcatcggtgatactgttgtgatatctgtgacaaaggaaggtgtgaagttctctacaagaggtgatatcggtgttgctaatatcgtctgtaggcagaacactactgttgacaagcctgaagaagcaacaatcatagagatgaatgagccagtatcattgacatttgctctgaggtacatgaactccttcacaaaagcatcccccttgtcaaacacagttactatcagcctctcttctgaactgccagttgtggttgagtacaagattgctgagatggggtacataaggttctacttggctccgaagatagaagaggatgaagatgagacaaagcctcaagtttgaaccttatgccacggcacaggcctgcccttagttgacttgattgtgcttttgaaatccatgtagagaatttctatttgaggtgttccctgctttctaagtgattga

SEQ ID NO: 2846 - DNA, 1047 bp, Arachis hypogaea
caaactaccctcgactgttaggaagagtttcctccacgcgttgcccaaaatagtgatggcgggaacttaatttatttaattacaatcagatcccgccaatcccttcacagaaccttacgctatataaacccctttccctccttttctctcattccctcgttcgttctgtttttcccaccaattttcccgagaaacccaaaaccctaaccctaccgagacaaagcaagaaaacctccaaacccccattttcaagatgctagaactccgtttagtgcaaggttcgctgctgaagaaggttctagacgcaatcagggagctcgtgaacgatgcgaacttcgattgctccgcgactgggttttcactccaggccatggactcgagccacgttgctctcgtggccctcctactgcggtccgaagggttcgagcactaccggtgcgaccgtaacatctcgatggggatgaatctcaacaacatggccaagatgctacggtgcgccggaaatgatgacatcatcaccgtcaagggcgatgacggcagcgacaccgtcactttcatgttcgagagcccaacacaagataaaatttctgattttgagatgaagttgatggatatcgacagtgagcaccttggaattcctgaggcagagtaccatgccattgttagaatgccgtctgctgagtttgctaggatttgcaaagatcttagcagtattggtgacactgttgtcatttctgttactaaggaaggtgtaaagttttccacaaaagggtgatattggaactgcaaacatagtctgcaggcagaattcttctgtggacaagcctgaagaagccactactgtagagatgaatgagcctgtatccttgacatttgcattgcggtacatgaactctttcacaaaggcaactccattgtctaaccaagttaccatcagtctttcaaatgagcttccagttgtggttgaatacaagattgctgagatggttatgtccgcttctatttggctcccaagatagaagaggaagaagacgagacaaaacctga

SEQ ID NO: 2847 - DNA, 1160 bp, Raphanus sativus
ggaccaacaccaaaccagaagcagcgggaaccaaataccctaaaatcaagccttttaatatcgattcccgcgaactcatttcaccaatcaatcgtcctcccagaaaggttcagagccctaaaaacccaaacccttagccacacaacccttcgagaaagatgttggagcttcgtctagtccaaggctctctgctgaagaaggttctagaatcagtcaaggatctggtgaacgatgccaacttcgactgctccagcaccgggttctccctccaggccatggactccagccacgtggcgctggtgtctcttctcctgagatccgaaggtttcgagcactacaggtgcgacaggaacctctccatggggatgaatctcggaaacatgtccaagatgctcaaatgcgccggaaatgatgacatcatcaccatcaaagccgatgacggaagcgacaccgtcaccttcatgttcgagagccctacacaagacaagattgcagattttgagatgaagctgatggatatcgacagtgagcatttaggaatccctgacgctgagtaccactctattgtgaggatgccttctggtgaattttccaggatttgcaaagatctcagtagcattggtgacacagttgtcatctctgtgacgaaagaaggtgtgaagttttcaacagctggtgatatcgggacagctaacattgtactcaggcagaacacaactgtcgacaaacctgaagacgcaattgtgatagaaatgaacgagcctgtgtcgctttcattcgctttgaggtacatgaactccttcacaaaggcgactcctttgtctgaaaccgtgacaatcagtttgtcctcggaattaccagtcgtggtggagtataaagtggctgagatgggttacattcggtactatttggctcccaagattgaagaagaagaagacactaatgcctaacacgtctgtggcttctggatgcagaatctttggaactcttcgtggatgaatgctgttttctttactgtagtcctttgttaaaatatttttctgtttggattcagtttgttttctggatttactatgttactactgcaacgctagattagatcatggtgaaaaacaagttcgactggttttgcaatttgagaaaaaaaggtttacaacttt

SEQ ID NO: 2848 - DNA, 1056 bp, Picea glauca
ggaacgagttgcatcttctctcgagctctgtttttttcttcattcaacaacgaaaggagtcctcttctctctggagttgtcttcgccataacaatgttggaactaaggcttgtgcaggggagtcttctgaagaaggtgctggagtctatcaaggacctcgtcaccgatgccaacttcgattgctcggccacgggcttctccctgcaggccatggactccagccacgttgccctcgtttccctgttgctcagatccgaaggcttcgagcactatcgctgtgatcggaacatgtccatggggatgaacctcaataacatggccaagatgctcaagtgcgccggcaacgatgacataatcaccatcaaggccgacgatggaggcgacactgttaccttcatgttcgaaagccccaaccaggataagatttcggacttcgaaatgaagttaatggatattgacagcgagcatctgggcattccagagtcagagtaccatgccattgtgaggatgccatctcaagaatttgctcgtatttgcaaggatctcagctccattggggacactgttgtgatctcagtgagcaaggaaggagttaagttctcaacaaggggagatattggtagtgctaacattgtgtgcagacaaaacccttctgttgataagccggacgaggcaacaattattgagatgcaggagcctgtatcactgacatttgctctgagatacatgaactcattcaccaaggcaactccgctgtctaacacagtgacaatcagcatgtcatcggaattgccagttgttgtcgagtacaaaattgcagatatgggttatattaggttttacttggctcctaagattgaggaggaaggtgaaagctaagtgccctctttgcattgcatagagcagaggctctagtttagttgtatggtcttttgcttgtatttaagcatgtgatggagaggtccaaaaaaatgcaatggcttgatttgctcacatgttttattctcatcttattaaagtaagtagtcttgtttccgcagaaaaaaaaaaaaaaaa

SEQ ID NO: 2849 - DNA, 1030 bp, Eutrema halophilum
cccttaaccctagacgagcgattcggattctgagcactgggaagacgatatgttggagctacgtcttgttcagggttctctgttgaagaaggttctagaatcgatcaaagatcttgtgaacgatgcgaactttgactgctccagcactgggttctcgctccaagccatggattcgagtcacgtggcgctggtctctctcctgcttagatccgaaggcttcgagcactacaggtgcgacaggaatctctccatggggatgaacctcggaaacatgtcgaaaatgctcagatgtgccggaaatgatgacatcatcaccatcaaagctgatgacggcggcgacaccgtcactttcatgttcgagagccccacgcaagacaagattgcagactttgagatgaagctgatggacatagacagtgagcatttgggaattcctgatgctgagtaccattcaattgtgaggatgccgtcaaatgagttttccaggatttgcaaagatttaagcagcatcggtgacacagttgtgatctccgtgactaaagaaggggttaagttttctactgctggtgacattgggacagctaacattgtgctcagacagaacacaagtgttgacaagccggaagatgcaattgtgatagagatgaacgagccagtgtcactctcatttgccctgaggtacatgaactcattcacaaaggcaactccactgtcagacacggtgactatcagcttatcatcggagctgccagttgtggtggagtataaggtagctgagatgggttacattcgttactacttggctcctaaaattgaagaagaagaagacactaagccctaaaactccttagtatattcatcctaaaagtcagaagatttttcttgatgatgatgatgatgtttttctgtgattccatttagtgcccctcttgaacagtttgtttccatgacttattatgttttacgataacaaagttcggcaaaattagtggcttctgaaacgatttatcatctatttccaattcacaag

SEQ ID NO: 2850 - DNA, 991 bp, Eutrema halophilum
cccttaaccctagacgagcgattcggattctgagcactgggaagacgatatgttggagctacgtcttgttcagggttctctgttgaagaaggttctagaatcgatcaaagatcttgtgaacgatgcgaactttgactgctccagcactgggttctcgctccaagccatggattcgagtcacgtggcgctggtctctctcctgcttagatccgaaggcttcgagcactacaggtgcgacaggaatctctccatggggatgaacctcggaaacatgtcgaaaatgctcagatgtgccggaaatgatgacatcatcaccatcaaagctgatgacggcggcgacaccgtcactttcatgttcgagagccccacgcaagacaagattgcagactttgagatgaagctgatggacatagacagtgagcatttgggaattcctgatgctgagtaccattcaattgtgaggatgccgtcaaatgagttttccaggatttgcaaagatttaagcagcatcggtgacacagttgtgatctccgtgactaaagaaggggttaagttttctactgctggtgacattgggacagctaacattgtgctcagacagaacacaagtgttgacaagccggaagatgcaattgtgatagagatgaacgagccagtgtcactctcatttgccctgaggtacatgaactcattcacaaaggcaactccactgtcagacacggtgactatcagcttatcatcggagctgccagttgtggtggagtataaggtagctgagatgggttacattcgttactacttggctcctaaaattgaagaagaagaagacactaagccctaaaactccttagtatattcatcctaaaagtcagaagatttttcttgatgatgatgatgatgtttttctgtgattccatttagtgcccctcttgaacagtttgtttccatgacttattatgttttacgataacaaagttcggcaaaattagtg

SEQ ID NO: 2851 - DNA, 1226 bp, Gossypium raimondii
gtgtcattggcgggaaccaaaacacttccctttcccgctaattgaattccatcacgattcaaatcttcccagcttttttatctataaaaccctaaccccaaaatttccaatctctgtgcttcaatcgaagggaaaaaaaggaaaaaagaaagaaaaccccaaaaatgctagagcttaggctagttcaaggttcgcttctgaagaaagtattggaagcgattaaggacttggtcaacgatgctaacttcgactgttcggcgaccggattctcattgcaagccatggattcaagccacgttgctttggtggctctgctgctcagatcggaaggtttcgagcactatcgttgcgataggaacctttccatggggatgaatctcaataacatgtctaagatgatgaaatgtgccggtaatgatgatatcatcacaatcaaggctgatgatggcagtgatactgttactttcatgttcgaaagtcccacacaagacaagatatcggattttgagatgaagctgatggatattgatagtgagcatcttgggattccagaggcagagtatcaatctattgtgaggatgccttcagctgagtttgctaggatttgtaaagatcttgctagcattggtgatactgttgttatctctgtaaccaaggaaggtgtgaaattttccacaagaggtgatatcggaactgctaatatcgttctcaggcaaaataccacggtagacaaacctgaagaagcgactatcatagagatgaacgagcccgtttcattgacatttgcattgaggtacatgaattcatttacaaaagcaactccattgtcaagtacagtgacgattagcttatcttcggaattgccggttgtggttgagtacaagatagctgaaatgggtcatattaggttttacttggcacccaagattgaagaggatgaagatgagactaacccacaaggttaacttgattaaaaaaaaatttggggttggatttagttttcttggtacactgaaaatgggtatttgatgtttatgccattaatggttttcattggggtttttctactttagggtttcaagtttgtagctgaacataaagtagtttaggattttgatggatgataagttatatttgttgcatttttttaatcttgtttgtctttacttctattgcaacttaatagtttctctttaatggttgcatttaagataaattatttagat

SEQ ID NO: 2852 - DNA, 1208 bp, Glycine max
cactcctcatttccattttcaattttaatttcctctcaaaccctaaccctaaccctaaccctccccgtcacaaaagaaaaccctctttgtccgatcatcgtcgtcaagatgttggaactccgtctcgtgcaaggctccctcctgaagaaggttttggaatccgtcaaggagctcgtgaacgacgcgaacttcgactgctcctccaccgggttctccctccaggccatggactccagccacgtcgccctcgtcgctctcctcctccgatccgagggcttcgagcactaccgctgcgaccgcaacatctccatgggcatgaacctcaacaacatggccaagatgcttaagtgtgctggtaatgacgacatcatcaccatcaaggccgacgacggcagcgacactgtcactttcatgttcgaaagccctacacaagacaagatttctgattttgaaatgaagctgatggacattgatagtgaacaccttgggattccggaggcagagtatcatgctattgttaagatgccatcctctgagtttgctaggatctgcaaggatctcagtagtattggtgacactgttgtcatttcggttactaaggagggtgtgaagttttccaccaaaggagatattggaactgccaatatagtttgtaggcagaatacttctgtggacaagcctgaagaagcaactgtcattgagatgaatgagcccgtgtccttgacatttgctttgcgatatatgaactcttttacaaaggcaacgccattgtctaacacagttaccattagtctttcaaatgagttgccagttgttgttgagtacaagattgctgagatgggttatgtgcggttctatttggctcccaagatagaagaggatgaagaagatacgaaacctcaagtttaatctacctattagatggttgggttaggatattaggattttaatgtctttgaacttgtagctttcgtcatacatcttctgttgaagatattttaaccgtgtgagcaatgaattcacattttgtggatttcttagatgtgtattggttacctaccaccttattttccctcgatttgattgttaagaacaattcgaaacaattggtgtgtatttttcatgttgatgcgtttttatttgtgaactggaacagcttcataaaaaaatactgcatcaaagcaagaaaccttgagttaaccaaataa

SEQ ID NO: 2853 - DNA, 1249 bp, Ricinus communis
tttctggttccctccattataaaaacgatggcgggaactaaagtctaactcctccaaaagtcccgccaaccccaaaatctccctacctctccttttaaaaccctagtcgccacctctcacttactcttgcccacacgatctttggaaacaaaaccctaaccctaatcctaatttgaaggaaaaaaaaacagccaaaatgttggagctaaggttggtgcaaggatcattgctaaagaaggttttagattcaatcaaggacttagtgaacgatgccaacttcgactgttcatcgacgggattctcccttcaggcaatggattcgagccacgtggcacttgtggcactgcttctaagatcggagggttttgagcattatcgatgtgaccgtaatatctcaatggggatgaatctgaataatatgtctaaaatgttgaggtgctctggtaacgacgacatcatcactatcaaagctgacgatggcagtgataccgtcactttcatgtttgaaagtcccacacaagataaaatttcggatttcgagatgaagctcatggacattgacagtgagcacctaggaattcctgaggcagaatatcatgctattgtcaggatgccatcagctgagtttgcaaaaatttgtaaagatcttggaagcattggggatactgttgttatatctgttacaaaggaaggagtaaagttctccacaaggggtgatattgggactgctaatattgttgtcaggcagaatactacagtagataagccagaagaagccaccatcattgagatgaatgaaccagtgtccttgacatttgctctgagatacatgaactccttcaccaaggcaactccattgtcaagcacagttacaatcagcttgtcttctgaactgcctgttgtggtggagtacaagattgctgaaatgggttatatcagattctacttggctcctaagatcgaagaggatgaggatgaaactaagcccgaagtttaattctactttgtcattttatgttcactgaaagcacactccttgaggttttgattatggtgcttgtcattttggtcgatatttacctgtaaaaacctcatcatgtggtagtttgtagaatccttaaattttcttttagtgctaagatttttaggtactattttgtgagaaacaagtgacctttttctatcaatgttcatagaatccttcttattaatgaattagttctgctcacttgaattgtttgaaagtaat

SEQ ID NO: 2854 - DNA, 1347 bp, Gossypium raimondii
caaaattatcgagaactcgaataatttacatataccagtatcgtataagttgcatgacaaagactctacaaacaaaaccacctaatcctttccccgcgtctccattttgctaaagtgtcattggcgggaaccaaaacacttccctttcccgctaattgaattccatcacgattcaaatcttcccagcttttttatctataaaaccctaaccccaaaattgccaatctctgtgcttcaatcgaagggaaaaaaaggaaaaaagaaagaaaaccccaaaaatgctagagcttaggctagttcaaggttcgcttctgaagaaagtattggaagcgattaaggacttggtcaacgatgcgaactttgactgttcggcgaccggattctcattgcaagccatggattcaagccacgtggctttggtggctctgctgctcagatcggaaggtttcgagcactatcgttgcgataggaacctttccatggggatgaatctcaataacatgtctaagatgatgaaatgtgctggtaatgatgatatcatcacaatcaaggctgatgatggcagtgatactgttactttcatgttcgaaagtcccacacaagacaagatatcggattttgagatgaagctgatggatattgatagtgaacaccttgggattccagaggcagagtatcaatctattgtgaggatgccttcagctgagtttgctaggatttgtaaagatcttgctagcattggtgatactgttgttatctctgtaaccaaggaaggtgtgaaattttccacaagaggtgatatcggaactgctaatatcgttctcaggcaaaataccacggtagacaaacctgaagaagcgactatcatagagatgaacgagcccgtttcattgacatttgcattgaggtacatgaattcatttacaaaagcaactccattgtcgagtacggtgacgattagcttatcttcggaattgccagttgtggttgagtacaagatagctgaaatgggtcatattaggttttacttggcacccaagattgaagaggatgaagatgagactaacccaaaaggttaacttgattaaaaaaaattttggggttggatttagttttcttggtacactgaaaatgggtatttgatgtttatgccattaatggttttcattgggggttttctactttagggtttcaagtttgtagctgaacataaagtagtttaggattttgatggatgataagttatttgttgcatttttttaatcttgtttgtctttacttctattgcaacttaatagtttctctttaatggttgcatttaagataaattatttagataaacaataa

SEQ ID NO: 2855 - DNA, 1146 bp, Cucumis melo
acttcttcttctcgcgctctctctcgaaaccctagtcagccccatccctagctctgcaatttctctcaaaaatgttggagcttcgtcttgtgcagggttctctcctcaagaaagtcttggaatcgatcaaggatttggttaacgatgccaactttgactgttcggccactggattctcgctccaagccatggattcgagccatgttgccctggttgctcttctccttcgagcggagggcttcgaacattatcgctgcgatagaaacatttccatgggaatgaacttgaataacatgtcgaaaatgctcaagtgtgctggtaacgatgatatcattacgatcaaggccgatgacggcagtgatactgtcactttcatgtttgaaagccctactcaagataagatttcggattttgagatgaaattgatggacatcgacagtgagcatcttggaattccagatgcagagtatcatgctattgttaggatgccttctgttgagttcgctagaatatgcaaagatctcagcagcattggtgataccgttgtaatttctgtgacgaaggagggtgtaaaattctcaacaagaggtgatattggatctgccaatattgtttgcaggcagaataccacagtagacaagcctgaagaagcaacagttatagagatgaatgagccggtttctttgacgtttgctttaaggtatatgaattccttcactaaggcaacgcccctttcaaacacggtcaccatcagcttgtcctctgacctacctgttgttgtcgaatacaaaatagcagagatgggatatgtaaggttttacttggctcccaaaatagaagaagatgaggatgagacaaagcctcaagcctaaatatatttagtcatttgttctataaaatccgtttagaatatttcctaactttatttttctttttcttttattctgtagtatagcagttgtgagttgtagtttaggagtttttatagtccaatatgtactctgtttccaagcttaaaattttcattctttccccctcttatcttatcatcatttgatttaataggatacttgaggaactgaaattgaatattttgggcagtattatgattaccacaaacggtgaagagtctttggtataaaacag

SEQ ID NO: 2856 - DNA, 1355 bp, Glycine max
aaacctcatggcgggaactgaattatttccccccaaatccccccaactgtttccagaaccttccccttatataaacctcaccttccctctcatttcccactcctcatttccattttcaattttaatttcctctcaaaccctaaccctaaccctaaccctccccgtcacaaaagaaaaccctctttgtccgatcatcgtcgtcaagatgttggaactccgtctcgtgcaaggctccctcctgaagaaggttttggaatccgtcaaggagctcgtgaacgacgcgaacttcgactgctcctccaccgggttctccctccaggccatggactccagccacgtcgccctcgtcgctctcctcctccgatccgagggcttcgagcactaccgctgcgaccgcaacatctccatgggcatgaacctcaacaacatggccaagatgcttaagtgtgctggtaatgacgacatcatcaccatcaaggccgacgacggcagcgacactgtcactttcatgttcgaaagccctacacaagacaagatttctgattttgaaatgaagctgatggacattgatagtgaacaccttgggattccggaggcagagtatcatgctattgttaagatgccatcctctgagtttgctaggatctgcaaggatctcagtagtattggtgacactgttgtcatttcggttactaaggagggtgtgaagttttccaccaaaggagatattggaactgccaatatagtttgtaggcagaatacttctgtggacaagcctgaagaagcaactgtcattgagatgaatgagcccgtgtccttgacatttgctttgcgatatatgaactcttttacaaaggcaacgccattgtctaacacagttaccattagtctttcaaatgagttgccagttgttgttgagtacaagattgctgagatgggttatgtgcggttctatttggctcccaagatagaagaggatgaagaagatacgaaacctcaagtttaatctacctattagatggttgggttaggatattaggattttaatgtctttgaacttgtagctttcgtcatacatcttctgttgaagatattttaaccgtgtgagcaatgaattcacattttgtggatttcttagatgtgtattggttacctaccaccttattttccctcgatttgattgttaagaacaattcgaaacaattggtgtgtatttttcatgttgatgcgtttttatttgtgaactggaacagcttcataaaaaaatactgcatcaaagcaagaaaccttgagttaaccaaataacaatactgcttctactgtcttataaaatcaaggataattgtttttctact

SEQ ID NO: 2857 - DNA, 1275 bp, Glycine max
cacacattccacaaaacctcatggtgggaactgaattatttccccccaaatcccgccaactgcttccagaaccttcccctatataaaccccccttccctctcatttccatttcaatttcaatatccgctcaaaccctaacctaactcctctcgtcgtcacaaaaagtcttcttctccgatcgttacgatgttggaactccgtctcgtgcaaggttcccttctgaagaaggttctggaatcgatcaaggagctcgtaaacgacgcgaacttcgactgctcctccaccgggttctccctccaggccatggattccagccacgtcgccctcgttgcgctcctcctccggtccgagggctttgagcactaccgctgcgaccgcaatacctccatgggcatgaacctcaacaacatggccaagatgctcaagtgcgccggcaatgacgacatcataaccatcaaggccgacgacggcagcgacaccgtcactttcatgttcgaaagccctacacaagataagatttctgattttgagatgaagctgatggacattgacagtgagcaccttgggattccagaggcagagtatcatgccattgttaagatgccatcctctgagtttgctaggatctgcaaggatctcagtagtattggtgacactgttgtcatttcaattactaaggagggtgttaagttttccaccaaaggagacattggaactgccaatatagtttgcaggcagaatacttctgtggacaagcctgaagaagctactgtcattgagatgaatgagcctgtgtccttgacatttgctttgcgatatatgaactcttttacaaaggcaacgccattgtccaacacagttaccattagtctgtcaaatgagctgccagttgtagtcgagtataagattgctgagatgggttatgtgcggttctatttggctcccaagatagaagaggatgaagaagatacgaaacctcaagtttaatctacctattagatgttgggttaggatattaggattttaatgccttttgaacttgtttttgttatacatctttgaagatattttaaccttgtgagcaacgaattggcattttgtggatttcttatgtgtattagtttcctgccaccttattttctcctgaatttattgtttattgtttagaacaatgtgaaacaattggtgtgcatttttcttgttgatgtgattttattttttgtgaactggaacaacttcataacaaaatactgcatgtaagtagaaaccttgag

SEQ ID NO: 2858 - DNA, 1157 bp, Glycine max
atttcaatttcaatatccgctcaaaccctaacctaactcctctcgtcgtcacaaaaagtcttcttctccgatcgttacgatgttggaactccgtctcgtgcaaggttcccttctgaagaaggttctggaatcgatcaaggagctcgtaaacgacgcgaacttcgactgctcctccaccgggttctccctccaggccatggattccagccacgtcgccctcgttgcgctcctcctccggtccgagggctttgagcactaccgctgcgaccgcaatacctccatgggcatgaacctcaacaacatggccaagatgctcaagtgcgccggcaatgacgacatcataaccatcaaggccgacgacggcagcgacaccgtcactttcatgttcgaaagccctacacaagataagatttctgattttgagatgaagctgatggacattgacagtgagcaccttgggattccagaggcagagtatcatgccattgttaagatgccatcctctgagtttgctaggatctgcaaggatctcagtagtattggtgacactgttgtcatttcaattactaaggagggtgttaagttttccaccaaaggagacattggaactgccaatatagtttgcaggcagaatacttctgtggacaagcctgaagaagctactgtcattgagatgaatgagcctgtgtccttgacatttgctttgcgatatatgaactcttttacaaaggcaacgccattgtccaacacagttaccattagtctgtcaaatgagctgccagttgtagtcgagtataagattgctgagatgggttatgtgcggttctatttggctcccaagatagaagaggatgaagaagatacgaaacctcaagtttaatctacctattagatgttgggttaggatattaggattttaatgccttttgaacttgtttttgttatacatctttgaagatattttaaccttgtgagcaacgaattggcattttgtggatttcttatgtgtattagtttcctgccaccttattttctcctgaatttattgtttattgtttagaacaatgtgaaacaattggtgtgcatttttcttgttgatgtgattttattttttgtgaactggaacaacttcataacaaaatactgcatgtaagtag

SEQ ID NO: 2859 - DNA, 1800 bp, Fragaria vesca
ccattctcaagctccatacaccctcaaacccatcaaacaccaccagatcctttttctgctcactgcaatagattaccccgcagcaaacctttagccatagcaagttctcatcttttgcaactcatgtgcttctagctcccacgcctcatgccatattgcaagctctttcatgtactttgttcatctatcatgcaatgaaaaccacatcaagtttatgcctccagatcacaagcaacatgtcaccgcagcaggctatcgtccccgcagcaagccaatattactgcaggagagatcctggggaaaacaagcacaaagctccttgaagctctgggcccagttttgaaactcagaagaggtagaaagaggaaatcaagccatgcaagcaaatctagcagcctctgttcaaaatgaccccaacaattgtactatgtacttgcatgtcatgcatacaataaggaatttatgtgtttagaatacttccctcaaatcgtaatagcaaatgcaaaaacatcgactgtaggcaagttgaggcacatgattaaatgcagagaatcaccgtaggcaagtcctcccaaatcgcgagcgggaacacaatcccactaaatcccgccaataaaacccaaaaaattcccaaatccagtccccctatataaaccctaaccctccctctcatttctctctcacaaaagaaagtaagaaaccctaaatctctcatttctcgccggaaacgatgttggagctccgattggtccagggctcgcttctcaagaaggttctggagtccatcaaggacctggtcaccgacgccaacttcgactgctccgccaccgggttctccctccaggccatggactccagccacgtcgccctcgtcgctctgcttctcagatctgaaggcttcgagcactaccgctgcgaccggagcatctccatggggatgaacctcggcaacatgtccaagatgctcaagtgcgccggcaacgatgacatcgtcaccctcaaggctgacgacggcagcgataccgtcaccttcatgtttgagagccccacacaagataaaatttctgattttgagatgaagctgatggacatcgacagtgagcaccttggaattccagaggcagaataccatgctattgttaggatgccttctgctgagtttgccaggatttgcaaagatctcagcggcattggtgatactgttgtgatttctgtgacaaaggaaggagtcaagttctctacaagaggggatatcggcactgctaatattgtctgtagacagaacactactgttgacaagcctgaggaagcaacaatcatagagatgactgagccagtttcattgacatttgctctgaggtacatgaactccttcacaaaagcatcccccttgtcaaacacagttaccatcagcctctcttcggaactgccagttgtggttgagtacaagattgctgagatgggctacataaggttctacttggctccaaagatagaagaggatgaagaagagacaaagcctcaagtttgaaccttatgccactgcacaggcctcctcttagttgacttgattgtgcttttaaaaatccatgtacaggatttgcttaaacaatttctgtttgaggttttccctatctctgtgattgagtaaagcatctctgtagttacagaagtattctaattcattaggtagtgggtactatcttcttgcctttcaattgaaaacaatgttgtttgttctgtttttgggttctacttcttggattcatctgattttatcattgatggttatataatcca

SEQ ID NO: 2860 - DNA, 1173 bp, Tripterygium wilfordii
aaaccctaacgaatccaaacgcagaaaaaccttgaaagcaaagatgctagagcttcgtctcgtgcaaggttcccttctcaagaaagtcttggagtcgattaaggacttggtgaatgatgccaactttgactgctcggcgaccgggttctcgcttcaggccatggactccagccacgttgctctggtggctctgcttctcagatccgagggttttgagcactaccgttgtgaccggaacctctccatgggcataaatcttggtaacatgtccaagatgcttcggtgtgctggaaatgatgatatcatcacgattaaggccgacgatggcagcgacactgttactttcatgtttgaaagtccaacacaagacaagatatcagactttgagatgaaactgatggacattgatagtgaccaccttgggattccagaggctgaataccatgctattgttagaatgccttctgcagagtttgctaggatttgtaaagatctcagcagcattggtgacactgttgtgatctccgtgacaaaggaaggcgttaagttctccacaagaggtgacattggagctgcaaatatagtcttgaggcagaacacaacagtggacaagccagaagaagctacaattatagagatgaatgagccagtgtctttgacgtttgcattgaggtacatgaactcctttactaaggctactccattgtcaagcacggttacaataagcttatcgtcagaactgcctgttgtggttgagtataagattggagaaatgggttatatacggttttatttggctcctaagatcgaagaggatgaagatgagacaaagcccggaatttgaatgtcttcttgcatacaagcttaccttagtttttcatttgtaaccatcaatattgtggatttttaggtggattgccaatttgtaggatgcatcatatgtgacttccactagactgcatgtggtaagagagttttagattttcttcaagcccttatctttttcttccgcttcttgttacgctagcaaccatcctctatattttcagacctcctttaaggtttgtaggtgatttttttatgctttttggagctttctccaaccatatggtagtgttgtgcaaggtgctttgaacttttttctctatgttctgtaaaaattgtgcttcattt

SEQ ID NO: 2861 - DNA, 1171 bp, Panax ginseng
cctgctctcccactctttttccttcaaaccctaaccctaatttccccagaaagcagtccaattctcacaaaaatgttggagctgaggctagtccaagggagtcttctcaagaaggtgatggattccatcaaagacctcgtcaatgacgccaatttcgactgctcggccaccggattttccctccaagcaatggattcgagccacgtggcgctggtgtcgctgcttcttagatcggagggttttgagcattatcggtgtgacaggaacatttccatggggatgaatatgggtaatatgactaagatgctaaagtgcgccggtaatgatgatataattaccattaaggccgatgatggaagtgatactgtcaccttcatgtttgaaagccccacacaagataagattgctgactttgagatgaaactcatggacatcgatagtgagcatcttggtataccagaagcagagtaccatgctattgttcggatgccttcagctgagtttgcgaggatctgtaaagatctcagtagtattggtgacacagttgttatctctgtgaccaaggaaggtgtaaagttctctacaagaggtgatattggaactgcaaatattgtctgcaggcaaaataccacagtagataagccagaggaggctacaattatagagatgaatgaaccagtctcgttgacatttgcactgaggtacatgaattctttcacgaaggcaagtcccttgtcaagcacagtcacaataagtttatcttctgagcttcctgttgtggttgagtacaagattgctgaaatgggttatataaggttctacttggcacccaagatagaagaggatgatgatgaaaacaagccctaaagttgatgtttgctggtgataacagttatccaattttaggtgtgtaggctacaatgtgtcaatgtgcgccttctcatgcattatttgaagatttcactgatgcatgatagcttctcactgtctagaaattggtagatctcaagattttcagtcttaatgtttaggaaatgaaaccgtgttgaatttctctatccttttctttttaaatccttgaccttttctttatgatgtatgctgatcattttctctatgttcacgccttcaacagcaatcttttctggtttaatatgccttttccccccaa

SEQ ID NO: 2862 - DNA, 1191 bp, Mimulus guttatus
cctaaccccaatttcccctccaaaaattgcactcaccgaacccccaatttcagtccggcgaagaaacgaaatcaggcgtttgattaattgtgattaaaaaaattgaagagagatgttggaactgaggctggtgcaggggagcttgctgaagaaggttctggaagcggtgaaggatctggtgaacgatgcgaatttcgactgctccgccaccggattctcccttcaggccatggattccagccacgtggcgctggtggcgcttctgctccggtcggagggtttcgagcactaccgctgcgaccgcaacatctccatgggtatgaacctcggtaacatggccaagatgttgaagtgcgccggaaacgatgacatcatcacactcaaggctgatgacggcagcgatgttgtcacttttatgtttgaaagccctactcaagacaagattgcagatttcgagatgaagcttatggatatcgacagcgagcatcttggaattcccgaagctgagtaccatgccatagtcagaatgccgtcttccgagtttgcaagaatttgtaaagatcttagcagcatcggtgacacagttgtgatttctgttacaaaggaaggtgtaaagttctcaacaagaggagatatcggaactgcaaatatcgtctgcaggcaaaacaccactgtcgacaagccagaggaagcaactgtgatagaaatgaacgagccagtgtctttgacctttgcactgaggtacttcaactcgttcacaaaggcaactccgttgtcgaacactgtaacattaagcttgtcttcggagcttccagtggtggttgagtacaagattgcggaaatgggctatatcaggttttacttggcgcccaagattgaagatgatgatgaagatgccaaaccttgagattcattattcgagtgtttcttttccttggtcgtagttaaattcgcaagccttgtaggtcttgtatatctgtttcttctgcattttcttgatgtaattgtcgacactatgtttgatttccttggtgtttttcgaacactgttcttatgctgctactgcttatgctctagaaagtaagaaggaagtattgcaattagagctgcattgtttgatttgtattagtgatgatgccttggcttctttttgtcaaattctgtgattagagtgaatttttctttattgaa

SEQ ID NO: 2863 - DNA, 947 bp, Raphanus sativus
  misc_feature (39)..(39): n is a, c, g, or t
  misc_feature (165)..(165): n is a, c, g, or t
  misc_feature (169)..(169): n is a, c, g, or t
  misc_feature (172)..(172): n is a, c, g, or t
  misc_feature (174)..(174): n is a, c, g, or t
  misc_feature (192)..(192): n is a, c, g, or t
  misc_feature (203)..(203): n is a, c, g, or t
  misc_feature (207)..(208): n is a, c, g, or t
  misc_feature (210)..(210): n is a, c, g, or t
  misc_feature (246)..(246): n is a, c, g, or t
  misc_feature (318)..(318): n is a, c, g, or t
  misc_feature (363)..(363): n is a, c, g, or t
  misc_feature (402)..(402): n is a, c, g, or t
  misc_feature (582)..(582): n is a, c, g, or t
  misc_feature (711)..(711): n is a, c, g, or t
  misc_feature (717)..(717): n is a, c, g, or t
  misc_feature (720)..(720): n is a, c, g, or t
  misc_feature (738)..(738): n is a, c, g, or t
  misc_feature (777)..(777): n is a, c, g, or t
agctctgatactacgaaaatgttggagctacgtcttgtncagggctctctgctgaagaaggttctagaatcgatcaaggatctcgtcaacgatgccaacttcgactgctccagcaccggcttctccctccaagccatggactccagccacgtggcgctcgtctcnctcntgntnagatccgaaggcttcgancactacaggtncganngnaacctctccatggggatgaatctcggcaacatgtcnaagatgctcaaatgcgccggaaacgatgacatcatcaccatcaaagctgacgacggcggcgacaccgtcacnttcatgttcgagagtcccaagcaagacaagattgcagattttganatgaagctgatggatatagacagtgagcatctgggtatncctgatgctgaataccagtccattgtgaggatgccttccaatgagttctcaaggatttgcaaagatctcagtagcattggtgacacagttgtgatctctgtgactaaagaaggagttaagttttctactgctggtgacattgggacagctaacattgtgttaagacagaacacaactgtngacaagccggaagatgcaattgtgatagagatgaaggaaccagtgtcactctcatttgccctgaggtacatgaattccttcacaaaggcaactccgttgtcagacacggtgacgatcagcttatcgtcngagctnccngttgtggtggagtataangtggctgagatgggttacattcgttactacttggctccnaagattgaagaagatgaagaagacaccaaggcctaagacccctttgtatccagaactttttctgtccgtcctaaaatgtccaagattcatgatgtttttgtgtgattccattaaattaccctttagaatcagttgttttgtttgacttggtatgttctaatgacatgttt

SEQ ID NO: 2864 - DNA, 992 bp, Brassica napus
gcttccccaaaacctagacaatcgattcggattccaaaagctctgattaatccgaaaatgttggagctacgtctcgtgcagggctctctcctgaagaaggttctcgaatcgatcaaggatctcgtcaacgacgccaacttcgactgctccaccaccggcttctccctccaagccatggactccagccacgtggcgctcgtctccctcctgctcagatccgaaggcttcgagcactaccgctgcgaccgtaacctttccatggggatgaatctcggaaacatgtcgaagatgctcaaatgcgccggaaacgacgacatcatcaccatcaaagccgatgacggcggcgacaccgtcaccttcatgttcgagagtcccaagcaagacaagattgcagattttgagatgaagctgatggatatagacagtgagcatttggggatacctgatgctgagtatcattcgattgttaggatgccgtctaatgagttctctagaatctgcaaagatctcagtaccatcggtgacactgttgtgatatctgtgactaaagaaggggttaagttctctactgctggtgacattgggacagctaacatgtgttgagacagaacacaactgtgacaagccggaagatgcgattgtaatagagatgaacgagccggtgtcactctcgtttgccttgaggtatatgaattccttcacaaaggcgactcctttgtcagacacggtgacgatcagcttatcgtcggagctgccagttgtggtggagtataaggtggctgagatgggttacattcgttactacttggctcctaagattgaagaagatgaagaagacaaggcttaagatcccttttgtacccagagcttcttctgttcttactaaaatgtccaagattcagtcatgatgattatgatgttttcccgtttaatttccctctagaatcagttgttttgtttgacttgttatgttctaaaatgatatgtttggt

SEQ ID NO: 2865 - DNA, 773 bp, Centaurea maculosa
ggagagatgttggagctgaggctagttcaggggagtctcctgaagaaggtgatggagtccatcaaggacctggtcaacgacgccaattttgactgctctgccaccgggttttctcttcaggccatggactccagccacgtggcgctggtctccctccttctcagatcggaagggttcgaacactaccggtgtgatcggaacctgtccatgggcatgaatctcggtaacatgaccaagatgctaaagtgcgccggaaatgatgacatcatcactatcaaggccgacgatggtagcgataccgttactttcatgtttgaaagccctactcaagacaagattgctgattttgagatgaaacttatggacattgatagtgagcaccttggaattcctgaagcagagtaccatgccattgttcggatgccttcatccgagtttgcaaggatatgcaaagatctcagcagtattggtgatacagttgtaatttctgtgaccaaggaaggtgtgaagttctcaacaagaggtgatattggaactgcaaatgttgtttgtaggcagaacaccaccgtagataagccagaggaggcgacaatcattgagatgaacgaaccagtatcattgacgtttgcattgaggtacatgaactcgtttacgaaagcaactccattgtcgaacacggtgacaatcagcttgtcttcagagcttcctgtggtggtggagtacaagatagctgagatgggttatatcaggttctatttggctcctaagataga

SEQ ID NO: 2866 - DNA, 990 bp, Chenopodium quinoa
tcttccctctttccctctttttctcccatttcaaaccctaatttcatctcaaaccctaaatcccaaaaaatgttggaattacgattagttcaaggaagtcttctgaagaaggtaattgaatcgatcaaagatttggtgactgatgccaactttgattgttcagcgactggtttctctctccaagctatggattcaagccatgtcgcactcgtcgcacttttgctacgagctgagggtttcgagcattacaggtgcgacaggaatatctcaatggggatgaatcttactaacatgtctaaaatgcttaagtgttctggaaatgatgatattatcactattaaagctgatgatggaagtgatactgttactttcatgtttgaaagccccaaccaggataaaattgctgattttgagatgaagctgatggacattgacagcgagcatcttggaattcctgaagctgaataccatgccattgtgagaatgccttcagctgaatttgccagaatttgtaaagatttgagcagtattggtgacacagttgtaatctctgttaccaaagaaggtgttaagttttccacgagaggtgacattggagctgcaaacatcgtctgcagacagaacacaacagttgacaagcctgaagaagccacagttatagagatgaacgagcctgtgaatttgacctttgcactgcgatacatgaactcttttaccaaggcaacacccctctcgaacactgtcacactcagtttgtcttcagagcttcctgtcgtggttgaatacaagattgcagagatgggttacattcggttctacttggctcccaagattgaagaagatgagaatgaataatgaagttagaatatctagtcttctacctgttgcttcttgctgtaaggcttgcctttaatctaggttaatgtttgatttttaccaggatgttctcatgcgttatcttgcctgaatttgttaaagctctgaagacta

SEQ ID NO: 2867 - DNA, 945 bp, Chenopodium quinoa
atccgaatccacccgacacttcctcttcttcttccctctttcccccttttttctcccatttcaaaccctaatttcatctcaaaccctaaatcccaaaaaaatgttggaattacgattagttcaaggaagtcttctgaagaaggttattgaatcgatcaaagatttggtgactgatgccaactttgactgttcagcgactggtttctctctccaagctatggattcaagccatgtcgcactcgtcgcactcttgctacgagctgagggttttgagcattacaggtgcgacaggaatatctcaatggggatgaatcttactaacatgtctaaaatgcttaagtgttctggaaatgatgatattatcactattaaggctgatgatggaagtgatactgttactttcatgtttgaaagccccaaccaggataaaatagctgattttgagatgaagctgatggacattgacagcgagcaccttggaattcctgaagctgaataccatgccattgtaagaatgccgtcagctgaatttgccaggatttgtaaagatttgagcagtatcggtgacacagttgtaatctctgtgacaaaagaaggtgttaaattttccacaagaggtgacattggagctgcaaacattgtctgcagacagaacacaacagttgacaagcctgaagaagccacagttatagagatgaacgagcctgtgaatttgacctttgcactgcggtacatgaactcttttaccaaggcaacacccctctcgaacactgtcacactcagtttgtcttcggagcttcctgttgtggttgaatacaagattgcagagatgggttacattcggttctacttggctcccaagattgaagaagatgagaatgaataatgaatttagaatttttagtcttctacctgttgcttgttgctgcaaggcttgtctttaat

SEQ ID NO: 2868 - DNA, 997 bp, Arabidopsis lyrata
aaacgattctccttcttaactctgataatatctaaagacgacgagatgttggagctacgacttgttcagggctcgttgttgaagaaggttctagaatcaatcaaggatctggtgaacgatgcgaatttcgactgctccagcactggcttctcgctccaagctatggattcgagtcacgtggcgctggtgtctctcttgctaagatccgaaggcttcgagcactacagatgcgacaggaatctctccatggggatgaatctcggcaacatgtcgaagatgctcaaatgtgccggaaatgatgacatcatcaccatcaaggctgatgacggcggcgacaccgtcaccttcatgttcgagagccccacgcaagacaagattgccgattttgagatgaagttgatggatatagacagtgagcatctgggaatacctgatgctgagtaccactcaatcgttaggatgccgtcgaatgagttttccaggatttgcaaagatctcagtagcattggtgatacagttgtgatctctgtgactaaagaaggggtgaagttttccactgccggtgacattggaaccgctaacattgtgcttaggcagaacacaactgtagacaagccggaagatgcaattgtgatagagatgaaggaaccagtgtcactctcatttgccctaaggtacatgaattccttcacaaaggcaactccattgtcagacactgtgacaatcagcttatcgtcagagttgccagtggttgtggagtataaggttgctgagatgggttacattcgttactacttggctcctaagattgaagaagaagaagacactaatccctaagagccctttgtatccacaatttctcttcatcctaatgttgaagattcattgataatgttggtgtttttttttttgtgagattccattgtatgaccctctagaatcagttgttttcttgacttattatgttttatgataacaaagttcagcataattagtt

SEQ ID NO: 2869 - DNA, 1016 bp, Arabidopsis lyrata
ctttctaaaacccacaaaacgattctccttcttaactctgataatatctaaagacgacgagatgttggagctacgacttgttcagggctcgttgttgaagaaggttctagaatcaatcaaggatctggtgaacgatgcgaatttcgactgctccagcactggcttctcgctccaagctatggattcgagtcacgtggcgctggtgtctctcttgctaagatccgaaggcttcgagcactacagatgcgacaggaatctctccatggggatgaatctcggcaacatgtcgaagatgctcaaatgtgccggaaatgatgacatcatcaccatcaaggctgatgacggcggcgacaccgtcaccttcatgttcgagagccccacgcaagacaagattgccgattttgagatgaagttgatggatatagacagtgagcatctgggaatacctgatgctgagtaccactcaatcgttaggatgccgtcgaatgagttttccaggatttgcaaagatctcagtagcattggtgatacagttgtgatctctgtgactaaagaaggggtgaagttttccactgccggtgacattggaaccgctaacattgtgcttaggcagaacacaactgtagacaagccggaagatgcaattgtgatagagatgaaggaaccagtgtcactctcatttgccctaaggtacatgaattccttcacaaaggcaactccattgtcagacactgtgacaatcagcttatcgtcagagttgccagtggttgtggagtataaggttgctgagatgggttacattcgttactacttggctcctaagattgaagaagaagaagacactaatccctaagagccctttgtatccacaatttctcttcatcctaatgttgaagattcattgataatgttggtgtttttttttttgtgagattccattgtatgaccctctagaatcagttgttttcttgacttattatgttttatgataacaaagttcagcataattagttatc

SEQ ID NO: 2870 - DNA, 1025 bp, Arabidopsis thaliana
ccactttccaaaatagccgcaaacgattctcattgtgaactctgataatatctaagacgacgaaatgttggagctacgtcttgttcagggctcgttgttgaagaaggttctagaatcaatcaaagatctggtgaacgatgcgaatttcgactgctccagcactgggttctcactccaagctatggattcgagtcacgttgctctggtgtctctcttgctaagatccgaaggcttcgaacactacagatgcgacaggaatctctccatggggatgaatctcggcaacatgtcgaagatgctcaaatgcgccggaaatgatgacatcatcaccatcaaggctgatgacggcggcgacaccgttaccttcatgtttgagagccccacgcaagacaagattgctgattttgagatgaagttgatggatatagacagtgaacatctgggaatacctgatgctgagtaccactcaatcgtgaggatgccttccaatgagttttccaggatttgcaaagatctcagtagcattggtgacacagttgtgatctctgtgactaaagaaggcgtgaagttttctactgccggtgacattggaaccgctaacattgtgctcaggcagaacacaactgtagacaagccggaagatgcaattgtgatagagatgaaggagccagtgtctctctcatttgccctgaggtacatgaattccttcacaaaggcaactccattgtcagacacagtgacaatcagcttatcgtcggagttgccagtggttgtggagtataaggttgctgagatgggttacattcgttactacttggctcctaagattgaagaagaagaagacactaatccctaagaccccttttatatccacaatttctcttcattctaaaatgttgaagatttattgacaatgttggtgtttttttttggtgagattcctttgtatcccccctctagaatcagttgttttcttgacttattatgttttatgataacaaagttcagcaaaattagttgtcttg

SEQ ID NO: 2871 - DNA, 1225 bp, Beta vulgaris
cccgtttcgacccgtatcgtgtcgtatcgtatctcttctttcactttcattccccccttttcaaaaccctaaccctagaaatttcttcacacagcaaaatttcaagaaaaaatgttggaattacgattagtacaaggaagtcttctgaagaaggttctagattcgatcaaagatttggttaccgatgcaaactttgattgttcagccactggtttctctctacaagctatggattccagccacgtggcactcgttgcgcttttgctacgagcagagggtttcgagcattatagatgtgataggaatatttcaatggggatgaatcttactaacatggcgaaaatgctaaaatgcgctggaaatgatgatattattactattaaggctgatgatggaagtgatactgttactttcatgtttgaaagtcccaaccaagacaaaattgcggattttgaaatgaagctgatggatattgacagtgagcatttggggattcctgaagctgaataccatgccattgtgaggatgccttcagctgagtttgcccggatttgtaaagatttgagcagtattggtgacactgttgtgatatctgtatcaaaagaaggtgttaaattcttcacaagaggtgatattggagctgctaacattgtttgcagacaaaacacaacagttgataagcctgaagaagccacagtcatagagatgaatgagcccgttacactgacctttgcgctaagatacatgaattctttcaccaaggcaacacccctttcgaacactgtcacactcagcctgtcttcagagcttcctgttgttgtcgaatacaagatcgcagagatggggtacatccggttctacttggctcctaagattgaagaggatgagaatgaatcatagttttagtatcataagtcttcatatctcttgcttcatgctgtaaggtttgttctaatcttagatagttgtttgatttcccagtattttctcatgcgtttttgcatgaatttgtaaaactttgagagcgcaagataatttcttcgctatttattttctttttcaaaatctccaattagtgcatactgtgtttaggctgttataatggttgcgcaagtatgttccatgtttagaagcttcttagtttttagtgtatgtatcggaacaacttcttacagctttgtagtttgttactcgtgtttcataatatttgactactttattaccc

SEQ ID NO: 2872 - DNA, 1049 bp, Cephalotaxus harringtonia
ctcttcagccatgttggaactaaggcttgttcaggggagtctgctgaagaaagtgctggaggccataaaagatttggtcacggacgccaacttcgattgttcggcaacaggattttctctgcaggctatggattccagccacgttgccctggttgccctgctgctaaggtcggagggtttcgagcatttcaggtgcgacaggaatatgtcgatggggataaatttgaataacatgtcgaagatgttgaaatgcgcagggaatgacgatattatcaccattaaggccgacgatggaggggataccgttaccttcatgtttgagagtcccaaccaggataagatatcagactttgaaatgaagttaatggatattgacactgagcatttgggtattcctgagtctgagtaccaagccattgtgaagatgccatcacaagagtttgctcgtatttgcaaggatttgagcagtattggggacacagtcgtaatttctgtgaccaaggaaggagtgaagttctctaccaagggtgatattggaagtgcaaatattgtatgtaggcaaaatacttctgtcgacaagcctgaggaggctacagtcattgaaatgcaggagccagtgtcattgacctttgctttacgatacatgaattcatttactaaggcaacagctttatcaaactcggtgacaatcagcatgtcctcagatctgcctgtggttgtagaatacaaaattgcagatatgggctatattaggttttatttggcccccaagattgaggaggaagaaggcgaatcttagttgtcctttgtattgcttacccactttctcatgggaggttttggttctaagatgcttattttgtcaaggtttatagagggaaacattatatacactttttagcactggtatgcttcttgtgtaagtattctgagtatgcataactgtgtagtttaattttttgccttttgtaaaggtgatctctttgcaacattttgcaagactaagttttaaacagtttttgtaaaaagtatgctcatgtcctctttac

SEQ ID NO: 2873 - DNA, 1314 bp, Distylium racemosum
ccattacaaaacccttcagaccctccttcccgccctacgaaaacctagcaatcccgtccgcatgttctcaatttcccttttgtttgcagaaaccctagcatttttttacacaaatcttagcaacatattcttcacattccttcgtttttcaggaaccctaggaaacttctgtcaccatgttggaactgaggcttgttcaggggagtttgctgaaaaaggtgttggaggccatcaaagatttggtcacggatgccaacttcgattgctcggcgacggggttttcccttcaggccatggattccagccacgtggcccttgtggccctgctgctcaggtccgagggtttcgaacatttcaggtgcgataggaatatctccatggggatgaatttgaacaacatggcgaagatgttgaagtgcgctgggaatgatgacattatcacccttaaggccgatgatgaaggggatacagttaccttcatgtttgaaagtcccaaccaggataagatctcggactttgaaatgaagttaatggacatagacactgaacatttgggtattcccgagtctgagtaccaagcgattgtaaggatgccatcacaagagtttgctcgtatttgtaaagacttgagcactattggtgacacagttgttatttctgtgaccaaggaaggagtgaagttctctacgaggggcgatattggaagtgcaaatattgtttgtaggcagaatacttctgttgacaagcctgaggaggcaacaatcattgaaatgcaggagtctgtgtcattgacatttgcattaaggtacatgaattcattcaccaaggcaacacctttatcaaatacggtgacaatcagcatgtcgtcggatctgcctgttgttgtagaatacaaaattgcagatatgggttatgtcaggttttatttggcccccaagattgaagaggaagaaggtgaatcttagttagtcttctatgttgcttagcctccatttcatggaataagatgcgtatttggtcatgattgaccatataactgagtctaatggatggaaatgtgtcttgcttgagtgctgtcagtggcgctagccggtctcctcgcgtgcttcactcaatggacgctcgtcaaagcgattgagaaggagacgccgaagcttgagaaccaaattatcggcttctcagacaaagtcatcaattcgctgaataacgccagcgagcagtgggccgtcggaactaaccgcatcatcctcgacacgaacgacgatatcaacaaggatgtcttcggctgggtcaacacttccacgactgctgtca

SEQ ID NO: 2874 - DNA, 1101 bp, Pseudotsuga menziesii
catcttctcttgagctctgtcttttccttcatagtcctcttctctctgtattctgtgtggtttgatcttggaatcgcctgcacaatgttggaactaaggctagtgcagggaagtcttctgaagaaggtgttggagtccatcaaggaccttgttaccgatgccaacttcgattgctcggccacgggcttctccctgcaggccatggactcgagccacgttgccctcgtttctctgttgctcagatccgaaggctttgagcactatcgctgcgatcggaacatgtctatggggatgaatctcaacaatatggccaagatgctcaagtgcgcgggcaacgatgacatcattaccatcaaggctgatgatggaggcgacaccgttacctttatgttcgaaagccccaaccaggacaagatttcagacttcgaaatgaagttaatggacatcgacagtgagcatctgggcattccggagtcagagtaccatgccattgttaggatgccatctcaggaatttgctcgtatttgcaaggatctcagctccattggagatactgttgtgatctctgtgagcaaggagggagtgaagttctcaacaaggggagatattggtagtgctaatgttgtgtgtagacaaaacccatctgttgacaagccggacgaggcaacgattattgagatgcaggagcctgtatcactgacatttgctttgagatacatgaactcattcaccaaggcaactcccctgtcaaacacagtgaccatcagcatgtcctcggagttgccagttgttgttgaatacaaaattgcagagatgggttatgttagattttacctggctcctaagattgaggaagaaggtgaaagctaactgccctcttcactgtattgcattgagcagagaggctgtcttagttatagtttcatggtcttcttttgcttgtatctgaacatgtgacggagggatcctaacaagtgcaatggttttatttgctctcatatgcccctccggttttttctcatcttatttaagtaaatcaatgtttccacagttcctatgtaccattttgtgtttggctagtgagttcaaaatataattgag

SEQ ID NO: 2875 - DNA, 1369 bp, Pteridium aquilinum
cccaatcacgcatacatatgcatgtacaaaggcacaggcgctcttctacgcattacacaggctgtctgttagggtttccaagctagctcctgcactctctcttctccctcagaaccagacctcatttgcatcttcgccttcccgcacagcgcagcgcaatcatgttggagctcagattgctgcagggaagcttgctgaagaaggtcctcgaggccatcaaggatcttgttaccgatgctaattttgactgttctgcaacgggcttctctctgcaggccatggactccagtcacgttgctcttgttgccctgcttctacgctctgagggctttgagcattaccgctgtgaccgcaacctctccatgggcatgaaccttaacaacatgtcgaagatgctcaagtgtgctggcaacgacgacatcatcaccatcaaagcagacgatggtggtgacactgtcacattcatgtttgaaagcccaaatcaagacaagatttcagattttgaaatgaagctgatggacatagacagtgaacacttgggtataccagagactgagtatgaggctattatcagaatgccatctcaagagtttgcaaggatttgtcgggatcttagttcaattggagacactgtggtgatctcagcctccaaggagggagttaaattttccaccaaaggtgatataggaagtgcaaacattgtttgtcgccagaatacttcggttgacaagcctgaggatgcaactgttattcagattcagcagcctgtctcattaacttttgctttgcgctacatgaactctttcacgaaggcaactcctctgtcaaacactgtaaccataagcatgtcaagtgagttgcctgttgttgtggagtacaagattgcagagatgggttacataagattctatctggctcccaagattgaggaggacgaagaggtaaactcttagtcaattgtcaaggccaagctgtgcttgagcaagtgcaattggctgctcaccatttactcagcaaaaatgattcagatgtatttttgaagttgaccaatttttctagcttttgatgaaacttgtgccaagagcctctgttgtagttaattaaatgtgctgtaaactgaggggtgagatctatgtgagaatcattcctctgtagtttgtctaagcctactagttaactagcctcgaaatgtcgtatttaattgagttgacttgcagttggagtcgtgcctctgtgcatggtactttattgtctgcccttgtggcaatttgtatggagaatgtgaggaaaattttagtgcaagtgcttacaaaagatagcacaatataatttcaaattggttagaaaaaagaaaaagtaccgaactgcg

SEQ ID NO: 2876 - DNA, 1070 bp, Eutrema halophilum
aaaatcaaggcgtattacatcgattcccgcgaacaccatttcgcaaatcttccttcgaacgctgaccaattttcaacaattccccaggagagaagaagaagatgttggagcttcggttagttcaaggctctctgctaaagaaggttctagaatcagtcaaggatctggtgaacgatgcgaacttcgactgctcgagcacagggttctcgctccaggccatggactcgagccacgtggcgctggtttctcttctcctgagatccgaaggattcgagcactacaggtgcgataggaacctctccatggggatgaatctgggaaacatgtccaagatgctcaaatgtgctggaaatgatgacatcatcaccatcaaggccgacgatggaagcgataccgtcactttcatgttcgagagcccaacgcaagacaagattgcagactttgagatgaaactgatggatattgacagtgagcatttaggaatccctgacgctgagtaccactcaattgtgagaatgccctctggtgaattttccaggatatgcaaagatctcagtaccattggtgacacagttgtgatctctgtgacgaaagaaggggtgaagttttcaacagcaggtgatatcgggacagcgaacattgtactgaggcagaacactactgtagacaaaccggaagatgcaattgtgatagagatgaatgagcctgtgtcactttcattcgcgttgaggtacatgaattccttcacaaaggcgactcctttgtctgaaaccgtgacaatcagtttgtcctcggagttacctgtcgttgtagagtacaaggtggctgagatgggttacattcgatactatttggcgcctaagatcgaagaagaagaagacgctaatgcctaacacatttgtttctggctagtgatgatgaatgtctttactttgtagaatctttgtttaagatgtctatctagatttacatgtttggatttactatgtgtgctagatttagctgtttttttttttgggatttactatgggtaatgctagataaccaagtttggcttgatttgcattttg

SEQ ID NO: 2877 - DNA, 1042 bp, Eutrema halophilum
cactaaaccagaggcgggaacaaaataccctaaaattgctaaaataccgccacaaaatcaaggcgtattacatcgattcccgcgaacaccatttcgcaaatcttccttcgaacgctgaccaattttcaacaattccccaggagagaagaagaagatgttggagcttcggttagttcaaggctctctgctaaagaaggttctagaatcagtcaaggatctggtgaacgatgcgaacttcgactgctcgagcacagggttctcgctccaggccatggactcgagccacgtggcgctggtttctcttctcctgagatccgaaggattcgagcactacaggtgcgataggaacctctccatggggatgaatctgggaaacatgtccaagatgctcaaatgtgctggaaatgatgacatcatcaccatcaaggccgacgatggaagcgataccgtcactttcatgttcgagagcccaacgcaagacaagattgcagactttgagatgaaactgatggatattgacagtgagcatttaggaatccctgacgctgagtaccactcaattgtgagaatgccctctggtgaattttccaggatatgcaaagatctcagtaccattggtgacacagttgtgatctctgtgacgaaagaaggggtgaagttttcaacagcaggtgatatcgggacagcgaacattgtactgaggcagaacactactgtagacaaaccggaagatgcaattgtgatagagatgaatgagcctgtgtcactttcattcgcgttgaggtacatgaattccttcacaaaggcgactcctttgtctgaaaccgtgacaatcagtttgtcctcggagttacctgtcgttgtagagtacaaggtggctgagatgggttacattcgatactatttggcgcctaagatcgaagaagaagaagacgctaatgcctaacacatttgtttctggctagtgatgatgaatgtctttactttgtagaatctttgtttaagatgtctatctagatttacatgtttggatttactatgt

SEQ ID NO: 2878 - DNA, 1066 bp, Eutrema parvulum
ttcagtcctctttccaaaaaaaaccttaaaccctagacaagcgattcgtattccgagccctgagatttcccttaggaaagcacatatgttggagctacgtcttgttcagggatcactgttgaagaaggtccttgaatcaatcaaggatcttgtgaacgatgcgaacttcgactgctccagcactgggttctcactccaagccatggattcgagtcacgtggcgctggtctctctcttgctaagatccgaaggcttcgagcactacaggtgtgacaggaatctctccatggggatgaatctcgggaacatgtcgaagatgctcaaatgtgccggaaatgatgacatcatcactatcaaagctgatgacggcggcgacaccgtcaccttcatgttcgagagtcccacgcaagacaagattgcagatttcgagatgaagctgatggacatagacagtgagcatttgggaatacctgatgctgagtaccattccattgtgaggatgccgtcaaatgagttttccaggatttgcaaagatctcagtagcatcggtgacacagttgtgatctctgtgactaaagaaggggttaagttttctactgctggtgacattgggacagctaacattgtgctaagacagaacacaactgtagacaagccggaagatgcaattatgatagagatgaacgagccagtgtcactctcatttgctctgaggtacatgaattccttcacaaaggcaactccattgtcagacacaatgacaatcagcttatcatcggagttgccagttgtggtagagtataaggtagctgagatgggttacattcgttactatttggctcctaagattgaagaagaagaagacactaaggcctaagacacctttttatccacagcttactctattcatcctaaaatgtccaagattccttgatgatgtttttgtgtgattccattgtatgcccttctagaatcagttgtgttcttgacttcttatgctttacgataacaagtttgtcaaaattagtgatctttgcagctctactgagtactgactcatcaacaa

SEQ ID NO: 2879 - DNA, 1058 bp, Eutrema parvulum
ccttaaaccctagacaagcgattcgtattccgagccctgagatttcccttaggaaagcacatatgttggagctacgtcttgttcagggatcactgttgaagaaggtccttgaatcaatcaaggatcttgtgaacgatgcgaacttcgactgctccagcactgggttctcactccaagccatggattcgagtcacgtggcgctggtctctctcttgctaagatccgaaggcttcgagcactacaggtgtgacaggaatctctccatggggatgaatctcgggaacatgtcgaagatgctcaaatgtgccggaaatgatgacatcatcactatcaaagctgatgacggcggcgacaccgtcaccttcatgttcgagagtcccacgcaagacaagattgcagatttcgagatgaagctgatggacatagacagtgagcatttgggaatacctgatgctgagtaccattccattgtgaggatgccgtcaaatgagttttccaggatttgcaaagatctcagtagcatcggtgacacagttgtgatctctgtgactaaagaaggggttaagttttctactgctggtgacattgggacagctaacattgtgctaagacagaacacaactgtagacaagccggaagatgcaattatgatagagatgaacgagccagtgtcactctcatttgctctgaggtacatgaattccttcacaaaggcaactccattgtcagacacaatgacaatcagcttatcatcggagttgccagttgtggtagagtataaggtagctgagatgggttacattcgttactatttggctcctaagattgaagaagaagaagacactaaggcctaagacacctttttatccacagcttactctattcatcctaaaatgtccaagattccttgatgatgtttttgtgtgattccattgtatgcccttctagaatcagttgtgttcttgacttcttatgctttacgataacaagtttgtcaaaattagtgatctttgcagctctactgagtactgactcatcaacaagctaatttcaattca

SEQ ID NO: 2880 - DNA, 1070 bp, Lotus japonicus
actctcatttcattttcccaccaattttcccgagaaaatcgaaaccctcaaaaccctagctccgtgagaagaaaccgccaccgccagatcaagatgttggaactccgtttggttcaaggttctctgctgaagaaggttctggagtcaatcaaggagctggtcaacgatgccaacttcgattgctccaccaccggattctccctccaggccatggactccagccacgtcgcactggtggcgctgctgctccgttcggaggggtttgaacactaccgctgtgaccgcaacatttccatgggtatgaatctcagcaacatgtctaagatgctcaaatgcgctggaaatgatgatatcatcaccatcaaggccgatgatggcagtgacactgtcaccttcatgtttgaaagccctacacaagacaagatttctgattttgaaatgaagctgatggacattgatagtgagcaccttgggattccagaggcagaataccatgccattgttaggatgccatctgctgagtttgctaggatctgcaaagatctcagtagcattggtgacactgtggtcatttctgttaccaaggaaggtgtgaagttttccaccaaaggagacattgggactgcaaatatagtctgtaggcagaatacttctgtggacaagcctgaagaagccacagtcatagagatgaatgagcctgtctcattgacctttgctttgcgatacatgaactcattcacaaaagcaacaccattatctagtactgtcaccattagcctgtcaagtgagcttccagttgttgttgagtacaagattgcagagatgggatatgttcggttctacttggctcccaagatagaggaggaggaagaagagactaaacctcaagtttagttttggtgttgcattgtttgtttctgaatttggttgtagttgtaggatgcttttatacatttcctatccagtacatgtaactgtttttccctaaatcaatggtcaatttctgaattttggggagagccatattggatcctgcactattttgccttattgttgcttagaaccatctt

SEQ ID NO: 2881 - DNA, 1407 bp, Prunus mume
gtcgagcgcgggaacacaattccacgaaatcccgccaattgaaacccaaaattcccaaacacggttcatttccctcctccactatataaacccttgccccataccccacccactcaaaccctcaaaatctcctgcacctattttccccccaaaaggaaaccctagccccaatcaagaatccgtacacctccacgacccggaaacgatgttggagctccgactggttcaggggtcgctgctgaagaaggttcttgagtccatcaaggacctcgtcaacgacgccaacttcgattgctccgccactggcttctccctccaggccatggattccagccacgtggcgctggtggcgctgctgctcagatccgagggcttcgagcactaccgctgcgaccgcaatatctccatgggcatgaacctcaccaacatgtccaagatgctgaaatgcgccggaaatgatgacatcatcaccatcaaggctgacgatggcagcgatactgtcaccttcatgttcgaaagtcccacgcaagataaaatttctgattttgagatgaagctgatggacattgatagtgagcaccttggaattccggaggcagaataccatgctattgttaagatgccttcatctgagtttgctaggatatgtaaagacctcagtggcattggtgatacagttgtgatatctgtgaccaaggaaggtgtgaagttctctacaagaggggatattggcactgctaacatcgtctgtaggcagaacactacagtggacaagcctgaagaagcaacagttattgatatgaatgagccagtttcattgacatttgctctgaggtacatgaattccttcacaaaagcgaccacattgtcgaacacagttacaatcagcctgtcttctgaacttccggttgtggttgagtacaagattgcagagatgggctacatcaggttctacttggctcctaagatagaagaagatgaagatgagacgaagcctgaagtttgagtgttatgccacggcagaggcatatacttgtttgtttacttgaactgcactgtttaaaaatccatgtagaggattttttttcatatacgcttcgatctgaggttttccttgctttctctgtgactgagttggcaaatctgtagtttaggaatcttcaaatctattaggttctgtgttgtaggtttttaattgaaaacattgttctttctcatctccttttccttttttagggttcatgtttgatttgtggttatataatcaaatgaactctgcaaatgctcactgataatggtgcctagtagctatgcgaaggtaaaagtttcatgtataactaaatcatcatatcatctttcattgattttcaaaattgaagaatgatatacagaattacaacaccaaat

SEQ ID NO: 2882 - DNA, 1356 bp, Brassica rapa
agcgggaacaccagataccctaaaatcaaggcttttaatatcgattcccgcgaacccatttcaccatcaaataatctcctccttcagaaagctccagaaccctaaaaccacaatccttcttcgaacaagatgttggaacttcgtttggttcaaggctctctcttgaagaaggttctagaatcggtcaaggatctggtgaacgatgccaacttcgactgctccagcactggcttctccctccaggccatggactccagccacgtagcgctggtgtctcttctcctgagatccgaaggcttcgagcactacaggtgcgacaggaacctctccatggggatgaatctcggcaacatgtccaagatgctcaaatgcgccggaaatgatgacatcatcaccatcaaagccgatgacggcggcgacaccgtcaccttcatgttcgagagccctacacaagacaagattgcggattttgagatgaagctgatggatatcgacagtgagcatttaggaatccctgacgccgagtaccactctattgtgaggatgccttctgctgaattttccaggatatgcaaagatctcagtagcattggtgacacagttgtcatctctgtgacaaaagaaggtgtgaagttttcaacagctggtgatattgggacagccaacattgttctcaggcagaacacaactgtggacaaacctgaagatgcaattgtgatagagatgaacgagcctgtatccctttcattcgcgttgaggtacatgaactccttcacaaaggcgactcctttgtctgataccgtgacaatcagtctttcctcggagttgcctgtcgtggtggagtataaagtggctgagatgggttacattcgctactatttggctcccaagattgaagaagaagaagatactaatgcctaacacgtctctggcttctagatgcagaacctttggaactcgaatgaatgtttttttttctttactaaagtcctttgttaagatgtctgtctgtttggattcagttgttttctagattttctatgttactgcaccgctagattagaaaaacaagttcggctggttttgcaatttgaaaaaaaaaaacatgtttaccactttcttcttgttttgttcttcaaacttgcaaaccgaagacaaaaaagaacaaaatgttactttcaagacgcagaaacctgtctgcttaagaaaaccagactcgaatgcatcgaagcaagaccagaaaaaatttgtaacagttatatatcacataattcacttgtttagagagtttgcctccaatcttctccagcatacacagcttgatccccaagctcttcctcaatccgaagcaactgc

SEQ ID NO: 2883 - DNA, 956 bp, Taraxacum officinale
ggccgggggcttcgatttcctcattttcttcgtttttaaaaagtatctcttattttagtacttgaatctcttgatttcacttttttcagcttaaaaatgttggagctaaggttggttcaggggagtctcctaaagaaggtgatggaatcaatcaaggatctggtaaacgacgccaatttcgactgctcagcaactggattctcgctacaggcgatggactccagtcatgtggcgttggtgtctctcctcctcagatccgaaggcttcgaacattaccgttgtgaccggaacatttccatgggtatgaatttgggcaacatgtctaagatgctaaagtgcgctggaaacgacgatatcattaccctaaaagccgacgatggcagtgataccgtaactttcatgtttgaaagccccactcaggataaaattgctgatttcgagatgaaacttatggacattgacagcgagcaccttggcatccctgaagcagagtatcacgccattgttcgtatgccttcatctgagttcgcaagaatttgtaaagatctcagcagtattggtgatacagttgtaatatctgtcaccaaagaaggtgtcaagttctcaacaagaggcgacatcggaactgcaaatgtagtttgcagacagaacacaacagtagacaaaccagaagaggctactgtgattgaaatgaacgaaccagtgtctttgacatttgcattgaggtacatgaattcatttaccaaagctacaccactgtcaagtactgtcacactcagcctatcttcagagcttccggtggtggttgaatacaaggtagctgagatgggttatttaaggttttacttggctcctaagattgaagaagatgatgaagaaccacattcttgagcagttatactaatgacttttttcataaagagttcatttagaaattaagatttttatgatgggat

SEQ ID NO: 2884 - DNA, 1549 bp, Pinus pinaster
tcgattcttcaaatgcccactcgctgcaattacccgccctcctgttcttcttcatagtataccctcgatatgctgcagccctacacacagagtcccacctgcaccttaaaaaaaccctaagaactctcgaagtccagaaaaacgctcatatccactgccattaaaaaagccaataccctcgaacctccaaaatcacacgtttcgacctcacaatttcacatcctatttcataggtgcagaggactctgctgactctctcattttcttcgatacccgtttgttcgttttcttcgatacacgtttgttcattttcttttcgccatgttggagctaaggcttgtgcaggggagcctgctgaaaaaagtgcttgaagccattaaggatttagttacggatgccaatttcgactgctcggcaacggggttttctctgcaggccatggattccagtcatgtggccctcgtggcccttctgctaaggtcggagggtttcgagcattacagatgcgatagaaatctgtcgatggggatgaatatcaataacatgtccaagatgttgaaatgcgctgggaatgatgatattatcaccattaaagccgatgatggaggagatactgtcaccttcatgtttgaaagccccaaccaggataagatttcagattttgaaatgaagttgatggatattgacactgagcatttgggtatccccgagtctgagtaccaagccattgtaaggatgccatcaccagagtttgctcgtatttgcaaagatcttagcactattggtgacacagttgtcatttcggtcaccaaggaaggagtaaagttttctaccagaggcgatattggaagtgcaaacattgtctgtaggcaaaatacttctgttgacaagcctgaggaggcaacattgattgaaatgcaggagcctgtgtcattaacatttgctctacgatatatgaactcatttacaaaggcatcgcctctatctaacatagtgacgataagcatgtcatccgatctgcctgttgttgttgaatacaaaattgcagatatgggatacgttcggtattatttggcccccaagattgaggaggatggaggagaatcttaagtttactatgcagtgctggcccactttttcttgtaaggttttgggatgcatgattgctcagtttgctgcagtcatctatatgatggggttgtatgaattgaagcattccagatacttctatctatttcttctatacatttggtatagtggggctattaagtatccttgtctgtgtagttaattttgcatttcccggagaaaataaggactttatgctgtatttaccaggaataaacagttcatggttgttgactatgcctgattcctatttcgttggtacattggattttatcttgaaagcttgtgggcttcatatgtactttacaaagttatgaactcatgccaatttacccaaacaaactttaatctgttgaaggcattgttggtgacagagtagtgaatatgaaaatggatcaaaggattttgttaagtttcaaac

SEQ ID NO: 2885 - DNA, 985 bp, Raphanus sativus
  misc_feature (49)..(49): n is a, c, g, or t
  misc_feature (114)..(114): n is a, c, g, or t
  misc_feature (181)..(181): n is a, c, g, or t
  misc_feature (202)..(202): n is a, c, g, or t
  misc_feature (206)..(206): n is a, c, g, or t
  misc_feature (208)..(208): n is a, c, g, or t
  misc_feature (211)..(211): n is a, c, g, or t
  misc_feature (474)..(474): n is a, c, g, or t
  misc_feature (509)..(509): n is a, c, g, or t
ggcttccccaaaccctagacaatcgattcggattctgagctctgatacnacgaaaatgttggagctacgtcttgttcagggctctctgctgaagaaggttctagaatcgatcanggatctcgtcaacgacgccaacttcgactgctccagcaccggcttctccctccaagccatggactcnagccacgtggcgctcgtctcnctcntnctnagatccgaaggcttcgagcactacaggtgcgacagaaacctctccatggggatgaatctcggcaacatgtctaagatgctcaaatgcgccggaaacgatgacatcatcactatcaaagctgacgacggcggtgacaccgtcaccttcatgttcgagagtcccaagcaagacaagattgcagattttgaaatgaagctgatggatatagacagtgagcatctgggtatacctgatgctgaatacgagtccattgtgaggatgcnttccaatgagttctcaaggatttgcaaagatctcngtagcattggtgacacagttgtgatctctgtgactaaagaaggggttaagttctctactgctggtgacattgggacagctaacattgtgttaagacagaacacaactgttgacaagccggaagatgctattgtgatagagatgaaggaaccagtgtcactctcgtttgccctgaggtacatgaattcattcacaaaggcaactccattgtcagacacggtgactatcagcttatcgtctgagctcccagttgtggtggagtataaggtggctgagatgggttacattcgttactacttggctccaaagattgaagaagatgaagaagacaccaaggcctaagacccctttgtatccagaacttcttctgtccgtcctaaaatgtccaaagattcatgatgtttttgtgtgattccattaaattaccctttagaatcagttgttttgtttgacttggtatgttctaatgacatgttt

SEQ ID NO: 2886 - DNA, 915 bp, Taxus baccata
cctcagtctcttctccgttttgtgcagaggatacaccatacccagcatttttccttttcgttttatttttctctcccgtttttgcagccatgttggaactaaggcttgttcagggaagtctgctgaagaaagtgctggagtccatgaaggatttggttacagatgccaacttcgattgctcggcaacaggattttctctgcaggccatggattccagccacgtggccctgattgccctgctgttgaggtcggagggtttcgaacattacaggtgcgacaggaacatgtcgatggggatgaatctgaataatatggccaagatgttgaagtgcgcggggaatgacgatattatcaccattaaggccgacgatggaggggataccgttaccttcatgtttgaaagtcccaaccaggataagatatcagactttgaaatgaagttaatggacattgacactgagcatttgggtattcccgagtctgaataccaagcaattgtgaagatgccgtcgcaagagtttgcccgtatttgcaaagatttgagcactattggtgacacagttgtcatttctgtgaccaaggaaggagtgaagttctctaccaagggtgatattggcagtgcaaatatcgtctgcaggcaaaataattctgttgacaagccggaggaggcaacagtcattgaaatgcaggagcctgtgtcattgacctttgctttacgatacatgaattcattcaccaaggcaacatctttatcaaactcagtgacaatcagcatgtcctcagatctgcccgtggttgtagaatataaaattgcagatatgggctacatcagattttatttggcccccaagattgaggaggaagaaggggaatcctagttgcctttgtattgctcgttcacttttcatgggaggt

SEQ ID NO: 2887 - DNA, 1406 bp, Eutrema parvulum
ccagccactaaaccagaggcgggaacgaaataccctaaaatggctaaaataccgccacaaaatcaaggcgtttaatatcgattcccgcgaacgcattttagcaaattcttccttctttcttcagagaagcttaagaaccctaaataaaaccttttaaccgaacgattcgataattctcccggaggagaagaaaagatgttggagcttcgtttagttcaaggctctctgttgaagaaggttctagaatcggtcaaggatctggtgaacgatgcgaacttcgactgctcgagcactgggttctcgctccaggccatggattcgagccacgtagcgctggtgtctcttcttctgagatccgaaggtttcgagcactacaggtgcgataggaacctctccatggggatgaatctcggcaacatgtctaagatgctcaaatgtgccggaaatgatgacattatcaccatcaaagccgatgatggaagcgacaccgtcactttcatgttcgagagccctacacaagacaagattgcagactttgagatgaagctgatggatatcgacagtgagcatttaggaatccctgacgctgagtaccactcaattgtgaaaatgccctctggtgaattttccaggatatgcaaagatctcagtaccattggtgacacagttgtgatttctgtgacaaaagaaggtgtgaagttttcaacagcaggtgatatcgggacagccaacattgtactgaggcagaatactactgtagacaaacctgaagatgcaattgtgatagagatgaatgagcctgtatcgctttcatttgcgttgaggtacatgaactccttcacaaaggcgactcctttgtctgaaaccgtgactatcagtttgtcctcggagttacctgtcgtcgtggagtataaagtggctgagatgggttacatccgatactatttggcgcccaagattgaagaagaagaagacacaaatccctaaaaaaatctgcttctggcttcagacccttaggaacttgtgctcggtgaatgtttttctgttctttgctggtatccttcatgaagatgtctgtttgtctggatttactatgttaatgcaacgctagattaggtcacgggtaaaacaagtttggctggttttgctatttgaagaaagaaaaaccgtttaacactctttcttcttctttttgtttttcaaattcgctgaaccaaaaaaaaatgttattttcaaagacacaataatctgtatgtgtaagaaaatcagatcgagagaattggagtaaaacgagaaaaatgaaacagttctatatcacagatgcatttgattagagagattgcctccagtcttctccagcatacacagcttgatccccaagctcttcctcaatccgaagcaactgc

SEQ ID NO: 2888 - DNA, 1123 bp, Malus domestica
ccctaaccccccactccctcgctcaaaccctccaaatctccccctcgaattctccaaatcgaacaacccgtacgcctccgacgacccggaaacgatgttggagctccgactggtccagggctcgctgctgaagaaggtgctggagtccatcaaggacctggtgaacgacgccaacttcgactgctcctcctccggcttctccctccaggccatggactccagccacgtggcgctcgttgccctcctcctcagatctgagggcttcgagcactaccgctgcgaccgcaacatgtccatgggcatgaacctcggcaacatgtccaagatgctcaggtgcgccggaaatgatgacatcatcaccatcaaggctgacgacggcagcgacaccgtcaccttcatgttcgaaagccccacacaagataaaatttctgattttgagatgaagctgatggatattgatagcgagcaccttggaattccggaggcagaataccagtctattgtgacaatgccctcttctgagtttgctagaatatgtaaagacctcagtggcattggtgatactgttgtgatatctgtgaccaaggaaggagtgaagttctctacaagaggggatattggcactgctaacattgtctgcaggcagaacactactgttgacaagcctgaagaagcaactgtcataaatatgagcgagccagtgtcgttgacatttgctctgaggtacatgaactcgttcacaaaggctaccacattgtcgaacacggtcacaatcagcttgtcttctgaactcccagttgtggttgagtacaagattgcagagatgggctacattaggttctacttggctcccaagatagaagatgacgaagacgaaaccaagcctgaagtttgagtgttatgccaaatcatcatcggcacactcttgctgacttgaactgctctgtttaaaaatccatgtagaggattcttaatacgagttttttctcgctttctctgggacaatgagttagcaaatctgtagtttaggagttttcgaatccgtcaggtaaagatgttgtaggttttctattgaaaacaatgttatttctcccatttcttttctctttatgatttctgggtt

SEQ ID NO: 2889 - DNA, 895 bp, Cucumis sativus
ccagccccagccccagccccagccccacctctccaatttctctcgacaatgttggaacttcgtcttgttcagggttctctcctcaagaaggtcttggaatcgatcaaggatttggttaacgatgccaacttcgactgttcggccactggattctcgctccaagccatggattcgagccatgtcgcactggttgctcttctccttcgagcggagggcttcgaacattatcgctgcgacagaaacatttccatgggaatgaacttgaataacatgtcgaaaatgctcaagtgtgctggtaacgatgatatcattacaatcaaggccgatgacggcagtgatactgtcactttcatgtttgaaagccctactcaagataagatttctgatttcgagatgaaattgatggacatcgacagtgagcatcttggaattccagatgcagagtaccatgctattgttaggatgccttctgttgagtttgctagaatttgcaaagatctcagcagcattggtgataccgttgtaatttctgtgacaaaggagggtgtaaaattctcaacaagaggtgatattggatctgccaatattgtttgcaggcagaataccactgtagacaagcctgaagaagcaacagtaatagagatgaatgagccggtttctttgacgtttgctttacggtatatgaattccttcactaaggcgacacccctttcaaacacggtcaccatcagcttgtcttctgacctacctgttgttgtcgagtacaaaatcgcagagatgggatatgtaaggttttacttggctcccaaaatagaagaagatgaggatgacacaaagcctcaagcctaaatatatttagtaaatccgttaggatatttcctaactttattttttc

SEQ ID NO: 2890 - DNA, 971 bp, Pisum sativum
ccaccgtcaagatgttggaactccgtctcgttcaaggttcacttctcaagaaggttctggaatcgatcaaggagttggtgaacgatgcgaacttcgactgttcgtctactggtttctctctgcaagctatggattccagccacgttgctcttgtggctctgcttctcagatcggaggggtttgagcattatcggtgtgaccggaacctttccatgggtatgaatctaaacaacatggccaagatgctcaagtgtgctggtaatgatgatatcattactattaaggctgatgatggaagtgacactgttaccttcatgtttgaaagccctacccaagataagatttctgattttgagatgaagctgatggacattgatagcgaacaccttggaattccggaggctgaatatcatgccattgttaggatgccatcagctgagtttgctaggatttgcaaagatctaagtagcattggtgatactgttgtcattgcggtttccaaagagggtgtcaagttttccaccaaaggagatattggaagtgcaaatatagtttgcaggcagaatactactgtggacaagcctgaagaagctacagtcatagagatgaatgagcctgttgccttgcagtttgccctgagatacatgaactcttttacaaaagcaacccctctgtccagttcagttactatcagtctgtcaaatgagctgccagttgttgttgagtacaagattgctgagatggggtatgttcggttctatttggctcccaaaatagaggaggacgaagaagaaaccaaaccacaagcttagtctgatattaggttttgaatttggacttagatgtaggatgttttatacattactactgtttggcactctatgcatttgaaagacgtgtaagcttcattgtcacattattttctacttctacaagaacaattctaaacaatgaatgagtggttatttttc

SEQ ID NO: 2891 - DNA, 1163 bp, Cajanus cajan
aacccttctccctcccgctacttcttcacatttcatttccgaatctcgaacccgcgcgaaaccctaaccctaacccaattacactctcgatccacgatgttggaactccgtctcgtgcaaggttcccttctcaagaaggttctcgatgccatcaaggagctcgtcaacgacgccaacttcgattgctcctccaccggcttctcccttcaggccatggactccagccacgtggcgctcgtcgccttgcttctccgatcggaggggttcgagcactaccgctgcgaccgcaacatctccatgggcatgaacctcggcaacatggcaaagatgctcaagtgcgctggcaacgatgacatcatcactattaaagctgatgacggtggtgataccgtcactttcatgtttgaaagccctacgcaagataagatttctgattttgagatgaagttgatgtccattgacagtgaacatcttgggattccggaggcagagtatcatgccattgttaagatgccatcttctgagtttgctagaatctgcagggatcttagtagcattggtgacactgttgttatttcggtgactaaagagggtgtcaagttttccaccaaaggagatattggaactgctaatatagtttgcaggcagaatacttcggtagacaagcctgaggaagctacattgattgagatgaatgaacctgtgtccttgacgtttgccctgcggtacatgaactctttcaccaaggcaacaccgttgtctaatacagttacgattagtctgtcaaatgagctgccggtagtggttgagtacaaaattgctgagatgggttatgttcggttttatttggctccaaagatagaagaggatgacgaagaaacaaaacctgaagtttagtttatttttgaatggactccgaggatagaagaggatgaagacacaacctgaagtttaatctatttctgaatgaattgggatgtaaggattttaatacggttgcacttaggatgctgttatatattttttgtttgaagatattttaactgttcaaaaaatttgctaatttatgaattctgtagaagagatgtattgtactattgtttcttcaccaccttgttttcccattttattggtaattaattcagtgtgaaacaattggtgta

SEQ ID NO: 2892 - DNA, 1140 bp, Prunus persica
atctcctgcacctatttcccccccaaaaggaaaccctaaccccaatcaagaatccgtacacctccacgaccgggaaacgatgttggagctccgactggttcaggggtcgctgctgaagaaggttcttgagtccatcaaggacctcgtcaacgacgccaacttcgattgctccgccactggcttctccctccaggccatggattccagccacgtggcgctggtggcgctgcttctcagatccgagggcttcgagcactaccgctgcgaccgcaatatctccatgggcatgaacctcaccaacatgtccaagatgctgaaatgcgccggaaatgatgacatcatcactatcaaggctgacgatggcagcgatactgtcaccttcatgttcgaaagccccacgcaagataaaatttctgattttgagatgaagctgatggacattgatagtgagcaccttggaattccggaggcagaataccatgctattgttaagatgccttcagctgagtttgctaggatatgtaaagacctcagtggcattggtgatacagttgtgatatctgtgaccaaggaaggtgtgaagttctctacaagaggggatattggcactgctaacatcgtctgtaggcagaacactacagtggacaagcctgaagaagcaacagttattgatatgaatgagccagtttcattgacatttgctctgaggtacatgaattccttcacaaaagcgaccacattgtcgaacacagttacaatcagcctgtcttctgaacttccggttgtggttgagtacaagattgcagagatgggctacatcaggttctacttggctcctaagatagaagaagatgaagatgagacgaagcctgaagtttgagtgttatgccacggcagaggcatatacttgtttgtttacttgaactgcactgtttaaaaatccatgtagaggattttttgtcatatacgcttcaattcgaagttttccttgctttctctgtgaatgagttggcaaatctgtagtttaggaatcttcaaatccattaggttctgtgttgtaggtttttaattgaaaacattgttctttctcctctccttttcctttttttgggttcgtgtttgatttgtggttatataatc

SEQ ID NO: 2893 - DNA, 922 bp, Nicotiana tabacum
cccccgggctgcaggaattcggcacgagccaccgtcaagatgttggaactccgtctcgttcaaggttcacttctcaagaaggttctggaatcgatcaaggagttggtgaacgatgcgaacttcgactgttcgtctactggtttctctctgcaagctatggattccagccacgttgctcttgtggctctgcttctcagatcggaggggtttgagcattatcggtgtgaccggaacctttccatgggtatgaatctaaacaacatggccaagatgctcaagtgtgctggtaatgatgatatcattactattaaggctgatgatggaagtgacactgttaccttcatgtttgaaagccctacccaagataagatttctgattttgagatgaagctgatggacattgatagcgaacaccttggaattccggaggctgaatatcatgccattgttaggatgccatcagctgagtttgctaggatttgcaaagatctaagtagcattggtgatactgttgtcattgcggtttccaaagagggtgtcaagttttccaccaaaggagatattggaagtgcaaatatagtttgcaggcagaatactactgtggacaagcctgaagaagctacagtcatagagatgaatgagcctgttgccttgcagtttgccctgagatatatgaactcttttacaaaagcaacccctctgtccagttcagttactatcagtctgtcaaatgagctgccagttgttgttgagtacaagattgctgagatggggtatgttcggttctatttggctcccaaaatagaggaggacgaagaagaaaccaaaccacaagcttagtctgatattaggttttgaatttggacttagatgtaggatgtttttatacattactactgtttggcactctatgcatttgaaa

SEQ ID NO: 2894 - DNA, 993 bp, Triphysaria pusilla
ttcccaccaaaaccacagagctttaaaccggaaagatgttggagctcaggctagtgcaggggagtttgttgaagaaggttctggattcggttaaggatctagtgaacgatgccaattttgactgctcggcgaccggattctctctacaggccatggactcgagccacgtggctttggtgtcgcttcttctcagatcggaagggtttgagcactacagatgcgaccgcaacctctcgatgggcatgaacctcggcaacatggccaagatgctcaaatgcgccggaaacgatgatatcatcactatcaaggctgatgacggcggcgacaccgtcaccttcatgtttgagagccccactcaagataagattgcagattttgagatgaagctcatggatattgacagtgagcatcttggaatcccagaggcagagtaccacgctattgttcggatgccgtcttctgagtttgctagaatttgtaaagatctgagcagtattggtgacacagttgttatatctgtcacaaaggaaggtgtgaaattctcaactagaggtgatattggaactgcaaatgttgtctgcaggcaaaatactactgttgataagcctgaggatgcaacagtgatagagatgaatgagcccgtgtcattgacttttgctctgaggtatttgaactcttttaccaaggcaagtccattgtcgaacacagtcactatcagcttgtcctcagagcttccagttgtggttgagtacaagattgcagagatgggctttgtcaggttctacctggcacccaagattgaagatgatgatgatgaaaccaagcctatgtcataatccactaatagttagttgtcttggtaatgtttgtcttgtttcatttagacctttttcaagaattggaagtgttgtttagatatttgtttgtttgattcaacttcttagtttgcatcattttatgagtgactagcaaacatttttcttggttcctctt

SEQ ID NO: 2895 - DNA, 1129 bp, Citrullus lanatus
acttcttcttctcgcgctctttctcaaaaccctagccagccccagccccagccccagccccagcccctgctctaacgcttcaatttttctaaaaaaatgttggaatttcgccttgttcagggttcgctcctcaagaaggtcttggaatcgatcaaggacttggtgaacgatgccaacttcgactgttcggccactggattctcgcttcaggccatggactcgagccatgtcgccctggtggctcttctccttcgagcagagggcttcgaacattatcgctgcgacagaagcatttccatgggaatgaacttgaacaacatgtcgaaaatgctcaagtgtgccggcaatgatgatatcattacaatcaaggccgatgacggcagtgatactgtcactttcatgtttgaaagccctacccaagataagatttccgattttgagatgaagttgatggacatagacagtgagcatcttggaattccagatgcagagtatcatgctattgttaggatgccttctgttgagttcgctagaatatgcaaagatctcagtagcattggtgatactgttgtaatttctgtgacaaaggaaggtgtcaagttctcgacaagaggtgatataggatctgccaatattgtttgcagacagaatactactgtagacaagcctgaagaagcaacagttatagagatgaacgagccagtttctttgacatttgctctaaggtatatgaattcgttcactaaggcgacacccctttctaacacggttacgatcagcttgtcttctgacctacctgtagttgttgagtacaaaatagcagagatgggatatgtaaggttttacttggctcccaaaatagaagaagatgaggatgagacaaagcctcaggcctaaatatattgaattaccatttgttctataaatctgttttaggatgtttcctaacttttttctaatctgtagtatagcagttgccagttgttatattgtccaatatgtactctgttcctgagcttaaaattttgatttttttttgccctcttatcttatcatcacttggtttcgatatttaggatatttgagggactgaaattgaatgtttggagcaatattatgattaccacaa

SEQ ID NO: 2896 - DNA, 1080 bp, Brassica napus
aaaaccgaggcgtttaatatcgattcccgcgaactcatttcaccatcaatctcctccttcagaaagctccagaaccctaaatccacaatccttcgaacaagatgttggaacttcgtttggttcaaggctctctcttgaagaaggttctagaatcggtcaaggatctggtgaacgatgccaacttcgactgctccagcactggcttctctctccaggccatggactcgagccacgtggcgctggtgtctcttctcctgagatccgaaggtttcgagcactacaggtgcgacaggaacctctccatggggatgaatctcggcaacatgtccaagatgctcaaatgtgccggaaatgatgacatcatcaccatcaaagccgatgacggcggcgacaccgtcaccttcatgttcgagagccctacacaagacaagattgcggattttgagatgaagctgatggacatcgacagtgagcatttaggaatccctgacgctgagtaccactctattgtgaggatgccctctggtgaattttccaggatatgcaaagatctcagtagcattggtgacacagttgtaatctctgtgacaaaagaaggtgtgaagttttcaacagcaggtgatatcgggacagctaacattgtactcaggcagaacacaactgtggacaagcctgaagatgcaattgtgatagagatgaacgagcctgtagcgctttcattcgcgttgaggtacatgaactccttcacaaaggcgactcccttgtctgataccgtgacaatcagtttgtcctcggagttgccagtcgtggtggagtataaagtggcggagatgggttacattcggtactatttggctcccaagattgaagaagaagaagacactaatgcctaacacgtctctggcttctagatgcacaacctttggaactcttcttggatgaatgtttttttctttactaaagtccattgttaagatgtctgtctgtttggattcagttgttttctggattttctatgttactgcatcgctagattagatcatggtaaaacagattcggctggttttgcaatttgaaaaa

SEQ ID NO: 2897 - DNA, 1073 bp, Pteridium aquilinum
ggtctgtgcctcacagtttctatttaagctaggtttcaatttttctgtcctgcgtggttccctcagactgctatttagggttccgaagtgttcaaggcttgagctttccattatagctaccggatccctgtgccgtgctacttcagattgcgatcttgggtctgggggacctgtgcgacctgcaaaagcgcaaattcagcagcagcgtacttctatctggcaagaagaagataccctagctccttcacagcaacatcatgttggagctcaggttgctgcagggaagtttgctgaagaaggtcctggaggccattaaggacctcgtaacagatgctaacttcgactgctctgctacaggattttctttgcaagccatggactccagccatgttgccctcgtggccctgctcctgcgagctgagggttttgagcactaccgatgtgatcgcaacctctctatgggcatgaaccttaacaacatgtccaagatgctcaaatgtgcaggcaatgacgacattattactatcaaggcggatgatgggggagacactgtcaccttcatgtttgaaagtcctaatcaagacaagatttcagactttgaaatgaagctgatggatatagacagtgaacatttgggtatacctgagacagagtatgaggccattatcaggatgccttctcaggagtttgccagaatttgccgcgaccttagctccattggggacacggttgtaatctcagcctctaaagagggagtaaagttttccacaaaaggtgatataggaagtgccaatattgtttgccgccaaaatacctctgtggacaagcccgaggatgcaactgtcattcagatccagcagcctgtatccctgacatttgcgctccgctacatgaactcttttacaaaggcaacaccactttcaaacactgtaacaattagcatgtcaagtgagctgccagttgtggtggagtataaaattgcagagatgggttatataaggttttatctggcacctaagattgaggaggatgaggaagtcaatccttaggcagcagaatatgactgatgtaat

SEQ ID NO: 2898 - DNA, 1045 bp, Centaurea maculosa
aaccctaaccctagatcggaaaattccccatccgtcgccgggagagatgttggagctaaggctagttcaggggagtctcctgaagaaggtgatggagtccatcaaggacctggtcaacgacgccaactttgactgctccgccaccgggttctcgcttcaggccatggactccagccacgtggcgctggtttcgctccttcttcgatcggaagggttcgaacactaccggtgtgatcggaacctgtccatgggtatgaatctcggtaacatgaccaagatgctaaagtgcgccggaaatgatgacatcatcaccatcaaggccgacgatggtagcgataccgttactttcatgtttgaaagccctactcaagacaagattgctgattttgagatgaaacttatggacattgatagtgagcaccttggaattcctgaagcagagtaccatgccattgttcggatgccttcatccgagtttgcaaggatttgcaaagatctgagcagtattggtgatacagttgtaatttctgtgaccaaggaaggtgtgaagttctcaacaagaggtgatatcggaactgcaaatgtcgtttgtaggcagaacaccaccgtagataagccagaggaggcgacaatcattgagatgaacgaaccagtatcgttgacgtttgcgttgaggtacatgaactcgtttacgaaagcaactccattgtcgaatacggtgacgatcagcttgtcttcagagcttcctgtggtggtggagtacaagatagctgagatgggttatatcaggttctatttggctcccagatagagagatgagagacacaatatgatgaccttgtgtgtttctaataaacttactttagtacattgtgtagtagctagctgtagctccgtgtagtagtagtatcagtttgcgtatcatcgtatctgaaattctatcttgtcttgtctgtgcatcgaactaaccctgcagtgatgactgtgccattggtattgtttccgaaacacaatgaaaaggcgctaatactacacagaggcctat

SEQ ID NO: 2899 - DNA, 1278 bp, Lactuca sativa
tctctctctctctctctcgcaagaatcaacatcagtttctctcacagacgagaaaatgttggaactaaggttggttcagggcagtcttttgaagaaagtgatggaatccataaaggatctggtgaacgacgccaactttgactgttcggcgacaggattctcactgcaggccatggattcaagccatgtagcgcttgtctcactcctactcagatctgagggtttcgagcactaccgatgcgatcgtaacctctcaatgggaatgaatctcggtaacatggcaaaaatgctaaaatgcgccggcaatgacgacattgtcaccgtcaaggctgacgacggcggcgactgcgtcaccttcatgtttgaaagccctaatcaagataagattgctgattttgagatgaagctgatggatattgatagtgaacatcttggaataccagaagcagaatatgaagccattgtccgaatgccatctgcagagtttgcaagaatctgcaaagatcttagcaccataggagacactgttgtgatatctgtcaccaaagaaggtgtaaaattttccaccagaggtgacattgggactgcaaacatcgtcttaagacaaaatacttctgttgacaagccagaagaagcaactataatcgaaatggagacaccagtttccttaacatttgctttaaggtacatgaactccttcaccaaggcgactccattagcaagccaagtgacagtgagtttgtcttctgagctgccagttgtggtggaatacaaaattgcagaaatgggttatctaagattctatttggctccaaagattgaagaagatgaggagatgggcggtggtcatcaggctgagcccaagaaacaaccagagaagaaaccaaagactgagcctaaatcaaatggagaaggggctcctaaacgacgtgtcttgaaggtagatcttgatgaagaagaagaggaaactaaaccacaggttgtgaagaaatctggaagtgagaatggtgattatgttgaagttttggatgttaaggctggaactggtgttattgagccaaaaacagaggttgaagtaatggatgttgagtaggttagtgatgaaaagtcttatgaagttaagttgttggggttaattttgtttatgcaatatgaaagtatgtatgtaaacccttgagtagtgttttcaaatagaaatgagagagcattggtgtcttgttttaacattaactaaatcattttatccagaaagggttaatgccactaaatagctattca

SEQ ID NO: 2900 - DNA, 1287 bp, Vaccinium corymbosum
aacatattcatcgtctatacatacagaagatgtttgagttaaggttggtgcaggggagtctcctgaagaaggttctggaatcgatcaaggacttggttaacgatgccaacttcgattgctcggccacggggttctctctccaggccatggactccagccacgttgcgctggtggccctcctcctccgatcggagggcttcgagcactaccgctgcgaccgcaacatctccatggggatgaacctcggaaacatggccaagatgctaaagtgcgccggaaacgacgacatcgtcaccatcaaggcagatgacggcagcgactgcgtcactttcatgtttgaaagccctactcaagataagatttccgattttgagatgaagctcatggacattgatagcgagcatcttgggattccagaatcagaatatgatgctatgttaggatgccgtcatctgagtttgcaaggatttgcaaagaccttagctccattggtgatacggttgtaatatcagtgacaaaggaaggcgtgaagttctccactagaggtgacattggtactgcaaacattgtctgtaggcagaatacttcagtagacaagcctgaagacgctaccatcatagaaatgaaggagatggtttcattgacctttgcactaaggtacatgaattcgtttgcaaaggccacccctttggcaagccaagtgactatcagcctgtcttcagaactacctgtggtggttgagtacaaaattgcggagatgggttacgttaggttctatttggctcccaaaatagaagaggaggaagctgatccttatgtagagaccaagtctaaagcacagggtaagcctacagcagagacaaagcctaaactggagattaagcctgatgtggagatgaaacctgaagttgattctaacatggacaatgaagtggtggagatcaagcctgacttggagtctaaaaatggagcctgaagaggaaagcaagaccgacttggatatcaagcctaagaaggaagctaatggtgaagttcaagtaatggacgttgagtagttttatcctccaagattatcactcagttagtatgtcatttaagtttttgggtaatgtacattgcattggaagtacttgagggccttcggattttgggctataaccttcgttcgtatgctagatggagtctcgaggggagatttcagttttgatgttctcggttctaatgttccaaaactagtgaaaatggcacattttttcttggcagaatccagagtggaagcgactccta

SEQ ID NO: 2901 - DNA, 1441 bp, Aquilegia formosa
ccttcccccctcagaaggcgcacgattagattctttccctaaaattttccctcgttccccaaataaattagcgggaaaactttattggcgaaaccaatcaaaagcgggaaacatcaatctcccgccgactgaaattaggttttcaaataaatcaaattactctatttataactccccattttcctccattttctactttttctctcccttcttcctctctcatccaaaccctaaaaaccctaattttctctctccgaccttcgaaaccccaaatcgaagatgttggaactaaggttggttcaaggtagtcttttgaagaaggttttagaggcaattaaagatcttgttaacgatgccaacttcgattgctcagctactgggttttctcttcaagccatggattcaagccacgtggctctggttgctcttcttctcagaaatgagggttttgagcattatcgttgtgatcgaaacatctccatgggtatgaatcttggtaacatgaacaagatgctcaagtgtgctgggaacgatgatatcatcactcttaaagctgatgatgggagtgatactgttactttcatgtttgaaagccctaatcaggataagattgccgattttgagatgaagttgatggacattgatagtgagcatcttgggataccagaagcagagtatcatgcaattgttagaatgccatctgctgagtttgcaagaatttgcaaggatctcagcagcattggcgacactgttgtaatctctgtgacaaaggaaggtgtgaagttctccacaaagggtgatattggtaccgcaaacattgtttgtaggcagaataccactgttgacaagccagaggaagctacagtgattgagatgaaggagcctgtgtcattgacattcgcactgaggtacatgaactcctttgccaaggcaactccactgtcccatactgtgactatcagcttatcgtcggagctgcctgttgtggttgaatacaagattgaagacatgggttatgtcaggttttatctcgctcccaagattgaagaagatgaagaagaagacactaagcccaaagtttaaaagattccttgccttctggggatatatatttcttgatttgtatgtggtggtttcttgacatcggtgcatgttattcctgctatttggagttttcaatattgaatatgctagatatcatggacaagcactctaatgtgttccaaatttgtagtccttagatcctttactattcaataatctatggctttgtggttcagcatgtgtcttatttcagaatattggggtatgtaacaacatatggtctaggtttaattgcatctaaatactggattaaggtctgcaaatcattccacattccatgttgtatattgatcggcatctaggctcttattcatggatatgttacattagatgcttt

SEQ ID NO: 2902 - DNA, 1005 bp, Euphorbia peplus
aaccctaacccccaaattcgagatgctggaactccgattggtccaaggttccgtcctcaagaaggtgctggagtccatcaaggacttggttaccgatgccaatttcgactgctcctccaccggattctccctccaggccatggattccagccacgtcgctcttgtcgccctcctccttagatctgaggggtttgagcactatcgatgtgatcggaacatatctatggggatgaatttgaataatgtgtctaagatgttgaagtgctccggtaatgatgatattattactattaaggcggatgatggcagcgacaccgtcactttcatgtttgaaagtccaacacaagataagatatctgattttgagatgaagctaatggacattgatagtgagcatctgggaattcctgaggcagagtatcatgctattgtgaggatgccatcagctgagttttcaaagatttgtaaagatcttgcaagtattggcgatacagttgtgatctctgttacaaaggaaggagttaaattctccacaagaggagatattggggctgcaaacatcgtggtcaggcagaacaccacagttgacaagccggaacaagcaacaatcgtggagatgaatgagccggtatcattgacatttgcactgaggtacatgaactctttcaccaaggccactccattgtctgagacggtcacaatcagcttgtcttcagagctgcctgttgtggttgagtacaagattgctgagatgggttatgtcagattctacttggctccaaagatagaggaggaggaagatgagactaaaccacaagtttgaatgttatatctgattggaaatcattatcttttttccgtgccattacaatgaaaagatgagtatagtataggatgtttcttgttttcagctatgctctttgtgtaggcacctaacgatccagtattttgtagaattcttgaagtttatttaactgctaagagatttgattagaacttgcttta

SEQ ID NO: 2903 - DNA, 1228 bp, Papaver somniferum
tctaacctatttcatttgtctaaaaactcttttacacagttttctcagaactaaaatctccctctcttttctttcgaaaccctagaaatctctttctgtccgcagaaaccccaaaaccaaaccctagtagtagtcgtcgaagaagaagatagtaaagatgttggaactaaggttggtgcaagggagtttgttgaagaaagtaatggaatcattgaaagatctagttaatgatgcaaactttgattgttcagcaactgggttctctctacaagctatggattcaagtcatgtagctcttgttgccctgttacttagatctgaaggttttgaacattatcgatgtgaccgtaatatctctatgggtatgaagctcgaaaacttgacaaagatcttgaagtgtgctggtaatgatgatattatcaccattaaaggtgatgatggtggtgatactgttactttcatgtttgaaagccctagtcaggataagattgctgatttcgaaatgaagttgatggacattgatagcgaacatcttggtattccggatgccgagtatcaagctattgttaggatgccatccgctgagtttgcaaggatttgcaaggacttgagcaccattggagatactgttgtaatctctgtgacaaaagaaggtgtgaagttctccacaaagggtgatattgggactgcaaatatcgtctgcaggcagaacacaactgttgataagccagaagaagctactgtcattgagatgcaggaaccagtatcactaacatttgcactccgatatatgaactctttcaccaaagcaacaccgttgtccaacaccgtaactatcagcttgtcttcggagttgcctgttgtcgttgaatacaagattgctgaaatgggttacattaggttctacctggctcccaagattgaagaagatgaggaagatacaaagccccaagtttgagaggcagccataccattatcccttgttctagtaaatgagtccttaattgctcttcactttgtttgaagtagtgttactgtttcttaagtagattttctttttttttttttatgaatcctttagtgggtagaatttgagattgatcatcctaaaatgttaaaatgttttaagagtttcagacctgtttggataatttgttaattaggtgtgcctcttacattcaaagtttgtgtagtcttaatgcttgaccaagtttaaaaattaagtctg

SEQ ID NO: 2904 - DNA, 1072 bp, Papaver somniferum
gtagtcgtcgaagaagaagaaggcagtaaagatgttggaactaaggttggtgcaagggagtttgttgaagaaagtaatggaatcattgaaagatctagttaatgatgcaaactttgattgttcagcaactgggttctctctacaagctatggattcaagtcatgttgctcttgttgctctgttacttagatctgaaggttttgaacattatcgatgtgaccgtaatatctctatgggtatgaagctcgaaaacttgactaagatcttgaagtgtgctggtaatgatgatattatcaccattaaaggtgatgatggtggtgatactgttaccttcatgtttgaaagccctagtcaggataagattgctgattttgaaatgaagttgatggacattgatagcgaacatcttggtattccggatgctgagtatcaagctattgttaggatgccatctgctgagtttgcaaggatttgcaaggacttgagcaccattggagatactgttgtaatctctgtgacaaaagaaggtgtgaagttctccacaaagggtgatattgggactgcaaatatcgtctgcaggcagaacacaactgttgataagccagaagaagctactgtcattgagatgcaggaaccagtatccctaacatttgcactgcgatatatgaactctttcaccaaagcaacaccattgtccaacactgtaactatcagcttgtcttcggagttgcccgtggtagtagaatacaagattgctgaaatgggttacattaggttttacctggctcccaagattgaagaagacgaggaagatacaaagccccaagtttgagaggcagctatacccattatcccttgattcagtaaatgagtccttaattgctcttcactttgtttgaagtagttctactgtttcttaagtagatttttttttctttttttatgaatcctgtagtgggtagaatttgagattgatcatcctaaaatgttttaagagtttcagacctgtttggataatttgttaattaggtatgtgcctcttcacattcgaagtttgtgtactcttaatgct

SEQ ID NO: 2905 - DNA, 1114 bp, Euphorbia esula
  misc_feature (9)..(9): n is a, c, g, or t
  misc_feature (153)..(153): n is a, c, g, or t
  misc_feature (822)..(822): n is a, c, g, or t
  misc_feature (893)..(893): n is a, c, g, or t
  misc_feature (898)..(898): n is a, c, g, or t
  misc_feature (900)..(900): n is a, c, g, or t
gagcaaacnctaaaacctaaccctaaaccccacgaagacgaagaagaagaaatcaagatgctggaactacgattggttcaaggttcagtcctgaagaaggtgctagagtctatcaaggatttggttaccgatgccaatttcgattgctcatcnactggattctctctccaggccatggattccagccacgttgctctcgtggctctccttctcagatctgagggttttgaacactatcgctgcgaccgtaacatctccatgggcatgaatctcaataacgtctccaagatgttgaagtgctccggtaacgatgatattatcaccatcaaagctgacgacggaagcgacaccgtcactttcatgtttgaaagtccaacacaagataagatatctgattttgagatgaagctaatggacattgatagtgagcatctgggaattcccgaggcagagtatcatgctattgtgaggatgccatcagctgagttttcaaagatttgtaaagatcttgcaagtattggtgatacagttgtgatctctgtaacaaaggaaggagttaaattctccacaagaggtgatattggagctgcaaatattgtggtcaggcagaacaccacagtagacaagccggaacaagcaacaatcgtagagatgaatgagcctgtgtcattgacttttgcactgaggtacatgaactctttcactaaggccactccattgtcagagacagttacgatcagcttatcttcagagctgcctgttgtggttgagtacaagattgctgagatgggttatgtcagattctacttggctcctaagatngaagaggaggaagatgagactaaaccccaagtttgaatgttagttttgattggaaatcatatctttattcngtgcnantactatgaaaagatgagtatagtatagggtgtttcttgttttcagctatgctcttctgtaggcacctaaggatccagtattttgtagaattcttgaagtttatttaactgctaagagattttattagaacttgctttacatgtgtgcgtctgtaagtacattcttatttttgctgtagttctggtttatgctttcaaaaaaactggaagaattc

SEQ ID NO: 2906 - DNA, 1099 bp, Brassica oleracea
  misc_feature (607)..(607): n is a, c, g, or t
gaaaaccgaggcgtttaatatcgattcccgcgaactcatttcaccatcaatctcctccttcagaaagctccagaaccctaaatccacaatccttcgaacaagatgttggaacttcgtttggttcaaggctctctcttgaagaaggttctagaatcggtcaaggatctggtgaacgatgccaacttcgactgctccagcactggcttctctctccaggccatggactcgagccacgtggcgctggtgtctcttctcctgagatccgaaggtttcgagcactacaggtgcgacaggaacctctccatggggatgaatctcggcaacatgtccaagatgctcaaatgtgccggaaatgatgacatcatcaccatcaaagccgatgacggcggcgacaccgtcaccttcatgttcgagagccctacacaagacaagattgcggattttgagatgaagctgatggacatcgacagtgagcatttaggaatccctgacgctgagtaccactctattgtgaggatgccctctggtgaattttccaggatatgcaaagatctcagtagcattggtgacacagttgtaatctctgtgacaaaagaaggtgtgaagntttcaacagcaggtgatatcgggacagctaacattgtactcaggcagaacacaactgtggacaagcctgaagatgcaattgtgatagagatgaacgagcctgtagcgctttcattcgcgttgaggtacatgaactccttcacaaaggcgactcccttgtctgataccgtgacaatcagtttgtcctcggagttgccagtcgtggtggagtataaagtggcggagatgggttacattcggtactatttggctcccaagattgaagaagaagaagacactaatgcctaacacgtctctggcttctagatgcacaacctttggaactcttcttggatgaatgtttttttctttactaaagtccattgttaagatgtctgtctgtttggattcagttgttttctggattttctatgttactgcatcgctagattagatcatggtaaaacagattcggctggttttgcaatttgaaaaaagacatgtttaccaattg

SEQ ID NO: 2907 - DNA, 1054 bp, Raphanus sativus
ggaacgctctttccataaaaaccctagacgacgacaatgttggagctacgtctcgttcagggctctctgctaaaaaaagttctcgaatcggtcaaggatctggtcaacgatgccaacttcgactgctccagcaccggcttctccctccaagccatggactccagccacgtggccctcgtctccctcctgctcagatccgaaggcttcgagcactacaggtgcgacaggaacctctccatggggatgaatctcggcaacatgtccaagatgctcaagtgcgccggaaacgatgacatcatcaccatcaaagctgatgacggcggcgacactgtcaccttcatgttcgagagtcccacgcaagacaagattgcggattttgagatgaagctgatggatatagacagtgagcatttggggatacctgatgctgagtaccattccattgtgaggatgccgtctggtgagttctcgaggatttgcaaggatctcagtaccatcggtgacactgttgtgatctctgtgactaaagaaggggttaagttttctactgctggtgacattgggacagctaacattgtcttaagacagaacacaactgtagacaagccggaagatgcgattgtgatagagatgaacgagcctgtgtcactctcatttgccctgaggtacatgaattccttcacaaaggcaactccattgtcggacacagtgacaatcagcttatcctcggagctgccagtggtggtggagtataaggtggctgagatgggttacatccgttactacttggctcctaagattgaggaagaagaagatgacaacaaggcctaagaaccagtttgtatcccaacagcttctattcatctttgttgctgtcattgtgtgtttccgttgtattcccctctagaatcagttgttttttcttagacttattatgcttcatgataccaatgtttgacaaagttattgcaactctaattactcatcaacaaactaagattgtaatgtgaagtattacaagaaaagctgtatggattcaactatacttctcgga

SEQ ID NO: 2908 - DNA, 1150 bp, Phaseolus vulgaris
caattattcccccaatcccgccaattgattccagaagcttcctctatataaatccccttccctcctttttctgttcagtttctctcaaaaccctaaccatttctaaacgaaaccctaatcctcccttcgctctcgatcaaaatgttggaactacgtctcgtgcaaggttctcttctgaagaaggttctggaatccatcaaggagctcgtcaacgacgccaacttcgactgctcctccaccgggttctccctccaggctatggattccagccacgtggcactcgtcggacttctcctccgatccgagggcttcgagcactaccgttgcgaccgtaacatctcgatgggtatgaacctcaacaacatggctaagatgctgaaatgtgccggtaatgatgacatcatcaccatcaaagccgatgatggcggtgacaccgtcaccttcatgttcgaaagccctacgcaagataaaatttctgattttgaaatgaagttgatggatattgatagcgagcatcttgggataccggaggcagagtatcacgctattgtgaagatgccatcctccgagtttgctagaatctgcagggatcttagtagcattggtgacactgtcgtcatttcagtcactaaagagggtgtgaagttttccacaaaaggagatattggatctgcaaatatagtctgcaggcaaaatacttctgtggacaagcctgaagaagctactatgattgatatgaacgagcctgtgtcactgacatttgcattgcgttacatgaactcttttacaaaggcaacacccttgtccaatacagtctccattagtctgtcaaatgagctgccagttgttgttgagtacaagattgcagagatgggttacgtgcgattttatttggcccccaagatagaagaggaagaagaagagaaacctcaagtgtaatcactattgaatgttgggttaggatattagaatttttctttcacttgaacttgtagttttctttatacatttcttttgaagatattttaactgtgagcaacgaatttggaattcagttattttacatctatcgattctgtcagtatattttgcctataatttgttcagaacacttttagtttaccaaattggctgtgcaaattttcctggt

SEQ ID NO: 2909 - DNA, 1078 bp, Phaseolus vulgaris
tttttctgttcagtttctctcaaaaccctaaccatttctaaacgaaaccctaatcctccattcgctctcgatcaaaatgttggaactacgtctcgtgcaaggttctcttctgaagaaggttctggaatccatcaaggagctcgtcaacgacgccaacttcgactgctcctccaccgggttctccctccaggctatggattccagccacgtggcactcgtcggacttctcctccgatccgagggcttcgagcactaccgttgcgaccgtaacatctcgatgggtatgaacctcaacaacatggctaagatgctgaaatgtgccggtaatgatgacatcatcaccatcaaagccgatgatggcggtgacaccgtcaccttcatgttcgaaagccctacgcaagataaaatttctgattttgaaatgaagttgatggatattgatagcgagcatcttgggataccggaggcagagtatcacgctattgtgaagatgccatcctccgagtttgctagaatctgcagggatcttagtagcattggtgacactgtcgtcatttcagtcactaaagagggtgtgaagttttccacaaaaggagatattggatctgcaaatatagtctgcaggcaaaatacttctgtggacaagcctgaagaagctactatgattgatatgaacgagcctgtgtcactgacatttgcattgcgttacatgaactcttttacaaaggcaacacccttgtccaatacagtctccattagtctgtcaaatgagctgccagttgttgttgagtacaagattgcagagatgggttacgtgcgattttatttggcccccaagatagaagaggaagaagaagagaaacctcaagtgtaatcactattgaatgttgggttaggatattagaatttttctttcacttgaacttgtagttttctttatacatttcttttgaagatattttaactgtgagcaacgaatttggaattcagttattttacatctatcgattctgtcagtatattttgcctataatttgttcagaacacttttagtttaccaaattggctgtgcaaattt

SEQ ID NO: 2910 - DNA, 875 bp, Taraxacum officinale
cggggatgttgttcttcgtcccactctttctctctagaatcaacaacagtttcgctctcacacgcaagaaaatgttggagcttaggttagtgcagggtagtttgttgaagaaagtgatggaatccatcaaggatctggtgaacgacgataacttcgaatgttcggcggcgggattctcactgcaagccatggattcaagccatgtagcacttgtgtcgctacttctcagatctgagggtttcgagcactaccgaagcgatcgtaacctttaaatgggaatgaatctcggtaacatggcgaagatgctcagatgcgccggaaacgacgatattgtcacgatcaaggccgacgacggcggcgattgcgttactttcatgttcgaaagtcctaatcaagacaagatcgctgacttcgagatgaagctgatggacatcgacagcgaacatctcggaattccagaagcagaatacgaagccattgttcgaatgccatcttccgagttcgcgagaatctgcaaagatctcagcaccataggagacaccgtcgtgatatctgtaaccaaagaaggcgtaaagttttccaccagaggtgacatcggaaccgcaaacatcgtctgtagacaaaacacctccgtcgacaagccagaagaagctacaataatcgaaatggaaacaccggtatcattaaccttcgctttaaggtacatgaactcgttcacaaaagcaaccccattagcaagccaagtaacagtaagtttatcatccgagctccctgttgtggtggagtacaaaatagccgaaatggggtacctgagattctatttggcgccaaagatcgaagaagatgaacaaatgggtggtggtggtggtggtggt

SEQ ID NO: 2911 - DNA, 1319 bp, Populus trichocarpa
cgggaatcagaccgccccaaatccaaaaaccccgccaatcacagtcttaccaatttaaataccaaaccccactccaacactacccctcaccccctctctccttccctgtcacagaagaaatcctaaccctaaaaaaggaaaagaaagaaaaaatgttggagctaaggctggtacaagggtctcttctgaagaaagttttagaggcaatcaaggacctggtcaacgatgcaaactttgactgctcgtcctctgggttctctctccaggccatggattccagccacgttgccctggtggctctactcctcagatcggagggtttcgagcactaccgctgtgaccgtaacacgtcaatgggcatgaatcttggtaacatgtctaagatgctgaagtgtgctggaaacgatgacatcatcaccattaaaggcgatgatggtagcgatacagtaactttcatgtttgaaagtcccacacaagacaaaattgctgattttgagatgaaactgatggacatcgatagtgagcacctaggaatcccggaggcggaataccatgctattgttacgatgccttcagccgagttttcaaggatttgtaaagatctttctagcattggtgatacagttgtgatctccgtgacaaaggagggtgttaagttttccacaagaggtgatattggaactgcaaatattgtcctcaggcaaaacaccacagttgataagccggaagatgccactgtcattgagatgaacgagccagtgtcattgacatttgcactgaggtacatgaactccttcacgaaggcaaccccattgtcaaacacagttaaaatcagcttgtcttcagagctacctgttgtggttgagtacaaaatcgctgaaatgggttacgtcagatactacttggctccaaagatagaagaggacgaggatgagaatgagactaaacctcaagtttaatgttatttatttccttgttcactgaaatcaccttgtaggtctggaaatcgttttcaggatgtttatcattttcatcaatggctttcatgcagggagccagtcccttcctagtcattagatgtctctaaagtttctttcagcgcgattactgagatttttagatggttgtgtgataaacagtcatttacattttccaacgtaggattctcactggtttgttcgtatctgtgacttagaaagactgttatgtttcttctatttttaagataccttgatgccatgacatgaggttggaagcccagctaaggcttggcaagaatttctcttcttgatttcaataaaaacactggagtcacagca

SEQ ID NO: 2912 - DNA, 1107 bp, Malus domestica
aaatctccccgcccaaaaaaacctagattgcccaaatcaaacaaccagaacgcttcttccgacgacccggaaacgatgttggagctccgactggttcaggggtcgctgctgaagaaggtgctggagtccatcaaggacctggtgaacgacgccaacttcgactgctcctcctccggcttctccctccaggccatggactccagccacgtggcgctcgtcgccctcctcctcagatccgagggcttcgagcactaccgctgcgaccgcaacatgtccatgggcatgaacctcggcaacatgtccaagatgctcaggtgcgccggaaatgatgacatcatcaccatcaaggctgacgatggcagtgacacggtcaccttcatgttcgaaagccccacacaagataaaatttctgattttgagatgaagctgatggatattgatagcgagcacctaggaattccggaggcagaataccagtcaattgtgacaatgccctcggctgagtttgctaggatatgtaaggacctcagcggcattggtgatacagttgtgatatctgtgaccaaggaaggtgtgaagttctccacaagaggggatataggcactgctaacattgtctgtcggcagaacactactgttgacaagcctgaagaagcaacggtcataaacatgagcgagccagtgtcgttgacattcgctctgaggtacatgaactcgttcacaaaggcaaccacattgtcgaatacagtcacaatcagcttgtcttctgaacttccagttgtggttgagtacaagattgcagagatgggctatattaggttctacttggctcccaagatagaagaagacgatgaaggcgaaaccaagcctgaagtttgagtgttcacgccacgtcatcaccagcatactctgttgatgactcgaactactctttaaaaatccatgtggagggatttctcaatacttctctgtttgaggtttttcttgctttctctgtgacaattagttaggaaatctgtagtctaggagttttcgaatcaattccgttaggtaaaacaatgttgtttctccttggttttttaattgatttgtgggttgcataattaa

SEQ ID NO: 2913 - DNA, 1074 bp, Vigna unguiculata
ggactctaaacccccaaacttcttttcgatctcaaaccctaatcctttctacgtaatatcaaaatgttggaactccgtttggttcaaggttctcttctgaagaaggttcttgaatccatcaaggagctagtcaccgatgctaacttcgattgctcgtctaccggtttctcccttcaggccatggattccagccacgtggccctcgttgcacttctcctccgatcggagggtttcgagcactaccgctgtgaccgcaacatgtccatgggtatgaacctcaacaacatggctaagatgttaaaatgtgcgggtaacgatgacatcatcacaatcaaagccgaggacggtggtgacaccgtcactttcatgttcgaaagccctacgcaagacaaaatttccgattttgagatgaagcttatggatattgatagcgagcatcttgggataccggaggcagagtatcatgctattgtgaaaatgccgtccactgagtttgcaaggatctgtagggatctcagcagcattggagacactgttgtcatctctgtcaccaaggagggtgtgaagttttccaccaaaggagatattggatctgcaaacatagtttgtaggcaaaatacttctgtggacaagcctgaagaatcaactgttattgagatgaatgaaccagtgtcattgacatttgcattgcgttacatgaattcttttacaaaagcaacacctttatccaacacagtttccataagtctatcaaatgagttgcctgttgttgttgaatacaaggttgctgagatgggttatgtccggttctatttggcccccaagatagaagaggaggaagaagaaaaacctgaagtttaatctctatttgatgttgttgggttaggagattagggattttccttcagttgaactttgtagttttcttaatacatttctcttgaagacacttaaactgtgatcagtgaatttaggattcaagtattttacgtctattgttgccctcaggccactgtattttgcctagaatttgttgttcaggacaatgtgatagtataacaattggctgtgcaa

SEQ ID NO: 2914 - DNA, 953 bp, Fagopyrum esculentum
accctagcaatcttccttccagctactaaacagaagaaaatgttggaattgaggttgattcaagggagccttctgaagaaggttttggattcgatcaaggatctggtcaatgatgccaacttcgactgctcctccactggattttctcttcaggccatggattccagccacgtcgctttggtagctctccttctcagggcggaggggttcgaacactaccgctgcgatcggaacatctccatgggaatgaatctgggtaacatggcgaaaatgttgaagtgtgctggaaatgatgatatcatcactatcaaggccgacgatggaagcgacaccgtcaccttcatgtttgaaagtccgacacaagacaagatctcagactttgagatgaagctcatggatatagacagtgagcatcttgggataccagaagcagaataccatgctatagtgaaaatgccttcagctgagtttggtaggatctgtagggatctcagcagcattggtgacaccattgtgatctctgtcactaaagagggagttaagttctctactcgtggagacattggaactgcaaacattgtctgcaggcaaaatacaacagtagataagcccgaggaagcaactgtcatagagatgaatgagccagtgtcactaacctttgccctgagatacttgaactcctttactaaggctacacctctgtcaagcacagtgacattaagtctgtcttcagagcttccggttgtggttgaatacaagattgcagagatgggtcatattaggttctacttggctcctaaagttgaggaggatgaggatgagaagccttagcttttgagtagatcattagtaggatcactgaacttcaatgctttgttatcaatttagagttgatgtgtattgacttttccccaaaatactggtcatattttatgaagtatatgcaatttact

SEQ ID NO: 2915 - DNA, 973 bp, Fagopyrum esculentum
ggggtctcttcctccaccaaaaccctcaccctagcaatcttccttccatctctaagcagggaaaatgttggaattgaggttgattcaaggaagccttctgaagaaggttttggattcgatcaaggatctggtgaatgatgccaactttgactgctcttccactggattttctcttcaagccatggattccagccacgtcgctttggtagctctccttctcagggcagaggggtttgagcactaccgctgcgatcggaacatctccatgggaatgaatttgggtaacatgtcgaaaatgttgaagtgtgctggaaatgatgatatcatcactatcaaggccgatgatggaagcgacaccgtcaccttcatgtttgaaagtccgacacaagacaagatctccgattttgagatgaagctcatggatatagacagcgaacatcttgggataccagaagcagaataccatgctatagtgaaaatgccttcagctgagtttgctaggatctgtagggatcttagcagcattggtgacaccgttgtgatctctgtcactaaagagggagttaagttctctactcgtggagacattggaactgcaaacattgtctgcaggcaaaatacaacagtagataagcccgaggaagcaactgtcatagagatgaatgaaccagtgtcactaacctttgccctgagatacttgaactcctttactagggctacacctctgtcaagcaccgtaacactaagtctgtcttcagagcttccggttgtggttgaatacaagattgcagagatggggcatattaggttctacttggctcctaaaattgaggaggatgaggatgagaagccttagcttttgagtagatcattagtaggattgttaaacttcagtgctttgttatcaatttacagtttgtgtattgacattttccccaaatgctggtcacattttatgaagtatatgcaattt

SEQ ID NO: 2916 - DNA, 1237 bp, Phalaenopsis aphrodite
aaactttgcttccttcacttttgtaaaaattgttgtcgtatcaaccgcagctcgcgagaagatgttggagctaaggttagtgcagggcagtcttctgaagaaggttctcgaggccatcaaagatttagtgactgatgccaacttcgattgttcagcgactgggttctccctccaggccatggattccagccatgtcgctctagtggcgctgctcctccgatcggagggtttcgaacactatcgctgcgatcgaaacatctccatggggatgaacctcaataatatgtccaagatgcttaagtgtgcaggaaatgatgacatcattaccatcaagggtgatgatggcagcgacaccgtcactttcatgttcgagagccccaatcaagacaagatttctgatttcgagatgaaacttatggacattgatagtgagcatctcggcattccggaggcagagtatcacgcaattgtaaagatgccatcttcagaatttgcaaggatatgcaaggatctcagcagcataggagatactgttgtaatttccgccgccaaagaaggagtaaagttttctactagaggagatattggatctgctaacattgtctgcaggcagaataagacagttgataagccagaggaggcgactattattgagatgaatgagcctgtcagcctaacctttgctctcagatacttaaattctttcaccaaagcaacatcattatctgaatctgtgactattagtctttcttctgagctaccagtggtggttgagtacaagattgcggacatggggtacattaggtttacttggcccctaagatcgaagatgaagaagatgagatgaaatcgtaaagctttctccttgccatatttgttttggttttctattttttattttacctcgtttcgtacgagtggtgtagagtcactagtcgttaatagtccgtcgtgtcggacgtagtacgtacttttactttaccgttacgtttagttacggtacttaaacgttaacttaaacgttaattaagttacggtcgggtagggacgtaacgacgtaccgtaacgacggggtaaggtaggtagagcgtgcgagcgtgggctgcgtgctagcagtctgagtcggtggcttacggcttagacggtgaacgtcggtacgctagactgtgcgtatcggagctaggctcaacgttgctaggtcggatccatgcctggttacagtcaaggttcaaggtcc

SEQ ID NO: 2917 - DNA, 1111 bp, Secale cereale
ggggggggaggtgctggaggcgatcaaggacctggtgacggacgccaacttcgactgctccgggaccggcttctcgctgcaggccatggactcctcccacgtcgcgctcgtggccctcctcctccgctccgagggcttcgagcactaccgctgcgaccgcaacctctccatgggcatgaacctcggcaacatggccaagatgctccgctgcgccggcaacgacgacatcatcaccatcaaggccgacgacggctccgacaccgtcaccttcatgttcgagtcacccaatcaggataagatcgcggacttcgagatgaaactcatggacatcgacagcgagcacctcggcatccccgactccgaataccaggccatcgtccgtatgccgtcctccgagttctccaggatctgcaaggatcttagcagcatcggcgacactgttattatctctgtcaccaaggagggtgtcaagttctccactgctggagacattggaactgcaaacatcgtctgcaggcagaacaatactgttgacaagcctgagcaatcgaccattatagagatgcaagagccggtgtcactcacctttgctctgaggtacatgaactccttcaccaaggcaagcccactgtcggaccaagtcaccatcagcctctcctctgagctgcctgtggttgtcgagtacaagatcggagagatgggatacattagggttttatctggcgcccaagatcgaagatgatgaggaaatgaaggcatgattgtgttccaaggatatgcttatattgcctactttccctactagtttaaactgccgtttgcttaactattgtttgaaattaaaaaaaggatgttatgcttggtttagctactcctgtatctggatttccagtgatgaatgttagattagtgaattatgcttacaccagtgctattatggtttgatttagcattttccattgtcagggatttgtggcgctgtgtggaaacaagaaaccataatttctaggctagcagtgtctttttagtcgttggctggtctggtgttggttcaccagattcgcatatatgtcatgtttgaggcagtcagaaatatcacaatagtcatcaa

SEQ ID NO: 2918 - DNA, 1098 bp, Arachis hypogaea
gcgtggcagaacctaatagcaacacccaacgtgatatccagcttgttcttgaaagcaaatatgattgctcctgcatgttcagctgcattgccaacaattggtagcaaaattatgctgagaaaacctgtaaaaccccccattttcaagatgctagaactccgtttagtgcaaggttcgctgctgaagaaggttgtagacgcaatcaaggagctcgtgaacgatgcgaacttcgattgctccgcgactgggttttcactccaggccatggactcgagccacgttgcactcgtggcgctcctactgcggtccgaagggttcgagcactaccggtgcgaccgcaacatctcgatggggatgagtctcaacaacatggccaagatgctacggtgcgctggaaatgatgacatcatcaccctcaaaggcgatgacggcagcgacaccgtcactttcatgttcgagagcccaacacaagataaaatttctgattttgagatgaagttaatggatattgacagtgagcaccttggaattcctgaggcagagtaccaggccattgttagaatgccgtctactgagtttgctaagatttgcaaagatcttagcagtattggtgacactgttgtcatttccgttactaaggaaggtgtaaagttttccacgagaggtgatattggatctgcaaacatagtctgcaggcagaacacttctgtggacaagcctgaagaagccactactgtagagatgaatgagcctgtgtccttgacatttgcattgcggtacatgaactcctttacaaaggcaacaccattgtctaaccgagttgccatcagtctttcaaatgagcttccagttgtggttgaatacaagattgctgagatgggttacgtccgcttctatttggctcccaagatagaagaggaagaagaggagacaaaacctgaagtttaggtgttggattgactctattgggtcttcaatttgtttgtagtaacatgccttgatgcatcttgttgaagatacttttacactttggcaaacggattggaaaattttattagatagtagtccccccctaaatcctttctgttacttagaaca

SEQ ID NO: 2919 - DNA, 792 bp, Antirrhinum majus
aaaatttcagatctcaattcaattctatgtttgagcttcgtcttgttcaggggagtttgctgaagaaggtgctggagtcgatcaaagatctggtcaacgatgccaattttgactgctcggcgaccggattctctctacaagccatggattcaagccacgtggcgctggtggcgctgctcctcagatcggaaggttttgagcactaccgatgtgaccgcaatctttctatgggcatgaatctcaacaacatgtcgaagatgctaaaatgcgccggaaatgatgacatcatcacgcttaaggctgacgacggcagtgatactgtgactttcatgttcgaaagccctactcaggataagattgcggattttgaaatgaagctaatggacatagacagtgagcatctcggaattcctgaagccgagtaccacgctattgtgagaatgccgtctgctgaatttgcgagaatttgcaaggatctgagcagtattggtgattcgattgtgatctccgttaccaaagaaggtgttaagttttcaacgagaggtgatattggtactgctaatgttgtgtgcaggcagaataccactgtagacaagccagaagaagcgacagtcatagaaatgaacgagcctgtgtcgttgacgtttgctcttaggtatttgaactcgttcacaaaggcgactccattgtcgaacacggttactataagcttgtcttcggagctacctgtgatggtggagtataagattgctgagatggggtatgtgaggttctatttggcgcccaagatag

SEQ ID NO: 2920 - DNA, 1014 bp, Fagopyrum esculentum
ttggaattgaggttgattcaagggagtcttctgaagaaggttttggattcgatcaaggatctggtgaatgatgctaacttcgactgttcttctactggattttctcttcaggccatggattcgagccacgtcgctttggtggctctccttctcagggcggaagggttcgagcactatcgctgcgatcggaacatctccatgggaatgaatctaggtaatatgtcaaagatgttgaagtgtgctggaaatgatgatataatcactatcaaggccgatgatggaagcgacactgtcaccttcatgtttgaaagtccgacacaagataagatttcagactttgagatgaagctcatggacatagacagtgagcatcttgggattccagaagcagagtaccacgctattgtgaagatgccttcagctgagtttgctaggatttgtagggatctcagcagcattggtgacaccattgtgatctctgtcactaaagagggtgttaagttttctactcgtggagacattggaactgcaaacattgtctgcaggcaaaatacaacagttgacaagcctgaagaagcaactgtcatagagatgaatgagccagtgtcactaacctttgccttgagatacttgaactccttcacaaaggctacacctctgtcaagcattgtaacattgagcctgtcttcagagcttccagttgtggttgaatacaagattgcagagatgggtcatatcagattctacttggctcctaaaattgaggaggatgaggatgagaagccctagctttcgagtagatcattctgttacaagcaagacacagttctctggttcattgttaatccttttcatttcatttgtgtggaatgcattagtagaaattttaaacttgcactaaatgttttgtatcagtttagagtttgtgtattgaattgcagttcttaacaattgctggtcatattttctaaatcctatacgcaatttacctaataatcagcaatagtgggatga

SEQ ID NO: 2921 - DNA, 933 bp, Sciadopitys verticillata
ctggtgcagggtagtctgctgaagaaggttctagaagcagttaaggaccttgtgaccgatgctaacttcgattgttcgactactggcttctctttacaggccatggattccagccacgttgccctggttgccctgcttctcagatccgagggctttgagcacttccgatgtgatcggaatatgtcgatggggatgaatcttaacaacatggccaagatgctcaagtgtgctggcaatgatgatattataactcttaaggcagatgatggaggggacactgttaccttcatgtttgaaagcccaaatcaagataagatttccgattttgaaatgaagctgatggacatagacagcgagcatttgggcattccagagtcagagtaccatgccattgtgagaatgccatctcaggagtttgcccgtatttgcaaggatctcagctccattggggatactgttgtgatttctgtgaccaaggaaggggtgaagttctccacaaggggagacattgggagtgctaacattgtttgcagacagaatacctctgttgacaagccagaggaggcaacaattattgaaatgcaggagcctgtgtctttaacatttgcactacggtacatgaattctttcacaaaggcaactcctctttctaatactgtgaccatcagcatgtcagcagatttgcctgttgttgttgaatacaaggttgcagatatgggttatataaggttctatttggccccaaagattgaggaggaaggagaaagctaattctgtattcatgtaattttaagacagccctcccccttgcttgtaatttgagtgcagtatgggaggaggattcaaaaaaatgcttctaaggggttatttactcctaggctttttgcagtgtttgtttcctaaagtttgttcaatcgaataaaatggcctctt

SEQ ID NO: 2922 - DNA, 1148 bp, Silene vulgaris
tgctggaactaaggctagtccaaggaagtctcctgaaaaaagtaatcgaatcaatcaaagacttagtaacagatgcaaacttcgattgttcagcttcaggattctctctccaagccatggattcaagccacgtggcactcgtagcattgttacttcgtgctgaaggttttgaacattatcgctgtgatcggaatatttcaatggggatgaatcttgttaatatggcgaaaatgctaagtgtgctggtaatgatgatattattactcttaaggctgatgatggtagtgatactatcactttcatgtttgaaagccctaaccaggataagatatcagattttgaaatgaagctcatggacattgatagcgagcatcttggtatccctgaagcagaataccacgccattgtgaggatgccttcagctgagtttgccaagatttgtaaagatttaagctcctttggggacactgtggtgatctctgtgagtaaagaaggtgtgaagttttcgacaagcggtgatactggagttggaaacattgtcctcaaacagaacactaccgtagataagcctgaagaagccacgatcatagagatgaatgagccagtgtctttgacatttgcactaaggtacatgaactctttcaccaaagcaactcctctctcaaacactgttactatcagtttgtcttcagagcttcccgtcgttgtcgaatacaagattgccgagatgggttacatcaggttctatttggctcccaagatcgaagaagatgagaatgagtcataaccttgaaacttttagtcttccatctctcgcttctatcaaccagaggttcttcctgaagttaatgttccatgcctctttctgagatctttcctcctgtagtttcccttgaacatgctcgagtcgtaaactgaactagtttagtgctgtttgtgttagttgattaatgcatattgtattaggctgtaagcattgcgctgtttttagatgtttctgggatctctatctataggttggttgtgtgacttgtgtcgttaaatttctgcttcgagttctattaagacggtttgttatagatttgatcatctacaatattcatgagttcctctgttactttttatgagactgcctcacaattgagacg

SEQ ID NO: 2923 - DNA, 1143 bp, Amborella trichopoda
gagaaagggagagagaatagagttcgttagtcacagagtattagagagagaaacattgtttgcatttgtgagggagttttagagagagagagaggccaatcggcatgctggagctaaggcttgtgcaggggagcctcctgaagaaggtattggatgccattaaagacctggtcaccgatgccaacttcgattgttcgagcacgggtttctcattgcaagccatggattcaagccatgttgctcttgttgcccttcttctcagatctgatggttttgagcattttcggtgcgaccgttctgtgtcagtggggatgaatctgaacaatatggcaaagatgctcaaatgcgcatcgaatgatgatattatcaccattaaatctgatgatggtggtgatgctgtaaccttcatgtttgagagtccaaatcaggataaaatctctgatttcgaaatgaagcttatggatatcgatagcgagcatctgggcattcccgaggctgaatatcacgccattgttaagatgccttcttctgaatttgctacaatttgcaaggatctcagcaccattggggacactgtgatgatatcagtaaccaaggaaggagtgaggttttccaccaaaggggatattggaagcgccaacatagtctgccgccaaaacacctctgttgacaagccagaagaggcaactataatagagatgcaagaaccagtgtccctaacatttgccttgaggtacttgaactccttcacaaaggcaacccccctatcatcatcagtcaccataagcctctcatctgagctaccagtcgtggtcgagtacaagatcgcagatatgggttaccttcgattttaccttgctccaaagattgaagatgagggagatgagtcttgaaccatctgttatgaattcctttttttccttcaatctgttctctttttgtttgggttgtaaggtagttttagaacatgtaattagttgattagttaaagcattccatactctctaattatcttttattggtattcattattcttggttgaaaaagtagctttacaccatgtgaccagtgcattaattaaagcactccatgacctctttttatctcttgttaatgttaaagtaactaggtggtgttaaagta

SEQ ID NO: 2924 - DNA, 896 bp, Brassica juncea
caaggctctctcttgaagaaggttctagaatccgtcaaggatctggtgaacgatgccaacttcgactgctccagcaccggcttctccctccaggccatggactcgagccacgtggcgctggtgtctctgctcctgagatccgaaggtttcgagcactacaggtgcgacaggaacctctccatggggatgaatctcggcaacatgtccaagatgctcaaatgcgccggaaatgatgacatcatcaccatcaaagccgatgacggcggcgacaccgtcaccttcatgttcgagagtcccaagcaagacaagattgcagattttgagatgaagctgatggatatagacagtgagcatttggggatacctgatgctgagtatcattcgatcgtgaggatgccgtctaatgagttctctaggatttgcaaagatctcagtaccatcggtgacactgttgtgatatctgtgactaaagaaggggttaagttctctactgctggtgacattgggacagctaacattgtgttgagacagaacacaactgttgacaagccggaagatgcaattgtgattgagatgaacgagccagtgtcactctcgtttgccctgaggtacatgaattccttcacaaaggcaactcctttgtcggacacggtgacgatcagcttgtcgtctgagctcccagttgtggtggagtataaggtggctgagatgggttacattaggtactacttggctcctaagattgaagaggaagaagaagacaaggcctaagacccctttgcatctgtagcttctttgtattcatcctaaaatgtccaagatttagtcatgatgattacgatgtttctgtgtgattccgttaagctcccctctagaatcagttgttttgtttgact

SEQ ID NO: 2925 - DNA, 1188 bp, Pinus pinaster
taatgttttcattctggcgggaaaacagagcagagttcccgccatttcagtctacaaacacacatccacactcactcgaaacccatctttctgctctcggaacgaattacgtttatctcgagctctgtcacaagggaaagagtcctcttctctcagaatttgttttcactgtaaagatgttggaactaaggcttgtgcaggggagtcttctgaagaaggtgctggagtccatcaaggacctcgtcactgatgctaacttcgattgctcggctacgggcttctccctgcaggccatggactcgagccacgttgccctcgtttccctgttgctcaggtctgagggcttcgagcactatcgctgcgaccggaacatgtccatggggatgaacctcaataatatggccaagatgctcaagtgcgccggcaacgatgacatcatcaccatcaaggccgacgatggaggcgacaccgttaccttcatgttcgaaagccccaaccaggacaagatttcagacttcgaaatgaagttaatggacattgacagcgagcatttgggcattccagagtcagagtaccatgccattgtgaggatgccatctcaagaatttgctcgcatctgcaaggatctgagctccatcggggacactgttgtgatctctgtgagcaaggaaggagtgaagttctcaaccaggggagatattggtagtgctaacattgtgtgtaggcaaaacccttctgttgataagccggatgaagcaacaattattgagatgcaagagcctgtgtcactcacatttgcactgaggtacatgaactcgttcaccaaggcaactccgctgtctaacacagtgaccattagcatgtcatcggagttgccagttgttgttgaatacaaaattgcagagatgggttatattaggtttacttggccctaagattgaggaggaaggtgaaagctaactgctctttcctctgcgttgtctgcattgcattgagcagaaaggctcttagttagttgcatggtcttctttgcttgtattgttgagcatgtcatggagggatccaaaaaggtgcaatggctttatttgcccgtcatgtatcccttgaagggtttattctcctcttatttaagtcttatttacacagatcccatatacaggtttgtgtttgggtagtaagtacaaagat

SEQ ID NO: 2926 - DNA, 1468 bp, Panax ginseng
agaagaaagaagaaaaatgttggaactaaggttggtgcaggggagcctgttgaagaaagtgatggaatcaattaaggatctggtgaacgacgctaacttcgactgctccgccaccggattctctctccaagcaatggattccagccacgtggcgctcgtcgccctccttctccgatctgagggtttcgagcactaccgctgcgatcggaacctctccatgggaatcaacctcggcaacatgtccaagatgctgaaatgtgctggcaatgatgacattgtcaccatcaaggcagacgacggtggcgacaccgtcaccttcatgttcgaaagccctactcaagataagattgccgattttgagatgaagctcatggatattgatagtgagcatctgggaattcccgaatcagaatacgaagctattgtgaggatgccatcggctgagtttgcaagaatctgcaaagatctcagcaccattggtgatactgttgtgatatctgtgacaaaggaaggtgtgaagttctccactagaggtgacattgggacagcaaacattgtttgcaggcagaacacttctgtagacaagccagaagaagctaccatcatagagatgcaggaaccgatttcattgacctttgccctgagatatatgaattccttcacaaaggccacccctttggcaaaccaagtgactgtcagcttatcctctgaactcccagtggtgattgagtacaaaattgcagaaatgggctacatcagatactatttggctcctaagatagaagaagaggaggggggagcttatgcagaacctggaccaacaaagtccgctgcggagaccaacaccaaaagggcagccaaccctgagcctagagttgaagccgtgtctgagatggaagctgatcctgttataaagagtgagcctgaagaggaaagcaacactgcagccaagaccataactaagatggaaaccaagcctgagaagcaaactaatggtgaggatgatgttattgaagttatggacaccaagcctaagacaaactaatggagaggctgaagttatggatgttgagtaactttgtcttgttgaaccttgtcattttctattaactatcggtagatatatgtttaacttggtgattatcattgaggttgaagaaatagtagttgaaactgggctataattttttgtgcaccagatgagagccttattagtttgaagcatatttccatttcctgttgtagaactactagtctaaacaaggcatggttatgaatttcacttgtaaaacaatgccctatttcatatgcagttgactgcttaatgactatttcaaccttgaaacatgagcttaacctcaaagtggaggacaaaattagaattttttcaaagtcagttgcactccccagaccgtattcccactttacaaggctatatcccatgtactctgcgttgataccactgctt

SEQ ID NO: 2927 - DNA, 1759 bp, Physcomitrella patens
tgaggaggaggaggaggaggagaaggatttggtgcagcagcagctctgcaacgaggccaatgctacgaaacaagcgacgacaccgcgtcgtagagagagagcgagatagatacatagatggatagatagatagatagatagatagatagagagagagagagagatagttgcatggatggattgctagttcgatggattctatgtttggtagattgccgctgcgccctccataaaaaagttcccgccatcacaccatgccggcctctctctccgcgctcctctttcttttccgttgatactccgccgctcggtacttaatcttgttgcggtctctctgtgtgcgaccgtttgagacgagtgttgtacagtttcagctctctcgtgtgagcctaggcactttggtcttggttgcgaatcggtcgtggtgtggtgacacgaaggaaagatgttggagttgaggcttgtgcaggggagtttgctcaagaaggtgttggaagctataaaagatctggtgaccgatgccaacttcgattgctcaacgacaggcttctcattgcaagccatggactccagtcatgttgcactggttgcattgcttctcagatctgagggctttgagcattatcgttgcgaccgtaacatctcgatgggcatgaaccttaccagcatggccaagatgcttaagtgcgctggtaacgacgacatcattactattaaagccgacgatggcggtgattctgtcactttcatgtttgaaagccctaatcaagagagaatctctgacttcgagatgaagctgatggacattgatagcgagcaccttggaatacctgaaactgagtatgaagctatcgtgagaatgccatcttcagagtttgcccgtatatgcaaggatctcagtacaattggtgatacagttgttatctctgtgaccaaggaaggagtgaaattttccactgggggtgacattgggagcgcaaacatcatctgcagacaaaatacttcagttgataaggaggaggagaagaccgtggtggagatgcaggaacctgttaccttgacatttgccttgcgctacttgaattctttcaccaaagctacaccactatctagcaccgtcacgttgagcatgtctaaagagcttcctgtagcggtggagtataagatcgcagacatgggtcacatccggttctaccttgcgcctaagatagaggaagacgaagagatggcatcctaaatcaagtttttttcgcatccacttcctgagggtctagagattagaagtggtaaacctgtaaatggcagtagacgcgattcgaattgtctgtcccatcagccaggtgggccaaattcatggcgtgatcgttcgatctcatcatgttcactgattatcaagacgttttttttttttcttttcaactcgagactcgaatcttaagaggctctttcgactattcttttgcctatcctgtcgaaatagtgaccagtacaaagtattttaagcccatgttctgggtcaattcgtaacataccatggacactaccttgttactctattttgaagtgccgagatttgacacgtgttgaatagtttatgaaatcagtttacaatttccgtcagacctcaggtatttctaatgagaagttctgtgtctgagaagcttgaagcggctaatgaaggagaaatggaaaggaaaaaaaaaacgtcttcttgtgttgtatagatctgctattgcaaagcaaatcctttcaagagaag

SEQ ID NO: 2928 - DNA, 2024 bp, Physcomitrella patens
tgaggaggaggaggaggaggagaaggatttggtgcagcagcagctctgcaacgaggccaatgctacgaaacaagcgacgacaccgcgtcgtagagagagagcgagatagatacatagatggatagatagatagatagatagatagatagagagagagagagagatagttgcatggatggattgctagttcgatggattctatgtttggtagattgccgctgcgccctccataaaaaagttcccgccatcacaccatgccggcctctctctccgcgctcctctttcttttccgttgatactccgccgctcggtacttaatcttgttgcggtctctctgtgtgcgaccgtttgagacgagtgttgtacagtttcagctctctcgtgtgagcctaggcactttggtcttggttgcgaatcggttcgttctcacctcgtccagagctattttgtactgatttgcatttctccagtgcaagtcgtggtgtggtgacacgaaggaaagatgttggagttgaggcttgtgcaggggagtttgctcaagaaggtgttggaagctataaaagatctggtgaccgatgccaacttcgattgctcaacgacaggcttctcattgcaagccatggactccagtcatgttgcactggttgcattgcttctcagatctgagggctttgagcattatcgttgcgaccgtaacatctcgatgggcatgaaccttaccagcatggccaagatgcttaagtgcgctggtaacgacgacatcattactattaaagccgacgatggcggtgattctgtcactttcatgtttgaaagccctaatcaagagagaatctctgacttcgagatgaagctgatggacattgatagcgagcaccttggaatacctgaaactgagtatgaagctatcgtgagaatgccatcttcagagtttgcccgtatatgcaaggatctcagtacaattggtgatacagttgttatctctgtgaccaaggaaggagtgaaattttccactgggggtgacattgggagcgcaaacatcatctgcagacaaaatacttcagttgataaggaggaggagaagaccgtggtggagatgcaggaacctgttaccttgacatttgccttgcgctacttgaattctttcaccaaagctacaccactatctagcaccgtcacgttgagcatgtctaaagagcttcctgtagcggtggagtataagatcgcagacatgggtcacatccggttctaccttgcgcctaagatagaggaagacgaagagatggcatcctaaatcaagtttttttcgcatccacttcctgagggtctagagattagaagtggtaaacctgtaaatggcagtagacgcgattcgaattgtctgtcccatcagccaggtgggccaaattcatggcgtgatcgttcgatctcatcatgttcactgattatcaagacgttttttttttttcttttcaactcgagactcgaatcttaagaggctctttcgactattcttttgcctatcctgtcgaaatagtgaccagtacaaagtattttaagcccatgttctgggtcaattcgtaacataccatggacactaccttgttactctattttgaagtgccgagatttgacacgtgttgaatagtttatgaaatcagtttacaatttccgtcagacctcaggtatttctaatgagaagttctgtgtctgagaagcttgaagcggctaatgaaggagaaatggaaaggaaaaaaaaaacgtcttcttgtgttgtatagatctgctattgcaaagcaaatcctttcaagagaaggaagcaaagaagtctcacaactccaatctgcgtaaaattgtaggctgacatttgccagtgatgtgaaggttttggtataagttaaacatgtggaactggtgacctttgtgaccagtgaatactcttgtttagacgagtacaagtggggactggttggtaaccttatacacccattcgaaaattgattcaatttttttttctaattgac

SEQ ID NO: 2929 - DNA, 1375 bp, Artemisia annua
cccacttctcacacacgcactctaaaaacacgcagtaaaaaaacacacagtaaaaaaacacacacacagagttaacaaaatgttggaactaaggctagtacaaggcagcctcctaaaaaaggtaatggagtccataaaagacctggtcaacgacgcaaactttgactgctcagcaactgggttctccctccaggcaatggattcaagccacgtggcactggtgtcactgctgctgagatcagaagggtttgagcattacagatgtgataggaatatgagcatggggatgaatatagggaatatgagtaagatgttgaaatgtggcgggaatgatgatattgttactattaaggctgatgatggtggtgattctgttacttaatctcctaatcaagacaagattgctgattttgagatgaagttgatggacatcgatagtgagcatcttgggataccagaatcagaatatgaagccatagttcgtatgccatcggctgagtttgcccgtatctgcaaagatcttagcaccattggagacactgttgtgatatctgttacaaaggaaggcgtgaagttttcgactaaaggtgatatcgggactgcgaatattgtgctgagacagaacacttctgttgacaagccagaagaagctaccataattgaaatggaaacaccagtttcactgacatttgcactgaggtacatgaattctttcacaaaggcaaccccattggcgagccaagtgacagtcagcttgtcatctgagctgccagttgtggtcgaatacaagattgcagaaatgggttatctgaggttctatctcgctccaaagatagaagaagatgaggagatgaatggtcatcgagctgctgaaccacaagcggaaaccacgaaacaaccagagaaaaggccaacaaccgagcccaaaaccaatggggagccaaaacgtcgtgtcatgaagattgatcttgatgaggatgaagaggaactaaaaccaaaagttgcaaccaatgggaacaatgactatgttgaagttgtgggttctaagcctgggaacggaattttgaagcctaaggaagagatcaatggcgatgaggaggttaatgatgtgaagcctggcgttgagaaagaaaccaatggtgaagctgaagtaatggatgtcgagtagaacccaagagttgtcattttgtttataactaggttattggggttaattttctggtgccacatgagaacatatttgtaaaccctggagcatgtttgatgtgctaatctttttcaaatctcctaagtattgtaaaccttagcagtgggtttcaccgacttctaactttggattttggtttatttatgtgtactttacggccttaaaatt

SEQ ID NO: 2930 - DNA, 987 bp, Guizotia abyssinica
tctacagattcgttcatttcaggtggaaaaatgttggagctacggttagttcagggaagtctcctgaagaaggtgatggagtcgataaaggatctggttactgacgccaattttgactgctccgctaccggattttcgcttcaggcgatggactccagtcacgtggcgttggtgtctcttcttcttagatctgaaggttttgaacactaccgctgtggccgtaacaggtccatggggatgaatctcaataacatgtcgaagatgctgaagtgtgctggaaatgatgatattatcactctcaaggctgatgatggcagtgatactgttactttcatgttcgagagtcctactcaagataagatgctgatttgagatgaacctatggacattgatagcgagcatcttggcattcctgaggctgagtatcatgccattgtaaggatgccttcatctgagtttgcaagaatctgtaaagatctcagcagcattggtgacacagttgtgatttctgtcaccaaagaaggtgtgaaattctcaaccagaggtgatattggaactgcaatgttgtttgcagacagaacacgacagttgataagcctgaagaagctactgttgtcgagatgaatgagcctgtttctttgacatttgctttgaggtatatgaactccttcaccaaggcaacacctttatcaagtactgtcacactcagcctgtcttctgagcttcccctcgttgttgagtacaaaatagctgaaatgggctatgtaaggttttacttggctcctaagattgaagaagatgatgaagaaaacaacaaatcgtgataatttaaggtacttaacttcataaatgtctcgtttatgactaaagttacagtttgattttgaaaatctgaagtatgtagccagagtttgaagtttaatcctctttatgttcatgttgggtagtgaaatgcctttgtagttttttcatgtcatggtgaatttg

SEQ ID NO: 2931 - DNA, 1309 bp, Physcomitrella patens
catcttctcactccctcgctcccatttctctcttcatctatctctcgctttcctctcgtttctgccctcgccgcattcactgctctgtgttgcagtttagcggtgagttaggtgcgtcggcgtggtctgctctttcgccggttgtggcggagttagtgaggtagggaaacatgttggagcttaggcttgtgcagggaagcctgctgaagaaggtcttggaagctatcaaggatctggtaaccgatgccaattttgattgctccacgacgggtttctcattgcaagccatggactccagtcacgtcgctttggttgcgttgctcctgagatccgagggctttgagcattatagatgtgatcgcaacatttccatgggcatgaaccttaccagcatggctaagatgctgaagtgcgctggcaacgacgatatcattactattaaggcagatgacggcggtgactctgtaactttcatgttcgagagcccaaatcaagagagaatctccgactttgagatgaagctgatggacatcgacagcgagcacttaggaatccccgaaactgagtacgaagcaatcgtaaggatgccatctgcagagtttgctcgtatttgcaaggatctcagcaccatcggtgacacagttgttatatctgtgaccaaggaaggggtgaaattctctactgggggagacattgggagtgcgaatattatatgcagacagaatacatccgtcgataaggaagaggagaagactgtggttgagatgcaagaacctgttactttgacatttgctttgcgctacttgaactctttcaccaaagccacaccattgtctagcactgtcaccttgagcatgtccaaagaacttcctgtagctgtagaatacaaaattgcagacatgggtcacatccgattctacctcgcacctaagatcgaggaagacgaagagatggcaagctaaagtcacctttgggttggaatccacttacgggaagaccttaggttagaagtagtaaagctgtaaaggggagtaattgtgatttggtttctttgttgtatcagccaggtggctaaatccttgtcgtgatcattttgcttcatgttcatcacactgaatcttatatcaggacctggccatcacgaagtggtgtaaacgcactctaggcttcacttgtagcttggttctatctttgcagccctatctagatgtgagcagagcgcccctactcccgggtttcactccgtcgttattgtatatttgaggatgtgatttttgacatacacatgcaaactaccaatgaattgtca

SEQ ID NO: 2932 - DNA, 1231 bp, Amborella trichopoda
aaatctatttctctttctctttaacattgttctccctccggcctctgcactttaaaatccccagattttcagaagccctagagttgcataaatcctatagtttttcgtttttctcaagccctaggttttcaaaaaccctaaattttcgaagatgttggagttcaggcttgttcagggaagccttctgaagaaggtcatggaagccattaaagaccttgttactgacgcgaacttcgagtgctcgtctactggtttttctctgcaagccatggactcgagtcatgtggctctggtggcccttttgctcagatccgagggttttgagcattacaggtgcgacaggaacttatcaatgggcatgaacctcaataacatgtcaaagatgctaaaatgtgcagggaatgatgatattatcaccatcaaggctgatgatggaggcgacattgttacctttatgttcgagagccccagccaggataagatatcagactttgagatgaaactgatggatatcagcagtgagcagttgggtattccagaatctgaatatcagtcgatagttagaatgccagctgctgagttccaacgtatatgcaaggatctgagcagcataggggacacagttattatatcagtgaccaaggaaggagtgaagttctctacaaggggtgatatcggaagtgcaaatattgtttgcaggcaaaacacctctgtggacaagcctgaagaggccactgtcattgagatgaaggagccagtttccctgacctttgcacttcgatacatgaattccttcacaaaggcaactccactctcaaactctgtaagtctcagcatgtcttcagatttaccactggtggtggagtacaaaattgcagacatgggatatttgaggttctacttggcacccaagatagaagatgaggaggagcagtcttgagcttttcttttcttttgtttcctgtgccacttttagttgtagattgggattcaacctatatgaccaagggttagtttgtaggtgcatgcaaaagtttaaatttgatattactcagagtttgaggaatttcatgtgagattgccatcaagggtattcccttgtctctgtagcagtgttatgcagttcacttccattgtatactctctctctctctctctctctctttagaattttcatgaaattgcttttcatgaaatctcaagttaatttctacctttaatggaaaaccgt

SEQ ID NO: 2933 - DNA, 827 bp, Euphorbia peplus
ctccttatctcacattcccagagcaaacacgaaaacctaaccctcgcgaagaggaagaagaaatcaagatgctggaactacgattggttcaaggttcagtcctgaagaaggtgctagagtctatcaaggatttggttaccgatgccaatttcgattgctcatccactggattctctctccaggccatggattccagccacgttgctctcgtggctctccttctcagatctgagggttttgaacactatcgctgcgaccgtaacatctccatgggcatgaatctcaataacgtctccaagatgttgaagtgctccggtaacgatgatattatcaccatcaaagctgacgacggaagcgacaccgtcactttcatgtttgaaagtccaacacaagataagatatctgattttgagatgaagctaatggacattgatagtgagcatctgggaattcccgaggcagagtatcatgctattgtgaggatgccatcagctgagttttcaaagatttgtaaagatcttgcaagtattggtgatacagttgtgatctctgtaacaaaggaaggagttaaattctccacaagaggtgatattggagctgcaaatattgtggtcaggcagaacaccacagtagacaagccggaacaagcaacaatcgtagagatgaatgagcctgtgtcattgacttttgcactgaggtacatgaactctttcactaaggccactccattgtcagagacagttactatcagcttatcttcagagctgcctgttgtggttgtgtacaagattgctgggatgggttatgtcagattctacttggctcct

SEQ ID NO: 2934 - DNA, 1027 bp, Centaurea maculosa
cacctgaaatccccaaacttttacttcaatccataacctaaaaatagttggaactaaggctagttcaagggagtctcctgaagaaggtgatggaatccatcaaggatctcgtaaacgatgcaaatttcgattgctcggccaccggcttctcgcttcaggccatggactccagccatgtggccttggtgtctctgctgcttagatcggaaggattcgagcattaccgctgcgatcggaacatttccatgggtatgaatctgaataacatgtcgaagatgctaaagtgcgctggaaacgatgatatcatcactctaaaggcggatgatggcagtgatactgttactttcatgtttgaaagccctactcaagataagattgctgattttgagatgaaattaatggacattgatagtgagcatcttggcattcctgaagctgagtaccatgccattgttcgtatgccttcatccgagtttgcaagaatttgtaaagatctcagtagtattggtgacacagttgtaatttctgtcaccaaggaaggtgtgaagttctcaacaagaggtgatattggaacagcaaatgttgtttgtagacagaacacaacagtagataagccagaagaggcgactatcattgagatgaatgagccggtttctttgacatttgcattgaggtacatgaattcattcaccaaggctactccactttcgaacaccgtcacaatcagcctatcttcagagcttcctgtggtggttgagtacaagatagctgaaatggggtacataaggttctatttggctcctaagatagaagaagatgatgaagaaaacaaatcttgaaaaaggtaaaacccaaacttaatgaatttgctctatgctatgactaatgaattggcttcttcatgggctaaagttacacttgcaaaggaagttttagtagtatgtaacaagcttttaaaagtttactgtgtttttttttctatgttgggatcgatagtgtagcgatgttgtagggtgttattgttttt

SEQ ID NO: 2935 - DNA, 849 bp, Cirsium arvense
gatggagtccatcaaggacctggtcaacgacgccaactttgactgctccgccaccggttctcgcttcaggccatggactccagccacgtggcgctggtctccctccttctcagatcggaagggttcgaacactaccggtgtgatcggaacctgtccatgggtatgaatctcggtaacatgactaagatgctaaagtgcgccggaaatgatgacatcatcactatcaaggccgatgatggtagcgataccgttactttcatgtttgaaagccctactcaagacaagattgctgattttgagatgaaactcatggacattgatagtgagcaccttggaattcctgaagcagagtaccatgccattgttcggatgccttcatccgagtttgcaaggatatgcaaagatctcagcagtattggtgatacagttgtaatttctgtgaccaaggaaggtgtgaagttctcaacaagaggtgatattggaactgcaaatgttgtttgtaggcagaacaccaccgtagataagccagaggaggcgacgatcattgagatgaacgaaccagtatcgttgacgtttgcattgaggtacatgaactcgtttacgaaagcaactccgttgtcgaacacggtgacaatcagcttgtcttcagagcttcctgtggtagtggagtacaagatagctgagatgggttatatcaggttctatttggctcctaagatagaagaagatgaggaagacaacaaataatgatggacttcaaaaagattgttggttggttttctaaagacactttgccttttaaggtacattgtgtagtagcctaagcctgtagactccagttgtagtagt

SEQ ID NO: 2936 - DNA, 755 bp, Cirsium arvense
catcgtcgccggagagatgttggagctgaggctagttcaggggagtctcctgaagaaggtgatggagtccatcaaggacctggtcaacgacgccaactttgactgctccgccaccggctttcccttcaggccatggactccagccacgtggcgctggtttcgctacttctcagatcggaagggttcgaacactaccggtgtgatcggaacctgtccatggggatgaatctcggtaacatgaccaagatgctaaagtgcgccggaaatgatgacatcatcaccatcaaggccgacgatggtagcgatactgttactttcatgtttgaaagccctactcaagacaagattgctgattttgagatgaaacttatggacattgatagtgagcaccttggaattcctgaagctgagtaccatgccattgttcggatgccttcatccgagtttgcaaggatatgcaaagatctcagcagtattggtgatacagttgtaatttctgtgaccaaggaaggtgtgaagttctcaacaagaggtgatattggaactgcaaatgttgtttgtaggcagaacaccaccgtagataagccggaggaggcgacgatcattgagatgaacgaaccagtatcgttgacgtttgcattgaggtacatgaactcgtttacgaaagcaactccgttgtcgaacacggtgacaatcagcttgtcttcagagcttcctgtggtagtggagtacaagatagctgagatgggttatat

SEQ ID NO: 2937 - DNA, 876 bp, Flaveria ramosissima
aatatccttttccccgcgtctttcgagccctaaccctagtttttccaccggaatttcatctttcgccggagatatgttggagctgaggctagttcaggggagtctcctcaagaagacgatggaggcaatcaaggatctagtcaccgatgccaattttgactgctccgccaccggcttttcgcttcaggcgatggactccagccacgtggctctggtttcgcttctctcagatcggaagggttcgaacactacagatgtgaccgtaacttatccatggggatgaatcttaataacatctccaagatgctcaagtgacgcgggaaatgatgatattatcactctcaaggctgacgatggtagcgacaccgttactttcatgtttgaaagccctactcaggataaaattgctgattttgagatgaaactcatggacattgatagtgagcatcttggtattcctgaagctgagtaccatgccattgttcggatgccttcaaccgagtttgccaggatctgtaaagatcttagcagtattggtgatacagttgtgatctctgtgaccaaggagggtgttaagttttcaacgcgaggagatattggaactgcaaatgttgtctgtaggcagaacactacagtagacaagccagaggaagcaactatcatagagatgaacgaacctgtgtctttgacatttgcgttaagatacatgaactcgtttacaaaggcgactccgtatcaagtactgtcacaatcagtttgtcatcagagcttcctgtagtggtggagtacagatcgcggagatgggttacattctaggttctattagctctaaatgagagatgaggggacacagtctgatttaagctagaagtcatg

SEQ ID NO: 2938 - DNA, 855 bp, Euonymus alatus
gtgtgaatcaaatacctcataaatccgctactctcttcaacgctcaagttctctggattgaactcgaagccctgactctagtcctaacgaatccaaacgcagaaaaaccttcaaaacaaagatgctagagcttcgtctcgtgcaaggttcccttctcaagaaagtcttggagtcgattaaggacttggtgaacgacgccaactttgactgctcggcgaccgggttctcgcttcaggccatggactccagccatgttgctctggtggctctgcttctcagatccgagggttttgagcactaccgttgtgaccggaacctctccatgggcatgaatctcaataacatgtccaagatgcttcggtgtgccggaaatgatgacatcatcacgattaaggccgacgatggcagcgacactgttactttcatgtttgaaagtccaacacaagacaagatatcagactttgagatgaaactgatggacattgacagtgagcaccttgggattccagaggctgaataccatgctattgttagaatgccttctgcagagtttgctaggatttgtaaagatctcagcagcattggtgatactgttgtgatctctgtgacaaaggaaggtgttaagttctccacaagaggtgacattggagctgcaaatatagtcctgaggcagaacacaacagtggataagccagaagaagctacaattatagagatgaatgagccagtgtctttgacatttgcattaaggtacatgaactcctttactaaggctactccattgtcaagcacagttacaataagcttgtcgtcagaactgcctgttgtggttgagtataagattgcagagatggg

SEQ ID NO: 2939 - DNA, 1163 bp, Silene vulgaris
aatcaaaacccctagatctcccctcccaccggaacccgaaaaccgaatcgaaccctgaaaatgctggaactccggctagtccaagggagtctcctaaaaaaactcctggaatcaatcaaagacttagtaaccgatgccaacttcgattgctcggcgaccgggttttcgctacaagcgatggactcgagccatgttgcgctcgtagcgttattgctacgagccgaagggttcgagcattatcggtgtgataggaatatatcaatggggatgaatttagggaatatggctaaaatgttgaagtgtgctggtaatgatgatattattactcttaaggctgatgatggtagtgatactattaccttcatgtttgaaagccctaaccaggataagatatcggattttgaaatgaagctcatggacatcgacagtgagcatcttggtatccctgaagctgagtaccatgccattgtgaggatgccttctgctgagtttgccaggatttgtagagatctgagcagcattggggacactgtggtgatctctgtggctaaagacggtgttaagttctccacaagcggtgacattgcaagcgcaaacactttcctcaaacagaacactacagtagacaagcctgaagaagccataaccatagaaatgaacgaaccagtatcactgacatttgcacttaggtacttgaactcattcaccaaagcaactcccctctcaaacacggtaacaatcagcttgtcttcagagcttccagtggctgttgaatacaagattgcagaaatgggttacatcaggttctatctcgctcccaagatcgaagaagatgaaaatgaatcttaagctttgaaattcaagtcattcatctcttgcattctcctatattatgctttatccttctgttaggctaattgtatgattccttttatctgggatctttgctcatatctttatgcttgaagtagatgtagtcaaaagatcgaatatttcagtgtttgttgacactgtattgggatatgctgtaagcattctgctgcttttagtagttttgatgttaatgagatctgttttgatctgttgtgtagttaagagatgatgtcttcatgatcttctctgttatcaagttcttatttgctcgttttgtgagtcgattaatg

SEQ ID NO: 2940 - DNA, 959 bp, Actinidia deliciosa
  misc_feature (858)..(858): n is a, c, g, or t
ctctctccagaagaagaagaggaaaatgtttgagctaaggctggtgcaagggagcctgctgaagaaggtgatggaggcgatcaaggatctggtgaacgacgccaacttcgactgctcgacgacgggcttatctatgcaggccatggactccagccacgtggcgttggtggcatttctcctccgatccgagggcttcgagcactaccgttgcgatcgcaacatctccatgggcatcaacctcgccaacatggccaaaatgctcaagtgcgccggcaacgacgacatcgtcaccgtcaaggccgacgacggcaccgactccgtcaccttcatgttcgagagccccactcaagataagattgcggattttgagatgaagctcatggacatagatagcgagcaccttgggattccagaagcagaatacgatgccattgttaggatgccatccgccgagtttgcaaggatttgcaaagatctcagctccattggggacaccgttgtaatatccgtgacaaaggaaggtgtaaagttctctactagaggtgatattggcaccgcaaacattgtctgcaggcagaatacttcgattgacaagccagaagaagccaccatcatagaaatgaaggagatggtctcactgacctttgcgctaaggtacatgaactcgttcgcaaaggccaccccattggcaagccaagtgactatcagcctctcttcagatctacctgtggtggttgagtacaaaattgccgaaatgggctacatcaggttctatttggctcccaaaatagaagaagaggaagccgaaactcacgcagagaccaagtctaaatccgaggcgaagccgaagcgacctanaccagaggtaaagcctgaagtgcagatccatcttgaagtagaggactcttgcatggagcctgcagttgaaagcaagcctccgttggacttggatatcaagc

SEQ ID NO: 2941 - DNA, 1062 bp, Cajanus cajan
cggaaccctgaacctaaccctaaccgaaccacactctcgactcgcgatgttggaactccgtctcgtgcaaggttcccttttcaagaaggttctcgatggcatcaaggatctcgtcaatgacgccaacttcgattgctcttccaccggcttctcccttcaggccatggactccagccacgtggcactcgttgccttgcttctccgatcggagggcttcgagcactaccgctgcgaccgcaacatctctatgggcatgaacctcagcaacatggctaagatgttcaagtgcgctggcaacgacgatatcatcactataaaagctgacgacggcggagatactgtcactttcatgtttgaaagccctactcaagataagatttctgattttgaaatgaagctgatgagtattgatagtgagcatcttgggattccggaggcagagtatcatgctattgttaagatgccatcgtctgagtttgctaggatttgcagggatctcagtaccattggtgacactgttgttatttctgtgagtaaagagggtgtcaagtttactacgaaaggagatattggaattgcaaatatagtttgcaggcagaatacttctgtggacaagcctgaggaagctacagtgattgagatgaatgagcctgtgtccttgacgtttgcactgcgatacatgaactctttcaccaaggcaacaccattgtctaatatagttacaattagtctgtcaaatgagcttccggtagtggttgagtacaaaattgctgagatgggttatgttcggttctatttggctccgaagatagaagaggatgaagaagaaacaaaacctgaagtttaatctgttattgaatggattgagatgttaggactagaattttaacgcggttgtactgttaggatgctgttatactttttgtttgaagacattttatctgtgttcaaaagatttggcaattaatgaattccatagatatattggttcttcaccaccttgttttctctcgattttatcggtaattagtacagtgtaaaacaattggtgtacattttttt

SEQ ID NO: 2942 - DNA, 1421 bp, Ceratodon purpureus
ggctgctggccgcgtctgtttactcctcatcccctcttcccgccttcacctcatcgccagactgctctaccgcatcccctaaaccctgccctccctcgctgctcccgaaacgcaagcgcttttctgcattgccgcagccctcgcaccctcgcattaacattatcagtggccactgcgctctccagtgtcctgtgcggctcctcctggtgtgggtggtgcgaggcgggtagggcaagatgttggagcttcggctggtgcaggggagcctgctgaagaaggtgttggagtcgatcaaggatctggtgacggatgcgaacttcgactgctcgtcgacggggttctcgctgcaggcgatggactcgagtcacgtggcgctggtggcgctgctgctgagatcggacgggttcgagcactatcggtgcgaccggaacatctcgatggggatgaacctgacgagcatggcgaagatgctgaagtgcgcggggaacgacgacatcatcacgatcaaggcggacgacgggggcgactcggtgacattcatgttcgagagcccaaatcaagagagaatctccgacttcgagatgaagctgatggacattgacagcgagcacctgggaattcctgagaccgagtatgaggcaatcgtgaggatgccatctgcagaatttgctcggatatgcaaggacctgagtactattggagacacagttataatctccgtgacgaaggaaggcgtgaagttctcaaccggaggagacattggaagtgcgaacatcgtatgcaggcagaacacttcagtcgacaaggaggaggagaagacggtagtggagatgcaagagcctgtgacgctgacatttgcgttgcggtacctgaactctttcacgaaagccacgccgttgtcgagcactgtgacgttgagtatgtcgaaggagcttccagttgctgtggaatacaagattgcagatatgggtcacatcaggttctacttggcgcctaagatcgaggaagacgaggacatggcaacctagttctaatgttcctgttcattttggttctttctaatgttagcatccattcgctgagcaagatcctgtacatgagaattcaagacatgaattgttttgccagtcgagcgtgtgatcgctggtgggagttcaggcaatggtttacatcaggtgtgctgcgtgcacgtagcttcctgtaggtcagcatgcgatacttacatgtctgtagaagtaccatgagaaagatatggggacaaattgtccaaaatgtacccacttcatgaagtggctaaaatctggctgtgaccattttgagttgtggtcccggtactaccgaatcttagaagagaactttgactgtcaatttcggtcccgaactggaccactacaatctctcgaatgcagaaaccacaaata

SEQ ID NO: 2943 - DNA, 1312 bp, Populus trichocarpa
ggctccagcactctcttcctaccattttaatttaaaaaccccccactccccttcaaattccctctcattttccctctctctctccttctctctctcagtacaaaccctaaccctaaattacaccaggaaggaaaaatgttggagctgaggctggtacagggatctcttcttaagaaagtcttagagtccatcaaggatctggtcaacgatgcaaactttgacttctcgtcctctgggttctctctccagtccatggattccagccacgttgccctggtggctctactcctcaaatcggagggttttgagcactaccgctgcgaccgtaacacgtcaatgggcatgaatcttggtaacatgtctaagatgttaaagtgcgctggtaacgatgacatcatcaccatcaaaggcgacgatgggagtgatactgtcactttcatgtttgaaagtcccacacaggacaaaattgctgattttgagatgaagttgatggacattgatagtgagcaccttggaattccagaggcagaataccatgctattgttaagatgccttcagctgagtttgctaggatttgtaaagaccttgctagcattggtgatacagttgtgatctctgtgacaaaggagggtgttaagttctccacaagaggtgatattggaactgcaaatatcgtcctgaggcagaaaaccactgttgacaagccagaagatgcaacagtcattgagatgaatgagccagtgtcgatgacatttgcactgaggtacatgaactccttcaccaaggcaaccccactgtcaaacacagttacaatcagcatgtctccagacctgcctgttgtggttgagtacaagattgctgaaatgggctatgtcagattctacctggctcccaagatggaagaggatgagcctgaacccggagcctaactattattcatttccttcacctaaatcacttttgtaaattcggaaatcgttttcaggatgcctatcatttccttcagtggctttcatgcagggagccggtccctctgtagttattatgtctttaaagcttcctttaatgatggctgctgagatttttagatgtaatgtgataggcaggactcaacattttcccgtgtaggtttttttttattggtttgttcctatttgtgccttggaaagaactggtttatgtttcttctatttttaagatgcctcgataccatgacaatgaggatgggagcccagtggtttcggttggtgagctaaatacaaaataaaaagctaaaatttcctgggaaacataaaaaatagcttgttatct

SEQ ID NO: 2944 - DNA, 1199 bp, Echinacea purpurea
atggaatccataaaggatctggtgaacgacgcaaacttcgactgctcagcgaccggattctcactgcaggccatggattcaagccacgtggcactggtgtctcttcttctcagatccgagggctttgagcactaccggtgcgatcgtaacctctcaatgggcatgaatctcggtaacatggccaaaatgctccggtgtgctggaaatgatgatatcgtcactattaaggctgatgacggcggcgattgcgtcactttcatgtttgaaagccctaatcaagacaagattgctgattttgagatgaagctgatggacattgacagtgagcatttagggattccagaagcagaatatgaagccattgttagaatgccatcatctgagtttgcaagaatctgcaaagatcttagctccattggagacactgttgttatttctgtaacaaaagaaggtgtaaagttttcgaccaaaggtgacattggtactgcaaatattgtgtgcagacaaaacacttctgttgacaagccagaagaagctacaataattgaaatgcagacaccagtttctctgacatttgcactgaggtacatgaactctttcacaaaggcgactccgttggcgagtcaagtgacagtgagcttgtcttctgaactgccgattgtggtggaatacaagattgcagaaatgggttacctgcggttttatttggctccaaagatagaagaggatgaggagatgggtggtcagcaacctgagccaatggagaccaagaagcaaccagaaaagaagcccaaacctgagcccacgtccaatggggaacccaaacgtcgggtcatgaagattgatcttgatgacgaagaagaggaattgaagccaaaggttgaagccaagttgaaaggtgacactgatggttatgttgaagttatcggttctaaacccgggaatgggattgtgaaacctaaggaagagatgactgaagatgaggttatggatgtgaagcctacaattgagaaagaaacaaatggtgaagctcaagtaatggatgaagagtagaggttgtttggttgtttataatctatgatgattgggttaattttcttgtgctagtagtaaaagcatttttgtaaacccttatcctagcagcggatttcatcaacttaattttggtttttggttgaattagattatttgcctttttt

SEQ ID NO: 2945 - DNA, 1014 bp, Zostera marina
ggtaaagtaagagaaaatcgaagatgttggagttgagattgatacaggggagtctcctgaagaaggtcttggaagcgatcaaggacctcgtcactgaggccaacttcgattgctcagccactgggttctctcttcaagcgatggactccagtcacgtcgctctcgtcgcactactacttagatccgagggtttcgatcattacagatgcgatcggaatctgtctatggggatcaatcttaataatatgtccaagatgctccgctgtgccggaccggaagacatcatcaccatcaagggggacgatggaactgatactgttactttcatgttcgaatctcaaaaacaagataaaatttcggattttgagatgaaacttatggacatagacagtgagcatcttgggatcccagatgccgagtaccaagctattgttaggatgccttctgccgagttcgcaaggatatgcaaggatctgggcagtattggtgacacagtggtcatatctgttacaaaagaaggtgtgaaattctttaccagaggtgatgttggatctgctaatatcgtctgtagacaaaataccagtgttgataagcctgaagactctactgtgatagaaatgaacgaaccggtttcgctaacatttgcactgagatacatgaattccttcaccaaagccactacattgtctgaggtcgtcaccatcagtctttcgtctgaattgccggtggtcgttgaatacaagatagctgaaatgggttacattagattctacttggctcccaaaattgaagacgaagacgaagaaatggtgccccagaatcaagctgatgtcaaggccgaacctgcttaaatccttaaaacattctgtcttttacgcttctcttattatctaaattcaaacatctattttatgcttctatcatgttgcaactggtaagtgataactattgtctaattagctagaaaaatggaattgtgtgttattaacttattctaatcttttacagtcattg

SEQ ID NO: 2946 - DNA, 1086 bp, Citrullus lanatus
agaaacccaagagacccgccattaactctcagtctcacaacacccacaaaaatgttggagttccgtctagttcaggggagtcttctaaagaaggttcttgaagccatgaaggacctcgtcaacgacgccaacttcgattgttcctgtactggtttctccctccaagctatggattccagtcacgtcgctttagtttctctccttctccgctccgagggtttcgagcactatcgctgtgatcgcagcatctccatgggaatgaacctcaacaacatggctaagatgctccgttgcgctggtaacgacgacattgttacgcttaaggccgatgatggtggcgattgcgtcaccttcatgttcgaaaacccttcgcaagataagatcgctgacttcgagatgaagctgatggatattgatagcgagcatctcggcatccctgatgctgaatatcagtccattgttagaatgccagcagctgagtttgcgaggatttgcaaggatctcagctccattggcgacactgttctgatatctgtgtccaaggaaggagttcaattctcaactagaggtgacatcggcactgccaatatagtttgtagacgaaataccacagttgacaagccagaggaagctgttataatagagatggaagaaccagttagcttaacctttgccctgaggtacctcaactctttcacaaaggcaaccccgctagcaaaccaggtgacgattagcatgtcttcagatctgcctgtggtggttgaatacagaattgaagacatgggttatataagatactacttggctcctaagatcgaagaagaagatgaagctgcagcggcagcagaagcgtttagcagaactgagacagagcccaagcatacagcaaaggcaaaacccaaaacagacttgaagccaaaggtcgagcccaaccctgaatcagagatgaagattaaagaggacaaggtgtctataactgagatcaaggatgaagacaacaagacagtacttgaaatcaatgatgaagaaaagaactctccagttgaaagcaaggaaccgaagattgaaacaatggaacttgagtga

SEQ ID NO: 2947 - DNA, 910 bp, Ambrosia trifida
cagggtagtctgttgagaaggtgatggaatcgataaaggatctggtcaacgacgccaattttgactgctcggcgaccgggttctcgctacaggcgatggattcgagccacgtggcgcttgtgtctctccttcttagagcggaagggtttgagcattatcggtgtgataggaatatatctatggggatgaatctgaataatatgtcgaagatgttgaagtgtgctgggaatgatgatattattactcttaaggctgatgatggcagtgataccgttacgtttatgtttgagagtcccactcaagacaagattgctgattttgagatgaagctaatggacatcgatagcgagcatcttggcattcctgaggctgagtatcatgccattgtaaggatgccctcatctgagtttgctagaatctgtaaagacctcagcagtattggtgatacagttgtgatctctgtctccaaagaaggtgtgaaattctcaacaagaggtgatattggaactgcaaatgttgtttgcagacagaacacaacagttgataagcctgaggaagctactgttattgagatgaatgaaccagtttctctaacatttgcattgaggtatatgaactcattcaccaaagcgacaccattgtcaagtaccgtcacaatcagcttatcttctgagcttcctgtggttgttgagtacaaaatagctgaaatgggctacataaggttttacctagctcctaagattgaagaagacgatgaagaaaacaaatcataaaaacttgaggtaccaaacttcataaatggctagtttatgattaagttaccctatggtttcaaaagtctctagaatgtaacaacaatttgaagcttacttgttattattgttatgttggatagtgtaatgctcatgta

SEQ ID NO: 2948 - DNA, 1266 bp, Secale cereale
ccgcccgcccgcccgcccgcgaagatgttggagctgaggctggtgcaggggagcctgctgaagaaggtgctggaggcgattaaggagctggtgacggacgccaacttcgactgctccgggacgggcttctcgctgcaggccatggactcttcccacgtcgcgctcgtcgccctgctcctccgctccgagggcttcgagcactaccgctgcgaccgcaacctgtccatgggaatgaacctcggcaacatggccaagatgctccgctgcgccggtaacgacgacatcatcaccatcaaggctgatgacggctccgacaccgtcaccttcatgtttgagtcgcccaatcaggataagattgcggactttgagatgaagctcatggacatcgacagtgagcacctcggtatccccgactccgagtaccaggccattgttcgcatgccctcttcggagttctccaggatctgcaaggatcttagcagcattggcgacactgttattatctctgtcacaaaggaaggtgtcaagttctccactgctggagacattggaactgcaaacatcgtttgcaggcaaaacaagactgttgacaagcctgaggaatctaccattatagaaatgcaagagcctgtgtcacttacctttgctctgaggtacatgaactccttcaccaaggcaagcccacgtgtcagaccaagtcaccatcagcctctcatctgaactgcccgtggttgttgagtacaagattggtgagatgggctacattaggttttatctggcacccaagattgaagatgatgaggaaatgaaggcatgattgtgtttccaaggatatgctgatcttgcctacattaagttttatctggcacccaagatcaaagaagacaaggaaatgaaggcatgattgtgtttcaaggatatgcttatgttgcctacattccctagttgttaaaccaacctccatttgcttaatgattgtttgtaagcaaaatgatgttatgcttgttttagctacttgtatctgtgactggtggttcatggatttccatctatgatgttttagctgcttgtatctgtgaccgttggtctatgttacaccagtgctgttattgttaggcaacaacttagattgtttttatcataaaattctactgattggtcatttgattgaatgcatttctaggtatcctgagtgtttcatcaggtatatactgcaatggttgtaactgacaaaactgttactaataatgttattacctattgcgt

SEQ ID NO: 2949 - DNA, 892 bp, Cirsium arvense
ttttccatctgaatctttaattttcgtttaaaaatgttggaactaaggttagttcagggggagtctcctcaagaaggtgatggaatcgatcaaggatctggtaaatgacgccaattttgattgttcggccaccggattttcgcttcaggccatggactccagccacgtggctttggtctctcttcttcttagatcggaaggctttgaacattatcggtgtgaccgcaacatttccatgggtatgaacctcagtaacatgtctaagatgctaaagtgcgctggaaatgacgatattatcactctcaaggcggatgatggcagtgatactgttactttcatgttcgaaagccctactcaagataagattgctgattttgagatgaaactaatggacattgatagtgagcatcttggcattcctgaagcagagtaccatgccattgttcgtatgccttctgccgagtttgcaagaatttgtaaagatctcagtagtattggtgacacagttgtaatttctgtgaccaaagaaggtgtgaagttttcaacaagaggtgatattggaacagcaaatgttgtttgtagacagaacacaacagttgataagccagaagaggcgactataattgagatgaatgagccggtttctttaacatttgcattgaggtatatgaattcattcaccaaggctactccactttcgaatactgtcacactcagcttatcttcagagctgcctgtggtggttgagtacaagatagctgaaatgggctacataagattctacttggctcctaagatagaagaagatgacgaagagaaccaatcttgaaaaggtaagagtgtaagaccccaactttataaatttgccctatgattatgattaatcgatgtg

SEQ ID NO: 2950 - DNA, 828 bp, Cucumis sativus
cacaatgttggagctccgtctagttcaggggagtcttctgaagaaggttcttgaagccttgaaggatcttgtcaacgacgccaacttcgactgttcctcctctggtttctccctccaagcaatggattccagtcacgtcgctttagtttctcttcttctccgttctgagtctttcgagcactatcgctgcgatcgtaccatgtccatgggaatgaacctcaacaatatggctaagatgctccgttgcgctggtaacgacgatattgttactcttaaggctgatgatggtagcgattccgtcaccttcatgtttgaaaatccttcgcaagataagatagctgattttgagatgaagctgatggatattgatagtgagcatcttggaattcctgatgctgaataccagtctattgttaaaatgccagcggttgagtttgccaggatttgtaaggatcttagctccattggcgatactgttttgatctctgtgtccaaggaaggagttcaattctcaactagaggcgatatcggtactgcaaacatagtttgtagacgaaataccacagttgacaagcctgaagaagctgtaatgatagagatggaagagccagttagcttaacctttgcgctgaggtacctcaactcttttacaaaggcaacccctctagcaaaccaggtgactattagcatgtcttcagatctgcctgtagtggttgaatacagaattgaaggcatgggttatataagatactacttggctcctaagatcgaagaagaagatgaagctgcaacaattagcaaaccagagacagagcccaaacatacagc

SEQ ID NO: 2951 - DNA, 1006 bp, Festuca arundinacea
gccaacttcgactgctccgccaccggcttctcgctgcaggccatggactcctcccacgtcgcgctcgtcgcgctcctcctccgctccgagggcttcgagcactaccgctgcgaccgcaacctctccatgggcatcaacctcgccaacatggccaagatgctccgatgcgccggcaacgacgacatcatcaccatcaaggccgacgacggctcagacaccgtaaccttcatgttcgagtcgccaaaccaggacaagatcgccgacttcgagatgaagctcatggacatcgacagcgagcacctcggcatcccggactccgagtaccaggccatcgtccgcatgccatcctccgagttctccaggatctgcaaggacctcagcagcatcggggacaccgttatcatctccgtcaccaaggagggcgtcaagttctccactgctggagacattgggaccgccaacatcgtctgcaggcagaacaagactgttgacaagccagaggaatctaccattatagagatgcaggagccggtgtcacttacctttgctctgaggtacatgaactccttcaccaaggcaagcccgctgtcggaccaggtcaccatcagcctctcatctgagctaccagtggtggttgagtacaagattggtgagatgggctacattagattctacctagcaccgaagattgaagaggacgaggaaatgaaggcgtgattgcagcactaagggcgtgcttatgttgcattacttttccaggtcttcggaccactttgcttagcgcttgcctgtaagcaaaaaatgatgttatgctagctttaccatttctgtatctgtgactgttcgtcgttgctggattaccaggggttaatgttagattagtgaattgtgcttctccatgttacctctgttatctgttagaatagtattattcatgacacaaactgagggtgcactccagcctccaggacatgaatgtagccattattcctagcaacttttgctt

SEQ ID NO: 2952 - DNA, 955 bp, Ipomoea batatas
tttccggcgagaaaatgttggaacttcgtcttgttcaggcccagtctcctcaagaaggttatggatgcgatcaaggacctggttaacgatgccaacttcgactgctccgccactggcttctcgctgcaggccatggactccagtcacgtcgcgctggtcgctctcttgctcagatctgaagggtttgaacactatcgctgtgaccgcaacatttccatggggatgaacctcaacaacatggccaagatgctcaagtgcgccgggaatgatgacatcatcaccatcaaggccgacgacggcagtgacactgtcactttcatgtttgaaagccccacccaagacaagattgcggattttgaaatgaagcttatggacattgatagtgagcatcttgggattccagaaacagactaccatgctattgttaggatgccgtctgcagaattcgctcgaatttgcagagatcttagcagcattggtgatacaattgttatctcagtgacaaaggaaggagtgaagttctcaaccagaggtgacattggaaatgcaaatgtggtgtgcagacaaaacaccacagtagacaagccagaggaggcaacagtcatagagatgaatgagccggtgtcgctgacatttgctttgaggtacttgaactctttcacgaaagcaactccattgtccaacacggttaccctcagcttgtcttcggagcttcctgttgttgttgaatacaagattgctgagatgggacacataaggttctatttggcacctaagattgaagaggatgaagaggatactaaaccttaaggagcctgctctttgcaaagcataatcttgttgcattatgctaaaatgtacgaatttttagggttattttggcattttaattttcacaagtaacaccgtactgtatttgcaaaactattaaaatccatgctgctagctttcttac

SEQ ID NO: 2953 - DNA, 874 bp, Vinca minor
ccataaaggatttggttgtggatgccaattttgattgctctgctagtgggttctctttgcaagccatggactcgagtcatgtagctctagtggctctccttcttagatctgaaggatttgagcactatcgctgtgaccggaatctttctatggggatgaatcttaataacatggctaagatgttgaagtgcgccggtaatgatgacatcatcaccctcaaagctgacgacggcgctgacactgttactttcatgttcgaaagtcccacccaagataagatttctgattttgagatgaagctcatgaacattgatagtgagcaccttggaattcctgaagcagagtaccatgctatagttaggatgccgtcagccgagtttggaagaatttgtaaggatcttagcagtataggcgacacagttgtgatatctgtcaccaaggaaggtgtaaagttttccacaagaggtgatattggaactgcaaatatagtttgccgccaaaatacgacagttgataagccggaggaagcaaccgttatagagatgaatgagccggtgtcattaacctttgccctgaggtatttgaactcctttactaaggcaagcccattatccaacactgttactctcagcttgtcttcagagcttcctgttgtggtggaatacaaaattgcagagatgggatatatcaggttctacttggcaccaaagattgaagaggaagaggaagagatgaagccttgaatcccttttgagtttaatgatgatacatatcttagttgttgtgtttgtttaaggaccttgcacatttagaaattgtaggtttgaattgtttagcaagttaaacagatgttttttggtaacctgctgctaca

SEQ ID NO: 2954 - DNA, 1390 bp, Aristolochia fimbriata
atatatccgtggcagtggcgggaaagagtttcttcgcatccatttcccgccctctcgagccctagatttcaaaacccctataaatcaacttccctgccccgcccctccgccctaatttctttcttgtgtttattgttcgatatcccctggtacccatttctctgctcttccccttggttttatccccttagttgcctctgtcttttggtgtcacagtcagaaaagcaagatgttggagctaaggctggttcaggggagcctcctgaagaaggtccttgaagccgtaaaggacctagttacagatgctaacttcgattgctcggccaccggattttctctccaggcgatggattccagccatgtagctctcgtcgctcttctcctcagatcggagggctttgagcactaccgatgcgatcgtaacatctccatgggtatgaatctcaacaacatgtcaaagatgttgaaatgcgccggaaacgatgatattatcaccataaagggtgacgatggcagtgacactgttactttcatgtttgagagccccaaccaagataagattgcggattttgagatgaagctgatggacatagacagtgagcatctaggaattccagaagcggaataccatgccatcgtgaaaatgccttctacagaatttgccaggatatgcaaggatctaagcactattggtgacacagttgtgatatctgttactaaagaaggtgtcaagttttccaccagaggggatattggaactgcaaatattgtatgcaggcagaatacttctgttgacaagcctgaagaagctactgtcattgagatgaaagagccagtttcattgacatttgctctgagatacatgaactctttcaccaaagctactcctctatccacgactgttgtcattagtctgtctcctgagctgccagttgtggtggaatacaaagttgctgaaatgggttatgtcaggttttatttggctccaaagattgaagatgatgaagtagatgaagtggtcgaacaaccaagtaagaagtccaaggcgcaacccaaggatgaagatgactaaagatggttctgctaggttacctttctctcctgtttaattctgttttctaatttgcatatttctttgtaagacagctgtagaaaggtaaaatttttatccagctgcttgtataatgtttcttatgttgtgttagattaatgccacttctgcaccttagctgaaagtttatttcatgtgaattttaaagccagttgtggtttacaatttagcatttattgcttagatgatcactgttttggcaatattgtcttgttagatggatgagtttcacctcatatatttgtggattgatatgtttgagaatgggttgcagcaaaa

SEQ ID NO: 2955 - DNA, 1090 bp, Centaurea maculosa
  misc_feature (225)..(225): n is a, c, g, or t
  misc_feature (513)..(513): n is a, c, g, or t
  misc_feature (882)..(882): n is a, c, g, or t
  misc_feature (897)..(897): n is a, c, g, or t
  misc_feature (1007)..(1007): n is a, c, g, or t
  misc_feature (1018)..(1018): n is a, c, g, or t
  misc_feature (1020)..(1022): n is a, c, g, or t
  misc_feature (1024)..(1024): n is a, c, g, or t
ggacgccgacagtttcggtccggattcccgggatattttgaaaccctaaccctagatcggaaaattccccatccgtcgccgggagagatgttggagctaaggctagttcaggggagtctcctgaagaaggtgatggagtccatcaaggacctggtcaacgacgccaactttgactgctccgccaccgggttctcgcttcaggccatggactccagccacgtggcnctggtttcgctccttcttcgatcggaagggttcgaacactaccggtgtgatcggaacctgtccatgggtatgaatctcggtaacatgaccaagatgctaaagtgcgccggaaatgatgacatcatcaccatcaaggccgacgatggtagcgataccgttactttcatgtttgaaagccctactcaagacaagattgctgattttgagatgaaacttatggacattgatagtgagcaccttggaattcctgaagcagagtaccatgccattgttcggatgccttcatcngagtttgcaaggatttgcaaagatctgagcagtattggtgatacagttgtaatttctgtgaccaaggaaggtgtgaagttctcaacaagaggtgatatcggaactgcaaatgtcgtttgtaggcagaacaccaccgtagataagccagaggaggcgacaatcattgagatgaacgaaccagtatcgttgacgtttgcgttgaggtacatgaactcgtttacgaaagcaactccattgtcgaatacggtgacgatcagcttgtcttcagagcttcctgtggtggtggagtacagatagctgagatgggttatatcagttctatttggctccaagatagagagatgagagacacaatatgatgattcactngtgtgttttctaaanacacttactcttagtacattgtgtagtagctagctgtagctccgtgtagtagtagtatcagtttgcgtatcatcgtatctgaaattctatcttgtcttgtctgtgcatcnaactaaccctncnnngntgactgtgccattggtattgtttccgaaacacaatgaaaaggcgctaatactacacagaggcctat

SEQ ID NO: 2956 - DNA, 740 bp, Platanus occidentalis
tatggaatcgattaaggacctggtgacagatgccaacttcgattgctcggccaccggattctcgctccaggccatggattccagccatgttgcccttgtggcacttcttcttagatcggagggcttcgagcactaccgctgcgaccggaatctgtccatgggcatgaaccttaacaacatgtccaagatgctcaaatgcgctggtaacgatgatattatcaccatcaaggccgatgacgggagcgacaccgtcactttcatgttcgaaagccctacacaagataagatctcggattttgagatgaagctgatggacatcgatagtgatcatcttggaattccagaagcagaataccaatccatcgttcgaatgccgtcgtctgagtttgcaaggatttgcaaagatctcagtagtattggtgataccgttgtgatatcggtgacaaaagaaggggtgaagttttccactagaggtgacatcggagctgcaaatattgtttgtaggcagaataccacagtggataagccagaggaagctatcgtcatagagatgcaggagccagtgtctttaacgtttgcactgagatacatgaattcatttaccaaggcgacgccattgtcgagcactgtgaccatcagcatgtcttcggatctgcctattgtggtcgagtacaagattgcagaaatgggttatgtcaggttttacttggctccaaagattgaagacgaggaggaagata

SEQ ID NO: 2957 - DNA, 1223 bp, Musa acuminata
atgagtgataatccaatatatatatatatatgttccattaatcttccacagcacggcaaccgccgaaccgccccctctataaaagaaggaagctaccgatccttttcttcgttggagctctctctctcgtttgaagggggatccgatctttcctttggttcgagcgaagtaacgcgagagagagagagagagagagagagagagagagagagaggaagatgctggagctcaggctgctgcagggcgggctgctgaagaaggtgctggaggcgatgcgggagctggtgacggacgccaacttcgactgctcccggtccggctgctccctccaggccatggactccagccacgtcgccctcgtcgccctcctcctccgctccgacggcttcgaccacttccgctgcgaccgcaaccgctccatgggcatgaacctcaaccacgtcgccaagctgctgcgctgcgccggcaacgatgacatcgtcaccctcaaggccgacgacgacggcgacaccgtcaccttcatgtttgagagccccaagcaggataagattgcagattttgaaatgaagttgatggatatccaaagtgagcacttaggcattcctgaagcagaatatcaagctattgtaaagatgccatcacaagagtttgcacgaatttgcagagatctgagtaccataggtgacactgttgtaatatctgtgacaaaggaaggagtgaagttctcgaccaaaggagacattggaagtgcaaatattgtttgccggcagaacaccaccgtagacaagccagaagaatcaactgtaatagagatgaaggacccagtttccttgacgtttgctcttcgctatctgatctcatttactaaggcaacacctttgtcaaatactgtcacagtaagcatgtcctcagatctacctatggtcgtcgagtacaagattgcagacatgggctatatcagatactacctggctcccaagatcgatgaagatgaagaccaggcttaacatctcccaagatctgtgtgtttttttttttggttttgttttgggatggtttgatgttcttatcgtctcttgatgtggtgcttgtttttttctctcatataggtttgtaatgctgaacataaacgaatgcatcaattactttgaggatgagtttttgttgtcataattagattgattcttttccagttgtgatcatgttattacttaagttgggga

SEQ ID NO: 2958 - DNA, 803 bp, Glycyrrhiza uralensis
cgttttaattttcccaccagttttaccgagaaaaccgaaaacccgcaaaaaccctaacccggagtaaaccgaccctctgatacctcggtcaagatgttggaactccgtctagtccaaggttcgctcctgaagaaggtgttggaggcgatcaaggagctggtgaacgatgcgaacttcgattgctcctcgaccgggttctccctccaggccatggactccagccacgtggcactggtggcgctgctgctccgctcggaagggttcgagcactatcgctgcgaccgcaacatttccatgggcatgaatctcaacaacatgtccaagatgctccgatgcgccggcaacgacgacatcatcaccatcaagggcgatgacggcagtgacaccgtcaccttcatgttcgaaagccctacgcaagacaaaatttctgattttgagatgaagctgatggacattgatagtgaacaccttggaattccagaggcagaatatcatgccattgttaggatgccatcggctgagtttgctaggatctgcaaagatctcagcagcattggtgacactgttgtcatttcggtaactaaggagggtgtaaagttttccaccaaaggagatattggagctgcaaatattgtctgcagacagaatactaccgtggacaagcctgaagaagctactgttatagagatgaatgagcctgtgtccttgacatttgcattacgatacatgaactcttttacaaaggcaacaccattgtctaatacagttaccattagtctgtcaaatgagctgccagttgtggt

SEQ ID NO: 2959 - DNA, 1180 bp, Elaeis guineensis
aatcccatatttctttgccgtagttcgttctactcctggtcgccaaactcccaccctttcttctctctcgttcccaaagataacgaaggcctctttctttctctcgagaagatgttggaactaaggctggtgcaggggagcctcctgaagaaggtcctggaggcgatccgggagttggtgaacgacgccaacttcgactgctcggcgacgggcttctccctccaggccatggactcgagccacgtggcgctggttgctctcctcctccgatccgagggcttcgagcactaccgctgcgaccgcaacctctccatgggcatgaacctcaacaacatggccaagatgctccgttgtgctggcaacgacgacatcatcaccatcaaggccgacgatggcagcgacaccgtcaccttcatgtttgaaagccccaatcaagataagattgcggattttgagatgaagcttatggacattgatagcgagcatctgggcattccagatgcggagtaccatgccattgtgcgaatgccgtcctcagaatttgcaaggatttgcaaagatctcagcagcattggcgatactgttgttatttcagtgacgaaggaaggtgtgaagttttcgaccgcgggagacattggaacggcaaatattgtttgcagacagaacaagacttttgacaagccagaggaagcaaccatcatagagatgcaagagccggtgtccttgacttttgcccttaggtatatgaactccttcaccaaggcaacaccgcttatctgaaactgtaaccatcagcctttcttctgagctgcctgtggttgtggaatacaagattgctgacatgggttacatacgatattacttggctcccaagattgaagaggatgaggaggatatgaagccataatcagttctatttttctcctcctttctttccttaagtttattctatacaagagggttggtctggttccacttgtatgggggtattggaagaattttaaatgctgggagcatctggaaggttgtgtagattgatgatcatatttcccaagtttttatggcagattttggcattttccatcttgtaacaaccaggccatgggccttgatgaacaagaacgagagcctcgtgctgttctgcaagaaaaattcattatagcatcaaaaaaaaaaaaaa

SEQ ID NO: 2960 - DNA, 1315 bp, Glycine max
agcacccacccagaggtgcaagagaagaaagcgaacgaaatggtaggcattgtcactgctgccacttggatttgatttgtgtgcgcttataagaatagccaactaaggtggggcatggcctacacccattctacactcgcctccttccaaaaccgcaccctccacacacctcttcctctttcgccccctcagattcaaaagacctgtccccccgctgaaagcgtcgatggcggagaccaacaacaacgttgccgtcgaggtccttgaaaaagaggatcttgccgtgtccctggccaaatacgtcgccgatctctccaacaaattcacttccgaaagaggggctttcactgtttgcctgtctggcggctctttgatcaactatctccggaagctgctggaaccgccttatgttgatactcttgaatggtccaaatggcacgtgttttgggtggatgagagagtcgtgcccaagactcacgaagatagcaactacaagcttgctttggatggacttctctccaaggtgccaattcccccgggcaatgtttatgcaatcaatgatgccctttcagccgagggagcggccaatgattacgagacatgtctcagacacttggtcaagaacagtattatagcttcatcgccagccaatggatttccaaaatttgatctaatgctgctgggcatgggccctgatggccacatagcttctttgttcccaggccatcctcttgtggaggaaaaacaaagatgggttaccttcattaaggactcccctaaaccacccccagagagaataactttcaccttaccagtgattaatacttctgcttatgcagcgcttgtggtgactggcaagggtaaagcagatgcagttcactctgtgttaggcaaatctcaaaattttgctaagcttcctgttggattggtttcacctgaaggagagttgaaatggttcttagacaaaggtgcagcctcaaagctggcagcttagccatgatcctatatgttgtgccagtgtatttaactatttacctttttgcaataattaagtgtgtatgagaagaagagacatatctagtactgaatctccttatctcagtgatagttttgcactggagagggtccttggtcatttgtgacaataaagggaatatgaagttagtattttgcttcaacatttctaatttcttctccacagatttccaattaatgtgcaccaaccccacccttttcaacggatgtgttcattcgatttaaatgccgttgttccgtctttgtcattgaaatgaatcaaataatcacttcatgttaa

SEQ ID NO: 2961 - DNA, 1858 bp, Glycine max
gaaattggaaacataagcagtagcacccacccagaggtgcaagagaagaaagcgaacgaaatggtaggcattgtcactgctgccacttggatttgatttgtgtgcgcttataagaatagccaactaaggtggggcatggcctacacccattctacactcgcctccttccaaaaccgcaccctccacacacctcttcctctttcgccccctcagattcaaaagacctgtccccccgctgaaagcgtcgatggcggagaccaacaacaacgttgccgtcgaggtccttgaaaaagaggatcttgccgtgtccctggccaaatacgtcgccgatctctccaacaaattcacttccgaaagaggggctttcactgtttgcctgtctggcggctctttgatcaactatctccggaagctgctggaaccgccttatgttgatactcttgaatggtccaaatggcacgtgttttgggtggatgagagagtcgtgcccaagactcacgaagatagcaactacaagcttgctttggatggacttctctccaaggtgccaattcccccgggcaatgtttatgcaatcaatgatgccctttcagccgagggagcggccaatgattacgagacatgtctcagacacttggtcaagaacagtattatagcttcatcgccagccaatggatttccaaaatttgatctaatgctgctgggcatgggccctgatggccacatagcttctttgttcccaggccatcctcttgtggaggaaaaacaaagatgggttaccttcattaaggactcccctaaaccacccccagagagaataactttcaccttaccagtgattaatacttctgcttatgcagcgcttgtggtgactggcaagggtaaagcagatgcagttcactctgtgttaggcaaatctcaaaattttgctaagcttcctgttggattggtttcacctgaaggagagttgaaatggttcttagacaaaggtgcagcctcaaagctggcagcttagccatgatcctatatgttgtgccagtgtatttaactatttacctttttgcaataattaagtgtgtatgagaagaagagacatatctagtactgaatctccttatctcagtgatagttttgcactggagagggtccttggtcatttgtgacaataaagggaatatgaagttagtattttgcttcaacatttctaatttcttctccacagatttccaattaatgtgcaccaaccccacccttttcaacggatgtgttcattcgatttaaatgccgttgttccgtctttgtcattgaaatgaatcaaataatcacttcatgttaattgcctttattattgtcctttctcacaatcagtgcatcatgtattgaccccctacacggttcttggtacttccacgtggagactttttttttaggctgcgtgttgtatatgtgactctaccgtattatgaggacgcggcttgctgcaacaggcgtgaggatatataaattatggaaagaattactgagttgaaaagtcaagataagcaagaactaatcaatgatgaattggctactgatgcatggttatatttatgggaaggtttttcatgtgagcaaatgcatgttgggaagtcaaatttccctggtgagcaaaaaaaagaagcaaaaaacaaaatagacagcctagaagtcttcatgacagaaaaattcggtgcttccctaccttgtgagcaaatacaccatcactcaagagattaacctagtttgggccattgatcggactcttagaattcttgttgttatcttttccctttttggtccttagttgttgtctgaaccaagaaggtacaaagcttccaca

SEQ ID NO: 2962 - DNA, 1407 bp, Cajanus cajan
ggaagctgtaaaacgtatagcaattagcaattgatggtatcgcctggtcaatgtgagaaattggtggaagagaagagtagaaagcgaacgagatggtaggcattgtgagtggtgtttgatttataagaaggtgggtcatggcttacacccattctacactcttttccaacactcttcgattcccactcgcctctttcccaaacacccacctccatccaccctccgcacacctctcccttcgccccctcactttcagacgcctcattgccattgccctccattccaacgcccttcttcccccaatcaaagcttccatggccgacaccaacaaaaacgtcgccgtcgaggtcttcgacaaggacgatctcgccgtctctctcgccaaatacgtcgccgatctctccgacaagttcaccaaggaaagaggggctttcactgtttgcctctccggtggctctttgatcaaatatctcgggaagcttctggaacccccttatgttgattctcttgaatggtccaaatggcacgtgttttgggtcgatgagagagtcgtgcccaagacccatgaggatagtaactacaagcttgccctcgatggccttctctccaaggtgccaattcctccaggcaataattatgcaatcaatgatgccctttcagctgagggagcagctgatgattatgagacatgtctaagacaattggtcaagaacaatgtgatagcttcatcaccagccagcggatttccaaaatttgatctcatgctgctgggcatgggccctgatggccacgtagcttcattgttcccggggcatcctcttgtggaggagaataaaagatgggttgccttcattaaggactccccaaaaccacccccagagagaataactttcacctttccggtgattaatgcttctgcctacgcagcacttgtggtgactggcaagggtaaagcagatgcagttaactctgtgttgggcaaatctcaaaattctgctaagcttcctgctggattggttgcacctgaaggggagttgaaatggttcctagacaaaggtgcagcctcaaagctgtagatccagtagctaagccatgatctaaatgctgtgctagtgtattttacctttgcaataatcgagtgtgtatgagaagagagacatatacactatactgaatatccttatctcggttatagttttgcactgaagagggtccattgtcatttgtgacaataaagaggatatgaagttattttgcttcaaaatttcttatttgtcccccctccaaattttccaattaatgtgcaccaaccccaccctttcagcgcatgtgttcttcgattttaagtccactgttccgtcgttatcatttaaatgaatcaaataatcgcctcatgttaattgtctt

SEQ ID NO: 2963 - DNA, 1212 bp, Phaseolus vulgaris
gtagaccttgttactgtgagtgtgttccaattgatttgtttgagtgcgcttataagaaggctactgagctatggcttctgtgcattctacactctcaacaaacactctccgattcccattctcttccttccccaacaccaaccttcatccaccgtcaacgcacatcttcttctctcgccccctcacgttcaaaggtgttagcgtcaatcccaagagctttctgaccccgttgaaagtgtccatggcggagaccaacaacgttgttgccaccgaagtcttcgaaaaggaggatcttgccgtctctctggccaaatacgtcgccgatctctccaataaattcacttcggaaaggggggctttcaccgtttgcttgtctggtggctctttgatcaagtatctcgggaaactgctggaaccgccctatgttgattctcttgaatggtccaaatggaatgtgttttggctggatgagagggtcgtgcctaagactcatgacgatagtaactacaagcttgctttagatggccttctctccaaggtaccaattcctccgggcaatgtgtatgcaatcaatgataccctttcagctgagggagcagccgatgattatgagacacgcctcagagaattggtcaataagagtgtgattacttcatcagcaaccagtggatttccaaaatttgatctcatgctgttaggcatgggccctgatggccacgtggcttctttgttcccagggcatcctcttgtgcaggagagtaaaagatgggttaccttcatcaaggactcccccaaaccacccccagagagaataactttcacttttccagtgattaatgcctctgcttatgcagcgcttgtggtgactggcaagggtaaagcagacgtggttcactccgtgttaggcaagtctgaaaatcctgttaagcttcctgccggattggtttcccctgaaggggagttaaaatggttcttagataaagatgcagcctcaaagttgtagatgcagcagctaagtcagttgatctatagttgtgctagttacttttacctttacaatgttgagcttgtgtttgagaagtgctgaatttcctattctcagtgacaattagcattggacagggtccttagtcatttgtgccaataaagggaatattaagttatgttgcttcagactctcatttcttataaaaaagacaaatttccaatcaa

SEQ ID NO: 2964 - DNA, 1219 bp, Phaseolus vulgaris
ttactgtgagtgtgttccaattgatttgtttgagtgcgcttataagaaggctactgagctatggcttctgtgcattctacactctcaacaaacactctccgattcccattctcttccttccccaacaccaaccttcatccaccgtcaacgcacatcttcttctctcgccccctcacgttcaaaggtgttagcgtcaatcccaagagctttctgaccccgttgaaagtgtccatggcggagaccaacaacgttgttgccaccgaagtcttcgaaaaggaggatcttgccgtctctctggccaaatacgtcgccgatctctccaataaattcacttcggaaaggggggctttcaccgtttgcttgtctggtggctctttgatcaagtatctcgggaaactgctggaaccgccctatgttgattctcttgaatggtccaaatggaatgtgttttggctggatgagagggtcgtgcctaagactcatgacgatagtaactacaagcttgctttagatggccttctctccaaggtaccaattcctccgggcaatgtgtatgcaatcaatgataccctttcagctgagggagcagccgatgattatgagacacgcctcagagaattggtcaataagagtgtgattacttcatcagcaaccagtggatttccaaaatttgatctcatgctgttaggcatgggccctgatggccacgtggcttctttgttcccagggcatcctcttgtgcaggagagtaaaagatgggttaccttcatcaaggactcccccaaaccacccccagagagaataactttcacttttccagtgattaatgcctctgcttatgcagcgcttgtggtgactggcaagggtaaagcagacgtggttcactccgtgttaggcaagtctgaaaatcctgttaagcttcctgccggattggtttcccctgaaggggagttaaaatggttcttagataaagatgcagcctcaaagttgtagatgcagcagctaagtcagttgatctatagttgtgctagttacttttacctttacaatgttgagcttgtgtttgagaagtgctgaatttcctattctcagtgacaattagcattggacagggtccttagtcatttgtgccaataaagggaatattaagttatgttgcttcagactctcatttcttataaaaaagacaaatttccaatcaatgatgtgcaccaacccc

SEQ ID NO: 2965 - DNA, 1669 bp, Phaseolus vulgaris
atggagttgtgcactgccaacgcgattcttccaccaaggttctccgttcctacactccacgcagcttgcgttcgaaacctcaaatactccgttccgttcccccgtttcatcatccgcacccaacgaaaattcgacagaagaagaggatcgggaccccgtgcgactgttagtgacggccgttcctgtgaggcggtggacgagagccgaatgcatagagtgtgtgacaagctgattggggttttcatggtggacaagcccacccctaccgattggagaaggttgttggctttcagcagagaatggaacaaccttaggcctcacttttttgcgcgctgtcacgaaagagccgatgccgaagaggatcccgccatgaaggagaagttgctacgccttgcaaggaagctcaaacagattgatgaggatgtacagagacacaatgagcttattgaggtggtaaaacgggatccttctcaaattagtgagattgtctccaagcgtcgcaaagattttactgaggagttctttattcaccttcatacagtggctgaatcctactatgataacaaagaaaagcaaaatgaattggcaaagcttgggaactcatgcttggctgctgttcaagcctatgatgctgcaactgaaaacattgaacaggtaaatgcggcagagttgaaattccaagatattatcaattctccttcgcttgatgctgcctgcaggaagatagacaatttggctgaaaaaaaagaacttgactcaacattagtattgatgatcaccaaagcttggtcagctgccaaggagtcggacatgatgaaagatgaggtaaaggatatcctctttcatttatacaagactgcagtgggaaatcttcagaaactcgtgccaaaagagattagaatagtcaagtatcttattcaaatcgatgatcctgaagagcaactctctgccctcaaagatgcctttacacccggagaagaacttgaaggaaaggatgtggataatttgtacacgactccagagaagcttcacacttggataaagagtgtggtggatgcttatcatttgagtagagaaggtaccctcattagggaagcaagggatctgttgagtccggagatcatccaaaaattggaggggctcaagatgattgtcgaaaggaacttcatgtgaataggagagtaaccaaaagtatattcatcggaattctttttaaccatagaataagcaacttttttttagtgaaaatagataagcaaagcaggaaacaaaatacacaacaatcataatgacagcatctaagttaggtctgtctatggttttggtaacaatagctacatgaaattgaaaagtgagtagggaaatgtgttctttacacgtaggagagggaactattacatagtagacccctatatgaatacgggacttggacttgagccctggcacagggtgattgttctaccaaaagcctaggcctttggttaagtcacttgtaaggttgaagatagaatgtatgtactgttggttactaaagttcatttctctaattttaattttactgttttgtcttcccggtctaagcaaatgaccactcaattagggctgtttttggtttttggaaacggatttttcccttcaattcaattatgtccaacttgaagaaagaaaa

SEQ ID NO: 2966 - DNA, 1784 bp, Cajanus cajan
ccctggttgaatgcgcccctatctagaagggcgaagtgaaggagatggagttaagcacttggattctcccttcacgctgtcgccttccagttctccccacaccccatgcagcttccctcacaaccccactccccttccctaagtgcccaaccatttcccaagcgcccagaagaggattgcgaccctcaccctgtgcgaggctcagtcaagccaattcccctccccaggcgttggaccagcaccgcatgaatggagtctgcgacaagctgattggtgtcttcatggtcgacaagcccacccccaccgattggagaacgttgttggctttcagccgagagtggaacaacctcagaccccacttcttcgcccgatgccaggacagagccctcgctgaacacgaccccgccatgaaggagaacctgctacgccttgccaggaagctcaaacagattgatgaggatgtgcagagacacaatgatctccttcaggtggtgcgacaggacccttcgggaattactgagattgtctccaagcgtcgtaaagattttacggaagaattctttgttcaccttcacacagtggccgaatcttactatgataataaacatgagcaaaatgaattggcaaagctcgggaatgcatgtttggctgctgtacaagcctacgatgctgcaactgaaagcattgagcagctaaatgctgcagagttgaaattccaagatattatcaattctccttcacttgatgctgcctgcaggaagatagacaatttggctgaaaaaaaagaacttgattcaacattggtattgatgatcaccaaagcttggtcagctgccaaggagtcaaacatgatgaaagatgaggtgaaagatatcctctatcatctatacaagactgcagtgggaaatcttcagagactcgtgcctaaagagattagaatagtcaagtatcttattcgaattgaggatcctgaggagcaactaactgccctcaaagatgcatttacacctggagaagaacttgaaggaaaggatgtggataacttgtacacgactccagagaagcttcacacctggataaagagtgtgttggatgcttatcatttgagtagagaaggtaccctcattagggaagcaagggatctgttgaatccagaagtcatccaaaaattggaggtgctcaagaaggttgtggagaggaacttcatgtgaataggagcttaaggaacatgctaaagtggttttcctattttgaaaggccaaaagcatactcgaggcatgagattctcgatgtccacaaattacaaaccatggtctactgtggcattactgcgagaggaaacatgtagatgttggctagtgtttaaggacctaaaattcgttttttaaacaatagaataagaaaaataggaaacaaaatagacaaactatcataattacagcatctatgttaggcttatctttgttttcggttaccaattacaataggaaaggatcccagatgaatagaagacttgaggaactgaacctggcacagggtgagggtgacagttcaaaccaaagcctaggtaggcccttagttaagtcacttgaagataaaatgtacatcctcacgaatttgttctattatatttttgtgttactgaaatgtcatgtttgtaattttaaatccactgttatttatatgttgcaggtctgagcgagtgatcacaattagtggggattgtttggtttgttcttggaaacatatttttcttaaaatagaaacgatgtttgttttgacaa

SEQ ID NO: 2967 - DNA, 1791 bp, Phaseolus vulgaris
cgtaaaccctgcttctacccctgtttgtctctgtctacggcgagtaaccataaccatatctaactgagtgaagggcgagcgagttgatccttctctgactctcaatttcaaaaccgaaccaaatggagttgtgcactgccaacgcgattcttccaccaaggttctccgttcctacactccacgcagcttgcgttcgaaacctcaaatactccgttccgttcccccgtttcatcatccgcacccaacgaaaattcgacagaagaagaggatcgggaccccgtgcgactgttagtgacggccgttcctgtgaggcggtggacgagagccgaatgcatagagtgtgtgacaagctgattggggttttcatggtggacaagcccacccctaccgattggagaaggttgttggctttcagcagagaatggaacaaccttaggcctcacttttttgcgcgctgtcacgaaagagccgatgccgaagaggatcccgccatgaaggagaagttgctacgccttgcaaggaagctcaaacagattgatgaggatgtacagagacacaatgagcttattgaggtggtaaaacgggatccttctcaaattagtgagattgtctccaagcgtcgcaaagattttactgaggagttctttattcaccttcatacagtggctgaatcctactatgataacaaagaaaagcaaaatgaattggcaaagcttgggaactcatgcttggctgctgttcaagcctatgatgctgcaactgaaaacattgaacaggtaaatgcggcagagttgaaattccaagatattatcaattctccttcgcttgatgctgcctgcaggaagatagacaatttggctgaaaaaaaagaacttgactcaacattagtattgatgatcaccaaagcttggtcagctgccaaggagtcggacatgatgaaagatgaggtaaaggatatcctctttcatttatacaagactgcagtgggaaatcttcagaaactcgtgccaaaagagattagaatagtcaagtatcttattcaaatcgatgatcctgaagagcaactctctgccctcaaagatgcctttacacccggagaagaacttgaaggaaaggatgtggataatttgtacacgactccagagaagcttcacacttggataaagagtgtggtggatgcttatcatttgagtagagaaggtaccctcattagggaagcaagggatctgttgagtccggagatcatccaaaaattggaggggctcaagatgattgtcgaaaggaacttcatgtgaataggagagtaaccaaaagtatattcatcggaattctttttaaccatagaataagcaacttttttttagtgaaaatagataagcaaagcaggaaacaaaatacacaacaatcataatgacagcatctaagttaggtctgtctatggttttggtaacaatagctacatgaaattgaaaagtgagtagggaaatgtgttctttacacgtaggagagggaactattacatagtagacccctatatgaatacgggacttggacttgagccctggcacagggtgattgttctaccaaaagcctaggcctttggttaagtcacttgtaaggttgaagatagaatgtatgtactgttggttactaaagttcatttctctaattttaattttactgttttgtcttcccggtctaagcaaatgaccactcaattagggctgtttttggtttttggaaacggatttttcccttcaattcaattatgtccaacttgaagaaagaaaa

SEQ ID NO: 2968 - DNA, 1781 bp, Zea mays
gccgaatcgagcagcagtagccaccttgccatggcgatgcaggctgctttcctcgcggggttctcgcagctcgccgcgcagccgagccgcgactgcgccgtggcagtggcgccgacgcgggtggccgttgctgcggtgggtagcgccaaggtgggcgcgcgggtaggcttgaaggcggggatcgccgcgcccgcgcccgcggcgggccgcggggtgcggtgccgcgcaagcctgatcgagcccgacggcgggcagctggtggacctagtggcgcccgaggagggcgggcggcgcgcggcgctccggcgggaggcggcggaactgccgcaccggctgcgcctcggccgcgtcgacaaggaatgggtccacgtcctcagcgaagggtgggcgagtccgctgcaagggttcatgcgcgagcatgagttcctccaaacacttcattttaatgccatccgcggccaggatggcaggatggtcaacatgtccgtccccatcgtgctctccgtaggggacgcacagcgaagggccatccaggccgacggcgccacgcgcgtcgcgctcgtcgacgaacgcgaccgccccatcgccgtcctcagcgacattgagatctataagcataataaggaagaaagaatagcacggacatgggggacaactgcacctggattaccttatgttgaggaggcaattaccaatgctggtgactggttgattggtggggacttggaggttatagaaccaatcaagtacaatgatggtctagatcagtatcgcctgtctccagcacagctgcgtgaagagtttgccaggcgcaatgctgatgcagtatttgcctttcagcttcgcaatccagtacacaatgggcatgctctacttatgaccgacacacgcaaacgcctccttgagatgggttataaaaaccctgttcttctgctccatccactgggaggattcacaaaagcagatgatgtgcctcttagttggagaatgaagcaacatgagaaggttcttgaggaaggtgtcctcaacccagaatcaactgttgttgcgatcttcccctctcctatgcattatgctgggccaactgaggttcaatggcatgctaaggctcgtattaatgctggtgcaaacttctatatcgttggaagggatcctgctggtatgagccaccccacagagaaaagggacctctatgatgctgatcacggaaagaaggttttgagcatggctcctggccttgagaggctcaacatccttcctttcaaggtggctgcgtatgacacaaagcaaaagaaaatggatttctttgatccatcaaggaaagatgatttcctgttcatctctggcacaaagatgcgcactcttgccaagaaccgagagagtcccccagatggttttatgtgcccgggtggctggaaggtactcgttgaatactatgacagcttggtgccatctgagggcagcagcaagctgcgtgaaccaattgcagcctaaaatctggaaaatccttcatataaggaatgctactatatcttagcaagcggttctttgcgacatagaaccgatgctatatgattgtatactggctgtaagactgtaaaacactaggcttgattcggatgttaatgtgtgctttgtacccggtgtaccttctctgctggcagtgttgcacatgcactggagcacatcaaacgtttggtgttaataaggacaggctatgtatcctctgccagattgtacatatatacattgtggtgatatataattataaagctgacctc

SEQ ID NO: 2969 - DNA, 2055 bp, Sorghum bicolor
cggcaggctacgttcaccgcgcccatggcctccctccccgcaatcccatccaggttcacgcacacccgcctccccctcttgccttttcctaatcaattcacccacgcagccactgcgaaggtccggtggtggccgccaattttacaaaaccaaacaaaacgcacccgcgatataaagaggacaccaccaggtggtgaggtggaagaggcagaggtggacgaggcgcgccaccggccgagccgaatcgagcagcagcagcgccctcccaccttgccatggcgacgcaggctgctttccttgcggggttatcgcagctcgccgcacagccgggccgggaccgcgccgtggcgccggcgcgggtggccgtggcggcggtgggtgtgggtagcgccaaggtgggtgtgcgggtgggcgtgaaggcggggaccgccgaggccaaagcggtggcgcagcgccgcggggtgcggtgccgggccagcctgatcgagcccgacggcgggcggctggtggacctggtggcgcccgaggagggcgggcggcgcgcggcgctgcggcgggaggcggccgagctgccgcaccgcctgcgcctcagccgcgtcgacaaggaatgggtccacgtcctcagcgaagggtgggcgagcccgctgcaagggttcatgcgcgagcatgagttcctccaagcacttcatttcaatgccatccgcggcgcggatggcaggatggtcaacatgtccgtccccatcgtgctctcccttggggacgcacagcggagggccatccaggccgacggcgccacgcgcgtcgcgctcgtcgaccaacgcgaccgccccatcgccgtcctcagcgacatcgagatctataagcataataaggaagaaagaatagcaaggacatgggggacaactgcacctggattaccttatgtcgaggaggcaattaccaatgctggtgactggttgattggtggggacttggaggttatagaaccaatcaagtacaatgatggtctagatcagtatcgcctgtctccagcacagctgcgtgaagagtttgccaggcgcaatgctgatgcggtatttgcctttcagcttcgcaatcctgtacacaatgggcatgctctgcttatgaccgacacacgtaaacgcctccttgagatgggttataaaaatcctgttcttctgctccatccactgggaggattcacaaaagcagatgatgtgcctcttagttggagaatgaagcaacatgagaaggttcttgaggaaggtgtcctcaacccagaatcaactgttgttgcgatctttccctctccaatgcattatgctgggccaaccgaggttcagtggcatgctaaggctcgtattaatgctggcgcaaatttctatattgttggaagggatcctgctggtatgagccatcccacagagaaaagggacctctatgatgcggatcatggaaagaaggttttgagcatggctcctggtcttgagaggctcaacatccttccattcaaggtggctgcatatgacacaaagcaaaagaaaatggatttctttgatccatcaaggaaagatgatttcctcttcatctctggcacaaagatgcgcactcttgccaagaaccgcgagaatcccccagatggttttatgtgcccgggtggctggaaagtactcgttgaatactatgacagcttggtgccatctgagggcagcagcaagctgcgagaaccagttgcagcctaaaatctgggaagtgcttcagataaggagtcctattatatcagcgcaagcggttctttgcgacatagaaccgatgttatatgattgtataccggctgtaagacttaaaaacactgggcttggttcggacgttaatgtgtgcttttgtgactggtgtgccctatctgctggcagtgctgcacatgcagtagagcacatcaaatgtttggtgttaataaggacaggctatgtatcgtctgccagattgtacatatacattgtggtgatataattaaaaccctgtcttctgccgttcaggctccgtaatgatgaccct

SEQ ID NO: 2970 - DNA, 2576 bp, Sorghum bicolor
caaatcttctctcaattcatgaacgatataaactccgtagctatgaaccagtgtgccacagacctagtctgcgcagagaatccctcactaccaaagacacataggttcagacgttagaaaggtgtcatcacacacacacacacacacactaacagcagtccaaatccaacctgctcaccatcctaaacaaaacaccaaaagccaagcaggcatgatccatcctcatcgacccccattaaccctgccccacgttccccgctcggcaggctacgttcaccgcgcccatggcctccctccccgcaatcccatccaggttcacgcacacccgcctccccctcttgccttttcctaatcaattcacccacgcagccactgcgaaggtccggtggtggccgccaattttacaaaaccaaacaaaacgcacccgcgatataaagaggacaccaccaggtggtgaggtggaagaggcagaggtggacgaggcgcgccaccggccgagccgaatcgagcagcagcagcagcagcagcgccctcccaccttgccatggcgacgcaggctgctttcctcgcggggttatcgcagctcgccgcacagccgggccgggaccgcgccgtggcgccggcgcgggtggccgtggcggcggtgggtgtgggtagcgccaaggtgggtgtgcgggtgggcgtgaaggcggggaccgccgaggccaaagcggtggcgcagcgccgcggggtgcggtgccgggccagcctgatcgagcccgacggcgggcggctggtggacctggtggcgcccgaggagggcgggcggcgcgcggcgctgcggcgggaggcggccgagctgccgcaccgcctgcgcctcagccgcgtcgacaaggaatgggtccacgtcctcagcgaagggtgggcgagcccgctgcaagggttcatgcgcgagcatgagttcctccaagcacttcatttcaatgccatccgcggcgcggatggcaggatggtcaacatgtccgtccccatcgtgctctcccttggggacgcacagcggagggccatccaggccgacggcgccacgcgcgtcgcgctcgtcgaccaacgcgaccgccccatcgccgtcctcagcgacatcgagatctataagcataataaggaagaaagaatagcaaggacatgggggacaactgcacctggattaccttatgtcgaggaggcaattaccaatgctggtgactggttgattggtggggacttggaggttatagaaccaatcaagtacaatgatggtctagatcagtatcgcctgtctccagcacagctgcgtgaagagtttgccaggcgcaatgctgatgcggtatttgcctttcagcttcgcaatcctgtacacaatgggcatgctctgcttatgaccgacacacgtaaacgcctccttgagatgggttataaaaatcctgttcttctgctccatccactgggaggattcacaaaagcagatgatgtgcctcttagttggagaatgaagcaacatgagaaggttcttgaggaaggtgtcctcaacccagaatcaactgttgttgcgatctttccctctccaatgcattatgctgggccaaccgaggttcagtggcatgctaaggctcgtattaatgctggcgcaaatttctatattgttggaagggatcctgctggtatgagccatcccacagagaaaagggacctctatgatgcggatcatggaaagaaggttttgagcatggctcctggtcttgagaggctcaacatccttccattcaaggtggctgcatatgacacaaagcaaaagaaaatggatttctttgatccatcaaggaaagatgatttcctcttcatctctggcacaaagatgcgcactcttgccaagaaccgcgagaatcccccagatggttttatgtgcccgggtggctggaaagtactcgttgaatactatgacagcttggtgccatctgagggcagcagcaagctgcgagaaccagttgcagcctaaaatctgggaagtgcttcagataaggaatcctattatatcagcgcaagcggttctttgcgacatagaaccgatgttatatgattgtataccggctgtaagacttaaaaacactgggcttggttcggacgttaatgtgtgcttttgtgactggtgtgccctatctgctggcagtgctgcacatgcagtagagcacatcaaatgtttggtgttaataaggacaggctatgtatcgtctgccagattgtacatatacattgtggtgatataattaaaaccctgtcttctgccgttcaggctccgtaatgatgaccctgttttatcactagttctctttaagcatgtacttttttgtacttttatcaatgagcataagttattgggttaaccttatgtcctcatggttttgatcttttggaagccgcaaccttttttgtgtgacttcacatttggtattggattcactacttgcaagagcttgtttggatcacagttggtttattgtaatctggatcatatgtagaattattataattggaattatagattttaataatgagtgtttggg

SEQ ID NO: 2971 - DNA, 1993 bp, Zea mays
tcccatccaggttcacgcgcacccgcctcccctcttgccttttcctaatcaaatcacccacgcagccactgcgaaggtccggtggtggccgcctttcacaaaaccaaacaaaacgcacccgcaatataaagaggagaccaaggcgtgaagtggaggaggcagaggtggacgaggcgcgccaccgcccgagccgaatcgagctgcagaaaccaccttggcatggcgacacaggccgctttcctcgcagggttctcgcagctcgccgcgcagccgggccgcgaccgcgccgtggcggtggcggtggcgccggcgccgggcccggcccgggtggccgttgcggcggtgggtagcgccaagttgggcgtgaaggcggggacgtccaggaccgcggcggtggcgcgcctcggggtgcggtgccgggccagcctgatcgagcccgacggcgggcggctggtggacctggtggcgcccgaggagggcgggcggcgcgcggcgctgcggcgggaggcggcggagctgccgcaccggctgcgcttgggccgcgtcgacaaggaatgggtccacgtcctcagcgaagggtgggcgagcccgctgcaagggttcatgcgcgagcatgagttcctccaagcacttcatttcaatgccatccgcggccaggatggcaggatggtcaacatgtccgtccccatcgtgctctctgtcggggacgcacagcgaagggccatccaggccgacggcgccacgcgcgtcgcgctcgttgacgagcgcgaccgccccatcgccgtcctcagcgacattgagatctataagcataataaggaagaaagggtagcacggacatgggggacaactgcacctggattaccttatgtcgaggaggcaattaccaatgctggtgactggttggttggtggggacttggaggttatagaaccaatcaagtacaacgatggtctagatcagtatcgcctgtctccagcacagctgcgtgaagagtttgccaggcgcaatgctgatgcagtatttgcctttcagcttcgcaatcctgtacacaatgggcatgctcttcttatgaccgacacacgcaaacgtctccttgagatgggttataaaaaccctgttcttctgctccatccactgggaggattcacaaaagcagatgatgtgcctcttagttggagaatgaagcaacatgagaaggttcttgaggaaggtgtcctcaacccagaatcaactgttgttgcgatctttccctctccaatgcattatgctgggccaactgaggtgcagtggcatgctaaggctcgtattaatgctggtgcaaatttctatattgttggaagggatcctgctggtatgagccatcccacggagaaaagggacctctatgatgctgaccacgggaagaaggttttgagcatggctcctggcctcgagaggctcaacatccttcctttcaaggtggctgcatatgacacaaagcaaaagaaaatggatttcttcgatccatcaaggaaagatgatttcctcttcatctctggcacaaagatgcgcactcttgccaagaaccgcgagagtcccccggatggttttatgtgcccgggtggctggaaagtgctcgttgaatactatgacagcttggtgccatccgagggcagcagcaagctgcgcgagccagttgcagcctgaaatatgggaagcgcttcagataaggaaccgtactatgtcagcacaagcggttctttgcgacatagaaccgttgttgtatgattgtatactggcttgtaagacttaaaaacactgggcttgatttggacgttaatgtgtgcattgtaactggtgtgccctatctgctgacagtgttgcacatcacatgtttggtgttaataaggacagactatgtatcatctgccagattgttgtacatatacattgtggtgatataaacatgaagctgtcttctgctattttataaccagttctttttaagcat

SEQ ID NO: 2972 - DNA, 1875 bp, Zea mays
cacaaaaccaaacaaaacgcacccgcaatataaagaggagaccaaggcgtgaagtggaggaggcagaggtggacgaggcgcgccaccgcccgagccgaatcgagctgcagaaaccaccttggcatggcgacacaggccgctttcctcgcagggttctcgcagctcgccgcgcagccgggccgcgaccgcgccgtggcggtggcggtggcgccggcgccgggcccggcccgggtggccgttgcggcggtgggtagcgccaagttgggcgtgaaggcggggacgtccaggaccgcggcggtggcgcgcctcggggtgcggtgccgggccagcctgatcgagcccgacggcgggcggctggtggacctggtggcgcccgaggagggcgggcggcgcgcggcgctgcggcgggaggcggcggagctgccgcaccggctgcgcttgggccgcgtcgacaaggaatgggtccacgtcctcagcgaagggtgggcgagcccgctgcaagggttcatgcgcgagcatgagttcctccaagcacttcatttcaatgccatccgcggccaggatggcaggatggtcaacatgtccgtccccatcgtgctctctgtcggggacgcacagcgaagggccatccaggccgacggcgccacgcgcgtcgcgctcgttgacgagcgcgaccgccccatcgccgtcctcagcgacattgagatctataagcataataaggaagaaagggtagcacggacatgggggacaactgcacctggattaccttatgtcgaggaggcaattaccaatgctggtgactggttggttggtggggacttggaggttatagaaccaatcaagtacaacgatggtctagatcagtatcgcctgtctccagcacagctgcgtgaagagtttgccaggcgcaatgctgatgcagtatttgcctttcagcttcgcaatcctgtacacaatgggcatgctcttcttatgaccgacacacgcaaacgtctccttgagatgggttataaaaaccctgttcttctgctccatccactgggaggattcacaaaagcagatgatgtgcctcttagttggagaatgaagcaacatgagaaggttcttgaggaaggtgtcctcaacccagaatcaactgttgttgcgatctttccctctccaatgcattatgctgggccaactgaggtgcagtggcatgctaaggctcgtattaatgctggtgcaaatttctatattgttggaagggatcctgctggtatgagccatcccacggagaaaagggacctctatgatgctgaccacgggaagaaggttttgagcatggctcctggcctcgagaggctcaacatccttcctttcaaggtggctgcatatgacacaaagcaaaagaaaatggatttcttcgatccatcaaggaaagatgatttcctcttcatctctggcacaaagatgcgcactcttgccaagaaccgcgagagtcccccggatggttttatgtgcccgggtggctggaaagtgctcgttgaatactatgacagcttggtgccatccgagggcagcagcaagctgcgcgagccagttgcagcctgaaatatgggaagcgcttcagataaggaaccgtactatgtcagcacaagcggttctttgcgacatagaaccgttgttgtatgattgtatactggcttgtaagacttaaaaacactgggcttgatttggacgttaatgtgtgcattgtaactggtgtgccctatctgctgacagtgttgcacatcacatgtttggtgttaataaggacagactatgtatcatctgccagattgttgtacatatacattgtggtgatataaacatgaagctgtcttctgctatttt

SEQ ID NO: 2973 - DNA, 2112 bp, Setaria italica
cgcaatcccatccaggttcactcgccgtcctcgctgccttttcctaatcaaatcacccacgcagccactgcgaaggccccgtggtggccgccgatgcaaaaaccaaacagaaagcacccgcattataagaggaggcgaccaaggcgggaggttgaagacgaggaggcggcgaccgaccggccgaatcgagaagcagcagcagccagctagctagccatggcgacgcaggccgccttcctcgcgaggttcccgcagctcgccgcgcagccgggccgcgaccgcgctgggatggggggcccggcgcgggtcagcgtggcggcgattggcagcgccgccaaggtgggtgtgggcatgagggcggtggcgcgccgcggggtgcggtgcagggccagcctgatcgagcccgacggcgggcggctggtggacctggtggcgcccgaggagggcggccggcgcgcggcgctgcggcgggaggcggcgtcgctgccgcaccgggtgcgcctcggccgcgtcgagaaggagtgggtccacgtcctcagcgaagggtgggccagcccgctgcaagggttcatgcgcgagcatgagttcctccaagcacttcatttcaacgccatccgcggcgaggatggcaggatggccaacatgtccgtccccatcgtgctctccctcggggacgcgcagcgacgggccatcctcgctgacggcgccacgcgcgtcgcgctcgtcgacgaccgcgaccgccccatcgccgtgttgagcgacattgagatctacaagcacaataaggaagaaagaattgcaaggacatgggggacaactgcacctggattaccttatgttgaggaggcaattaccaatgctggtgactggttgattggaggggacttggaggttatagaaccgatcaagtacaatgatggtcttgatcagtatcgcctgtctccggcacagctgcgcgaagagtttgccaggcgtaatgctgatgctgtatttgcctttcagcttcgcaatcctgtacacaatgggcatgctttgcttatgaccgacacacgcaaacgcctccttgatatgggttacaaaaaccctgttcttctgctccatccactggggggattcacaaaagcagatgacgtacctcttagttggagaatgaagcagcatgagaaggttcttgaggaaggtgtcctcaacccagaatcaactgttgttgcaatcttcccctctccaatgcattatgctgggccaactgaagtgcagtggcatgctaaggctcgtattaatgctggtgcaaatttctacattgttggaagggaccctgcgggtatgagccatcccacagccaaaagggacctttatgatgctgatcatggaaagaaggttttgagcatggctcctgggcttgagaggctcaacatccttccattcagagtggctgcatatgacacaaaacaaaagaaaatggatttcttcgatccatcaaggaaagatgatttcctgttcatctctggaacaaagatgcgcactcttgccaagaaccgcgagagccccccagatggttttatgtgtccaggtggctggaaggtcctcgtggaatactatgacagcttggtgccatcagagggcagcagcaagctccgcgagccagtcgcagcctagaagctgaaaatgcttaagataatggatactactatatctcagcaaggggttctttgcgacatagaaccaatgttatatgattgtatgccggtcgtaagactcactgggcttgattcagacattactgtgtggtttgtaactggtgtgccctatccgctggcagtgttgcacatgcaatggagcccatcatcacgtgttctgtgccaataaggacggactctgtatgctctgccagattgtacatatacattgtggtgatatgtttacaaggcttgatatgcttgctaagatctcgtaagctaatttggtttgcagatttctcgtccaagcttcggttcaggctcagaatgatgaattgttgtttgtcattgatttgaccatcacagctttttggattgaatttgataatgcactatttgatttaacctatgagtataacattcatgtaattttact

SEQ ID NO: 2974 - DNA, 2033 bp, Setaria italica
atcaaatcacccacgcagccactgcgaaggccccgtggtggccgccgatgcaaaaaccaaacagaaagcacccgcattataagaggaggcgaccaaggcgggaggttgaagacgaggaggcggcgaccgaccggccgaatcgagaagcagcagcagccagctagctagccatggcgacgcaggccgccttcctcgcgaggttcccgcagctcgccgcgcagccgggccgcgaccgcgctgggatggggggcccggcgcgggtcagcgtggcggcgattggcagcgccgccaaggtgggtgtgggcatgagggcggtggcgcgccgcggggtgcggtgcagggccagcctgatcgagcccgacggcgggcggctggtggacctggtggcgcccgaggagggcggccggcgcgcggcgctgcggcgggaggcggcgtcgctgccgcaccgggtgcgcctcggccgcgtcgagaaggagtgggtccacgtcctcagcgaagggtgggccagcccgctgcaagggttcatgcgcgagcatgagttcctccaagcacttcatttcaacgccatccgcggcgaggatggcaggatggccaacatgtccgtccccatcgtgctctccctcggggacgcgcagcgacgggccatcctcgctgacggcgccacgcgcgtcgcgctcgtcgacgaccgcgaccgccccatcgccgtgttgagcgacattgagatctacaagcacaataaggaagaaagaattgcaaggacatgggggacaactgcacctggattaccttatgttgaggaggcaattaccaatgctggtgactggttgattggaggggacttggaggttatagaaccgatcaagtacaatgatggtcttgatcagtatcgcctgtctccggcacagctgcgcgaagagtttgccaggcgtaatgctgatgctgtatttgcctttcagcttcgcaatcctgtacacaatgggcatgctttgcttatgaccgacacacgcaaacgcctccttgatatgggttacaaaaaccctgttcttctgctccatccactggggggattcacaaaagcagatgacgtacctcttagttggagaatgaagcagcatgagaaggttcttgaggaaggtgtcctcaacccagaatcaactgttgttgcaatcttcccctctccaatgcattatgctgggccaactgaagtgcagtggcatgctaaggctcgtattaatgctggtgcaaatttctacattgttggaagggaccctgcgggtatgagccatcccacagccaaaagggacctttatgatgctgatcatggaaagaaggttttgagcatggctcctgggcttgagaggctcaacatccttccattcagagtggctgcatatgacacaaaacaaaagaaaatggatttcttcgatccatcaaggaaagatgatttcctgttcatctctggaacaaagatgcgcactcttgccaagaaccgcgagagccccccagatggttttatgtgtccaggtggctggaaggtcctcgtggaatactatgacagcttggtgccatcagagggcagcagcaagctccgcgagccagtcgcagcctagaagctgaaaatgcttaagataatggatactactatatctcagcaaggggttctttgcgacatagaaccaatgttatatgattgtatgccggtcgtaagactcactgggcttgattcagacattactgtgtggtttgtaactggtgtgccctatccgctggcagtgttgcacatgcaatggagcccatcatcacgtgttctgtgccaataaggacggactctgtatgctctgccagattgtacatatacattgtggtgatatgtttacaaggcttgatatgcttgctaagatctcgtaagctaatttggtttgcagatttctcgtccaagcttcggttcaggctcagaatgatgaattgttgtttgtcattgatttgaccatcacagctttttggattgaatttgataatgcactatttgattt

SEQ ID NO: 2975 - DNA, 1893 bp, Pennisetum glaucum
cgggtcagcgtggcggcgattgggagcgccgccgccaaggtgggtgtgggtgtgggcgtgagggcggtggcgcgccgcggggtgcggtgccgggccagcctgatcgagcccgacggcgggcggctggtggacctggtggcgcccgaggagggcggccggcgcgcggcgctgcggcgggaggcggcgtcgctgccgcaccgggtgcgcctcggccgcgtcgagaaggagtgggtccacgtcctgagcgaagggtgggccagcccgctgcaagggttcatgcgcgagcatgagttcctccaagcacttcatttcaacgccatccgcggcgaggatggccgggtggccaacatgtccgtccccatcgtgctctccctcggggacgcgcagcgacgggcaatcctcgccgacggcgccacgcgcgtcgcgctcgtcgacgaccgcgaccgccccatcgccgtgctcagcgacattgagatctacaagcacaataaggaagaaagaattgcaaggacatgggggacaactgcccctggattaccttatgttgaggaggcaattaccaatgctggtgactggttgattggaggggacttggaggtcatagaaccgatcaagtacaatgatggtctcgatcagtatcgcctgtctccggcacagctgcgcgaagagtttgccagacgtaatgctgatgctgtatttgcctttcagcttcgcaatcctgtacacaatgggcatgctttgcttatgactgacacacgcaaacgcctccttgacatgggttacaaaaaccctgttcttctgctccatccactggggggattcacaaaagcagatgatgtacctcttagttggagaatgaagcagcatgagaaggttcttgaggaaggtgtcctcaacccagaatcaactgttgttgcaatcttcccctctccaatgcattatgctgggccaactgaagtgcagtggcatgctaaggctcgtattaatgctggtgcaaatttctatattgttggaagggaccctgcgggtatgagccaccccacagccaaaagggacctttatgatgctgatcatggaaagaaggttttgagcatggctcctggccttgagaggctcaacatccttcctttcagagtggctgcatatgacacaaaacaaaagaaaatggatttcttcgatccatcaaggaaagatgatttcctgttcatctctggaacaaagatgcgcactcttgccaagaaccgcgagagccccccagatggttttatgtgcccaggtggctggaaggtcctcgtggaatactatgatagtttggtgccgtcagagggcagcagcaagcttcgtgagccagttgcagcctagagaaactgaaaatgctcaagacaatggatactagtatatctcagcaagcggttctttgcgacatagaaccaatgttatatgattgtatgctggtcgtaagactcactgggcttgattcagacattagtgtgtggtttgtaattggtgcgccctatccgctggcagtgttgcacatgctgacatgcaatggagcccatcacgtgttatggtcaataaggatgggctctgtatcctctgccagattgtacatatacattgtggtgatatgtttacaggaattgatatgcttgctaaaaaaaaaaaaaaaaaaaaaaaagtaaactctgcgggggaagttggtgtgttgatatttctgcacccctcgtgggatccgaaaggaagctgagtggatgcttgagaacaaagtcttggtgccccgatacctccatggagatcatggagttttgccgtagatcttgtgagggacaactttatgaattgggtcgctccaagcatttggctcggggtcgctgtgaatacttctgatgataa

SEQ ID NO: 2976 - DNA, 1858 bp, Panicum virgatum
cgccagggcggggggcgtgaaggcgggggccgccgggcccgggtgggcggcggcgccccgcggggtgcggtgccgggccagcctgattgagcccgacggcgggcggctggtggacctggtggcgcccgaggagggcggccggcgcgcggccctgcggcgggaggcggcgtccctgccgcaccggctgcgcctgggccgcgtcgacaaggagtggctccacgtcctgagcgaaggatgggccagcccgctgcaagggttcatgcgcgagcatgagttcctccaagcacttcatttcaacgccatccgcggcgcggatggcaggatggtcaacatgtccgtccccatcgtgctctccctcggggacgcgcagcgacgggccatccaggccgacggcgccacgcgcgtcgcgctcgtcgacgaccgcgaccgccccctcgccgtattgagcgacattgagatctacaagcacaacaaggaagaaagaattgcaaggacatgggggacaactgcacctggattaccttacgttgaggaggcaattaccaatgctggtgactggttgattggtggggacttggaggtcatagaaccgatcaagtacaatgatggtctcgatcagtatcgcctgtctccggcacagctgcgcgaagagtttaccaggcggaatgctgatgctgtatttgcctttcagcttcgcaaccctgtacacaacgggcatgctttgcttatgactgacactcgcaaacgcctccttgatatgggctacaaaaaccctgttcttttgctccatccactggggggattcacaaaagcagatgatgtacctcttagctggagaatgaagcagcatgagaaggttcttgaggaaggtgtcctcaacccagaatcaactgttgttgcaatcttcccctctccaatgcattatgcggggccaactgaggtgcaatggcatgctaaggctcgtattaatgctggtgcaaatttctatattgttggaagggatcctgccggtatgagccatcctactgcgaaaagggacctttatgacgctgatcatggaaagaaggttttgagcatggctcctggccttgagaagctcaatatccttcctttcagggttgctgcatatgacacaaagcaaaagaaaatggatttcttcgatccatcaaggaaagatgattttctgttcatctctggcacaaagatgcgcactcttgccaagaaccgcgagagccccccagatggttttatgtgcccgggtggctggaaagttctcgtggaatactatgacagcttggtgccgtcagaggggagcagcaagctgcgcgagccagttgcagcctagaagctggaaatgcttaagataatggatactactgtatctcagcaagcggttctttgcgacatagaaccaatgttatatgattgtataccggtcgtaagacctacactgggcttgattcagacaattactgtgtggtttgtaattggtgtgcattatctgctggcagtgttgcacatgcaacgcagcccatctcgtgttcagtgtcaataaggacgggctctgtatcctctgccagattgtacatatacgttgtggtgatatgtttacaaggcttgatatgcttgctaagatctcttaagctaatttggttttccaaatttctcgtccagctatcgttcaggctcggaatgatgaattgttggttgtctttgattggccggcataacttttggattgaatttgagaacgcgctatttgttttaagctgagtataatttacttttactattcaaaaaacatttatttactcttatcagtgagcataaacttttaggttaacctcatattttctga

SEQ ID NO: 2977 - DNA, 2054 bp, Oryza sativa
atgttcaccccgcccccatgccccgcaatcccatccaggttcatccgcctcccgtcttcttttttttttcattcatccgcaaccactgcgaacttgcgaaggccgcgggtacaagaaaagaagagaaaaataaaaaggagccgcattataagtaggtagtggtggtggtggaggaggaggagagcaaatcgaggtagccatggcgatgcaggccgccttcgccgcctcgatgttcccgcagctggcgcagcggaggggaagcgatcgcgcggtggtggtggcgccgccggcgccggcgccggtgagggtggcgatgaggagcggtggggcggcggcggcggcggcgagaggggtgaggtgcagggcgagcctgatcgagcccgacggggggaggctggtggagctggtggtgccggaggagggagggcggcgggaggcggcgcggcgggaggcggcggcgctggcgcaccgggtgaggctggggcgggtggagacggagtggctgcacgtgctgagcgaagggtgggcgagcccgctgcgagggttcatgcgcgaggccgagttcctccaagcacttcatttcaacgccatccgcggcggagacggggccatggtcaacatgtccgtgcccatcgtcctccctctcggtgacgcccagcgccgcgccatcgaggcgtccggcgcccgccgcgtcgcgctcgtcgacgccgccgaccgccccctcgccgtcctcagcgacattgagatctacaagcataacaaagaagaaaggattgcacggacatggggaacaactgcacctgggctgccttatgttgatgaggcgattacaaatgctggtgattggttaattggtggtgacttggaggttatagaaccaatcaagtacaatgatggtcttgatcagtatcgcttgtctccagcccagctgcgtgaagagtttgccagacgcaatgctgatgcggtattcgcgtttcagcttcgcaatcctgtacacaatggacatgctttgctcatgactgatacacgcaaacgccttctcgagatgggttacaaaaatcctgttcttctgcttcatccattgggaggattcacaaaagcagatgatgtgcctcttagttggagaatgaagcagcatgaaaaggttcttgaggaaggtgtcctcaacccagaatcaactgtcgttgcaatcttcccctctccaatgcattatgcagggccaactgaagtgcaatggcatgctaaggctcgtataaatgctggtgcaaacttctacatagttggaagagatcctgctggtatgggccacccaactgaaaagagggacctgtatgatgctgatcatgggaaaaaggtgttgagcatggctcctgggcttgagaagctcaatatccttcctttcaaggtggctgcatatgacacaaagcaaaagaaaatggactttttcgatccatcaaggaaagatgatttcctgttcatctctggcacaaagatgcgtactcttgccaagaactgccagagcccccctgacggattcatgtgcccgggtggctggaaggtccttgttgaatactacgacagcttgacgccatcagcggacagcagcaaactgcgcgaggcggttgcggcctagaaagctgaaactacctcaaataagcaagaacattgcatcttgcaactgtaaaatggttctttcagagagagaaccaatggtatatgtgtatactactggtcgcaaggcctaaacatttgggtttgattggaagcgcattctggtgtgatttgtatgtgccctatcatctggtaatgctacattggaagctcatcatgctgttggtgttaataaggatgagcctttgtgtgctctgctagatatgtacatatacaatgtggtggtatttatatagtgcttggtgtgtttgctattatagaagagcaggtttcatcttctattgtcgcatctggtcattggacagggctcgaggacatgagggatggtcagcaatatttttgttaacactggaatctcatcaaggtttctgtatggtatgggc

SEQ ID NO: 2978 - DNA, 2421 bp, Oryza sativa
aaataagttcatatgaagtctattattaaaattatttattaaaaagtaaaaaaaaaacacatacacacgccctagctcactccagctgatccaaaatactactccacccaaacaaaccaaaaaaaaaactcaagttcgcagaagatccaaaccttaaacatgacacacaagttcatacgcctgcttggcagtagaccagtccaaatccaaccctgtcccccaaattaacaaaccccagaaatgcccccaaaagacaacaaagcactcaccacccccccaaccctaatcagcatttgattttgatccatcctcatcaacccccactattaatcctcttccccttccccccgctctccgtccatgttcaccccgcccccatgccccgcaatcccatccaggttcatccgcctcccgtcttctttttttttaattcatccgcaaccactgcgaacttgcgaaggccgcgggtacaagaaaagaagagaaaaataaaaaggagccgcattataagtaggtagtggtggtggtggaggaggaggagagcaaatcgaggtagccatggcgatgcaggccgccttcgccgcctcgatgttcccgcagctggcgcagcggaggggaagcgatcgcgcggtggtggtggcgccgccggcgccggcgccggtgagggtggcgatgaggagcggtggggcggcggcggcggcggcgagaggggtgaggtgcagggcgagcctgatcgagcccgacggggggaggctggtggagctggtggtgccggaggagggagggcggcgggaggcggcgcggcgggaggcggcggcgctggcgcaccgggtgaggctggggcgggtggagacggagtggctgcacgtgctgagcgaagggtgggcgagcccgctgcgagggttcatgcgcgaggccgagttcctccaagcacttcatttcaacgccatccgcggcggagacggggccatggtcaacatgtccgtgcccatcgtcctccccctcggtgacgcccagcgccgcgccatcgaggcgtccggcgcccgccgcgtcgcgctcgtcgacgccgccgaccgccccctcgccgtcctcagcgacattgagatctacaagcataacaaagaagaaaggattgcacggacatggggaacaactgcacctgggctgccttatgttgatgaggcgattacaaatgctggtgattggttaattggtggtgacttggaggttatagaaccaatcaagtacaatgatggtcttgatcagtatcgcttgtctccagcccagctgcgtgaagagtttgccagacgcaatgctgatgcggtattcgcgtttcagcttcgcaatcctgtacacaatggacatgctttgctcatgactgatacacgcaaacgccttcttgagatgggttacaaaaatcctgttcttctgcttcatccattgggaggattcacaaaagcagatgatgtgcctcttagttggagaatgaagcagcatgaaaaggttcttgaggaaggtgtcctcaacccagaatcaactgtcgttgcaatcttcccctctccaatgcattatgcagggccaactgaagtgcaatggcatgctaaggctcgtataaatgctggtgcaaacttctacatagttggaagagatcctgctggtatgggccacccaactgaaaagagggacctgtatgatgctgatcatgggaaaaaggtgttgagcatggctcctgggcttgagaagctcaatatccttcctttcaaggtggctgcatatgacacaaagcaaaagaaaatggactttttcgatccatcaaggaaagatgatttcctgttcatctctggcacaaagatgcgtactcttgccaagaactgccagagcccccctgacggattcatgtgcccgggtggctggaaggtccttgttgaatactacgacagcttgacgccatcagcggacagcagcaaactgcgcgaggcggttgcggcctagaaagctgaaactacctcaaataagcaagaacattgcatcttgcaactgtaaaatggttctttcagagagagaaccaatggtatatgtgtatactactggtcgcaaggcctaaacatttgggtttgattggaagcgcattctggtgtgatttgtatgtgccctatcatctggtaatgctacattggaagctcatcatgttgttggtgttaataaggatgagcctttgtgtgctctgctagatatgtacatatacaatgtggtggtatttatatagtgcttggtgtgtttgctattatagaagagcaggtttcatcttctattgtcgcatctggtcattggacagggctcgaggacatgagggatggtcagcaatatttttgttaacactggaatctcatcaaggtttctgtatggtatgggcaattgctt

SEQ ID NO: 2979 - DNA, 1890 bp, Triticum aestivum
aagcagcagccatggcgacgcaggccgccttcgcagtgaggttcccgcagctggcgcggccgggcaggggccatggccagggacagccggcgacgcgggtcgcggtaaggggcggcagggccgcggcggcggcggcgcgcggggtgcggtgccgggccggcggcctgatcgagccggacgggggcaggctggtggagctggtggcgcccgaggagggcggccggcgggcggcgctgcgccgggaggcggcggcgctgccgcaccggctgcgcctgggccgcgtggacaccgagtggctgcacgtgctcagcgagggctgggccagcccgctgcgcggcttcatgcgcgagaccgagttcctccaagcacttcatttcaacgccgtccgcggcgccgatggcagcctcgtcaacatgtccgtgcccatcgtcctcgccctcgacgacgcccagcgccgcgccatccaggccgacggcgccaccaccgtcgcgctcgtcgacgcccacgaccgccccgtcgccgtgctcagcgatattgagatctacaagcataacaaggaagaaagaattgcacggacttggggaacaactgcacgtggactgccgtacgtagaggaggcgattacaaatgctggtgattggttgattggtggagacctggaggttatagaaccaatcaagtataatgatggtctggatcagtatcgtttgtctccagcacagctgcgtgaagaatttgccaggcgcaatgcagatgcggtatttgcttttcaactgcgtaaccctgtgcacaatgggcatgcgttgctcatgactgatacacggaggcgccttcttgagatgggctacaaaaaccctgttcttcttctccatccactgggaggattcacaaaagcagatgatgtgcctcttagtgtgagaatgaagcagcatgagaaggttcttgaggaaggtgtcctaaacccagaatcaactgtggttgcaatcttcccctctccaatgcactatgctgggccaactgaggtccagtggcatgctaaggctcgtataaatgctggtgcaaacttctatattgtcggaagagaccctgctggtatgggccacccaaccgaaaagagggacctttatgatgctgatcacgggaaaaaagtactgagcatggctcctgggcttgagaggctcaatatccttcctttcaaggtggctgcatatgacacaaaacataacaagatgaatttctttgatccatcaaggaaagaagacttcctgttcatctctggcacaaagatgcgcagccttgccaagaaccgtgagagcccaccagatggttttatgtgccctggtggctggaaggtcctcgttgagtactacgacagcttggcaccgccagaaggcagcagcaaactgcgagaggcagttgcagcgtagaagctgaaagacgcttcggataagtaatatcgttgtatcacgtgtcatgaaccgatgatatatgattgtgtattggtggtaagacttgacatttgggcatgatccccagcactccccgtgtggtttgtactgcttactagtatatctgctagcagtgttgccccctggagcccatcatgtgcttgtggtgccaataaggatgggttttgtatcctcttcggatttgtacataacgacatataatagtgtggtggtaatctatctagtgcttgatgtgcttgctaagatctcttcttaggtttgatattcaaatttcttcatgactttagttccatggtgttatatttttcactggagcacatgatatacatatagattatggcaaaatgaaagggaaacattcaagcgtaagtagtgaacttgacatgatagattcttttagggactgcctgagttcttctct

SEQ ID NO: 2980 - DNA, 1737 bp, Brachypodium distachyon
ggcgaagctgggggaggactaaattcgagaagcagcagcagccatggcgacgcaggccgccttcctggtcaaattcccgcagctggcgctgtccgcgcagccgagccgtggccagtcgtgggtcgcggtcgcggcgggcaaggtggccgcgccgcgcggggtgcggtgccgcgccggcggcctgatcgagcccgacgggggcaggctggtggagctggtggcgcccgaggagggcgggcggcgcgcggcgctgcggcgggaggcggcggcgctgccgcaccgggtccggctgggccgcgtggagacggagtgggtgcacgtgctcagcgagggctgggccagcccgctgcggggcttcatgcgcgagagcgagttcctccaagcacttcatttcaacgccgtccgcggcgacgatgggaaactggtcaacatgtccgtgcccatcgtgctcgccgtcgacgacgcccagcgccgcgccatcgaggcgtccggcgccacccgcgtcgcgctcgtcgacgaccacgaccgccccgtcgcggtccttagcgacattgaaatctacaagcataataaggaagaaagaattgctcggacttggggaacaattgcacgtggactgccgtatgtagaggaggcaattgcaaattctggtgattggttgattggtggggacttggaggttatagaaccaatcaagtataatgatggtctcgatcagtatcgcttatctccagcacagctgcgtgaagaatttaccaggcgcaatgctgatgcagtatttgctttccaacttcgcaaccctgtacacaatggtcatgctttgctcatgactgatacacgcaggcgccttcttgagatgggttacaaaaaccctgttctccttctccatcctttgggaggattcacaaaagcagatgatgtgcctcttagtgtgagaatgaagcagcatgagaaggttcttgaggaaggtgtcctcaacccagaatcaacagtggttgcaatcttcccgtctccaatgcattatgctgggccaactgaggtccaatggcatgccaaggctcgcattaatgctggtgcaaacttctatattgtcgggagagatcctgctggtatgagccacccaattgaaaaaagagacctttatgatgctgatcatggaaaaaaagtgttgagtatggctcctgggcttgagaggcttaatatccttcctttcaaggtggctgcatatgacacaaagcagaacaagatgaattttttcgacccatcaaggaaagatgacttcctgttcatctctggcacaaagatgcgtagtcttgccaagaaccgtgagagtccaccagatggttttatgtgcccgggtggctggaaagtccttgtcgagtactatgatagcttgacaccaccagaaggcagcagcaaactgcgagaggcagttgcggcgtagaagctgaaagatgcttcagataagtattaacgttgtatccggttcttcacgatggcgaaccgatgatatatgattgtatatgggtcggaagacttacatttgggcctggttcccgacactccctcgtggtttgtactgcttgctgtctactggcagtgttacggtatttgcctcctgaagcccatcatgtgcttggtgccaataaagatggatttattatcctctgccagatttgtacataactacatatacagtatgttggtaatttatctagtgcttgatgtgtttgcgta

SEQ ID NO: 2981 - DNA, 1992 bp, Triticum aestivum
cccgccagccacaaggcaagagcgagacgaaaacataaacgccccgacacgatataagtagtgcggcggaggtggaatctgagagagaccaaatcgtcgacgggaagcagcagcagccatggcgacgcaggccgccttcgcagtgagattcccgcagctggcgcggccgagcaggggccatggtcagggacagccggcgcgggtgggggtcgcggtgaggggcggcagggcggcggcgcgcggggtgcggtgccgggccggcggcctgatcgagccggacgggggcaggctggtggagctggtggcgcccgaggagggcggccggcgggcggcgctgcgccgggaggcggcggcgctgccgcaccgcgtgcgcctgggccgcgtggacaccgagtggctgcacgtgctcagcgagggctgggccagcccgctgcgcggcttcatgcgcgagaccgagttcctccaagcacttcatttcaacgccgtccgcggcgccgatggcaccctcgtcaacatgtccgtgcccatcgtcctcgccctcgacgacgcccagcgccgcgccatccaggccgacggcgccaccgccgtcgcgctcgtcgacgcccacgaccgccccgtcgccgtgctcagcgatattgagatctacaagcataacaaggaagaaagaatcgcacggacttggggaacaactgcacgcggactgccgtacgtagaggaggccattacaaatgctggtgattggctgattggtggagacctggaggttatagaaccaatcaagtataatgatggtctggatcagtatcgtttgtctccatcacagctgcgtgaagaatttgccaggcgcaatgcagatgcagtatttgcttttcaacttcgtaaccctgtgcacaatgggcatgcgctgctcatgactgatacacggaggcgccttcttgagatgggctacaaaaaccctgttcttcttctccatccactgggaggattcacaaaggcagatgacgtgcctcttagtgtgagaatgaagcagcatgagaaggttcttgaggaaggtgtcctaaacccagaatcaactgtggttgcaatcttcccttcaccaatgcattatgctgggccaactgaggtgcagtggcatgccaaggctcgtattaatgctggtgcaaacttctatattgtcggaagggatcctgctggtatgggccacccgaccgaaaagagggacctttatgatgctgatcacgggaaaaaagtactgagtatggctcctgggcttgagaggctcaatatccttcctttcaaggttgctgcgtatgacacaaaacataacaagatgaatttctttgatccatcaaggaaagaagacttcctgttcatctctggcacaaagatgcgcagccttgccaagaaccgtgagagcccaccagatggttttatgtgccctggtggctggaaggtcctcgttgagtactacgacagcttggcaccgccagaaggcagcagcaaactgcgagaggcagttgcagcgtagaagctgaaagacgcttcggataagtaatatcgttgtatcacgtgtcatgaaccgatgatatatgattgtgtattggtggtaagacttgacatttgggcatgatccccagcactccccgtgtggtttgtactgcttactagtatatctgctagcagtgttgccccctggagcccatcatgtgcttgtggtgccaataaggatgggttttgtattctcttcggatttgtacataacgacatataatagtgtggtggtaatttatctagtgcttgatgtgcttgctaagatctcttcttaggtttgatattgaaatttcttcatgactttagttccatggtgttatatttttcactggagcacatgatatacatatagatcatggcaaaatgaaaaggatacattcaagcgtctgaaattgacatgagagattattttagggactgactgagttagaaaatacagtt

SEQ ID NO: 2982 - DNA, 3537 bp, Brachypodium distachyon
ctgcgtcctcatcagcccccattagcgcaggcaggcagccagcccccacattccccgctccctttgtccacgttcagcgcgcccatggcctccgccccgcaccctccccgcgatcccatccaggttcaccctcctccgttttttataatccccacgcacgcaaccactgcgaaggtctcgccaccaggaggagtaatacagaataaaaacttctttactaacaccgcgggtgatttgattataagtagtcggaggaggggaggcggagctgggggaggactaaattcgagaagcagcagcagccatggcgacgcaggccgccttcctggtcaaattcccgcagctggcgctgtccgcgcagccgagccgtggccagtcgtgggtcgcggtcgcggcgggcaaggtggccgcgccgcgcggggtgcggtgccgcgccggcggcctgatcgagcccgacgggggcaggctgatggagctggtggcgcccgagcagggcgggcggcgcgcggcgctgcggcgggaggcggcggcgctgccgcaccgggtccggctgggccgcgtggagacggagtgggtgcacgtgctcagcgagggctgggccagcccgctgcggggcttcatgcgcgagagcgagttcctccaagcacttcatttcaacgccgtccgcggcgacgatgggaaactggtcaacatgtccgtgcccatcgtgctcgccgtcgacgacgcccagcgccgcgccatcgaggcgtccggcgccacccgcgtcgcgctcgtcgacgaccacgaccgccccgtcgcggtccttagcgacattgagatctacaagcataataaggaagaaagaattgctcggacttggggaacaattgcacgtggactgccgtatgtagaggaggcaattgcaaattctggtgattggttgattggtggggacttggaggttatagaaccaatcaagtataatgatggtctcgatcagtatcgcttatctccagcacagctgcgtgaagaatttaccaggcgcaatgctgatgcagtatttgctttccaacttcgcaaccctgtacacaatggtcatgctttgctcatgactgatacacgcaggcgccttcttgagatgggttacaaaaaccctgttctccttctccatcctttgggaggattcacaaaagcagatgatgtgcctcttagtgtgagaatgaagcagcatgagaaggttcttgaggaaggtgtcctcaacccagaatcaacagtggttgcaatcttcccgtctccaatgcattatgctgggccaactgaggtccaatggcatgccaaggctcgcattaatgctggtgcaaacttctatattgttgggagagatcctgctggtatgagccacccaattgaaaaaagagacctttatgatgctgatcatggaaaaaaagtgttgagtatggctcctgggcttgagaggcttaatatccttcctttcaaggtggctgcatatgacacaaagcagaacaagatgaattttttcgacccatcaaggaaagatgacttcctgttcatctctggcacaaagatgcgtagtcttgccaagaaccgtgagagtccaccagatggttttatgtgcccgggtggctggaaagtccttgtcgagtactatgatagcttgacaccaccagaaggcagcagcaaactgcgagaggcagttgcggcgtagaagctgaaagatgcttcagataagtatagtgttgtatccggttcttcacgatggcgaaccgatgatatatgattgtatatgggtcggaagacttacatttgggcctggttcccgacactccctcgtggtttgtactgcttgctgtctactggcagtgttacggtatttgcctcctgaagcccatcatgtgcttggtgccaataaagatggatttattatcctctgccagatttgtacataactacatatacagtatgttggtaatttatctagtgcttgatgtgtttgcgtagatctcttcttaaaagcaaagtttggttttcatatttgaagtgtcttttacattcatggtctgttatttttcagtgggtcacatgatacagatatagtccctgacaaaatgaagacaaagtatttagatgttagcgatgaaatgtgtcttttacattaatggtctgttatttttcagtgggtcacatgatacagaaatagtccctgacaaaatgaagacaaaatatttagatgttagtgatgaaatggaacgaggagatactgttataacataattcctgttatagattttaaagtacctaaagattgccaaaatatcatcaaagaacaaaaaaatagcgtacatggccatctaaatatatgtgccaatttcagttacatagacagaacgtaagataaagtctcatgcttataatgggtttaggagaagggaaagaacaatattacaaactacccacgacgaatttacggtggagacagtgcatccaatctgagaaccagtggtttcacatctatcaccagcacctttgaggggatcaccagcttgttcagccagatatcttgcgttcagcatttttcatcatgagcacaaattcatcgtagttcaccagcccatcaccgtcagtatccgcctccctgatcatctgctcgacctcctcgtcggtcatcttctccccgagattgatcatcaccgtccttagctgcatttacatggacaagattaaagcagtgcctatctgaactttttatttaatgttaattttatctgaacttattctagcaaaaagaaaatatctgaacttgagaagttttttttttttgaaactatctgaacttgagaaggtacctcaacaggggagataaaaccgttctggtccttgtctaggacctcgaaagcttccttcagctcttcatcgccgtctccatcctgcaaatcacatggaaatcagatatttggcaagtccagcttagcagaagggaaagaaggtagtgtaagccaatgatgaagcatccttcagattgtagcttgcagagcctcaccttcatcttcctggcaataaggctcaagaactcctggaagtctatggtgccgttcccatccgtgtcaacctcacgcatcatgtcactgagctcctgctcggtcggctcaaggccaagggagcgggtcaccgcagccaactcttccaagctgatgcatcctgcgtgtggccaaaaccaatgttccaagatctcacatgcgaaccagattcaaatttctgttcattttagctcacaaatatcctaatcccagaggggacaacaccacgtgccaatgcccaaggacggtcaaaggttctgagttttgactaaagataagagacgtttgaggcaagcttatgatcgattaactgctaaactgtcagagggggattgcatgacacaaacaatatcatcatggccacccgaaaagtcttgattcttcaagtccatgctgtagattactagtaatattacttaagagagcttggcctatagattagcatgtccgagcaaaagaaaaa

SEQ ID NO: 2983 - DNA, 1923 bp, Avena sativa
cccacgcacgcaaccactgcgaaggtctccaggtcgaaacaaaggcagaaacgtttgtacaacctgcccgagaaagagccgtggtggtataagtagttgggggcggaggtggagggagaccaaatcgagaagaaccagcagcagccatggcgacgcaggctgccttcgtggtgaaattcccgcagcagctggcgcggccgagccgggttcagggtcggccggtgccgccggcgcgggtggggatcgcggtgagtaggggatcgcccggcaacaaggccgtctcggcggcggcgccgccgccccgcggggtgcggtgccgggccggcggcctgatcgagcccgacgggggcaagctggtggagctggtggcgcccgaggagggcggccggcgcgcggcgctgcggcgcgaggcggcggcgctgccccaccgggtccgcctgggccgcgtggacaccgagtgggtgcacgtgctcagcgagggctgggcatccccgctgcggggcttcatgcgcgagaacgagttcctccaagcacttcatttcaacgccgtccgcggcgacgatggcaccatggtcaacatgtccgtgcccatcgtcctcgccgtcgacgacgcgcagcgccgagccatcctggcgtccggcgccaccagcgtcgcgctcgtggacgaccacgaccgccccgtcgccgtcctcagcgatattgagatctacaagcataacaaggaagaaagaattgcacggacttggggaacaactgcacgtggactgccatatgtagatgaggcgattacaaatgctggtgattggttgattggtggagacttggaggttattgaaccaatcaagtataatgatggtctcgatcagtatcgcttgtctccagcacagctacgtgaagaatttgccaggcgcaatgctgatgcagtatttgcttttcaacttcgtaaccctgtgcacaatgggcatgctttgctcatgactgatacccgcagacgccttcttgagatgggctacaaaaaccctgttcttcttctccatccattgggagggttcacaaaagctgacgatgtgcctctgagtgtgagaatgaagcagcatgagaaggttcttgaggaaggtgtcctaaacccagagtcaactgtggttgcaatcttcccctccccaatgcattatgcagggccaactgaggtgcagtggcatgccaaggctcgtatcaatgctggtgcaaacttctacattgttggaagagatcctgctggtatggggcacccaatcgaaaagagggacctttatgatgccgatcatgggaaaaaagtattgagtatggctcctgggcttgagaggctcaatatccttcctttcaaggtggctgcatatgacagaaagcataacaagatgaatttcttcgacccatcaaggaaagaagacttcctgttcatctctggcacaaagatgcgtggtcttgccaagaaccgtgagagtccaccagatggttttatgtgcccaggtggctggaaagtcctcgtcgagtactacgacagcttaaccccaccagaagacagccccaaactgcgagaggcagttgcggcgtagaagctgaaagatgcttcagataatgaacagtggtgtatctcgtattatggccggttctttccgactaagaaccgatgatatatgattgtatacatatactggtggtgtgactgaacatttgggcatgattcctagcactccccgtggtggtttgtactgtgcatactatctgctagcagtgttgcccccctggagcccatcatgtgctagtggtgccaataaggatgggttttgtatcctcttgcctgatttgtacataactacatatactgtatggtggtgatttatatagtgtatgatgtgtttgctatgatcccttctcaaatcaatg

SEQ ID NO: 2984 - DNA, 1731 bp, Secale cereale
tacgcgcacccaccgcgaaggtcaggccgccccgccagccagccacaaggcaagcgcgagacgagaccgcaaacgccccgacacgatataagtagcgggccggaggcggaatccgggagagaccagatcgtcgacgagaagcagccgcagcagccatggcgacacaggccgccttcgcagtgagattcccgcagctggcgcgggagagcagggggcaggggcagggccaggcccggccggcccgggtcgcggtgaggggcggcagggctgtggcggcgcgcggggtgcggtgccgggccggcggcctgatcgagcccgacgggggcaggctggtggagctggtggcgcccgaggagggcggccggcgggcggcgctgcgccgggaggcggcagcgctgccgcaccgggtgcgcctgggccgcgtggacaccgagtggctgcacgtgctcagcgagggctgggccagcccgctgcgcggcttcatgcgcgagaccgagttcctccaagcacttcatttcaacgccgtccgcggcggcgatggcagcctcgtcaacatgtccgtgcccatcgtcctcgccctcgacgacgcccagcgccgcgccatccaggcctccggcgccaccagcgtcgcgctcgtcgacgcccacgaccgccccgtcgccgtcctcagcgatattgagatctacaagcataacaaggaagaaagaattgcacggacttggggaacaactgcacgcggactgccatacgtagaggaggcgattacaaatgctggtgattggttgattggtggagacctggaggttatagaaccaatcaagtataatgatggtctggatcagtatcgtttgtctccagcacagctgcgtgaagaatttgccaggcgcaatgcagatgcagtatttgcttttcaacttcgtaaccctgtgcacaatgggcatgcgctgctcatgactgatacgcggaggcgccttcttgagatgggctacaaaaaccctgttcttcttctccatccactaggaggattcacaaaagcagatgatgtgcctcttagtgtgagaatgaagcagcatgagaaggttcttgaggaaggtgtcctaaacccagaatcaactgtggttgcaatcttcccctctccaatgcactatgctgggccaactgaggtccagtggcatgctaaggctcgtataaatgctggtgcaaacttctatatcgtcggaagagaccctgctggtatgggccaccccaccgaaaagagggacctttatgatgctgatcacgggaaaaaagtactgagcatggctcctgggcttgagaggctcaatatccttcctttcaaggtggctgcatacgacacaaagcataacaagatgaatttcttcgacccatcaaggaaagaggacttcctgttcatctctggcacaaagatgcgtagccttgccaagaaccgcgagagcccaccagacggttttatgtgcccgggtggctggaaggtcctcgtcgagtactacgacagcttggcaccaccagaaggcagcagcaaactgcgggaggcggttgcggcgtagaagccgtggcgttgtatctcgtatcatgaaccaatgatatatgattgtatattggtggtaagacttgacatttgggcatgatccccaacactccctgtgtggtttgtgtactgcatactagtatctgcaatgctagcagtgttgccccctggagcccatcatg

SEQ ID NO: 2985 - DNA, 1670 bp, Secale cereale
cagggctgtggcggcgcgcggggtgcggtgccgggccggcggcctgatcgagcccgacgggggcaggctggtggagctggtggcgcccgaggagggcggccggcgggcggcgctgcggcgggaggcggcggcgctgccgcaccgggtgcgcctgggccgcgtggacaccgagtggctgcacgtgctcagcgagggctgggccagcccgctgcgcggcttcatgcgcgagaccgagttcctccaagcacttcatttcaacgccgtccgcggcggcgatggcagcctcgtcaacatgtccgtgcccatcgtcctcgccctcgacgacgcccagcgccgcgccatccaggcctccggagccaccagcgtcgcgctcgtcgacgcccacgaccgccccgtcgccgtcctcagcgatattgagatctacaagcataataaggaagaaagaattgcacggacttggggaacaactgcacgcggactgccgtacgtagaggaggcgattacaaatgctggtgattggttgattggtggagacctggaggttatagaaccaatcaagtataatgatggtctggatcagtatcgtttgtctccagcacagctgcgtgaagaatttgccaggcgcaatgcagatgcagtatttgcttttcaacttcgtaaccctgtgcacaatgggcatgcgctgctcatgactgatacgcggaggcgccttcttgagatgggctacaaaaaccctgttcttcttctccatccactaggaggattcacaaaagcagatgatgtgcctcttagtgtgagaatgaagcagcatgagaaggttcttgaggaaggtgtcctaaacccagaatcaactgtggttgcaatcttcccctctccaatgcactatgctgggccaactgaggtccagtggcatgctaaggctcgtataaatgctggtgcaaacttctatatcgtcggaagagaccctgctggtatgggccaccccaccgaaaagagggacctttatgatgctgatcacgggaaaaaagtactgagcatggcgcctgggcttgagaggctcaatatccttcctttcaaggtggctgcatacgacacaaagcataacaagatgaatttcttcgacccatcaaggaaagaggacttcctgttcatctctggcacaaagatgcgtagccttgccaagaaccgcgagagcccaccagacggttttatgtgcccgggtggctggaaggtcctcgtcgagtactacgacagcttggcaccaccagaaggcagcagcaaactgcgggaggcggttgcggcgtagaagccgtggcgttgtatctcgtatcatgaaccaatgatatatgattgtatattggtggtaagacttgacatttgggcatgatccccaacactccctgtgtggtttgtgtactgcatactagtatctgcaatgctagcagtgttgccccctggagcccatcatgtgcttgtggtaacaataaggatgggttttgtatcctcttgccagatttgtacataactaaatatacaatattgtggtaatttatcttgtgctttaagaaaaaaaaaaaaaaaaaagaaaaaaaaaaaaaagaaaaaaaaaaaaactaaaaagaagaacgtagacgaacgacgacacaacgggaggtagagggggggggggg

SEQ ID NO: 2986 - DNA, 989 bp, Triticum aestivum
gtatacacggatctaggcctaccgcacaggcctccagcgacactcacgctcgctccccacgaatgtcgcgtgcggccaccagaatattcccgacgccgtcgttgctcccacttccacttcccaagtggctgcgtaggcggcggccaagcatctgcccagcgaggagagccttcgcgatggcggcgtctggattcggaggcggcgaggcgttccggctgtcggctgcggcgggggccggcgcgctgaagctgcacaagggcgacatcaccctctggtccgtcgacggcgccaccgacgccatcgtcaatgctgctaatgaacgaatgctaggagggggaggtgttgatggagctatacatcaagctgctggaccacagcttgtacaagcatgccgtgaagttccagaggttaaacctggagtccgttgccctactggagaagctagaattactccagcttttgagcttcccgtgtcctgtgtgatccatacagttgggcccatatatgatatggacaggaagcctgaggtgtcactaaagaatgcatacgaaaatagcttaaaggttgctaaagagaatggcattcagtacgttgcattccctgctatatcttgtggtattttccgttaccctccaaaggaagcatcaaacatagctatttcagctgctcaacaattttcaggggatattaaagaggtgcattttgttctgttctcggatgagctctacaacgtttggcgtgggactgcccaggagatgctgacgcaatttgagaaatgaataactatgatatcagtgtagtatgcgcatgttagccagcgtctaatatgaccactagagtctgttgaccatgatcgtatgtatggcgcagtttgaatgtgtttatctgaaagatagttggatggatatgccggatgagtgccctgaataatattttaccgttctttatgcttcattttcatatctataagatggccggcaagtgacagc

SEQ ID NO: 2987 - DNA, 1118 bp, Secale cereale
gtgggaaaagtaaagtaggggacaaaaatccaatcccccataatcctccagagcttgtgtccgtgcggccaccagaattgccgatcaaattgtggtctttgatcgttaataaagcttggattatccctaaaaaaaagaatgtctcgtgcggccaccagaattttcctgacgctgtcgttgctcccactcccacttcccaagtggctgcgtaggcggcagccaagcatctgcccagcgaggagagccttcgcgatggcggcgtccggattcggaggcggcgaggctttccggctgtcggctgcggcggggggcggcgcgctgaagctgcacaagggcgacatcaccctctggtccgtcgacggcgccaccgacgccatcgtcaatgctgctaatgaaagaatgctaggagggggaggtgttgatggagctatacatcaagctgctggaccacagcttgtacaagcatgccgtaaagttccagaggttaagcctggagtccgttgccctactggagaagctagaattactccagcttttgagctgcccgtgtctcgtgtgatccatacagttgggcccatatatgatatggacaggaagcctgaggtgtcactaaagaatgcttacgaaaatagcttaaaggttgctaaagagaatggcattcagtacgttgcattccctgctatatcttgtggtattttccgttaccctccaaaggaagcatcaaacatagctgtttcagctgctcaacgattttcaggggatattaaagaggtgcattttgttctgttctcggatgagctctacaacgtttggcgtgagactgcccaggagatgctgacacagtttgagaaatgaataactatgatatcagtgtagtctgcgcatgttagccagcatggcagcatctaatatgaccactagagtctgttgaccatgatcgtatgtatggtgcagtttgaatgtgtttatctgaaagatggttggatggatatgccggatgagtgccctgaataatattttactgttctttatgcttcattttcatatgtataagttcacagtaatttttttgaacttgtggtatactttattcatctaagataattgatactccctcc

SEQ ID NO: 2988 - DNA, 1066 bp, Brachypodium distachyon
ccagggacagaaagcacgcagtcacgctagagttcgtccccgaaagtcaaatgtcgcgtgcggccactagattattcctgacgccgtcgctcctcccaattccactccccaagtggctgcagcggaggcggcgggccagcatctgcacgaccaggaggtccttcgcgatggcggcttcggggttcggagacggtgaggcgttccggctgtcggcggcggcgggggccggcgtgctgaagctgcacaagggtgacatcaccctctggtccgtcgacggcgccacagacgccatcgttaatgctgctaatgaacgaatgctaggaggtggaggtgttgatggagctatacatcgagctgctggaccacaacttgttgaagcatgccgtaaagttccagaggtagaacctggagttcgttgcccgactggagaagctagaattactccagctttcaagcttcccgtttccagtgtgatacacacagttggacccatatatgatatggacagacagcctgaggtgtctttaaagaatgcttacgcaaatagcttgaagcttgctaaagagaatggcattcagtacattgccttccctgctatatcatgtggtgtttttcgttaccctctagaggaagcatcaaaaatagctgtttcaactgctcaacaattttctggggatattaaagaggtgcactttgttctgttttcagatgagctctacaatgtttggcgtcaggctgcccaggagatgctgacgcaatttgagaaatgaatagccgatagagttccctgatgtagggtagtatgttcttgtcagccggctagtgtagttggttcattatgatagaatgtatggtactactatttttatgcttttgtctgaaagagagttggatggatatgttggatcagtgtctgccctgtgctacattttcttatgaataaacgtaccgaagccaaaatgttgttacataagatgcctgagaggtgttataatattacagcacgtttttcgctcctaagtaacaactcgagcgaaactcattcaattctcggctgcgtttttta

SEQ ID NO: 2989 - DNA, 928 bp, Setaria italica
agaggcaaaacgcggcctcgctctctcagagtgtctccctgactcccccgcgatgtcgcgtgcggccactagatttttcctgacgcggtcgctgctcccacttcccctcccaaagtggcagcggcggcgggggcggctggggtctagcattctcgcggcgagggctttctccatggcggcctcggggttcgggggtggcgatacgttccggctctcggccgcgccgggtgccggcgcgctgaagctgcacaagggcgacatcaccctctggaccgtcgacggcgccactgacgccatcgttaatgctgctaatgagcgtatgctaggaggtggaggtgttgatggagctatacatcgagctgctggatcagaattagtagaagcatgccgcaaagttccagaggtcaaaccaggagttcgttgcccgactggagaagctaggattactccagctttcaagcttcctgtgtcccgagtgattcacactgttgggcccatatatgacatggacaagcatcctgaggtgtcactaaagaatgcctatgaaaatagtttgaagcttgctaaagagaatggcattcagtatattgcattccctgctatatcttgtggtattttccgttatcctcccgaagaagcgtcaaaaatagctgtttctactgcacaacaattttcagatgatatcaaagaggtgcattttgttctgttttcggatgatctgtatgagatttggcgcaagactgctcaggagatgctttcacaatttgagaaatgaatggtcttatagtttatgatggctgctatcctgtgtaacaatacaactatatgattgtatcgaacgacattttaatctttaaccatgtcttgcacttgtggtataacgtccaatgaataaggtttggcgaaattgagaagcgctttcaattat

SEQ ID NO: 2990 - DNA, 869 bp, Saccharum officinarum
acaccaatgtcgcgtacggccactagatttttcctgacgcggtcgctgctcccacttcccctcctccccccgaagtggcagcggcggcggggtagcatttgcgctacgagagcttttgccatggcggcctcggtgttcggcggcggcgaggcgttccggctctcggccgcgccgggggccggtgtactgaagctgcacaagggcgacatcaccctctggtccgtcgacggcgccaccgatgccatcgttaatgctgctaatgagcgaatgttaggtggcggaggtgtggatggagctatacatcgagctgctggaccagagctagtgcaagcatgccgtaaagttccagaggtcaaaccaggagttcgttgccctactggagaagctaggattactcctgctttcgagcttcctgtctctcgagtgattcacactgttgggcccatatacgatatggacaagcatcctgaggtgtcattaaagaaggcctatgaaaatagcttgaagcttgctaaagataatggcattcagtacatcgcattccctgctatatcttgtggtgtttttcgttatcctcccaaggaagcatcaaaaatagctgtttctaccgcacaacaattttcagaggatatcaaagaggtacattttgttctgttttcggatgacctttacaatatttggcgcgagactgcccaggagttgctatcacagtttgagaaatgaatggtctgtgagcgctattggcagtttgcctgatgtaacaaaagagtgtatcaaacaacattttaatcttgaaccatgtattgcacttgtggtataatgctgaatgagtaaggtttggcaatacggagcaattgcaaccgtcagtc

SEQ ID NO: 2991 - DNA, 1316 bp, Setaria italica
tccgtttgatgttaaacttcattgaagtcaccaatacgcaaacgcgatgatgactttatgtgtttcaataaatcccacgccttgaatcgttcactagtttgagcctcattcttccactgcggctctaactgtttacagaaaagcataatagaaagggcagttgttctgacagacaaagttaatgggcccaaattaggcccagtaagcaacatgaattaagcacaatggcccagagctccaggctccacgagaggcaaaacgcggcctcgctctctcagagtgtctccctgactcccccgcgatgtcgcgtgcggccactagatttttcctgacgcggtcgctgctcccacttcccctcccaaagtggcagcggcggcgggggcggctggggtctagcattctcgcggcgagggctttctccatggcggcctcggggttcgggggtggcgatacgttccggctctcggccgcgccgggtgccggcgcgctgaagctgcacaagggcgacatcaccctctggaccgtcgacggcgccactgacgccatcgttaatgctgctaatgagcgtatgctaggaggtggaggtgttgatggagctatacatcgagctgctggatcagaattagtagaagcatgccgcaaagttccagaggtcaaaccaggagttcgttgcccgactggagaagctaggattactccgttaagctttcaagcttcctgtgtcccgagtgattcacactgttgggcccatatatgacatggacaagcatcctgaggtgtcactaaagaatgcctatgaaaatagtttgaagcttgctaaagagaatggcattcagtatattgcattccctgctatatcttgtggtattttccgttatcctcccgaagaagcgtcaaaaatagctgtttctactgcacaacaattttcagatgatatcaaagaggtgcattttgttctgttttcggatgatctgtatgagatttggcgcaagactgctcaggagatgctttcacaatttgagaaatgaatggtcttatagtttatgatggctgctatcctgtgtaacaatacaactatatgattgtatcgaacgacattttaatctttaaccatgtcttgcacttgtggtataacgtccaatgaataaggtttggcgaaattgagaagcgctttcaattattagtcactttattttataatactgacgaaagagcaactacctgtcagatacccagtttgccgtgtgtttaccaattgtcatctcacatggagaagagtaaccgttaaactggttcagggctgagttgactgctga

SEQ ID NO: 2992 - DNA, 1149 bp, Brachypodium distachyon
taggcccagggcataccccaagtccagggacagaaagcacgcagtcacgctagagttcggccgcgaaagtcaaatgtcgcgtgcggccactagattattcctgacgccgtcgctcctcccaattccactccccaagtggctgcagcggaggcggcgggccagcatctgcacgaccaggaggtccttcgcgatggcggcttcggggttcggagacggtgaggcgttccggctgtcggcggcggcgggggccggcgtgctgaagctgcacgagggtgacatcaccctctggtccgtcgacggcgccacagacgccatcgttaatgctgctaatgaacgaatgctaggaggtggaggtgttgatggagctatacatcgagctgctggaccacaacttgttgaagcatgccgtaaagttccagaggtagaacctggagttcgttgcctgactggagaagctagaattactccagctttcaagcttcccgtttccagtgtgatacacacagttggacccatatatgatatggacagacagcctgaggtgtctttaaagaatgcttacgcaaatagcttgaagcttgctaaagagaatggcattcagtacattgccttccctgctatatcatgtggtgtttttcgttaccctctagaggaagcatcaaaaatagctgtttcaactgctcaacaattttctggggatattaaagaggtgcactttgttctgttttcagatgagctctacaatgtttggcgtcaggctgcccaggagatgctgacgcaatttgagaaatgaatagccgatagagttccctgatgtagggtagtatgttcttgtcagccggctagtgtagttggttcattatgatagaatgtatggtactactatttttatgcttttgtctgaaagagagttggatggatatgttggatcagtgcctgccctgtgctacattttcttatgaataaacgtaccgaagccaaaatgttgttacataagatgcctgagaggtgttataatattacagcacgttttttgctcctacgtaacaactcgagcgaaactcattcaattctcggctgcgttttttagttcctgacgatcaaatttgggattcagttagggagggcacatcagttggtatagtcaca

SEQ ID NO: 2993 - DNA, 1316 bp, Panicum virgatum
tatgtatgatataatctacaaaatgttacggtaactcctgatcaaagataacaaaatttcgaatcttgggttcaaagtgggatttcttcagaaatggcagctgttctgacagaaaagttaatgggccctaaattttggcccagcaaactatacgaatagccagcatggatgatggcccagcacagggaaggcccgccagctccaggcttccagaggcaagatggatgcggccggccggccggccgccgtgcgtgctcgactgctcgcccagcggctattccagtgttcggactcccccaatgtcgcgtgcggccactagatttttcctgacgcggtcgctgctcccacttgctcttcccaagtcgcagcggcggcgggggcggctggggtctagcgtttgcgcggcgagggctttccccatggcggcctcggggttcggcggcggcgaggcgttccggctctcggccgcgccgggggccggcgcgctgaagctgcacaagggagacatcaccctctggtccgtcaacggcgccaccgacgccatcgttaatgctgctaatgagcgaatgctaggaggtggaggtgttgatggagcaatacatcaagctgctggaccagaattagtgcaagcatgccgcaaagttccagaggtcagaccaggagttcgttgcccaactggagaagctaggattactccagctttcaagcttcctgtgtcccgagtgattcacactgttgggcccatatatgacatggacaagcatccagaggtgtcgttgaagaattcctatgaaaatagcttgaagcttgctaaagagaatggcattcagtacatcgcattccctgctatatcttgtggtgtttttcgttatccgcccaaagaagcatcgaaaatagctgtttctactgcacaacaattttcggaggatttcaaagaggtgcattttgttctgttttcagatgatttgtacgagatttggcgcgagactgcccaggagatgctatcacaatttcagaaatgagtggtcctatagtttctgatgcggctgtgtacttggctgctgtccttattgagatgcgagagccagaggctgtttaccgatgtaacaactataggacatttacatctttaaccatgtcgtgcacttgtggtgtaacgtcgaatcaataaggtttgtgataccacgaagaacttgcaattgttagtcaccttatttgttaatgctgaagaaggaaagagcaactacctgtcagataaccaggtgccaggttctgcgagataccagtttgccgtgtgtttacaacacagtagttat

SEQ ID NO: 2994 - DNA, 869 bp, Pennisetum glaucum
ctcccccaatgtcgcgtgcggccactagatttttcctgacgcggtcgctgctcccacttcccctcccaaagtggcagcgggggcggctggggtctagcattctcgcggcaagcgcttcctccatggcggcctcggggttcggcggcggcgacacgtttcggctctcggccgcgccgggtgccggcgcgctgaagctgctcaagggcgacatcaccctctggtccgtcgacggcgccactgacgccatcgttaatgctgctaatgagcgtatgcttggaggtggaggtgttgatggagctatacatcgtgctgctggaccagaattagtagaagcatgccgcaaagttccagaggtcaaacctggagttcgttgccccactggagaagctaggatcactccagctttcaagcttcctgtgtcccgtgtgattcacactgttgggcccatatatgacatggacaagcatcctgaggtgtcactaaagaatgcctatgaaaatagtttgaagcttgctaaagagagtggcattcagtacattgcattccctgctatatcttgtggtgtcttccgttatcctcccaaagaagcgtcaaaaatagctgtttctactgcacagcaattttcagaggatatcaaagaggtgcattttgttctgttttcggatgatctgtacgatatctggcgcgagacttcccaagagatgctatcacaatttgaaaaatgaatggtcttatagtttcttatggctgttatcatgtgtaacatacaactatgagtgtgtcaaatgacattttaatctttaaaatgtcttgcacttgtggtataacgtccgatgaataaggtttggcgagtttggcgaaattgagat

SEQ ID NO: 2995 - DNA, 1366 bp, Sorghum bicolor
aggctcttaagttgaccatcgtctgaaggctctagaggttagcccacgaaacatgggccttccaacatttttcgtactcctaccagcttcagcctaaacgcggccccgtgcagcgttttttttttcttttcacttccgtgcagcgtttgttgggggaacttgactcacaccaatgtcgcgtgcgtccactagatttttcctgacgcggtcgctgctcccacttcccctcctccccccaaagtggcagcggcggcggggtagcattcgcgctacgagggctgttgccatggcggcctcggggttcggcggcggcgaggcgttccggctctcggccgcgccgggggccggcacactgaagctgcacaagggcgacatcaccctctggtccgtcgacggcgccaccgacgccatcgttaatgctgctaatgagcgaatgttaggtggcggaggtgtggatggagctatacatcgagctgctggaccagagctagtgcaagcatgccgtaaagttccagaggtcaaaccaggagttcgttgccctactggagaagctaggattactcctgctttcgagcttcctgtctctcgagtgattcacactgttgggcccatatatgatatggacaagcatcctgaggtgtcattaaagaaggcctatgaaaatagcttgaagcttgctaaagataatggcattcagtacatcgcattccctgctatatcttgtggtgtttttcgttatcctcccaaggaagcatcaaaagtagctgtttctactgcacaacaattttcagaggatatcaaagaggtgcattttgttctgttttcagatgacctttacaatatttggcacgagactgctcaggagttgctatcacagtttcagaaatgaatggtctatatgttgttgtctagtgttgagatgtgagcgctgtaggcagtttccctgatgtaacaaaatgagtgtatcaagcaacattttaatcttgaaccaatgtattgcacttgtggtatgatgctgaataaggtttggcaataccgagcacttgcaactgtcagtcatcttatttgatcatggagggaagaactagtacctgtcagatttaatagaaattacttgtgaaataatgccaggttctgtattttagggggtaacatattcggacagcattataattttgaaccatgtattgtacttgtgctacaatgttgtatgagcaaggtttggcaataccgagcaatcatgaagggaagaactagtacctgtcagatttaacagaaattacttgcgaaatgataccaggttctatatttttatcttttttatggaattttatatttttatctttgtcgggggtggggtggggtg

SEQ ID NO: 2996 - DNA, 966 bp, Zea mays
aacatgccagggcaaaacgcggacccgtgctgtgcgttccacccaatgtcgcgtgcggccactagatttttcctgacgcggtgtctgctcccacttcccctcctctcccccaggtggcggcagcggcggcggggtagcatttgtgctacgagggcttttgcaatggcggcttcggggttcggcggcggcgaggcgttccggctctcggccgcgccgggggccggcttactgaagctgcacaagggcgacatcaccctctggtccgtcgactgcgccaccgacgccatcgttaatgctgctaatgagcgaatgttaggtggcggaggtgttgatggagctatacatcaagctgctggaccagagctagtgcaagcatgccggaaagttccagaggtcaaaccaggagtccgttgtcctactggagaagctaggattactcctgcttttgagcttcctgcctctcgggtgattcacactgttggccctatatatgatttggacaagcatcctgaggtgtcattaaagaaggcctatgaaaatagcttgaagcttgctaaggataatggcattcagtacatcgcattccctgctatatcttgtggtgtttatcgttatcctcccaaggaagcatcaaaaatagctgtttctaccgcacaaaaattttcagaggatatcaaagaggtgcattttgttctgttctcggacgacctttacaatatatggcgcgagactgcccagcagttgctatcacagtttgagaaatgaatggtccataggcagtttgctagcactagcagttgcccagcagtcgttgtctagtgttgagatgtgagcgccataggcagtttgcctggtgtaataaaaatgggtgtatcagacaacgtttaaatcttgatgaaaccgtgtattgcacctgtggtataatgctgaatgagtaaagtttggcgataccgagcagttgcaata

SEQ ID NO: 2997 - DNA, 1253 bp, Sorghum bicolor
gaaacatgggccttccaacatttttcgtactcctaccagcttcagcctaaacgcggccccgtgcagcgttttttttttcttttcacttccgtgcagcgtttgttgggggaacttgactcacaccaatgtcgcgtgcgtccactagatttttcctgacgcggtcgctgctcccacttcccctcctccccccaaagtggcagcggcggcggggtagcattcgcgctacgagggctgttgccatggcggcctcggggttcggcggcagcgaggcgttccggctctcggccgcgccgggggccggcacactgaagctgcacaagggcgacatcaccctctggtccgtcgacggcgccaccgacgccatcgttaatgctgctaatgagcgaatgttaggtggcggaggtgtggatggagctatacatcgagctgctggaccagagctagtgcaagcatgccgtaaagttccagaggtcaaaccaggagttcgttgccctactggagaagctaggattactcctgctttcgagcttcctgtctctcgagtgattcacactgttgggcccatatatgatatggacaagcatcctgaggtgtcattaaagaaggcctatgaaaatagcttgaagcttgctaaagataatggcattcagtacatcgcattccctgctatatcttgtggtgtttttcgttatcctcccaaggaagcatcaaaagtagctgtttctactgcacaacaattttcagaggatatcaaagaggtgcattttgttctgttttcagatgacctttacaatatttggcacgagactgctcaggagttgctatcacagtttcagaaatgaatggtctatatgttgttgtctagtgttgagatgtgagcgctgtaggcagtttccctgatgtaacaaaatgagtgtatcaagcaacattttaatcttgaaccaatgtattgcacttgtggtatgatgctgaataaggtttggcaataccgagcacttgcaactgtcagtcatcttatttgatcatggagggaagaactagtacctgtcagatttaatagaaattacttgtgaaataatgccaggttctgttttttagggggtaacatattcggacagcattataattttgaaccatgtattgtacttgtgctacaatgttgtatgagcaaggtttggcaataccgagcaatcatgaagggaagaactagtacctgtcagatttaacagaaattacttgcgaaatgataccag

SEQ ID NO: 2998 - DNA, 1431 bp, Panicum virgatum
caaaagttaatgggccctaaattgtagcccagcaagctacacgaatagcaagcatggatgatggccgaacatagggaaggcccgccagctccaggctccagagtccagaggcaaagatggatgcggcggccgccgtgcgttctcgactgctcgcccagcgctattcctccagtgttcggattccccgatgtcgcgtgcggccactagatttttcctgacgcggtcgctgctcccacttgccctcccgaagtcgcaggggcggccggggtctagcatttgcgcggcgagggctttctccatggcggcctcggggttcggcggcggcgaggcgttccggctctcggccgcgccgggggccggcgcgctgaagctgcacaagggcgacatcaccctctggtccgtcaacggcgccacggacgccatcgttaatgctgctaatgagcgaatgctaggaggtggaggtgttgatggagcaatacatcgagctgctggaccagaattagtgcaagcatgccgcaaagttccagaggtcagaccagaagttcgttgcccaactggagaagctaggattactccagctttcaagcttcctgtgtcccgagtgattcacactgttggacccatatatgacatggacaagcatccagaggtgtcgttgaagaatgcctatgaaaatagcttgaagcttgctaaagagaatggcattcagtacatcgcattccctgctatatcttgtggtgtttaccgttatccgcccaaagaagcatcgaaaatagctgtttctactgcacaacaattttcggaggatatcaaagaggtgcattttgttctgttttcggatgatttgtacgagatttggcacgagactgcccaggagatgctgtcacaatttcagaaatgagtggtcctatagtttctgatgcggctgtgtacttggctgctgtccttgttgacatgcgagagccagaggccgtttaccgatgtaacaactaacaatatgagtgtattaaatgacatttaaatctttaaccatgtcgtgcgcttgtgtaaactgtaatgtcgaatgaataaggattgcggatttgtaataccgagaagcacttgcaattgtgagtcactttgtttggtaatgctgaagaaggaaagagcaactacctgtcagataactaggtgccaggttctgcgagatacaagtttgccgtgtgtttacaacaccgttgttatctcacaggcagaacggatcgccgtaaggttcagggctaacttggctgttgacagaagtaacttttgcagtaggttacacaagtcagatggcacaatatcatacgccttagaagtggacatatcgttcgctgcgaccatctgcttctgtacgagattatgcaaaccacttcatttcacattccaatggtaactgcttgggttacacaa

SEQ ID NO: 2999 - DNA, 1044 bp, Oryza sativa
cagacaacggagacgccacgacccgacgaaatgtcgcgtgcggccgctagaattttcctcacgccgtcgcggctcccactcccactccctctcccactcctccccaagcggcggcggcggcggccgccaccgagcagcggcgcgacgagggcatcgttcgccatggcggccgcgccggggcgaggcggcggcgaggcgttccgtctgtcggcggatgcgggcgcgggcgcgctcaagctgcagaagggcgacatcaccctctggtccgtcgacggcgccaccgacgccatcgttaatgctgctaatgagcgaatgctaggaggtggaggtgtagatggagctatacatcgaactgctggacctgaactcgtagaggcatgccgtaaagttccagaggtcaaatctggagttcgctgccccactggagaagctaggattactccagcattcaagcttcctgtttcccgcgtgatacacactgttgggcccatatatgatatggacaagcaacctgaggtctccttaaataatgcctacacaaatagcttgaagctcgctaaacagaatggtattcaatacattgcattacctgcaatttcttgtggtgtttatcgttatcctccaaaggaagcatcgaagattgctgtttctactgcacaacgattttctaatgatattaaagaggtacactttgttctgttttctgatgagctctatgatatctggcgtgagactgccaaggaatttctgtcacaatttgagaaatgaattgtgaactgtgatggggcttacttcctggtgtaagtctggtgccgaccgtgccgtagttgccgtcgttaatatgagcactagagccggttggccatgataaaacctgtatctgtatgacagtatgagttgcttagtggtgaatggatatgccctgaatggcatatttatcaaaataaaggtttcatctctgaattatgctaattaacatacttgtactcgaaaaccaataaccatgtcttatcgttagacttagaatgttacatctaacctggg

SEQ ID NO: 3000 - DNA, 1157 bp, Oryza sativa
cccgacgaaatgtcgcgtgcggccgctagaattttcctcacgccgtcgcggctcccactcccactccctctcccactcctccccaagcggcggcggcggcggccgccaccgagcagcggcgcgacgagggcatcgttcgccatggcggccgcgccggggcgaggcggcggcgaggcgttccgtctgtcggcggatgcgggcgcgggcgcgctcaagctgcagaagggcgacatcaccctctggtccgtcgacggcgccaccgacgccatcgttaatgctgctaatgagcgaatgctaggaggtggaggtgtagatggagctatacatcgaactgctggacctgaactcgtagaggcatgccgtaaagttccagaggtcaaatctggagttcgctgccccactggagaagctaggattactccagcattcaagcttcctgtttcccgcgtgatacacactgttgggcccatatatgatatggacaagcaacctgaggtctccttaaataatgcctacacaaatagcttgaagctcgctaaacagaatggtattcaatacattgcattacctgcaatttcttgtggtgtttatcgttatcctccaaaggaagcatcgaagattgctgtttctactgcacaacgattttctaatgatattaaagaggtacactttgttctgttttctgatgagctctatgatatctggcgtgagactgccaaggaatttctgtcacaatttgagaaatgaattgtgaactgtgatgaggcttacttcctggtgtaagtctggtgccgaccgtgccgtagttgccgtcgttaatatgagcactagagccggttggccatgataaaacctgtatctgtatgacagtatgagttgcttagtggtgaatggatatgccctgaatggcatatttatcaaaataaaggtttcatctctgaattatgctaattaacatacttgtactcgaaaaccaataaccatgtcttatcgttagacttagaatgttacatctaacctggggcgttttgaactgttaactgtcgaagacattccaacatctcgttcatgtgcacgagctaaatgattcaatcaaggtgcctgagtagtcacggccatagaatgttcattctcattcattgtgtcaattcagactt

SEQ ID NO: 3001 - DNA, 6022 bp, Cicer arietinum
gccagcgagcgagcttgcacaagtaacaacaacagttacaaaacacactcactctctatattcgtgcctcaaaacattctcattctcatctctctgcattactattagggctttttcattcccctccaactcttctctcatttgaagttaggtcggtgagagaagacaatgtcgtcgagagccgggccgtcggagtctcagggaccgccgcagagacgaataacgcggacgcaaactgctggaaaccttggtgaagccatttttgacagtgaagttgtgccttcatctctcgttgaaattgctcctattcttcgtgttgctaatgaggttgaaaagactcatcctagagttgcttatctctgtcggttttatgcgtttgagaaagctcatagattggaccctacttcaagtggtcgtggtgttcggcaatttaaaactgctcttcttcaacgtctggaaagagaaaatgatccaacattgaaaggaagggtaaagaagagtgatgcccgtgagatgcagagtttttatcagcattactacaaaaaatatatccaagctttacaaaatgctgctgataaggctgatcgtgcacagctaaccaaggcatatcagactgctaatgttctttttgaggttttgaaggctgttaatatgacacaatctatggaagttgatcgcgagattttggagactcaagataaagttgccgagaaaacagagatcttagttccttacaatattcttcctcttgatcctgatagtgcaaatcaggcaataatgagatttcctgagatccaagctgctgtatttgctcttcgtagcacaagaggtctttcctggccaaaggactacaagaaaaaaaaagatgaagacattttggattggctcgggtcaatgtttgggtttcagaagcacaatgtggcaaatcagagagagcatttaatcttattgcttgcaaacgtacatataagacagtttcccaagcctgatcaacagcctaagttggatgagcgcgcactgacagaagtgatgaagaagcttttcaagaattacaaaaagtggtgcaagtatttgggtcgaaagagtagcctttggctgccaaccatacaacaagaagtgcagcaacgtaaattactatacatgggtctttatcttctaatatggggtgaagcggccaacctaagattcatgccagagtgcctttgctatatatatcaccatatggcttttgaattgtatggtatgcttgctggtaatgttagtccaatgacgggagagaatatcaagccagcctatggaggtgaagaggaggctttcttaaggaaagttgtaacccccatatataatgtgattgcaaaggaagctgaaaggagcaaaagaggcaggtcaaagcattcgcaatggaggaactatgatgatataaatgaatatttctggtcagttgattgttttcggcttggttggccaatgcgtgctgatgctgatttcttttgccttccagttgaacagctatattttgataagttgactgataacaagccagctaacaaggacagatgggttggaaaggccaactttgttgagataaggtcattttggcatattttcagaagttttgatcgcatgtggatttttttcattctatgcttacaggctatgattattgttgcttggaatggatctggggatccaagtgcaatatttaatggtgatgttttcaagaaggcacttagtgtgtttataacagcagctatattaaagctcggagaagctattcttgatgtgatcctcagttggaaagcacaacggagtatgtcaatgcatgttaagttaagatacattctaaaagttgtttcagctgcagcatgggtgattgttctatcggtcacatatgcttatacgtgggacaatcctcctggctttgctcaaaccatccaaagttggtttggaagcaattcgcattcaccttcaatgtttattatggccgttgttgtatacctgtcaccaaatatgctagctgccatattgtttttgttcccactcattcggcgttttcttgagagatcaaattataggattgtgatgctaatgatgtggtggtcgcagccccgtctctatgtcggtagggggatgcatgagagcacattttcccttttcaagtacacagtgttttgggttctcttgttaattacaaagttagcattcagttactatattgagataaaacctctggtagaacctacaaaggctataatgagtgtaaaaatcacgcatttccagtggcatgaattctttccacgagctcgaaacaatattggtgttgtaattgccctttgggctccaattattttggtatacttcatggatacccagatttggtatgccatattctcgacattatttggtggtatttatggggcattccgtcgcctcggtgagataaggacactgggaatgcttagatctcggtttgaatcattgcctggtgcctttaatgcctgtttgatcccagaggaaaagagtgagccaagaaagaaaggattgaaagcaactttatctcgcagatttgatcagatcccatctaataaaggtaaagaagctgcaagatttgcacaactatggaaccaaattatcactagttttagagaagaagatcttatcagtaatagggaaatggaccttttgcttgtgccttattgggctgatcctgagttggaccttatacaatggccaccatttctactcgccagcaagattccaattgcattggatatggctaaggacagcaatggaaaggatcgagagctgagaaaaagaattgagtttgacaactatatgtattgtgctgttcgggagtgttatgcttcatttaagagcattattaggtacttggttcaaggggatcgtgagaaacaggttatagaatacattttctctgaggtagacaaacatattgaagttggtgacctaataagtgaattcaaactgagtgcgcttcctagcctctatgggcaatttgttgaactaatcaaatatttgttagacaataagcaagaagacagggaccaagttgtgattctattccaggacatgctggaggtggtgacaagggatataatgatggaggatcatatattcagcttggtagattttgtacatggtggatctggacacgaagggatgcttcctcttgagcaacaacaccagttatttgcatctgaaggggctatcaggtttccaattgcttcggttacagaagcttggacagagaagattaagcgcctatacttgctgcttacaacaaaagaatcagcaatggatgtaccatctaacttagaagccaaaagacgtatttcttttttctcaaattcactgtttatggatatgcctacagcacccaaagttcgcaacatgctttcattctcggttttaactccatactacacagaagaggttctcttttccttgcgtgagttggaatcacccaatgaagatggtgtttcaatacttttctacttacaaaagatctttccagatgaatggaacaactttcttcagcgagtgaattgttacaatgaagaagaacttaaagaatatgatgagttagaagaagaacttcgtcgctgggcatcataccgaggccaaactttgaccagaactgttagaggcatgatgtactacagaaaagccttggagctccaggcttttctcgatatggctaaagatgaagatttgatggaaggctataaagccatagaaaattcagacgataactcaaagggggaaagatcattatggacacaatgtcaagccgtagctgatatgaagttctcatatgtggtatcatgccaacaatatgggattgacaagcgatctggtgctgctcgtgcgcaggacatattgaggcttatggcaagatatccttcacttcgagttgcctatattgatgaggtagaagaacctagcaaagagagaccaaaaaagatcagcaaggtttattattcctgcttggtgaaggctatgccaaaatccagtagttcttctgaggcagagcctgagcaatgtttggaccaggtcatatataaaataaagcttcctgggcctgctattttgggtgagggtaaacctgaaaatcagaatcatgccataatgttcacacgcggagaaggcttgcaaacaatagatatgaaccaggataattacatggaagaagctttgaaaatgaggaatttgttgcaagaattcctcaagaagcacgatggagtgaggtatccaagtattcttgggcttcgggagcatatatttactggaagtgtttcttctcttgcatggttcatgtcaaatcaggaaaccagttttgtgacaattggtcagagattgttagctaatccactgaaggttcgattccactatgggcatcctgatgtctttgatagaatttttcacctcacaaggggaggtgtaagcaaagcctccaaggttatcaatttgagtgaagatatatttgctggctttaattctaccctccgtgaaggaaatgttactcatcacgagtacatacaagttgggaaaggaagagatgtgggtctcaaccagatttctatgttcgaggcaaagatagctaatggcaatggagagcaaacactgagtagagatgtataccgacttggtcaccgatttgacttcttcagaatgttgtcttgttatttcaccacaattgggttttacttcagtactcttattactgttgtcactgtgtacgtattcctctatggtcgcctttatctcgttcttagcggtcttgaagaaggtttgagtacacaaaaagctgtccgagataataagcctcttcaagtggctctcgcctctcagtcctttgttcaaattggatttttgatggctttgcccatgttgatggaaattggcttggaaaggggattccgaactgcacttagtgagttcatattaatgcagttgcagctagctccagttttcttcacattttctcttggaacaaagactcactattatggaaggacgttgcttcacggaggtgcaaaatatagacctactggtcgagggtttgtggttttccatgctaaatttgctgacaactatagactttactcccgtagccactttgtcaagggtattgagctattgactttgctcattgtataccaaatttttggtcattcttatagaagtggagtagcatatttgttgattaccataccaatgtggtttatggtgggcacctggctttatgctcccttcttgttcaatccttctgggttcgagtggcaaaagattgttgatgattggactgattggaataaatggattagcatccgaggcggtatcggtgtaccacctgagaagagttgggaatcctggtgggaggaggaacaagagcatctcaaatattcagggatccgtggaaccatagctgagatattattatctttgcgcttttttatctatcagtatggtcttgtttatcacttgaactttacgaaaaatacaaaaagtttcctcgtctatggcatatcatggttggtgatctttctaatattatttgtgatgaagacggtgtctgtcgggagaaggaaattcagtgcaaattttcaacttgtcttccggctaatgaagggattaatttttgtgacttttgtctcgattctagtaaccatgtttgcccttcctcacatgacatttcaggacattattgtttgcattcttgccttcatgccaactggttggggaatgctacagattgcacaagcattaaagcctctagtacgccgagctggattttgggagtcagtgaaaactctagcacgtggctatgaggttatcatgggtttgcttttgttcactcctgttgcattcttggcttggtttccatttgtgtcggaatttcagactcgtatgcttttcaaccaagcattcagcagaggtttgcaaatttctcgtattcttgggggccaaaggaagggtcgatcctctcgcaacaaggaat

SEQ ID NO: 3002 - DNA, 6167 bp, Cajanus cajan
atgtcttcctcgaggggaggcgcgggaccgtcttcggaggcgccgccgcccaggcggatcatgcggacacagactgcggggaatttgggagagtctgtcattgacagtgaggtcgtgccttcgtctctcgtcgagattgcgcccattcttcgtgtcgctaacgaagtcgaaaagactcatcccagggttgcttatctctgccgtttttacgcctttgagaaagcgcataggttggatcccaattcaagtggtcgtggtgttcgccaattcaaaaccgctcttcttcaacgtcttgaaagagaaaatgatccaactctgaagggaagggtaaagaaaagtgatgctcgtgagatgcagagtttttatcagcattactacaaaaagtacatccaagctttacaaaatgctgctgataaagctgaccgggcacaacttaccaaggcatatcaaacagctaatgttctttttgaggttttgaaggctgttaacatgacacaatctatggaagttgatcgtgaggttattatccaagctgctgtatatgcccttcgtaacactaggggtcttccttggccttctaacgagtacaagaaaaaaaaggatgaagacattctggattggcttgggtcaatgtttggatttcaggtaaaactcaatcagaaattggatgagcgtgctctgacagaagtgatgaagaaactgttaaagaattacaaaaagtggtgcaagtatttgggtcggaaaagtagcctttggttacctaccatacaacaagaagtacagcagcggaaactactatatatgggtctgtatcttttaatatggggtgaagctgccaacctaagattcatgccataatgcctttgttatatatatcaccatatggcttttgaattgtatggtatgcttgctggtaatgtcagtcctatgactggagagaatgtgaagccagcgtatggaggtgaagacgaggcttttttaaggaaagtggtcactcctatctataacgtgattgctaaggaagctggacgtagtaaaaaaggaaggtcgaagcattcacaatggaggaactatgatgatttaaatgaatatttctggtctggtgattgttttcggttaggttggccaatgcgtgcagatgctgatttcttttgtctgccaactgaaaatcagagttttgataaatctaatgggaggataaggatgtcctcaacaagatctattatgctgcggtgtgcaatggctgatgatccatcgatctctatgcaaattgttcattcttccattgaaatcattcttacatgtatattatgttctagagtaagaaaattcatgaacaaattcccttgtatgctgttcttttgtcaggaaatgataatttatgtaataatatgttggatagaggagttttccccccttccaatcaaaagggatgacaagccacctaacagagacagatgggttgggaaagtgaattttgttgagataagatcattttggcatattttcagaagttttgatcgaatgtggagttttttcattctgtgtttacaggctatgattattgttgcttggaatggacctggggatccaagtgtaatcttcaagggtgatgtgttcaagaaggtgctgagtgtgtttataacagcagctatattgaagttagggcaagctgttcttgatgtgatcctaagttggaaagcacaacggagcatgtcactgcatgtcaagttaagatacattctaaaagttgtttcagctgcagcatgggtgattgttctgtcagttacttatgcgtatacttgggataatcctcctggttttgctcaaaccattaaaagttggtttggaagtggtggttcaagtgctccatcgttgttcattttggctgttgttgtttacctgtcaccaaatatgctcgcggcaatattctttctgatcccttttattcgtcgtcatcttgaaaggtcaaactataggattgttatgctaatgatgtggtggtcacagcctcgtttgtatgttggtaggggaatgcatgagagcgcattttcccttttcaagtacacaatgttttgggtcctccttataataacgaagttggctttcagttactatatagagataagacctctggtgggacctacgaaagctataatgagtgtaaaaatcacgactttccagtggcatgaattctttcctcatgctaggaacaatattggtgttgtaattgcactttgggctccaattattctggtatactttatggacacccaaatttggtatgccatattctcaacattatttggtggaatttatggtgcctttcgtcgacttggggagatacggacattaggaatgctaaggtctcgatttcaatcattgcctggtgccttcaatgccagtttgattccggaggaaacaaaagagccgaagaaaaaaggattaaaagccactttatcccgcaaatttcctgagatctcatcgaacaaagggaaggaagctgcaaggtttgcccaattgtggaaccaaataattactagtttcagggatgaagatcttattagtgatagggaaatggaccttttgcttgtaccttattgggctgatactcagttggaccttatacaatggcccccctttctacttgctagcaagatcccaattgcactagatatggctaaggacagcaatgggaaggaccgagaactgaagaagagaattgtggctgaaaattacatgtcttgtgctgttcgtgagtgctatgcttcatttaagagcattattatacacttggttcaaggggaacgggaaacaccgtttatagagtacatgttcaatctagtggataaacatatacaagaagatgacgtgatgagtaaattcaaaatgagtgcacttcctggcctgtatgaaaagtttgttaagctaatagaatatttgctggcaaatgatccgaaagatagggacctagttgtgattctattccaggacatgctggaggttgtgacaagagatatgatggaggatcaggataccattttcagttggatggattcaagccatggtggtaccggacttgagggcatgcttcagcttgagcctgagccacatcaccaactgtttgcatctgaaggagctatcaggtttccaattgaaccagttacagcagcttggacagagaagattaaacgactttacttgctgcttacaacaaaagaatctgccatggatgtaccatctaacttagaagcaagaaggcgtatatctttcttctcaaattcactgtttatggacatgcctattgcaccaaaagttcgcaacatgctttcattctcggttttgactccatactatactgaagaggttctgttctccttaaatgatttggattcaccgaatgaagatggtgtttcaatactgttctacttgcaaaagatctttcctgatgagtggaacaattttcgtgagcgagtgaattattctgaggaggatattaaagggtgtgaatctgatgaattagtagaagaacttcgtctttgggcatcatatagagggcaaacattgactaaaactgttagaggtatgatgtattatagaaaagctttggaactccaggcttttcttgatatggccaaagatgaagatttgatggaaggttataaagccatagaaaactcagatgacaattcaagtggggaaaggtcattgtggacacagtgtcaagcagtagctgatatgaaatttacatatgttgtatcatgccaacaatatggtattgacaagcgatctggttctcctcgtgcacaggacatattaaggcttatgacaagatatccttcacttcgagttgcctatattgatgaggtagaggaaactgtccaagacagtaagaaaaagatcaacaaggtttactactcttgcttggtgaaggctatgccgaaatccagtagttcttcagagcctgagcagaacctagaccagattatatataaaataaagcttcctggaccggcaattttgggtgagggtaagcctgaaaatcagaatcatgccataattttcacacgtggagagggcttgcaaacaatagatatgaaccaggataactacatggaggaagctttaaaaatgaggaatttgttgcaagaatttcttaagaagcatgatggtgttcggttccctagtattcttggacttcgggagcatatatttactggaagtgtttcttcccttgcatggttcatgtcaaatcaggagacaagtttcgtgacaattggtcagagattgttggctaatcctctaaaggttcgtttccattatggtcatcctgacgtctttgataggctttttcacctgacaagaggtggtgtcagtaaatcctccaaagttatcaatctaagtgaagatatttttgctggcttcaactctactctccgtgaaggaaatgtaactcaccatgagtacatacaagtagggaagggaagagatgtgggtctcaaccagatttctatgtttgaagcaaaaattgctaatggcaatggagagcaaacactaagtcgagatgtataccgacttgggcaccgttttgacttcttcagaatgttgtcctgttatttcaccacagttggattttatttcagcactctcataactgttctcactgtatatgtattcctctatggtcgcctctatcttgttcttagtgggctcgaagaaggtcttagtacacaaaaagccattcgagacaataagcctcttcaggtggctcttgcttctcagtcatttgttcaaattggggttttgatggccctgcccatgttgatggaaattggtttggaaaggggcttccgaactgcgcttagtgagtttatattaatgcaactgcagctggccccagtattcttcacattttcacttggaacgaagactcactattttggaagaacattgcttcatggaggtgcaaaatatagacccactggtcgaggatttgtggttttccatgctaagtttgctgataactacagactttactctcgtagccactttgtcaagggtattgagctcatgatattgcttgttgtatatcaaatttttggtcatagttacagaagtgctgttgcatatatcttgattaccgcatcaatgtggtttatggtgggtacctggctgtttgctcccttcttgttcaatccttctgggtttgaatggcaaaaaattgttgatgattggactgattggaataaatggattagtaaccgagggggtataggtgtactgcctgaaaaaagctgggaatcttggtgggaagaggaacaagagcatctccaatattcaggaatgcgaggaatcatagtggagattctgttatcattgcgattttttatctaccagtatggtctggtatatcacttaaatattacaaagaagggcgagaaaagttttctggtctatggcgtttcatggttggtgatattcgtaatattgtttgtgatgaagacggtatctgttgggaggcgtaaattcagtgcaaattttcagcttgtcttccgactaatcaaggggatgatattcctcacttttgtctcaattcttgtcattttgattgcccttccgcatatgacagtgcaggacatcattgtttgcattcttgctttcatgccaactggttggggaatgctgcagattgctcaagcattaaaacctgtagtacgccgtgctgggttttggggatcagtgaaaacacttgctcggggttatgagattatcatgggtttgcttttgttcactcctgttgcttttctggcttggtttccttttgtttcagaatttcaaacccgtatgctgttcaaccaagcattcagcagaggtttgcaaatttctcgtattcttggtggccaaaggaaggagcgcacttctcgcaacaaggaatagcttgtctaggtgaaggcttaatttattaggagcccaaaattcttggttgcgctaatagctgcagcaagatttctgtagcaattgtaagtaagaagttgtaactatgagacagatgctacgtttctcttttgttatagcatttgattatcattgtctaacatgaaagttatcaagtccgtaagttatgcatcttcggtgagttttaaatcttcttatgttgcacctccacc

SEQ ID NO: 3003 - DNA, 6340 bp, Vitis vinifera
agtatcagtaccttttgcatgttcttcgagccccctcatcgtttcctttccttctaagctttgcttaaagtttcagccagcctctctctctcttagggttttctactgtcactgaaacccattttctttctaacgccctccttcgtttccacttcatttctcttcaaatctctctcaatcacttcacatttcagtgctctctctctcattggcttcttatgtcagattcagatacctaggaaacaaacaggggtggtggctgtgagttcacaaaaaaatggcgtccagaagcggctcggatcagccgcagccgcagccgcagcagcggcggatcacgcggacacagacggcagggaatcttggcgagtcgattttcgacagtgaggtggtgccgtcgtcgctggtggagatcgctccgatcctccgtgtggctaatgaagtcgaatctagccatcctagagttgcttatctatgtcgattttatgcctttgagaaggctcacaggttggatcccacctctagtggacgtggtgtccgtcagtttaaaactgcacttctacaacgtctagaaagggagaatgatccaacattaatgggaagggtaaaaaaaagtgatgcgcgtgaaatgcagagtttttatcagcattactacaaaaaatatatccaggctttacaaaatgctgccgataaagctgatcgggcacagctcacaaaagcatatcagaccgctaatgttctatttgaggttttgaaagctgttaatcatactcaagctattgaagttgatcgtgagattttagaagctcaaaatcaagttgcagagaagacagagatttatgtgccttacaatattcttcctcttgatcctgatagtgcaaatcaggcaattatgagatatccagagattcaagctgctgtttatgctcttcgtaacacaaggggtcttccatggccacgggattacaagaagaaaaacgatgaagacattctagactggctacaggcaatgtttggatttcagaaggataatgtggccaatcaaagggagcatctgattttattacttgcaaatgtgcacatacggcagtttcctaagcctgatcaacaacccaagttggatgaacgcgcactgacagaagtgatgaagaaactgtttaagaattacaaaaaatggtgcaagtacttggatcggaaaagcagtctttggctaccaactatacaacaggaagtgcaacagcgcaaactattgtacatgggcttatatcttcttatttggggagaagctgcaaacttaagattcatgccagaatgcctgtcatatatttatcatcatatggcatttgagctgtatggtatgctggctgggaatgtcagtcccatgacaggtgaacatgtgaaaccagcctatggaggtgaagaagaggctttcttaaagaaagtggttactcctatctatgaagtgatcgcaaaggaagctgataggagcaaaaggggaaaatctaagcattcccaatggaggaactatgatgatttaaatgaatacttctggtcagttgattgcttccgactaggttggccaatgcgtgcagatgccgatttcttttatctgccgatagaagagacgcataacgaaagaaatggggatggcaaaccaactgccagagatcgctggatgggaaaagttaattttgttgagatacgttccttttggcatattttcagaagctttgatagaatgtggagtttcttcattttgtgcttacaggctatgataattgttgcttggaatggttcgggggaaccaagttcaatctttagtggtgatgttttcaagaaagtactgagcgtctttataactgctgcaatactgaagcttgggcaagctgtccttgatgtaatcctcagttggaaagcaagggaaagcatgtcattctatgttaagctacgatacattttaaaggttgtcttggctgctgcatgggtgataattctgccagtcacttatgcttacacttgggagaatcctcctggatttgctcaaaccattaaaagttggtttggcaacagttcacattcgccttccttgtttattttggctgttgtggtatacttgtcgccaaacatgctagctgctgtattgtttctttttcccttcattcgccgtttccttgaaagatcgaactataagattgtgatgctcatgatgtggtggtcgcagcctcgactttatgttgggaggggaatgcatgagagtacattttctcttttcaagtacacaatgttttgggttcttcttattataacgaagttggcattcagttactatatagagataaagcctctagtgggtccaacaaaagctatcatgagtgtcaagataactaatttccagtggcatgaattttttcctcgtgcaaagaacaatattggtgttgttgttgctctctgggctccaatcatacttgtctattttatggatacccagatctggtatgctatattctcaacattgtttggaggtatatacggtgcatttcgtcgtctaggggagatacgaactttaggaatgctaagatctcgatttcaatcattgcctggtgcttttaatgcctgtttaattccggaagaaaagagtgagccaaaaaagaaaggactaaaagccactttttctcgtaactttgcccagataccatctaacaaagagaaagaggctgcaagatttgcccagttgtggaacaaaattatcactagttttagagcagaagatcttataagtgatagggaaatggacttattgcttgttccttattgggctgaccgtgatttggaacttatacagtggcctccatttttacttgctagcaagattccaatagcattggacatggctaaggacagtaatggtaaggacaaagagctgaagaagaggattgagaatgataactacatgtcttgtgctgttcgtgagtgctatgcttcattcaggaacatcatcaaattcttagttcggggagaccgagagaaagaggtcatagaatgtatattctctgaggttgacagacacatagaagcaggtgatttaataagagaattcaagatgagcgctcttcctagcctctatgatcactttgttaagcttatcggctatttgttagagaataaacaggaggacagggatcaagttgtgattcttttccaggacatgctggaggtagtaacaagagacataatgatggaggataatgtatccagtttggtagacactggtggacccgggtatgaggggatgacctcccttgaacaacattctcagttatttgcatcttctggagcaattaagtttccaattcttccttcatctgaagcttggaaggagaagatcaaaagactttatctattgcttactgtaaaggagtctgcaatggacgtgccgtcaaacttggaagctagaaggcgtatttctttcttctcgaattctttgttcatggacatgcctattgcacctaaagttcgcaatatgctttccttttctgtgttgactccatattacacagaggaggttctcttctctttgcatgatttggaagtgccaaatgaagatggtgtttcaatcctcttttacttgcaaaagatttttccagatgaatggaacaactttcttgagcgaatgggatgcaataatgaagaagagcttttggaaggtgataaattagaagaacttcgcctttgggcatcatacaggggtcaaacattgtccaaaactgtaagaggtatgatgtattatcggaaagctttggagcttcaggctttccttgatatggccaaagatgaagatttaatggaagggtataaggctatcgaactaaatacggaggaccattccaagggggaaagaacactctgggcacaatgtcaagctgtagctgatatgaagttcacttatgtggtatcttgtcagaaatatgggattcacaagcgttctggtgatcatcgtgcacaggacattttgaagcttatgaccacatacccttccctccgtgtggcatacattgatgaggttgaagaacctagcaaggacagaaaaaagatcaatcagaaggcttattattctgttctggtgaaggctgctccgccaaacattaattcttcagagccggtgcaaaacttagaccagattatttataaaataaaacttcctggacctgctatccttggtgagggaaaaccagaaaatcagaatcatgctattattttcactcgtggagaaggcttgcaagcaatagatatgaaccaggacaactacatggaagaagccttaaaaatgaggaacttgcttcaagagtttctcacgaagcacgatggtgtaagattccctacaattcttggacttagggagcatatatttactggaagtgtttcttctcttgcatggttcatgtcaaatcaggagaccagttttgtgactattggtcagagattgttagccaaccctctgaaggttcggttccactatgggcatccagatgtgtttgataggctgtttcacctgactagaggaggaatcagtaaagcatccaagattataaatttaagtgaggacatatttgcaggattcaattccacacttcgtgaaggcaatgtcactcatcatgaatatatacaagttggaaaagggcgggatgtgggccttaaccagatttctatgtttgaggcaaagatagctaatggcaatggagaacagacattaagccgtgatatctacaggcttggacaccgttttgacttcttccggatgttgtcgtgttatttcacaacgattggtttttacttcagtaccctgataacagtactcactgtatatatattcctatatggccgtctttatcttgtccttagtggacttgaagaaggtttaagcactcaagcagcatttcgagacaataaacctttgcaagtggcccttgcttctcaatcatttgtccaaattggatttttaatggcactgcctatgttgatggaaattggcttggagagggggttccgaactgcattaagtgaattcatactgatgcaattacaattggctccagtatttttcacattttctcttggaacaaagacccactattatggaaggacattactccatggaggtgcaaaatatagacctacaggtagaggattcgtggtgttccatgcgaagtttgctgaaaactataggctctattctcgtagtcattttgttaagggaattgagctgatgattctgcttcttgtttaccaaatttttggacatacttatagaagtgcagttgcttatgtcttgatcactatatcaatgtggttcatggtgggaacctggctttttgctcccttcctcttcaatccttctgggtttgagtggcagaagattgttgatgattggactgattggaataagtgggtaagcaaccgagggggaattggtgtaactgcagaaaaaagttgggaatcatggtgggaggaggagcaagaacatcttcgtcattctggaaagcgtggtatcattgctgagatattgttatcgttaagattcttcatctatcaatatgggcttgtttatcacctgaacctcacaaagaataccaaaagttttctggtctatggcatatcatggctggtgatctgtataatattgtttgtgatgaagactgtttctgtgggacggcgaaaattcagtgccaatttccaactcatgttccggctaattaaaggattgatcttcctgacatttgtctccattctggtcactctgattgcgctcccccatatgaccttacaggacatcatagtctgcattcttgcgttcatgccgactggttggggattacttctgattgcacaagcctgcaagcctgttgttgagcgagctgggttctgggcatcggttcgaacacttgctcgtgggtatgagatcatcatgggcttgcttctattcaccccagttgcatttctggcatggtttccctttgtttcagagttccaaacccgaatgctattcaaccaagcgttcagcagaggcctgcagatctctcgtattcttggtggtcataggaaggatcggtcttctcgcaacaaagagtaaggtaaatgagagtatgactaagtgttcattttggtttaatgttcgtatgtactattattgtgagcttgttcatatctattactgtaagctgttgtaattatatggattgagatattggcagcatttttgttgattagaattgactgggaagtcctgccagctcttttctgtacatcttattaatttaagattatatcatctatgggttcttgcaaa

SEQ ID NO: 3004 - DNA, 6306 bp, Vitis vinifera
ctcatcgtttcctttccttctaagctttgcttaaagtttcagccagcctctctctctcttagggttttctactgtcactgaaacccattttctttctaacgccctccttcgtttccacttcatttctcttcaaatctctctcaatcacttcacatttcagtgctctctctctcattggcttcttatgtcagattcagatacctaggaaacaaacaggggtggtggctgtgagttcacaaaaaaatggcgtccagaagcggctcggatcagccgcagccgcagccgcagcagcggcggatcacgcggacacagacggcagggaatcttggcgagtcgattttcgacagtgaggtggtgccgtcgtcgctggtggagatcgctccgatcctccgtgtggctaatgaagtcgaatctagccatcctagagttgcttatctatgtcgattttatgcctttgagaaggctcacaggttggatcccacctctagtggacgtggtgtccgtcagtttaaaactgcacttctacaacgtctagaaagggagaatgatccaacattaatgggaagggtaaaaaaaagtgatgcgcgtgaaatgcagagtttttatcagcattactacaaaaaatatatccaggctttacaaaatgctgccgataaagctgatcgggcacagctcacaaaagcatatcagaccgctaatgttctatttgaggttttgaaagctgttaatcatactcaagctattgaagttgatcgtgagattttagaagctcaaaatcaagttgcagagaagacagagatttatgtgccttacaatattcttcctcttgatcctgatagtgcaaatcaggcaattatgagatatccagagattcaagctgctgtttatgctcttcgtaacacaaggggtcttccatggccacgggattacaagaagaaaaacgatgaagacattctagactggctacaggcaatgtttggatttcagaaggataatgtggccaatcaaagggagcatctgattttattacttgcaaatgtgcacatacggcagtttcctaagcctgatcaacaacccaagttggatgaacgcgcactgacagaagtgatgaagaaactgtttaagaattacaaaaaatggtgcaagtacttggatcggaaaagcagtctttggctaccaactatacaacaggaagtgcaacagcgcaaactattgtacatgggcttatatcttcttatttggggagaagctgcaaacttaagattcatgccagaatgcctgtcatatatttatcatcatatggcatttgagctgtatggtatgctggctgggaatgtcagtcccatgacaggtgaacatgtgaaaccagcctatggaggtgaagaagaggctttcttaaagaaagtggttactcctatctatgaagtgatcgcaaaggaagctgataggagcaaaaggggaaaatctaagcattcccaatggaggaactatgatgatttaaatgaatacttctggtcagttgattgcttccgactaggttggccaatgcgtgcagatgccgatttcttttatctgccgatagaagagacgcataacgaaagaaatggggatggcaaaccaactgccagagatcgctggatgggaaaagttaattttgttgagatacgttccttttggcatattttcagaagctttgatagaatgtggagtttcttcattttgtgcttacaggctatgataattgttgcttggaatggttcgggggaaccaagttcaatctttagtggtgatgttttcaagaaagtactgagcgtctttataactgctgcaatactgaagcttgggcaagctgtccttgatgtaatcctcagttggaaagcaagggaaagcatgtcattctatgttaagctaagatacattttaaaggttgtcttggctgctgcatgggtgataattctgccagtcacttatgcttacacttgggagaatcctcctggatttgctcaaaccattaaaagttggtttggcaacagttcacattcgccttccttgtttattttggctgttgtggtatacttgtcgccaaacatgctagctgctgtattgtttctttttcccttcattcgccgtttccttgaaagatcgaactataagattgtgatgctcatgatgtggtggtcgcagcctcgactttatgttgggaggggaatgcatgagagtacattttctcttttcaagtacacaatgttttgggttcttcttattataacgaagttggcattcagttactatatagagataaagcctctagtgggtccaacaaaagctatcatgagtgtcaagataactaatttccagtggcatgaattttttcctcgtgcaaagaacaatattggtgttgttgttgctctctgggctccaatcatacttgtctattttatggatacccagatctggtatgctatattctcaacattgtttggaggtatatacggtgcatttcgtcgtctaggggagatacgaactttaggaatgctaagatctcgatttcaatcattgcctggtgcttttaatgcctgtttaattccggaagaaaagagtgagccaaaaaagaaaggactaaaagccactttttctcgtaactttgcccagataccatctaacaaagagaaagaggctgcaagatttgcccagttgtggaacaaaattatcactagttttagagcagaagatcttataagtgatagggaaatggacttattgcttgttccttattgggctgaccgtgatttggaacttatacagtggcctccatttttacttgctagcaagattccaatagcattggacatggctaaggacagtaatggtaaggacaaagagctgaagaagaggattgagaatgataactacatgtcttgtgctgttcgtgagtgctatgcttcattcaggaacatcatcaaattcttagttcggggagaccgagagaaagaggtcatagaatgtatattctctgaggttgacagacacatagaagcaggtgatttaataagagaattcaagatgagcgctcttcctagcctctatgatcactttgttaagcttatcggctatttgttagagaataaacaggaggacagggatcaagttgtgattcttttccaggacatgctggaggtagtaacaagagacataatgatggaggataatgtatccagtttggtagacactggtggacccgggtatgaggggatgacctcccttgaacaacattctcagttatttgcatcttctggagcaattaagtttccaattcttccttcatctgaagcttggaaggagaagatcaaaagactttatctattgcttactgtaaaggagtctgcaatggacgtgccgtcaaacttggaagctagaaggcgtatttctttcttctcgaattctttgttcatggacatgcctattgcacctaaagttcgcaatatgctttccttttctgtgttgactccatattacacagaggaggttctcttctctttgcatgatttggaagtgccaaatgaagatggtgtttcaatcctcttttacttgcaaaagatttttccagatgaatggaacaactttcttgagcgaatgggatgcaataatgaagaagagcttttggaaggtgataaattagaagaacttcgcctttgggcatcatacaggggtcaaacattgtccaaaactgtaagaggtatgatgtattatcggaaagctttggagcttcaggctttccttgatatggccaaagatgaagatttaatggaagggtataaggctatcgaactaaatacggaggaccattccaagggggaaagaacactctgggcacaatgtcaagctgtagctgatatgaagttcacttatgtggtatcttgtcagaaatatgggattcacaagcgttctggtgatcatcgtgcacaggacattttgaagcttatgaccacatacccttccctccgtgtggcatacattgatgaggttgaagaacctagcaaggacagaaaaaagatcaatcagaaggcttattattctgttctggtgaaggctgctccgccaaacattaattcttcagagccggtgcaaaacttagaccagattatttataaaataaaacttcctggacctgctatccttggtgagggaaaaccagaaaatcagaatcatgctattattttcactcgtggagaaggcttgcaagcaatagatatgaaccaggacaactacatggaagaagccttaaaaatgaggaacttgcttcaagagtttctcacgaagcacgatggtgtaagattccctacaattcttggacttagggagcatatatttactggaagtgtttcttctcttgcatggttcatgtcaaatcaggagaccagttttgtgactattggtcagagattgttagccaaccctctgaaggttcggttccactatgggcatccagatgtgtttgataggctgtttcacctgactagaggaggaatcagtaaagcatccaagattataaatttaagtgaggacatatttgcaggattcaattccacacttcgtgaaggcaatgtcactcatcatgaatatatacaagttggaaaagggcgggatgtgggccttaaccagatttctatgtttgaggcaaagatagctaatggcaatggagaacagacattaagccgtgatatctacaggcttggacaccgttttgacttcttccggatgttgtcgtgttatttcacaacgattggtttttacttcagtaccctgataacagtactcactgtatatatattcctatatggccgtctttatcttgtccttagtggacttgaagaaggtttaagcactcaagcagcatttcgagacaataaacctttgcaagtggcccttgcttctcaatcatttgtccaaattggatttttaatggcactgcctatgttgatggaaattggcttggagagggggttccgaactgcattaagtgaattcatactgatgcaattacaattggctccagtatttttcacattttctcttggaacaaagacccactattatggaaggacattactccatggaggtgcaaaatatagacctacaggtagaggattcgtggtgttccatgcgaagtttgctgaaaactataggctctattctcgtagtcattttgttaagggaattgagctgatgattctgcttcttgtttaccaaatttttggacatacttatagaagtgcagttgcttatgtcttgatcactatatcaatgtggttcatggtgggaacctggctttttgctcccttcctcttcaatccttctgggtttgagtggcagaagattgttgatgattggactgattggaataagtgggtaagcaaccgagggggaattggtgtaactgcagaaaaaagttgggaatcatggtgggaggaggagcaagaacatcttcgtcattctggaaagcgtggtatcattgctgagatattgttatcgttaagattcttcatctatcaatatgggcttgtttatcacctgaacctcacaaagaataccaaaagttttctggtctatggcatatcatggctggtgatctgtataatattgtttgtgatgaagactgtttctgtgggacggcgaaaattcagtgccaatttccaactcatgttccggctaattaaaggattgatcttcctgacatttgtctccattctggtcactctgattgcgctcccccatatgaccttacaggacatcatagtctgcattcttgcgttcatgccgactggttggggattacttctgattgcacaagcctgcaagcctgttgttgagcgagctgggttctgggcatcggttcgaacacttgctcgtgggtatgagatcatcatgggcttgcttctattcaccccagttgcatttctggcatggtttccctttgtttcagagttccaaacccgaatgctattcaaccaagcgttcagcagaggcctgcagatctctcgtattcttggtggtcataggaaggatcggtcttctcgcaacaaagagtaaggtaaatgagagtatgactaagtgttcattttggtttaatgttcgtatgtactattattgtgagcttgttcatatctattactgtaagctgttgtaattatatggattgagatattggcagcatttttgttgattagaattgactgggaagtcctgccagctcttttctgtacatcttattaatttaagattatatcatctatgggttcttgcaaa

SEQ ID NO: 3005 - DNA, 6271 bp, Populus trichocarpa
gatatgtaagactcataagccattgctcacttctcctaattcttctgaaggaaagagatgtcgtcgacgtcgagaggaggaggaatggggatggatcaggcggctggggggccgttagcgacaccaccgcagacgcaacggaggttaacgaggacgcagacagctgggaatcttggagagtcgatatttgatagtgaagtagtgccgtcttcacttgttgagatcgcgccgattcttcgtgttgctaatgaagttgaatctagcaatcctagagttgcttatctttgtcgattttatgcctttgagaaagcgcataggttggatcctacttctagtggaagaggtgttcgtcaatttaaaactgcacttcttcaacgtctcgaaagggagaacgatccaaccttgatgggaagggttaaaaaaagtgatgcacgagaaatgcagagtttttatcagcattactacaaaaaatacatccaagcattgcataatgctgctgataaagctgaccgcgcccagcttaccaaggcataccagactgctaatgtgctctttgaggttttaaaggctgttaatacgacacaatctattgaagttgatcgtgagattttagaagctcaagataaagttgcagaaaaaactcagatctatctgccttacaatatcctgccacttgatccagatagtgcaaatcaagcgattatgagatatcctgagatccaagctgctgttgttgctctgcgtaacacaagaggtcttccgtggcccaaggattacaagaagaaaaacgacgaagatgttttggattggcttcaggcaatgtttgggtttcagaaggataatgtggcaaatcaaagagagcacttaatcttattacttgcaaatgtgcacatacggcaatttcccaagcctgaccaacaaccaaagttggatgagcgtgcattgactgaagtgatgaagaaactttttaagaactacaaaaaatggtgcaagtacttggatagaaaaagtagcctttggttaccaaccatacagcaggaggtgcaacagcgtaaattattgtacatgggtctgtatcttttgatatggggggaagctgcaaacctgagattcatgccagaatgcatttgctatatttatcatcatatggcatttgagttatatggcatgctagctggaaatgtcagtcctatgacaggagaaaatgtaaagcctgcctatggaggtgaagaagaggctttcttgagtaaagttgttactcctatctacaacatgatcgcaaaggaagctgaaaggagtaaaaaagggaagtcaaagcattctcagtggaggaactacgacgatttaaatgagtacttctggtcagttgattgtttccgcttaggctggcccatgcgtgcagatgctgatttcttttgcctgtctgatcatcaccattttgaaaaaaatggggataataaaccagcctatagagatcgatgggtaggaaaagttaatttcgtggagatacgatcattcttgcatgtctttagaagctttgatcgaatgtggagtttttttatcctgtgcttacaggctatgattacggttgcttggcatggttcggggcaaccaagtgttatctttagcggtgatgtatttaagaaagtattgagtgtcttcattactgctgcaatattaaagctcgggcaagctatccttgatgtcattcttaattggaaggcacgacaaataatgtcattccatgtcaagttgagatttattctgaaggttgtttcagctgctgcatgggtggtagttttaccagtaacttatgcttacacttgggatgataaacctccaggatttgcccaaaccatcaaaggttggtttggcaatggtttcagctcgccttccttgtttatattggctgtagttatctacctggcaccaaatatgctggctgcagtattgtttctttttcccttcatacgtcgattccttgagaggtctaactataggatcgtgatgcttatgatgtggtggtcacagcctcggctctatgttgggaggggaatgcatgagagtacaatttctctcttcaagtatacaatgttttgggttcttcttattataacaaagttgacatttagttactatatagagataaggcctctagttgttccaacaaaagccataatgagtgttcatataactactttccaatggcatgaattctttccacgagcaaagaacaatattggtgttgtgattgcactctgggctccaattattcttgtatattttatggattcccagatttggtatgccatattttccaccttctttggaggtatttatggtgcatttcgacggcttggagagattcgaacattgggaatgcttagatctcgtttccaatcattgcctggtgctttcaatgcctgtttaattccaggggataagagtgagccaaagaagaaaggctttaaggcaaccctgtctcgcaaatttgctgagatcccatctaacaaagaaaaggaggcagcaagatttgctcagttgtggaataaaatcatcagtagtttcagagaagaagaccttataagcaataaggagatggacttgttgcttgttccatattgggctgaccgtgatttggaccttatacagtggcctccatttctgctggctagcaagatcccaatagcattagacatggctaaggacagtaacggtaaggataaggagctgaaaaagagaatcgagtttgacaactacatgtcttgtgctgttcgtgaatgctatgcttctttcaagaacatcatcttgtttttggttcaagggaaacgtgagaaagaggtgatcgatttcatattctctgaagttaacatacacatagacggaggtgatttgataagtgaatacaaaatgagtgctcttccgttcctctatgatcactttgtgaagcttatcaaatacttgctggctaataaaccggaggacagggatcaagttgtgattctctttcaggacatgctggaggttgtgacaagagacataatgatggaggatcatatatccaatctggtggattctattcatggcggatctggacatgagggaatgactctccatgaacgacaatatcagttatttgcatcttctggagctatcaagtttccaattgaaccagtcacagaagcatggaaagagaagatcaagaggctttttcttttgcttaccacgaaagaatccgcgatggatgtaccatccaacttagaagctaggaggcgtatatctttcttctcaaactcactgtttatggacatgcctactgcacctaaagttcgcaatatgctttctttctctgttttaactccttactatacagaggatgtgcttttctccttgcttgatttggaagtgccaaatgaagatggtgtttccatcctcttttacttgcaaaagatctttccagatgagtggaacaactttcttgaacgagtggactgcagcagtgaagaagaactcaaaggaagagacaacttggatgaagaacttcgtttatgggcatcatataggggccaaactttgactagaacggtgagaggtatgatgtactatcggcatgctttggagcttcaggcattccttgatatggccggagatgaagatttgatggagggctataaggctattgaattgagtactgatgatcagtcgaaggggggaaggtcactgttggcacagtgtcaggcagttgctgatatgaaatttacgtatgtagtatcatgccagaaatatgggattcacaagcggtccggtgatcctcgtgcacaggatattttgaggctcatgacaacatatccatctctccgtgtggcatacattgatgaggttgaagaaactaatccagacagatccaaggtcatccaaaaagtttactattcatctctagtgaaggcagccttacctaagtccattgattcctctgagccagtgcaaaacttggaccaggtcatttatcgaataaaacttccaggaccagccatcttgggtgaaggaaaaccagaaaaccaaaaccatgctattatcttcacacgtggagaaggcttgcaaacaatagatatgaaccaggataactacatggaagaagccttgaaaatgaggaatttgctgcaagaatttcttaaaaagcctgatggtgtgaggaatccttcgatacttgggcttagagagcatatatttactggaagtgtttcatctcttgcatggtttatgtcaaatcaggaaaccagttttgtgactatcggtcagaggctattggccaaccctcttaaggtgcggttccactatggtcatccggatgtatttgataggctttttcacttgactagagggggtgtcagtaaagcttctaaggttatcaatctgagtgaagatatatttgccggcttcaattctacactacgtgaagggaatgttacccatcatgaatatatacaagttgggaaggggagagatgtgggcctcaatcagatttctatgtttgaggccaaaatagctaatggaaatggagagcagactttgagtcgtgatatataccggcttggacaccgctttgactttttccgaatgctgtcttgctacttcaccacagttggtttttacttcagcactctgataaccgtgctcacggtgtatgtatttctttatggccgcctctatcttgttctcagtggacttgaagaaggtttgagcacacagaaagcaattcgagacaacaaacctcttcaagtggctcttgcatctcaatcttttgttcaaattggatttttgatggcgttgcctatgttgatggaaattggcttggaaaggggtttccgcactgcactaagtgaatttatactgatgcaattacaactagcacctgtatttttcacattttctcttggcacaaagacccactactatggaaggacattgctccatggaggtgcgaaatataggcccactggtagagggtttgtagtgttccatgccaagtttgctgacaattacaggctctattcccgcagtcattttgtgaagggtattgagatgatgattttgctcgttgtgtatcaaatatttggtcagccatacagaagtgcagtcgcctatctcttaataactatatctatgtggtttatggttggtacctggctttttgctccattcctcttcaatccttctggatttgagtggcagaagattgttgatgattggactgattggaacaagtggataagtaaccgtggaggaataggtgttccatcagagaagagttgggaatcatggtgggaagaagaacaggagcatcttcgtcactctggaaagcgtggtattctagcagagatattgttatctctacgattctttatctatcaatatggactagtatatcatttaacgatcacaaagaaaaccaaaagttttttggtctatggtgtatcatggctggtcatctttctaatattgttcgtgatgaagaccgtatctgttgggcggcgaaagttcagtgctaacttccagcttgcgttccgtctaattaagggaatgatattcctaacatttatctccattcttgtcactttgattgcactgcctcatatgacggtgcaggacatctttgtatgcattcttgctttcatgccaactggctgggggatgcttttgattgcacaagcatgcaagccaatcgttcaacgagcagggttttggggatcagttcagacacttgctcgtggttacgaaatcgttatgggcttgctcctgttcactccagttgcattccttgcctggtttccatttgtgtctgaattccagactcgtatgctgttcaaccaagcatttagtagaggtctgcaaatttctcgaattcttggcggcccaaggaaggatcgctcttcaaggaacaaggagtgatcttagtaccacactagcagtatcacactggcttgtgaaaattctgttaatatgtttgctaaccattgtacttgtggatgagtaaggaattgcatttttcgtaattgggataaaatcaacttctagcagcccccccccccaacttgaataaattttttccactaaatcatcagttctgttttgagcatctttgatcaaattatcaatgttatgctatgtattgtagggtctcatgcctgaaacaagcaagactgagtttgtgcaggggttttaggttctgtttatgttgaaagtaatttttttaaaaaaattattttgatgt

SEQ ID NO: 3006 - DNA, 6238 bp, Citrus clementina
ctttctctctcttcttcactttctctcccttagggtttctactttctctttatgtcagattcactacaaccttaaactgttcctcctcatcagctggaaaaaggggtgtattctgagcgtgtgattcgaggaaaatgtcgtcaagaggagggggccctgatcagcctccaccgcagaggcggatcatgcggacgcaaacggcagggaatcttggagagtcaatgtttgatagtgaggtcgtgccctcatcactttctgagattgcaccgattctacgtgtggctaatgaagttgaatccagcaatccaagagttgcttatctctgccgtttttatgcctttgagaaagcgcataggctggaccccacttctagtggtcgaggtgttcggcagtttaaaactgccctccttcaacgtcttgaaagggagaatgctccaacatatatggaaagagggaaaaaaagtgatgcacgtgaaatgcagagtttttatcaacattactacaaaaagtatattcaagccttgcaaaatgctgctgataaagctgatcgtgcacagcttaccaaggcctaccaaactgcgaatgttctctttgaggttttgaaggccgtaaatttgacagagtcaatggaagttgatcgtgagattttggaagctcaagataaagttgcagagaaaacacagatctatgttccttacaatatccttcctctggatcctgacagtgcaaatcaggcaattatgagatatcctgagattcaagcagcagttcttgctcttcgttacaccaggggtcttccttggcccaatgagcacaataaaaagaaagacgaagacattctagattggcttcaggaaatgtttgggtttcagaaagataatgtggcaaatcagagagagcacctgatcttactccttgcaaatgtgcatatccgacagtttccaaagcctgatcaacaacccaagttggatgatagagcactgacagatgtgatgaagaagcttttcaagaactacaaaagatggtgcaagtacttggatcggaaaagtagtctttggttaccaaccattcagcaagatgtacaacagcgtaaattactatacatgggtctttatcttcttatatggggagaagctgcaaacttgagattcatgccagaatgcctgtgttatatttaccatcatatggcatttgaattgtatggtatgcttgctggaaacgtcagtcccatgactggagagaatgtgaaaccagcttacggaggtgaagatgaagctttcttgagaaaagttgttacccctatctatgaagtaattgccagggaagctgaaagaagcaaacgaggaaaatcaaaacattctcaatggaggaattatgatgatttaaacgaatacttctggtcagttgattgtttccggttaggttggcctatgcgtgcagatgctgatttctttggtctacctattgaacagctccgtttcgaaaaaagcgaggataacaaaccagctaatagagatcgatggctggggaaggttaattttgtagagatacgctcgttctggcatattttcagaagctttgatcgaatgtggagtttcttcattctatgcttacaggtcatgattattgttgcttggaatggttcggggaacccgagttcaatatttgaagttgatgtattcaagaaagtattgagtgtattcataactgcagcaatactcaagcttgggcaagctatccttgatgtgatactcaattggaaagcacggcgaagcatgtcatttcatgttaagttgagatatattttgaaggttgtctcagctgctgcatgggtgattgtgctaccggtcacttatgcctatacatgggagaatcctccggggtttgctcaaaccatcaaaagttggtttggcagtactgcaaattcaccctccttgttcattttggctgttgttatctatttgtcaccaaatatgctatctgctgttttatttcttttcccattcattcgtcgggtgctggagaggtccaattacaggattgtaatgctcataatgtggtggtcacagcctaggctctatgttggaaggggaatgcatgaaagcgcattttctctcttcaagtatacactattctgggttcttcttataattacaaagttggcttttagttactacattgagataaaacctttggtgggtccaacaaaggacatcatgcgtgtacggataaccgatttccagtggcatgaattttttcctcgtgcaaagaacaatattggggttgtgattgctctgtgggctccgattattcttgtatattttatggatgcccagatttggtatgccatattctctacaatatttggaggcatttatggtgcatttcgtcgtcttggagagattcgaacactaggaatgctaaggtctcgctttcaatcactgcctggtgcttttaatggttgtttgattcctgaagagaggagtgagccaaagaagaaaggattgagggccactttgtctcgcaactttgctgagatcccgtctaacaaagaaaaagaggctgcaagatttgctcagctctggaacaaagtaatcactagcttcagagaggaagatcttataagtgatagggaaatgaacctgctacttgttccatattgggctgaccgtgatttgggccttattcagtggcctccgttcttacttgctagcaagataccaatagcattagacatggctaaagacagtaatggcaaggatcgagaactgaaaaagagaattgaggctgatgattacatgtcctgtgctgtcaaggagtgttatgcttcatttaggaacatcattaagttcttggttcaaggaaacgagaaaagggttatagatgacatattttctgaagttgatagacacatagaagccggtaacctgattagtgaatacaagatgagttctcttcctagcctctatgaccactttgtgaagctgatcaaatatttgttagataataaacaggaggacagggatcaggttgttattctattccaggatatgctggaggttgttacaagagatataatgatggaggaccatatatccagtctggtagagtcagtccacggcggatctgggcatgaagggctggttcctcttgaacaacggtatcagttatttgcatcatctggagctatcagattccctgcaccggagacagaagcttggaaagagaagatcaaacggctttatctgttacttaccacaaaagagtctgctatggatgtaccatccaacttagaagctagaaggcgcatttctttcttctcaaattcattgtttatggacatgcctgaagcgcctaaagttcgcaacatgctttctttctctgttttaactccctactacactgaggaagttctcttctccttgcgtgaccttgaaatccacaatgaagatggtgtttcaatcctcttctatctgcaaaagatttttccagatgaatggaccaactttcttgagcgagttaaatgcaataatgaagaagaacttaaaggatctgatgaattggaagaagaacttcgtctctgggcatcatacaggggccaaactttaaccaggactgtaagaggtatgatgtactatcggaaagctttggagcttcaggcctttctagatatggccaagcatgaagatttgatggaaggctataaggcaatagaactgaattcggatgacaagggggaaaggtcgttgttgacgcaatgtcaggcagtagctgatatgaaattcacatatgtggtttcttgccaactatatggtattcacaagcgatctggtgatgctcgtgcacaagacattctgaagctgatgacaaaatatccatcactccgtgttgcatacattgatgaggttgaagaacctagcaaagacagatcaaaaaagatcaaccaaaaggtctattactctgctttagtaaaggctgttccaaagtcaaaggattcgtcgattccagtgcaaaatctggaccaggttatttatcgcataaaacttccgggacctgctatattgggtgaggggaagccggaaaaccaaaatcatgctattatattcacacgtggagaaggcttgcaaacaatagatatgaaccaggataattacatggaagaagccttaaaaatgaggaatttactgcaagaattccttaaaaagcatgatggtgttaggtacccttcaattcttggacttcgagagcatatatttactggaagtgtttcgtcgcttgcttggttcatgtcaaatcaggagactagttttgtgactattggtcagagattgctagccaaccctctaaaggttcggttccattatggtcatccggatgtattcgataggctttttcaccttactagagggggtgtaagtaaagcatccaagattatcaacttgagtgaagacatttttgctggcttcaattccactcttcgtgaaggcaatgttacacatcatgaatacatacaagttggaaaggggagggatgtgggtctaaatcagatttccatgtttgaggccaaaatagctaacggcaatggagagcagacgctgagtcgagacctgtatcggcttggacaccggtttgacttcttccggatgttgtcatgctattttaccacaattggattctactttagtactctgataactgtgctcactgtatatgtattcctttatggccgcctctatcttgttctcagtggacttgaagaagggttgattacacagcctgcaattcgagacaataagcctcttcaagtggcccttgcttctcaatcttttgttcaacttggatttatgatgtccttgcctatgttgatggagattggcttggaaagaggtttccgaactgcgttaagtgaatttattctcatgcaattgcagttggcacctgtatttttcacattctctttggggacgaaaactcactattatggaaggacattacttcatggtggtgcaaaatacagatcgacaggtcgaggatttgtggtctttcatgccaaatttgctgacaactacaggctttactcgcgtagtcactttgttaagggtatcgagatgatgatattgcttattgtgtaccaaatctttggtcaatcttacagaggtgcagttgcttacatcttaatcacaatatctatgtggtttatggtgggaacttggctttttgctcctttcttgttcaatccttctggttttgagtggcaaaagattgttgatgattggactgattggaataagtggataagtaaccgaggaggcataggtgtaccacctgagaaaagttgggaatcatggtgggaggaagaacaggagcatctccagcactctggaaagcgtggtatcatagctgagatagtgttagctttaaggttctttatctatcagtatggactcgtgtaccatttgaaaatgacaaagcacactaaaagttttctggtctacggtgtatcatggctggtgatctttcttgtattgtttgtgatgaagactgtatctgttgggcggcgaaagttcagtgcaaatttccaactcgtgttccgactgataaagggattgatatttttgactttcatctccatcctggtcactttgattgcacttccacacatgacagtgcgcgacatcattgtgtgtattctcgcattcatgcccactggttggggaatgcttttgattgcacaagctttgaagcctgttattcaccgagctggattctggggatcagttaggacacttgcgcgtggctacgagattgttatgggtttgcttctgttcaccccagttgcgttccttgcttggtttccttttgtgtcagaattccagactcgtatgctcttcaaccaagcattcagcagaggtctacagatctctcgtattcttggcgggcagcggaaggatcgttcctctcgtaacaaggagtaaaatgagtgatagcgagagcagaatctgtggtaatttgttaatcactctcgcatgtttaaagaaagttgtccataatttatatttgtatcctctgcggttgttgtaatcatggatgacgtctgggggctgcatttttggtaattaatttgattgtaagtcctggcagcccatagctgtcatattgattgtatcaaaattatgattagtaatttttataatctattatcttattgaaatagatgatttgtctggaatggtgagta

SEQ ID NO: 3007 - DNA, 6238 bp, Citrus sinensis
ctttctctctcttcttcactttctctcccttagggtttctactttctctttatgtcagattcactacaaccttaaactgttcctcttcatcagctggaaaaaggggtgtattctgagcgtgtgattcgaggaaaatgtcgtcgagaggagggggccctgatcagcctccaccgcagaggcggatcatgcggacgcaaacggcagggaatcttggagagtcaatgtttgatagtgaggtcgtgccctcatcactttctgagattgcaccgattctacgtgtggctaatgaagttgaatccagcaatccaagagttgcttatctctgccgtttttatgcctttgagaaagcgcataggctggaccccacttctagtggtcgaggtgttcggcagtttaaaactgccctccttcaacgtcttgaaagggagaatgctccaacatatatggaaagagggaaaaaaagtgatgcacgtgaaatgcagagtttttatcaacattactacaaaaagtatattcaagccttgcaaaatgctgctgataaagctgatcgtgcacagcttaccaaggcctaccaaactgcgaatgttctctttgaggttttgaaggccgtaaatttgacagagtcaatggaagttgatcgtgagattttggaagctcaagataaagttgcagagaaaacacagatctatgttccttacaatatccttcctctggatcctgacagtgcaaatcaggcaattatgagatatcctgagattcaagcagcagttcttgctcttcgttacaccaggggtcttccttggcccaatgagcacaataaaaagaaagacgaagacattctagattggcttcaggaaatgtttgggtttcagaaagataatgtggcaaatcagagagagcacctgatcttactccttgcaaatgtgcatatccgacagtttccaaagcctgatcaacaacccaagttggatgatagagcactgacagatgtgatgaagaagcttttcaagaactacaaaagatggtgcaagtacttggatcggaaaagtagtctttggttaccaaccattcagcaagatgtacaacagcgtaaattactatacatgggtctttatcttcttatatggggagaagctgcaaacttgagattcatgccagaatgcctgtgttatatttaccatcatatggcatttgaattgtatggtatgcttgctggaaacgtcagtcccatgactggagagaatgtgaaaccagcttacggaggtgaagatgaagctttcttgagaaaagttgttacccctatctatgaagtaattgccagggaagctgaaagaagcaaacgaggaaaatcaaaacattctcaatggaggaattatgatgatttaaacgaatacttctggtcagttgattgtttccggttaggttggcctatgcgtgcagatgctgatttctttggtctacctattgaacagctccgtttcgaaaaaagcgaggataacaaaccagctaatagagatcgatggctggggaaggttaattttgtagagatacgctcgttctggcatattttcagaagctttgatcgaatgtggagtttcttcattctatgcttacaggtcatgattattgttgcttggaatggttcggggaacccgagttcaatatttgaagttgatgtattcaagaaagtattgagtgtattcataactgcagcaatactcaagcttgggcaagctatccttgatgtgatactcaattggaaagcacggcgaagcatgtcatttcatgttaagttgagatatattttgaaggttgtctcagctgctgcatgggtgattgtgctaccggtcacttatgcctatacatgggagaatcctccggggtttgctcaaaccatcaaaagttggtttggcagtactgcaaattcaccctccttgttcattttggctgttgttatctatttgtcaccaaatatgctatctgctgttttatttcttttcccattcattcgtcgggtgctggagaggtccaattacaggattgtaatgctcataatgtggtggtcacagcctaggctctatgttggaaggggaatgcatgaaagcgcattttctctcttcaagtacacactattctgggttcttcttataattacaaagttggcttttagttactacattgagataaaacctttggtgggtccaacaaaggacatcatgcgtgtacggataaccgatttccagtggcatgaattttttcctcgtgcaaagaacaatattggggttgtgattgctctgtgggctccgattattcttgtatattttatggatgcccagatttggtatgccatattctctacaatatttggaggcatttatggtgcatttcgtcgtcttggagagattcgaacactaggaatgctaaggtctcgctttcaatcactgcctggtgcttttaatggttgtttgattcctgaagagaggagtgagccaaagaagaaaggattgagggccactttgtctcgcaactttgctgagatcccgtctaacaaagaaaaagaggctgcaagatttgctcagctctggaacaaagtaatcactagcttcagagaggaagatcttataagtgatagggaaatgaacctgctacttgttccatattgggctgaccgtgatttgggccttattcagtggcctccgttcttacttgctagcaagataccaatagcattagacatggctaaagacagtaatggcaaggatcgagaactgaaaaagagaattgaggctgatgattacatgtcctgtgctgtcaaggagtgttatgcttcatttaggaacatcattaagttcttggttcaaggaaacgagaaaagggttatagatgacatattttctgaagttgatagacacatagaagccggtaacctgattagtgaatacaagatgagttctcttcctagcctctatgaccactttgtgaagctgatcaaatatttgttagataataaacaggaggacagggatcaggttgttattctattccaggatatgctggaggttgttacaagagatataatgatggaggaccatatatccagtctggtagagtcagtccacggcggatctgggcatgaagggctggttcctcttgaacaacggtatcagttatttgcatcatctggagctatcagattccctgcaccggagacagaagcttggaaagagaagatcaaacggctttatctgttacttaccacaaaagagtctgctatggatgtaccatccaacttagaagctagaaggcgcatttctttcttctcaaattcattgtttatggacatgcctgaagcgcctaaagttcgcaacatgctttctttctctgttttaactccctactacactgaggaagttctcttctccttgcgtgaccttgaaatccacaatgaagatggtgtttcaatcctcttctatctgcaaaagatttttccagatgaatggaccaactttcttgagcgagttaaatgcaataatgaagaagaacttaaaggatctgatgaattggaagaagaacttcgtctctgggcatcatacaggggccaaactttaaccaggactgtaagaggtatgatgtactatcggaaagctttggagcttcaggcctttctagatatggccaagcatgaagatttgatggaaggctataaggcaatagaactgaattcggatgacaagggggaaaggtcgttgttgacgcaatgtcaggcagtagctgatatgaaattcacatatgtggtttcttgccaactatatggtattcacaagcgatctggtgatgctcgtgcacaagacattctgaagctgatgacaaaatatccatcactccgtgttgcatacattgatgaggttgaagaacctagcaaagacagatcaaaaaagatcaaccaaaaggtctattactctgctttagtaaaggctgttccaaagtcaaaggattcgtcgattccagtgcaaaatctggaccaggttatttatcgcataaaacttccgggacctgctatattgggtgaggggaagccggaaaaccaaaatcatgctattatattcacacgtggagaaggcttgcaaacaatagatatgaaccaggataattacatggaagaagccttaaaaatgaggaatttactgcaagaattccttaaaaagcatgatggtgttaggtacccttcaattcttggacttcgagagcatatatttactggaagtgtttcgtcgcttgcttggttcatgtcaaatcaggagactagttttgtgactattggtcagagattgctagccaaccctctaaaggttcggttccattatggtcatccggatgtattcgataggctttttcaccttactagagggggtgtaagtaaagcatccaagattatcaacttgagtgaagacatttttgctggcttcaattccactcttcgtgaaggcaatgttacacatcatgaatacatacaagttggaaaggggagggatgtgggtctaaatcagatttccatgtttgaggccaaaatagctaacggcaatggagagcagacgctgagtcgagacctgtatcggcttggacaccggtttgacttcttccggatgttgtcatgctattttaccacaattggattctactttagtactctgataactgtgctcactgtatatgtattcctttatggccgcctctatcttgttctcagtggacttgaagaagggttgattacacagcctgcaattcgagacaataagcctcttcaagtggcccttgcttctcaatcttttgttcaacttggatttatgatgtccttgcctatgttgatggagattggcttggaaagaggtttccgaactgcgttaagtgaatttattctcatgcaattgcagttggcacctgtatttttcacattctctttggggacgaaaactcactattatggaaggacattacttcatggtggtgcaaaatacagatcgacaggtcgaggatttgtggtctttcatgccaaatttgctgacaactacaggctttactcgcgtagtcactttgttaagggtatcgagatgatgatattgcttattgtgtaccaaatctttggtcaatcttacagaggtgcagttgcttacatcttaatcacaatatctatgtggtttatggtgggaacttggctttttgctcctttcttgttcaatccttctggttttgagtggcaaaagattgttgatgattggactgattggaataagtggataagtaaccgaggaggcataggtgtaccacctgagaaaagttgggaatcatggtgggaggaagaacaggagcatctccagcactctggaaagcgtggtatcatagctgagatagtgttagctttaaggttctttatctatcagtatggactcgtgtaccatttgaaaatgacaaagcacactaaaagttttctggtctacggtgtatcatggctggtgatctttcttgtattgtttgtgatgaagactgtatctgttgggcggcgaaagttcagtgcaaatttccaactcgtgttccgactgataaagggattgatatttttgactttcatctccatcctggtcactttgattgcacttccacacatgacagtgcgcgacatcattgtgtgtattctcgcattcatgcccactggttggggaatgcttttgattgcacaagctttgaagcctgttattcaccgagctggattctggggatcagttaggacacttgctcgtggctacgagattgttatgggtttgcttctgttcaccccagttgcgttccttgcttggtttccttttgtgtcagaattccagactcgtatgctcttcaaccaagcattcagcagaggtctacagatctctcgtattcttggcgggcagcggaaggatcgttcctctcgtaacaaggagtaaaatgagtgatagcgagagcagaatctgtggtaatttgttaatcactctcgcatgtttaaagagagttgtccataatttatatttgtatcctctgcggttgttgtaatcatggatgacgtctgggggctgcatttttggtaattaatttgattgtaagtcctggcagcccatagctgtcatattgattgtatcaaaattatgattagtaatttttataatctattatcttattgaaatagatgatttgtctggaatggtgagta

SEQ ID NO: 3008 - DNA, 6462 bp, Fragaria vesca
cagtactagagtgtagcttttgcaagtttgcttaaacttgcagcactcatcgcagcactcatcttcttctctcttccgcggccttgggtgagagtagctttctctctcctagggtttcttttccacctcaactctctcctctgtaaagctctctttcctcactcgccttttccccattcacatttcgctctcctttttcatcttttcttctcgctttgcatgtctcagatgcctgattcggaagcctaaccttctctggtttcgccggattttgtgagcaaagcttgagtggagtgattgagctgcggaggttttgatcggctttgcgaagagcaatgtcgtcgtcgagagcgggggcggatcagccgccgcagccgcagcggcgtatccagcggacgcagacagctggaaacctcggagagacggctttcgacagtgaggtggtgccgtcgtcgctagtcgaaatcgctccgattcttcgggtggccaacgaggtcgaatcgcacaatcccagggttgcttatctatgtcgattttatgcattcgagaaagcacatagattggatcccacttctagcggacgtggtgttcgtcaatttaaaactgctcttcttcaacgtctggaaagggagaatgatccaacccttatgggaagggtgaaaaaaagtgatgcacgtgaaatgcagagcttctatcaacactattacaaaaaatatattcaagctttgcaaaatgcggccgataaagctgaccgtgcacaacttaccaaggcctaccagactgccaatgttctatttgaggttttaaaggctgttaatatgacacaatctatggaagttgatcgtgagattttggaagctcatggtaaagttgcggaaaagacagagctattggttccttacaatatccttccacttgatcctgatagtgtaaatcaagcaattatgaaatacccagagattcaagctgctgttctcgctcttcgtaacaccaggggtcttccttggcccaaggaatacaaaaagagaaaagacgaggatgttcttgattggctgcagtcaatgtttgggtttcagaaggacaacgtggcaaatcaacgggagcacctgatattattacttgcaaatgtgcacataaggcagtttccaaagcctgatcaacagcctaagttggatgaccgtgctctgacggaagtgatgaagaagcttttcaagaattacaaaaagtggtgcaagtacttgggccggaaaagtagcctttggttaccgaccatacagcaagaggtgcaacagcgtaagctactatacatgggtctatatcttttgatatggggtgaagctgcaaatttgagattcatgccagaatgcctttgttacatatatcatcatatggcatttgaattgtatggtatgttagctgggaatgtcagtccaatgacaggagaaaatgtgaagccagcatatggaggtgaagaagaggcgttcttgaagaaagttgtgactcctatttataaagtgattgctgaggaagctgagaggagcaaacgtgggaaatcaaagcattcccagtggaggaactatgatgatataaatgaatacttttggtcagtggattgtttccggttgggttggccgatgcgtgcagatgctgatttcttttgcatgcctagtgagcaacactattttgataaaagcagtgaggatcacaaaccagctggtggagatcgatgggtggggaaagttaacttcgttgagatacggtcattttggcatatctttagaagctttgaccgcatgtggagtttctttattttatgtttacaggttatgataattgttgcttggaatggctcgggccaaccaacgtcaatattttctgccgatgtattcaagaaagctttgagcgtcttcataactgctgcaatattgaagcttgggcaagctgttctagatgtgattcttagctggaagtctaggcggagtatgtcgttccatgttaagttgagatacattgctaaggtcatttcagctgctgcgtgggtaataattctaccggtaacatatgcatatacttgggaaaaccctcctgggttcgctcaaaccattaaaggttggtttggcaataattcaaattcgccctccttgttcatcttggctgttgttatctacttgtcaccgaatatgctggctggggtgttgtttcttttcccatttatccgccgattccttgagcgatcaaactacaggattgtgatgcttatgatgtggtggtcacagcctcggctctatgttgggaggggaatgcatgagggaacattttcccttttcaagtacacgatgttttgggttcttcttatagttacaaagttggcattcagttactatatagagataaagcctttagtaggtccaacaaaagccatcatgaaagtacgtataactaacttccagtggcacgagttctttccccgtgcaaaaaacaatatcggtgttgtgattgcactctgggctccaattatccttgtctattttatggatacccagatctggtatgcaatatattccacaatatttggaggtatttatggggcattccgtcgccttggtgagattcgaacactaggaatgctgagatctcgctttgaatcattgcctggtgcttttaacgctcgtttgattccggtggacaagagtgagccaaagaagaaaggactgaaggctacgttgtcccgcacctttggtcaggtggaaggtagcaaagaaaaacaggctgcaaggtttgcgcagttatggaacaaaataataagtagtttcagagaggaggatcttataaataatagggaaatgaaccttttgcttgttccttattgggctgatcgtgatttggacctcatacagtggcctccatttttactcgctagcaaaatcccgatagcattagacatggccaaggacagcaatggcaaggataaagagctaacaaaaaggatcttggctgacgaatacatgcattgtgctgttcgtgaatgctatgcttcatttagaaacataattaagttcctggttcaggggaaccgtgagaaagaggttatagaatatatattttccgaggttgacaagcacatcgcagagggtaccctgatccgtgaattcaagatgagtgctcttcctagcctctatgaccactttgttaggcttatagattttctgtcaaagaataatcaggacgacagggatcaggttgtgattctattccaggacatgctggaggtagtgacgagagacataatgatggaggaccatatatccagcttggtggattcagtccatggcgggtcaggccatgaggggatgataccgctcgatcaacatcaacagcatcagttgtttgcatctgctggagctattaagtttcctcttacacaagtgacagaggcttggaaggagaagattaatcgtctttacctattactgacaacaaaggagtctgccatggacgtgccatccaacttggaagctagaaggcgaatttctttcttctcgaattcgttgtttatggatatgcctccagcgccaaaagttcggaatatgctttctttctctgttttgactccttactacaccgaagaggttctcttttccattgaagggctggaacgtccgaatgaagatggtgtttctattctgttctatttgcaaaagattttcccagatgaatggaccaactttcttctgcgtgtaaattgctccagcgaagatgaacttaaagggtctgatgaattggaagaagagcttcgcctatgggcatcatatagaggccaaactttgactcgtactgttagaggaatgatgtactaccggaaagctttggagcttcaggcttttctcgatatggccaaagatgaggatttaatggaaggctacaaggcaatagagttgaattcagaagatcaatcaaaggagggaaggtcactatgggcgcaatgtcaagcagtagctgatatgaaattcacatatgtggtttcgtgccaactttatgggattcagaagcgatctggtgattatcgtgcacaggacattctaaggctcatgacaacatacccatcattacgagtggcatatattgatgaggttgaagaacctagcaaagataggtctcagaagataaaccaaaaggcgtattattctactttagtaaaggctgctatgccaaagtcaattgattcttcagagccagtacaaaatctcgaccaggttatatatcgcataaagcttccaggacctgctatcttgggagagggaaagccagaaaatcaaaatcatgccattattttcacacgtggggaaggcttgcaaacaattgacatgaaccaggataactacatggaagaagctttgaaaatgaggaatttgctacaagaatttctcaagcatgacggcgtgagacaccctacaattcttggacttagggagcatatatttacaggaagtgtttcctctctagcttggttcatgtcaaatcaggagaacagttttgtgactattggtcaaagacttctggccaaccctctcaaggttcgatttcattatggccatcctgatgtgtttgacagactctttcaccttagtagagggggtgtcagtaaggcatccaaggttattaatttgagtgaagacatttttgctggctttaattccactcttcgtgaaggcaatgtaactcatcatgaatacatacaagtggggaaggggagagatgttggtcttaaccaaatctccatgttcgaggcaaaaattgctaatggcaatggcgagcagacgctcagtcgagatatataccgacttggacatcgttttgactttttccgtatgttgtcatgctatttcaccacaattggtttctactacagtactctgatcactgtgcttacagtttatgtcttcctttatggtcgcctctacctggttcttagtggacttgaagaaggtttaaacactcaagaagcaattcgagataataagcctcttcaggttgctcttgcttcacaatcatttgtccaaataggattcttgatggctttgcctatgttaatggaaattggtttggaaaagggtttccgaactgcactgagtgaattcatattgatgcaattgcaactggcccctgtatttttcacattctcacttggaacaaagacccactattatggacggacattactgcatggtggtgccaaatatagatctactggtcgtgggtttgttgtgttccatgccaagtttgctgacaactataggctttactcccgcagccactttgtgaagggtattgagctcctgattttacttgtggtataccagatctttggtcatacttacagaagtgctgttgcctacattttgataactgtatctatgtggtttatggtggttacctggctttttgctccctttctgttcaatccttctggttttgagtggcaaaaaattgttgatgattggactgattggaataagtggataagcaaccgtggaggtataggtgttccacctgaaaaaagttgggaatcatggtgggaggaggaacaagaacatcttcggtattctggaaaacgtggtattgtagctgagatactgctatctctacgattctttatctatcagtatgggctcgtatatcacttaaacattgcaaagaagaccaagagtgtcctggtctatggtatctcatggctggtgatcgtccttattttgtttgtcatgaagactgtatctgttggtaggagaaagttcagtgctgagtaccaacttgtattccggctgattaagggattgatatttgtgacttttgtggccattttggtcactttgattgtgctacctcacatgaccctgcaagacatcattgtttgcattcttgctttcatgccaactggttgggggatgcttatgattgcccaagcttgcaagcctcttgttcaaaaagctggtctatggccgtcagttaggactctagctcgtggctttgagatagttatgggcttgcttctgttcaccccagttgcattcttggcttggtttccttttgtttcggaatttcaaacacgtatgctcttcaaccaagcgttcagtagaggtctacagatttctcgtattcttggcggacaacgtaaggatcgttcaacccggaacaaggagtgaccttacgcctaacaagatcaacattgaagctaatttttggatggctagggtcacaagactagttaaacaagatcttgttatctgttgtaattatgaatatgatgggctgcatttttgttagttcattatgactgatcgagttaagatgcatatatatctagctttcatttatcttccttaggatggatggtcgtctatcatttcattctttgcaatacagtgatgtagagaacctactgtgtttgagctctgtagcacaaga

SEQ ID NO: 3009 - DNA, 6118 bp, Eutrema halophilum
gaggcttaggaaccttttaatacagcttatcctggaggtttagattaggagtaatgtctgcttcaagaggaggtcctgatcaaggaccatcccagcctcagcagcgccggatcatacggactcagactgctggtaatctcggagaatcattcgatagtgaagttgtcccgtcgtcgcttgttgagattgcccctattctccgtgttgctaatgaggttgaatctagcaacccaagggttgcgtatctctgtcggttttatgcattcgagaaagctcacaggctggatcccacctccagtggaagaggtgttcggcagtttaagactgcgcttcttcagcgtcttgaaagagaacatgatccaacactgatgggcagggttaagaaaagtgatgcccgtgaaatgcaaagcttttaccaacattactataagaagtatatccaagctttgcagaatgccgctgataaggctgaccgtgctcagctgacaaaggcataccaaactgccaatgttttgtttgaggttctgaaggctgttaatctgacacagtctattgaggttgaccgggagattttggaagctcaagataaggttgcagaaaagacacagttgtatgtcccctataatatcctacctctcgatcctgatagtgcaaatcaagccattatgagatatcctgagatccaagctgccgttcttgctcttcgcaacactagagggcttccttggccagaaggtcacaagaaaaagaaagatgaagacatgcttgattggcttcaagaaatgtttggatttcagaaagacaatgtggctaatcaaagggagcacctgatcttattacttgctaatgtgcatataagacagtttcccaagcctgatcagcagccaaagttagatgatcaagcgctgacagaagtgatgaagaagctcttcaagaactataagaaatggtgcaaataccttggtcgaaagagtagtctatggttgccaactatacagcaggaaatgcaacagcgcaaactattgtatatggctttgtatcttctgatctggggtgaagcagcgaacttgagattcatgccagagtgtctctgctacatttatcatcatatggcatttgaactctatggtatgctggctgggaatgttagtcccatgactggggaaaatgtgaagccagcttatggaggcgaggaagacgcattcttgaggaaagttgtgactcctatttatgaagtgattggcatggaggctcaaaggagcaagaaagggaagtccaagcactctcagtggaggaactatgatgatttgaatgaatacttttggtcagttgattgtttccgattaggctggcctatgagagctgatgctgatttcttttatccacctgttgctgagctcaatacagaaaaagaaggggataacagcaagcctgctgttgcaagggatagatgggtcgggaaagttaattttgttgagattcgttccttctggcatgtcttcagaagtttcgatcgaatgtggagcttctatattctgtgccttcaggccatgattattatggcttgggatggtggagaaccaagttcagtctttggagctgatgttttcaagaaagttctgagtgtgtttatcacagctgcaataatgaagcttggacaagcttctcttgatgtgatccttaatttcaaagctcatcgaagcatgtcactacatgttaaactaagatacatcctgaaggtgctctctgctgcagcatgggttataattctgcctgttacttatgcctacagctggaaagaccctccagcatttgccagaactatcaagagttggtttgggagtgccatgcattcaccttcactatttataatagctgtcgttttctatttgtcccctaatatgctcgcgggcgtactgtttcttttccctctgctacgtcggtttcttgagaggtccaactacagaattgtaatgctaatgatgtggtggtctcagcccagactctatgttggcagaggaatgcatgagagcgcattttccctcttgaaatataccatgttctgggtgtcgcttattgcaacaaagctagcattcagttactacattgagatcaagcctttagttgctccaacacaagccattatgaaggcccgtgtgactaattttcagtggcatgaattctttcctcgtgccaaaaacaatattggtgtcgttatcgcgctctgggcacctattattctggtatactttatggatagtcagatttggtatgccatattttccacattatttggaggtatatacggtgcattccgccgccttggagagattcgtacactgggaatgcttagatcacgatttgaatcactgcctggcgcttttaatgaccgcttaattccggatggaaagaatcaggaaaggaagaagggattaagggcaactttgtctcataactttacagaggataaggtacctgttaacaaagagaaagaggctgcaagatttgcacagctgtggaacacaataatcagtagttttagagaggaagatcttataagtgatagggagatggatctattgcttgttccgtattgggctgaccgtgatttggatctcatacagtggcctccgttcttactggctagcaagattccaatagcattggatatggcaaaagacagtaatgggaaggacagagagctcaagaagagaattgagagtgactcttatatgaaatgtgctgtccgtgagtgctatgcttcattcaagaatatcataaaatttttggttcagggaaaccgtgaaaaagaagtgatagagattatattttccgaggtcgacaaacatatagaagcaggtcatttaattcaagagtgcaagatgagtgctcttcctagcctctatgaccactttgtcaagctgatcaaatatttgctagacaataaggtggaagatagagatcacgttgtaattctcttccaagacatgctggaagttgtaacaagagacattatgatggaggattacaacatatcgagcttggtagattcgagtcatggtggcacttggcatgggggaatgatcccgctcgaacaacagtatcagctgtttgcatcttcaggtgccattagatttcctattgaaccagttacagaagcttggaaagagaagatcaaacggctgtatcttttgctgactactaaagagtctgccatggatgtcccctctaacttagaagcaagaaggcggatctctttcttctcaaattcattgttcatggacatgcctacggcacctaaagttcgcaacatgctatcattttctgtattgactccatattacactgaagaggtcctcttctccttgcgtgacctggaaacaccaaatgaagatggtgtttcgatcctcttttacctacaaaagatttttccagatgaatggaacaattttcttgagcgggtgaagtgcgtaagtgaagaggaacttaaagactttgatgaattagaggaggaacttcgtttatgggcttcatacagggggcaaactctgactagaactgtaagaggaatgatgtactatcgaaaagcattggagcttcaggcattccttgacatggccatgcacgaagatttgatggaaggttacaaggctgtagaactgaattcagagaacaattcaagaggcgaaagatcactctgggcacagtgccaggctgttgccgacatgaagtttacatatgttgtatcatgtcaacaatatggtatccataaacgatccggtgatcctcgtgcacaggatatattaaggcttatgacaagatacccttcgctccgtgttgcatatattgatgaggtcgaagaaccagtgaaagacaagtcaaagaaagggaaccagaaagtgtattattctgtgttggtaaaggtgcctaaatcaactgaatccagcctagcgcaaaatctggaccaggttatctacagaattaagcttcctggacctgctattcttggagagggaaagccagaaaaccaaaatcatgctatcattttttctcgtggagagggtttacagacaatcgatatgaatcaggataattacatggaggaagccttaaagatgagaaatttgcttcaagaatttcttacaaagcatgatggtgtgaggcatccgtccattcttgggctcagggaacatatatttactggatccgtttcctcccttgcttggttcatgtcaaatcaagagactagttttgttaccattggtcagagattactggcaaaccctttgagggttcgtttccactatggtcatccagatgtatttgatagactgtttcatctaacaagaggtggtgttagcaaagcatccaaggtaatcaacctcagtgaagacatatttgcaggattcaattctacacttcgtgaaggaaatgttactcatcatgaatacatacaagttggtaaaggaagagatgttggtttaaatcagatctctatgtttgaggccaagattgctaacggcaatggagagcagacattgagtcgtgacatttacaggcttggacaccgttttgactttttccgtatgatgtcatgttacttcaccactgtcggcttttacttcagcaccctgattaccgttctcactgtctatatcttcctttatggacgtctctaccttgttttgagtgggctcgaacaaggactaagtacacagaaaggcatccgagacaatacaccgttgcaaatagctcttgcttcacagtcttttgttcagattggtttcctgatggctttacctatgcttatggaaattggattagagagaggttttaggactgccttgagtgaattcgtgctgatgcagcttcaattggcgccagtgttctttacgttctctcttgggacgaagactcactactatggaaggactttacttcatggtggtgccaagtacaggtcgacaggcagaggttttgtcgtctttcatgccaaattcgctgataactacaggctctattcccggagccattttgtaaaggggcttgagatgatgctgctacttgttgtgtatcaaatatttggaagtgcttacagaggcgtacttgcatatcttctgatcaccatatctatgtggttcatggtcgggacttggctttttgctcccttcctcttcaatccttctggttttgaatggcagaaaattgttgatgattggactgactggaacaaatggataaacaacattggtggtattggtgtcccggcagagaaaagttgggaatcgtggtgggaagaagagcaagaacatctccgatattccggaaagcgtggcataatcgttgagattttgttatccctgcggttctttatctatcaatacgggcttgtttatcatctcacgattacggagaacactaaaaactttctggtttacggagtatcgtggctggtgattttcttgatattgtttgtgatgaagactgtttctgttggaaggcggaaattcagcgctagtttccagctgatgttccggctgataaaggggctaatattcatgacattcatcgcaattattgtgatattgatcactcttgctcacatgacgatacaagacataattgtatgcatccttgcatttatgcctacaggctggggcatgctcttgattgcgcaagcgtgtaagcctctggtacatagactaggattctggggatcagtgaggacactagctcgtgggtacgagatagttatgggactgttgctgttcacgccggtggctttcttggcttggtttccatttgtgtcggagttccaaacacgtatgctcttcaatcaagctttcagtagaggtcttcagatctctcgtatccttggaggacataggaaggatcgctcttcaagaaacaaggagtgaatcatcacttctcctcctcccacttcactgtcatgcagggatgtctaatttatcattttgttcctctagtcttgtcgtgtgtagaagtagcgaatcttgtggattgagtagtgttaaattatatcgcctaggttttttttaaaaaaaaaaaacactagtacgtaatctactattatcaatcaattttacttctataaaat

SEQ ID NO: 3010 - DNA, 6177 bp, Arabidopsis lyrata
ctttgcgtacttagcagctaagtagcttaaaagttgtggctccgccattgttagggtttctggatctccatctctctggaggcttaggaaaccttaaaaaaaaaacgattaacctggaggaggttttagggtacaaggaatgtctgctacgagaggaggtcctgaacaaggaccgtctcagcctcagcagcggcggatcgtacgaactcagactgctggtaatctaggagagtctttcgatagtgaagttgttccttcatcgcttgttgagattgctcccattcttcgtgttgctaatgaggttgaatctagtaaccctagggttgcttatctctgtcggttttatgcatttgagaaagctcatagattggatcctacctccagtggaagaggtgttcggcagtttaagactgcacttctacagcgtcttgaaagagaacatgatccaacactgatgggcagggttaagaaaagtgacgcccgtgaaatgcaaagcttttatcaacattactataagaagtatattcaagctttgcacaatgctgcagataaggctgaccgtgcccagctgacaaaggcataccaaactgccaatgttttgtttgaggtgttgaaggctgttaatctcacacagtcgattgaggttgaccgggagattctggaagctcaagataaggttgcagaaaagacacagttgtatgtcccctataatatcctacctctcgatcctgatagtgcaaatcaagcgattatgagatatcctgagatccaagctgctgttcttgctctccgcaatactagaggtcttccttggccagaaggtcacaagaaaaagaaagatgaggacatgcttgattggcttcaagaaatgtttggatttcagaaagacaatgtggctaatcaaagggagcatctgatcttattacttgctaatgtgcatataagacaatttcctaagcctgatcagcagccaaagttagatgatcaagcattgacagaagtgatgaagaagcttttcaagaactataagaagtggtgcaaataccttggtcgaaagagtagtctttggttgccaactatacagcaagaaatgcaacagcgcaaactattgtatatggccctgtatcttctaatttggggtgaagcagcgaacttgagattcatgcctgagtgtctctgctacatttatcatcatatggcatttgaactctatggtatgctggctgggaatgttagtcctatgactggggaaaatgtgaagcctgcttatggaggcgaggaagatgcattcttgaggaaagttgtgactcctatttatgaagtgattcagatggaggctcaaagaagcaaaaaagggaagtctaagcactctcagtggaggaactacgatgatttgaatgaatacttttggtcagttgattgttttcgattaggttggccaatgcgagctgatgctgatttcttttgtctgcctgttgctgtacccaatacagaaaaggacggggataacagcaagcctactgtcgccagggatagatgggttggaaaagttaattttgttgagattcgttccttctggcatgtcttcagaagtttcgatcgaatgtggagcttctatattctgtgccttcaggccatgattattatggcctgggatggcggacaaccaagttcagtctttggagctgatgtattcaagaaagttctgagcgtgtttatcacagctgcaataatgaagcttggacaagctgttcttgatgtgatccttaatttcaaagctcatcaaagcatgacactacatgttaaactaagatacattctgaaagtgttatctgctgctgcctgggttattattctgcctgttacttacgcctacagctggaaagatcctccagcatttgccagaactatcaagagttggtttgggaatgccatgcactcaccttcactatttataatagctgtcgttttctatttgtcgcctaacatgctcgcgggtgtaatgtttcttttccctctgctacgacggtttcttgagaggtccaactacagaattgtgatgctaatgatgtggtggtctcagcccagactctatgttggtagaggaatgcacgagagcgcattttccctcttcaaatataccatgttttgggtgttgcttattgcaacaaagctggcattcagttactacattgagatcaagcctttagttgccccaacacaagccattatgaaggcccgtgtgacaaattttcagtggcatgagttctttcctcgtgccaaaaacaatattggtgttgttatcgccctctgggcccccattattctggtatattttatggatagtcagatttggtatgctatattttccacattatttggaggtatttacggtgcattccgccgccttggagagattcgtacactgggaatgcttagatcacggtttgaatcactgcctggagcttttaatgaccgcttaattccagatggaaagaaccagcaaaagaagaagggaataagggcaactttatctcataactttacggaggataaggtacctgtgaacaaagagaaagaggctgcaagatttgcacagttgtggaacacaataatcagtagttttagagaggaagatcttataagtgatagggagatggatctgttgcttgttccatattgggctgaccgtgatttggatctcatacagtggcctcccttcttattggctagcaagattccaatagcattagacatggcaaaagacagtaatgggaaagacagagagctcaagaagaggattgagagtgacacttacatgaaatgtgctgtccgtgaatgctatgcttcattcaagaatatcataaaatttgtggttcagggaaaccgtgaaaaagaggtgatagagatcatatttgccgaggtggacaaacatatagatacaggggatttgattcaagaatacaagatgagtgctcttcctagcctctatgatcactttgtcaagttgatcaaatatttgctagacaataaggaggaagatagagatcacgttgtaattctcttccaagacatgctggaagttgtaacaagagacattatgatggaggattacaatatatcaagcttggtagattcgagtcatggtggcacttggcatgggggaatgatccctctcgaacaacaatatcagctgtttgcatcctcaggtgccattagatttcctattgaaccagtaacagaagcttggaaagagaagatcaaacggatatatcttttgttgactactaaagagtctgctatggatgtcccctctaacttggaagcaagaaggcggatctctttcttctcaaattcgttgttcatggacatgcctatggcacctaaagttcgcaacatgctatcgttttctgttttgactccatattacactgaagaggtcctcttctccttgagggatctggaaacaccaaatgaagatggtgtttcgatcctcttttacttacaaaagatttttccagatgaatggaacaattttcttgagcgggtgaagtgcttaagcgaagaggaacttaaggagtctgatgaattagaggaggaacttcgtttatgggcttcatatagagggcaaactttgactagaactgtaagaggaatgatgtactatcgaaaagcattggaacttcaggcattccttgacatggctatgcatgaagatttgatggaaggttacaaggctgtagaactaaattcagagaacaattcaagaggtgaaagatcactctgggcacagtgccaagccgttgctgacatgaagtttacatatgttgtatcatgtcaacaatatggtatccataaacgatccggtgatcctcgtgctcaggatatattgaggcttatgacaagatacccttcgctccgtgttgcatatattgatgaggtcgaagaaccagtgaaagacaagtcaaagaaagggaaccagaaagtgtattattctgtgttggtaaaggtgcctaagtcaactgatcattctagcttagcacaaaatctggaccaggttatctataggattaggcttcctggacctgctattcttggagaaggaaagccagaaaaccaaaatcatgctatcatcttttctcgtggagaaggtttacagacaatcgatatgaatcaggataattacatggaagaagcgttaaagatgaggaatttgcttcaagaatttcttacaaagcatgatggtgttaggcatccatccattcttggacttagggaacatatatttactggatctgtttcctcccttgcttggttcatgtcaaatcaagagactagttttgttaccattggtcagagattattggcaaacccattgagggttcgtttccattatggtcatccagatgtgtttgatagactgtttcatctaacaagaggtggtgttagcaaagcatccaaggtaatcaacctcagtgaagatatatttgcaggtttcaattctacacttcgtgagggaaatgttacccatcatgaatacatacaagttggtaaaggaagagatgtcggtctaaatcagatatctatgtttgaggccaagattgctaacggcaatggagagcagacattaagtcgggatatttacaggcttggacaccgttttgactttttccgaatgatgtcatgttacttcaccactgtcggcttttacttcagcaccttgattactgttctcactgtctatatcttcctttatggacgtctctatcttgttttgagtggcctcgaacaaggcttaagtacacagaaaggcatccgagacaatacacctttgcaaatagctctggcttcacagtcttttgtccagattggtttcctgatggctttacctatgcttatggaaattggattagagaggggttttaggactgccttgagtgaatttgtgctgatgcagcttcagttggcgccagtgttctttacgttctctcttgggacaaagactcactactatgggaggacgttacttcatggcggtgccaagtacaggtccacaggaagaggatttgtcgtctttcatgccaaatttgctgataattacagactgtattcccggagccattttgtaaaggggcttgagatgatgctgctacttgttgtgtatcaaattttcggaagtgcttacagaggcgtccttgcatatcttttgatcaccatatctatgtggttcatggtcgggacttggctttttgctcccttcctcttcaatccttctggttttgagtggcagaaaattgttgatgattggactgattggaataaatggataaacaacatcgggggtattggtgttccggcagaaaaaagttgggaatcctggtgggaggaagagcaagaacatctccgatattccggaaaacgtggtatagttgttgagattttgctggcactgcggttctttatctatcaatatgggcttgtttatcatctcacgataacagagaggactaaaaactttctggtttatggagtatcatggctggtgattttcttgatattgtttgtgatgaagactgtttcggttggaaggcggagattcagcgcgagttttcagctgatgttccggttgataaaggggctaatattcatgacgtttatcgcaatcattgtgatattgatcacactggctcacatgacgatacaagacataattgtgtgtatccttgcctttatgcccacaggttgggggatgctcttgattgcgcaagcgtgtaagccggtggttcatagagcaggattctggggatcagtgaggacactagctcgtggatacgagatagtaatgggactgttgctgtttacgccagtggcgttcttggcatggtttccatttgtgtcggagttccaaacgcgtatgctctttaatcaagctttcagtagaggtcttcagatctctcgtatcctcggaggacacaggaaggatcgctcttctcgtaacaaggaatgattcatctcttcattgtaatgacagggatgtctaatttatccctttttatctacttgttggtacaagtagcgaatcttatggattgattagtgttaatgtaatttagttttcaacatgtcgcttaggtaaaaacattgtagtagtcttccttaaattagacgtaatctatc

SEQ ID NO: 3011 - DNA, 6160 bp, Arabidopsis thaliana
ctttgcgtacttagcagctaagtagcttaaaaagttgtggctcctttgctccgccattgttagggtttctggatctccgtttctctggaggctgaggaaaccttaaaacgatttaaaacctggaggttatagggtagacaaaatgtctgctacgagaggaggtcctgatcaagggccgtctcagcctcagcagcggcggattatacgaactcagactgctggtaatcttggagagtcattcgatagtgaagttgttccatcatctcttgttgagattgcccccattcttcgggttgctaatgaagttgaatctagtaatcctagggttgcgtatctctgtcggttttatgcatttgagaaagcacatagattggatcctacctccagtggaagaggtgttcggcagtttaagactgcacttctacagcgtcttgaaagagaacatgatccaacactgatgggcagggttaagaaaagtgatgcccgtgaaatgcaaagcttttatcaacactactataagaagtatattcaagctttgcacaatgctgctgataaggctgaccgtgcccagctgacaaaggcataccaaactgccaatgttttgtttgaggtgttgaaggctgttaatctgacacagtccattgaggttgaccgggagattctggaagctcaagataaggttgcagaaaagacacagttgtatgtcccctataatatcctacctctcgatcctgatagtgccaatcaagcgattatgagatatcctgagatccaagctgctgttcttgctctccgcaatactagaggtcttccttggccagaaggtcacaagaaaaagaaagatgaagacatgcttgattggcttcaagaaatgtttggatttcagaaagacaatgtggctaatcaaagggagcatctgatcttattacttgctaatgtgcatataagacaatttcctaagcctgatcagcagccaaagttagatgatcaagcattgacagaagtgatgaagaagcttttcaagaactataagaaatggtgcaaataccttggtcgaaagagtagtctttggttgccaactatacagcaggaaatgcagcagcgcaaactattgtatatggccctgtatcttctaatttggggtgaagcagcgaacttgagattcatgccagagtgtctctgctacatttatcatcatatggcatttgaactctatggtatgctggctgggaatgttagtcctatgactggggaaaatgtgaagccagcttatggaggcgaggaagatgcattcttgaggaaagttgtgactcctatttatgaagtgattcagatggaggctcaaagaagcaaaaaagggaagtctaagcactctcagtggaggaactacgatgatttgaatgaatacttttggtcagttgattgttttcggttaggttggccaatgcgagctgatgctgatttcttttgtctgcctgttgctgtacccaatacagaaaaggacggggataacagcaagcctattgtcgccagagatagatgggttggtaaagttaattttgttgagattcgttctttctggcatgtcttcagaagtttcgatcgaatgtggagcttctatattctgtgcctccaggccatgattattatggcctgggatggcggacaaccaagttcagtctttggagctgatgtattcaagaaagttctgagcgtgtttatcacagctgcaataatgaaacttggacaagctgttcttgatgtgatccttaatttcaaagctcatcaaagcatgacactacatgttaaactaagatacattctgaaagtgttctctgctgctgcctgggttattattctgcctgttacttacgcctacagctggaaagatcctccagcatttgccagaactatcaagagttggtttgggagtgctatgcactcaccttctctatttataatagcagtcgtttcctatttgtcacctaacatgctcgcgggtgtaatgtttcttttccctctgctacgacggtttcttgagaggtccaactacagaattgtaatgctaatgatgtggtggtctcagcccagactctacgttggcagaggaatgcacgagagcgcattttccctcttcaaatataccatgttctgggtgttgcttattgcaacaaagctggcattcagttactacattgagatcaggcctttagttgccccaacacaagccattatgaaggcccgtgtgacaaattttcagtggcatgagttctttcctcgtgccaaaaacaatattggtgtcgttatcgccctctgggcccccattattctggtatattttatggatagtcagatttggtatgctatattttccacattatttggaggtatctacggtgcattccgccgccttggagagattcggacactgggaatgctcagatcacggtttgaatcactgcctggagcttttaatgaccgcttaattccagatggaaagaaccagcaaaagaagaagggaataagggcaacgttatctcataactttacggaggataaggtacctgtgaacaaagagaaagaagctgcaagatttgcacagttgtggaacacaataattagtagttttagagaggaagatcttataagtgatagggagatggatctgttgcttgttccttattgggctgaccgtgatttggatctcatacagtggcctcccttcttattggctagcaagattccaatagcattagatatggcaaaagacagtaatgggaaggacagagagctcaagaagaggattgagagtgacacttacatgaaatgtgctgtccgtgaatgctatgcttcattcaagaatatcataaaatttgtggttcagggaaaccgtgaaaaagaggtgatagagatcatatttgcagaggttgacaaacatatagatacaggggatttgattcaagaatacaagatgagtgctcttcctagcctctatgatcactttgtcaagttgatcaaatatttgcttgacaataaggaggaagatagagatcacgttgtaattctcttccaagacatgctggaagttgtaacaagagacattatgatggaggattacaatatatcgagcttggtagattcaagtcatggtggcacttggcatgggggaatgatccctctcgaacaacaatatcagctgtttgcatcctcaggtgccattagatttcctattgaaccagtaacagaagcttggaaagagaagatcaaacggatatatcttttgttgactactaaagagtctgctatggatgtcccctctaacttggaagcaagaaggcggatctcattcttctcaaattcgttgttcatggacatgcctatggcacctaaagttcgcaacatgctatcattttctgttttgactccttattacactgaagaggtcctcttctccttgcgggacctggaaacaccaaatgaagatggtgtttcaatcctcttctacctacaaaagatttttccagatgaatggaacaattttcttgagcgggtgaagtgcttaagtgaagaggaacttaaggagtctgatgaattagaggaggaacttcgtttatgggcttcatatagagggcaaactttgactagaactgtaagaggaatgatgtactatcgaaaagccttggagcttcaggcattccttgacatggctatgcatgaagatttgatggaaggttacaaggctgtagaactaaattcagagaacaattcaagaggtgaaagatcactctgggcacagtgccaagctgttgctgacatgaagtttacatatgttgtatcatgtcaacaatatggtatccataaacgatccggtgatcctcgtgcgcaggatatattgaggcttatgacaagatacccttcactccgtgttgcatatattgatgaggtcgaagaaccagtgaaagacaagtcaaagaaagggaaccagaaagtgtattattctgtgttggtaaaggtgcctaagtcaactgatcattctaccctagcacaaaatctggaccaggttatctacaggattaggcttcctggacctgctattcttggagaaggaaagccagaaaaccaaaatcatgctatcattttttcccgtggagaaggtttacagacaatcgatatgaatcaggataattacatggaggaagcgttaaagatgaggaatttgcttcaagaatttcttacaaaacatgatggtgttagacatccatccattcttggacttagggaacatatatttactggatcagtttcatcccttgcttggttcatgtcaaatcaagagactagttttgttaccattggtcagagattattggcaaatccattgagggtgcgtttccattatggccatccagatgtttttgatagactgtttcatctaacaagaggtggtgttagcaaagcatccaaggtaatcaacctcagtgaagatatatttgcaggattcaattctacacttcgtgaaggaaatgttacccatcatgaatacatacaagttggtaaaggaagagatgttggtctaaatcagatctctatgtttgaggccaagattgctaacggcaatggagagcagacattaagtcgggatatttacaggcttggacaccgttttgactttttccgaatgatgtcatgttacttcaccactgttggcttttatttcagcaccctgattactgttctcactgtctacatcttcctttatggacgtctctatcttgttttgagtgggctcgaacaaggtttaagtacgcagaaaggcatccgagacaatacacctttgcaaatagctctggcttcacagtcttttgtccagattggtttcctgatggctttacctatgcttatggaaattggattagagaggggttttaggactgccttgagtgaatttgtgctgatgcagcttcagttggcgccagtgttctttacgttctctcttgggacaaagactcactactatgggaggacgttacttcatggcggtgccaagtacaggtccacaggaagaggatttgtcgtctttcatgccaaatttgctgataattacagactgtattcccggagccattttgtgaagggacttgaaatgatgctgctactcgttgtgtatcaaatatttggtagtgcttacagaggcgtccttgcatatcttttgatcaccatatctatgtggttcatggtcgggacctggctttttgctcccttcctcttcaatccttctggttttgaatggcagaagattgttgatgattggactgattggaataaatggataaacaacatcgggggtattggtgttccggcagaaaaaagttgggaatcgtggtgggaggaagagcaagaacatctccggtattccggaaaacgtggtatagttgttgagattttgctagcactgcggttctttatctatcaatatgggcttgtttatcatctcactataacagagaagactaaaaactttctggtttatggagtatcatggctggtgattttcttgatattgtttgtgatgaagactgtttcggttggaaggcggagattcagcgcgagttttcagctgatgttccggttgataaaggggctgatattcatgacgtttatcgcaattattgtgatattgatcacactggctcacatgacgatacaagacataattgtgtgtatccttgcctttatgcccacaggttgggggatgctcttgattgcgcaagcgtgtaagccggtggttcatagagcaggattctggggatcagtgaggaccctagctcgtggatacgagatagtaatgggactgttgctgttcacgccagtggcgttcttggcatggtttccatttgtgtcagagttccaaacgcgtatgctctttaatcaagctttcagtagaggtcttcagatctctcgtatccttggaggtcatcgtaaggatcgctcttctcgaaacaaggaatgattcatctcttcattgtaatgacagggaagggatcttaatttatcccttttttatcttcatggatgattagggttaatgtaatttagttttcaatatatcgcttaggtaaaaacattgtagtattcatctataaattagacgttatctatc

SEQ ID NO: 3012 - DNA, 6313 bp, Populus trichocarpa
tttccattttctctatcatagggtttcttatatgctagattcatagttattgctcacttctcttaaatcttctggagagagatggcgtcgacgtcgagaggaggaggaggaggaggaggaatggggatggatcaggcggcggcgggggtagggactggagcgacgccaccgccgacgcaacggaggataacgaggacgcagactgcggggaatctgggagagtcggtatttgatagcgaaatagtgccttcttcgctttttgagatagcgccgattcttcgtgttgcaaatgaagttgaaactagcaatcctagagttgcttatctttgtcgattttatgcctttgagaaggctcataggttggatcctacttcgagtggacgaggtgttcgtcaatttaaaaccgcgcttcttcagcgtttggaaagggagaatgatccaaccttgatgggaagggttaaaaaaagtgatgcacgagaaatgcagggtttttatcagcattactacaaaaaatacatccaagcattgcacaatgctgctgataaagctgaccgcgcccagcttaccaaggcttatcagactgccaatgtgctctttgaggttttaaaggccgttaatatgacacaatccattgaagttgatcgcgagattttagaagctcaagatgaagttgcagaaaaaactcagatctatctcccttacaatattctgccacttgatccagatagtgcagatcaagcgattatgagatatcctgaaatccaagctgctgttttggctctgcgtaacacaaggggtcttccatggcccaaggactacaagaagaaaacggacgaagatgttttggattggcttcaagcgatgtttgggtttcagaaggataatgtggcaaatcaaagagagcacttaatcttattacttgctaatgtgcacatgcgacaatttgtcaagccagatcaacaaccgaagttggatgagcgtgcattgactgaagtgatgaagaaactttttaagaactacaaaaaatggtgcaagtacttggacagaaaaagtagcctttggttaccgaccatacagcaggaggtgcagcagcgtaaattattgtacatgggtttgtatcttttgatatggggggaagctgcgaacctcagattcatgccggaatgcctttgctatatctatcatcatatggcatttgagttatatggcatgctagctggaaatgtcagtcctatgactggagaaaatgtaaagccagcctatggaggtgaagaagaggctttcttgaggaaagttgttactcctatatacaatgtgattgcgaaggaagctgaaaggagtaaaaaagggaagtcaaagcattctcaatggaggaactatgacgatataaatgagtacttctggtcagttgattgtttccgcttaggctggccaatgcgtgcagatgctgatttcttttgcctgtcttctgaacagctccgttttgtacaaaatggggatgataaaccagcctatagagatcgatgggtaggaaaagttaatttcgtggagatacgaacattctggcatgtctttagaagctttgatcgaatgtggagtttttttattctgtgcttacaggctatgattattgttgcttggaatggttcggggaaactgagtgctatctttagtggtgatgtatttaagaaagtattgagtgtcttcatcactgctgccatattaaagcttgggcaagctatccttgatgtcatccttagttggaaagcacggcagataatgtcatttcatgtcaagttgagatatattttgaaggttgtttcagctgctgcatgggtggttgttttaccagtaacttatgcttacacttggaaggagaatcccccaggatttgctcaaaccatcaaaggttggtttggcaacagttcaagctcgtcttccttgtttgtattggctgtagttatctacttggcaccaaatatgctggcagcattattgtttctttttcccttcatacgtcgattccttgagaggtccgactataggattgtgatgtttatgatgtggtggtcgcagcctcggctctatgttgggaggggaatgcatgagagtacaatttctctcttcaagtatacaatgttttgggttcttcttatagtaacaaagttggcatttagttattacatagagattaagcctttagttgatccaacaaaagccataatggatgtccatataacggctttccagtggcatgaattctttccacaagcaaagaacaatattggtgtggtgattgcgctctgggctccaatcattcttgtgtattttatggatgcccagatttggtatgcaatattttccacattatttggaggaatttatggtgcatttcgacgtcttggagagattcgaacattgggaatgcttagatctcgtttccaatcattacctggtgctttcaatgcctgtttaattccagacgaaaagagtgagcgaaagaagaaaagcttgaaggcaaggttttctcgcaattttaatgagaacccccccaacaaagatacagaggcaccaaggtttgcacagctttggaataaaatcatcagtagttttagagaagaagatcttataagcaatagggaaatggatttgttgcttgttccatattgggctgaccgtgatttgggtgttttgggccttacacaatggcctccatttttgctcgctagcaagatcccaatagcattagacatggctaaggacagtaatggtaaggataaagagctgaaaaagagaatcgaggctgacaactacatgtcttgtgctgtttgtgaatgctatgcttcttttaagaacatcatcaagtttttggttcaagggagacctgagacagaggtgattgattccatatttgttgatgttgagaatcacataaagcaaggtgatctgataaaagattacaaaatgagtgctcttcctttactatacgatcaccttgtgaagcttatcaaatgcttggtggataataggccagaggacagggatcaagttgtgattctcttccaggacatgctggaggttgtgacaagagacataatggaggatcaaatatccagcctggtggactctatccctgatggatctggatatgagggaatgaaaccccttgaacaacaatatcagttatttgcatctgctggagctatcaagtttccaattgagccagaaacagaagcatggaaagagaagatcaagaggctttatcttttgcttaccacaaaagaatctgctatggatgtaccatccaacttagaagctaggaggcgtatttctttcttctcaaactcattgtttatggacatgcctgcggcacctaaagttcgcaatatgctttctttctctgttttaactccttactatacagaggaggtacttttctccttgcatgatttggaagagccaaatgaagatggtgtttccatcctcttttacttgcaaaagatctttccagatgagtggaaccactttcttgaacgagtgaactgcactggtgaagaagaacttaaagaaagagatgacttggaagaacttcgattatgggcatcatataggggtcagactttgactagaacagtgagaggtatgatgtactatcggcatgctttggagcttcaggcattccttgatatagccaaacatgaagatttgatggagggatataaggcaattgaattaaatactgaagatcagtcaaaggggggaagctcactgttggcagagtgtcaagcagtagctgatatgaaattcacatatgtagtatcatgccagcaatatgggattcacaagcgttctggtgatcttcgtgcacaggatattctgaggctcatgacaacatatccgtctctccgtgtggcatacattgatgaggttgaagaaactaatccagacaaatccaagaaggtcatccaaaaagtttactattcatctctagtgaaagctgccttgcccaagtccattgattcttctgagccagtgcaaaacttggaccaggtcatttaccggataaaacttccaggaccagctatcttgggtgaaggaaaacctgaaaaccagaaccatgctattatctttacacgtggagaaggcttgcaaacaatagatatgaaccaggataactacatggaagaagccttaaaaatgaggaatttgctgcaagaatttcttaagaagcctgatggtgtgaggcatccttcgatactaggacttagagagcatatatttactggaagtgtgtcatctcttgcttggtttatgtcaaatcaggaaaccagttttgtgactattggtcagaggctactggccaaccctctgaaggtgcggttccactatggtcatccagatgtatttgataggcttttccatctcactagagggggtgttagtaaagcatctaaggttatcaatctgagtgaagatatatttgctggcttcaattccacactacgtgaagggaatgttacccatcatgaatatatacaagttgggaaggggagagatgtgggccttaatcaaatttccatgttcgaggccaaaatagctaatggcaatggagagcagactctgagtcgtgatatctaccggcttggacaccgttttgacttcttccgaatgttgtcttgctatttcaccacagttggtttctacttcagtactctgattacagtgctcacagtgtatgtattcctttatggccgcctataccttgttctcagtgggcttgaagaaggtttgagtactcagaaagcaattcgagacaacaaacctcttcaagtggctcttgcttctcaatcttttgttcaaataggatttttgatggcattgcctatgttgatggaaattggcttggaaaggggtttccgcactgcactaagtgaatttttattgatgcaattacaactagcacctgtatttttcacattttctcttggcacaaagacccactactatggaaggacattgctgcatggtggggcaaaatataggtccactggtagaggttttgtggtcttccatgccaaatttgctgacaactataggctttattcccgcagtcactttgtcaagggtattgagatgatgattttgcttgttgtttatcaaatatttggtcagccatacagaagtgcagtcgcctatgtcctaataactatatctatgtggtttatggttggtacctggctttttgctccattcctcttcaatccttctggttttgagtggcagaagattgttgatgattggtctgattggaacaagtggataagtaaccgtggaggaataggtgtcccaccagaaaagagttgggaatcatggtgggaagaagaacaggagcatcttcatcactcgggaaagcgtggtattgtagcggagatactgttatctctacgattctttatctatcaatatggtttagtatatcatttaacgattacaaagaagatgaaagacagaagttttttgatctatgggatatcatggctggtgatccttctaatattgtttgtgatgaagactgtatctgttggacgacgaaagttcagtgctaacttccagcttgtgtttcgtctaatcaagggaatgatattcctaacttttgtgtccattcttgtcactttgattgcactgcctcatatgacggtgcaggatgtcattgtatgcattctcgctttcatgccaaccggttggggaatgctcttgattgctcaagcttgtaaacctgttgttcaacgagccgggttttggggatcagttcggacacttgcacgtgggtatgaaatcgttatgggcttgctcctgttcactccagttgcattcctcgcctggttcccttttgtgtctgaattccagactcgtatgctgttcaaccaagcattcagtagaggtctgcaaatttctcgcattcttggcggccataggaaggatcgctcttcaaggaacaaggagtaatctcagtaccaattcaacactagtgtgtgtgtgtatctattctgtcagtcacactagcctgactgtgaaaattctgttcatatctattctaaccttgtaattatggaagagccaggaataatagctgttgagttcatggcatttttattaaacaatatagaggtgtttaaaaatttattatttaaagatttgattttttttatttgaataattttttaaagactgatttgttgcaaattatatgctgtttaattgtccaatctttgatggtaatttacatgaacaaccaatgataaatcttctaaat

SEQ ID NO: 3013 - DNA, 6286 bp, Brassica rapa
attcaggccacgcacataagacatctctctctctctctctctctctctctttctctctcacacacacacttttgcgtactacttagcagctaagtaggcttaaagtttcgctgctttcctttgctcatcctccattgctagggtttctggatctctctgaacctggaggttttaggacaggactaatgtcggcttcgagaggaggtcctgaccaaggaccgtcccagccacagcagcgacggatcgtacggactcagaccgctggtaatctaggagaatcattcgacagtgaagttgttccttcctctcttgtcgagattgcccctattctccgtgttgctaatgaggttgaatctagcaaccctagagttgcttatctctgtcggttctatgcattcgagaaagctcacaggctggatcctacttcaagtggaagaggtgttcgacagtttaagaccgctcttctacagcgtcttgaaagagaacatgatccaacattgatggggagggttaagaaaagtgacgcccgggagatgcaaagcttttatcagcattactacaagaagtacatccaagctttgcagaatgctgctgataaggctgaccgggctcagctgacaaaagcataccaaactgccaatgtcttgttcgaggtgttgaaggctgttaatctgacacagtctattgaggttgacagagagatcttggaagctcaagataaggttgctgagaagacacagttgtatgtccactataatatcttacctctggatcccgatagtgcaaatcaagcgattatgagataccctgagatccaagctgctgttcttggtctccgcaacactagaggtcttccatggccagaaggtcacaagaaaaagaaagatgaagacatgcttgattggcttcaggaaatgtttggctttcagaaagacaatgtggctaatcaaagggagcacctgatcttgttacttgccaatgtgcatatacgacagtttcctaagcctgatcagcagccaaagttagatgatcaagcactgacggatgtgatgaagaagctcttcaagaactataagaaatggtgcaaataccttggtcgaaagagtagtctttggttgccaactatacaacaggaaatgcaacagcgcaagctattgtatatggccctatatcttctaatttggggtgaagcagcgaacttgagattcatgccagagtgtctctgctacatttatcatcatatggcatttgaactctacggtatgctggctgggaatgttagtcccatgactggagaaaatgtgaagccagcttatggaggcgaggaagatgcattcctgaggaaagttgtgactcctatctatgaagtgattgccatggagtctcaaaggagcaagaaaggcaagtccaagcactctcagtggaggaactatgatgatctgaatgaatacttttggtcagttgattgtttccgtttaggttggccaatgagagctgatgctgatttcttctatccgcatgttgatcagcccaatacagaaaaagatggggataacagcaagcctgctgtggccagagatagatgggtggggaaagttaattttgttgagattcgttccttctggcatgtctttagaagtttcgatcgaatgtggagcttctatattctgtgtcttcaggcgatgattattatggcttgggatggcggacaaccaagttcggtctttggagctgatgtcatcaagaaagttctgagtgtattcatcacagcagcaataatgaagcttggacaagcttctcttgatgtgatccttagtttcaaagctcatcgaagcatgtcactacatgttaaactaagatacatcctgaaggtgctatctgctgcagcgtgggttattattctgcctgttacttacgcttacagctgggaagaccctccaggattcgccagaactatcaagagttggtttgggagtgccatgcactcaccttcattgttcataatagctgtggtcttctacttggcgcctaatatgctcgcgggagtgttctttcttttccctatgttacgccggtttcttgagaggtccaactacagaattgtaatgctaatgatgtggtggtctcagcctagactctatgttggcagaggaatgcatgagagcgcattttccctcttcaaatataccatgttctgggtgttgcttattgcaacaaagctgacgttcagttactacattgagatcaagcctttagttgctccaacacaagctatcatgagggcccgtgtgacagactttcagtggcatgagttctttcctcgtgccaaaaacaatattggtgtcgttattgctctttgggcccctattattctggtgtacttcatggatagtcagatttggtatgcaatattctccacaatatttggaggtatatatggtgctttccgccgccttggagagattcggacactgggaatgcttagatcacggtttgaatcactgcctggagcttttaatgaccgcttgattccagatggaaagaaccagcagaggaagaagggattaagggcaactctatctcataactttacagaggataaggtacctgttaacaaagagaaagaagctgcaagatttgcacagttgtggaacacaatcatcagtagtttcagagaggaagatcttataagcgatagggagatggatctgctgcttgttccatactgggcggatcgtgatttggatctcatacagtggcctccgtttttattagctagcaagattccaatagcattggatatggcaaaagacagtaatgggaaggacagagagctcaagaagaggattgagagtgactcttatatgaaatgtgctgtccgtgagtgctatgcttcgttcaagaatgtcataaagtttctggttcagggaaaccgtgagaaagaggtgatagagttcatattcgccgaggttgacgaacatatagagaaaggtgatttgattcaagtgtacaagatgagttgtctccctagcctctatgaccactttgtcaagctgatcaaatacttgctagacaacaatgtggatgatagagatcatgttgtaattctcttccaagacatgctggaagtagttacaagagacattatgatggaggattctatatcgagcttggtggattcgagtcatggtggcacttggcatgggggaatggtccctctggaacaacaataccagctgtttgcatcttcaggtgccattagatttcctattgaaccagtaacagaagcttggaaagagaagatcaaacggttgtatctattgctgactactaaagagtctgcaatggatgtcccctctaacttggaagcaagaaggcggatctctttcttctcaaattcattgttcatggatatgcctgcagcaccgaaagttcgcaacatgctatcattttctgtgttgactccatattacactgaagaggtcctcttttctatgcatgacctggacacaccaaatgaagatggtgtctcgatcctcttttacctacaaaagattttcccagatgaatggaacaatttccttgagcgggtgaagtcaaatgaagaagaaattaaagagtctgttgaattagaggaggaacttcgtttatgggcttcatatagagggcagactttgactagaacagtaagaggaatgatgtactatcgaaaagcattggagcttcaagcattccttgacatggctatgcatgaagatttgatggaaggttacaaggctgtagaactaaactctgagaacaactcaagaggggaaagatcactatgggcacagtgccaagctgttgctgacatgaagttcacatatgttgtatcatgtcaacagtatggtattcataaacggtccggtgatcctcgcgcgcaggatatattaaggcttatgacaagatacccttcgctccgtgttgcatatatcgatgaggttgaagaaccagtgaaagacaagtcgaagaaaggaaacgagaaagtgtattattctgtgttggttaaggtgcctaagtcaactgatcactccagccttgcacaaaatcttgaccaggttatctataggatcaagcttcctggacctgctattcttggagagggaaagccagaaaaccaaaatcatgctattattttctctcgtggagaaggtttacagacaattgatatgaatcaggataattacatggaggaagcgttaaagatgaggaacttgcttcaagaatttctcacaaagcatgatggtgtgaggcatccatccattcttggacttagggaacatatatttactggatccgtttcctcccttgcttggttcatgtctaatcaagagactagttttgttaccattggtcagcgattactggcaaatcctttgagagtccgtttccattatggtcatccagatgtcttcgatagactgtttcatctaacaagaggtggtgttagcaaagcatccaaagtaataaacctcagtgaagatatctttgcaggattcaattctacccttcgtgaaggaaatgttacacatcatgagtacatccaagtaggtaaaggaagagatgtgggtctaaatcagatctctatgtttgaggccaagattgctaacggcaacggagagcagacattaagccgggacatttacaggcttggacaccgttttgactttttccgaatgatgtcgtgttacttcaccactgtcggcttctacttcagcactctgattacggttctcactgtctacatcttcctctatggacgtctctaccttgtcttgagcgggctcgaacaaggactaagcacacagaaaggcatccgagacaacacacctctgcaaatagctctcgcttcacagtcctttgttcagattggtttccttatggctttacctatgctcatggaaatcggattagagagaggtttcaggaccgccttgagcgagttcgtcctcatgcagcttcagctagcgccagtgttcttcacattctctctcggcacaaagactcactactacggaagaaccttactccacggcggcgccaagtacaggtccacagggagaggcttcgtcgtcttccacgccaagttcgctgataactacagactctactcgagaagccactttgtcaaagggcttgagatgatgctgctgctagttgtgtaccagatcttcggaagtgcttatagaggcgtggttgcgtatcttctgatcaccatatctatgtggtttatggtcgggacgtggctctttgctcccttcctcttcaacccttcgggcttcgagtggcagaagattgttgatgactggactgattggaataaatggataaacaacatcggaggtatcggtgtcccggctgagaagagttgggagtcgtggtgggaggaggagcaagagcatctcagacattcggggaagcgtggcatagttgttgagatcttgttgtctctgcggttctttatctatcagtatgggcttgtttatcatctcacgattacagagaagactaaaaactttctggtttatggagtatcgtggctggtgatcttcttgatactgtttgtgatgaagactgtttcggttggaaggaggaagttcagtgcgagtttccagctgatgttccggttgataaaggggctaatattcttgacattcatcgcaatcattgtgatactgatcacacttgctcacatgacgatacaagacataatcgtctgcatccttgcatttatgcctacaggctggggcatgctcttgattgcgcaagcgtgtaagccggtggtgcatagagcagggttctggggatcagtgaggacgctggctcgcgggtatgagatagtgatgggactgttgctgttcacgccggtggccttcttggcttggtttccgtttgtgtcggagtttcagacgcgtatgcttttcaatcaagcgttcagtagaggtcttcagatctctcgtatccttggaggtcataggaaggatcgttcttctcggaacaaggaatgattcattatcatcttcacttctcattcacttgatgtaatgtctaatgtctttagccgttgttgttgctgttggtacatgtagcacgaatcaaatggatgtgatattagtttaaaattattttaattatttattgccaatgtagaaacaatgtagtaatatgtttcaacttttaaccatccaaaaatattttaaactttcatccacgatattaaagctttttgcaatcatgtctttgaggt

SEQ ID NO: 3014 - DNA, 6372 bp, Mimulus guttatus
gcgtgcgcgagttgatttcttcaagtagttatctcgtatgtgctgtggcattttgactacatacttgggtgaggaaagggggtacaaagtaagatgtcgtcgcgaggtgttccctcgcagcagaatccgcagctgcaaagacgaatcacacgtactcagactgtggggaatctaggggagtctatttttgacagtgaagtagtgccttcatcactggtcgaaattgcacccattctccgtgttgcgaatgaagtcgagcctagcaaccctcgtgttgcctacctctgtaggttttatgctttcgagaaagctcataggttggatcccacttctagtggacgtggtgttcgtcaatttaaaacagcgcttctgcaacgtcttgaaagggaaaatgatcctaccttaatggggagagtaaaaaaaagtgatgctcgagaaatgcagagcttttatcagcattattacaaaaaatatattcaagctttgcaaaatgctgccgacaaagctgatcgtgcacagctgacaaaagcataccaaacggctaatgttctctttgaggttttgaaggcagttaatcagacgcagtctgtggaagttgatcgtgaggtattggaaactcacgataaagttgcagagaagacagaaatctacgttccttataatattttacctctggatcctgatagtgcaaatcaggcaatcatgaaatatccagaggtacaagccgctgtacacgcgcttcgaattaccagaggtcttccttggccgaaggattacaagaagaaaaaggatgaagatatccttgactggcttcaagccatgtttggttttcagaaagatagtgtggcaaatcaaagggagcatttgattttgctacttgcaaatgtacacatacgacaatttccaaagcctgatcaacaaccgaagttggatgagcgtgcactagatgaagtgatgaagaagcttttcaagaactacaaaaagtggtgcaagtatttggaccgcaaaagtagcctctggttaccgactattcaacaagaagtgcaacagcgtaaattgttatatatggggctgtatcttcttatatggggagaggctgccaatttgagattcatgccagagtgcctatgctacatctatcatcatatggcttttgaactttatggcatgctcgctggaaatgttagtccaatgactggtgaaaatgtgaaaccagcctatggaggggaggaagaggctttcttaaaaaaagttgtcaagccaatttatgaagtgattgctcaggaagcggcgagaagcaaaacagcaaaatcaaaacattcccagtggagaaattacgatgatttgaacgaatacttttggtctgttgattgttttcgtttaggatggccgatgcgtgccgatgctgactttttctgtaggcctgctgatccacttccaggtgaaaggaacggggataataggcctagaagagatcgatgggttgggaaagttgattttgttgagatccgatcatattggcatatctttagaagttttgacagaatgtggagtttcttcatactgtgtctgcaggcaatgatcattattgcttggaatggtggacagccaagttcagcttttaattctaatgttttcaagaaagtgttaagcatctttataactgctgcaatactgaagctcggtcaagctgttcttgatgtaattctgagttggaaagctagacagagtatgtcattccatgtcaaactacgatacgttctgaaagtggtggctgctgctgggtgggtggttgttctccctgttacttatgcttatacatgggagaatcctcctggatttgcccagactatcaaatcatggtttggcaacagctcaagttctccttcattatttatcttggctattgttctctacttgtccccaaatatgctcggtgtcttgctgttccttttcccgttcattcgccggttccttgaaagttcgaattacaaaattgtgatgctagcgatgtggtggtcacagcctcgactctatgttggaaggggaatgcatgaaagcacattttccctcttcaagtacacattattctggatgctgcttatcattacaaaattggctttcagtttttatgttgagataaagcctctggtaggtccaacaaaagctatcatgcaggttcgtatatcaacttaccagtggcatgagtttttcccccaagccaagaacaatataggtgtcgtgattgcactctgggcaccagttattcttgtttatttcatggattcccagatctggtatgctatattttccacactgtttggaggtatatatggtgcattccgtcgccttggagagattcggacattaggaatgcttagatcccgatttcagtcgttacctggtgctttcaatggttgtttaatcccagaggagagaactgagccagtgaaaaagaagggactgaaggccaccttttcccgcaagtttgaagtgatcccgtccagtaaggaaaaagaagctgcgaggtttgctcagttgtggaacaaaataattacaagtttcagagaggaggatattataagtaatagggaaatggatctattgctcgttccatattgggccgatcgtgaattggagctgatgcaatggcctccttttttgctcgccagcaagatcccgatagcagtggatatggccaaggacagcagtaatggcaaggacggcgaactgaaaaagcggatcaagtctgatgactatatgtattctgctgtttgcgagtgctatgcttcatttcggaacatcattaaattattagttcgtggaaaacaagagaaagaggttattgagtatatattttctgaagtggacaagcatatcgaggaggatgatctattaagtgaatacaagctgaatgctcttcctagtctgtatgatctcttcgtcaagcttgtgaaatacttgctagagaataagccggaggacagggaccaagttgtcattcttttccaagacatgcttgaagttgtgacccgagacataatgatggaagatcatgtatccaacttgttagattcaatccacggtggatcaggacatgaaggaatggtccctcttgatcaacaatatcagctatttgcatcagctggtgccatcaagttcccagctcctgaatcggaagcttggaaagagaagatcaagaggttgtacttgttgctgacagtgaaggaatctgctatggatgtaccatcgaacttagaagccagaagacgcatgtccttcttctctaattccttatttatggacatgccattagctcctaaagtccgcaatatgctttctttctctgttttgactccatattacacggaagaggttctcttctcattgcctgtgctagaagtgccgaatgaagatggtgtttcaattctcttttacttgcagaaaatttacccagatgaatggaacaattttttggagcgtgtcaactgtctcagtgaagaagaacttagggggtccgatgaactagaagaacagctacgcctttgggcatcatataggggccaaacattgactaaaactgtcagaggaatgatgtattatcgcaaagctctggaacttcaggcattccttgatatggccaaggacgatgatttaatggaaggctataaggcgattgaattgaatgaggatcagatgaaaggagagagatcgctttggactcaatgtcaagcagtggctgatatgaagttcacatatgtggtctcctgtcaattgtacggtattcaaaaacgttctggagatcagcgagcgcaagatatattaagacttatgacaacatatccatctcttcgggtggcatatattgatgaagttgaagagcctagtaaagacagaaccaagaaggttaatgataaggtgtactactccactcttgtgaaagctgccttgccaaagtcaaattcctcagacccaggacagaatcttgatcagattatctatcgtataaaacttcctggccctgctatcctcggtgaaggaaaacctgaaaatcagaatcatgccattattttcactcgtggagaaggcttacagacaattgatatgaatcaggataactacatggaagaggctttcaaaatgagaaacttgcttcaagaatttcttaaaaagcatgatctgaggcacccatcaattcttggtctgagggaacatatattcactggaagtgtttcttcactcgcttggtttatgtctaatcaagagacgagtttcgtcactattggtcagaggctgcttgccaaccctcttaaggttcggtttcactatggtcatccagatgtttttgatagattgtttcatcttacaagaggcggggtgagcaaagcatcaaagattatcaacctgagtgaggatatctttgctggattcaattctacacttcgtgagggcaatgtgacccatcatgaatacatacaagttggtaaagggagggatgtgggtcttaaccagatttctctattcgaggcaaaaatcgcgaatggaaatggagaacaaaccttgagtcgtgatttatataggctgggccatcgctttgacttcttccgaatgctatcatgttatttcaccaccattggtttctacttcagtactttgattactgtactcacagtgtatatatttctctacggtcgcctttatcttgtgcttagtggtctcgaacatggattaagtacgcaaccaggaattcgggataacaaggctctcgaaatcgctcttgcttctcagtcctttgtgcaaattggatttctgatggctctccctatgatgatggaaatcggactagaaaagggtttccgaactgcactaagtgaattcatattaatgcagctgcaactcgcaccagtatttttcaccttttcgctcggaaccaagacccactattatgggaggacattactccatggaggtgcaaagtacaggcccacgggccgtggtttcgttgtgttccacgccaaatttgccgagaactaccggctctactctcgtagccactttgtcaagggactcgagctgatgatactgcttcttgtttatcaaatatttggccaatcttacagaggcgctgttgcgtatatcataatcactgtatcgatgtggtttatggtcggcacgtggctttttgctcccttcctcttcaatccttctggttttgagtggcaaaaaatagttgatgactggactgattggaataagtggatcagcaacagaggaggtattggtgttccgccggagaagagttgggaatcgtggtgggaggaggagcaagaccatctccgccactctgggaagcggggaatcattgctgagatagtattggcgttgaggtttttcatttatcagtatgggctcgtatatcacttgcacattacaaggaataccaaaagtattttggtatacggtgtatcgtggctggtgattgttctgattctttttgtgatgaagacaatttctgtcggacggaggaaattcagcgcaaattttcaactcgttttccggctcataaagggtttgatcttcgtgacattcatctctatcatcgctatattaatcgctctcccacacatgacaccacgagatatcatcgtttgcatactcgccttcatgcctactggttggggtttgcttctgattgcacaagcatgcaagcccgtggttcaaaaatttggattctgggggtccgttcgaacactagcacgtgggtacgaaatattgatggggttactcctgttcacacctgttgcatttcttgcatggttccctttcgtgtcggaatttcagacacgaatgttgttcaaccaagcattcagtagaggtcttcagatttctcgtattcttggcggccacaggaaagacaggtcctctaggaacaaggagtagttgtgatagctcctctgttccactggtaattaatcatgtttttattgtcttccgttctattttaatttaactgtttaattatttaagctgcatttttgagcttttattaggtgttgtaattataaccatcaaactcagtctactaggaagttgatgttattattacattgtcaattattcttactagatgtatttaggtcaatcctttctattgataatatttagttgagttaaaagtgggctttttcttttctttaatttttaatgacaaataaaaagtagttatttgtagcaactgcataattaggaagctgcctgaattctttgttggtgtaccaaaatgaactgtccaaaagcatctattttgaccagtaactgatttaggagttgccagagttgtatggataattatttacaattattaaaacgtta

SEQ ID NO: 3015 - DNA, 6218 bp, Solanum lycopersicum
gctaagtagcttaaagttgcagcctccccaaaaactcccttctctctctactagggtttattttgctggttgctcttccacttttcaccttttgctttaacaccattcttgaactaacaattaatgcctcttaaagtgaagatataaaggtgtgaaagttgaatataatggcgtcaagagggggaccggagccgtcgctgcagcggcggattacacggacccaaacgatggggaacattggggagtcgatgattgacagtgaagtggtgccatcgtctctggcggagattgctcctattcttcgtgttgcgaatgaagttgagcccagtaacccccgtgtagcatatctatgtcgattttatgcttttgagaaagctcatcggttagatcccacttcaagtggacgtggtgttcgacaatttaaaacttccctcctgcagcgacttgaaagggaaaatgatccaactttgatcggaagggttaaaaaaagtgatgcacgtgaaatgcagagcttttaccagcattactacaagaagtacattcaagctttgcaaaatgctgctgagaaagcagatcgtgcacaacttaccaaggcataccaaactgcaaatgtactctttgaggttttgaaagcagttaatcagactcaagcagtagaagttgatcgggagattttggaagctcatgataaagttgccgagaagacacagatcttagtcccttataatattcttcctctggatcctgatagtgtaaatcaggcaattatgagatttcctgaggttcaggctgctgtttacgctctccgaaataccagaggtcttccatggcccaaggattacaagaagaagaaagatgaagatattcttgactggcttcaagctatgtttgggtttcagaaagatagtgttgcaaatcaaagggaacatctcattttgctgctagccaatgtacacatacgccagtatccaaagcctgaccaacaacccaagctggatgagcgtgctttgaatgaagtcatgaagaagcttttcaaaaactacaagaaatggtgcaagtacttggacaggaaaagcagtttatggctgccaacgatacaacaggaagtgcagcagcgtaagttattatatatgggattatatcttctcatatggggggaagctgcaaatttaagattcatgccggaatgcctttgctacatttaccatcatatggcatttgaactctatggcatgctagctggcaatgttagtcccatgacaggtgaaaatgttaagccagcttatggaggggaagaggaggctttcttgagaaaagttgttactcctatttatgaagtgattgcacgggaagctgcaagaagcagaagaggaaaagcaaagcattcccagtggaggaactatgatgatctaaatgaatacttttggtcagtggactgcttcagattaggttggcctatgcgtgctgatgctgatttcttttgccttcctgtagatgaagagcaagctgagagaaatggggacaacaaggctttaagtgatcgctggctgggaaaagttaattttgttgagatacgatcatatttgcacatctttaggagctttgacagaatgtggagcttcttcatattgtgtttacaggcaatgataattattgcttggaatggttcgggagacctgagcatggttttcacttcaaatgttttcaagaaagtattgagtgtgtttattacagctgcagttttgaagcttgggcaagccactcttgatgtgatgcttaattggaaagctaggcgaagcatgtcattctatgttaaactgcgatacatattgaaggtcatatctgcagctgcttgggtgatcattttacctgttacatatgcttacacatgggaaaatcctcctccatttgcccaagccattagaaattggtttggcagcaactcagattctccttcgctgtttatactggctgtggtaatctacttgtcacccaatatgcttgctgctctgctctttctttttcccttcgttcgccgattcctagagagatcacactacaaaattgtgatgctgatgatgtggtggtcacagcctcgtctttatgttggtagaggaatgcatgagagcactttctcattgttcaaatacactatgttctgggtacttctaattgcgacaaaactagcattcagtttttatgtggagataaagcctttagtggaaccaacaaaaaaagttatgaatgtccacattaccacttaccagtggcatgaatttttcccccatgcaagcagcaacattggtgttgttatcgctctttgggctccagttatccttgtttatttcatggatgctcagatatggtatgccatattctccacaatattcggtggtatttatggagcatttcgcaggcttggagagattcgaactttaggcatgctgaggtccaggttccagtctttgcccggtgcttttaatgcttgtttgataccagaggagaagagtgagcaacctaaaaagaaaggactaaaagcaacattctctcgaaatttcgccagggtgccatccaacaaggaaaaagaagctgcaaggtttgctcaattgtggaataaaataatcacaagttttagagaggaagatcttattagcaatcgtgagatggatcttttgcttgttccttactgggctgatcgtgagttggatctcgtgcaatggccaccatttttgcttgctagcaagattccaatagcagtggatatggctaaggatagcaacggaaaggaccgtgagctgaaaaagaggattgaggctgacccatatatgtcatctgctgtttgtgagtgctatgcttcatttcgcaatgtgataaaagttttggtttcaggtcgtcgtgagaaggaggttatagagtatatcttctcagaagttgacaagcatattgaggctggtaatttaattagtgagtacaagatgagttctcttcccagcctgtatgatctgtttgttaagctcataaaatacttgctagaaaataggcaggaggacagggatcaagttgtacttctattccaagacatgctggaagttgttacgcgagatataatgatggaagatcaactatcaagcttggtagattccatccatggagccccagggtatgaaggaatgatccctcttgatcagcaatatcagttatttgcttctgctggagctatcaaattcccccctcctgaatcagaagcttggaaagagaagatcaaaagattgtatttgctgcttacagtaaaggagtctgcaatggatgtaccatccaacttagaagctaggaggcgaatatccttcttctccaattcattgttcatggacatgcccacagcaccaaaagtccgcaatatgctttctttctctgtcttgaccccatactacacggaggaggtgcttttctcatcagatgatttggataaacaaaatgaagatggtgtttccattctgttctatttgcagaaaatttatccagatgaatggaacaatttccttgaacgtgcggactgcataagtgaggacgaccttaggtttaaatggtctcctgagttagaagaaaatctccgtcattgggcttcatatagaggacagactttaactaggactgtgagagggatgatgtattaccgcagagctctagagcttcaatctttccttgacatggcccaggatgatgatttgatggaggggtataaggctatcgaattaaatgacgatcagatgaagggagaacggtctctgtgggcacaatgtcaagcagttgctgatatgaaatttacgtatgttgtttcatgccagctatatggtattcacaagcgatctggtgatcaacgtgcacaagatattctgcggcttatgactacgtacccatctatgcgtgttgcttatattgatgaaattgaagaaccaagcaaagataggtccaagaaagttaatccaaaggcctactattccactcttgtcaaagctgctctgccaaattcacattctactgagcctggtcaaaacttggatcaggttatctaccgcataaaacttccaggtcctgctatcttgggtgagggaaagcctgaaaaccagaatcatgctattatattcactcgtggagaggggctgcagactatagatatgaatcaggataactacatggaggaagccttaaaagtgaggaatttgctccaagaatttcttaagaaacatgatggtgtgaggttccctactatacttgggctgagagagcacatatttactggaagtgtttcttctctcgcttggtttatgtcaaatcaagagacaagttttgtgacaataggccagagactgttggcaaaccctctgaaggttcgattccattatggccaccctgatatttttgacagacttttccaccttacaaggggtgggattagcaaagcttctaagattatcaacttaagtgaggacatatttgctggctttaattctacacttcgtgaaggcaatgttactcatcatgagtacattcaagttggtaaagggagggatgtggggcttaatcaaatatctctatttgaagccaaaatagcgaatggcaatggagaacagaccctgagtcgggatttatacaggcttggacatcgttttgattatttcagaatgttatcatgttatttcactaccatcggtttctatttcagtaccttgattacagttctcaccgtgtatgtgtttctctatggccgcctttaccttgtccttagtggacttgaggaaggactcagcaaagaaccagctattaaaaacaacaagcctcttcaagtggctcttgcttctcagtcgtttgtgcaaattgggtttttgatggccctccctatgatgatggagattgggttggaaaagggattccgcactgcactcagtgaatttatactgatgcaactgcagttggcacctgtattcttcacgttttcacttggtactaagacccattattatggaagaacattactccatggaggtgcaaagtataggcctactggtcgtggttttgtggtctttcatgcgaagtttgctgataactatcgcttctactcccgtagccacttcgtcaagggacttgagctaatgatattgttactcgtgtatcaaatttttggtcaagaaaacagaggagctgttgcatatatcttaatcactgtctcaatgtggttcatggtgggaacctggctctttgctcccttcctcttcaacccctctggttttgaatggcaaaagatagttgatgattggactgattggaataagtggataagtaacagaggaggtattggtgtcccccctgagaaaagttgggaatcatggtgggaggaggaacaagaacatcttaggcattctggaatacgcggtattgttgctgaaattttgttgtctttgcgcttctttatctatcagtatgggctcgtctatcacttgaagatcacagtgaaaaatcagagttttctggtttatggtgcatcatggttagtaataattctggtactatttgtcatgaagacaatatctgttggtcgacgaaaattcagcgcaaatctccaactcgtgttccgtcttataaagggattgatattcttaacattcgtcgcaaccctggtgattctgatgacactgctcaagatgactcctaaagacatggttatatgtgttctcgctttcttgccaactggctggggcatgcttctgattgctcaagcattgaaacctgttgttcggagagctggattctggggatcagttcgaactctagctcgtggctatgagattgtgatgggattgcttctgttcactccggttgcttttctggcttggtttccatttgtatccgagtttcaaacacgtatgctgttcaaccaagcattcagtagaggtcttcagatttctcgtattcttggtggtcaacgtaaagatcgttcctctcgaaacaaggactagagtttcttgacatgaatagagctacattattaacattcatccttcaatgtttgtaattgttgttcattcacattgtaagctgctgcctttgtaattatctagtggtgatagcagcatttttgggcaaataccatatcactttttttttttggtgaaaattccttaatggaatcattctcttacattttttaaaaacatttgatc

SEQ ID NO: 3016 - DNA, 6337 bp, Theobroma cacao
actcactcactctcttcggtctctgtttctcactctatagttgtttttctctctcttagggtttttctctgtgagctctctttcctcttcacattgccttcaccatttcggtgtttaatctgttgctgtttttggtagatgacttagtagctcaaagtattctctttaattgcttgggaagttagtgtttttttccccgttgagattttgggtggaaggcgagggcaaagatgtcctcgagcagggtgtcagatcaatcgcaaccgctgaggcggatcacacgcacgcagactgctggtaatctaggagagacagcttttgacagtgaggtggtgccatcttctcttagcgagattgcacccattctccgtgttgctaatgaggtcgaatcaagcaacccaagggtggcttatctctgtcgattctatgcatttgagaaagctcacaggctggatcccacttccagtggacgtggtgttcgccaatttaaaactgctctgcttcaacgtcttgaaagagagaatgatccaactctacagggaagggttaagaaaagtgatgcccgtgaaatgcaaagtttttatcaacactattacaaaaagtacatccaggcattgacaagtgctgctgataaagctgatcgggcgcaacttacaaaagcataccaaactgcgaatgttctttttgaggttttgaaggccgtcaatttgacacaatctattgaagttgaccgtgagattttggaagctcaagataaagttgcagaacagacacagatcttggtcccttacaacatccttcctcttgatcctgaaagtgcaaaccaggctataatgcaatattctgagatccgagcagctgtttatgctcttcgtaacactaggggtcttccatggcccaaagaccacaggagaaagaaagatgaagacattctagattggcttcaagaaatgtttgggtttcagaaagataatgtggcaaatcaaagggagcatttgatcttattgcttgcaaatgtgcacatacggcaatttccaaagcctgatcaacaacccaagttggatgatcatgcgctaacagaagtgatgaagaaactttttaagaactataaaaagtggtgcaagtacttggatcggaaaagtagtctttggttgccaaccattcagcaggaagtgcaacagcgaaaattattatacatgggtctgtatcttttaatatggggtgaagctgcaaacttgagattcatgccagaatgcctttgctacatctatcatcatatggcatttgaactttatggtatgctagctggaaatgtcagtcctatgaccggagagaatgtgaagccagcctatggaggcgaggaggaagcttttttgaagaaagttgttacacctatctatgatgttatttggagggaagctgaaagaagtaaacgagggcaatcaaagcattcacaatggaggaattacgatgatttaaatgaatacttctggtccgttgattgtttccggttgggttggccaatgcgtgctgatgctgatttcttttctcggccaattgatcaacttcgtgagaaaaatggggataacaagccatctactaatgatcgatggatggggaaagttaactttgttgagatacgctcattctggcatgttttcagaagctttgatcgaatgtggagttttttcatcctgtccttgcaggccatgattattattgcttggcatggctcggggcaaccaagttcaatctttaggggtgatttgttcaagaaagtgctgagtgtcttcataactgctgctatattgaagcttggccaagctgtccttgatgtaatccttagctggaaagcacagcagagcatgtcatttcatgttaagttaagatacatattgaaagttctttctgcagccgcgtgggtgatcgttctacctgtcacttatgcttatacttgggacgatccttcagggtttgcacgaaccatccaaagctggtttggcaatacctcaaattcaccttccttgtttattttggctgttgtaatttacttgtcaccaaatatgctggccgcaatgttgtttctttttccattcattcgtcgattccttgaaagttcacactacaaaattgtgatgcttatgatgtggtggtcacagcctcgtctctatgttggtagggcaatgcacgagagcacattttctctcttcaagtatacaatgttttgggtcctacttatcatcactaagttgacatttagttattatattgagataaagcctttagttggtcccacaaaagctgttatgtctgttcggataagtaaattccaatggcatgaatttttcccccgagcaaagaacaacattggtgtcgtgattgctctctgggctccaatcattcttgtctattttatggatacccagatttggtatgcaatattctccacattgtttggaggtatttatggcgcatttagacgacttggagagattcgaacattaggaatgctcagatctcgttttgaatcattgcctggtgcttttaatgcccgtttaattccagaggatctaagcaagaaaaagaggaaaggagtttggggttttttctctcgcagctttgggcagccaccatctaataaagagaaaggggctgcaaaatttgctcagttgtggaacaaaataatcagcagttttcgacaggaagatcttataagcaataaggaaatgaacctgttgcttgttccctattgggctgaccgtgatttagagcaaatccagtggccaccatttttgcttgctagcaagatcccaatagcattggatatggccaaggacagtgatagcagggataaagagctgcaaaagagaattgaagctgacccttacatgttctgtgcaattggtgaatgctatgcctcattcagaagtattattaagtttttggttgaagggccccgggaaaaagaggttataaatgacatattttccaaggttgacaaacgtatagaagatggtagtctaattatggcttacaaaatgagtgctctccctagtctctatgaccatattgtgaagttgatcaaatttttgttggaaaataagcaggaggaaaggggtcaagtggtactctgtttccaggatatgctggagactgtgacaaaagacataatgacagaggatgaaatctccagtttggtggattcaatacatggagggtccgggcatgaggggatgatcctacttgatcaacattatcaattatttgatcaaaaaaaattagatcaattatttgcctctgctggagccatcaagtttccaatatctcctgttacagaagcgtggaaagaaaagatcaaccgactttatctgttacttaccacaaaggaatctgctatggacgtgccatctaatttagaggctaggaggcgaatttctttcttttcaaattctttgtttatggatatgcctgctgcgcctaaagttcgcaatatgctttcattctctgttttgactccttactacacagaggaagttcttttctccttgcaagaattggaaaatccaaatgaagatggtgtttccatcctcttttacttgcaaaaaatctttccagatgaatggaataactttcttgaacgggtgaaatgcagcagtgaagaagaacttaaagaatctcctgagttagaagaacaccttcgtttatgggcatcatataggggccaaactttaacgagaactgttagaggtatgatgtactatcgtgaagctttggagctgcaggctttccttgatatggccaaacatgaagatttgatggaaggctataaggccatagaattaagtacggaggataacaaagaggataggtcactgaaggtacagtgtgaagcagtagctgatatgaaattcacatatgttgtgtcttgtcaactatatggcattcagaagcggtctggtgaccagcgtgcacaggacattctgaggcttatgactaaatacccgtcacttcgcgttgcatacattgatgaggttgaacaacgtaatgaggataggttgaagaagcttaatggcaaggttaattacttttctgttctagtgagggctgtgccaaagtctagtgattcttcagagccggtgcaaaatctagaccaggaaatttatcggataaaacttccagggcctgctatcttgggtgaagggaaacctgaaaaccaaaatcatgccattatcttctcacgaggagaaggcttgcaaacaatagatatgaaccaggataattacatggaagaggcattgaaaatgaggaatttgttgcaagaattcctcacaaagcatgatggtgtaagatacccgacaattcttgggcttagagagcacatatttacaggaagtgtttcttctcttgcatggttcatgtcaaatcaggagacaagttttgttactattggtcagagactgttagccaaccctctaaaggttcggttccactatggtcatccggatgtatttgataggctctttcacctcacaagagggggtgtaagtaaagcatccaaagtcattaatttgagtgaagatatttttgctggcttcaattctacacttcgtgaaggcaatgtcacccatcatgaatacatacaagttgggaagggaagggatgtgggtctcaatcagatatctatgtttgaggcaaaaatagctaatggcaatggagagcagactttgagtcgggatatataccggcttggacatcgttttgactttttcagaatgctgtcttgttatttcactacagttggtttttacttcaatactttgataacagtgctcactgtctatgtgttcctttatggtcgcctctatcttgtactgagtggccttgaacaaggattaagtgagcaaccagcaattcgtgataataagcctcttcaagtggctcttgcttctcaatcttttgttcaaattggatttttgatggcattacctatgttgatggagattggcttggaaaggggtttccgaactgcattaagtgaatttatattaatgcagttgcaattggcaccagtatttttcacattttctcttggaacaaagacccactattatggaaggacattgcttcatggaggtgcaaagtacaggcctacaggccgagggtttgtggtgttccatgccaagtttgctgacaactaccggctttattcacgtagccattttgtgaagggtattgagatgatgatcttgcttctagtgtaccaaatctttggtcatacttacagaagtgcagttgcttatgtattgatcactgtatctttgtggtttatggtgggcacatggctttttgctcccttcctattcaatccttctggtttcgagtggcagaagattgttgatgattggactgattggaataagtggataaacaaccgaggtggtataggtgtacctccagaaaaaagttgggaatcatggtgggaggaagagcaagagcatcttcaatattctgggaagcgtggtattattgctgagatattgttagctttacgattctttatctaccagtatgggcttgtctatcacttgaatgttatcaaagaaaacagaagctttttgatctatggtgcatcatggctggtgattgttctgatattatttgtgatgaagactgtatctgttgggaggcgaaagttcagtgcaagttatcaacttgtttttcggctcatcaagggattaatattcttgacattcgtggccattctggttactttgattgctctccctcacatgacacttcaagacattattgtgtgcattcttgcatttatgcctacaggttggggaatacttctgattgctcaagctttgaggccttttgttaagaaagctggtttttggggatcagtacgaactcttgctcggggttatgagatagtgatggggttgcttcttttcactccggtagcattcctggcctggtttccttttgtctcagaatttcagactcgtatgcttttcaaccaagcattcagtagaggtctgcagatttctcgtattcttggtggacaacgtaaagatcgcacttctcgtaacaaggagtaagcaatagtggtaatgatatgcatgttattgatccccctgattcaatcatggaacgctttgttaatagttgtaattatattatggatgaagaggggacagcaattttggcattgggaactgacccaattgcttaccacctagcatgactttgaacaatatttgtaagattatgatgaaacatactattattcaatttcatcaatatatctatatatattttgtgtgtaacttca

SEQ ID NO: 3017 - DNA, 6639 bp, Gossypium raimondii
aaatttgaatccacttaccagaaagaccttaggtgtgggttgtaatgtagacttgtgttttttcttagcttcactctctgctttgcttccattgagatggtttagtagcttaaaatcttctttctagtgatctaggaagtgagtgttttcctttttactttgttgagattttgagtggaagacgagggcaaaaatgtcctctagcagggggtcagatcagtcacagctgatgaggcggatcacccgaacgcagactgctggtaatctaggagagaccgcttttgacagtgaggtggtgccatcttctcttagcgagattgcacccattctccgtgttgccaatgaggtcgaatcaagcaacccaagggtggcttacctctgccgattctatgcatttgagaaagctcacaggttggatcccacttctagtggacgtggtgttcgccaatttaaaacagcactccttcagcgtcttgaaagagagaacgatccaactctacagggaagggttaagaaaagtgatgctcgtgaaatgcaaagtttttatcaacactattacaaaaaatacatccaggccttgacaaatgctgctgataaggctgatcgggcacaactcactaaagcataccagactgcgaatgttctttttgaggttttaaaggctgtcaatttgacacaatctattgaagttgaccgtgagattttggaagctcaagataaagttgcagaacaaacacaaattttggtcccctacaacatccttcctcttgatcctgatagtgcaaaccaggctattatgcaataccctgagatccaagcagctgtttatgctcttcgtaacacaaggggtcttccatggcccaatgatcacaagagaaagaaagatgaagacattctagattggcttcaagaaatgtttgggtttcagaaagataacgtggcaaatcaaagggaacatctgatcttattgcttgccaatgtccacataagacgatttccgaagcctgatcaacaacccaagttggatgaccatgcactgacagaagtgatgaagaaactttttaagaactacaaaaagtggtgcaagtacttggatcgcaaaagtagtctttggttgcccaccattcagcaggaagtgcaacagagaaaattattatacatgggtctgtaccttttaatatggggtgaagctgcaaacttgaggttcatgccagaatgcctttgctacatctatcatcatatggcatttgaactttatggtatgctggctggaaatgtcagtccactaactggagaaaacatccagccagcctatggaggagaggaggaagcttttctgcagaaagttgttacacccatctatgaagttattcgaagggaagctgaaaggagtaaacgagggaaatcaaagcattcacaatggagaaattatgatgatttaaatgaatacttctggtctgttgattgcttccgattgggttggccaatgcgtgctgatgctgatttcttttgtctgccaattgaacaacttgaaaaaaatggagataacaagccacaagctactagggaccgatgggtggggaaagttaactttgttgagatacgctcgttctggcatgtttttagaagctttgatcgaatgtggagctttttcattctctgcttgcaggttatgatcattgttgcttggaatggcaatggtcaaccaagttccatctttacgggtgatgtgttcaagaaagtactgtctgtctttattactgctgctatattaaagcttggccaagctgtccttgatgtaatccttagttggaaagcacagcagagcatgtcatttcatgttaagttaagatacatattgaaagttgtttcagcagctgcatgggtgattgttctgcccgttacttatgcttatacttcagacaatccttcaggaattgcgcgaacaatccaaagctggtttggcagtacctcaagttcaccttccttgttcattttagctgttgtgatttacttgtcaccaaatatgctggctgcaatattgtttctctttccgtttgttcgtcgattccttgaaagttcacactacaagattgtgatgcttatgatgtggtggtcacagcctcgtctctatgttggtaggggaatgcatgagagcacattttctctcttcaagtatacaatgttttgggtcctacttatcatcactaagttggcattcagttattatattgagataaaacctttagttcgtcccacaaaagctattatgtctgttcgggtaaggcatttccaatggcatgaatttttcccccaagcaaggaacaacataggcgttgtgattgctctctgggctccaatcattcttgtctattttatggatacccagatttggtatgcaatattctctacattatttggaggtatttatggtgcatttagacgccttggagagattcgaacattaggaatgctccggtctcgttttggatcattgcctggtgcttttaatgactgcttaattccaggggataagagcgagaaaaagaacaaaggattttggctttttttctctcgcagctttgggcagccactgtctaataaagagaaagaggctgcaaaatttgctcagttgtggaacaaaattatcagtagttttcgggaggaggatcttataagcaacaaggagatgaatctgttgcttgttccctattgggcagatcgtgatttagatcaaatccagtggccaccttttttgcttgctagcaagatcccaatagcgttagacatggccaaggacagtgatagcagggatagagaactgcaaaagcggattgaagctgacccttacatgttctgtgcaattcgtgaatgttatgcttcattccgaagcattattaggtttttagttgaagggcagcgtgagaaaagggttatagatgacatatttttcaaggttgacaaacgtatagcagatggtagtctaattaagacttacaaaatgagtgctgttcctagtctctgtgatcatattgtgaagttgataaaactcttgttggaaaataagcaagatgaaaggggtcaagtggtactttgtttccaggacatgctggagattgtgacaaaggacataatggcagaggaagaattctccagcttggaacatggagggtctgggcatgatgggatgaatccagatccacttcatcaattatttgatacaaaaaagttagatcaattatttgcttcaactggagctatcaaatttccaactcctgtttcagaagcatggagagaaaagatcaaccggctctatttattgcttaccacaaaggaatctgcaatggatgtaccctctaatatagatgctaggaggagaatttctttcttctcaaattctttgtttatggacatgcctgctgcacctaaagttcgcaatatgctttcttttactgttttaactccttactacacagaagaagttctcttctccttgcaagaattggaagagccaaatgaagatggtgtttccattctgttttacttgcagaaaatctttccagatgaatggaataactttcttgaaagggtggaacgaaacaatgaagaagaacttaaagaatctcctgaattagaagaaaaacttcgtctgtgggcatcatatagggggcaaactttaacaagaactgttagaggtatgatgtactatcgagaagcattggagcttcaggctttccttgatatggccaaacatgaagatttgatggaaggctataaggccatagaactaaatacagaggatagtgaagagaacagatcactgaaggcacagtgtgaagctgtagctgatatgaaatttatgtatgtggtgtcttgccaacaatatggcattcagaagcgatctggtagtgagcgtgctcaggacattctgaggcttatgacaaaatatccatcactccgtgtagcatatattgatgagattgaacaacgtagtgaggataggtcgaagaagcttaatggcaaggttaattatttctcagttctggtgagggctgtgccaaagtcctttgattcttcagagcaaaatctagaccaggaaatttatcggataaagcttccaggacctgctatcttgggtgaaggaaaaccagaaaaccaaaaccatgctatcatcttcacacgaggagaagggttgcagacgatagacatgaaccaggataattacatggaagaggccttgaaaatgaggaatttgttgcaagaattcctcaagaagcatgatggtgtgagataccctacaatacttgggctcagagagcacatatttactggaagtgtttcttctcttgcgtggtttatgtcaaatcaggagaccagttttgttactattggtcagcgactgttagccaaccctctaaaggttcgattccattatggtcatccagatgtatttgataggctctttcacctcacaagaggaggtgtcagtaaagcatccagagtcattaatttgagtgaagatatttttgctggcttcagttctacacttcgtgaaggcaatgtgactcatcatgaatacatacaagttgggaagggaagggatgtgggtctaaatcagatatctatgtttgaggccaaaatagctaatggcaatggtgagcagacattgagtcgagatatataccggctgggacatcgttttgactttttcagaatgctgtcttgttatttcactacagttggtttttatttcagtactctggtaacagtgcttaccgtctatgtgtttctttatgggcgcctctatcttgtactcagtggtcttgaacaaggattgagagaggaaccagcaatccgtgataataagcctcttcaagtggctcttgcttctcaatcttttgttcaaattggatttttgatggcactacccatgttgatggaaattggcttggaaaggggtttccaaactgcattgagtgaatttatattaatgcaactgcaactggcaccagtatttttcacattttctcttggaacaaaaacccactattatggaaggacattgcttcatggaggtgctaagtacaggcctacaggccgagggtttgtggtgttccatgcaaagtttgctgaaaactaccggctttattcacgtagccattttgttaagggtattgagatgatgatcttgcttatcgtgtaccaaatctgtggtcatacttacagaagtacagttgcttatgtattgatcactgtatccttgtggtttatggtgggcacatggctttttgctcccttcctattcaatccttctggttttgagtggcagaagattgttgatgattggactgattggaataagtggataaacaaccgaggtggtataggtgtaccttcagaaaaaagttgggaatcgtggtgggaagaggagcaagagcatcttcaatattctggcaagcgtggtattattgctgagatattgttagctttacgtttctttatctaccagtatgggcttgtctatcacttgcatgttacaagggaaaccaaaagttttttggtttatggtgcatcatggcttgtgattgttctaatattgtttgtaatgaagactgtatctgttggaaggcgaaagttcagtgcaagctatcagcttgttttccggctcatcaagggattaattttcttgacatttgtgtccattctggttattttggtcacacttgctcatatgacaattcaagacattatagtgtgtatttttatcttcatgcctacgggttggggaatgcttctgattgctcaagctttgaggcctgttgtaaagaaagctggtttttggggatcagttcgaacacttgctcgtggatatgagattgtaatgggcttgcttcttttcactccagttgcattccttgcctggtttccatttgtctctgagttccagactcgaatgcttttcaaccaagcattcagcagaggtctgcagatttctcgtattctaggtggacaccgtaaagatcacgcttctcgtcacaaggagtaatatactaagtggctgcaggttgtaattatattgatgttgtcgatccctcacttgaattcaatcttgaaaatcttgtcaattgttgtaattatactgtggttattgatggaaggggcttggcaattttggcattttgaatggaacagtcttatgatatgggtgccaatgtattattctgcatacctattacttttgtcggctaaacactgctgggaaatgggaatggatgtcatgaattactttttaagggcagagtcttaggcaattcaatttccttgcaccctgcattaacaactaatgtggagattgattttgtcatacattactcgtccgagtatagtagttgattaatattttgatttgttagtgctatttgcataggtacaagcctatgtcgagcaactatgggacgagtgaaacctgatgcattgaaaaaagaataggaaaaagattttattgtctgtaaattattattattttcattatttttttttcaagtgcttgaatgtaaaatgaacacggaataaatcgattgccctattttgtatgaactgcctgaatgaactaattgaaataatagagatcattctact

SEQ ID NO: 3018 - DNA, 6313 bp, Arabidopsis thaliana
ttcactttgcgtacttagcagctaagtagcttaaaaagttgtggctcctttgctccgccattgttagggtttctggatctccgtttctctggaggctgaggaaaccttaaaacgatttaaaacctggaggttatagggtagacaaaatgtctgctacgagaggaggtcctgatcaagggccgtctcagcctcagcagcggcggattatacgaactcagactgctggtaatcttggagagtcattcgatagtgaagttgttccatcatctcttgttgagattgcccccattcttcgggttgctaatgaagttgaatctagtaatcctagggttgcgtatctctgtcggttttatgcatttgagaaagcacatagattggatcctacctccagtggaagaggtgttcggcagtttaagactgcacttctacagcgtcttgaaagagaacatgatccaacactgatgggcagggttaagaaaagtgatgcccgtgaaatgcaaagcttttatcaacactactataagaagtatattcaagctttgcacaatgctgctgataaggctgaccgtgcccagctgacaaaggcataccaaactgccaatgttttgtttgaggtgttgaaggctgttaatctgacacagtccattgaggttgaccgggagattctggaagctcaagataaggttgcagaaaagacacagttgtatgtcccctataatatcctacctctcgatcctgatagtgccaatcaagcgattatgagatatcctgagatccaagctgctgttcttgctctccgcaatactagaggtcttccttggccagaaggtcacaagaaaaagaaagatgaagacatgcttgattggcttcaagaaatgtttggatttcagaaagacaatgtggctaatcaaagggagcatctgatcttattacttgctaatgtgcatataagacaatttcctaagcctgatcagcagccaaagtttatcctttcgtttgttctcattgtgccctcacagttagatgatcaagcattgacagaagtgatgaagaagcttttcaagaactataagaaatggtgcaaataccttggtcgaaagagtagtctttggttgccaactatacagcaggaaatgcagcagcgcaaactattgtatatggccctgtatcttctaatttggggtgaagcagcgaacttgagattcatgccagagtgtctctgctacatttatcatcatatggcatttgaactctatggtatgctggctgggaatgttagtcctatgactggggaaaatgtgaagccagcttatggaggcgaggaagatgcattcttgaggaaagttgtgactcctatttatgaagtgattcagatggaggctcaaagaagcaaaaaagggaagtctaagcactctcagtggaggaactacgatgatttgaatgaatacttttggtcagttgattgttttcggttaggttggccaatgcgagctgatgctgatttcttttgtctgcctgttgctgtacccaatacagaaaaggacggggataacagcaagcctattgtcgccagagatagatgggttggtaaagttaattttgttgagattcgttctttctggcatgtcttcagaagtttcgatcgaatgtggagcttctatattctgtgcctccaggccatgattattatggcctgggatggcggacaaccaagttcagtctttggagctgatgtattcaagaaagttctgagcgtgtttatcacagctgcaataatgaaacttggacaagctgttcttgatgtgatccttaatttcaaagctcatcaaagcatgacactacatgttaaactaagatacattctgaaagtgttctctgctgctgcctgggttattattctgcctgttacttacgcctacagctggaaagatcctccagcatttgccagaactatcaagagttggtttgggagtgctatgcactcaccttctctatttataatagcagtcgtttcctatttgtcacctaacatgctcgcggaaactaacgaaaaccttctgttgtgttgtttaactgatgtgactataattaacaccttgcagcccagactctacgttggcagaggaatgcacgagagcgcattttccctcttcaaatataccatgttctgggtgttgcttattgcaacaaagctggcattcagttactacattgagatcaggcctttagttgccccaacacaagccattatgaaggcccgtgtgacaaattttcagtggcatgagttctttcctcgtgccaaaaacaatattggtgtcgttatcgccctctgggcccccattattctggtatattttatggatagtcagatttggtatgctatattttccacattatttggaggtatctacggtgcattccgccgccttggagagattcggacactgggaatgctcagatcacggtttgaatcactgcctggagcttttaatgaccgcttaattccagatggaaagaaccagcaaaagaagaagggaataagggcaacgttatctcataactttacggaggataaggtacctgtgaacaaagagaaagaagctgcaagatttgcacagttgtggaacacaataattagtagttttagagaggaagatcttataagtgatagggagatggatctgttgcttgttccttattgggctgaccgtgatttggatctcatacagtggcctcccttcttattggctagcaagattccaatagcattagatatggcaaaagacagtaatgggaaggacagagagctcaagaagaggattgagagtgacacttacatgaaatgtgctgtccgtgaatgctatgcttcattcaagaatatcataaaatttgtggttcagggaaaccgtgaaaaagaggtgatagagatcatatttgcagaggttgacaaacatatagatacaggggatttgattcaagaatacaagatgagtgctcttcctagcctctatgatcactttgtcaagttgatcaaatatttggtaaatgttcttcctgtgcttgacaataaggaggaagatagagatcacgttgtaattctcttccaagacatgctggaagttgtaacaagagacattatgatggaggattacaatatatcgaggttggcgactttctaccgcaccgcaatggcttgtcattcaagtcatggtggcacttggcatgggggaatgatccctctcgaacaacaatatcagctgtttgcatcctcaggtgccattagatttcctattgaaccagtaacagaagcttggaaagagaagatcaaacggatatatcttttgttgactactaaagagtctgctatggatgtcccctctaacttggaagcaagaaggcggatctcattcttctcaaattcgttgttcatggacatgcctatggcacctaaagttcgcaacatgctatcattttctgttttgactccttattacactgaagaggtcctcttctccttgcgggacctggaaacaccaaatgaagatggtgtttcaatcctcttctacctacaaaagatttttccaggtgatttttgttcatatgctgttaacgtagcctatattcttgaatcacgtcttgaacctgaccttttatctccagatgaatggaacaattttcttgagcgggtgaagtgcttaagtgaagaggaacttaaggagtctgatgaattagaggaggaacttcgtttatgggcttcatatagagggcaaactttgactagaactgtaagaggaatgatgtactatcgaaaagccttggagcttcaggcattccttgacatggctatgcatgaagatttgatggaaggttacaaggctgtagaactaaattcagagaacaattcaagaggtgaaagatcactctgggcacagtgccaagctgttgctgacatgaagtttacatatgttgtatcatgtcaacaatatggtatccataaacgatccggtgatcctcgtgcgcaggatatattgaggcttatgacaagatacccttcactccgtgttgcatatattgatgaggtcgaagaaccagtgaaagacaagtcaaagaaagggaaccagaaagtgtattattctgtgttggtaaaggtgcctaagtcaactgatcattctaccctagcacaaaatctggaccaggttatctacaggattaggcttcctggacctgctattcttggagaaggaaagccagaaaaccaaaatcatgctatcattttttcccgtggagaaggtttacagacaatcgatatgaatcaggataattacatggaggaagcgttaaagatgaggaatttgcttcaagaatttcttacaaaacatgatggtgttagacatccatccattcttggacttagggaacatatatttactggatcagtttcatcccttgcttggttcatgtcaaatcaagagactagttttgttaccattggtcagagattattggcaaatccattgagggtgcgtttccattatggccatccagatgtttttgatagactgtttcatctaacaagaggtggtgttagcaaagcatccaaggtaatcaacctcagtgaagatatatttgcaggattcaattctacacttcgtgaaggaaatgttacccatcatgaatacatacaagttggtaaaggaagagatgttggtctaaatcagatctctatgtttgaggccaagattgctaacggcaatggagagcagacattaagtcgggatatttacaggcttggacaccgttttgactttttccgaatgatgtcatgttacttcaccactgttggcttttatttcagcaccctgattactgttctcactgtctacatcttcctttatggacgtctctatcttgttttgagtgggctcgaacaaggtttaagtacgcagaaaggcatccgagacaatacacctttgcaaatagctctggcttcacagtcttttgtccagattggtttcctgatggctttacctatgcttatggaaattggattagagaggggttttaggactgccttgagtgaatttgtgctgatgcagcttcagttggcgccagtgttctttacgttctctcttgggacaaagactcactactatgggaggacgttacttcatggcggtgccaagtacaggtccacaggaagaggatttgtcgtctttcatgccaaatttgctgataattacagactgtattcccggagccattttgtgaagggacttgaaatgatgctgctactcgttgtgtatcaaatatttggtagtgcttacagaggcgtccttgcatatcttttgatcaccatatctatgtggttcatggtcgggacctggctttttgctcccttcctcttcaatccttctggttttgaatggcagaagattgttgatgattggactgattggaataaatggataaacaacatcgggggtattggtgttccggcagaaaaaagttgggaatcgtggtgggaggaagagcaagaacatctccggtattccggaaaacgtggtatagttgttgagattttgctagcactgcggttctttatctatcaatatgggcttgtttatcatctcactataacagagaagactaaaaactttctggtttatggagtatcatggctggtgattttcttgatattgtttgtgatgaagactgtttcggttggaaggcggagattcagcgcgagttttcagctgatgttccggttgataaaggggctgatattcatgacgtttatcgcaattattgtgatattgatcacactggctcacatgacgatacaagacataattgtgtgtatccttgcctttatgcccacaggttgggggatgctcttgattgcgcaagcgtgtaagccggtggttcatagagcaggattctggggatcagtgaggaccctagctcgtggatacgagatagtaatgggactgttgctgttcacgccagtggcgttcttggcatggtttccatttgtgtcagagttccaaacgcgtatgctctttaatcaagctttcagtagaggtcttcagatctctcgtatccttggaggtcatcgtaaggatcgctcttctcgaaacaaggaatgattcatctcttcattgtaatgacagggaagggatcttaatttatcccttttttatcttcatggatgattagggttaatgtaatttagttttcaatatatcgcttaggtaaaaacattgtagtattcatctataaattagacgttatctatcatttaatgactgtttaa

SEQ ID NO: 3019 - DNA, 6893 bp, Gossypium raimondii
acctcactccaccaatagcagttaaaaggaaaaaaaaaaaggaaaaagatagaagggaagagaccatagctgtgggttgtaatgtaaacttgtgtttttttcttagcttcactctcttttttgcttcctttgatgctaagtagcttaaagtagccgcccttctgtttctccctctctatatctggttttctcttctctcttagggtttttctctctgtgagctctctttctagttttgctttctaattttctcctcacattacctttactgtttcagtgtttaccctgttcctgtctatgcagatgatttaatagcttaaaatcttctttctagtgacctgggaagtgagtgtttttcccttttttctgttgagattctgggtggaagacgagggcaaaaatgtcctcgagcagggggtcagatcaatcacagccgatgaggcggatcacacgaacacagactgctggtaatctcggagaggccgcttttgatagtgaggtggtgccatcttctcttagcgagattgcacccattctccgtgttgccaatgaggttgaatcaagcaacccaagggtggcttacctctgccgattctatgcatttgagaaagctcacaggttggatcccacttctagtggacgtggcgttcgccaatttaaaactgcactccttcagcgtctcgaaagagagaatgatccaactctacagggaagggttaagaaaagtgatgctcgtgaaatgcaaagtttttatcaacactattacaaaaaatacatccaggccttgacaaatgctgccgataaggctgatcgggcacaactcacaaaagcataccagactgcaaatgttctctttgaggttttaaaggctgtcaatttgacacagtctattgaagttgaccgcgagattctggaagctcaggatagagtagcagaacaaacacagattttggtcccctacaacatccttccgcttgatcctgatagtgcaaaccaggctattatgcaataccctgagatccaagcagctgtttatgctcttcgtaatacaaggggtcttccttggcccaatgatcacaagagaaagaaagatgaagacattctagattggcttcaagaaatgtttgggtttcagaaagataatgtggcaaatcaaagggagcacctgatcttattgcttgcaaatgtccacatacggcaatttccgaagcctgatcaacaacccaagttggatgaccatgcactgacagaagtgatgaagaaactttttaagaactacaaaaagtggtgcaagtacttggatcgcaaaagtagtctttggttgcccaccattcagcaggaagtgcaacagagaaaattattgtacatgggtctgtaccttttaatatggggtgaagctgcaaacttgcggttcatgccagaatgcctttgctacatctatcatcatatggcatttgaactttatggtatgctggcgggaaatgtcagtccactgactggagagaatatccagccagcctatggaggagaggaggaagcttttctgaagaaagttgttacacctatctatgaagttattcgaagggaagctgaaaggagtaaacgagggaaatcaaagcattcacaatggagaaattatgatgatttaaatgaatacttctggtatggaatttttatttacaacttttatctgtccacactgttatactcggcgatttatttacctttgtttaattttaggtctgttgattgcttccgattgggctggccaatgcgtgctgatgctgatttcttttgcctgccaattgaacaacttgttgaaaaaaatggagataacaagccacaagctactagggaccgatgggtggggaaagttaactttgttgagatacgctcgttctggcatgtttttagaagctttgatcgaatgtggagctttttcattctctgcttgcaggttatgatcattgttgcttggaatggcaatggtcaaccaagttccatctttacgggtgatgtgttcaagaaagtgctgtctgtctttattactgctgctatattaaagcttggccaagctgtccttgatgtaatccttagttggaaagcacagcagagcatgtcatttcatgttaagttaagatacatattgaaagttgtttcagcagctgcatgggtgattgttctgccggttacttatgcttatacttcagacaatccttcaggaattgcgcgaacaatccaaagctggtttggcagtgcctcaagttcaccttccttattcattttagctgttgtgatttacttgtcaccaaatatgctggctgcaatattgtttctctttccgtttgttcgtcgattccttgaaagttcacactacaagattgtgatgcttatgatgtggtggtcacagcctcgtctctatgttggtaggggaatgcatgagagcacattttctctcttcaagtatacaatgttttgggtcctacttatcatcactaagttggcattcagttattatattgagataaaacctttagttggtcccacaaaagctgttatgtctgttcggataacgcgtttccagtggcatgaatttttcccccaagcaaggaacaacataggcgttgtgattgctctttgggctccaatcattcttgtctattttatggatacccagatttggtatgcaatattctctacactatttggaggtatttatggtgcatttcgacgccttggagagattcgaacattaggaatgctccggtctcgttttggatcattgcctggtgcttttaatgcccgcttaattccgggggataagagcgagaaaaagaaaaagggattttggctttttttctctcgcagctttgggcagccacggtctaataaagagaaagaggcggcaaaatttgctcagttgtggaacaaaataatcagtagttttcgggaggaggatcttataagcaacaagtatttacactctgttctccatgttatatatgtgttacattcatcttactgtttctatgtattgagttgttttatttttagggagatgaatctgttgcttgttccctattgggcagaccgtgatttagatcaaatccagtggccaccttttttgcttgctagcaagatcccaatagcattagacatggccaaggacagtgatagtagggatagagagctgcaaaagaggattgaagctgacccttacatgttctgtgcaattcgtgaatgctatgcttcattcagaagcattattaggtttctagttgaagggcagcgtgagaaaagagttatagatgacatattttccaaggttgacaaacgtatagccgatggtagtctgattaagacttacaaaatgagtgctcttcctagtctctatgaccacattgtgaagttgataaaacttttgttggaaaataagcaggacgaaaggggtcaagtggtactttgtttccaggacatgctggagattgtgacaaaggacataatggcggaggaagaattctccagcttggaacatggagggtctgggcatgatgggatgattgatccacttcatcaattatttgatacaaaaaagttagatcagttatttgcttctactggagctatcaaatttccaactcctgtttcagaagcatggagagaaaagatcaaccggctctatttattgcttaccacaaaggaatctgcaatggatgtaccctctaatatagatgctaggaggcgaatttctttcttctcaaattctttgtttatggacatgcctgctgcacctaaagttcgcaatatgctttctttctctgttttaactccttactacacagaagaagttctcttctccttgcaagaattggaagagccaaatgaagatggtgtttccattctgttttacttgcagaaaatctttccagatgaatggaataactttcttgaaagggtggaacgaaacaatgaagaagaacttaaagaatctcctgaattacaagaaaaacttcgtctgtgggcatcatatagggggcaaactttaacaagaactgttagaggtatgatgtactatcgagaagcattggagcttcaggctttccttgatatggccaaacatgaagatttgatggaaggctataaggccatagaactaaatacagaggatagtaaagagaacagatcactgaaggcacagtgtgaagctgtagctgatatgaaatttacatatgtggtgtcttgccaacaatatggcattcagaagcgatctggtagtgagcgtgcacaggacattctgaggcttatgacaaaatacccatcactccgtgtagcatatattgatgagattgaacaacgtagtgaggataggtcgaagaagcttaatggcaaggttaattatttctcagtgctagtgagggctgtgccgaaatccattgattcttcagagcaaaatctagaccaggaaatttatcggataaagcttccaggacctgctatcttgggtgaaggaaaaccagaaaaccaaaaccatgctattatcttcacacgaggagaaggcttgcagacaatagacatgaaccaggataattacatggaagaggccttgaaaatgaggaatttgttgcaagaattcctcaaaaagcatgatggtgtaagatacccaaccatacttgggctcagagagcacatatttactggaagtgtttcttctctcgcgtggtttatgtcaaatcaggagaccagttttgttactattggtcagcgactgttagccaaccctctaaaggttcgattccattatggtcatccagatgtatttgataggctctttcacctcacaagaggaggtgtcagtaaagcatccaaagtcattaatttaagtgaagatatttttgctggcttcaattctacacttcgtgaaggcaatgtgactcatcatgaatacatacaagttgggaagggaagggatgtgggtctaaatcagatatctatgtttgaggccaaaatagctaatggaaatggtgagcagacattgagtcgagatatataccggctgggacatcgttttgactttttcagaatgctgtcttgttatttcactacagttggtttttatttcagtactctggtaacagtgctcaccgtctatgtgttcctttatgggcgcctctatcttgtactcagtggccttgaacaaggattgagtagggaaccagcaatccgtgataataagcctcttcaagtggctcttgcttctcaatcttttgttcaaattggatttttgatggcactacccatgttgatggaaattggcttggaaaggggtttccgaactgcattgagtgaatttatattaatgcaactgcaactggcaccagtatttttcacattttctcttggaacaaaaacccactattatggaaggacattgcttcatggaggtgctaagtacaggcctacaggccgagggtttgtggtgttccatgcaaagtttgctgaaaactaccggctttattcacgtagccattttgttaagggtattgagatgatgatcttgcttatcgtgtaccaaatctttggtcatacttacagaagtacagttgcttatgtattgatcactgcatccttgtggtttatggtgggcacatggctttttgctcccttcctattcaatccttctggttttgagtggcagaagattgttgatgattggactgattggaataagtggataaacaaccgaggtggtataggtgtaccttcagaaaaaagttgggaatcgtggtgggaagaagagcaagagcatcttcaatattctggaaagcgtggtattattgctgagatattgttagctttacgtttctttatctaccagtatgggcttgtctatcacttgcatgttacaaggaaaaccaaaagttttttggtttatggtgcatcatggcttgtgattgttctaatattgtttgtaatgaagactgtatctgttggaaggcggaagttcagtgcaagctatcagcttgttttccggctcatcaagggattaatattcttgacatttttgtccattttggttattttggtcacacttgctcatatgacaattcaagacattatagtgtgtatttttatcttcatgcctacgggttggggaatgctcctgattgctcaggctttgaggcctgttgttaagaaagctggcttctggggatcagttcgaacacttgctcgtggatatgagattgtaatgggcttgcttcttttcactcctgttgcattccttgcctggtttccatttgtctctgagtttcagactcgaatgcttttcaaccaagcattcagcagaggtctgcagatttcacgtattctaggcggacaccgtaaagatcgcacatctcgtcacaaggagtaatatactaagcagccgcagtttgtaattatattgatgttattgatccctcgcatgaattcaatcttgaaaatctcgtcaattgttgtaattatattatggttatggatgtaagagggggcttggcaattttggcattttgaatggaacagtcatatgatatgggtgccaattgtttaaccctagcatggttctgaacaaaatttgcaagttttaccaatgtattattctgcatatctattacttttgtcggctaaacgccgctgggaaataggcatgaatgttatgaattgctttttaagggcagagtcttaggcaattcaattcccttgcaccctgcattaatattgtgaacaataaaacgtgcttatgggttaggtttggcttagcagtggcaaataggcgggtttcggcatgcttggaccgagttgtctttggatttagattattttgtgtttattccaaagagattaagaatatttta

SEQ ID NO: 3020 - DNA, 5147 bp, Phaseolus vulgaris
atgactggagagaatgtgaagccagcttatggaggtgaagaagaagcatttttaaggaaagttgtcactcctatctacaacgtgattgctaaggaagctgcacgcagcaaaaaaggaaggtcaaagcattcacagtggaggaactatgatgatttaaatgaatatttctggtctggtgattgttttcggttaggttggccaatgcgtgctgatgctgatttcttttgcctgccttccgaaaactcattttttgataaatctaatgatgacaaaccacctagcagagacagatgggttgggaaagtgaattttgttgagataagatcattttggcacattttcagaagttttgaccgaatgtggatttttttcattctgtgtttacaggctatgattattgttgcttggaatggatctggtgatccaagtgtgatctttaatggtgccgtgttcaagaaggtgttgagtgtgtttataacagcagctatattgaagtttgggcaagctgtccttgatgtgatcctgagttggaaagcacaatggagtatgtcgctgtatgtgaagttaagatacattctaaaagttgtttcagctgcagcatgggtgattgttctgtcagttacttatgcttatacttgggataatcctcctggatttgctcaaaccattaaaagttggtttggaaatggtggttcaagtgctccttcattgtttattttggctgttgtggtttacctgtcgccgaatatgcttgctgcaatattctttctgattccttttattcggcgtcatcttgagaggtcaaactatagggttgtgatgctaatgttatggtggtcacagcctcgtttgtatgttggtaggggaatgcatgagagcacattttcccttttcaagtacacaatgttttgggtgcttctcataattacaaagttggctttcagttactatattgagataaaacctcttgtgggacctacaaaagctataatgagtgtaaaaatcacaactttccagtggcacgaattctttcctcatgcaaggaacaatattggtgttgtaattgcactttggtctccgattatcctggtatacttcatggatacccaaatttggtatgccatattctcaacattatttggtggtatttatggtgccttccgtcggcttggggagatacggacactaggaatgctaaggtctcgttttgaatcattgcctggtgccttcaatgccagtttgattcctgaagaagcaagtgagccaaagaaaaaaggattaaaagccactttgtcccgcagatttcccaatatctcatctaacaaggggaaggaggctgcaaggtttgcacaactgtggaaccaaataattactagtttcagggatgaagatcttattagtgatagggaaatggaccttttgcttgtaccatattgggctgatactcagttggaccttatacaatggcccccctttctacttgctagcaagatcccaattgcactagatatggctaaggacagcaatggaaaggatcgagagctaaagaaaagaattgggcttgatacttacatgtcttgtgctgtccgtgagtgctatgcttcatttaagagcattattaagcatttggttcaaggggaacgggagacaaaggttatagagtacatgtttgatgaagtggataaacatatagaatcagataaactgattgttgaattcagaatgagtgcacttcctaacctctgtaaacagtttgttcagctaatagagtatttgttggcaaatgatccaaaagatagggacctagttgtgattctattccaggacatgctggaggttgtgacaagagatataatgatggaggaccaggatcaaatattcagtttggtggattcaacccatggtggtaccgggcatgaggggatgcttcaccttgagcctgagccccatcaccaattgtttgcatctgaaggagctatcaagtttccaattgaaccatttactgcagcttggacagagaagattaaacgacttttcttgctgcttacgacaaaagaatctgccatggatgtaccatctaacttagaagcaagaaggcgtatatctttcttctcaaattcattgtttatggacatgcctttggccccaaaagttcgcaacatgctttcattctcggttttgacaccatactatacagaagaagtactattctccttacaagacttagattcacctaatgaagatggtgtttcaatactgttctacttgcaaaagatttttccagatgagtggaacaattttattcagcgtgtgaagtctactgaggaggatattaaagggtgtgaatctgatgagttagtggaagaacttcggctttgggcatcatatagagggcaaacattgaccagaactgtaagaggtatgatgtattacagaaaagctctggaactgcaggcgtttcttgatatggccaaagatgaagatttgatggaaggttataaagccgtagaaaactcagatgacaattcaaggggggaaaggtcattgtggacgcaatgtcaagcggtagctgatatgaaattcacatatgtggtatcatgtcaacaatatggcattgacaagcggtctggttctcgccttgcacaggacatattaaggcttatgacaagatatccgtctcttcgagttgcctatattgatgaggtagaggaacctgtcaaagacagtaagaaaaagatcaacaaggtttactactcttgcttggtgaaggctatgccaaaatcaaatagtgcttcagagcctgagcagaatctggatcagattatatataaaataaagcttcctggaccagcaattttgggtgagggtaagcctgaaaatcagaatcatgccataattttcacacgtggagagggcttgcaaacaatagatatgaaccaggataattacatggaagaagctttgaaaatgagaaatttgttgcaagagtttcttaaaaagcatgatggtgttcggttccctagtatccttggacttagggagcatatatttactggaagtgtttcttccctcgcatggttcatgtcaaatcaggagacaagttttgtgacaattggtcagagattgttggctaatcctttgaaggttcgtttccattatggtcaccccgatgtctttgatagactttttcacctcacaagagggggtgtgagtaaagcctccaaggttatcaatctaagtgaagatatttttgctggctttaactctacactacgtgaagggaatgttactcaccatgagtacatacaagtagggaagggaagagatgtgggtctcaatcagatatctatgtttgaagcaaaaatagctaatggcaatggggagcaaacacttagtcgagatgtataccgacttgggcatcgttttgacttcttcagaatgttgtcttgttatttcaccacagttggattttatttcagcactcttataactgttctcactgtatatatattcctctatggtcgcctttatcttgttctcagtgggctcgaagaaggtctgagcactcaaaaagccattcgagataataagcctcttcaagtagctcttgcatctcagtcgtttgttcaaattggggttttgatggccctgcctatgttgatggaaatcggtttggagaggggcttccgaactgctctcagtgagttcatattaatgcaactgcagctggccccagtattctttacattttcacttgggacaaaaactcattattttggaagaacattgctgcatggaggtgctaaatatagaccaactggtcgaggatttgtggttttccatgctaaatttgctgacaactacagactttactctcgtagccactttgtgaagggtattgagctcatgatactgcttattgtgtatcaaattttcggtcattcttacagaagtgctgttgcatatatcttgattactgcatcaatgtggtttatggtgggtacctggctgtttgctcctttcttgttcaatccttctgggtttgaatggcaaaaaattgttgatgattggactgattggaataaatggattagtaatcgagggggtataggtgttctacctgaaaaaagttgggaatcttggtgggaagaggaacaagagcatctccaatattcaggactgcggggaatcatagtggagatactgttatcattgcgattttttatctaccagtatggtctggtatatcacttgaatattacgaaaaaaggccaaaaaagttttctggtctatggcatttcatggttggtgatatttgtagtattgtttgtaatgaagacggtatctgttgggaggcgtaaattcagtgcaaattttcaacttgtcttccgtctaatcaagggaatgatattcctcacttttgtctcaattctagtcattttgatagcccttccgcacatgacagtgcaggacatagttgtttgcattcttgctttcatgccaactggttggggaatgctgcagattgctcaagcattaaaacctttagtacggcgggctgggttttggggatcagtgaaaactcttgctcgaggttatgagattgtgatgggtttgcttctgttcactccggttgcttttctggcttggtttccttttgtttcagagtttcaaacccgtatgctgttcaaccaagcattcagcagaggtttgcaaatttctcgtattcttggtggccaaaggaaggagcgatcgtctcgcaacaaggaatagttttccaactatgatggcttagtattcggatgtaccaattgtaagtagttgtaacttgtaacttgtatctatgaatgacagattctacacttcgctttcattacaacgttaaattatcattatcaaatattcaagttatcaagtctttcacctacaaaaaccaaaagctcaatccaactttcttttgggtgataaccagagtgagtggacattcgagtgtggcgtaattcgtttactattataatattgaatggttaagaggtgatatgtattattaatttcatttttttgtaaaatatacgttagtttaatcatttgccccgactttttgtaattaaaattattatggaaatgcgatatgtatgttgaggtga

SEQ ID NO: 3021 - DNA, 6370 bp, Theobroma cacao
gcaagatgaaaagaaacagctttttttcttgcagcgaagttagtgtttttttccctgttgagattttgggtggaaggcgagggcaaagatgtcctcgagcagggggtcagatcaatcgcaaccgctgaggcggatcacacgcacgcagactgctggtaatctaggagagacagcttttgacagtgaggtggtgccatcttctcttagcgagattgcacccattctccgtgttgctaatgaggtcgaatcaagcaacccaagggtggcttatctatgtcgattctatgcatttgagaaagctcacaggctggatcccacttccagtgggcgtggtgttcgccaatttaaaactgcactgcttcaacgtcttgaaagagagaatgatccaactctacagggaagggttaagaaaagtgatgcccgtgaaatgcaaagtttttatcaacattactacaaaaagtacatccaggcattgacaaatgctgctgataaagctgatcgggcgcaacttacaaaagcataccaaaccgcgaatgttctttttgaggttttgaaggccgtcaatttgacacaatctattgaagttgaccgtgagattttggaagctcaagataaagttgcagaacagacacagatcttggtcccttacaacatccttcctcttgatcctgaaagtgcaaaccaggctataatgcaatatcctgagatccaagcagctgcttatgctcttcgtaacactaggggtcttccatggcccaaagaccacaagagaaagaaagatgaagacattctagattggcttcaagaaatgtttgggtttcagaaagataatgtggcaaatcaaagggagcatttgatcttattgcttgcaaatgtgcacatacggcaatttccaaagcctgatcaacaacccaagtgtcgtaaagaggtgaaacaagatgaagtagagcagcatagaggatttggaatggtcgctagagtatggagtgctgtggtaggtggaatgattgaaaggttagaaagaattgattctcaagcagcggttaaggaatgtgatgatgtgttgaataggagacatgggttgccaaccattcagcaggaagtgcagcagcgaaaattattgtacatgggtctgtatcttttaatatggggtgaagctgcaaacttgagattcatgccagaatgcctttgctacatctatcatcatatggcatttgaactttatggtatgctagctggaaatgtcagtcctatgaccggagagaatgtgaagccagcctatggaggcgaggaggaggcttttttgaagaaagttgttacacctatctatgatgttattcggagggaagctgaaataagtaaacgagggaaatcaaagcattcacaatggaggaattacgatgatttaaatgaatacttctggtccgttgattgtttccggttgggttggccaatgcgtgctgatgctgatttcttttctcggccaattgatcaacttcgtgagaaaaatggggataacaagccatctactaatgatcgatggatggggaaagttaactttgttgagatacgctcattctggcatgttttcagaagctttgatcgaatgtggagttttttcatcctgtccttgcaggccatgattattattgcttggcatggctcggggcaaccaagttcaatctttaggggtgatttgttcaagaaagtgctgagtgtcttcataactgctgctatattgaagcttggccaagctgtccttgatgtaatccttagctggaaagcacagcagagcatgtcatttcatgttaagttaagatacatattgaaagttctttctgcagccgcgtgggtgatcgttctacctgtcacttatgcttatacttgggacgatccttcagggtttgcacgaaccatccaaagctggtttggcaatacctcaaattcaccttccttgtttattttggctgttgtaatttacttgtcaccaaatatgctggccgcaatgttgtttctttttccattcattcgtcgattccttgaaagttcacactacaaaattgtgatgcttatgatgtggtggtcacagcctcgtctctatgttggtagggcaatgcacgagagcacattttctctcttcaagtatacaatgttttgggtcctacttatcatcactaagttgacatttagttattatattgagataaagcctttagttggtcccacaaaagctgttatgtctgttcggataagtaaattccaatggcatgaatttttcccccgagcaaagaacaacattggtgtcgtgattgctctctgggctccaatcattcttgtctattttatggatacccagatttggtatgcaatattctccacattgtttggaggtatttatggcgcatttagacgacttggagagattcgaacattaggaatgctcagatctcgttttgaatcattgcctggtgcttttaatgcccgtttaattccagaggatctaagcaagaaaaagaggaaaggagtttggggttttttctctcgcagctttgggcagccaccatctaataaagagaaaggggctgcaaaatttgctcagttgtggaacaaaataatcagcagttttcgacaggaagatcttataagcaataaggaaatgaacctgttgcttgttccctattgggctgaccgtgatttagagcaaatccagtggccaccatttttgcttgctagcaagatcccaatagcattggatatggccaaggacagtgatagcagggataaagagctgcaaaagagaattgaagctgacccttacatgttctgtgcaattggtgaatgctatgcctcattcagaagtattattaagtttttggttgaagggccccgggaaaaagaggttataaatgacatattttccaaggttgacaaacgtatagaagatggtagtctaattatggcttacaaaatgagtgctctccctagtctctatgaccatattgtgaagttgatcaaatttttgttggaaaataagcaggaggaaaggggtcaagtggtactctgtttccaggatatgctggagactgtgacaaaagacataatgacagaggatgaaatctccagtttggtggattcaatacatggagggtccgggcatgaggggatgatcctacttgatcaacattatcaattatttgatcaaaaaaaattagatcaattatttgcctctgctggagccatcaagtttccaatatctcctgttacagaagcgtggaaagaaaagatcaaccgactttatctgttacttaccacaaaggaatctgctatggacgtgccatctaatttagaggctaggaggcgaatttctttcttttcaaattctttgtttatggatatgcctgctgcgcctaaagttcgcaatatgctttcattctctgttttgactccttactacacagaggaagttcttttctccttgcaagaattggaaaatccaaatgaagatggtgtttccatcctcttttacttgcaaaaaatctttccagatgaatggaataactttcttgaacgggtgaaatgcagcagtgaagaagaacttaaagaatctcctgagttagaagaacaccttcgtttatgggcatcatataggggccaaactttaacgagaactgttagaggtatgatgtactatcgtgaagctttggagctgcaggctttccttgatatggccaaacatgaagatttgatggaaggctataaggccatagaattaagtacggaggataacaaagaggataggtcactgaaggtacagtgtgaagcagtagctgatatgaaattcacatatgttgtgtcttgtcaactatatggcattcagaagcggtctggtgaccagcgtgcacaggacattctgaggcttatgactaaatacccgtcacttcgcgttgcatacattgatgaggttgaacaacgtaatgaggataggttgaagaagcttaatggcaaggttaattacttttctgttctagtgagggctgtgccaaagtctagtgattcttcagagccggtgcaaaatctagaccaggcaggacctactgccaaatggttttgggttggatgcctttttatagtatcagagcttaggtatacttttttgttttgttgggattatcgccttttatttgatgtccatgtggaaatttatcggataaaacttccagggcctgctatcttgggtgaagggaaacctgaaaaccaaaatcatgccattatcttctcacgaggagaaggcttgcaaacaatagatatgaaccaggataattacatggaagaggcattgaaaatgaggaatttgttgcaagaattcctcacaaagcatgatggtgtaagatacccgacaattcttgggcttagagagcacatatttacaggaagtgtttcttctcttgcatggttcatgtcaaatcaggagacaagttttgttactattggtcagagactgttagccaaccctctaaaggttcggttccactatggtcatccggatgtatttgataggctctttcacctcacaagagggggtgtaagtaaagcatccaaagtcattaatttgagtgaagatatttttgctggcttcaattctacacttcgtgaaggcaatgtcacccatcatgaatacatacaagttgggaagggaagggatgtgggtctcaatcagatatctatgtttgaggcaaaaatagctaatggcaatggagagcagactttgagtcgggatatataccggcttggacatcgttttgactttttcagaatgctgtcttgttatttcactacagttggtttttacttcaatactttgataacagtgctcactgtctatgtgttcctttatggtcgcctctatcttgtactgagtggccttgaacaaggattaagtgagcaaccagcaattcgtgataataagcctcttcaagtggctcttgcttctcaatcttttgttcaaattggatttttgatggcattacctatgttgatggagattggcttggaaaggggtttccgaactgcattaagtgaatttatattaatgcagttgcaattggcaccagtatttttcacattttctcttggaacaaagacccactattatggaaggacattgcttcatggaggtgcaaagtacaggcctacaggccgagggtttgtggtgttccatgccaagtttgctgacaactaccggctttattcacgtagccattttgtgaagggtattgagatgatgatcttgcttctagtgtaccaaatctttggtcatacttacagaagtgcagttgcttatgtattgatcactgtatctttgtggtttatggtgggcacatggctttttgctcccttcctattcaatccttctggtttcgagtggcagaagattgttgatgattggactgattggaataagtggataaacaaccgaggtggtataggtgtacctccagaaaaaagttgggaatcatggtgggaggaagagcaagagcatcttcaatattctgggaagcgtggtattattgctgagatattgttagctttacgattctttatctaccagtatgggcttgtctatcacttgaatgttatcaaagaaaacagaagctttttgatctatggtgcatcatggctggtgattgttctgatattatttgtgatgaagactgtatctgttgggaggcgaaagttcagtgcaagttatcaacttgtttttcggctcatcaagggattaatattcttgacattcgtggccattctggttactttgattgctctccctcacatgacacttcaagacattattgtgtgcattcttgcatttatgcctacaggttggggaatacttctgattgctcaagctttgaggccttttgttaagaaagctggtttttggggatcagtacgaactcttgctcggggttatgagatagtgatggggttgcttcttttcactccggtagcattcctggcctggtttccttttgtctcagaatttcagactcgtatgcttttcaaccaagcattcagtagaggtctgcagatttctcgtattcttggtggacaacgtaaagatcgcacttctcgtaacaaggagtaagcaatagtggtaatgatatgcatgttattgatccccctgattcaatcatggaacgctttgttaatagttgtaattatattatggatgaagaggggacagcaattttggcattgggaactgacccaattgcttaccacctagcatgactttgaacaatatttgtaagattatgatgaaacatactattattcaatttcatcaatatatctatatatattttgtgtg

SEQ ID NO: 3022 - DNA, 2423 bp, Phaseolus vulgaris
atgtggaggttgaagataggagatggagggaagaatccatacatatttagcacaaacaattttgtaggaagacaaatttgggagtttgattctgaagcaggaactgatgaagaacgagcccaggtggaagctgctcgtcaacatttctatcaaaatcgctttaagctcaaggcttgtggtgatcgactatggcgatttcagattttgagggaaaagaacttcaaacaaaaaataaggaaagtgaagatagaagatgatgaagaaataacatgggagaaggctactctcaccctaaagagaacctctcattacctctccgcactgcaaactagtgatggccattggcctgctcatctttcgggttcccactttttccttccaatcatggtcatttctatatatagcacgggacatcttgattctgtacttccgaaagaatatcgtaaagaaattctccgttacttatataatcatcagaatgaagatggagggtggggattgcacatagagggtcctagcacgatgtatggtaccacactgaattatgtaagtatgagaattcttggagaaggagcaaatgacaatgcttgtgctaaggctagaaagtggattcatgatcatggtagcgtaacacatgtgccttcatggggaaaattttggctttcggtacttggtatagttgattggagtggatgcaacccattgccgcctgaattttggatacttcccacttttctccccatgcatcctgctaaaatgtggtattattgtcgacatgtatatatgcctatgtcatatatatatggaaaaagatttgggtgtccaatcacaccattgattagagatttaagagaagaactctttattcaaccatatgatgaaagtatgtggaagaaatcacgtcacaaatgtgctaaggaagacctttattatccccatcattggatacaagatctaatatgggatagtgcttatttagttactgagtcacttcttacacgttggcctttcaataagttgattagagaaaaagcacttcaactaacaatgaagcttattcactatgaagatgaaaatactcgatatatagatggtgggtgtgtgaacaaggctctgtctatgcttgcatgttgggtagaagatccaaatggagatgcttttaagaagcacattgcaagggtcccagattatttatggctttcagaagatggaatgtgtctacaggcacttagtacgcaatcatgggatgctggttttattgttcaagctcttcttgctactaatctaattgatgatcttggtcccacacttgcaaaagcacatgattttatcaagaaatctcaagtagtagaaaatcgttcaggagattttaagagtatgtttcatcacatttctaaagggtcttggacccttgctgatagagaccatgcattacaactttctgacggcactgcagaatgtatgaagtgttgtttacttttatccatgttaccagaagagattgtgggagaaaaattggaacctgaaaggttatatgattcagtcaattttatattgtcacttcagagtaaaaatggaggtgtaactgtgtgggagccagcaatagctcaaaagtggttggaacatctgaatcccgcggaatttctagctgacatagtaattgagcacgagtatcttgagtgtagtggagcaacaattcaggctttagtgttgttcaaaaaactatatccaaatcatagaagggaagagatagataatttcattgtcaaagcagcacaattcatcgaagatgaacaattaccaaacggaaattggcatgggaactggggagtttgcttcacttacggtgcctggtttgcagttggaggtttagttgctgctggaaagtcttacagtaattgtgttgccattcgtaaagctgtgaagtttctactctcaatacaaaatgaggatggtggttggggagaaagttatctttcatgtccaatgaagacctacgtgcctcttgaagggaatcgatcaaatattggtcaaacagcttgtgctctaatagctttgattcttggtggtcaggctgagagagatccaactcctcttcaccgtgctgcaaagttactcatcaattctcagttagaagatggtgattggccccaacaagaagcattgggggtgtacaagagaagttgcttgcttcattacccattctatagaactgtttttccgttgcaggctttatctgaatatcgtaacaatgttttagtgtcgttcacttgagaaactgtaagctcaaaacgacaatgtcaaacccttaaaaagtcaaacagataaaatcaaagttgatggtgatcaacaataataactgtatttctattatagttttgtaatatggaacaaacattatgtgttaaatattatacaataaa

SEQ ID NO: 3023 - DNA, 2532 bp, Phaseolus vulgaris
agttagtggagtgaaccccataaatacagagacatatattttgttaacttcaaaacattgggagcgaacacttgaagatctgtagtcaggagcaagtaaggtgaagaaaatgtggaggttgaagataggagatggagggaagaatccatacatatttagcacaaacaattttgtaggaagacaaatttgggagtttgattctgaagcaggaactgatgaagaacgagcccaggtggaagctgctcgtcaacatttctatcaaaatcgctttaagctcaaggcttgtggtgatcgactatggcgatttcagattttgagggaaaagaacttcaaacaaaaaataaggaaagtgaagatagaagatgatgaagaaataacatgggagaaggctactctcaccctaaagagaacctctcattacctctccgcactgcaaactagtgatggccattggcctgctcatctttcgggttcccactttttccttccaatcatggtcatttctatatatagcacgggacatcttgattctgtacttccgaaagaatatcgtaaagaaattctccgttacttatataatcatcagaatgaagatggagggtggggattgcacatagagggtcctagcacgatgtatggtaccacactgaattatgtaagtatgagaattcttggagaaggagcaaatgacaatgcttgtgctaaggctagaaagtggattcatgatcatggtagcgtaacacatgtgccttcatggggaaaattttggctttcggtacttggtatagttgattggagtggatgcaacccattgccgcctgaattttggatacttcccacttttctccccatgcatcctgctaaaatgtggtattattgtcgacatgtatatatgcctatgtcatatatatatggaaaaagatttgggtgtccaatcacaccattgattagagatttaagagaagaactctttattcaaccatatgatgaaagtatgtggaagaaatcacgtcacaaatgtgctaaggaagacctttattatccccatcattggatacaagatctaatatgggatagtgcttatttagttactgagtcacttcttacacgttggcctttcaataagttgattagagaaaaagcacttcaactaacaatgaagcttattcactatgaagatgaaaatactcgatatatagatggtgggtgtgtgaacaaggctctgtctatgcttgcatgttgggtagaagatccaaatggagatgcttttaagaagcacattgcaagggtcccagattatttatggctttcagaagatggaatgtgtctacaggcacttagtacgcaatcatgggatgctggttttattgttcaagctcttcttgctactaatctaattgatgatcttggtcccacacttgcaaaagcacatgattttatcaagaaatctcaagtagtagaaaatcgttcaggagattttaagagtatgtttcatcacatttctaaagggtcttggacccttgctgatagagaccatgcattacaactttctgacggcactgcagaatgtatgaagtgttgtttacttttatccatgttaccagaagagattgtgggagaaaaattggaacctgaaaggttatatgattcagtcaattttatattgtcacttcagagtaaaaatggaggtgtaactgtgtgggagccagcaatagctcaaaagtggttggaacatctgaatcccgcggaatttctagctgacatagtaattgagcacgagtatcttgagtgtagtggagcaacaattcaggctttagtgttgttcaaaaaactatatccaaatcatagaagggaagagatagataatttcattgtcaaagcagcacaattcatcgaagatgaacaattaccaaacggaaattggcatgggaactggggagtttgcttcacttacggtgcctggtttgcagttggaggtttagttgctgctggaaagtcttacagtaattgtgttgccattcgtaaagctgtgaagtttctactctcaatacaaaatgaggatggtggttggggagaaagttatctttcatgtccaatgaagacctacgtgcctcttgaagggaatcgatcaaatattggtcaaacagcttgtgctctaatagctttgattcttggtggtcaggctgagagagatccaactcctcttcaccgtgctgcaaagttactcatcaattctcagttagaagatggtgattggccccaacaagaagcattgggggtgtacaagagaagttgcttgcttcattacccattctatagaactgtttttccgttgcaggctttatctgaatatcgtaacaatgttttagtgtcgttcacttgagaaactgtaagctcaaaacgacaatgtcaaacccttaaaaagtcaaacagataaaatcaaagttgatggtgatcaacaataataactgtatttctattatagttttgtaatatggaacaaacattatgtgttaaatattatacaataaa

SEQ ID NO: 3024 - DNA, 1400 bp, Sorghum bicolor
cgactgatgacattcgcaggcatcgggacagccggaagtggatccaattgacatctcaagcaggaacggttggatcagaaaggaacggccggggggagtcaggagtggcttcgtttatagtggggctaaataatctccggtatccgcacggcagcaagccaagcctatcatctcctctagctgctccagcagctactagctcctccagacctccacctctccatggcgcgcctgctcctcttcccatcccaagcgtgcgtcgatcctggccgccaccacctcctcctcctccacccgccggtctccaggtcccgtgctgtccggtcggggcctcctcccgccgagccacgccgcgccagggtcgtctctcctccgcccctttgctcgacccaccatccatttcttccttgcagatcatcaaagagagtaggggtcgtttttgctgcagaaaatgcgcaagaaatttcttctcaccctcctggcaaggatgaaaggagaagtgggaatttgctcctgcgattcggtgcactcccatgttgcactatggcttggttgagcactgctcaattagcacaatctagtgttggaggaaagctaaatgtggtttatgaggtcggggagctgtttgagctgggaattcagctgtcttatctgctcatacttcttggtctgcttggagctggtacattttttgttatccgtcaggttcttgttcgtagggagcttgatctttctgccaaagagttgcaagaacaagtgagaagtggtgatgcaagtgctactgagtattttgagcttggagcagtcatgctacggagaaaattttatccagctgctatcaaatatctgcagcaagcaattgacaaatgggacagagacgagcaagatcttgcacaggtctacaatgccctgggggtcagctacaagcgagacaacaaactggacaaggcaatccagcagtttcagaaggcggtggagctccagccaggctatgtgacagcttggaacaacctgggtgacgcatatgagcagaagaaggacctgaaattggccctcaaggcctttgaggaggtcctactctttgatcccaacaacaaggttgcaaggccacgcgtggatgacctcaggccgcgtgtaagcatgtacaagggcgtgcctgtaaaatccgaaaagcgatagctattcctttttgggggtaaaatcatgcatctgtctagtccccgtgcagaatagcagttgttcattttttgaacggtagtattatttgtaaacatgatgagctttgtagtagcattggaaaggtccctgaaaaagggcggatgtaatacgattgtcttgatggagcgaaaattggagtattcgttgtaggaaccaatggatcgtctgctgtgagatggatg

SEQ ID NO: 3025 - DNA, 1434 bp, Sorghum bicolor
cgcacggcagcaagccaagcctatcatctcctctagctgctccagcagctactagctcctccagacctccacctctccatggcgcgcctgctcctcttcccatcccaagcgtgcgtcgatcctggccgccaccacctcctcctcctccacccgccggtctccaggtcccgtgctgtccggtcggggcctcctcccgccgagccacgccgcgccagggtcgtctctcctccgcccctttgctcgacccaccatccatttcttccttgcagatcatcaaagagagtaggggtcgtttttgctgcagaaaatgcgcaagaaatttcttctcaccctcctggcaaggatgaaaggagaagtgggaatttgctcctgcgattcggtgcactcccatgttgcactatggcttggttgagcactgctcaattagcacaatctagtgttggaggaaagctaaatgtggtttatgaggtcggggagctgtttgagctgggaattcagctgtcttatctgctcatacttcttggtctgcttggagctggtacattttttgttatccgtcaggttcttgttcgtagggagcttgatctttctgccaaagagttgcaagaacaagtgagaagtggtgatgcaagtgctactgagtattttgagcttggagcagtcatgctacggagaaaattttatccagctgctatcaaatatctgcagcaagcaattgacaaatgggacagagacgagcaagatcttgcacaggtctacaatgccctgggggtcagctacaagcgagacaacaaacttgacaaggcaatccagcagtttcagaaggcggtggagctccagccaggctatgtgacagcttggaacaacctgggtgacgcatatgagcagaagaaggacctgaaattggccctcaaggcctttgaggaggtcctactctttgatcccaacaacaaggttgcaaggccacgcgtggatgacctcaggccgcgtgtaagcatgtacaagggcgtgcctgtaaaatccgaaaagcgatagctattcctttttgggggtaaaatcatgcatctgtctagtccccgtgcagaatagcagttgttcattttttgaacggtagtattatttgtaaacatgatgagctttgtagtagcattggaaaggtccctgaaaaagggcggatgtaatacgattgtcttgatggagcgaaaattggagtattcgttgtaggaaccaatggatcgtctgctgtgagatggatggaggttaactactggagactggagagggtctggactctggagagagagttttttttttcttttttctaagggagggagggagctcaacgctggtgacagagagatttccgactatggtcttacagaaaggctaggatggtgggcagtggttttcacgaccttttcatttcaattcaat

SEQ ID NO: 3026 - DNA, 3603 bp, Sorghum bicolor
gacccactccaccaacgcagcgcaaggtctcgctccgtcgccttcctcctctccttatcttctgacctctccggctctcccctcccctctcctttttcccactaccgcggcaggcagctagcccctccctctcgtctcctccgccacctcctcccccgcctcgccggcgcagggtcgggacgcttccgccggcgcgcgctccacggcccctctgcgggagacgaaactcggcgcgggcttggtaggtagaggcctgggattgccttctgctagttcaacatggagggcgctctagttcagtctgcgattgttccaaccgtttacagaagcagctcaggtcgtttccgcgcgcgtgcaagggccagaacaaatgctacaatggtgcgcaatatgccagcaaggactcttactcttggtggcttccaagggctgcgtcagacaaactttttggacacgaggtctgtgatcaagcgtgactttgtgtcgatcgtggcaagtcagattgcaaggccgcgcgggtcggcctcacgaggggttgttcgtgccatgtttgaacgcttcactgagaaagcaatcaaggtgattatgctcgcgcaagaggaggcaaggcgccttggacacaactttgttgggacagagcagattttgctggggcttattggtgagggcacgggaattgcggcgaaggttctgaagtctatgggaatcaatcttaaggatgcccgagtggaagttgaaaagataattggacgtggcagtgggtttgtggctgttgaaatcccattcacgcctcgtgcaaaacgtgtattggaattgtcccttgaagaagctcgtcagcttgggcataactatataggatctgaacacttgctccttgggttacttcgtgagggtgaaggtgttgctgctcgtgtgcttgaaagccttggtgctgatccaaacaacatccgtacccaggtcataagaatggttggggaaagcacagaagccgttggggctggagttggtggaggaagcagtggccagaagatgcccacacttgaagaatatggtactaatttgacgaaattagcagaggagggtaaattggacccagttgttggtagacgggatcagattgagcgtgttactcagattttgggaaggcggacaaagaacaacccctgcctaattggagagcctggtgttggcaaaactgctattgctgaggggcttgctcaacgtattgccaatggggatgttcctgaaacaattgaaggaaagaaggttattactcttgacatggggctccttgttgctggaaccaaataccgtggagagtttgaagagagactaaagaaacttatggaggaaattaagcaaaatgaagacattattctcttcattgatgaagtgcacacactgattggagcaggtgcagcagaaggtgcaattgatgctgctaatattttgaagccagctcttgcaagaggtgaactgcagtgcattggtgctacaacgctggatgagtataggaagcatatagagaaagatcctgccttggaaagaaggtttcaaccagttaaggttcctgagcctactgtcgatgaaacaatacagatcttaagaggacttcgtgagagatatgaactccatcacaaactgcgatacacagatgatgctttaattgctgctgcacagctttcttatcagtatatcagtgatcgattcctgcctgacaaggccattgacttgattgatgaagctggatcccgtgttaggctgaggcatgcccagctccctgatgaagccaaagagctggacaaagagctgcggcagattaccaagcagaaaaacgaggctgtacgcagccaggactttgagaaggctggcgaattaagggaccgagaaatggagcttaaggctcaaattacagccattattgacaagagcaaggaaatgattaaagcagagactgaatctggtgaagtcggtcctcttgttactgaggcggacattcaacatattgtctcctcttggactggaattcctgtggagaaggtgtcatctgatgagtctgatcgtctcctaaagatggaagagacactgcatacacgtatcattggacaggatgaggctgtcaaagctattagtcgtgctatccgccgtgctcgtgttggcctcaagaatccaaataggccaattgccagcttcatattctctggaccgactggagttggcaaatcagagctagcaaaggctctggcggcctactactttggctcggaggaggctatgatcaggcttgacatgagtgagttcatggagagacatactgtctccaaactcattggatcacctccaggttatgttgggtacactgagggaggccaactaactgaagcagtccgtcgccgcccgtacacagttgttctctttgatgagattgagaaagcacatccagatgttttcaacatgatgcttcagatcttagaagatgggcggttaactgatagcaaggggcgcacagtggacttcaagaacacactattgatcatgacatctaatgtcgggagcagtgtcattgagaagggaggccgcaagattgggttcgaccttgactatgatgagaaagacacaagctataacaggatcaagagccttgtgactgaggagttgaagcagtacttccggccagagttcttgaacagattggatgagatgattgtattccggcagctgactaaattggaggtgaaggagattgcagacattatgctgaaagaagtgtttgacaggttgaaggccaaggacattaatctccaggttacagagaagttccgagatagagttgttgacgaaggttataacccgagctatggtgccagacctttgcggcgtgctatcatgaggcttctggaggatagtctggcagagaagatgctggctggtgaggtgaaagaaggtgactctgccatcgttgatgtggattcagatggcaaggtaatagtcctgaacggtggcagcggtgttgctgagccactggaacctgctctcagtacctaagcaaggtcaaaacctttggtccgaaatatggccttctttacaagtcagctgggctcctcgtgatggtaaaagtagactgacattacttggcgtctgccccattaggtgctttatctttcatggttttccttttcattggaagtgaggccgtagggttgctatggaaatgaatagatggtgaggaatttagcgaatgaaatatatgctagactttgagttgccttgtttttggaagaaacttggaattttcagtttgatgcacttgtattattaggacttgttagcaatgagatacggatgtttctgcgtttgatgttgtactttagtaacttatatcctgtatgtatggatatcacgtatccaagtttcgaataacagtggtgaattgctacactctgccttttggtctgcggatctaaaatttggaatcatttatttgcctcagaggttataattttcgaacttcagtattttagtctgcagctgttccttctggactgtattttgtcctgtttggttttgggtagacgtgaaaatggattggtgagggaatctcag

SEQ ID NO: 3027 - DNA, 3437 bp, Setaria italica
cccactaccgcggcaggcagaggcagctaccccctccctcccgtctgctccgccgcctcctctcgtttccactcgccggcgcagggtcgagacgcctacgccggcgcccgctccacggcccctctctgggagacgaacctcggcgtggcctcgtgggcttggtagatagaggaccaggattgtctcctgctagttcgatatggagggggctctagttcagtctgcaattgttccgaccatctacagaagcaactctggtcggttccgtgtgcgtgcaagggccagaacaaatgccacaatggtgcggaatatgccgacaaggacccttactcttggcggcttccaagggctgcgtcagacaaattttctggacacgaggtccgtggtcaagcgggactttggatctattgtggcaagccagattgcaaggccgcgggggtcggcgtcaaggggggtggttcgcgccatgttcgagcgcttcactgaaaaagcaatcaaggtgattatgcttgcgcaggaggaggcaaggcgtctgggccacaactttgttgggacggagcagattttgctcgggcttattggtgagggcactggaattgctgctaaggttctcaagtccatgggaatcaatcttaaggatgcccgagtggaagttgagaagatcattggacgaggcagtgggtttgtggctgttgaaatcccattcacacctcgtgcaaaacgtgtactggaactctcccttgaagaagcccgccagctagggcataactatataggatctgaacacttactcctggggctacttcgtgagggtgaaggtgttgcagcccgcgtgcttgaaagccttggtgctgatccaaacaacatccgcacccaggtcataagaatggtcggtgaaagtacagaagctgttggtgctggagttggtggaggaagcagtggccagaagatgcccacacttgaagaatatggtacaaatttgacaaaattagcagaagagggcaaattggacccagttgttggtagacaggatcaaatcgagcgtgtgacacagattttgggcaggcggacaaagaacaacccctgcctcattggagagcctggtgttggtaagactgctattgctgaggggctagctcaacgtatttccaacggggatgttcctgagacaattgaaggaaagaaggttattactcttgacatgggactccttgttgctggaaccaaataccgtggagagtttgaagagagactgaagaaacttatggaggaaattaagcaaaatgaagacattattctctttattgatgaagtgcacacacttattggagcaggtgcagcagaaggtgcaattgatgctgcaaatattttgaagccagctcttgccagaggtgaactgcagtgcatcggtgcaacaacgctggatgagtataggaagcatatagagaaggatcctgccttggaaagaaggtttcaaccagttaaggttcctgagcctactgttgatgaaacaatacagatcttaagaggacttcgtgaaagatatgagcttcaccacaagttgcgatacacagatgaagctttaattgctgccgcacagctgtcttatcagtatatcagtgaccgcttcctgcctgacaaagccattgacttaattgatgaagctgggtctcgtgttaggctgaggcacgcccagctccctgatgaagccaaagagctggacaaagagcttcggcagataaccaagcagaaaaacgaggctgtacgaggccaagattttgagaaggctggtgaattaagggatcgggaaatggagctgaaggcccagattacagccatcatcgacaagagcaaagaaatgattaaagcagagactgaatctggtgaagttggtcctcttgtcacagaggcagacattcagcatatcgtctcctcttggactggaattcctgtggagaaagtctcatctgatgagtctgatcgtctccttaagatggaggagacactacacacacgtatcattggtcaggacgaagcagtcaaagctattagccgtgctattcgacgtgctcgtgtcgggctcaagaatccgaatcgtccaattgctagcttcatattctctggacctactggagttggtaaatcagaattagcaaaggctctggcggcttactactttggctcagaggaggctatgatcaggcttgacatgagtgagttcatggagagacatactgtctccaaactcattggatcacctccaggttatgttggctacaccgagggaggccaattgactgaagcagttcgtcgccgtccgtacactgttgttctctttgatgagattgaaaaagcacatccagatgttttcaacatgatgcttcagatcttagaagatgggaggctaactgacagcaaggggcgcactgttgatttcaagaacacactattgatcatgacatcgaatgtcggaagcagtgtcattgagaagggaggccgtaagattgggttcgatcttgactatgacgagaaggacactagctacaacaggatcaagagcctggtgacggaggagttgaagcagtatttccgtccagaattcttgaacagattggatgagatgattgtgttccggcagctgacaaaattggaggtgaaggagattgcagacattatgctgaaggaagtgttcaacaggcttaaggccaaggacattgatctccaggttacagagaagttccgtgatagagttgttgatgagggttacaacccaagttatggtgcccggcctttgcggcgtgctatcatgaggcttctggaggatagtctggcagagaagatgcttgctggtgaggtgaaagaaggtgactcttgcattgtggatgtggattctgagggcaaggtaatagtcctgaatggcagtagtggtgttgctgagcccttggaacctgctctaagtgcctaactgaggtagaaaaatctttggtctgaaagatggccttctgtacaagtcagctgggctcctcatgatggtaaaaacttgattgacatggctcgcccaccccattagacgctttatctagatattttttcagttggaagtgaggcagtaggaatgctatggaaatgaataggcagagacgcatttagcgaacacactgtatgctagaccttgagttgccttgtttttgaaagaaacttggaattttcagttccctgcagttacttgtatcattacttcattagggttctgctagcaggatgacacggatatcgcttgcactgtcgtacttaaatctcccagcttgcactgtcgtacttaaatctcccagttatgtatggatgtaacttattcaagtcacaaataacattgatgggtgattgtatgttctttttttgagagtaagataatggtatgttgttagggcgcctggatc

SEQ ID NO: 3028 - DNA, 3518 bp, Setaria italica
ctctccttatcccttgacctctcccaccttccttccttccctgttccctccccactaccgcggcaggcagaggcagctaccccctccctcccgtctgctccgccgcctcctctcgtttccactcgccggcgcagggtcgagacgcctacgccggcgcccgctccacggcccctctctgggagacgaacctcggcgtggcctcgtgggcttggtagatagaggaccaggattgtctcctgctagttcgatatggagggggctctagttcagtctgcaattgttccgaccatctacagaagcaactctggtcggttccgtgtgcgtgcaagggccagaacaaatgccacaatggtgcggaatatgccgacaaggacccttactcttggcggcttccaagggctgcgtcagacaaattttctggacacgaggtccgtggtcaagcgggactttggatctattgtggcaagccagattgcaaggccgtgggggtcggcgtcaaggggggtggttcgcgccatgttcgagcgcttcactgaaaaagcaatcaaggtgattatgcttgcgcaggaggaggcaaggcgtctgggccacaactttgttgggacggagcagattttgctcgggcttattggtgagggcactggaattgctgctaaggttctcaagtccatgggaatcaatcttaaggatgcccgagtggaagttgagaagatcattggacgaggcagtgggtttgtggctgttgaaatcccattcacacctcgtgcaaaacgtgtactggaactctcccttgaagaagcccgccagctagggcataactatataggatctgaacacttactcctggggctacttcgtgagggtgaaggtgttgcagcccgtgtgcttgaaagccttggtgctgatccaaacaacatccgcacccaggtcataagaatggtcggtgaaagtacagaagctgttggtgctggagttggtggaggaagcagtggccagaagatgcccacacttgaagaatatggtacaaatttgacaaaattagcagaagagggcaaattggacccagttgttggtagacaggatcaaatcgagcgtgtgacacagattttgggcaggcggacaaagaacaacccctgcctcattggagagcctggtgttggtaagactgctattgctgaggggctagctcaacgtatttccaacggggatgttcctgagacaattgaaggaaagaaggttattactcttgacatggggctccttgttgctggaaccaaataccgtggagagtttgaagagagactgaagaaacttatggaggaaattaagcaaaatgaagacattattctctttattgatgaagtgcacacacttattggagcaggtgcagcagaaggtgcaattgatgctgcaaatattttgaagccagctcttgccagaggtgaactgcagtgcatcggtgcaacaacgctggatgagtataggaagcatatagagaaggatcctgccttggaaagaaggtttcaaccagttaaggttcctgagcctactgttgatgaaacgatacagatcttaagaggacttcgtgaaagatatgagcttcaccacaagttgcgatacacagatgaagctttaattgctgccgcacagctgtcttatcagtatatcagtgaccgcttcctgcctgacaaagccattgacttaattgatgaagctgggtctcgtgttaggctgaggcacgcccagctccctgatgaagccaaagagctggacaaagagcttcggcagataaccaagcagaaaaacgaggctgtacgaggccaagattttgagaaggctggtgaattaagggatcgggaaatggagctgaaggcccagattacagccatcatcgacaagagcaaagaaatgattaaagcagagactgaatctggtgaagttggtcctcttgtcacagaggcagacattcagcatatcgtctcctcttggactggaattcctgtggagaaagtctcatctgatgagtctgatcgtctccttaagatggaggagacactacacacacgtatcattggtcaggacgaagcagtcaaagctattagccgtgctattcgacgtgctcgtgtcgggctcaagaatccgaatcgtccaattgctagcttcatattctctggacctactggagttggtaaatcagaattagcaaaggctctggcggcttactactttggctcagaggaggctatgatcaggcttgacatgagtgagttcatggagagacatactgtctccaaactcattggatcacctccaggttatgttggctacaccgagggaggccaattgactgaagcagttcgtcgccgtccgtacactgttgttctctttgatgagattgaaaaagcacatccagatgttttcaacatgatgcttcagatcttagaagatgggaggctaactgacagcaaggggcgcactgttgatttcaagaacacactattgatcatgacatcgaatgtcggaagcagtgtcattgagaagggaggccgtaagattgggttcgatcttgactatgacgagaaggacactagctacaacaggatcaagagcctggtgacggaggagttgaagcagtatttccgtccagaattcttgaacagattggatgagatgattgtgttccggcagctgacaaaattggaggtgaaggagattgcagacattatgctgaaggaagtgttcaacaggcttaaggccaaggacattgatctccaggttacagagaagttccgtgatagagttgttgatgagggttacaacccaagttatggtgcccggcctttgcggcgtgctatcatgaggcttctggaggatagtctggcagagaagatgcttgctggtgaggtgaaagaaggtgactcttgcattgtggatgtggattctgagggcaaggtaatagtcctgaatggcagtagtggtgttgctgagcccttggaacctgctctaagtgcctaactgaggtagaaaaatctttggtctgaaagatggccttctgtacaagtcagctgggctcctcatgatggtaaaaacttgattgacatggctcgcccaccccattagacgctttatctagatattttttcagttggaagtgaggcagtaggaatgctatggaaatgaataggcagagacgcatttagcgaacacactgtatgctagaccttgagttgccttgtttttgaaagaaacttggaattttcagttccctgcagttacttgtatcattacttcattagggttctgctagcaggatgacacggatatcgcttgcagtgtcgtacttaaatctcccagcttgcactgtcgtacttaaatctcccagttatgtatggatgtaacttattcaagtcacaaataacattgatgggtgattgtatgttctttttttgagagtaagataatggtatgttgttagggcgcctggatcatcaggtttcctttcttttcttttttgttca

SEQ ID NO: 3029 - DNA, 3438 bp, Panicum virgatum
ctccagacctctcttccaccttccttgcctgccttccccactaccgcggcaggcagctaccgcatccgtccggtctcctcctccgcctcagagggctcgcccgactcgccggcgcagggtcgaggcgctcccgccggcgcccgctccacggcccctccctgggagacggacctcggcgcgggcttgtagataggggactgggatcttcttttgatagttcagtatggaggggtctctagttcagtctgcgattgtcccgactgtttacaaaagcaactctggtcggttccgtgtgcgtgcaagagccagaacaaatgccacaatggtgcggaatatgccgacaaggacccttactcttggcagcttccaagggctgcgtcaaacaaactttttggacacgaggtctgtggtaaagcgtgactttggcgctatcgtggcaagccagattgccaggcccagaggatcggcgacaagaggggtggttcgtgccatgttcgagcgcttcactgaaaaagcaatcaaggtgattatgcttgcgcaggaggaggcaaggcgtctgggccacaactttgttgggacggagcagattttgctggggcttattggtgagggcaccggaattgctgctaaggttctcaagtctatgggaatcaatcttaaggatgcccgagtggaagttgagaagatcattgggcgaggaagtgggtttgtggctgttgaaatcccattcacgcctcgcgcgaaacgtgtactggaactctcccttgaagaagcccgccagctagggcataactatataggatctgaacacttactccttgggttacttcgtgagggtgaaggtgttgcagcccgtgtgcttgaaagccttggtgctgatccaaacaacatccgcacccaggtcataagaatggttggtgaaagcacagaagctgttggtgctggagttggtggaggaagcagtggccagaagatgcccacacttgaagaatatggtacaaatttgacaaaattagcagaagagggaaaattggacccagttgttggtagacaggatcaaatcgagcgtgtgactcaaattttgggcaggcggacaaagaacaacccctgcctcattggagagcctggtgttggtaagactgctattgccgaggggcttgctcaacgtatttccaatggagatgttcctgaaacaattgaaggaaagaaggttattactcttgacatggggctccttgttgctggaaccaaataccgtggagagtttgaggagagactgaagaaacttatggaggaaattaagcaaaatgaagacattattctctttattgatgaggtgcacacactgattggagcaggtgcagcagaaggtgcaattgatgctgctaatattttgaagccagctcttgccagaggtgaactgcagtgtattggtgcaacaactctggatgagtataggaagcatatagagaaggatcctgccttggaaagaaggtttcaaccagttaaggttcctgaacctactgttgatgaaacaatacaaatcttaagaggacttcgtgaaagatatgagcttcatcacaagctgagatacacagatgaagctttaattgcagccgcacagctgtcttatcagtatatcagtgaccgcttccttcccgacaaagccattgacttgattgatgaagctggatctcgtgttaggctgaggcacgcccagctccctgatgaagccaaagagctggacaaagaactccggcagataaccaagcagaaaaacgaggctgtacgaggccaagattttgagaaggctggtgaattaagggatcgggaaatggagctgaaggcccagattacggccattcttgacaagagtaaagaaatgattaaagcagagactgaatctggtgaagttggtcctcttgtcacagaggcagacattcaacatattgtctcctcttggactggaatccctgtggagaaagtctcatctgatgaatctgatcgtctccttaagatggaggagacactacacacacgtatcattggtcaggatgaagctgtcaaagctattagccgtgctattcgacgtgctcgtgttgggctgaagaatccaaaccgtcctattgctagcttcatattctctggacctactggagttggcaaatcagaattagcaaaggcgctggcagcctactactttggctcagaggaggctatgatcaggcttgacatgagtgagttcatggagagacatactgtctccaaactcattggatcacctccaggttatgttggctacactgagggaggtcaattgactgaagcagttcgtcgccgtccatacactgttgttctctttgatgagattgaaaaggcacatccagatgttttcaacatgatgcttcagatcttagaagatgggaggctaactgacagcaaggggcgcacagttgactttaagaacacactattgatcatgacatcgaatgttgggagcagtgtaattgagaagggaggccgcaagatcgggttcgaccttgactatgatgagaaagacactagctacaacaggatcaagagcctggtgaccgaggagttgaagcagtatttccgtccagaattcctaaacagattggatgagatgattgtgttccggcagctgacgaagttagaggtgaaggagattgcggacattatgctgaaagaagtgtttgacaggctgaaggctaaggacattgacctccaggttacagagaagttccgtgatagagttgttgacgaaggttacaacccaagttatggtgcccggcctttgcggcgcgctatcatgaggcttctggaggatagtctggctgagaagatgcttgctggtgaggtgaaagaaggtgactctgccattgtcgatgtggattctgatggcaaggttatagtcctgagtggcggtagtggtgttgctgagcccctggaacctgctctcagtacctactgaggtcgaaaactctttggtccgaaatatggccttctttacaagacagttgggttcctcatgatggcaaaactagattgacatcgctcgcccgcccactgcagactcttcagctttccttggtatttaaattccattggaagtgaggcagtaggaatgctatggaaaggaatcggcagagacgcagcgagaacactgtatgcttagaccttgagttgcgttgtttttgaaaaaaaaacttgggacttttcagtttcctgcaattacatgtatcattacttcattagggctctgcaagcatgatgacatggttatcgcttgcactgttgtacttattctcccagttgtgtatgaatgtaacttattcaagtcacagataacattggtagataatgatatgctgttatggcgcctgagaactcaggttgttttaaccttttgttcattga

SEQ ID NO: 3030 - DNA, 3472 bp, Panicum virgatum
gggtatccgcgggggtgcctgttggtgtgggggaattgcggtcccggcggtgtgtacctaggctgggcagcacggcgcatcggcggggtgctttcctgggcttgtagataggggactgggattttcttttgatagttcaatatggaggggtctctagttcagtctgcgattgtcccgactgtttacagaagcaactctggtcggtttcgcgtgcgtgcaagagccagaataaatgccacgattgtgcggaatatgccgacaaggacccttactcttggcggcttccaagggctgcgtcagacaaactttttggatacgaggtccgtggtcaagcgtgactttggcgctatcgtggcaagccagattgcaaggcccagaggatcggcgacaagaggggtggttcgcgccatgttcgagcgcttcacggaaaaagcaatcaaggtgattatgcttgcgcaggaggaggcaaggcgtctgggccacaactttgttgggacggagcagattttgctgggccttattggtgagggcaccggaattgctgctaaggttctcaagtctatgggaatcaatcttaaggatgcccgagtggaagttgagaagatcattgggcgaggaagtgggtttgtggctgttgaaatcccattcacgcctcgcgctaaacgtgtactggaactctcccttgaagaagcccgccagctagggcataactatataggatctgaacacttactccttgggttacttcgtgagggtgaaggtgttgcagcccgtgtgcttgaaagccttggtgctgatccaaacaacatccgcacccaggtcataagaatggttggtgaaagcacagaagctgttggtgctggagtgggtggaggaagcagtggccagaagatgcccacacttgaagaatatggtacaaatttgacgaaattagcagaagagggaaaattggacccagttgttggtagacagggtcaaatcgagcgtgtgactcaaattttgggcaggcggacaaagaacaacccctgcctcattggagagcctggtgttggtaagactgctattgccgaggggcttgctcaacgtattgccaatggagatgttcctgaaacaattgaaggaaagaaggttattactcttgacatggggctccttgttgctggaaccaaataccgtggagagtttgaggagagactgaagaaacttatggaggaaattaagcaaaatgaagacattattctctttattgatgaggtgcacacactgattggagcaggtgcagcagaaggcgcaattgatgctgccaatattttgaagccagctcttgccagaggtgaactgcagtgtattggtgcaacaactctggatgagtataggaagcatatagagaaggatcctgccttggaaagaaggtttcaaccagttaaggttcctgagcctactgttgatgagacaatacaaatcttaagaggacttcgtgaaagatatgagcttcatcacaagctgcgatacacagatgaagctttaattgcagctgcacagctatcttatcagtatatcagtgaccgcttccttcctgacaaagccattgacttgattgatgaagctggatctcgtgttaggctgaggcacgcccagctccctgatgaagccaaagagctggacaaagaactccggcagataaccaaggagaaaaacgaggctgtacgaggccaagattttgagaaggctggtgaattaagggatcgggaaatggagctgaaggcccagattacggccattctcgacaagagtaaagaaatgattaaagcagagactgaatctgatgaagttggtcctcttgtcacagaggcagacattcaacatattgtctcctcttggactggaattcctgtggagaaagtctcatctgatgaatctgatcgtctccttaagatggaggagacactacacacacgtatcattggtcaggatgaagcagtcaaagctattagccgtgctattcgacgtgctcgtgttgggctgaagaatccaaaccgtcctattgctagcttcatattctctggacctactggagttggcaaatcagaattagcaaaggcgctggcagcctactactttggctcggaggaggctatgatcaggcttgacatgagtgagttcatggagagacatactgtctccaaactcattggatcacctccaggttatgttggctacactgagggaggtcaattgactgaagcagttcgtcgccgtccatatactgttgttctctttgatgagattgaaaaggcacatccagatgttttcaacatgatgcttcagatcttagaagacgggaggctaactgacagcaaggggcgcacagttgacttcaagaacacactattgatcatgacatcgaatgttgggagcagtgtaattgagaagggaggccgcaagatcgggttcgaccttgactatgacgagaaagacaccagctacaacaggatcaagagcctggtgactgaggagttgaagcagtatttccgtccagaattcctaaacagattggatgagatgattgtgttccggcagctgacgaagttagaggtgaaggagattgcggacattatgctgaaagaagtgtttgacaggctgaaggccaaggacattaatctccaggttacagagaagttccgtgatagagttgttgacgaaggttacaacccaagttatggtgcacggcctttgcggcgtgctatcatgaggcttctggaggatagtctggctgagaagatgcttgctggtgaggtgaaagaaggtgactctgccattgttgatgtggattctgatggcaaggttatagtcctgaatggcggtagtggtgttgctgagcccctggaacctgctctcagtacctaactgaggtcgaaaaatctttggtccgaaatatggccttctttacaagacagttgggttcctcatgatgggaaaactagattgacatcgctcgcccactgcagactctttagctttccttggcatttatattccattggaagtgaggcagtaggaatgctatggaaaggaatagccagagacgcagcgagcacactgtatgcttagagcttgagttgcgttgttttcgaaaaaaaaactggaattttcagtttcctgcaattacatgtatcattacttcattagggctcagctagcatgatgacacgggtatcgcttgcactgtttgtacttattctctcagctgtgtacggatgtaacttattcaagacacagataacattggtagataatggtatgctgttatggcgcctgggaactcagttttttttaaccttttgttcattgatatgcactgttttttaacattttgctctttgatatgcactgtgtttgtttttattcttcgtgtgagcatcttcaaaaatttgccatattctatttgacaaatcttgtgatttgccaactc

SEQ ID NO: 3031 - DNA, 3547 bp, Oryza sativa
gggaggggtcaggtcagtcgaggcggctctctcctctcctctctctcctcttcttatctcctcccctcgcgtgggtgcgtctccccttcctcctctcccatctcctcctcctcctcctccgccgcctccgcgtccccgtccccccctccccccgcgctgctagggttggtggccgccccctcgtcgccgccgcggttgaggtccggccagggattggattggtgggcaggtggctcggggttttccttttggggtaggtcggtatggaggggtcgctagtccagtccgcgattgctccgaccatatacaggaggagcggcaccgcgcggttccgcgtgcgcgcgagggccacgatgatgcgtaccatgccaacacggaccctcaccctggggggtttccagggcctgcggcagacgaatttcctggactcgaggtcggtgattaagcgtgacttcggctctattgtcgcgagccagatttcacgcccccgagggttggggtcaagaggggtggtccgcgccatgtttgagcgcttcacggagaaggcaatcaaggtgatcatgcttgcacaggaagaagcgaggcgcctgggccacaactttgttgggacggagcaaattctactgggccttatcggtgagggcacaggaatcgcggcaaaggttctcaagtctatgggtatcaaccttaaggatgcccgtgtggaagttgagaagatcattggacgtggtagcgggtttgtggctgttgagatcccattcacgcctcgtgcaaagcgtgtcttggaactgtcacttgaagaagctcgccagctagggcataactatataggatctgagcacttacttctggggctacttcgtgagggtgaaggtgtagcagcacgggtactggaaagtcttggtgctgatccaaacaacattcgtacccaggtcataagaatggttggtgaaagcacagaagctgttggtgctggagttggtggcggaagcagtggccagaagatgcctacactcgaagagtatggcactaatttgactaagctggcagaagagggtaaactagacccagttgttggcaggcaggatcaaattgagcgtgtaactcaaattttgggaaggcggacaaagaacaacccttgcctaattggagaacctggtgttggaaagactgctattgctgaggggcttgcacaacgtatttccaatggtgacgttccagaaacaattgaaggaaagaaggttattactcttgacatggggctccttgttgctggtaccaagtaccgtggagagttcgaagaaagactgaagaaacttatggaggaaatcaaacaaaatgatgacattattctctttattgatgaagtgcacacgctaattggagcaggtgctgctgaaggtgcaattgatgctgccaacatcttgaaaccagctcttgctagaggtgaactgcagtgcattggtgccacaacacttgatgagtacaggaaacatattgagaaagatccagctttagagcgacggtttcaaccagttaaggttccagagccaactgttgatgaaacaatacaaatcttaagaggacttcgtgagcgatatgaactgcatcataagctgcgatacacagatgattctttaattgctgcagcacaattgtcataccagtatatcagtgatcgcttcctgcctgataaggctattgacttgattgatgaagcaggatctcgtgttaggctcaggcatgcacagctccctgatgaagccaaggagctggacaaagagcttcgacaggtaaccaaagacaagaacgaggctgtacgtggccaagattttgaaaaggctggggaattaagagatcgggaaatggaattgaaggcccaaattacagccattattgacaagagcaaggaaatggttaaagcagagactgaatccggtgaagtcggtccccttgttactgaggcagatattcagcatatcgtgtcctcttggactggaatacctgtggagaaagtctcatctgatgagtctgaccgtctccttaagatggaggagacactccatacgcgtatcattggtcaggatgaggctgtcaaagctattagccgtgccatccgccgtgctcgtgttggcctcaagaacccaaatcggcctattgctagcttcatcttctctggaccaactggtgtcggtaaatcagagttagcaaaggctcttgcagcctactactttggctcagaagaggccatgatcagactagacatgagtgagttcatggagaggcatacagtctccaagctcattggatcacctccaggttatgttggttacactgagggtggtcaactgacagaagcagttcgccgccgaccatacactgttgttctcttcgatgagattgaaaaggcacatcctgatgtcttcaacatgatgcttcagatcttagaagatggaagactaactgacagcaagggtcggactgttgatttcaagaacacactgttgatcatgacatcaaatgttggaagcagtgtcattgagaagggaggacggaagattggatttgaccttgactatgatgagaaagacaccagctacaataggattaagagcttggtgactgaagagctgaagcagtacttccgacctgagttcttaaacagattggacgagatgattgtgttccggcagcttaccaagctggaggttaaggagattgctgatattatgctcaaagaagtgtttgacaggctcaaggcaaaggacatcgacctccaggtgacagagaagttccgggatagagttgtcgacgaaggttacaacccaagctatggtgccaggcctctgcggcgtgctattatgaggcttctggaggacagcttggcggagaagatgttggctggcgaggtcaaggaaggtgactctgctattgttgatgtggattcagagggcaaggtgatagttcttaacggtggtagtggtgttccggaaccactggcacctgctctgagtgtctaattgaaggataatatcgtcgttctggaattatggccttttctcttctctcagctggggcgctcatgatggtaaaactagatggcataaattctcccttcatttaggtgctttcacttttcctctttttttccaacagaggcagtaggaatgttatggaaatgaatcaacagagatgcatttagcaaacaaactgtatgctagatcttgagttgcttttatttttaaaaggatgtcagaagctttactccttcaagtacgtgtatttattcttttggtagcagtaagataaacgctgcactgttgtacctgtacattacttcgcaccagatggcttccaatactttttacacatggctgtaacttactttgaagtgtaggtaaatgctacggcatcctggccacccagcagcattaatatataatgatctgaaataagagtgatttttgtttggtttgtcaattgtcagttgcaactttactagtgactgttgccagatcaaccaagggtggaaaattggaatgttttt

SEQ ID NO: 3032 - DNA, 3441 bp, Oryza sativa
tcttcttatctcctcccctcgcgtgggtgcgtctccccttcctcctctcccatctcctcctcctcctcctccgccgcctccgcgtccccgtccccccctccccccgcgctgctagggttggtggccgccccctcgtcgccgccgcggttgaggtccggccagggattggattggtgggcaggtggctcggggttttccttttggggtaggtcggtatggaggggtcgctagtccagtccgcgattgctccgaccatatacaggaggagcggcaccgcgcggttccgcgtgcgcgcgagggccacgatgatgcgtaccatgccaacacggaccctcaccctggggggtttccagggcctgcggcagacgaatttcctggactcgaggtcggtgattaagcgtgacttcggctctattgtcgcgagccagatttcacgcccccgagggttggggtcaagaggggtggtccgcgccatgtttgagcgcttcacggagaaggcaatcaaggtgatcatgcttgcacaggaagaagcgaggcgcctgggccacaactttgttgggacggagcaaattctactgggccttatcggtgagggcacaggaatcgcggcaaaggttctcaagtctatgggtatcaaccttaaggatgcccgtgtggaagttgagaagatcattggacgtggtagcgggtttgtggctgttgagatcccattcacgcctcgtgcaaagcgtgtcttggaactgtcacttgaagaagctcgccagctagggcataactatataggatctgagcacttacttctggggctacttcgtgagggtgaaggtgtagcagcacgggtactggaaagtcttggtgctgatccaaacaacattcgtacccaggtcataagaatggttggtgaaagcacagaagctgttggtgctggagttggtggcggaagcagtggccagaagatgcctacactcgaagagtatggcactaatttgactaagctggcagaagagggtaaactagacccagttgttggcaggcaggatcaaattgagcgtgtaactcaaattttgggaaggcggacaaagaacaacccttgcctaattggagaacctggtgttggaaagactgctattgctgaggggcttgcacaacgtatttccaatggtgacgttccagaaacaattgaaggaaagaaggttattactcttgacatggggctccttgttgctggtaccaagtaccgtggagagttcgaagaaagactgaagaaacttatggaggaaatcaaacaaaatgatgacattattctctttattgatgaagtgcacacgctaattggagcaggtgctgctgaaggtgcaattgatgctgccaacatcttgaaaccagctcttgctagaggtgaactgcagtgcattggtgccacaacacttgatgagtacaggaaacatattgagaaagatccagctttagagcgacggtttcaaccagttaaggttccagagccaactgttgatgaaacaatacaaatcttaagaggacttcgtgagcgatatgaactgcatcataagctgcgatacacagatgattctttaattgctgcagcacaattgtcataccagtatatcagtgatcgcttcctgcctgataaggctattgacttgattgatgaagcaggatctcgtgttaggctcaggcatgcacagctccctgatgaagccaaggagctggacaaagagcttcgacaggtaaccaaagacaagaacgaggctgtacgtggccaagattttgaaaaggctggggaattaagagatcgggaaatggaattgaaggcccaaattacagccattattgacaagagcaaggaaatggttaaagcagagactgaatccggtgaagtcggtccccttgttactgaggcagatattcagcatatcgtgtcctcttggactggaatacctgtggagaaagtctcatctgatgagtctgaccgtctccttaagatggaggagacactccatacgcgtatcattggtcaggatgaggctgtcaaagctattagccgtgccatccgccgtgctcgtgttggcctcaagaacccgaatcggcctattgctagcttcatcttctctggaccaactggtgtcggtaaatcagagttagcaaaggctcttgcagcctactactttggctcagaagaggccatgatcagactagacatgagtgagttcatggagaggcatacagtctccaagctcattggatcacctccaggttatgttggttacactgagggtggtcaactgacagaagcagttcgccgccgaccatacactgttgttctcttcgatgagattgaaaaggcacatcctgatgtcttcaacatgatgcttcagatcttagaagatggaagactaactgacagcaagggtcggactgttgatttcaagaacacactgttgatcatgacatcaaatgttggaagcagtgtcattgagaagggaggacggaagattggatttgaccttgactatgatgagaaagacaccagctacaataggattaagagcttggtgactgaagagctgaagcagtacttccgacctgagttcttaaacagattggacgagatgattgtgttccggcagcttaccaagctggaggttaaggagattgctgatattatgctcaaagaagtgtttgacaggctcaaggcaaaggacatcgacctccaggtgacagagaagttccgggatagagttgtcgacgaaggttacaacccaagctatggtgccaggcctctgcggcgtgctattatgaggcttctggaggacagcttggcggagaagatgttggctggcgaggtcaaggaaggtgactctgctattgttgatgtggattcagagggcaaggtgatagttcttaacggtggtagtggtgttccggaaccactggcacctgctctgagtgtctaattgaaggataatatcgtcgttctggaattatggccttttctcttctctcagctggggcgctcatgatggtaaaactagatggcataaattctcccttcatttaggtgctttcacttttcctctttttttccaacagaggcagtaggaatgttatggaaatgaatcaacagagatgcatttagcaaacaaactgtatgctagatcttgagttgcttttatttttaaaaggatgtcagaagctttactccttcaagtacgtgtatttcttcttttggtagcagtaagataaacgctgcactgttgtacctgtacattacttcgcaccagatggcttccaatactttttacacatggctgtaacttactttgaagtgtaggtaaatgctacggcatcctggccacccagcagcattaatatataatgatctgtaataagagtgatttttgtttggtttgtcaattgtcagtt

SEQ ID NO: 3033 - DNA, 3327 bp, Panicum virgatum
aatactgtacctcttgcaggcttaagtgacatttggctagggattctttgactgattcaatatggaggggactctagttcagtctgcgattgttcccaccgtattacaccggagcagctctggtcgatctcgtgttcgcgcgagggccacgatgctgcgcagtacgccgacgcggatgcttactcttggaggcttccaagggctgcggcagacaaattttcttgacacgaggtctgtgatcaagcgtgatttcggatctatcgtagcaagccagatttcgcggccacggggttcagcgtcaagaggtgtggttcgggccatgttcgagcgcttcaccgaaaaggccatcaaggtgattatgcttgcgcaggaggaggccagacgtctaggccacaactttgttgggacagagcagattttactaggtcttattggtgagggaactgggatagcagcgaaggttctgaaatctatgggaattaatctaaaggatgcccgagtggaagttgagaagattattggccgaggtagtgggtttgtggctgttgaaatcccgttcacaccccgtgcgaagcgtgtattggaactgtcactcgaagaagctcgccagctagggcacaactatataggatctgagcacttactcctggggctacttcgtgagggtgagggcgtggccgcccgtgtgcttgagagccttggtgctgatccaaataacatccgtacccaggtcataagaatggttggtgaaagcacggaagctgttggtgctggagttgggggaggagctagtggccagaagatgcccacgcttgaggaatatggtactaatttgacaaaactggcagaagagggaaaacttgacccagttgttggcagacagaaccagattgagcgtgtaacccagattttgggcaggcgaacaaagaacaacccctgcctaatcggagagcccggtgttggcaagactgctattgcagaggggcttgcccagcgtattgccaatggggatgttccagaaacaattgaaggaaagaaggttattactcttgacatggggctccttgtggctggtaccaagtaccgtggagagtttgaagaaagattgaagaagcttatggaggaaataaagcaaaatgaagatattattctctttattgatgaagtgcacacgctgattggtgctggtgcagctgaaggtgctattgatgctgctaacatcttgaaacctgctcttgctagaggtgaactgcagtgcattggggccacaactctggatgagtataggaagcatatcgagaaagatcctgcgttggagagaaggttccaaccagttaaagttccagagccaactgttgatgaaacaacacagatcttaagaggacttcgtgagagatatgaactccatcataagctgagatacacagatgaagctctagttgccgcagcacagttatcatatcagtatatcagtgaccgcttcctgcctgataaagctattgacttgattgatgaagctggatcccgtgttaggctgaggcatgcacagctgcctgatgaagccaaagagctggacaaagagcttaggcagataaccaagcagaagaatgaggctgttcgtggccaagatttcgagaaggcaggggaattaagagatcgtgaaatggagttgaaggcccaaattacagctattattgacaagagcaaggagatgattaaagcagagactgaatctggcgaagttggtcctcttgtcacagaggcagacattcaacatatagtctcctcttggactggaataccagtggagaaggtctcatccgatgagtctgaccgtctccttaagatggaggatacactgcatacacgcatcattggccaggatgaggctgtcaaagctattagccgtgctatccgccgtgctcgcgttggactcaagaatccaaatcgaccaattgctagcttcatattctctggaccaactggtgttggcaaatcagaattagcaaagtctctagcagcctactactttggatcagaggaagccatgatcaggctggacatgagtgagttcatggagagacatactgtcgccaagctcattgggtcacctccaggttatgttggttacactgagggtggccaacttactgaagctgttcgtcgccgtccgtacacggttgttctctttgatgagattgaaaaggcacatccagatgtcttcaatatgatgcttcaaatcttggaggatgggagactaacggacagtaagggaaggacagttgattttaagaacacactgcttatcatgacatccaatgttggaagcagtgtcatcgagaagggaggccgcaagattggatttgaccttgactatgaagagaaggacagcagctacaacaggatcaagagcctggtaacagaggagttgaagcagtatttccggccagagttcttgaacagattggatgagatgattgtgttccggcagctgacaaagttggaggtgaaggagattgctgatattatgctgaaagaagtatttgatcggctcaaggcgaaggacattaatctccaagtcactgaaaggttccgcaatagggttgttgacgaaggttacaacccgagctatggtgccaggcctctgcgccgtgctatcatgaggctcttggaagacagtctggcagagaagatgctggctggtgaggtgaaagaaggtgattctgctattgttgacgtggattcagatggcaaggtagtagtcctgaacggtgggagaggtgttgctgagccactggaacctgctctcagcatatagtcgaggctgaaaatcctaggtttggaatatggcctgcgtcaaatcttactggggctcctcatgaatcatggtggtaaaactagatatacaatcactggcccttcgttaggtttctctttccttgtttctttttggggtttctttttggaattgaagcattgaagcagtagaaatgctatggaaatgaatagataggggcaaagtggatgctagatcctaagtgctttgtttttagaaggattttgaaagctttatttttggaaggatgttggaagcttggtttgcttcaattactgtattactagttcatgcttgcagtaaggtacggatattatcgcactgttgtacgtaaccttccaactatttatgagaatatccacgcctccaataacagtgtggcttacaatgatactgcttcatgctggttattggatgctacaactgaacttcaaagtcattgttcttttaggttgtaacattagtgatgttgtttagatcattttttgctg

SEQ ID NO: 3034 - DNA, 3292 bp, Setaria italica
ggattcattggctgattcaatatggaggggactctagttcagtccgcgattgttcccaccgtattacaccggagcagctctggtcgatctcgtgtgcgcgcaagggccacgatgctgcgcagtacgccaacgcggacccttactcttggaggcttccaagggctgcggcagacaaattttctggacacgaggtccgtggttaagcgtgactttggatatattgtagcaagtcagatttcgcgaccacgaggttcagcatcaagaggggtggttcgtgccatgttcgaacgcttcactgaaaaggccatcaaggtggttatgcttgcacaagaggaggccagacgtctaggccacaactttgttgggacagagcagattttactaggtcttattggtgagggaactgggattgcagctaaggttctgaaatctatgggaattaatcttaaggatgcccgagttgaagttgagaagattattggccgaggtagtgggtttgtggctgttgaaatcccattcacaccccgtgccaagcgtgtattggaactgtcacttgaagaagctcgccagctagggcacaactatataggatctgagcacttactcctggggctacttcgcgagggtgaaggtgtggccgcccgtgtgcttgagagccttggtgctgatccaaacaacatccgtacccaggtcataagaatggttggtgaaagcacggaagctgttggtgctggagttggtggaggaactagtggccagaagatgcccacacttgaggaatatggtactaatttgacaaaactggcagaagagggaaaacttgacccagttgttggcagacagaaccagattgagcgtgtaacccagattttgggcaggcgaacaaagaacaacccctgcttaattggagagcctggtgttggcaagactgctattgcagaggggctggcgcagcgtatcgccaatggggatgtcccagaaacaattgaaggaaagaaggttattactcttgacatggggcttcttgtggctggtaccaagtaccgtggagagtttgaagaaagattgaagaagcttatggaggaaatcaagcaaaatgaagatattattctctttattgatgaagtgcacacacttattggagctggtgcagctgaaggtgcaattgatgctgctaacatcttgaaaccagctcttgctagaggtgaattgcagtgcattggtgccacaactctggatgagtataggaagcacatcgagaaagatcctgcattagagagaagattccagccagttaaagttccagagccaactgttgatgaaacaacacagatcttaagaggtcttcgtgagagatatgaactccatcataagctgagatacacagacgaagctctagttgccgcagcacagttgtcatatcagtatatcagtgaccgcttcctgcctgataaagctatcgacttgattgatgaagctggatcccgtgttaggctgaggcatgcacagctgcctgatgaagccaaagagttggacaaagagctcaggcagataaccaagcagaagaatgaggctgtacgtggccaagattttgagaaggcaggggaactaagagatcgggaaatggagctgaaggcccaaattacagccattattgacaagagcaaggagatgattaaagcagagactgaatctggcgaagttggtcctcttgtcacagaggcagacattcagcatattgtctcctcttggactggaataccagtggagaaagtctcagctgacgagtctgaccgtctccttaagatggaggagacattgcatacgcgtatcattggccaggacgaggctgtaaaagctattagccgtgctatccgccgtgctcgtgttggcctcaagaatccgaaccgaccaattgctagcttcatattctccggaccaactggtgttggaaaatcagaattagcgaagtctctggcagcctactactttggctcagaggaagctatgatcaggctggacatgagtgagttcatggagagacatactgtcgccaagctcatagggtcacctccaggttatgttggctacactgagggtggccaacttactgaagccgttcgtcgccgtccatacactgttgttctgtttgatgagattgaaaaggcacatccagatgtcttcaatatgatgcttcagatcttggaagatgggagactaactgacagtaaaggaagaacagttgatttcaagaacacattgctgatcatgacatccaatgtcgggagcagtgtcatcgagaagggaggccgtaagattgggtttgatcttgactatgatgagaaggacagcagctacaccaggatcaagagcctggtgacggaggagttgaagcagtacttccggccagagttcctgaacagattggatgagatgattgtgttccggcagctgacaaagttggaggtgaaggagattgctgatattatgctgaaagaagtatttaatcggctcaaggcgaaggacattgatctccaggtcactgagaggttccgcgatagggttgttgatgaaggttacaacccgagctatggtgccaggcctctgcgccgtgctatcatgaggctcttggaagacagtttggcagagaagatgctggctggtgaggtgaaagaaggtgactctgctattgtcgatgtggattcagaaggcaaggtaatagtcctgaacggtgggagtggtgttcctgagccactggaacctgctctcagtgtctaggggaggctgaaatcctcggtttggaatctggccttttcacatctcagcggggctcctcatgaattatgatagtaaaactagatatacagcgctagcccccttccgttaggtttctctttcattgttttttttggggtttctttttggaattgaggcagtagaaatgctatggaaatgaataggtaggggcaaagtggatgctagatcctgagttgctttgtttttggaaggattttggaagctttatttttggaaggatgtcggaagcttggtttcctacattactgtattgctaggtcatgcttgcagtaggatattggatacggttgcactgttgtacggaaccttccaattatgtatggaaatataacttatccacgccttcaataacagtggcttatcatgattctaagtcatgctggttattctacaacactgatgctagaactgtacttgaatgttattgctcctgtaggttgtaaatttagcactgttaaatcaaattttgctgcat

SEQ ID NO: 3035 - DNA, 3468 bp, Setaria italica
cgagagctaccgctccatcccctccccctcaccctagggctccgtcgccgcgccggcgcagcgttcagccgccgccgccgccgtcggccccgcccgccctcttcaggaccaccctcctccggtcccgccactctcctccgcgcgtaatctctccggctcaggctccactgatttggatagggattcattggctgattcaatatggaggggactctagttcagtccgcgattgttcccaccgtattacaccggagcagctctggtcgatctcgtgtgcgcgcaagggccacgatgctgcgcagtacgccaacgcggacccttactcttggaggcttccaagggctgcggcagacaaattttctggacacgaggtccgtggttaagcgtgactttggatatattgtagcaagtcagatttcgcgaccacgaggttcagcatcaagaggggtggttcgtgccatgttcgaacgcttcactgaaaaggccatcaaggtggttatgcttgcacaagaggaggccagacgtctaggccacaactttgttgggacagagcagattttactaggtcttattggtgagggaactgggattgcagctaaggttctgaaatctatgggaattaatcttaaggatgcccgagttgaagttgagaagattattggccgaggtagtgggtttgtggctgttgaaatcccattcacaccccgtgccaagcgtgtattggaactgtcacttgaagaagctcgccagctagggcacaactatataggatctgagcacttactcctggggctacttcgcgagggtgaaggtgtggccgcccgtgtgcttgagagccttggtgctgatccaaacaacatccgtacccaggtcataagaatggttggtgaaagcacggaagctgttggtgctggagttggtggaggaactagtggccagaagatgcccacacttgaggaatatggtactaatttgacaaaactggcagaagagggaaaacttgacccagttgttggcagacagaaccagattgagcgtgtaacccagattttgggcaggcgaacaaagaacaacccctgcttaattggagagcctggtgttggcaagactgctattgcagaggggcttgcgcagcgtatcgccaatggggatgtcccagaaacaattgaaggaaagaaggttattactcttgacatggggcttcttgtggctggtaccaagtaccgtggagagtttgaagaaagattgaagaagcttatggaggaaatcaagcaaaatgaagatattattctctttattgatgaagtgcacacacttattggagctggtgcagctgaaggtgcaattgatgctgctaacatcttgaaaccagctcttgctagaggtgaattgcagtgcattggtgccacaactctggatgagtataggaagcacatcgagaaagatcctgcattagagagaagattccagccagttaaagttccagagccaactgttgatgaaacaacacagatcttaagaggtcttcgtgagagatatgaactccatcataagctgagatacacagacgaagctctagttgccgcagcacagttgtcatatcagtatatcagtgaccgcttcctgcctgataaagctatcgacttgattgatgaagctggatcccgtgttaggctgaggcatgcacagctgcctgatgaagccaaagagttggacaaagagctcaggcagataaccaagcagaagaatgaggctgtacgtggccaagattttgagaaggcaggggaactaagagatcgggaaatggagctgaaggcccaaattacagccattattgacaagagcaaggagatgattaaagcagagactgaatctggcgaagttggtcctcttgtcacagaggcagacattcagcatattgtctcctcttggactggaataccagtggagaaagtctcagctgacgagtctgaccgtctccttaagatggaggagacattgcatacgcgtatcattggccaggacgaggctgtaaaagctattagccgtgctatccgccgtgctcgtgttggcctcaagaatccgaaccgaccaattgctagcttcatattctccggaccaactggtgttggaaaatcagaattagcgaagtctctggcagcctactactttggctcagaggaagctatgatcaggctggacatgagtgagttcatggagagacatactgtcgccaagctcatagggtcacctccaggttatgttggctacactgagggtggccaacttactgaagccgttcgtcgccgtccatacactgttgttctgtttgatgagattgaaaaggcacatccagatgtcttcaatatgatgcttcagatcttggaagatgggagactaactgacagtaaaggaagaacagttgatttcaagaacacattgctgatcatgacatccaatgttgggagcagtgtcatcgagaagggaggccgtaagattgggtttgatcttgactatgatgagaaggacagcagctacaccaggatcaagagcctggtgacggaggagttgaagcagtacttccggccagagttcctgaacagattggatgagatgattgtgttccggcagctgacaaagttggaggtgaaggagattgctgatattatgctgaaagaagtatttaatcggctcaaggcgaaggacattgatctccaggtcactgagaggttccgcgatagggttgttgatgaaggttacaacccgagctatggtgccaggcctctgcgccgtgctatcatgaggctcttggaagacagtttggcagagaagatgctggctggtgaggtgaaagaaggtgactctgctattgtcgatgtggattcagaaggcaaggtaatagtcctgaacggtgggagtggtgttcctgagccactggaacctgctctcagtgtctaggggaggctgaaatcctcggtttggaatctggccttttcacatctcagcggggctcctcatgaattatgatagtaaaactagatatacagcgctagcccccttccgttaggtttctctttcattgttttttttggggtttctttttggaattgaggcagtagaaatgctatggaaatgaataggtaggggcaaagtggatgctagatcctgagttgctttgtttttggaaggattttggaagctttatttttggaaggatgtcggaagcttggtttcctacaattactgtattgctaggtcatgcttgcagtaagatattggatacggttgcactgttgtacggaaccttccaattatgtatgaaaatataacttatccacgccttcaataacagtggcttatcatgattctaagtcatgctggttattctacaacactgatgctagaactgtacttgaatgttattgctcctgtaggttgtaaatttagcactgttaaatcaaattttgc

SEQ ID NO: 3036 - DNA, 3102 bp, Secale cereale
gcgagaagcgagcgagagggtggggcggcggccaggggagcggctggacctgggggcaaggcagcgagcacggcgcgtgcacgagctgaggtatttcttcggcactggtaaacctgtggttctttggatagttcaatatggaggggactctggttcagtctgccgtcgctcctaccgcctacaggagtagctctacgcggttccgtgtgcgcacaagggccacaatgttacgcagtacgccaacgaggacccttactctcgggggttttcaaggactgcggcaaacaaatttcctggatacaaggtccgttatcaaacgcgactttggctccattgtagcaagccagatttcacgaccgcgtgggtcaggttcaagaatggttgtccgggccatgttcgagcgtttcacagagaaagcaatcaaggtgattatgcttgcacaggaggaagcaagacgcctaggccacaactttgttgggacagaacagattctgcttggccttattggtgaaggaactggaattgcagcaaaggttctaaagtctatggggatcagtcttaaggatgcccgtgtggaagttgaaaagattattggaagaggcagtgggtttgttgccgttgaaataccatttacacctcgtgcaaagcgtgtactcgaactgtcacttgaagaagctcgccagctagggcataactatataggatctgagcacttactcttagggctacttcgtgagggtgaaggtgtggcagctcgagttctcgaaagccttggtgctgatccaaacaacattcgtacccaggttataagaatggttggtgaaagcacagaagctgttggtgctggggttggtgggggaagcagtggccagaagatgcctacacttgaagaatacggtactaatttgacaaagctggcagaagagggtaaactagacccagttgttggcagacaggatcaaattgagcgtgtaactcaaattttgggccggcggacaaagaacaacccgtgcttaattggagagcctggtgtcggcaagactgctattgccgaggggcttgcacaacgtatttgtaatggtgatgttccggaaacaattgaaggaaagaaggttattacccttgacatggggctccttgttgctggtaccaagtaccgtggagaatttgaagaaaggctgaagaagcttatggaagaaattaagcaaaatgatgatattatactgtttattgatgaagtgcacacgttgatcggagcaggtgcagctgaaggcgcaattgatgctgctaacatcttaaaaccagctcttgcaagaggtgaactgcagtgcattggtgccacaacattggatgagtacaggaaacatattgagaaagatcctgctttggagcgaaggttccaaccagtcaaggttccagagcccactgttgaagaatcaatacaaatcttaagaggacttcgtgagagatatgaacttcatcataagctgcgatacacagatgatgctttagttgctgcggcgcagttatcatatcagtatatcagtgatcgcttcctgcctgataaggctattgacttgattgatgaagcggggtcccgtgttaggctcaggcatgcacagctacctgatgaggccaaggagctggacaaaaaacttcgccaaataacaaaggacaagaacgaggctgtgcgaggccaagattttgagaaggctggggaattaagagacgaggaaatggagctgaaggcccaaattacagccattattgacaagagcaaggaaatggttaaagcagagactgaatccggtgaagttggtcctcttgtcacagaggcagatattcaacacatcgtctcatcatggactggtatacctgtggagaaagtctcatctgatgagtctgaccgcctccttaagatggaagagactctccatacacgtatcattgggcaggatgaagctgtcaaagctattagccgtgctatccgccgtgctcgtgttggcctcaagaatccaaaccggcccattgctagcttcatattctctggaccaactggtgttggtaaatcagaattagcaaaggctctggcatcctactactttggctcagaggaagccatgatcagattagatatgagtgagttcatggagagacatacggtgtccaaactcatcggatcacctccaggttatgttggctacactgagggaggtcaactaacagaagcagtccgccgccgtccatacacagttgttctctttgatgagattgagaaggcacatccagatgtcttcaacatgatgcttcagatcttagaagatgggaggctgacagatagcaagggacgtacagttgatttcaagaacactctgctgatcatgacatcgaatgtcggaagcagtgtcattgagaagggaggccggaagattgggtttgaccttgactctgacgagaaagataccagctataacaggatcaagagcttggtgacagaggagttgaagcagtatttccggcctgagttcttgaacagattggatgagatgattgtgttccggcagctgacaaagttggaggtgaaagagatagctgatattatgctcaaagaggtgtttgataggctcaaggcaaaggaaatcgacctccaggtaacagagaagttccgggatagggttgtcgatgaaggttacaacccgagctacggtgccaggcctctgcgacgtgctattatgaggcttttggaagacagcctcgcggaaaagatgctggctggcgaggtcaaggaaggtgattctgctattgttgatgtggattcggacggtaaggtggtagttctcaacagtgggggtggtattgcagagccgctggagcctgctctgagtgcatagttggggacgccatcttttaatttcattatctcagcttggggtcctcgtgatggtacctagattaatatcactcccctttcagttatgtgttctcttcctttttttctctcttctttcactttcttgaagtttgaagtgaggcactagaaattatcatgtaaacgaaacaaacatagatgcatgtacgagcaaagatgtatgcttatctttt

SEQ ID NO: 3037 - DNA, 3215 bp, Triticum aestivum
ggcactggtaaacctgtggttctttggttagttcaatatggaggggactctggttcagtctgccattgctcctaccgcatacaggagtagctctacgcggtcccgtgtgcgcacaagggccacaatgttacgcagtacgccaacgaggaccctcactctcgggggttttcaaggactgcggcaaacaaatttcctggatacaaggtccgttatcaaacgtgactttggctccattgtagcaagccagatttcacgaccacgtgggtcaggttcaagaatggttgtccgggccatgttcgagcgcttcacagagaaagcaatcaaggtgattatgcttgcacaggaggaagcaagacgcctaggccacaactttgttgggacagaacagattctgcttggccttattggtgagggaactggaattgcagcaaaggttctaaagtctatggggatcagtcttaaggatgcccgtgtggaagttgaaaagattattggaagaggcagtgggtttgttgccgttgaaattccatttacacctcgtgcaaagcgtgtactcgaactgtcacttgaagaagctcgccagctagggcataactatataggatctgagcacttactcttagggctacttcgtgagggtgaaggtgtggcagctcgagttctcgaaagccttggtgctgatccaaacaacattcgtacccaggttataagaatggttggtgaaagcacagaagctgttggtgctggggttggtgggggaagcagtggccagaagatgcctacacttgaagaatacggtactaatttgacaaagctggcagaagagggtaaactagacccagttgttggcagacaggatcaaattgagcgtgtaactcaaattttgggcaggcggacaaagaacaacccgtgcttaattggagagcctggtgttggcaagactgctattgcagaggggcttgcacaacgtatttgtaatggtgatgttccggaaacaattgaaggaaagaaggttatcacccttgacatggggctccttgttgctggtaccaagtaccgtggagagtttgaagaaaggctgaagaagcttatggaagaaattaagcaaaatgatgatattatactttttattgatgaagtgcacacgttgatcggagcaggtgcagctgaaggtgcaattgatgctgctaacatcttaaaaccagctcttgcaagaggtgaactgcagtgcattggtgccacaacactggatgagtacaggaaacatatcgagaaagatcctgctttggagcgaaggtttcaaccagtcaaggttccagagcccactgttgaagaatcaatacaaatcttaagaggacttcgtgagagatatgaacttcatcataagctgcgatacacagatgatgctttagttgccgcggcgcagttatcatatcagtatatcagtgaccgcttcctgcctgacaaggctattgacttgattgatgaagcggggtcccgtgttaggctcaggcatgcacagctacctgatgaggccaaggagctggacaaaaaacttcgccaaataacaaaggacaagaatgaggctgtgcgtggccaagattttgagaaggctggggaattaagagacgaggaaatggagttgaaggcccaaattacagccattattgacaagagcaaggaaatggttaaagcagagactgaatccggcgaagttggtcctcttgtcacagaggcagatattcaacacatcgtctcatcatggactggtatacctgtggagaaagtctcatctgatgaatctgaccgcctccttaagatggaagagactctccatactcgtatcattggtcaggatgaagctgtcaaagctattagccgtgctatccgccgtgctcgtgttggcctcaagaatccaaatcggcccattgctagcttcatattctctggaccaactggtgttggtaaatcagaattagcaaaggctctggcatcctactactttggctcagaggaagccatgatcagattagatatgagtgagtttatggagagacatacggtgtccaaactcatcggatcacctccaggttatgttggctacaccgagggaggtcaactaacagaagcagtccgccgccgtccatacacagttgttctctttgatgagattgaaaaggcacatccagatgtcttcaacatgatgcttcagatcttagaagatgggaggctgacagatagcaagggacggacagttgacttcaagaacactctgctgatcatgacatcgaatgtcggaagcagtgtcatcgagaagggaggccggaagattgggtttgaccttgactctgacgagaaagataccagctataacaggatcaagagcttggtgaccgaggagttgaagcagtatttccggccagagttcttgaacagattggatgagatgattgtgttccggcagctgacaaagctggaggtgaaagagatcgctgatattatgctcaaggaggtgtttgacaggctcaaggcaaaggaaatcgacctccaggtaacagagaagttccgggatagggttgtcgatgaaggttacaacccgagctacggtgccaggcctctgcgacgtgccattatgaggcttttggaagacagtctggcggaaaagatgctggctggcgaggtcaaggaaggtgattctgctattgttgatgtggattcggatggtaaggtggtagttctcaacagcgggggtggtattgcagagccgctggagcctgctctgagtgcctagttgggtacaccatcttcttatttcgttatctcagcttggtgtcctggtgatggtacctagattaatatcactgccctttcagttatgtgttctcctcttcttttttttgtctctctcttctttcactctcttgaagttcgaagtttgaagcgaggcactagaaattgttatgtaaacgaaacaaacatagatgcatgtacgagcaagctgtatgccagtatatcttttgagttttcttttttctttttgagagagtagttgctctgtttctgaagaacagttgaaggcttcatttacctgcacttacttgctttgtactgtactccctccttccatgaataagtgtatctctagcttttgtcataagtcaaagttttaaaattttgaccaactttatagggaaaagtagcagcatttatggcac

SEQ ID NO: 3038 - DNA, 3392 bp, Triticum aestivum
cacgagttgaggtagtatttcttcggtaggagtattccacttttcattgtaacatggatcctacggagcagtagttatattaattttagctaagcctgtgaattgctaggatttcgcatctagctctcttccccgtgttatcgactccgcccgtcccaaggttctccctaggtcctccgccgctgggcggccacgtcgtcgccgaggcactggtaaacctgtggttctttggttagttcaatatggaggggactctggttcagtctgccattgctcctaccgcatacaggagtagctctacgcggtcccgtgtgcgcacaagggccacaatgttacgcagtacgccaaccaggaccctcactctcgggggttttcaaggactgcggcaaacaaatttcctggatacaaggtccgttatcaaacgtgactttggctccattgtagcaagccagatttcacgaccacgtgggtcaggttcaagaatggttgtccgggccatgttcgagcgctttacagagaaagcaatcaaggtgattatgcttgcacaggaggaagcaagacgcctaggccacaactttgttgggacagaacagattctgcttggccttattggtgagggaactggaattgcagcaaaggttctaaagtctatggggatcagtcttaaggatgcccgtgtggaagttgaaaagattattggaagaggcagtgggtttgttgccgttgaaattccatttacacctcgtgcaaagcgtgtactcgaactgtcacttgaagaagctcgccagctagggcataactatataggatctgagcacttactcttagggctacttcgtgagggtgaaggtgtggcagctcgagttctcgaaagccttggtgctgatccaaacaacattcgtacccaggttataagaatggttggtgaaagcacagaagctgttggtgctggggttggtgggggaagcagtggccagaagatgcctacacttgaagaatacggtactaatttgacaaagctggcagaagagggtaaactagacccagttgttggcagacaggatcaaattgagcgtgtaactcaaattttgggcaggcggacaaagaacaacccgtgcttaattggagagcctggtgttggcaagactgctattgcagaggggcttgcacaacgtatttgtaatggtgatgttccggaaacaattgaaggaaagaaggttattacccttgacatggggctccttgttgctggtaccaagtaccgtggagagtttgaagaaaggctgaagaagcttatggaagaaattaagcaaaatgatgatattatactttttattgatgaagtgcacacgttgatcggagcaggtgcagctgaaggtgcaattgatgctgctaacatcttaaaaccagctcttgcaagaggtgaactgcagtgcattggtgccacaacactggatgagtacaggaaacatatcgagaaagatcctgctttggagcgaaggtttcaaccagtcaaggttccagagcccactgttgaagaatcaatacaaatcttaagaggacttcgtgagagatatgaacttcatcataagctgcgatacacagatgatgctttagttgctgcggcgcagttatcatatcagtatatcagtgaccgcttcctgcctgacaaggctattgacttgattgatgaagcggggtcccgtgttaggctgaggcatgcacagctacctgatgaggccaaggagctggacaaaaaacttcgccaaataacaaaggacaagaatgaggctgtgcgtggccaagattttgagaaggccggggaattaagagacgaggaaatggagctgaaggcccaaattacagccattattgacaagagcaaggaaatggttaaagcagagactgaatccggtgaagttggccctcttgtcacagaggcagatattcaacacatcgtctcatcatggactggtatacctgtggagaaagtctcatctgatgagtctgaccgcctacttaagatggaagagactctccatacacgtatcattgggcaggatgaagctgtcaaagctattagccgtgctatccgccgtgctcgtgttggcctcaagaatccaaatcggcccattgctagcttcatattctctggaccaactggtgttggtaaatcagaattagcaaaggctctggcatcctactactttggctcagaggaagccatgatcagattagatatgagtgagttcatggagagacatacggtctccaaactcatcggatcacctccaggttatgttggctacactgagggaggtcaactaacagaagcagtccgccgccgtccatacacagttgttctctttgatgagattgaaaaggcacatccagatgtcttcaacatgatgcttcagatcttagaagatgggaggctgacagatagcaagggacggacagttgatttcaagaacacactgttgatcatgacatcgaatgtcggaagcagtgtcatcgagaagggaggccggaagattgggtttgaccttgactctgacgagaaagataccagctataacaggatcaagagcttggtgaccgaggagttgaagcagtatttccggcctgagttcttgaacagattggatgagatgattgtgttccggcagttgacaaagttggaggtgaaagagatcgctgatattatgctcaaggaggtgtttgataggctcaaggcaaaggaaatcgacctccaggtaacagagaagttccgggatagggttgttgatgaaggttacaacccgagctacggtgccaggcctctgcgacgcgccattatgaggcttttggaagacagtctggctgaaaagatgctggctggcgaggtcaaggaaggtgattctgctattgttgatgtggattcggatggtaaggtggtagttctcaacagcgggggtggtattgcagagccgctggagcctgctctgagtgcctagttgggtacaccatctttttatttcgttatctcagcatggggtcctggtgatggtacctagattaatatcactgccctttcagttatgtgttctcttccttttttgtctctcctctttcactctcttgaagttcgaagtttgaagcgaggcactagaaattgttatgtaaacgaaacaaacatagatgcatgtacgagcaagctgtatgccagtatatcttttgagttctgttttcttttttctttttgagggtagttgctctgtttctgaagaacagttgaaggcttcatttacctgcacttacttgctttgtactgtactccctccttccatgaataagtgtatctctagcttttgtcataagtcaaagttttaaaattttgaccaactttatag

SEQ ID NO: 3039 - DNA, 3191 bp, Triticum aestivum
tagctctcttccccgtgttatcgactccgcccgtcccaaggttctcccgaggtcctccgccgctgggcggccacgtcgtcgccgaggcaccggtaaacctgtggttctttggttagttcaatatggaggggactctggttcagtctgccattgctcctaccgcctacaggagtagctctacgcggtcccgtgtgcgcacaagggccacaatgttacgcagtacgccaacgaggaccctcactctcgggggttttcaaggactgcggcaaacaaatttcctggatacaaggtccgttatcaaacgtgactttggctccattgtagcaagccagatttcacgaccacgtgggtcaggttcaagaatggttgtccgggccatgttcgagcgcttcacagagaaagcaatcaaggtgattatgcttgcacaggaggaagcaagacgcctaggccacaactttgttgggacagaacagattctgcttggccttattggtgagggaactggaattgcagcaaaggttctaaagtctatggggatcagtcttaaggatgcccgtgtggaagttgaaaagattattggaagaggcagtgggtttgttgccgttgaaattccatttacacctcgtgcaaagcgtgtactcgaactgtcacttgaagaagctcgccagctagggcataactatataggatctgagcacttactcttagggctacttcgtgagggtgaaggtgtggcagctcgagttctcgaaagccttggtgctgatccaaacaacattcgtacccaggttataagaatggttggtgaaagcacagaagctgttggtgctggggttggtgggggaagcagtggccagaagatgcctacacttgaagaatacggtactaatttgacaaagctggcagaagagggtaaactagacccagttgttggcagacaggatcaaattgagcgtgtaactcaaattttgggcaggcgtacaaagaacaacccatgcttaattggagagcctggtgtcggcaagactgctattgcagaggggcttgcacaacgtatttgtaatggggatgttccggaaacaattgaaggaaagaaggttattacccttgacatggggctccttgttgctggtaccaagtaccgtggagagtttgaagaaaggctgaagaagcttatggaagaaattaagcaaaatgatgatattatactctttattgatgaagtgcacacgttgatcggagcaggtgcagctgaaggtgcaattgatgctgctaacatcttaaaaccagctcttgcaagaggtgaactgcagtgcattggtgccacaacactcgatgagtacaggaaacatatcgagaaagatcctgctttggagcgaaggtttcaaccagtcaaggtaccagagcccactgttgaagaatcaatacaaatcttaagaggacttcgtgagagatatgaacttcatcataagctgcgatacacagatgatgctttagttgccgcggcgcagttatcatatcagtatatcagtgaccgcttcctgcctgacaaggctattgacttgattgatgaagcggggtcccgtgttaggctcaggcatgcacagctacctgatgaggccaaggagctggacaaaaaacttcgccaaataacaaaggacaagaatgaggctgtgcgtggccaagattttgagaaggctggggaattaagagacgaggaaatggagctgaaggcccaaattacagccattattgacaagagcaaggaaatggttaaagcagagactgaatccggcgaagttggtcctcttgtcaccgaggcagatattcagcacatcgtctcatcatggactggtatacctgtggagaaagtctcatctgatgagtctgaccgcctccttaagatggaagagacactccatacgcgcatcattgggcaggatgaagctgtcaaagctattagccgtgctatccgccgtgctcgtgttggcctcaagaatccaaatcgacccattgctagcttcatattctctggaccaactggtgttggtaaatcagaattagcaaaggctctggcatcctactactttggctcagaggaagccatgatcagattagatatgagtgagttcatggagagacatacagtgtccaaactcatcggatcacctccaggttatgttggctacactgaaggaggtcaactaacagaagcagtccgccgccgtccatacacagttgttctctttgatgagattgaaaaggcacatccagatgtcttcaacatgatgcttcagatcttagaagatgggaggctgacagatagcaagggacggacagttgatttcaagaacacactgttgatcatgacatcgaatgtcggaagcagtgtcatcgagaagggaggccggaagattgggtttgaccttgactctgatgagaaagataccagttataacaggatcaagagcttggtgaccgaggagttgaagcagtatttccggcctgagttcttgaacagattggatgagatgattgtgttccggcagctgacaaaactggaggtgaaagagattgctgatattatgctcaaggaggtgtttgacaggctcaaggcaaaggaaatcgacctccaggtaacggagaagttccgggatagggttgtggatgaaggttacaacccgagctacggtgccaggcctctgcgacgcgccattatgaggcttttggaagacagtctggcggaaaagatgctggctggcgaggtcaaggaaggtgattctgctattgttgatgtggattcggatggtaaggtggtagttctcaacagcgggggtggtattgcagagccgctggagcctgctctgagtgcctagttgggtataccatctttttatttcgttatctcagcttggggtcctggtgatggtacctagattaatatcactgccctttcagttatgtgttctcctcttccttttttgtctctcttctttcactctcttgaagttcgaagtttgaagtgaggcactagaaattgttattgtaaacgaaacaaacatagatgcatgtacgagcaagctgtatgccagtatatcttttgagttttcttttttctttttgagagagtagttgctctgtttctgaagaacagttgaaggattcatctacctgcagttacttgctttgta

SEQ ID NO: 3040 - DNA, 3321 bp, Triticum aestivum
aggtattccactttcattgtaacatggatcctacggagcagtagttatattaattttagctaagcctgtgaattgctaggatttcgcatctaggtagctatcttccccgtgttatcgactccgcccgtcccaaggttctcccgaggtccttcgccgctgggcggccacgtcgtcgccgaggcaccggtaaacctgtggttctttggttagttcgatatggaggggactctggttcagtctgccatcgctcctaccgcctacaggactagctctacgcggtcccgtgtgcgcacaagggccacaatgttacgcagtacaccaacgaggacccttactctcgggggttttcaaggactgcggcaaacaaatttcctggatacaaggtccgttatcaaacgtgactttggctccattgtagcaagccagatttcacgaccacgtgggtcaggttcaagaatggtcgtccgggccatgttcgagcgcttcacagagaaagcaatcaaggtgattatgcttgcacaggaggaagcaagacgcctaggccacaactttgttgggacagaacagattctgcttggccttattggtgagggaactggaattgcagcaaaggttctaaagtctatggggatcagtcttaaggatgcccgtgtggaagttgaaaagattattggaagaggcagtgggttcgttgccgttgaaattccatttacacctcgtgcaaagcgtgtactcgaactgtcacttgaagaagctcgccagctagggcataactatataggatctgagcacttactcttagggctacttcgtgagggtgaaggtgttgcagctcgagttctcgaaagccttggtgctgatccaaacaacattcgtacccaggttataagaatggttggtgaaagcacagaagctgttggtgctggggttggtgggggaagcagtggccagaagatgcctacacttgaagaatacggtactaatttgacaaagctggctgaagagggtaaactagacccagttgttggcagacaggatcaaattgagcgtgtaactcaaattttgggcaggcggacaaagaacaacccgtgcttaattggagagcctggtgtcggcaagactgctattgcagaggggcttgcacaacgtatttgtaatggtgatgttccggaaacaattgaaggaaagaaggttattacccttgacatggggctccttgttgctggtaccaagtaccgtggagagttcgaagaaaggctgaagaagcttatggaagaaattaagcaaaatgatgatattatactgtttattgatgaagtgcacacgttgatcggagcaggtgcagctgaaggtgcaattgatgctgctaacatcttaaaaccagctcttgcaagaggtgaactgcagtgcattggtgccacaacactggatgagtacaggaaacatatcgagaaagatcctgctttggagcgaaggtttcaaccagtcaaggttccagagcccactgttgaagaatcaatacaaatcttaagaggacttcgtgagagatatgagcttcatcataagctgcgatacacagatgatgctttagttgctgcggcgcagttatcatatcagtatatcagtgaccgcttcctgcctgacaaggctattgacttgattgatgaagcggggtcccgtgttaggctcaggcatgcacagctacctgatgaggccaaggagctggacaaaaaacttcgccaaataacaaaggacaagaatgaggctgtgcgtggccaagattttgagaaggctggggaattaagagacgaggaaatggagttgaaggcccaaattacagccattattgacaagagcaaggaaatggttaaagcagagactgaatccggcgaagttggtcctcttgtcacagaggcagatattcaacacatcgtctcatcatggactggtatacctgtggagaaagtctcatctgatgaatctgaccgcctccttaagatggaagagactctccatactcgtatcattggtcaggatgaagctgtcaaagctattagccgtgctatccgccgtgctcgtgttggcctcaagaatccaaatcggcccattgctagcttcatattctctggaccaactggtgttggtaaatcagaattagcaaaggctctggcatcctactactttggctcagaggaagccatgatcagattagatatgagtgagtttatggagagacatacggtgtccaaactcatcggatcacctccaggttatgttggctacaccgagggaggtcaactaacagaagcagtccgccgccgtccatacacagttgttctctttgatgagattgaaaaggcacatccagatgtcttcaacatgatgcttcagatcttagaagatgggaggctgacagatagcaagggacggacagttgacttcaagaacactctgctgatcatgacatcgaatgtcggaagcagtgtcatcgagaagggaggccggaagattgggtttgaccttgactctgacgagaaagataccagctataacaggatcaagagcttggtgaccgaggagttgaagcagtatttccggccagagttcttgaacagattggatgagatgattgtgttccggcagctgacaaagctggaggtgaaagagatcgctgatattatgctcaaggaggtgtttgacaggctcaaggcaaaggaaatcgacctccaggtaacagagaagttccgggatagggttgtcgatgaaggttacaacccgagctacggtgccaggcctctgcgacgtgccattatgaggcttttggaagacagcctggcggaaaagatgctggctggcgaggtcaaggaaggtgattctgctattgttgatgtggattcggatggtaaggtggtagttctcaacagcgggggtggtattgcagagccgctggagcctgctctgagtgcctagttgggtacaccatcttcttatttcgttatctcagcttggtgtcctggtgatggtacctagattaatatcactgccctttcagttatgtgttctcctcttctttttttgtctctctcttctttcactctcttgaagttcgaagtttgaagcgaggcactagaaattgttatgtaaacgaaacaaacatagatgcatgtacgagcaagctgtatgccagtatatcttttgagttttttcttttctttttgagagagtagttgctctgtttctgaagaacagtcgaaggcttcatctacctgcagttacttgctttgtactatctccgtctcggtgaataagtctaggtcggcg

SEQ ID NO: 3041 - DNA, 3269 bp, Avena sativa
cttgaacagattggatgagatgattgagtgccgtctaatccgaggcaacgaaggcacggaggagactttagccctagcgagcgcgcggcggcggccagcggggaaggcagcgaacacggcggtcggcagttggctccgtccacgtgcgcggcaggcagaaaggagttgaggcactgctaaatcagtggttctctggttagttcaatatggaggggactctagttcagtctgtcattgctccaaccgcatacaggagcagccctacgcggttccgtgtgcgcacaagggccacgatgttacgcagtatgccaacgaggacccttactcttgggggttttcaagggctgcggcaaacaaacttcttggatacaaggtccgtcatcaaacgtgactttggctccatcgtagcaagccagatttcacggccacgagggtcggggtcaagaatggtagtccgggccatgttcgagcgcttcactgagaaagcaatcaaggtgattatgcttgcacaggaggaagcaagacgtctaggccacaactttgttggcacagagcagattctgctgggccttattggcgagggaactggaattgcagcgaaggttctgaagtctatggggatcagtcttaaggatgcccgtgtggaagttgagaagattattggacgaggcagtgggtttgttgctgttgaaatcccatttacaccccgtgcaaagcgtgtgctggaactatcacttgaagaagcccgccagctagggcataactatataggatctgagcacttactcctagggctacttcgtgagggtgaaggtgtggcagcccgggtactcgaaagtctgggtgctgatccaaacaacattcgtacccaggtcataagaatggttggtgaaagcacagaagctgttggtgctggtgttggtgggggaagcagtggtcagaagatgcctacacttgaagaatatggtactaatttgacaaagctggcagaagagggtaaactagacccagttgttggtagacaggatcaaattgagcgtgtcactcaaattttgggaagacggacaaagaacaacccgtgcctgattggagagcctggtgtcggcaagactgctattgcagaagggcttgcacagcgtatttgcaatggggatgttccagaaacaatcgaaggaaagaaggttattacccttgacatggggctccttgttgctggtaccaagtaccgtggagagtttgaagaaagactgaagaagcttatggaggaaattaagcaaaatgatgacattattctctttattgatgaagtgcacacattgatcggagcaggtgcagctgaaggtgcaattgatgctgctaacatattaaaaccagctcttgcaagaggtgaactgcagtgcattggtgccacaacgctggatgagtataggaaacatatcgagaaagatcctgcattggagcgcaggtttcaaccagttaaggttccagagcccactgttgatgaatcaatacagatcctaagaggacttcgtgagagatatgaacttcatcataagctgcgatacaccgatgaggctttagttgctgcggcacagttatcatatcagtatatcagtgaccgcttcctgcctgacaaggctattgacttgattgatgaagcgggttcccgtgttaggctcaggcatgcacagctccctgatgaagccaaggatctggacaaaaaacttcgccagataaccaaggacaagaacgaggctgtgcgtggccaagattttgagaaggctggggaattaagagatgaggagatggagctgaaggctcaaattacagccattattgacaagagcaaggaaatgattaaagcagagactgaatctggtgaagttggtcctgttgtcaccgaggcagatattcaacacattgtctcctcttggactggtatacctgtggagaaagtctcatccgatgagtctgaacgcctccttaagatggaagagacactccatacacgtatcattgggcaggatgaggctgtcaaagctattagccgtgctatccgccgtgctcgtgttggcctcaagaatccgaatcggcccattgctagcttcatattctctggaccaaccggtgttggtaaatcagaattggcaaaggctctggcatcctactactttggctcagaggaagccatgaccagattagatatgagtgagttcatggagagacatacagtctccaaactcatcggatcacctccaggctatgttggctacactgagggaggtcaactaacagaagcagtccgccgccgtccgtacacagttgttctctttgatgagattgagaaggcacatccagatgtcttcaacatgatgcttcagatcttagaagatgggaggctcactgatagcaagggacggacagttgatttcaagaacacgctgttgatcatgacatcgaatgttggaagcagtgtgatcgagaagggaggccggaagatcggatttgaccttgactctgacgagaaagacaccagctataacaggatcaagagtctggtgactgaggagctaaagcagtacttcaggcctgagttcttgaacagattggatgagatgattgtgttccggcagctgacaaagttggaggtgaaagatattgctgatattatgctcaaggaggtgtttgacaggctcaaggccaaggagatcaacctacaggtaacagagaagttccgggacagggttgtggatgaaggctacaacccaagctacggtgccaggcctctgcggcgtgctattatgaggctcctggaggacagtctcgcggaaaagatgctggctggcgaggtgaaggaaggtgactctgctattgttgatgtggatgcggacggtaaggtggtagttctcaacagtgggagcggtatcgcggagcctctggcacccgctttgagtgtctagctggggacaccatcgctggtctgtaatttggcttcctttacctctcagcttgggtcccggtgactgtaaaactagatttacgtcaaacccgtttgcagttatgtgctttgttgtttttcttttcgctcttttgaattttgaagtttgaatcgaggcagtagaaattgccatgtaaatctaacagatagagatgcatttcttttctcgaaacgatagagatatgcatttatgaagcaagctatacgctagattttgagttgctttgtttatgaaaggacgctggaagcctcgcggcaattcaagtataat

SEQ ID NO: 3042 - DNA, 3513 bp, Brachypodium distachyon
gcagccgactcttcttatctcttcttctcctcccccttctgtacatataaactccatatcccttcttcctgaatcctcctccccgacccgagtcccctcccctctcctagggtgacgtaacgtagcatcaaccgccttcctcaaccgccgccgccgcctccgcgtctatcgccgccgacgggcttccctcgacgccgggcgccggatccaattcgccttccgggtgccaccgccccgtccatatttggtcttggtaaaagggttgcctggggctttatttagatataccgacatggagggggctctggttcagtcagcaattgtccctacaatatataacagcggtgctcaggtccgtgcgcgtgcaagggcgacattggtgagggcagcatcagtgtgcagtatgcggacgcagaccatgaccctaggaggttttcaaggactgcggagggcaaactttttggacacaagatctgttgttagacgtgactttggctctattgtggcaagtcagcttgcacggccgagaggaaaggggtctcgaatggttgtacgtgccatgtttgagcgctttacagagaaagcaatcaaggtgattatgctcgcccaagaggaggcgagacggctaggccacaattttgttgggacagagcaaatcctgcttggccttattggtgagggtacaggcattgcagccaaggttcttaagtcaatgggcatcaatcttaaggatgctcgtgtagaagttgagaagatcattggccgaggcagtgggtttgtggctgttgagatcccattcacaccccgtgcaaaacgtgtattggaactgtcacttgaagaagctcgtcagcttgggcataattacataggatctgaacacttgctcctgggcctgcttcgcgaaggtgaaggtgtggctgcccgagtgctagaaagtctcggtgctgatccaaacaacattcgcacacaggtcataaggatggttggtgaaagcacggaagctgttggtgctggtgttggtggtggaagcagtggtcaaaaaatgcctacgcttgaggaatacggtactaatttgactaagttagctgaagagggtaaactagatccagttgttggcaggcaggatcaaattgagcgtgtcacccaaatattaggtaggcgaacaaaaaataacccttgcctaatcggagagcctggtgttggcaagacagctattgcagaggggcttgcacagcgtattaccaatggggatgttccagaaacaattgaagggaaaaaggttattacacttgacatgggcctgcttgttgctggtaccaaatatcgtggagagtttgaagaaaggcttaagaagcttatggaggaaattaagcaaagtgacgatattatcctcttcattgatgaagtgcacactttgattggtgctggtgcagctgagggtgcaattgatgcagccaacatcctgaaacctgctcttgcaagaggtgaactgcagtgtattggtgccacaactctggatgagtacagaaagcatattgagaaagatccagcactggagagaagatttcagccggtcaaggtgccagaaccaactgttgatgaaaccatacaaatcttgagaggtcttcgtgagagatatgagcttcaccataagctgcgatatacagatgatgctcttattgctgctgcaaagttgtcctatcaatatatcagtgatcgtttcctgcctgacaaagctatcgacctgattgacgaggctggatcacgtgtcaggcttaggcatgctcagctccctgacgaagcaaaagaattggacaaagaacttcgccaggttactaaggataaaaacgaggcagtacgtggccaagattttgagaaggctggggaactaagagacaaagaaatggaactaaaggcacagattacagccatcatcgacaaaagcaaggaaatggttaaggcagagacagagtctggtgaagttggtcctttggtcacagaggcagatattcagcacattgtgtcctcatggactggaatacctgtcgagaaggtctcctctgatgaatctgaccgtctcctgaagatggaggaaacactgcatcaacgtattatcggccaggatgaggctgtcaaagctattagccgtgcaatccgccgagcccgtgttggcctgaagaatccaaataggcctattgcaagtttcatattctctggaccaaccggtgttggtaaatcagaactggctaaagctttggcatcatactactttggctctgaggaagccatgatcagacttgatatgagtgagttcatggagagacatactgtctccaaactaattgggtcaccacctggatatgttggctataccgagggtggtcaattaactgaagcagttcgtcgtcgcccttacacggtagttctttttgatgaaattgagaaggcacacccagatgtcttcaacatgatgcttcaaatactggaagatgggagattgactgatagcaaggggcgtacagttgatttcaagaatacgttattgatcatgacatcaaatgttggaagtagtgtcattgagaagggaggccgcaagattgggttcgatcttgactacgacgagaaggacaccagctacaacaggatcaagagcctggtgactgaggagctgaagcagtacttccggcctgagttcctgaatagattggatgagatgattgttttccgccagctgacaaagctggaggtgaaggaaattgcagacattatgctgaaagaagtgtttgataggctgaaggtaaaagaaatcgacctccaagtgacggagaggttcagagatagggtggtggacgagggctacaaccctagctatggtgccaggccactgcgtcgtgctatcatgaggcttttggaagacagtttggcagagaagatgctagcaggtgaggtcaaggaaggtgattctgctatcgtcgatgttgattcagaaggcaaagttatagttctcaacagcggcagcggtgttccagaaccaatggcgcctgttttgagcacctaatcatgattctggactaccagttactctatttcgttcggtggtgttgttatcctcgatctttttcagcaccagcagtggaaatttcaggaagaccaatgaatataacttccacatagcctacagagacaccacgcctagatgtttagtttatttgctttagaaagaatcgtggaagcttgggttttgagacagcacgccttttgacggcactgtaatgtttgtaacgtgcttggcggcttggcgcccacctgctccctcacttgtggaaattagtagaaaaatcttcaataacgatggagacattgccgctggcaacttcaccacttacaaaatcggcggcatataccgtccaattgtttagtactaaaagattataaagaaaaattcacatgtgctaattggtattccaatagagaacctaaaattttagattagaagcatatcatgggaaatct

SEQ ID NO: 3043 - DNA, 3558 bp, Brachypodium distachyon
tcaggtcttggtaaaagggttgcttggggcttcctttagacataccgacatggagggggctctggttcagtcagcaattgtccctacaatatataacagcggtgctcaggtccgtgcgcgtgcaagggcaacatcagtgagggcagcatcggtatgcagtatgcggacgcagaccatgaccctagggggttttcaaggactgcggagggcaaattttttggacacaagatctgtggttagacgtgactttggctctattgtagcacatcagcttgcacggccgaggggaaaggggtctcgaatggttgtgcgtgccatgtttgagcgctttacagagaaggcaatcaaggtgattatgctcgcccaagaggaggcaagacggctaggccacaattttgtcgggacagagcaaatcctgcttggccttatcggtgagggtaccggcattgcagctaaggttcttaagtcaatgggcattaatcttaaggatgctcgtgtagaagttgagaagatcattggacgaggcagtgggtttgtggctgttgagatcccattcacaccccgtgcaaaacgtgtattggaactgtcgcttgaagaagctcgtcagcttgggcataattacataggatctgaacacttactcttgggcctgcttcgtgaaggtgaaggtgtggctgcccgagtgctagaaagtctcggtgctgatccaaacaacattcgcacacaggtcataaggatggttggtgaaagcacagaagctgttggtgctggtgttggtggtggaagcagtggtcaaaaaatgcctacacttgaggaatacggtactaatttgactaagttagctgaagagggtaaactagatccagttgttggcaggcaggaccaaattgagcgtgtcacccaaatattaggaaggcgaacaaagaataacccctgcctgatcggagagcctggtgttggcaagactgctatcgccgaggggcttgcacagcgtattaccaatggggatgttccagaaacaattgaaggaaaaaaggttattacactcgatatggggctgcttgttgctggtaccaaatatcgcggagaatttgaagaaaggctgaagaagcttatggaggaaattaagcaaagtgatgatattattctcttcattgatgaagtgcacactttgattggagcaggtgcggctgagggtgcaattgatgcagccaacatcttgaaacctgctcttgctagaggtgaactgcagtgtattggggccacaacgctggatgagtacagaaagcatattgagaaagatccagcactggagagaagatttcaaccagtcaaggttcctgaaccaactgttgatgaaaccatacaaattttgagaggcctccgtgagagatatgagcttcaccataagctgcgatacacagatgatgctcttactgctgctgcgaagttgtcgtatcagtatatcagtgatcgtttcctacctgacaaagctatcgacttgattgatgaagctggatcacgtgtcaggcttaggcatgcccagctccctgatgaggcaaaagaattggacaaagaacttcgcaaggttaccaaggataagaacgaggcagtacgcggccaagattttgagaaggctggggaactaagagacaaagagatggaactgaaggcacagattacggccatcattgacaaaagcaaggaaatggttaaggcagagacagagtctggtgaagttggtcctttggtcacagaggcagatattcagcacattgtgtcctcttggactggaatacctgtcgagaaggtctcctctgatgaatctgaccgtctcctgaagatggaggaaacactgcatcaacgtattatcggtcaggatgaggctgtcaaagctattagccgtgcaatccgccgagcccgtgttggcctgaagaatccaaacaggcctattgcaagtttcatattctctggaccaaccggtgttggtaagtcagaactggccaaagctttggcatcatactactttggctctgaggaagccatgatcagacttgatatgagtgagttcatggagagacatactgtctccaaactaattgggtcaccacctggatatgttggctataccgagggtggtcaattaactgaagcagttcgccgtcgcccttacacagtagttctctttgatgagattgaaaaggcacatccagatgtcttcaacatgatgcttcaaatactagaagatggaagattgacggacagcaaggggcggacagttgatttcaagaatacgctcttgatcatgacatcaaatgttggtagcagtgtcattgagaaggggggccgcaagattgggttcgaccttgactacgacgagaaggacaccagctacaacaggatcaagagcctggtgactgaggagctgaagcagtacttccggcctgagttcctgaatagattggatgagatgattgttttccgccagctgacaaagctggaggtgaaggaaattgcagacattatgctgaaagaagtgtttgataggctgaaggcaaaggaaattgaccttcaagtgaccgaaagattcagagatagggtggtggatgagggctacaacccaagctatggtgccaggccactgcgccgtgctatcatgaggctcttggaagacagcctggcagaaaagatgcttgctggtgaggtcaaggaaggagattctgctatcgttgatgtcgattcagaaggcaaagttatagtactcaacagcggcagcggcgttccggagccactgacgcctgctttgagcacctgattatcatttcggaatccaatgttttgacctcacgctgtgacttggagtttgcacaatttcctctcattcatttggcggtgatgtgtccctagatcttgttgcaagccaggcagtagaaatttgaggaagatcagtgaatataatttccacatagttctcatcgagaccagtctactagatttttagtttgtttgctttgagaagaaacctggaagctttgttttgtgtgaagttctgtgccgggtgtgcccatttcaggtattagttcttttttgaacattcttttcaggtacgaggtagcactgtactgtctcgtaagggcttgaagcgcagctgctgccctttcatggacgcactagtagaatgaaacagaaactcctcatttcgtgttctgttggatattaatgcatgataatgtttggcaatagcagctccgcttgagcatacaatatcttgtaataccttcatttcacacgcataactaaggggtatcggattgggatatatttaatcaacctatttgttctcattagatagattaacactttgtctatgtagtggcgacaaacaaggtccgcatctttgaatattagtgaaatttgttttgacttctaagtatgtgcgtgtggcataaaatatgaaacgaaaagagcttgagtagcaaattctttacctgatttgaccgaaacctccagcaatcttcagtgcatatttatcaccagatcatcagcaaacttaagatg

SEQ ID NO: 3044 - DNA, 3286 bp, Hordeum vulgare
atctagctctcttccccgtgttatccactctgcgcgtcccaaggttcttcctcggtccaccgccgctgggcggccacgccgtcgccgaggcacctgtaaacctgtggttttttggttagttcaatatggaggggactttggttcagtctgccatcgctcctaccgcctacaggaagagctctacacggttctgtgtgcgcacaagggccacaatgttacgcagtacaccaacgaggacccttactctcgggggttttcaaggactgcggcaaacaaatttcctggatacaaggtccgttatcaaacgtgactttggctccattgtagcaagccaaatttcacgaccacgtgggtcaggttcaagaatggtggtcagggccatgttcgagcgcttcacagagaaagcaatcaaggtgattatgcttgcacaggaggaagcaagacgccttggccacaactttgttgggacagaacagattctgcttggccttattggtgagggaactggaattgcagcaaaggttctaaagtctatggggatcagtcttaaggatgcccgtgtggaagttgagaagattattggaagaggcagtgggtttgttgccgttgaaattccatttacacctcgtgcaaaacgtgtactcgaattgtcacttgaagaagctcgccagctagggcataactatataggatctgaacacttgctcttagggctacttcgtgagggtgaaggtgtggcagctcgagttcttgaaagccttggtgctgatccaaacaacattcgtacccaggcaatttcttcactaatatctttcttagattactgcttgttttaaatggttggtgaaagcacagaagctgttggtgctggggttggtgggggaagcagtggccagaagatgcctacacttgaagaatacggtactaatttgacaaagctggcagaagagggtaaactggacccagttgttggcagacaggatcaaattgagcgtgtaactcaaattttgggcaggaggacaaagaacaacccatgcttaattggagagcctggtgtcggcaagaccgctattgcagaggggcttgcgcaacgtatttgtaatggggatgttccggaaacaattgaaggaaagaaggttattacccttgacatggggctccttgttgctggtaccaagtaccgtggagagtttgaagaaaggctgaagaagcttatggaagaaattaagcaaaatgatgatattatactctttattgatgaagtgcacacgttgatcggagcaggtgcagctgaaggtgcaattgatgctgctaacatcttaaaaccagctcttgcaagaggtgaactgcagtgcattggtgccacaacactggatgagtacaggaaacatatcgagaaagatcctgctttggagcgaaggtttcaaccagtcaaggttccagagcccactgttgaagaatcaatacaaatcttaagaggacttcgtgagagatatgaacttcatcataagctgcgatacacagatgatgctttagttgctgcagcgcagttatcgtatcagtatatcagtgatcgcttcctgcctgacaaggctattgacttgattgatgaagcggggtcccgtgttaggctcaggcatgcacagctacctgatgaggccaaggagctggacaaaaaacttcggcaaataacaaaagacaagaatgaggctgtgcgtggccaagattttgagaaggctggggaattaagagacgaggaaatggagctgaaggcccaaattacagccattattgacaagagcaaggaaatggttaaagcagagactgaatccggcgaagttggtcctcttgtcacagaggcagatattcaacacatcgtctcatcatggactggtatacctgtggagaaagtctcatctgatgagtcggaccgcctccttaagatggaagagacactccatacacgtatcattgggcaggatgaagctgtcaaagctattagccgtgctatccgccgtgctcgtgttggcctcaagaatccaaatcgacccattgctagcttcatattctctggaccaactggtgttggtaaatcagaattagcaaaggctctggcatcctactacttcggctcagaggaagccatgatcagattagatatgagtgaattcatggagagacatacagtgtccaaacttatcggatcacctccaggttatgttggctacactgagggaggtcaactaacagaagcagttcgtcgccgtccatacacagttgttctctttgatgagattgaaaaggcacatccagatgtcttcaacatgatgcttcagatcttagaagatgggaggctgacagatagcaagggacggacagttgatttcaagaacacactgttgatcatgacatcgaatgtcggaagcagtgtcatcgagaagggaggccggaagattgggtttgaccttgactctgatgagaaagataccagctataacaggatcaagagcttggtgaccgaggagttgaagcagtatttcaggcctgagttcttgaacagattggatgagatgattgtgttcaggcagctgactaagttggaggtgaaagagatagctgatattatgctcaaagaggtgtttgacaggctcaaggcaaaggaaatagacctccaggtaacagagaagttccgggatagagttgtcgacgagggttacaacccaagctatggtgccaggcctctgcgacgggctattatgaggcttttggaagacagcctcgcggagaagatgctggctggcgaggtcaaggaaggtgattctgctattgttgatgtggattcagatggtaaggtggtggttctcaacagtgggagtggtattgcagagccgctggcgcctgccctgagtgcctagttgggggtcctttttatttcgctatctccgcttggggtcctggtgatggtacctagattaatatcactcccctttcagtcatgtgttctactcttcctttttctctctcttctttcactctcttgaagtttcaagtttgaagcgaggcactagaaattgttatgtaaacaaaacaaacatagatgcatgtatgagcaagctgtatgctatatcttttgagttctctccctctttttctttttctttttttgagtgggcagttgctctgttcctgaataacagttgatggcctgtagttaggccctgtttggaaccactcagattatataatctgttttttataatctattatgtcttcaaacatgacatat

SEQ ID NO: 3045 - DNA, 3340 bp, Triticum aestivum
ccccgtgtataaacttcatatcctttctcttcttcctcccgaagccgcccccctctctcccatggtttgccccttctcgtacgcaaggtcttggtagaagggtagcttcaagtttcctttagacatacaggcatggagggggctctggtccagtcagcaattgttcctactgtatataacagctgcgctcaggtccgtgggcatgccagggcgacatcgttccgtagtatggagacacaaaccattacccttggaggttttcaaggactgaggagggcaaactttcttgatacgaaatctgtggtcaggcatgatttcggctctattgtggcaagtcagcttgcacgtccaagagggaaggggtctagaatggttgtccgtgccatgtttgagcgcttcacagagaaagcaatcaaggtgattatgcttgctcaagaggaagcgagacgtctaggccacaattttgttgggacagagcagatcctgcttggccttattggtgagggtacaggtattgcagctaaggttcttaagtcaatgggcatcaatcttaaggatgctcgtgtagaagttgagaagatcattgggcgaggcagtggttttgtggccgttgagattcctttcacaccccgtgcaaagcgtgtgttggagctgtcgcttgaagaagctcgtcaacttggtcataattacataggatctgaacacttgctgctgggcttgcttcgtgaaggtgaaggtgtggctgcccgagtgctagaaagtctcggcgctgatccaaacaacatccgcacacaggtcataagaatggttggtgaaagcacagaagctgttggtgctggtgttggtggtggaagcagtggtcaaaaaatgcccacacttgaagaatatggtactaatttgacgaaactagctgaagagggtaaactagatccagttgttggcaggcaggaccaaattgagcgtgtcacccaaatattaggcaggcgaacaaagaacaacccttgcctaattggagagccaggtgttggcaagactgctattgcagagggacttgcacagcgtattaccaacggggatgttccagaaacaattgaaggaaaaaaggttattacacttgacatggggctgcttgttgctggcaccaagtatcgtggagagtttgaagaaaggctgaagaagcttatggaggaaattaagcaaagtgatgatatcattctcttcattgatgaagtgcacactttgattggagctggtgcagctgagggtgcaatcgatgcagccaacatcttgaaacctgctcttgcaagaggtgaattgcagtgtattggtgccacaacgctggacgagtacagaaagcatattgagaaagatccggcactggagagaagatttcagccagtcaaggttccagaaccgactgttgatgaaaccatacaaattttgagaggtcttcgtgagagatatgagcttcaccataagctgcaatatacagatgatgctcttgttgctgctgcgaaattgtcataccagtatatcagtgatcgtttcctgcctgacaaagctatcgacctgattgatgaagctggatcacgcgtcagactgaggcatgctcagctccctgatgaagccaaagaattggacaaagaactccgccaggttaccaaggataagaacgaggcagtacgtggccaagattttgagaaggctggggaactaagagacagagaaatggaactgaaggcacagattacggccatcattgacaagagcaaggaaatggttaaggcagagagcgagtctggtgaagttggtcctttggtcacggaggcagatatccagcatattgtctcctcttggactggaatacctgtcgagaaggtttccgctgatgaatctgaccgtctcctgaagatggaggaaacactgcatcaacgtatcattggccaggacgaggctgtgaaagctattagccgtgcaatccgtcgagcccgtgttggcctcaagaacccaaacagacctattgctagttttatattctctggaccaaccggtgttggtaaatcagaacttgctaaagctttggcatcgtactactttggctctgaggaagccatgatcaggcttgatatgagtgagttcatggagagacatactgtttcgaaactaattgggtcgccacccggatatgttggctatactgagggtggtcaattaactgaagcagttcgtcgtcgcccttacacagtagttctctttgatgagatcgaaaaggcacatccagacgtcttcaacatgatgcttcaaatactggaagatggaagattgactgacagcaaggggcggactgttgatttcaagaatacgctgttgatcatgacatctaatgttggaagcagtgtcattgagaagggaggccgcaagatcggatttgaccttgactatgatgagaaggacaccagctacaacaggattaagagcctggtgactgaggagctaaagcagtacttccggcctgagttcttgaacagattggatgagatgattgttttccgccagctgacaaagctggaggtgaaggaaattgcagacattatgctgaaagaagtgtttgacaggctgaaggtaaaggaaatcgaccttcaagtgactgaaagattcagagatagggtggtggatgacggctacaacccaagctacggtgccaggccactgcggcgcgctatcatgaggctgttggaagacagcctggcagaaaagatgctggctggcgaggtcaaagaaggtgattccgctatcgtagatgttgattcagaaggcaaagttatagttctcaatggtggcagcggtgtcctggagccgctgacacctattttgagcacctaatcatacggagcacatgattacggaatccattgtttcagcacaagctgtggcgtggagctgacaccaattctctttcattaggtggtgttgtgtcgttagatattgcttgcaagcgaggcactagaagattccgtatagctcaccggcacgcctagattttctgtttttgcttttgaaaggaatctggaggctttatttttgggatgcctatatctgccacacgtgtggcacgaggacccccagaccaaactcccgtccccatcagtacacattatgccatgtcaccgtatgcatgtataaatgacgaaactgatggtgtcagtgaaaatcttttggaatgacaaaactaatgatgtcaatgggaatcttttggttttattttttatcttttaaatgaaaagtccgattgaaaaaccatttttaacattaaattcgtcgcgacgagatctttgaaact

SEQ ID NO: 3046 - DNA, 3879 bp, Sorghum bicolor
cgggcaaagatgagaaattgcaaaagcccgtgttgggatgggggtgacgtacgacccactccaccaacgcagcgcaaggtctcgctccgtcgccttcctcctctccttatcttctgacctctccggctctcccctcccctctcctttttcccactaccgcggcaggcagctagcccctccctctcgtctcctccgccacctcctcccccgcctcgccggcgcagggtcgggacgcttccgccggcgcgcgctccacggcccctctgcgggagacgaaactcggcgcgggcttggtaggtagaggcctgggattgccttctgctagttcaacatggagggcgctctagttcagtctgcgattgttccaaccgtttacagaagcagctcaggtcgtttccgcgcgcgtgcaagggccagaacaaatgctacaatggtgcgcaatatgccaacaaggactcttactcttggtggcttccaagggctgcgtcagacaaactttttggacacgaggtccgtgatcaagcgtgactttgggtcaatcgtggcaagtcagattgcaaggccacgcgggtcagcctcaagaggggttgttcgtgccatgtttgaacgcttcactgagaaagcaatcaaggtgattatgctcgcgcaagaggaggcaaggcgccttggacacaactttgttgggacagagcagattttgctggggcttattggtgagggcacgggaattgcggcgaaggttctgaagtctatgggaatcaatcttaaggatgcccgagtggaagttgaaaagataattggacgtggcagtgggtttgtggctgttgaaatcccattcacgcctcgtgcaaaacgtgtattggaattgtcccttgaagaagctcgtcagcttgggcataactatataggatctgaacacttgctccttgggttacttcgtgagggtgaaggtgttgctgctcgtgtgcttgaaagccttggtgctgatccaaacaacatccgtacccaggtcataagaatggttggggaaagcacagaagccgttggggctggagttggtggaggaagcagtggccagaagatgcccacacttgaagaatatggtactaatttgacgaaattagcagaggagggtaaattggacccagttgttggtagacgggatcagattgagcgtgttactcagattttgggaaggcggacaaagaacaacccctgcctaattggagagcctggtgttggcaaaactgctattgctgaggggcttgctcaacgtattgccaatggggatgttcctgaaacaattgaaggaaagaaggttattactcttgacatggggctccttgttgctggaaccaaataccgtggagagtttgaagagagactaaagaaacttatggaggaaattaagcaaaatgaagacattattctctttattgatgaagtgcacacactgattggagcaggtgcagcagaaggtgcaattgatgctgctaatattttgaagccagctcttgcaagaggtgaactgcagtgcattggtgctacaacgctggatgagtataggaagcatatagagaaagatcctgccttggaaagaaggtttcaaccagttaaggttcctgagcctactgtcgatgaaacaatacagatcttaagaggacttcgtgagagatatgaactccatcacaaactgcgatacacagatgatgctttaattgctgctgcacagctttcttatcagtatatcagtgatcgattcctgcctgacaaggccattgacttgattgatgaagctggatcccgtgttaggctgaggcatgcccagctccctgatgaagccaaagagctggacaaagagctgcggcagattaccaagcagaaaaacgaggctgtacgcagccaggactttgagaaggctggcgaattaagggaccgagaaatggagcttaaggctcaaattacagccattattgacaagagcaaggaaatgattaaagcagagactgaatctggtgaagtcggtcctcttgttactgaggcggacattcaacatattgtctcctcttggactggaattcctgtggagaaggtgtcatctgatgagtctgatcgtctcctaaagatggaagagacactgcatacacgtatcattggacaggatgaggctgtcaaagctattagtcgtgctatccgccgtgctcgtgttggcctcaagaatccaaataggccaattgccagcttcatattctctggaccgactggagttggcaaatcagagctagcaaaggctctggcggcctactactttggctcggaggaggctatgatcaggcttgacatgagtgagttcatggagagacatactgtctccaaactcattggatcacctccaggttatgttgggtacactgagggaggccaactaactgaagcagtccgtcgccgcccgtacacagttgttctctttgatgagattgagaaagcacatccagatgttttcaacatgatgcttcagatcttagaagatgggcggttaactgatagcaaggggcgcacagtggacttcaagaacacactattgatcatgacatctaatgtcgggagcagtgtcattgagaagggaggccgcaagattgggttcgaccttgactatgatgagaaagacacaagctataacaggatcaagagccttgtgactgaggagttgaagcagtacttccggccagagttcttgaacagattggatgagatgattgtattccggcagctgactaaattggaggtgaaggagattgcagacattatgctgaaagaagtgtttgacaggttgaaggccaaggacattaatctccaggttacagagaagttccgagatagagttgttgacgaaggttataacccgagctatggtgccagacctttgcggcgtgctatcatgaggcttctggaggatagtctggcagagaagatgctggctggtgaggtgaaagaaggtgactctgccatcgttgatgtggattcagatggcaaggtaatagtcctgaacggtggcagcggtgttgctgagccactggaacctgctctcagtacctaagcaaggtcaaaacctttggtccgaaatatggccttctttacaagtcagctgggctcctcgtgatggtaaaagtagactgacattacttggcgtctgccccattaggtgctttatctttcatggttttccttttcattggaagtgaggcagtagggttgctatggaaatgaatagatggtgaggaatttagcgaatgaaatatatgctagactttgagttgccttgtttttggaagaaacttggaattttcagtttgatgcacttgtattattaggacttgttagcaatgagatacggatgtttctgcgtttgatgttgtactttagtaacttatatcctgtatgtatggatatcacgtatccaagtttcgaataacagtggtgaattgctacactctgccttttggtctgcggatctaaaatttggaatcatttatttgcctcagaggttataattttcgaacttcagtattttagtctgcagctgttccttctggactgtattttgtcctgtttggttttgggtagacgtgaaaatggattggtgagggaatctcagtgggggtatttctttgatctcgtttgtgtttcatctcgtggttttagtgctaaactgctaaggaatgaaacaaccacactcaacaaggtgtttcatcatctcgtagtttcagagcttatttggattgaaggaatatcataggacagaggaaagaaaaccgcattcctctgaaatactgtaactggcaagcaatttaataggaaaggaatccgctcaacccattc

SEQ ID NO: 3047 - DNA, 3329 bp, Musa acuminata
ccttgttctcttccagggcttcatctgctcgttcggctcagtggctgcaatcataggtgtcgaatccgcctcgtttggacggatccttcgggtgttgtgaagatctgtgaaattgtctcctaatagaagaagagatggctggttctttggttcagtcagcaattcttcctactgttgcagtgaacaggatccaaagtcatctccgaggctctggaaaggttaaaagaggttccaaaatgatgtgccaaccgcgaaagcactcgctacgactgcaaggttttgcaggcttgcgaagatcagataatgtggaattctcatcaagaaatcaacgggattttcattcagtggtttcaggatatatctcttattcacgaggaaaagccagtcgaggagttgctaaagctatgtttgaacgctttacagagaaggcaattaaagttatcatgcttgcacaagaagaagctaggcgtctaggccacaactttgttggaacagaacagatactgttgggcctaatcggcgaagggactggtattgcagcaaaagttttaaaatcaatgggaataaatcttaaagatgctcgagtggaagtggagaagattattggaaggggaagtggttttgttgctgttgagataccttttacaccacgtgcaaaacgtgttcttgaactctctttagaggaagctcgtcaactcggtcataactatataggatctgagcacctgcttcttgggcttcttcgtgagggtgaaggtgtggctgctcgtgtgctcgagagtcttggagctgatccaagcaacatacggacccaggtcattcgaatggtcggtgaaacaactgaagctgttggtgctggggtagggggaggaagcagtggtaataagatgcctacacttgaggagtacggaactaatttgacaaagttagcagaggagggaaagctagatcctgttgttggcaggcaggaccagatagagcgtgttacgcaaattcttggaaggcgtacgaagaacaatccatgcctaattggggaacctggtgtgggaaagacagcaattgcagaaggacttgctcaacgtatagctaatggcgatgttccagaaacaattgaaggaaaaaaagtgattacccttgatatggggcttcttgttgctggtactaaataccgtggagagtttgaagaaaggttaaaaaagttgatggaggaaattaaacaaagtgatgaaataatactcttcattgatgaagtacacacattaattggagctggagcagcagaaggtgcaatagatgctgctaatatcttaaaaccagctctcgccagaggtgaattgcagtgtattggagccacaacacttgatgaatacaggaaacacatcgagaaggatcctgctttggagagacgttttcaacctgtaagagttccagaaccaacagttgatgagacaatactgattcttagagggcttcgtgaaagatatgagattcaccataaacttcgttacactgatgaggctttaattgctgctgctcagttgtcttaccagtatattagtgaccggtttctacctgataaagcaattgacttgattgatgaagctggttctcgtgttaggcttcgccatgcacaacttcctgaggaagccagagaacttgacaaagagcttaggcagattacgaaagagaaaaatgaagcagtccgcagccaagattttgaaaaggcaggggagttgcgcgatcgagagatggagctgaaggctcaaatctcagccttaattgataagggcaaagaaatgagccaagcagagagtgaggctggtgattcaggtcccactgtgacggaagcagacatacaacacatagtatcatcttggactggaattcctgtggagaaagtatcgagtgatgagtctgaccgtctcctcaaaatggaagaaactctccataaacgtgttatcggccaggatgaagctgtgaaagcgataagtcgagccattcgtcgagctcgtgttggtctcaagaatcccaatcgtccaattgccagcttcatattttctggtccaactggcgttggaaaatcggaattggcaaaggcactggcttcctattattttggctctgaagaagccatgatccggcttgatatgagtgaattcatggagaggcacactgtttccaagctcatcggttcaccacctggttatgttggttacaccgagggtggtcagcttactgaagcagttcgacgtcgcccctacactgttgtcctctttgatgagatagagaaagcccaccctgatgttttcaacatgatgctccagatattagaagatgggagattgacagacagcaaggggcggacagtagattttaagaatactctcctgatcatgacgtccaatgtagggagcagcgtcatcgagaagggaggacggaggattggttttgatctcgactatgatgaaaaggatagcagctacaatcggatcaagagccttgttactgaggagttgaagcagtacttccgaccagaattcctgaatcggctagatgaaatgatcgtcttccgacagctgacgaaactggaggtcaaggagattgctgacataatgcttaaggaggtatttgacaggctgaaagtgaaggatatagaacttcaggtgacagagagattcaaggatagggtggtggacgaaggttacaacccaagctacggagctaggccacttagaagagccataatgaggctcttggaggatagcttggctgagaaaatgctggctggcgagatcaaggagggagattcggctattgtggatgtcgactctgacgggaatgtcacagttctaaatggtgggagtggtgtgcctgagccaatccccccagctgtttccgtatagattcaatatcttttgtgtctgcggttcggtgccatgttgtaggttgctagtgtagggccaaggaaaaaaactgctgctgttcgttcaaatttataccatgtgatctccatttatattttagggtattaacatgaaaatttgttgtaagagaaacggagcagacaaaaaagatgggactgaagtgagactttgtttgtttacttgaagccagaagaagtacactgcttgtgacacttacggtctatgtgctcatgtatgttggatatgggtgacctcatggaaatcatccaagttactagtaaacacaaatctgtcttgtctgtttccaagaatagtttcgatgtgctacttcctaagataatgtttttgagcaaaacgatgtgcttctgctgtgtttttcgtcgtcacttaatcttctatgcaaac

SEQ ID NO: 3048 - DNA, 3048 bp, Pennisetum glaucum
acacgaggtccgtgatcaagcgtgactttggatctatcgtggcaagccagattgcaaggccacgggggtcggcgtcaagaggggttgttcgcgccatgtttgagcgctttactgaaaaagcaatcaaggtgattatgctggcgcaggaggaggcaaggcgtctgggccacaactttgttgggacggagcagattttgcttgggcttattggcgagggcactggaattgctgctaaggttctcaagtctatggggatcaatcttaaggatgcccgagtggaagttgagaagatcattggacgaggcagcgggtttgtggctgttgaaatcccattcacacctcgtgcaaaacgtgtactggaactctcccttgaagaagcccgccagctagggcataactacataggatctgaacacttactcctggggctacttcgtgagggtgaaggtgttgcagcccgtgtgcttgaaagccttggtgctgatccaaacaacatccgcacccaggtcataagaatggtcggtgaaagtacagaagctgttggtgctggagttggtggaggaagcagtggccagaagatgcccacacttgaagaatatggtacaaatttgacaaaattagcagaagagggcaaattggacccagttgttggtagacaggatcaaatcgagcgtgtgacacagattttgggcaggcgaacaaagaacaatccctgcctcattggagaacctggtgttggtaagactgctattgctgaggggttagcccaacgtatttccaatggggatgttcctgagacaattgaaggaaagaaggttattactcttgacatggggctccttgttgctggaaccaaataccgtggagagtttgaagagagactgaagaaacttatggaagaaattaagcaaaatgaagacattattctatttattgatgaagtacacacacttattggagcaggtgcagcagaaggtgcaattgacgctgcaaatattttgaagccagctcttgccagaggtgaactccagtgcatcggtgcaacaacgctggatgagtataggaagcatatagagaaggatcctgccttggaaagaaggtttcaaccagttaaggttcctgagcctacggttgatgaaacaatacagatcttaagagggcttcgtgaaagatatgagcttcaccacaagttgcgatacacagatgaagctttaattgctgccgcccagctgtcttatcagtatatcagtgaccgcttcctgcctgacaaagccattgatttaattgatgaagctgggtctcgtgttaggctgaggcacgcccagctccctgatgaagccaaagagctggacaaagagcttcggcagattaccaagcagaaaaacgaggctgtacgaggccaagattttgagaaggctggtgaattaagggatcgggagatggagctgaaggcccagattacagccatcatcgacaagagcaaagaaatgattaaagcagagactgaatctggtgaagttggtcctcttgtcacagaggcagacattcagcatattgtctcctcttggactggaattcctgtggagaaagtctcatctgatgagtctgatcgtctcctaaagatggaggagacactacacacacgtatcattggtcaggacgaagcagtcaaagctattagccgtgctattcgacgtgctcgtgttggcctcaagaatcctaaccgaccaattgctagcttcatattctctggacctactggagttggtaaatcagaattagcaaaggctctggcagcctactactttggctcagaggaggctatgatcaggcttgacatgagtgagtttatggagagacatactgtctccaaactcattggatcacctccaggttatgtcggctacactgagggaggccaattgactgaagcagttcgtcgccgtccgtacactgttgttctatttgatgagattgaaaaggcacatcccgatgtattcaacatgatgcttcagatcttagaagatgggaggctaactgacagcaaggggcgcactgttgatttcaagaacacactattgatcatgacatcgaatgtcggaagcagtgtcatcgagaagggaggccgtaagattggttttgaccttgactctgacgagaaggacactagctacaacaggatcaagagcctggtcacggaggagttgaagcagtatttccgcccagaattcttgaacagattggatgagatgattgtgttccggcagctgacaaaattggaggtgaaggagattgcagacattatgctgaaagaagtgtttgaccggctgaaggccaaggagattgacctccaggtcacagagaagttccgtgatagagttgttgacgaaggttacaacccaagttatggtgctcggcctttgcggcgtgctatcatgaggcttctggaggatagtctggcagagaagatgcttgctggtgaggtgaaagaaggtgactcttgcattgtggatgtggattctgagggcaaggtcatagtcctgaatggtggtagcggtgttgctgaacccctggaacctgctctaagtgcctaactgaggtcaagaaatttttggtatgaaatatggccttctttacaagtcagctgggctcctcgtgatggtaaaactagtctgacgtcgctcgcccgccccatgccccattagacgcttcatctttccctgatattttttcagttggaaatgaggcagtaggaatgatatggaaatgattaggcagagacgcatttagggaacacactgtacgctagaccttgagttgccttgttttgaaaaagaaacttggaattttcagttccctgcagttacttgtattgtatcactacttcattagggctctcatagcagggtgacacggatgtcgcttgcactgtcatacttaaatctcccagttatgtatggatgtaacttgttcaagtcacaaataatatttgtggataattgtatgtactttgttggagagtaagataattgttacttaaatcaggat

SEQ ID NO: 3049 - DNA, 3217 bp, Amorphophallus konjac
aaacccctccttcgtacctcaatctccagcctcctcctctcctgtggaagtagggggcagtaagaggccgctctatcctccccctccttccctccctacccctcgtcgcgccgctgcacccttctagggtttaccccggagcctctgcttccctcgaggggggctgcattatattaactttggaactcttgcttcatagtggaagcaatggctggggctttggttcagtcagctatccttccaggggcagttgcaaatggacgacgtagccaggtccgaggctctagtaaatccagaagggctgcaagaatgttgtgcactatggggtcacaccgtcctagaatgcaaggcttcacaggattgcggagttcaaatgttttggactttgtgccaagatctgaacggagttttcattctgtggtagcaactgctatctctgcaccacgggggaaggcctgccggggggttgctgtggctatgtttgaacgcttcacagaaaaggccattaaagttattatgcttgctcaagaagaggcaagaagacttggacacaattttgtcggtactgagcaaatactcttggggcttattggcgaaggaactgggattgctgctaaggttctcaagtccatgggaattaacctgaaggatgcccgtgttgaagtggaaaaaattattggaaggggtagtggatttgtggctgttgagataccatttacaccacgtgcaaagcgtgtattggaactatcactagaagaagctcggcaacttggtcataattacattggatctgagcacttgcttcttggactgctgcgtgagggtgaaggtgttgctgctcgtgtgcttgaaaaccttggagctgatccaggcaacatccgcacacaggttattagaatggtaggagaaagtgcagaagctgttggtgctggggttggaggaggaagcagtggcaataacaagatgcctacattggaggagtacggaaccaatttgacaaagttagcagaggagggcaaattagatcctgtcgttggcaggcaggaccaaatagagcgtgtgactcaaatcttgggcaggaggacaaagaataacccttgccttattggagaacctggtgttgggaagacagcaatagctgaagggcttgctcagcgtatttcaaatggtgatgttccagagacaatcgagggaaagaaggtgataactctcgatatggggcttctggttgctggtacaaaatatcgtggagagtttgaggaaagattaaagaagctgatggaagaaataaagcaaagtgatgagataattctctttattgatgaagtacatacattgattggagcaggagcagctgagggtgcaattgatgcagctaacatactaaagcctgctcttgcgagaggtgaactgcagtgcattggagcaacaacccttgatgagtatcggaagcacatagagaaggacccagccttggagagaagatttcaaccagtgaaggtaccagaaccaacagttgaagagacaattcaaattttgaaagggctgcgtgaacgatatgaaatccaccacaaacttcgttatacagatgaagctttagttgccgctgcacaattgtcatatcagtatatcagtgatcggttcctccctgacaaagcaatcgacttggttgatgaagccggttctcgtgttaggctccgccatgctcagcttcctgaggaggctagggaacttgataaagagctcaggcagataaccaaggagaaaaatgaggctgtccgtggacaagactttgaaaaggcaggagagctacgagatagagaaatggagctgaaggctcagatttctgccctcattgacaaaggcaaagaaagaacaaaagcagaaagtgaggcgggggaatctggtccaattgttactgaggctgatatacagcacattgtctcttcatggactggaattcctgtagagaaagtctcgagtgatgagtctgaccgtcttcttaagatggaagaaactcttcacaagcgtgtcattggccaggatgaggctgtcaaagccatcagccgagccatccggcgagcacgtgttggtctcaagaatcctaacagaccgattgccagcttcatcttttctggtccaaccggtgttgggaaatcggaacttgcgaaggctttggccgcctactactttggctctcaggaagcaatgatacgacttgatatgagtgaattcatggagagacatactgtttcaaaactcattggttctccacctgggtatgttggctacactgaaggtggccaacttacagaagctgttcgccgtcgaccctacactgtagttctctttgatgagatagagaaggctcaccccgatgtcttcaacatgatgctacagatcttggaagatggaagattgacggacagcaaaggtcggactgtggacttcaagaacaccctactgatcatgacatcaaatgttgggagcagtgtgattgagaagggaggacgcaggattgggtttgacctggactatgatgaaaaagacagcagctataaccgtatcaagagcctggttactgaggagctgaagcagtacttccggccagagttcctgaacaggttagatgaaatgatcgtcttcaggcaattgacaaagctagaggtgaaggagatagcagacataatgctgaaggaggtgttcgacagactgaaagcaaagaatatagaactccaagtaacagaaaggttcaaggatagggtggtggacgaaggttacaatccgagctatggtgcaaggccgctgaggagagccatcatgcggcttttggaggacagtttggcagaaaagatgcttgccggagagataaaagagggagactccgctatcgttgacgtcgactccgacgggaatgtgacggtcctcggtggtgagagtggcattccggagcccgctgcaccggccatgcccatataatcgagccaaccgccatgtgattatgctaggttgtagattataaatgtatcagtgatagttgttagtgagtagtgatattagggataaattcatccagtcgggtcctcgtcgaacgtcatttaccagcactttttgttgatgtcgttatgacactgctatatatgcagagtgtaaggcaattgcgtgagtgtggcaatagttgtatcatggatggagaatatatatatctctattagtt

SEQ ID NO: 3050 - DNA, 3374 bp, Aristolochia fimbriata
aatccctactttcttcctctccccttcccaagctcaaggaggggttcatattccacccccttgtttccttcccctctcgagcttaatctcccattgcttttctctttctttggtcgtagggcttcatcttgtttggagtcgttccagggtattacttgtctgattggttccttttgttgtcagaaatcatgactggtgctctgattcagtccgttatcctgcccggtgctgtcactggtagcggtaaccgattcagaagctctggtaaatcccgtaggatgtcaaaaatgataatcagttcccagacctcttctcctgcattgcgtggctttacaggattgcgaggatccaattatttggatatgatattaaagcctaagcaggatttctcttctctggttgcgtcctacatctctgcccctcgaggaaaggccagtcgaggagtgacagttgccatgtttgagcggtttacggagaaggctatcaaggttattatgttggcacaagaggaagcaaggcgtttggggcacaattttgttggtaccgaacaaattcttttgggtctaatcggagaagggactggtattgctgcaaaggttctaaagtccatgggaattaatttaaaagatgcccgcattgaagtagaaaagatcattggtaggggaagtgggtttgttgctgtagagatcccatttactccacgtgcgaagcgtgttttggaactctctctagaagaagcaagacaacttggtcacaactacattggatctgagcatttgcttcttgggctacttcgtgagggtgaaggtgtagcagcacgtgtactggagaaccttggagcagatccgagtaacatccgtacacaggttattcgtatggtgggagaaagtactgaagctgttggggctggagttggaggtggaactagtggaaacaagatgccgacacttgaggaatatgggactaatcttacaaagcttgcagaggagggtaaactggatcctgttgttggaaggcagcaacaaatagagcgtgtgactcaaattttggggaggaggactaagaataacccttgtttaattggggaacctggtgttggaaagacagcaattgcagaggggcttgctcaacggatctctaatggggatgtcccagagacaatagagggaaagaaggtgataacattggacatgggtcttcttgttgctggtacaaaataccgtggagagtttgaggaaagactgaaaaaactgatggaggaaatcaaacaaagcgatgagattattcttttcattgatgaggtacacacccttattggagcaggagctgcagaaggtgcaatagatgcagctaatatcttgaaaccggcacttgcaagaggtgaactccagtgcattggtgctacgacactcgatgagtacagaaagcatattgagaaagatccagctcttgagaggcgatttcaacctgtgaaagtaccagaaccatccgttgatgagactatacagattttgaaagggttgcgtgagagatatgaactgcaccacaagctcagatacactgatgatgctctggtggctgctgcacagttatcatatcagtacatcagtgaccgtttcctgccagataaagctattgatttgattgatgaggctggttctcgtgttcgacttcgccatgcacagcttcctgaagatgctaaagagcttgacaaggagctgaggcagatcacaaaagagaaaaatgaagctgttcggagccaagattttgaaaaggctggcgagcttcgtgacaaagaaatggagttgaaggctcagattacagcccttatagacaagggcaaagaaatgagcaaggctgagagtgtagctggtgagggaggcccaattgtcactgaggtggacattcagcacattgtctcttcgtggactggaattcctgttgagaaagtgtcaagtgatgagtctgacagacttcttaagatggaggagacattgcacaaacgtgtcattgggcaggatgaggctgtcaaggccatcagccgtgcaatccggcgtgctcgtgtaggacttaagaatcccaaccgcccaatagccagttttatattttctggcccaacaggtgtgggaaagtctgagctagcaaaggctcttgctgcttactatttcggctctgaagaagctatgatccgattggacatgagtgagttcatggaaaggcacacggtttccaagctcattggatcaccccccgggtatgtagggtacactgagggtggccagctgactgaagctgttcgccgccgtccttacactgtagtcctgtttgatgaaattgagaaagcccacccagatgttttcaacatgatgcttcagattcttgaagacggtaggctgactgatagcaaaggtcgtacagtggacttcaagaacaccctccttatcatgacatccaacgttggaagcagtgttattgagaaaggtggtcgtcggattggtttcgatcttgactatgatgagaaagacagcagctataacaggatcaagagcttggtgactgaggaactgaagcaatacttccgaccggagttcttgaacaggttggacgagatgatcgttttccggcaattgacaaaactggaagtaaaagatattgcagacattatgttgaatgaagtttttgagaggctcaaggccaaggacattgaactgcaagttaccgagaggttcagggagcgagtggtggaagaagggtacagcccaagctatggtgccagaccactgaggagggccataatgagactcttggaggacagtctggcggagaaaatgcttgcaggggagattaaggagggagactcggccatagtggatgtggattcggatggaaatgtgactgtgctcaatggcagcagcggcatcccagagcccttgccactgtaggtgcacccagttgaaaattgtgtgtaatgtttcattcaagcaggttttagtgaagttgaaacgcgaactgaccaccgagggaagccgagatatacggtgcggaatgcagtgtactgaaccaggttagccagcagctttcttttgtgaagcccaatcgaaaatgttaaagaaacgggggtaaagaggagagacttgtaacctgtgttatctggatgtgactagaaatacagatagaaaaccgtccttcacagtgtcgaattgcttaatttactttatttgaatgttacaacaataaacccttccggttcttgataagtgccaagttgtttcacatgtaccctaaaagtacaccacccttgctcaatttaccctttcaatggtctattttcgtataatttcttgagttttgagtagaactacacaaaaaaaaaa

SEQ ID NO: 3051 - DNA, 3323 bp, Elaeis guineensis
cctagctgcaactccgaggtttatgtatatatatatacattccatatagctgtttctcattaggcagaagatatggctggtgctttggtccagtcagctattcttcctgttcaagttgtgagcagaacctgtgaacagctgaaaggctctgggaagactagaaaggctgccaaaatgatgtgcaacttgagatcgcacgcactgagattgcaagcttttgcaggcttgcggggggcaaataatttggatttgctgtccaggtctagacaggattttcattctttggtatcagcttatatctctgctccacagggcaaggcttgtcgaggagtccctgtagccatgtttgaacgcttcacagagaaggcaatcaaagtaatcatgcttgcacaagaagaagcaaggcggctaggccacaattttgttgggacagaacaaatattgttgggtcttattggtgaagggactggtattgctgcaaaagttttaaaatcaatgggtataaatcttaaagatgcccgtgtggaagttgaaaagatcattggaaggggcagtggttttgttgctgttgaaataccatttacaccacgtgccaagcgagttttggaactgtcgcttgaggaagctcgccagctcggtcataactatataggatctgagcacttgcttcttgggctgctgcgggaaggtgagggtgtagctgctcgtgtgcttgagagtcttggagctgatccaagcaatatccgtacacaggtcattaggatggttggtgaaagcacagaagccgttggtgctggggttggaggaggaagtagtggcaataagatgcccacacttgaggagtacggaacaaatttgacaaagttagcggaggagggaaaactagatccagttgttggccggcaggagcaaatagaacgtgttactcaaattctgggaaggcggacgaagaacaatccctgcctgattggagagcctggtgttggaaagacggccattgcagaaggacttgctcaacgcatagcaaatggggatgttccagaaactattgagggaaagaaggtcattacccttgatatgggactccttgttgctggtacaaaatatcgtggagaatttgaagaaagattaaaaaagctgatggaggaaataaagcaaagtgatgagataatactctttattgatgaggtacacacattaattggagcaggcgcagcagagggtgcaatagatgctgctaatatcttaaaaccagctcttgcaagaggtgaactacagtgtattggagccacaacactcgatgaatacaggaagcacattgagaaggatcctgctctggaaagacgatttcagccagtaaaagtaccagagccgacagttgatgaaacaattcagattctgaaagggcttcgtgaacgctatgagattcaccacaaacttcgttacacagatgaggctttagtgtctgctgctcaattgtcacatcaatacattagtgaccgcttccttcctgataaagcaattgacttgattgatgaagctggttctcgtgtgaggctacgccatgcacagcttcctgaggaggcccgagaacttgacaaagagctcaggcagatcaccaaggagaaaaatgaggctgtccgtagccaagattttgagaaggctggggagcttcgtgatcgggagatggaactgaaggcacagatatcagctctgattgacaagggtaaagagagaagcaaagcagagagtgaggcaggtgatgcaggcccaattgtgacagaagcagacatacaacacattgtgtcttcatggaccggaatcccagttgagaaagtctcgagtgatgagtcagatcgcctccttaagatggaagagactctccacaagcgtgttattggccaggacgaggctgtcaaagccataagtcgtgccatccgccgagcccgtgttggtctcaagaatcccaaccggccaattgccagcttcatattttctgggccaactggtgttggaaaatcagagctggcaaaggcactggctgcttactactttggctctgaggaagccatgatcagattagacatgagtgagttcatggaaagacacacagtctctaaactcattggctcacctcctggttatgtcgggtacaccgagggtgggcagctaactgaagcagttcgccgtcgcccctatactgttgtcctctttgatgagatagagaaggctcaccctgatgtcttcaacatgatgcttcaaattttagaggatgggaggttaacagacagtaagggacgaactgtggatttcaagaacaccctgctgattatgacgtccaatgtcggaagcagcgtgatcgagaagggagggcgtaggataggatttgatcttgactacgatgagaaggacagcagctataaccgaatcaagagcctggttacggaggaattgaagcagtatttcaggcccgaattcttgaataggttggatgaaatgatcgtgttccggcagttgacaaagcttgaagtaaaggaaattgctgatataatgctgaaagaggtgtttgagaggctgaaggctaagaacatagaacttcaagttacagagagatttagagacagggtggtggaggaaggttatagcccaagctatggagcaaggcccttgaggagggccataatgaggctcttggaagacagcttggcagagaagatgcttgctggagagatcaaagagggagactctgccattgtggacgtcgactctgatgggaacgttacagtccttaatggtgcaactggtgtaccagagtccccagctattcctgtataaagtgtaataatcgacgtaccatttaatcgttgagcatttcatgttaatgtacttcatctaggtagaggctacgatgatccagcagcagcagtccaatcatcttatttgctggttttaagtttgcaacagcttacagcatacagccccatgaacatagtcggagtaattaaagtgtgaggttagtgcaccaagaagagagaattagtttgacttacacagactcaaagtgagctatttctgttctttatcaaaattgtgtactttctgtgatattattttcccgcttttcagtttctgtgtacaaactggctggattttatgcaacctagcttgtaatccatggtgagacctagatgtgggtctattgcctgacattttattcaccgctgggaaatttgtcattgatcagttaatcttccaggaggagatgcctagacttgcggtgttttgggtgtgctaccttttcttaatcacataatcaatcaatc

SEQ ID NO: 3052 - DNA, 3027 bp, Pennisetum glaucum
acggacccttactcttggaggcttccaagggctgcggcagacaaattttcttgacacaaggtctgtggtcaagcgtgacttcggatctatcgtagcaagtcagatttctcggccacggggttcagcgtcaagaggggtggttcgtgccatgttcgaacgcttcactgaaaaggccatcaaggtgattatgcttgcacaggaggaggccagacgtctaggccacaactttgtcgggacagagcagattttactaggtcttattggtgagggaactgggattgcagctaaggttctgaaatctatgggaattaatcttaaggatgcccgagttgaagttgagaagatcattggccgaggtagtggttttgtggctgttgaaatcccattcacaccccgtgccaagcgtgtattggaactgtcactcgaagaagctcgccagctagggcacaactatataggatctgagcacttactcctggggctacttcgtgagggcgaaggtgtggccgcccgtgtgcttgagagccttggtgcagatccaaacaacatccgtacccaggtcataagaatggttggtgaaagcacagaagctgttggtgctggagttggtggagggaccagtggccagaagatgcccacacttgaggaatatggtactaatttgacaaaactggcagaagagggaaaacttgacccagttgttggcagacagaaccagattgagcgtgtaacccagattttgggcaggcgaacaaagaacaacccctgcttaattggagagcctggtgttggcaagactgctattgcagaggggcttgcgcagcgtatcgccaatggggatgttccagaaacaattgaaggaaagaaggttattactcttgacatggggctccttgttgctggaaccaaataccgtggagagtttgaagagagactaaagaaacttatggaggaaattaagcaaaatgaagacattattctctttattgatgaagtgcacacacttattggagcaggtgcagcagaaggtgcaattgatgctgcaaatattttgaagccagctcttgccagaggtgaactacagtgtatcggtgcaacaacgctggatgagtataggaagcatatagagaaggatcctgccttggaaagaaggtttcaaccagttaaggttcctgagcctactgttgatgaaactacacagatcttaagaggacttcgggaaagatatgagcttcaccacaagttgcgatacacagatgaagctttgattgctgctgcacagctgtcttatcagtatatcagtgaccgcttcctgcctgacaaagccattgacttaattgatgaagctgggtctcgtgttaggttgaggcacgcccagctccctgatgaagccaaagagctggacaaagagcttcggcagataaccaagcagaaaaacgaggctgtacgaggccaagattttgagaaggctggtgaattaagggatcgggaaatggagctgaaggctcagattacagccatcattgacaagagcaaagaaatgattaaagcagagactgaatctggtgaagttggtcctcttgtcacagaggcagacattcagcatattgtctcctcttggactggaattcctgtggagaaagtctcatctgatgagtctgatcgtcttcttaagatggaggagacactacacacacgtatcattggtcaggacgaagcagtcaaagctattagccgtgctattcgacgtgctcgtgttgggctcaagaatccgaatcgtccaattgctagcttcatattctctggacctactggagttggtaaatcagaattagcaaaggccctggcggcctactactttggctcagaggaggctatgatcaggcttgacatgagtgagtttatggagagacatactgtctccaaactcattggatcacctccaggttatgttggctacactgagggaggccaattgactgaagcagttcgtcgccgtccatacactgttgttctctttgatgagattgaaaaggcacatcccgatgtattcaacatgatgcttcagatcttagaagatgggaggctaactgacagcaaggggcgcactgttgatttcaagaacacactattgatcatgacatcgaatgtcggaagcagtgtcatcgagaagggaggccgtaagattggttttgaccttgattctgacgagaaggacactagctacaacaggatcaagagcctggtcacggaggagttgaagcagtatttccgcccagaattcttgaacagattggatgagatgattgtgttccggcagctgacaaaattggaggtgaaggagattgcagacattatgctgaaagaagtgtttgaccggctgaaggccaaggagattgacctccaggtcacagagaagttccgtgatagagttgttgacgaaggttataacccaagttatggtgctcggcctttgcgacgtgctatcatgaggcttctggaggatagtctggcagagaagatgcttgctggtgaggtgaaagaaggtgactcttgcattgtggatgtggattctgagggcaaggtcatagtcctgaatggtgggggtggtgttcctgagccactggaacctgttctcagtgtctaggggaggctgaaaacctcagtttggaatctggccttcgtcacatctcaggggggctcctcatgaattatgatacacagcgctggcccttcgttagatttctctttcattgtttctttttggagttgatgcagtagaaatgctatggaaatgaataggtaggggcaaagtggatggcagatcctgagtttgtttatttttggaagcattttggaagctttatttttggaaggactgccattactgtattactaggtcatgcttgcagtaagagattggatatggttgcactgttgtacgaaaccttccaattatgtacgaaaatataatgtatccacgccttcaataacagtggcttatcatgataccaaataatgttccag

SEQ ID NO: 3053 - DNA, 3469 bp, Musa acuminata
ctttcttccttcccacgccgccctcgtttcccatttcatctcttcttgcggaagagagctccgctccccctcctctctctttctctctgttagatcgtcgctccttgtcagctccaaatcggaggtgttgcaagtgtctaagtgtggttgtcttttgttataagaagagatggctgattctttggtccattcggcaattcttccttctgctgtcatgaccaggagccaaagtcagcttcgaggctctggaaaggctaaaaggggtgcgaaaatggtccgatcgatgcggatgcatcccttaagactgcaaagctttgcaggcttgcgagcagcagacaatttggatttctcatcaagatgccagcaggatttccattcagtggtttcaagatatatatccaatccacgagggaaagccactagaggagtccctaaagctatgttcgagcgcttcacagagaaggcaattaaagttatcatgcttgctcaagaagaggcaaggcgtctaggccacaactttgttgggacagaacagattttgttgggccttattggcgaagggactggtattgctgcaaaagttttgaaatcaatgggaatcaatctcaaagatgctagggtggaagtggaaaagattattggaaggggaagtggatttgttgctgttgagataccctttacaccacgtgcaaagcgtgttttagaactctctttagaggaagcccgtcagcttggtcataactatataggatctgagcacttgcttcttgggcttctacgtgagggtgaaggtgtagctgctcgtgtgcttgagagtcttggagctgatccaagcaacatacgcacccaggcaaatatttttatagattttgttattcgaatggttggtgaaagcactgaagctgttggtgctggggtagggggaggaagcagtggaaacaaaatgcccacacttgaggagtatggaactaatttgacaaagttggcagaggaggggaagctagatcctgtagttggcaggcagccgcagattgaacgtgttacacaaattttgggaaggcgtacaaagaacaatccctgccttattggggaacctggtgttggtaagacagccatcgccgaaggacttgctcaacgcattgccaatggggatgttccagaaacaattgaaggaaagaaggtgattacccttgatatggggcttcttgttgctggtactaaataccgtggagagtttgaagaaaggttaaagaagctgatggaggaaattaaacaaagtgatgaaataatactcttcattgatgaagtgcacacattaattggagcaggagcagcagagggtgcaatagatgctgccaatatcttaaaaccagctcttgcaagaggtgaattgcagtgtattggagcaacaacacttgatgagtacagaaaacacatcgagaaggatcctgctttggaaagacgttttcaacccgtaagagtcccagaaccaacagtggatgaaacaatacagattcttagagggcttcgtgaaagatatgagattcaccacaaactccgttacaccgatgaggctttagttgctgctgctcagttgtcctatcagtacattagtgaccgtttcctgcctgataaggcaattgacttgatcgatgaagctggttctcgtgttaggcttcgccatgcacagcttcctgaggaagccagagaacttgacaaagaactcaggcagattacaaaagagaaaaatgaggcagtccgcggccaagattttgaaaaggcaggggagctgcgtgatcgggaaatggagcttaaggctcagatttcagccctaattgacaagggcaaagagaggagcaaagcagagagcgaggctggtgatgcaggccctgttgtaaacgaagcagacatacaacacattgtatcttcatggactggaatacctgtagaaaaagtctcaagtgatgagtctgatcgactcctcaagatggaagaaactctccacaagcgtgttattggccaggatgaggctgtcaaagcaataagtcgtgccattcgtcgagctcgtgttggtctcaagaatcccaaccgcccaattgccagcttcatattttctggtccaaccggtgttggaaaatcagaattggcaaaggcactcgcttcgtattattttggctccgaggaagccatgatccgacttgacatgagtgagtttatggagaggcacactgtttccaaactcatcggttcaccacctggttatgttggttacaccgagggcggccagcttactgaagcagttcgtcgtcgcccttatactgttgtcctctttgatgagatagagaaagcacaccctgatgttttcaacatgatgctccagattttggaagatgggagattgacagacagcaaggggcgaacagtagactttaagaacaccctcctgatcatgacctccaacgttggaagcagtgtgatcgagaagggaggtcgtaggattggttttgatctcgactatgatgagaaggatagcagctataacagaatcaagagccttgtcacagaggagctgaagcagtacttccggccagagttcctgaataggttggatgagatgatcgtcttccgacagctgacaaagctggaggtcaaggagattgctgatataatgcttaaagaggtatttgacaggctaaaagtgaaggatatagaacttcaagtgacagagaggtttaaggatagggtggtggacgaaggttacaacccaagttacggagctaggccccttagaagggccataatgaggctgttggaggacagcttggccgagaaaatgctggccggggagattaaggagggtgactcggccattgtggatgtcgacaccgaagggaatgttaccgttctcaatggtgggagcggtgtgcctgaatcaatacccccagctattcctgtatagaatccatatcctttgtgtttgctgtgatgtaatggtgaatcgtaggggccggcgaagagcatctgtggcttgcagccccattcatatcgtagggcattagcaggagaaatttgttgtgggaacaccagattggttgtcttaagcagatgaagaacaaggagtgaagtgaaactgaatattttcctggccaaaattgctggtaacacttatgatctatgcatgttgtcatttatgttggatttggtgacattctctggagatgagacatgccgatttgctatatgaattaccattgactaatttcgattccctggtggttcaatttctagttaaactagcttgtgtaccgtatcatgaaacttgagcatgtggagtctgaatcattttccttttcgtgagtgtattaaacatcatactattgcttcataaagtaacataaccttcgatctctcacagctgcatgatgacatcttttgaaggcatctgtgaatcacacggaaataatctctc

SEQ ID NO: 3054 - DNA, 3072 bp, Musa acuminata
atggctggttctttggttcaattgacaattcttcctagtgctctggcaaacaggagacaaagtcagcttcggggctctggaaaggctaaaaggggtgctaaaatgatgtgccaactgcaaatgcaccccctacgacttccaggctttgcaggcttgcgaagagcagataatttggagttcttctcaagaaatcgacatgattttcattcattggtttcagtatatgtctcctatgcatggggaaaagccagtcgaggggttgctaaagccatgtttgagcgctttacggagaaggcaatcaaagttattatgcttgctcaagaagaagcaagacggctgggccacaactttgttggaacagagcagatactgttgggccttattggcgaagggactggtattgctgcaaaagttttaaaatcaatgggaattaatcttaaggatgcccgggtggaagtggaaaagattattggaagaggaagtggatttgttgctgttgagataccttttactccacgtgcaaagcgtgttttagaactctctttggaggaagctcgccagcttggtcacaactacataggatctgagcacttgcttcttgggcttcttcgtgaaggtgaaggtgtggctgctcgtgttcttgaaagtcttggagctgatccaagcaacatacgtacccaggttattcgaatggtcggtgaaagcactgaagctgttggtgccggggtaggaggaggaagcagtggcaataagatgcccacacttgaggagtatggaactaatttgacaaagttggcagaggaaggaaagctagatccagtcgttggcaggcaggatcagatagaacgcgttacacaaattttgggaaggcgtacaaagaataatccatgcctaattggggagcctggtgttggaaagacagccattgcagaaggtcttgctcaacgcatagttaatggagatgttccagaaacaattgaaggaaaaaaggtgattacccttgatatgggtcttcttgttgctggtactaaatatcgtggagagtttgaagaaagattaaaaaagttgatggaggaaattaagcaaagtgatgaaataatactcttcattgatgaagtacacacattgattggagcaggagcagcagaaggtgccatagatgctgctaatatattaaaaccagctcttgcaagaggtgaattgcagtgtattggagccacaacacttgatgaataccggaaacatatcgagaaggatcctgctttggagagacgctttcaacctgtaaaggttccagaaccaacagtagatgaaacaatacagattcttagagggcttcgtgaaagatatgaaattcaccataaacttcgttacactgatgaggctttaattgctgctgctcagttgtcctatcagtatattagtgatcgattcctacctgataaagcaattgacttgattgatgaagctgggtctcgtgttaggcttcgccatgcgcagcttcctgaggaggcaagagaacttgacaaagagcttaggcagattacaaaagagaaaaatgaggcagttcgcagccaagattttgaaaaggcaggggaattgcgtgatcgggagatggagctgaaggctcagatctcagccttaattgacaagggcaaagaaagaagccaagcagagagcgaggctggtgattcaggtcctgttgtaacagaagcagacatacaacacattgtatcttcttggactggaattcctgtggagaaagtctcaagtgatgagtctgaccgtcttcttaagatggaagaaactctccataaacgtgtgatcggccaggatgaggccgtcaaagcgataagccgtgccattcgtcgagctcgtgttggtctcaagaaccccaaccgcccaattgctagcttcatattttctggtccaactggtgttggaaaatcagaattggccaaggcactagcttcgtattattttggctctgaggaagccatgatccgactcgatatgagtgagttcatggagaggcacactgtttccaagctcatcggctcaccacctggttatgttggttacactgagggtggtcagcttaccgaagcagttcgtcgtcgcccttacacggttgtcctctttgatgagatagagaaagcccaccctgatgttttcaacatgatgctccagattctggaagatgggagattgacggacagtaaggggcgaacagtagattttaagaataccctcttgatcatgacctccaatgtcgggagcagtgtgatcgagaaaggagggcgtaggattggttttgatcttgactatgatgagaaggatagcagctacaaccgaatcaagagccttgttacggaggagttgaagcagtacttccggccagaatttttgaataggctagatgaaatgattgttttccgacagctgacgaaactggaggtcaaggaaattgctgatataatgctcaaggaggtatttgacaggctgaaagccaaggatatagagctccaagtgacagagagattcaaggatagggtggtggaggaaggttacaacccaagttacggagctaggccacttagaagagccataatgaggctcctggaggatagcttggctgaaaaaatgttggctggggagatcaaggagggtgattcggctattgtggatgccgactctgaaggaaatgttacagttctcaatggcgggagcagtgtgcctgaatcaatgcccccggtcgttcctgtatagaatcagtatcctgtggcatcaccatggcacgatgccatgtttacaagggtaggggaagggaaacacctgtttgatcccccatttcacagcatccagatgattcatatgtgaggatattaacagcaaagtttcctgttacgagagaacccaatcattggattgtcttaaatcatatgaaaatataaaaaaaagatgctaggactgaagtgagacatggatgagggattatgatcttatgttatcatctgtgttggatgtgggtaaatgactttgaatgaatccgagacagcattgcgatatcat

SEQ ID NO: 3055 - DNA, 3256 bp, Eucalyptus grandis
caccgcctcgcggccgagtccccctactattatcatcctaaccaaaatcctcagcgcagtcgtcttcttcttcatctcttcctcctccttcttcgtcaatcttcttctatcttctctcctccctccctccctccctccctccctccgtcttctcagtcgagcgcttcagacgccttgctcggagttatggctggggtcctggcgcagtcagccaatgtgccggccatattgcctggccagagatatggcagctccggcggttctgccaagtccaggagaagtgtcaaaatgatgtccgctctcacggctcccggtataaggatgaggggcttctctggtctgagaggatctaacagtttggacactttgttgaattcaagctctgaccttcactctagggtggcgagttccatctcctttcgcagggggaaggcaagccgtggtgtggccagggccatgttcgagcgctttactgataaagccatcaaagtcatcatgcttgctcaagaggaagcacggaggctgggtcacaatttcgtggggacagagaacaaaattctcctgggtcttatcggcgaaggcaccggtattgctgctaaagtccttaagtcgatgggaatcaatttgaaagatgcgcgtgtggaggttgaaaaaataattgggaggggaagtggattcgttgccgtggagattcccttcactccacgtgcaaagcgcgtcttggaactgtcgctggaagaagctcgacagctaggccataactacattgggtctgagcacttgcttcttggactgcttcgcgagggtgagggcgtagctgctcgtgttcttgagaacttgggtgctgatcctagcaacattcgcacgcaggtcattaggatggtgggcgagagcactgaggctgttggtgctggtgttggtggagggagtagtggcaataagatgccaacgcttgaggagtatggaaccaacttgactaagctggcagaggagggaaaattggatcccgttgttggaaggcagcaacaaattgaacgtgttgtccagattcttggtcgccgaaccaaaaataatccttgccttattggagaacctggtgtggggaaaactgctattgctgaaggtcttgttcagcgtattgcaagtggtgacgttcctgaaacaattgaagggaagaaggtcattaccctggacatgggtcttctagttgctggaacaaagtatcgtggagagtttgaagagagattgaagaagctaatggaggaaattaaacagagtgacgaaataatactcttcattgatgaggtgcatactttaattggggcaggggcagcagagggggccattgatgctgcgaacattctgaaacctgctcttgcacggggtgaactgcagtgtattggggccaccaccctggatgaatataggaaacacattgagaaagacccagcattagaaagacgtttccagccagtcaaagttcccgaaccaacagtggatgaaactattcagattttgaagggactccgtgagagatacgagatccatcacaagttgcattacactgatgaagccttagtagccgctgcacagctctcttaccagtatattagtgaccgtttcttgccagacaaagccattgatttgattgatgaagcaggttcacgggttcgacttcgtcatgcacagctccctgaggaggccagagagcttgagaaagaactccggcagatcactaaggagaagaatgaggctgttcgcagtcaggattttgagaaggctggcgaattacgtgatcgggaaatggatctgaaggcacagataactgcgctgatagacaaaggcaaggagatgagcaaggctgaaactgaggctggggatgttggcccaatcgttacggaagtggacattcagcacattgtctcttcttggactggaattcctgtagagaaagtgtcaagtgatgagtcagatcgcctcctcaaaatggaagagacgctacacaaaacgagtcattggacaggacgaagcagttaaagcgattagccgtgccatcaggcgagctcgtgttggactcaagaaccctaatcggccgatcgccagtttcatcttttctggtccaactggtgttgggaagtcagaactggcaaaagcactagcggcttactactttgggtctgaagaggccatgattcgacttgacatgagtgagtttatggaaaggcacacagtgtccaagctaattggttccccacctggttatgttggatatactgagggtggccagctcactgaagctgttcgtcgacgtccatacacagtggttttgtttgacgagatcgagaaggcccatccggacgtcttcaacatgatgcttcaaattcttgaggatggaaggttgactgatagcaaggggagaactgttgattttaagaatacacttctcattatgacatctaatgttgggagcagcgtaatagagaagggaggccgccggataggatttgatcttgattatgatgagaaggatagcagttacaaccgtattaagagtctagtaacagaggagctgaagcaatatttcaggccggagttcctgaacagactagatgaaatgatagtgttccgtcagctcactaagttggaggtgaaggaaattgcggacatcatgcttaaggaagtgtttgagaggctgaaaggaaaggagattgaacttcaagtgacagagagatttagggaccgggtggtggacgaaggctacaatccaagctatggcgcaagacctctgagaagagctataatgagattattggaggacagtatggctgagaaaatgcttgctagggagatcaaagagggtgattccgtcatcgtcgatgttgactctgatgggaatgtaaccgtgctcaatggaggcagtggtgctccggagccattagctgaagcaatttctgtgtgaatggggcaacgtcttcatgcaacgtctgcttagatgcgaagggagtcttttgtattcgaaggggctaatgtggccagtggtggaagtgtcgtgttttagctggtaattggagctcgtatttttggctcagcaagtagcgccaacagcttttagatgtgtactgcttggcaacgaataatttgatatttgtcgatttgtattacagggaagtcgggatatactttgttttaagttagttccgttgatgatttatgataattaacaatagcaagccgtttccttccgcgactgatacaa

SEQ ID NO: 3056 - DNA, 2990 bp, Phalaenopsis aphrodite
atttcgccattggaagaaatcagacgctgctcttcttctacgagcttccatttatcacttcggggaggaagagataggtttctaccaaacctgcttcttgatcctctaggtacatatctgcagttccttcatacccatcaaccaagatggctggggcgtgcgttcaatctgttacccttccagctggtttggctagcattggccgcagtcgaggctctaggggttcccgaagagccgccaggatgctctgtagtccacgtttatatcctcttaggttccaaggatattctggattgcggtattctaatgtattagatcataattccaaatctggatatggttttcattcaatggtaggggcttatatctccgctccaaagggaaaggctataaggggcgttgctgtggctatgtttgagcgtttcactgagaaggcaattaaagttatcatgcttgcacaggaagaagctagaagattagggcacaatttcgtgggaactgaacagatattgctaggtcttattggcgaaggtacggggattgcggctaaagttctgaaatccatgggtataaatctgaaagatgctcgggtcgaagtggaaaagattattgggagaggcagcgggtttgttgctgttgaaataccatttacgccacgtgcaaaacgggttctagaactctccttggaagaagcccgtcaactaggtcataattacataggttcagagcatttactacttggattgcttcgcgagggtgaaggtgtggcagctcgtgtgttggagagccttggagccgacccaagcaatattcggacacaggttattcggatggttggtgagagcacagaagctgttggtgctggagttggagggggaagcagtgggaataagatgccaacactcgaggagtatggcactaatcttacgaagttggctgaggagggtaagcttgatcctgttgtaggtaggcagcagcaaatagagagggttacccagattttaggtaggcgaacaaagaataacccttgcctaattggagagcctggagttggtaaaacagccattgcagaagggctagctcaacgcattgcaaatggggatgtaccagagacaattgaaggaaagaaggtgatcactcttgacatgggccttcttgttgccggcacaaaatatcgtggagaatttgaagaaaggttgaagaaattaatggaggaaatcaaacagagtgatgagattatactctttattgacgaggtccacacattaattggagcaggagctgcggagggtgcaattgatgccgcaaatatcttgaaacctgcacttgctagaggtgaactgcagtgcattggagccactacacttgatgagtatcgaaagcacatagagaaagatcctgcattggaaaggaggtttcaacctgtgaaagtacctgaaccaacggtcgatgaaacaattcaaattctaaaaggacttcgcgagcgctatgaaattcaccacaaacttcgctacacggatgaggctctcattgctgctgcacagttatcttatcagtatatcagcgatcgattcctaccagataaagcgatcgacttgatcgatgaggccggttctcgcgttcgacttcgacatgctcaactccctgaggatgccagagaactggataaggagctccgacaaatcaccaaagataagaatgaagctgttcgcagccaggatttcgagaaggctggtgagttgagagaccgagagatggagctgaaggcccaaatctccgccctcatcgacaaaggcaaggaaataagcaaagccgagagtgaggccggcgacgccggccccatcgtcactgaagtagatatccaacatatcgtatcctcctggaccggaattcccgtcgagaaggtctccagcgacgaatccgaccgccttctcaaaatggaggaaacacttcaccagcgtgtcatcggccaagacgaggccgtcaaggccatcagtcgcgccattcgccgcgctcgcgtcggcctaaaaaaccctaaccgccccattgccagcttcattttctctggccctactggcgttggcaagtcggagcttgccaaggcccttgccgcctactacttcggctccgaagatgccatgattcgcctcgacatgagcgagttcatggaacgccacaccgtctcgaagctcatcggctcaccaccaggctatgttggctacaccgaaggtggccaattgaccgaagccgttcgccgacgtccatacaccgttgttctcttcgatgagattgagaaggctcacccggacgtcttcaacatgatgctccagatcttagaggacggccggctcaccgacagtaagggccgaaccgttgatttcaagaacacgcttttgatcatgacgtcgaacgtaggcagcagcgtgattgagaaaggagggcggagaatcggcttcgatctagactatgatgagaaggacagcagctataacagaatcaagagcctggtgactgaggagctgaagcagtatttccggccagagttcctgaaccggctcgacgagatgatcgtgttcaggcagctgacgaagctggaggttaaggagattgccgacatcatgctgaaggaggtgttcgagaggttgaagacgaaggacattgagttgcaggtgactgagaggttcagggatagggttgtggaagaagggtatagtccgagttatggggcgaggccattgaggagggcgattatgaggcttttggaggatagtttggctgagaggatgctttcgggggagataaaggaaggggattcagcgatcgtcgatgtcgattcagatgggaatgttacggtgttgaacggtagcagcgccccgccggagacgattagtccggcgatgtcaatctgatgcgatgcagcttttcggcgagatggggtgtggtttatgttgatgtagaatgaatgtgtagtaaactggttgtaaaacttt

SEQ ID NO: 3057 - DNA, 3078 bp, Phalaenopsis aphrodite
tcacttcggggaggaagagataggtttctaccaaacctgcttcttgatcctctagtttcttcatacccatcaaccaagatggctggggcgtgcgttcaatctgttacccttccagctggtttggctagcattggccgcagtcgaggctctaggggttcccgaagagccgccaggatgctctgtagtccacgtttatgtcctcttaggttccaaggatattctggattgcggtattctaatgtattagatcataattccaaatctggatatggttttcattcaatggtaggggcttatatctccgctccaaagggaaaggctataaggggcgttgctgtggctatgtttgagcgtttcactgagaaggcaattaaagttatcatgcttgcacaggaagaagctagaagattagggcacaatttcgtgggaactgaacagatattgctaggtcttattggcgaaggtacggggattgcggctaaagttctgaaatccatgggtataaatctgaaagatgctcgggtcgaagtggaaaagattattgggagaggcagcgggtttgttgctgttgaaataccatttacgccacgtgcaaaacgggttctagaactctccttggaagaagcccgtcaactaggtcataattacataggttcagagcatttactacttggattgcttcgcgagggtgaaggtgtggcagctcgtgtgttggagagccttggagccgacccaagcaatattcggacgcaggttattcggatggttggtgagagcacagaagctgttggtgctggagttggagggggaagcagtgggaataagatgccaacactcgaggagtatggcactaatcttacgaagttggctgaggagggtaagcttgatcctgttgtaggtaggcagcagcaaatagagagggttacccagattttaggtaggcgaacaaagaataacccttgcctaattggagagcctggagttggtaaaacagccattgcagaagggctagctcaacgcattgcaaatggggatgtaccagagacaattgaaggaaagaaggtgatcactcttgacatgggccttcttgttgccggcacaaaatatcgtggagaatttgaagaaaggttgaagaaattaatggaggaaatcaaacagagtgatgagattatactctttattgatgaggtccacacattaattggagcaggagctgcggagggtgcaattgatgccgcaaatatcttgaaacctgcacttgctagaggtgaactgcagtgcattggagccactacacttgatgagtatcgaaagcacatagagaaagatcctgcattggaaaggaggtttcaacctgtgaaagtacctgaaccaacggtcgatgaaacaattcaaattctaaaaggacttcgcgagcgctatgaaattcaccacaaacttcgctacacggatgaggctctcattgctgctgcacagttatcttatcagtatatcagcgatcgattcctaccagataaagcgatcgacttgatcgatgaggccggttctcgcgttcgacttcgacatgctcaactccctgaggatgccagagaactggataaggagctccgacaaatcaccaaagataagaatgaagctgttcgcagccaggatttcgagaaggctggtgagttgagagaccgagagatggagctgaaggcccaaatctccgccctcatcgacaaaggcaaggaaataagcaaagccgagagtgaggccggcgacgccggccccatcgtcactgaagtagatatccaacatatcgtatcctcctggaccggaattcccgtcgagaaggtctccagcgacgaatccgaccgccttctcaaaatggaggaaacacttcaccagcgtgtcatcggccaagacgaggccgtcaaggccatcagtcgcgccattcgccgcgctcgcgtcggcctaaaaaccctaaccgcccattgccagcttcattttctctggccctactggcgttggcaagtcggagcttgccaaggcccttgccgcctactacttcggctccgaagatgccatgattcgcctcgacatgagcgagttcatggaacgccacaccgtctcgaagctcatcggctcaccaccaggctatgttggctacaccgaaggtggccaattgaccgaagccgttcgccgacgtccatacaccgttgttctcttcgatgagattgagaaggctcacccggacgtcttcaacatgatgctccagatcttagaggacggccggctcaccgacagtaagggccgaaccgttgatttcaagaacacgcttttgatcatgacgtcgaacgtaggcagcagcgtgattgagaaaggagggcggagaatcggcttcgatctagactatgatgagaaggacagcagctataacagaatcaagagcctggtgactgaggagctgaagcagtatttccggccagagttcctgaaccggctcgacgagatgatcgtgttcaggcagctgacgaagctggaggtgaaggagatcgccgacatcatgctgaaggaggtgttcgagaggttgaagacgaaggacattgagttgcaggtgactgagaggtttagggatagggttgtggaagaagggtatagtccgagttatggggcgaggccattgaggagggcgattatgaggcttttggaggatagtttggctgagaggatgctttcgggggagataaaggaaggggattcagcgatcgtcgatgtcgattcggatgggaatgttacagtgttgaacggtagcagcggcgcgccggagacgattagtccggcgatgtcgatctgatgcgatgcagcttttcggcgagatggggtgtggtttatgttgatgtagaatgaatgtgtagtaaactggttgtaaaacttttaattgagtgtggagaagagggttctatgtaagctggagatgagttctggggttaggtttaaatagggtttaatgaaataataatgcagttaggtaaagtatggtgaatgatgatgatattttatagttaaaagtttgttagttttaaaaaaaaaaaa

SEQ ID NO: 3058 - DNA, 3778 bp, Brachypodium distachyon
gtgacgtagccggctcttcttatctcttgcttccccttgccctcctcctgtatgagctccatatcccttcttcctgaatcctcctcgccgagtcccctcccctctcctagggtggcgtagcgtagcatcaaccgtcgtcacccgccgccgccgccgccaacgggctcccctcgacgccgtgcgccggatccacttcgccttccgggtcccatcgacgccccgtccatatctggtcttggtaaaagggttgcttcgggcttcctttagacataccgacatggagggggctctggttcagtcagcaattgtccctacaatatataacagcggtgctcaggtccgtgcgcgtgcaagggcaacatcagtgagggcggcatcggtatgcagtatgcggacgcagaccatgaccctagggggttttcaaggactgcggagggcaaattttttggacacaagatctgtggttagacgtgactttggctctattgtagcacatcagcttgcacggccgaggggaaaggggtctcgaatggttgtgcgtgccatgtttgagcgctttacagagaaggcaatcaaggtgattatgctcgcccaagaggaggcaagacggctaggccacaattttgtcgggacagagcaaatcctgcttggccttatcggtgagggtaccggcattgcagctaaggttcttaagtcaatgggcattaatcttaaggatgctcgtgtagaagttgagaagatcattggacgaggcagtgggtttgtggctgttgagatcccattcacaccccgtgcaaaacgtgtattggaactgtcgcttgaagaagctcgtcagcttgggcataattacataggatctgaacacttactcctgggcctgcttcgtgaaggtgaaggtgtggctgcccgagtgctagaaagtctcggtgctgatccaaacaacattcgcacacaggtcataaggatggttggtgaaagcacagaagctgttggtgctggtgttggtggtggaagcagtggtcaaaaaatgcctacacttgaggaatacggtactaatttgactaagttagctgaagagggtaaactagatccagttgttggcaggcaggaccaaattgagcgtgtcacccaaatattaggaaggcgaacaaagaataacccctgcctgatcggagagcctggtgttggcaagactgctatcgccgaggggcttgcgcagcgtattaccaatggggatgttccagaaacaattgaaggaaaaaaggttattacactcgatatggggctgcttgttgctggtaccaaatatcgcggagaatttgaagaaaggctgaagaagcttatggaggaaattaagcaaagtgatgatattattctcttcattgatgaagtgcacactttgattggagcaggtgcggctgagggtgcaattgatgcagccaacatcttgaaacctgctcttgctagaggtgaactgcagtgtattggggccacaacgctggatgagtacagaaagcatattgagaaagatccagcactggagagaagatttcaaccagtcaaggttcctgaaccaactgttgatgaaaccatacaaattttgagaggcctccgtgagagatatgagcttcaccataagctgcgatacacagatgatgctcttactgctgctgcgaagttgtcgtatcagtatatcagtgatcgtttcctacctgacaaagctatcgacttgattgatgaagctggatcacgtgtcaggcttaggcatgcccagctccctgatgaggcaaaagaattggacaaagaacttcgcaaggttaccaaggataagaacgaggcagtacgcggccaagattttgagaaggctggggaactaagagacaaagagatggaactgaaggcacagattacggccatcattgacaaaagcaaggaaatggttaaggcagagacagagtctggtgaagttggtcctttggtcacagaggcagatattcagcacattgtgtcctcttggactggaatacctgtcgagaaggtctcctctgatgaatctgaccgtctcctgaagatggaggaaacactgcatcaacgtattatcggtcaggatgaggctgtcaaagctattagccgtgcaatccgccgagcccgtgttggcctgaagaatccaaacaggcctattgcaagtttcatattctctggaccaaccggtgttggtaagtcagaactggccaaagctttggcatcatactactttggctctgaggaagccatgatcagacttgatatgagtgagttcatggagagacatactgtctccaaactaattgggtcaccacctggatatgttggctataccgagggtggtcaattaactgaagcagttcgccgtcgcccttacacagtagttctctttgatgagattgaaaaggcacatccagatgtcttcaacatgatgcttcaaatactagaagatggaagattgacggacagcaaggggcggacagttgatttcaagaatacgctcttgatcatgacatcaaatgttggtagcagtgtcattgagaaggggggccgcaagattgggttcgaccttgactacgacgagaaggacaccagctacaacaggatcaagagcctggtgactgaggagctgaagcagtacttccggcctgagttcctgaatagattggatgagatgattgttttccgccagctgacaaagctggaggtgaaggaaattgcagacattatgctgaaagaagtgtttgataggctgaaggcaaaggaaattgaccttcaagtgaccgaaagattcagagatagggtggtggatgagggctacaacccaagctatggtgccaggccactgcgccgtgctatcatgaggctcttggaagacagcctggcagaaaagatgcttgctggtgaggtcaaggaaggagattctgctatcgttgatgtcgattcagaaggcaaagttatagtactcaacagcggcagcggcgttccggagccactgacgcctgctttgagcacctgattatcatttcggaatccaatgttttgacctcacgctgtgacttggagtttgcacaatttcctctcattcatttggcggtgatgtgtccctagatcttgttgcaagccaggcagtagaaatttgaggaagatcagtgaatataattgccacatagttctcatcgagaccagtctactagatttttagtttgtttgctttgagaagaaacctggaagctttgttttgtgtgaagttctgtgccgggtgtgcccatttcaggtattagttcttttttgaacattcttttcaggtacgaggtagcactgtactgtctcgtaagggcttgaagcgcagctgctgccctttcatggacgcactagtagaatgaaacagaaactcctcatttcgtgttctgttggatattaatgcatgataatgtttggcaatagcagctccgcttgagcatacaatatcttgtaataccttcatttcacacgcataactaaggggtatcggattgggatatatttaatcaacctatttgttctcattagatagattaacactttgtctatgtagtggcgacaaacaaggtccgcatctttgaatattagtgaagttcgttttgacttctaagtatgtgcgtgtggcataaaatatgaaacgaaaagagcttgagtagcaaattctttacctgatttgaccgaaacctccagcaatcttcagtgcatatttatcaccagatcatcagcaaac

SEQ ID NO: 3059 - DNA, 2970 bp, Triticum aestivum
tctggttcagtctgccattgctcctaccgcctacaggagtagctctacgcggtcccgtgtgcgcacaagggccacaatgttacgcagtacgccaacgaggaccctcattctcgggggttttcaaggactgcggcaaacaaatttcctggatacaaggtctgttatcaaacgtgactttggctccattgtagcaagccagatttcacgaccacgtgggtcaggttcaagaatggttgtccgggccatgttcgagcgctttacagagaaagcaatcaaggtgattatgcttgcacaggaggaagcaagacgcctaggccacaactttgttgggactgaacagattctgcttggccttattggtgagggaactggaattgcagcaaaggttctaaagtctatggggatcagtcttaaggatgcccgtgtggaagttgaaaagattattggaagaggcagtgggtttgttgccgttgaaattccatttacacctcgtgcaaagcgtgtactcgaactgtcacttgaagaagctcgccagctagggcataactatataggatctgagcacttactcttagggctacttcgtgagggtgaaggtgtggcagctcgagttctcgaaagccttggtgctgatccaaacaacattcgtacccaggttataagaatggttggtgaaagcacagaagctgttggtgctggggttggtgggggcagcagtggccagaagatgcctacacttgaggaatacggtactaatttgacaaagctggcagaagagggtaaactagacccagttgttggcagacaggatcaaattgagcgtgtaactcaaattttgggcaggcggacaaagaacaacccgtgcttaattggagagcctggtgttggcaagactgctattgcagaggggcttgcacaacgtatttgtaatggtgatgttccggaaacaattgaaggaaagaaggttatcacccttgacatggggctccttgttgctggtaccaagtaccgtggagagtttgaagaaaggctgaagaagcttatggaagaaattaagcaaaatgatgatattatactttttattgatgaagtgcacacgttgatcggagcaggtgcagctgaaggtgcaattgatgctgctaacatcttaaaaccagctcttgcaagaggtgaactgcagtgcattggtgccacaacactggatgagtacaggaaacatatcgagaaagatcctgctttggagcgaaggtttcaaccagtcaaggttccagagcccactgttgaagaatcaatacaaatcttaagaggacttcgtgagagatatgagcttcatcataagctgcgatacacagatgatgctttagttgctgcggcgcagttatcatatcagtatatcagtgaccgcttcctgcctgacaaggctattgacttgattgatgaagcggggtcccgtgttaggctcaggcatgcacagctacctgatgaggccaaggagctggacaaaaaacttcgccaaataacaaaggacaagaatgaggctgtgcgcggccaagattttgagaaggctggggaattaagagacgaggaaatggagttgaaggcccaaattacagccattattgacaagagcaaggaaatggttaaagcagagactgaatccggcgaagttggtcctcttgtcacagaggcagatattcaacacatcgtctcatcatggactggtatacctgtggagaaagtctcatctgatgaatctgaccgcctccttaagatggaagagactctccatactcgtatcattggtcaggatgaagctgtcaaagctattagccgtgctatccgccgtgctcgtgttggcctcaagaatccaaatcggcccattgctagcttcatattctctggaccaactggtgttggtaaatcagaattagcaaaggctctggcatcctactactttggctcagaggaagccatgatcagattagatatgagtgagttcatggagagacatacagtgtccaaactcatcggatcacctccaggttatgttggctacactgagggaggtcaactaacagaagcagtccgccgccgtccatacacagttgttctctttgatgagattgaaaaggcacatccagatgtcttcaacatgatgcttcagatcttagaagatgggaggctgacagatagcaagggacggacagttgatttcaagaacacactgttgatcatgacatcgaatgtcggaagcagtgtcatcgagaagggaggccggaagattgggtttgaccttgactctgacgagaaagataccagctataacaggatcaagagcttggtgaccgaggagttgaagcagtatttccggcctgagttcttgaacagattggatgagatgattgtgttccggcagttgacaaagttggaggtgaaagagatcgctgatattatgctcaaggaggtgtttgacaggctcaaggcaaaggaaatcgacctccaggtaacagagaagttccgggatagggttgttgatgaaggttacaacccgagctacggtgccaggcctctgcgacgcgccattatgaggcttttggaagacagtctggctgaaaagatgctggctggcgaggtcaaggaaggtgattctgctattgttgatgtggattcggatggtaaggtggtagttctcaacagcgggggtggtattgcagagccgctggagcctgctctgagtgcctagttgggtacaccatctttttatttcgttatctcagcatggggtcctggtgatggtacctagattaatatcactgccctttcagttatgtgttctcttccttttttgtctctcctctttcactctcttgaagttcgaagtttgaagcgaggcactagaaattgttatgtaaacgaaacaaacatagatgcatgtacgagcaagctgtatgccagtatatcttttgagtt

SEQ ID NO: 3060 - DNA, 3558 bp, Brachypodium distachyon
gttgtgcttatatcaaactaagctgaactgatatccatggagaaactctcatgctgacttgtttgtatgcaactctactgccgcttcaatatgggcttagttgggtgcgatttagatggatatggaactttctcgtcttacagggcgatgtttacttgctcttatcccataaaggtctatcttagctctattcatgaccatttcggcatattgtgatactcaccataatcagtaatacattttcaggtcttggtaaaagggttgcctggggctttatttagatataccgacatggagggggctctggttcagtcagcaattgtccctacaatatataacagcggcgctcaggtccgtgcgcgtgcaagggcgacattggtgagggcagcatcagtgtgcagtatgcggacgcagaccatgaccctaggaggttttcaaggactgcggagggcaaactttttggacacaagatctgtggttagacgtgactttggctctattgtggcaagtcagcttgcacggccgagaggaaaggggtctcgaatggttgtacgtgccatgtttgagcgctttacagagaaagcaatcaaggtgattatgctcgcccaagaggaggcgagacggctcggccacaattttgttgggacagagcaaatcctgcttggccttattggtgagggtacaggcattgcagccaaggttcttaagtcaatgggcatcaatcttaaggatgctcgtgtagaagttgagaagatcattggccgaggcagtgggtttgtggctgttgagatcccattcacaccccgtgcaaaacgtgtattggaactgtcacttgaagaagctcgtcagcttgggcataattacataggatctgaacacttgctcctgggcctgcttcgcgaaggtgaaggtgtggctgcccgagtgctagaaagtctcggtgctgatccaaacaacattcgcacacaggtcataaggatggttggtgaaagcacggaagctgttggtgctggtgttggtggtggaagcagtggtcaaaaaatgcctacgcttgaggaatatggtactaatttgactaagttagctgaagagggtaaactagatccagttgttggcaggcaggatcaaattgagcgtgtcacccaaatattaggtaggcgaacaaaaaataacccttgcctaatcggagagcctggtgttggcaagacagctattgcagaggggcttgcacagcgtattaccaatggggatgttccagaaacaattgaagggaaaaaggttattacacttgacatggggctgcttgttgctggtaccaaatatcgtggagagtttgaagaaaggcttaagaagcttatggaggaaattaagcaaagtgacgatattatcctcttcattgatgaagtgcacactttgattggtgctggtgcagctgagggtgcaattgatgcagccaacatcctgaaacctgctcttgcaagaggtgaactgcagtgtattggtgccacaactctggatgagtacagaaagcatattgagaaagatccagcactggagagaagatttcagccggtcaaggttccagaaccaactgttgatgaaaccatacaaatcttgagaggtcttcgtgagagatatgagcttcaccataagctgcgatatacagatgatgctcttattgctgctgcaaagttgtcctatcaatatatcagtgatcgtttcctgcctgacaaagctatcgacctgattgacgaggctggatcacgtgtcaggcttaggcatgctcagctccctgacgaagcaaaagaattggacaaagaacttcgccaggttactaaggataaaaacgaggcagtacgtggccaagattttgagaaggctggggaactaagagacaaagaaatggaactaaaggcacagattacagccatcatcgacaaaagcaaggaaatggttaaggcagagacagagtctggtgaagttggtcctttggtcacagaggcagatattcagcacattgtgtcctcatggactggaatacctgtcgagaaggtctcctctgatgaatctgaccgtctcctgaagatggaggaaacactgcatcaacgtattatcggccaggatgaggctgtcaaagctattagccgtgcaatccgccgagcccgtgttggcctgaagaatccaaataggcctattgcaagtttcatattctctggaccaaccggtgttggtaaatcagaactggctaaagctttggcatcatactactttggctctgaggaagccatgatcagacttgatatgagtgagttcatggagagacatactgtctccaaactaattgggtcaccacctggatatgttggctatactgagggtggtcaattaactgaagcagttcgtcgtcgcccttacacggtagttctttttgatgaaattgagaaggcacacccagatgtcttcaacatgatgcttcaaatactggaagatgggagattgactgatagcaaggggcgtacagttgatttcaagaatacgttattgatcatgacatcaaatgttggaagtagtgtcattgagaagggaggccgcaagattgggttcgatcttgactacgacgagaaggacaccagctacaacaggatcaagagcctggtgactgaggagctgaagcagtacttccggcctgagttcctgaatagattggatgagatgattgttttccgccagctgacaaagctggaggtgaaggaaattgcagacattatgctgaaagaagtgtttgataggctgaaggtaaaagaaatcgacctccaagtgacggagaggttcagagatagggtggtggacgagggctacaaccctagctatggtgccaggccactgcgtcgtgctatcatgaggcttttggaagacagtttggcagagaagatgctagcaggtgaggtcaaggaaggtgattctgctatcgtcgatgttgattcagaaggcaaagttatagttctcaacagcggcagcggtgttccagaaccaatggcgcctgttttgagcacctaatcatgattctggactaccagttactctatttcgttcggtggtgttgttatcctcgatctttttcagcaccagcagtggaaatttcaggaagaccaatgaatataacttccacatagcctacagagacaccacgcctagatgtttagtttatttgctttagaaagaatcgtggaagcttgggttttgagacagcacgccttttgacggcactgtaatgtttgtaacgtgcttggcggcttggcgcccacctgctccctcacttgtggaaattagtagaaaaatcttcaataacgatggagacattgccgctggcaacttcaccacttacaaaatcggcggcatataccgtccaattgtttagtactaaaagattataaagaaaaattcacatatgcttattggtattccaatagagaacctaaaattttagattagaagcatatcatgggaaatctgattgtttagatccattagtcaggccttaaacgcagcaacgaggag

SEQ ID NO: 3061 - DNA, 3035 bp, Platanus occidentalis
ttgtagatttctatcctgctggtggaagtcatggcaagtgctttggttcagtcgacaaatcttcctactgcagttgttggtgaaagtcttggccaacttcgaggatctggaaagacaaaaaggaatgtcaaaatgatgtgtaatgtgcaggcaccctgccttgggctgcggaatttctcaggattgcgaggatccaatgctttagataatatggtaaggtccagctgcaatttccattccaaggtggcagctgctatctcttttccacgaggaaaggcttcgcggggggttgttgtagctatgttcgagcgcttcacagaaaaagccattaaagttattatgcttgcccaagaggaagcaagacggcttggacacaattttgttggaactgagcaaattctgttgggtcttatcggtgaaggcactggtattgctgcaaaggtacttaaatcaatgggcatcaatttgaaggatgcccgtgtggaagtggagaagatcattgggaggggcagtggatttgttgctgtggagattccatttactcctcgtgcaaagcgtgtgttagaactttcattagaggaagcccgccagcttggtcataactatattggatcagagcacttgcttttgggactgcttcgtgagggtgaaggtgtagcagcacgtgtgcttgagaacctaggtgctgatgcaagtaacattcgtacacaggttatccgtatggtgggtgagagcacagaagccgttggtgctggggttggaggtggaagcagtggcaataagatgccaacactggaggagtatggcactaatttgacaaagctggcagaggagggtaaacttgatcctgttgttggaaggcagccacaaatagaacgtgtgacccaaattttgggtaggcggacaaagaacaacccctgccttattggagaaccgggtgttgggaaaacagcaattgcagaagggcttgctcaacggattgcaactggtgatgttccagaaacaattgaagggaagaaggtgattaccctggatatgggtcttctcgttgctggtacaaaatatcgtggagagttcgaggaaagattaaagaagctgatggaggaaatcaaacaaagtgatgagataatactctttatcgatgaggttcacaccttaattggagcaggagcagctgagggtgcaattgatgctgcaaacatcttgaaaccagccctttctagaggtgaactgcagtgtattggtgccacgacattagatgaatacaggaagcatattgagaaagacccagcattggaaagacgattccagcctgttaaagtgcctgaacctactgtcgatgagaccattcagattttgaaaggacttcgagagcgatatgagattcaccacaagctacgttatacggacgaagccctagttgctgcagcacagttgtcatatcagtacatcagtgatcgcttcctccctgacaaagcaatcgacttgattgatgaggctggttctcgggttcggcttcgtcatgcacagctccccgaggaagctagagagcttgaaaaagagctcagacagattacgaaggagaagaatgaagctgttcgcagccaagactttgaaaaggctggagagttgcgggatcgggaaatggacctcaaaactcagattgcaaatcttgtagacaaagggaaagagaaaagcaaggcagaaagtgaggcaggtgatgttggtccccttgttacagaagtggacatccagcacattgtttctgcttggactgggatccctgttgagaaggtctcgagcgatgagtctgaccgcctactcaagatggaagagacactccacaagcgggttgttggtcaggatgaagctgttaaagctatcagtcgtgccatccgccgtgctcgtgttgggctcaaaaaccccaaccggccaattgccagcttcatattttctggaccaactggtgttggaaaatctgaactggcaaaggctctggctgcctactacttcggctctgaggaagccatgattcggctggatatgagtgagttcatggagagacatactgtttctaagctcattggatcaccccctggctatgttggttacactgagggtggtcagctgactgaagcagtacgtcgccgcccctacactgtggtcctcttcgacgagattgaaaaggctcaccctgatgtcttcaacatgatgcttcagattctggaagatggaaggttgactgacagcaagggccggactgttgattttaagaacacgctccttataatgacatctaatgttggaagtagtgtgattgagaagggaggtcgtcgaattgggtttgatcttgactatgatgagaaggatagcagctataatcggataaagagcctagtgacggaggagctcaaacagtattttcggccggaattcctgaaccgattggatgagatgattgtcttccggcagctcaccaagttggaggtgaaggagattgcagacatcatgttaaaagaggtatttggtaggctgaaggctaaggacatagagcttcaggtgacggagaggtttagggacagggtggttgaggaagggtatagcccgagctatggtgcaaggccattgaggagagcaataatgagacttttggaggattgtatggccgaaaagatgcttgcaggagagatcaaagagggagactcagttatagtagacgttgattctgatgggaatgtgactgttctcaatggtagtagtggtgctcctgagctggctgagccagcattcccggtgtaaccaacatcctcttccagccggatgcatgtttatatttctagtttacattcagcttacgtttgaatggttatagtttcttttgtccaaagattgcacaagtgatggtcaaggaaaggtagatgctttaatattgtattaattagtgcagtacacgtactttttggcacaagatattggtgaagaaggtgtgcttaattagatggatagaaagataaaaaatgaaaatagaaaaaggt

SEQ ID NO: 3062 - DNA, 3289 bp, Amborella trichopoda
tatctcagatagaacgggttccgacctctcacttctttttacccgtaccattcttaatcttcagggcctaggggttggaattcctgctaaaatccttagatttctttcttgttcaaagcctaggtgttgagtgttatacgtaatatttacttggcagttgtcagctgaagtcatggctggtgcactggttcagacagcagtccttcctgctagagtagtaagcaggaatggggtacggcaaaatcacggttctggcaaaggcaaaacgggcactagaatgatggttcccatccgagtgaggccattaagtttaggaagttatagaggattgcgaggttctaatgccattgatttagttgcaattcggtctgaaagaagtttccatgcagctgtttcagctgctatcactttgccaaagggaaaaggcagccagggagtggtcaaagctatgtttgagcgtttcactgaaaaagcaatcaaagttattatgcttgcacaagaagaagcaagacgtctcggtcacaactttgttggaactgaacaaattttattgggccttattggtgaagggactggtattgctgccaaagttttgaagtccatgggaattaatttgaaggatgctcgtgtagaggttgagaaaattattgggaggggaagtggttttgttgctgtagagataccatttactccacgtgccaagcgtgtcttggaactttcccttgaggaagctcgtcagcttggacacaactatatagggtctgagcatttgcttttaggtttgcttcgtgaaggggaaggggttgcagcacgtgtgcttgaaaaccttggagctgatccaagcaatattcgtacacaggtcattcgaatggttggagaaagcacagaggctgttggtgctggtgttggtgggggaagtagtggaaacaagatgccaacacttgaggaatatggaaccaatcttacaaagctagcagaagagggtaaactggatcctgttgttggaaggcagatgcagattgagcgtgtgacccaaattctaggaaggcgaacaaagaacaatccttgccttattggagagcctggtgttgggaagactgcaattgctgaaggccttgctcaaagaattgcgaatggggatgttccagaaacaattgaggggaaaaaggtgattaccctggatatgggacttcttgtggctggtacaaaataccgtggagagtttgaagaaaggttgaagaagctgatggaggaaattaagcaaagtgatgagattattctgtttattgatgaggtgcacaccttaattggagctggtgcagcggagggtgcaattgatgctgccaatatcttgaagccagctttagcaagaggtgaactacagtgcataggtgctacaacactggatgagtacaggaagcacattgagaaagatccagccttggaaaggcggtttcagccagtcaaagtgccagaaccctctgttgatgaaacaatacagattctcaaggggctacgtgagcgatatgagcttcaccacaaacttcgttacacagacgtggccttggttgctgctgcacaactatcctaccagtacattagtgatcgcttcctccctgacaaggcaattgatttggtagacgaggctggatctcgtgtaagacttcgccatgcacagcttcctgaagaggccaaagagcttgacaaggagctcaggcagatcaccaaggagaaaaatgaggctgttcgtagccaggattttgagaaggctggtgagctacgtgaccgcgagatggagctcaaggctcaaatcacagccatcactgaaaagggcaaggagcaaagcaaggctgaggccgagtccggctcatccttgggtcccattgtcaccgaggtcgacatccaacacatcgtttcttcatggactggtatcccagtcgagaaggtctcgtccgatgaatctgaccgccttctcaaaatggaagagacccttcacaagcgtgtaataggccaagacgaggcagtaagagccatttctcgagccatcaggagggccagagtgggactcaaaaaccctaataggcccattgcctccttcattttctcgggcccaactggtgtaggtaaatctgagctggctaaggcacttgctgcctactatttcggctctgaagaagccatgattcgccttgatatgagtgagttcatggagcgccacactgtttcaaagctcattggatcaccacctggttatgttggctacactgagggtgggcaattaactgaggcagtgcgtcgaagaccatacactgtagtgctctttgatgagattgagaaggcccatcctgatgttttcaacatgatgctccaaattctcgaagatgggcggctaactgacagcaaaggcagaaccgtcgacttcaagaacacgctgctcatcatgacctctaatgtgggcagtagcgtaatcgagaagggtggcagacgaattgggtttgatttggactacgatgagaaggatagcagttataatcgcattaagagcttggtcacagaggagctcaagcaatatttcagacctgagttcttgaacaggcttgatgagatgatagtctttaggcaactcaccaaacttgaggttaaggagattgctgatataatgttgagggaggtgtttgagaggcttaaggcaaaggaaatagagttgcaagttactgagagatttagagatagggttgtggatgagggttatagccctagttatggtgcgaggcctttgagaagggcaattatgaggctcttggaggatagtttggctgagaagatgcttgctggagagataaaggaaggggactcggcgattgtggatgtggactcagagggtaatgtcacggtgcttaatggggcaagtggcacatcagatgcattgtcagagccagtgccgatatgagtgagagcttgcatgtggccactgtatttattctgctctcttttataaaattaagtttctgggctctcaagttcgagactattttttttaggagtactaatttgtgcttttagtgaaattgccttgagagttatgtatgttgattttgaattccctttgaaatggaggaaatactggtatagctttcagatgtcactgattttgacttcagtggttctccctttctgttcttgtttggatgtaagtttaaagctttataggggttttccctcaagttagtgcttctgatgtcatctttcagctgttaaatgttaatgagcaatgtatgttgcttggata

SEQ ID NO: 3063 - DNA, 3229 bp, Centaurea maculosa
cgtgtacaaataaccaaatgcgaagaagataataattatatagaccgaccgcctgttacttatcatccacatccattcaatccggcggaccttctcaccttcctttctctctcgtttccgattaaccggaaaacgactttcttccctaattctctcttcctctgatttagagttccttggctgcaatcatggctggggctttggtgcaatccaccagttttccttctgcagtttccagtgaaagcgagggccgttcaaagcgatctggtagtataaaaagagcagtcaagatgatgggcttacaagctcctccaatgagggttaggactttctctggtttgcgaggagtaaatgctttagacaacttggtaaagagaggccaggatttccactcaaaggttgcagcagccacctctgtccgaagagcaaaacctactcgaattgtgccaaaggccatgttcgagcgcttcacagagaaggctatcaaagttataatgcttgcacaagaggaggcaagacggcttggtcacaactttgtgggtacagagcagattttattaggtcttattggtgaaggcactggcattgcagcaaaggtactgaagtcaatgggaattaatttgaaagacgcacgtgttgaggtagaaaaaattattggtaggggtagtggatttgttgctgtagagattccatttacacctcgtgcaaagcgtgtgctggaactgtcactagaggaggcgcgacaacttggtcataattacattggttcagagcacttgcttcttggattgcttcgtgagggggaaggtgtagctgctcgtgttcttgagaacctaggcgcagacccaaataacattcgcacacaggtgatcagaatggttggagagagtgcagaagctgtgggtgctggagttggtggtggaagctctggtaacaagatgccaacactggaggaatatggtaccaacttgacaaagctagcagaggagggtaagctggatcctgttgtaggaaggcagccacaaattgaaagagttactcaaattctgggacgccgtacaaaaaacaatccctgcctcattggagaacctggtgttggaaagacagctattgcagaaggtcttgcccaaagaattgcaactggtgatgttccagaaacaattgagggaaagaaggtgattactctggatatgggtctgcttgttgctggcacaaagtatcgtggagagtttgaggagagactaaagaagttgatggaggaaatcaagcaaagtgatgaaattattctctttattgatgaagtccatacattaattggagcaggagcagcagagggggctattgatgctgctaacatcttgaagcctgctcttgccaggggtgaattacagtgtattggggcaacgacccttgatgagtaccggaagcatattgagaaagacccagcactggagagacgattccagcctgtaaaggtgcctgagccaacagttgatgagaccatacagattttgaaagggctgcgagaacgatacgagattcaccacaagcttcgttacactgatgaagcattggtagctgctgcgcagttgtcatatcagtacataagtgaccgttttcttcctgataaggctattgatttaatcgatgaagctggttctcgtgttcgacttcgtcatgcacagctcccggaagaagccagagagcttgagaaagagcttaggcagataacgaaagagaagaatgaagctgttcgcggccaggactttgaaaaggctggggagttacgcgatcgagagatggatctcaagactcagatttcagctcttgtggataagaacaaagagatgagcaaggccgagactgaggcgggagaggagggcccgatggtaacggaagcagacattcaacacattgtctcgtcttggacaggtataccggttgagaaagtctcgaccgatgaatccgaccgccttctcaagatggaagagactctccacacacgaatcattggtcaagatgaagccgtcaaagccattagtcgcgccattcgccgtgcccgtgttggactaaagaaccccaaccgccccattgccagtttcatcttttctggacctactggtgtcgggaagtcggaacttgctaaagcattggctgcttactattttggctcagaagaagccatgattcggctcgacatgagtgagttcatggagaggcacaccgtctcaaagctcatcggttcacctcccggttacgtcggttacaccgaaggcggtcaattgactgaggcggtgcggcgccgtccctacactgtggtgctattcgacgaaatcgagaaagctcaccctgacgtcttcaacatgatgcttcaaatcctcgaagatggaagattgaccgacagcaaaggaagaactgtggatttcaagaacacgcttctgatcatgacatctaacgtgggaagtagcgttatcgagaagggtggccgaaggattgggttcgacctcgactatgatgagaaagacagcagctacaaccgaatcaagagcctggtgaccgaggaactaaaacaatatttccggccagagttcttgaacaggcttgacgagatgatcgtattccgacagttgaccaaactggaggtcaaagaaatcgctgacataatgttgaaggaagtgttcgagaggctaaaggttaaagaaatcgagcttcaagtgacggagcggttcagggatcgggtcgtggacgagggatacaaccctagctatggtgcaaggccgctgagacgtgcaatcatgaggctattggaagacagcatggcggagaagatgcttgcacgtgaaatcaaggaaggtgattcggtcatcgtggatgtcgattctgacggcaatgtcaccgtcctcaatggaagcagcggagctccgccagaggctttgccggagccgatcccggtgtagacaaaagggcagtgtctgaactctcttatctacactcgaccaaatatgttgtttgtactgtgatgctttatttggcacataaaaacatatgataccgtcttattgaggcagcaaagctagggttctgctctgcccaatgaatttgcatgcacagtctagccacaacacggttataaatgttccagatttttttcttactaataaacgcttagaaaattgttaaatggtttttgttgttatggtatctgcaaaaccaaaccaaatacatttca

SEQ ID NO: 3064 - DNA, 3316 bp, Solanum tuberosum
tcaaataaaaaaataatatatacccccatcccctctcctctcttctcctccaatccagtcaccctaatcccattttcctctaaacccatctccccccttttcgtctatattcttcaacaatctcccagattcttctgggacttcactattattcaggtccatcatggctagagctctagttcagtcaacaagcatcccatcatcagttgctggtgaaaggacgaccaaattcaatggatctgggaaaacaaaaagagctgttacaatgctatgcaatgcacaatcatcttcacttacactgagggattttacaggattgcgaggatgcaatgcaatagatacactagttagatctggacaaactctccaatccaaagtagctgctgcaacttatgtcagacgaccacgaggttgccgatttgtaccaaaagcaatgtttgagcgcttcacagagaaggcgataaaagtcattatgcttgcacaagaagaggccagacgacttggtcacaattttgttggcactgagcagatcttgttgggtctaattggtgagggaactggtattgctgccaaggttcttaaatcgatggggatcaatttgaaagatgctcgtgtggaagtggaaaagataattggaaggggtagtgggttcgttgctgttgagatcccttttacccctcgtgccaagcgtgttctggaactctctctggaggaagcccgccagctagggcataactatattggttcggagcacttgttacttggattgctacgtgaaggtgaaggtgtggctgcccgtgtccttgaaaacttgggtgctgaccccagcaacatccgtactcaggtgatccgaatggttggtgagagtaatgaggctgttggtgctagcgttggaggtggaacttctggccaaaaaatgccaacactggaggagtacggaacaaatttgacaaaattggcggaagagggaaaattggaccccgttgttggaagacagccgcaaattgaacgggtcactcaaatcttgggtcggcggactaagaacaacccttgtcttattggagaaccaggtgttggcaaaacagctattgctgagggtttggcacaaagaattgcaaacggtgatgtccctgaaacaattgaagggaagaaggtgataactcttgatatgggattgcttgttgctgggacaaaataccgtggagagtttgaggaaaggctaaaaaagctgatggaggaaattaaacagagtgatgaaataatactatttatcgatgaagtgcacacattgattggagctggagcagcagagggggccatcgatgctgcaaacatcttgaaacctgccctagctcgaggtgaactacagtgtatcggagctactacactggatgaatacagaaagcatattgagaaagatcctgcactagagaggagattccaaccagttaaggtccctgaacctactgttgatgaaactatacagattctgaaagggcttcgtgagaggtatgagattcatcacaaacttcgttacactgacgaggccttagtggctgctgctcagctctcataccagtacatcagtgaccgatttctgcctgataaagcaattgatttgattgatgaagctggttctcgtgttcgacttcgccatgctcagctccccgaggaagcaaaagagctcgagaaagagcttcgtcagattacaaaggagaagaatgaagctgttcgcggtcaagatttcgaaaaggctggggagttacgtgatagagaaatggatcttaaggcacagatcacagccctcatagacaaaaacaaagaggtgagcaaggctgaaagtgaggctgcagatacaggtcctcttgtaacagaagcagatattcagcacatcgtctcttcttggactggtatccctgttgagaaggtctccactgacgaatctgaccgtctcctaaaaatggaagaaacacttcacacacgaatcattggccaggatgaagctgtcaaagccattagtcgcgctattcgacgtgcgcgagttggcctcaagaatcccaataggcctattgctagtttcatcttttccggtcccactggtgttgggaaatcagaactggcaaaggcactggctacatattactttggttctgaagaagcaatgatccggcttgatatgagtgagttcatggaaagacacacggtctctaagctcattggatccccccctggttatgttggttacacggagggtggtcaattgactgaagctgttaggcgtcgaccttatacagttgtgctctttgatgagattgagaaggctcatcctgatgtcttcaacatgatgcttcaaattcttgaagatggaagattgacagacagcaagggtagaactgtagatttcaagaacacacttctcatcatgacatcaaatgttggaagtagtgtaattgagaaaggtggccgtcgtataggttttgatctcgactttgatgagaaggatagcagttacaatcgtatcaagagcttagtgactgaagaattgaagcagtacttcaggccagagtttttgaacagattggatgagatgattgtattccgtcaactcactaagttagaggttaaggagatagctgatatcatgcttaaggaggtatttgagaggttgaaagttaaggaaatagaacttcaagtgacagaaaggtttagagacagggtggttgacgagggatacaaccctagctatggagcacgacctctgagaagagctattatgagactgttagaggacagcatggctgagaaaatgcttgcaggtgagattaaagaaggtgattcagttattgtggacgttgattcagatggcaatgtgactgtcctcaatggaagtagtggtactccctcggacccggctcctgagcctatccccgtttagatcaggtgatcacattttagctcaacagtctgtctgtggtcttttaagagttcatttgtgttggccactaagctttgtggggcatatgaaagcaacttttgagttttatctctgggaatgctcaggtaaatcttgccacgtcgagaaggcagcatcctttctatgttgagctttaatgattttacagaaatatattggattaagattgtagttggtcacaagaaagtgttgtattaacaagacactccttatcaaaaaacatatctagtttattgtaggcgacagttaaatcgttgtccttgtatctctcatcttatgtttacctcttttctcattattatttgactcagattacaatagtttagagggtgatatttcagt

SEQ ID NO: 3065 - DNA, 3307 bp, Solanum phureja
aaataaaaaaataatatatacccgcatcccctctcctctcttctcctccaatccagtcaccctaatcccattttcctctaaacccatcttcccccttttcgtctatattcttcaacaatctcccagattcttctgggacttcagtccatcatggctagagctctagttcagtcaacaagcatcccatcatcagttgctggtgaaaggacgaccaaattcaatggatctgggaaaacaaaaagagctgtgacaatgctatgcaatgcacaatcatcttcacttacactgagggattttacaggattgcgaggatgcaatgcaatagatacactagttagatctggacaaactctccaatccaaagtagctgctgcaacttatgtcagacgaccacgaggttgccgatttgtaccaaaagcaatgtttgagcgcttcacagagaaggcgataaaagtcattatgcttgcacaagaagaggccagacgacttggtcacaattttgttggcactgagcagatcttgttgggtctaattggtgagggaactggtattgctgccaaggttcttaaatcgatggggatcaatttgaaagatgctcgtgtggaagtggaaaagataattggaaggggtagtgggttcgttgctgttgagatcccttttacccctcgtgccaagcgtgttctggaactctctctggaggaagcccgccagctagggcataactatattggttcggagcacttgctacttggattgctacgtgaaggtgaaggtgtggctgcccgtgtccttgaaaacttgggtgctgaccccagcaacatccgtactcaggtgatccgaatggttggtgagagtaatgaggctgttggtgctagcgttggaggtggaacttctggccaaaaaatgccaacactggaggagtacggaacaaatttgacaaaattggcggaagagggaaaattggaccccgttgttggaagacagccgcaaattgaacgggtcactcaaatcttgggtcggcggactaagaacaacccttgtcttattggagaaccaggtgttggcaaaacagctattgctgagggtttggcacaaagaattgcaaacggtgatgtccctgaaacaattgaagggaagaaggtgataactcttgatatgggattgcttgttgctgggacaaaataccgtggagagtttgaggaaaggctaaagaagctgatggaggaaattaaacagagtgatgaaataatactatttatcgatgaagtgcacacattgattggagctggagcagcagagggggccatcgatgctgcaaacatcttgaaacctgccctagctcgaggtgaactacagtgtatcggagctactacactggatgaatacagaaagcatattgagaaagatcctgcactagagaggagattccaaccagttaaggtccctgaacctactgttgatgaaactatacagattctgaaagggcttcgtgagaggtatgagattcatcacaaacttcgttacaccgacgaggccttagtggctgctgctcagctctcataccagtacatcagtgaccgatttctgcctgataaagcaattgatttgattgatgaagctggttctcgtgttcgacttcgccatgctcagctccccgaggaagcaaaagagctcgagaaagagcttcgtcagattacaaaggagaagaatgaagctgttcgtggtcaagatttcgaaaaggctggggaattacgtgatagagaaatggatcttaaggcacagatcacagccctcatagacaaaaacaaagaggtgagcaaggctgaaagtgaggctgcagatacaggtcctcttgtgacagaagcagatattcagcacatcgtctcttcttggactggtatccctgttgagaaggtctccactgacgaatctgaccgtctcctaaaaatggaagaaactcttcacacgcgaatcattggccaggatgaagctgtcaaagccattagtcgcgctattcgacgtgcgcgagttgggctcaagaatcccaacaggcctattgctagtttcatcttttccggtcccactggtgttgggaaatcagaactggcaaaggcactggctacatattactttggttctgaagaagcaatgatccggcttgatatgagtgagttcatggaaagacacacggtctctaagcttattggatccccccctggttatgttggttacacagagggtggtcaattgactgaagctgttaggcgtcgaccttatacagttgtgctctttgatgagattgagaaggctcatcctgatgtcttcaacatgatgcttcaaattcttgaagatggaagattgacagacagcaagggtagaactgtagatttcaagaacacacttctcatcatgacatcaaatgttggaagtagtgtaattgagaaaggtggccgtcgtataggttttgatctcgactttgatgagaaggatagcagttacaatcgtatcaagagcttagtgactgaagaattgaagcagtacttcaggccagagtttttgaacagattggatgagatgattgtattccgtcaactcactaagttagaggttaaggagatagctgatatcatgcttaaggaggtatttgagaggttgaaagttaaggaaatagaacttcaagtgacagagaggtttagagacagggtggttgacgagggatacaaccctagctatggagcacgacctctgagaagagctattatgagactgttagaggacagcatggctgagaaaatgcttgcaggtgagatcaaagaaggtgattcagttattgtggacgttgattcagatggcaatgtgactgtcctcaatggaagtagtggtactccctcggatccggctcctgagcctatccccgtttagaacaggtgatcacattttagctcaacagtctgtctatcgtcttttaggagttcatttgtgttggccactaagctttgtggggcttatgaagcaacttttgagttttatctctgggaatgctcgggtaaatcttgccacgtcgagaaggcagcatcctttctatgttgagctttaatgattttacagaaatatatggattaagattgtagttggtcacaagaaagtgttgtattaacaagacactacttatcaaaaaacatatctagtttattgtaggcgacagttaaatcgttgtcctcgtatctctcatcttatgtttacctcttttctcattattatttgactcagattacaatagtgatatttcagtaatgtttatattatg

SEQ ID NO: 3066 - DNA, 3156 bp, Helianthus annuus
gaaccgtatggagttgcgtgtacaaataataatcaaagtagtttaaacaagatataatacactctccgcctgttatcatccacatctcatcgctccggtcgccggaatattccattccgaacagtaatcggagctcttctatcctgctccggccagttagaattctttgtttgcaatcatggcgggggctttggtgcaatctaccagctttccttctgcagtttcaagtgaaagcaaggtccgttcaaagcgatctggtaacacaaaaagagcagtcaagatgatgtcgggcttacaagctcctccagtgcgggtgcgaactttttccggtttgcgaggagtcaacgctttagacaacatggtaaacagaggccaggatttccactcaaaagtcgcaatagccacctcagttcggagagcaaagccttgtagaattgtaccaaaggccatgtttgaacgcttcacagagaaagcaattaaagtaattatgcttgcacaagaggaagcacgacgactcggtcacaattttgtgggtacagagcagattttattaggtcttatcggtgagggcactggcattgcagcaaaagtgctgaagtcaatgggaattaacttgaaggatgcacgtgttgaagtggaaaaaattattggtaggggtagtggattcgttgctgtagagattccattcactccccgtgccaaacgtgttctggaattgtcactagaggaggcgcgtcaacttggtcataattatattggatcagagcacttgcttcttggtttgcttcgtgagggtgaaggtgtagcagctcgtgttcttgagaatttaggtgcagatccaaataacatccgcacacaggtgatcaggatggttggtgagagtgccgaagcagtgggtgctggagttggtggtgggacctctggtaataagatgccaacactggaggaatacggtaccaacttgacaaagctagcggaggagggtaagctggatccggttgttggaaggcagccacaaattgaacgcgttacccaaattctggggcggcgtacgaagaacaatccctgcctcatcggagagcctggcgtcggaaagaccgccattgcagaaggccttgcacaaaggattgcaaatggtgatgttccagaaacgatcgaggggaagaaggtgattactctggatatgggtctccttgttgctggcacgaagtaccgtggggagtttgaggagagactaaagaagctcatggaggaaatcaagcaaagtgatgaaattattctctttattgacgaggtccatacgttaattggtgctggagcagcagagggggctattgatgctgctaacatcttgaagcctgctcttgctagaggagaattacagtgtattggggcaacgacccttgatgagtaccgaaagcatattgagaaggacccagcactggagagacggttccagcccgtaaaggtacctgagcccacagttgatgaaaccatacagattttgaagggtcttcgagaacgatatgaaattcaccacaaactccgctacaccgatgatgcactggtagctgccgcccagttgtcatatcagtacattagtgaccgttttctgcctgataaagccattgacttaatcgatgaagccggttctcgtgttagacttcgtcatgcacaactcccagaagaagctaaagagcttgagaaagaacttaggcagataacaaaagaaaagaacgaagcagttcgtggccaggactttgaaaaggctggggagttacgggatcgggaaatggatctcaagactcaaatatcagctcttatagacaagaacaaagagatgagcaaagccgagacagaggcaggagaggagggccccactgtaaccgaagcagacattcagcacattgtctcatcatggaccggtatacctgtggaaaaagtctccacagatgaatcagaccgtctcctcaaaatggaagaaacactccacacacgaatcatcggtcaagatgaagcggtcaaagccataagccgcgccatccgccgtgcccgtgttggactcaaaaacccgaaccgccccatcgccagtttcatcttctctggaccaaccggtgttggtaaatctgaacttgcaaaagctttggccgcgtactactttggctcagaagaagccatgatccggctcgacatgagtgagttcatggagagacacaccgtctcaaagctcatcggttcacctcctgggtacgttggttacacagagggtggtcagttaaccgaggcggtccgccgccgcccttacaccgtcgtcttattcgacgaaatcgaaaaagctcaccccgatgtcttcaacatgatgcttcaaatccttgaagacggaaggctgacggacagcaaaggacgaactgttgacttcaagaacacacttctaatcatgacttcaaacgttggtagcagcgtaatcgaaaaaggcggccggagaatcgggtttgaccttgactatgacgagaaggacagcagctacaacagaattaagagcctggtgaccgaagaacttaaacaatatttcaggcctgaattcttgaacaggttagatgaaatgattgtgttcagacagttgaccaaactcgaagtcaaagagattgctgatataatgttgaaggaagttttcgaaaggctaaaaggaaaggaaatcgagcttcaagtgactgagaggtttagagaccgggttgtggaggaagggtacaacccgagctatggtgcaaggccgcttagacgggcaatcatgaggctactggaggacagtatggcggaaaagatgcttgcacgtgatatcaaggagggcgattctgtcattgtcgatgttgattctgatggtaacgtgacggttctgaatggtagcagcggtgctccacctgaagcattgccggagccgatctcagtgtagaaaggaatctttcatcctctaaacttaagtcaaatatgttgtttgttatgtctaattgaatctgcatgcacagtcaaagggtcgtagatgtttaagctatacaatatatttaagaactcctagagtgtatttttgttttatctatggaaactaaattgtgtacttttcaggcaaatgaatccgaaaacctaaatatttgggatggt

SEQ ID NO: 3067 - DNA, 3384 bp, Solanum lycopersicum
atcttcttaaataaaaaaataatatatacccacatccgctctcctctcttctccaatccagtcaccctaatcccattttcctctaaacccatcttccccttttccatctatattcttcaacaatctcccagattcttctgggacttcaggtccatcatggctagagctctagttcagtcaacaagcatcccatcgtcagttgctggtgaaaggacaaccaaattcaatggatctgggaaaacaaaaagagctgttacaatgctatgcaatgcacaatcatcttcacttacactgagggattttacaggattgcgaggatgcaatgcaatagatacactagttagatctggccaaactctccaatccaaagtagctgctgcaacttatgtcagacggccacgaggttgccgatttgtaccaaaagcaatgtttgagcgcttcacagagaaggcgataaaagtcattatgcttgcacaagaagaggccagacgacttggtcacaattttgttggcactgagcagatcttgttgggtctaattggtgagggaactggtattgctgccaaggttcttaaatcgatggggatcaatttgaaagatgctcgtgtggaagtggaaaagataattggaaggggtagtgggtttgttgctgttgagatcccttttacccctcgtgccaagcgtgttctggaactctctctggaggaagcccgccagctagggcataactatattggttcggagcacttgctacttggattgctacgtgaaggtgaaggtgtggctgcccgtgttcttgaaaacttgggtgctgaccccagcaacatccgcactcaggtgatccggatggttggtgagagtaatgaggctgttggtgctagcgttggaggtggaacttctggccaaaaaatgccaacactggaggagtatggaacaaatttgacaaaattggcggaagagggaaaattggaccccgttgttggaagacagccgcaaattgaacgggtcactcaaatcttgggtcggcggactaagaacaacccttgtcttattggtgaaccaggtgttggcaaaacagctattgctgagggtttggcacaaagaattgcaaatggtgatgtccctgaaacaattgaggggaagaaggtgataactcttgatatgggattgcttgttgctgggacaaaataccgtggagagtttgaggaaaggctaaaaaagctgatggaggaaattaagcagagtgatgaaataatactatttatcgatgaagtgcacacattgattggagctggagcagcagagggggccatcgatgctgcaaacatcttgaaacctgccctagctcgaggtgaactacagtgtatcggagctactacactggatgaatacagaaagcatattgagaaagatcctgcactagagaggagattccaaccagttaaggtccctgaacctactgttgatgaaactatacagattctgaaagggcttcgtgagaggtatgaaattcatcacaaacttcgttacactgacgaagccttagtggctgctgctcagctctcataccagtacatcagtgaccgatttctgcctgacaaagcaattgatttgattgatgaagctggttctcgtgttcgacttcgccatgctcagctccccgaggaagcaaaagagctcgagaaagaacttcgtcagataacaaaggagaagaatgaagctgttcgtggtcaagatttcgaaaaggctggggaattacgtgatagagaaatggatctgaaggcacagatcacagccctcatagacaaaaacaaagaggtgagcaaggctgaaagtgaggctgcagatacaggtccacttgtgacagaagcagatattcagcacatcgtctcttcttggactggtatccctgttgagaaggtctccactgacgaatctgaccgtctcctaaaaatggaagaaacacttcacacacgaatcattggccaggatgaagctgtcaaagccattagtcgcgctattcgacgtgcacgagttgggctcaagaatcccaacagacctattgctagtttcatcttttccggtcccactggtgttgggaaatcagaactggcaaaggcactggctgcatattactttggttctgaagaagcaatgatccggcttgatatgagtgagttcatggaaagacacactgtctctaaactcattggatccccccctggttatgttggttacacagagggtggtcaattgactgaagctgttaggcgtcgaccttatacagttgtgctctttgatgagattgagaaggctcatcctgatgtcttcaacatgatgcttcaaattcttgaagatggaagattgacagacagcaagggtagaactgtagatttcaagaacacacttctcatcatgacatcaaatgttggaagtagtgtaattgagaaaggtggccgtcgtataggttttgatctcgaccttgatgagaaggatagcagttacaatcgcatcaagagcttagtgacagaagaattgaagcagtacttcaggccagagtttttgaacagattggatgagatgattgtattccgtcagctcactaagttagaggttaaggagatagctgatatcatgcttaaggaggtctttgagaggttgaaagttaaggagatagaacttcaagtgacagagaggtttagagacagggtggttgacgagggatacaaccctagctatggagcacgacctctgagaagagctattatgagacttttagaggacagcatggctgagaaaatgcttgcaaatgagattaaagaaggtgattcagttatcgtggacgttgattcagatggcaatgtgactgtcctcaatggaagtagtggtactccctcggatccggctcctgagcctatccccgtttagatcaggtgatcacattttagctcaacagtctctgtgtggtcttttaagagttcatttgtgttggccactaagctttgtggggcttatgaagcaacttttgagtttatctctgggaatgctcaggtaaatcttgccacgtcgagaaggcagcatcctttctatgttgatctttaatgattttacagaagtatactggattaagattgtagttggtcacaagaaagtattgtattaacaagacactccttatcaaaaaacatatctagtttattgtaggcgacagttgaatcgttatcctcgtattgctcatctaatgtagttatctgcgcttacctcttttctcattattattatctggctcagatcacaatagttagggggtgacataatgatgatttcagtaatgtttacattatgaatgtgttataatctaactatgtaggctaaatacgtctg

SEQ ID NO: 3068 - DNA, 3293 bp, Solanum lycopersicum
ttatcatccacatctattatcttcttaaataaaaaaataatatatacccacatccgctctcctctcttctccaatccagtcaccctaatcccattttcctctaaacccatcttccccttttccatctatattcttcaacaatctcccagattcttcagggacttcaggtccatcatggctagagctctagttcagtcaacaagcatcccatcgtcagttgctggtgaaaggacaaccaaattcaatggatctgggaaaacaaaaagagctgttacaatgctatgcaatgcacaatcatcttcacttacactgagggattttacaggattgcgaggatgcaatgcaatagatacactagttagatctggccaaactctccaatccaaagtagctgctgcaacttatgtcagacggccacgaggttgccgatttgtaccaaaagcaatgtttgagcgcttcacagagaaggcgataaaagtcattatgcttgcacaagaagaggccagacgacttggtcacaattttgttggcactgagcagatcttgttgggtctaattggtgagggaactggtattgctgccaaggttcttaaatcgatggggatcaatttgaaagatgctcgtgtggaagtggaaaagataattggaaggggtagtgggtttgttgctgttgagatcccttttacccctcgtgccaagcgtgttctggaactctctctggaggaagcccgccagctagggcataactatattggttcggagcacttgctacttggattgctacgtgaaggtgaaggtgtggctgcccgtgttcttgaaaacttgggtgctgaccccagcaacatccgcactcaggtgatccggatggttggtgagagtaatgaggctgttggtgctagcgttggaggtggaacttctggccaaaaaatgccaacactggaggagtacggaacaaatttgacaaaattggcggaagagggaaaattggaccccgttgttggaagacagccgcaaattgaacgggtcactcaaatcttgggtcggcggactaagaacaacccttgtcttattggtgaaccaggtgttggcaaaacagctattgctgagggtttggcacaaagaattgcaaatggtgatgtccctgaaacaattgaggggaagaaggtgataactcttgatatgggattgcttgttgctgggacaaaataccgtggagagtttgaggaaaggctaaaaaagctgatggaggaaattaagcagagtgatgaaataatactatttatcgatgaagtgcacacattgattggagctggagcagcagagggggccatcgatgctgcaaacatcttgaaacctgccctagctcgaggtgaactacagtgtatcggagctactacactggatgaatacagaaagcatattgagaaagatcctgcactagagaggagattccaaccagttaaggtccctgaacctactgttgatgaaactatacagattctgaaagggcttcgtgagaggtatgagattcatcacaaacttcgttacactgacgaggccttagtggctgctgctcagctctcataccagtacatcagtgaccgatttctgcctgacaaagcaattgatttgattgatgaagctggttctcgtgttcgacttcgccatgctcagctccccgaggaagcaaaagagctcgagaaagaacttcgtcagataacaaaggagaagaatgaagctgttcgtggtcaagatttcgaaaaggctggggaattacgtgatagagaaatggatctgaaggcacagatcacagccctcatagacaaaaacaaagaggtgagcaaggctgaaagtgaggctgcagatacaggtccacttgtgacagaagcagatattcagcacatcgtctcttcttggactggtatccctgttgagaaggtctccactgacgaatctgaccgtctcctaaaaatggaagaaacacttcacacacgaatcattggccaggatgaagctgtcaaagccattagtcgcgctattcgacgtgcacgagttgggctcaagaatcccaacagacctattgctagtttcatcttttccggtcccactggtgttgggaaatcagaactggcaaaggcactggctgcatattactttggttctgaagaagcaatgatccggcttgatatgagtgagttcatggaaagacacactgtctctaaactcattggatccccccctggttatgttggttacacagagggtggtcaattgactgaagctgttaggcgtcgaccttatacagttgtgctctttgatgagattgagaaggctcatcctgatgtcttcaacatgatgcttcaaattcttgaagatggaagattgacagacagcaagggtagaactgtagatttcaagaacacacttctcatcatgacatcaaatgttggaagtagtgtaattgagaaaggtggccgtcgtataggttttgatctcgaccttgatgagaaggatagcagttacaatcgcatcaagagcttagtgacagaagaattgaagcagtacttcaggccagagtttttgaacagattggatgagatgattgtattccgtcagctcactaagttagaggttaaggagatagctgatatcatgcttaaggaggtctttgagaggttgaaagttaaggagatagaacttcaagtgacagagaggtttagagacagggtggttgacgagggatacaaccctagctatggagcacgacctctgagaagagctattatgagacttttagaggacagcatggctgagaaaatgcttgcaaatgagattaaagaaggtgattcagttatcgtggacgttgattcagatggcaatgtgactgtcctcaatggaagtagtggtactccctcggatccggctcctgagcctatccccgtttagatcaggtgatcacattttagctcaacagtctctgtgtggtcttttaagagttcatttgtgttggccactaagctttgtggggcttatgaagcaacttttgagtttatctctgggaatgctcaggtaaatcttgccacgtcgagaaggcagcatcctttctatgttgatctttaatgattttacagaagtatactggattaagattgtagttggtcacaagaaagtattgtattaacaagacactccttatcaaaaaacatatctagtttattgtaggcgacagttgaatcgttatcctcgtattgctcatctaatgtagttatctgcgcttacctcttttctcatta

SEQ ID NO: 3069 - DNA, 3259 bp, Nicotiana benthamiana
tctcctcttctccaatccagtgaccctaatcccattttcctctaaacccatcttctccttccttctattttcttcaatctcctagattcttctgggactacagtagtaatattcaggtccatcatggctagagctttagttcagtcgacgaacataccatcatcagtgtctggtgaaaggacgacaaaattcaatggatctgggaaaacgaacagaactgttaaaatgctatgcagtgcacaatctccttcactaaggctgcgggatttttcaggattgcgaggatgcaatgcagtagatacactagttagatctggacaaactctccaatccaaggtagcagctgcaacttctgtgagacgaccacgaggttgccgatttgtaccaaaagcaatgtttgagcgcttcacggagaaggcaataaaagtcattatgcttgcacaagaagaggccagacgacttggtcacaattttgttggcacagagcagattctgttgggtcttattggtgagggaactggtattgctgctaaagttcttaaatccatgggaattaatttgaaagatgctcgtgtggaagtggagaagataattggacggggtagtggatttgttgctgttgagatcccttttacgcctcgtgccaagcgtgttttggaactctctctggaggaggcccgccagctagggcataactatattggttcggagcacttgctacttgggttgctccgtgaaggtgaaggtgtggctgcccgtgtccttgagaatttgggcgctgaccccagtaacatccgcactcaggtgatccgaatggttggagagagtaatgaggctgttggtgctagcgttggaggtggaagttctggccaaaaaatgcctacactggaggagtacggcacaaatttgacaaagttagctgaagagggaaaattagatcctgttgttggaagacaaccgcaaattgaacgggtcactcaaatcttgggtcggcggactaagaacaacccttgtcttattggagaaccaggtgttggcaaaacagctattgctgagggtctggcacaaagaattgcaaacggtgatgtccctgaaacaattgaggggaagaaggtgataactcttgatatgggtttgcttgttgctgggacaaaataccgtggagagtttgaggaaaggctaaagaagctaatggaggaaatcaaacagagtgatgaaataatactatttatcgatgaagtccacaccttgatcggagctggagcagcagagggggccatcgatgctgcaaacatcttgaaacctgccctagcacgaggtgaactacagtgtattggagctaccacactagatgaatacagaaagcatattgagaaagatcctgcattggagaggcgattccagccagttaaggtccctgaacctactgttgatgaaaccattcagattctgaaagggcttcgggagagatatgagattcatcacaagcttcgttacactgacgaggcattagaggctgctgcccagctttcataccagtacatcagtgaccgttttctgcctgataaagcaattgacttgattgatgaagctggttctcgtgttcgacttcgccatgcacagctccctgaggaagcaaaagagcttgagaaagagcttcgtcaaatcacaaaggagaagaacgaagctgtccgcggtcaggatttcgaaaaggctggggaattacgtgatagagaaatggatcttaaggcacagatcacggccctcatagacaaaaacaaagagatgagcaaggctgaaagtgaggctggagatataggtccgcttgtgactgaagcagatattcagcacattgtctcttcttggactggcatccctgttgagaaggtctctactgacgaatctgatcgcctcctaaaaatggaagaaacacttcacactcgaatcattggccaagatgaagctgtcaaagccattagtcgtgccattcgacgtgcgagggttgggctcaagaatcccaaccgacctattgctagtttcatcttttctggtccaactggtgttgggaagtcagaactggcaaagtcactggctgcatattactttggttctgaagaagcaatgatccggcttgatatgagtgagtttatggagagacacacagtctctaagctcatcggatcacccccaggttatgttggttacacagaaggtggtcaattgactgaagccgtaaggcgacgaccttatactgttgtgctctttgatgaaattgagaaggctcatcccgatgtcttcaacatgatgcttcaaattcttgaagatggaaggctgactgacagcaaggggagaactgtcgatttcaagaacacacttctcatcatgacatcaaatgttggaagtagtgtgatagagaaaggtggccgtcgtataggttttgatctcgattatgatgagaaggatagcagttacaatcgtatcaagagcttagtgactgaagaattgaaacagtacttcaggccagagtttttgaacagattggatgagatgattgtattccgtcagctcacaaagttagaggttaaggagataggtgatatcatgcttaaggaggtatttgagaggctgaagggtaaggagatagaacttcaagtgacagagaggtttagggatagggtggttgatgaaggatataacccgagctatggagcacggcctctgagaagagctatcatgagactgttagaggacagcatggcggagaaaatgcttgcaggtgagatcaaagaaggtgattcagttattgtggacgtggattcagacggcaatgtgactgtcctcaatggcagtagtggtactccctcagaccacgctccggagcctatccctgtgtagaactgtagatcaagtgatcatgttttagagttcgtttctgttggccactcagcttccccgagcatatgaagcaacttgtgggtttatctttggggcttttgggtaaaatcttgccacgttgagaaggcagcatcctttctatgttgagctttcaggattttacaaaaatatacgatgttggattaattggatcaggattgtagttcttcacaagaaagtgttgtattagctagacactccttaccaaaaacatatctgacttactatatgtggcagttaacattgtcctaagctttggtcttgctatcctcatttgtgatcctgtgaatttcttgcttctttacctcttctcattatattttgg

SEQ ID NO: 3070 - DNA, 3257 bp, Zostera marina
cctttccaccgctgttcccagaagagacgaaggggggcggatccaagaagaagaaagctgtcggacttctcgctccgatcgtcagatttctttacatattgatttaaattttctaaagccatggctggcgctctactccaatcagctatccttccaactgcttatgcaagcagaagttgtagccaaaggcgcggacctgggaaaggcagccggtcgatgggtgttgttcgaggatctcctattcgacttcaatcctattctggattacgtggattgaattctattgacttcaagtccaaaattgtaaaagattttcattccacggtagccgcatcaatttgcaagccacgaggaaagaaccgcacacgtagcgggatagtagcgatgtttgagcgtttcacggagaaggccatcaaagttatcatgcttgctcaagaggaagcaagacgtttgggtcataattttgtagggactgagcagattcttttgggtttgattggtgaaggcactggcatcgcagccaaagttttgaaatcaatgggtatcaatcttaaagatgctcgtcaagaagtggagaaaattatcggacgtggcagtggatttgttgctgttgaaatcccatttactccacgtgcaaagcgtgttttggagttgtcccttgaagaagctcgccaacttggtcataattatattggatctgagcatttgcttcttggattgcttcgtgagggtgaaggcgtagctgctcgagtccttgaaagcttgggagccgattcaaacaacatccgcacacaggttatacgaatggttggtgaaagcacagaggctgttggtgctggagttggaggaggaagcagtggaaacaagatgcccacactcgaagagtatgggactaatcttacaaaattagccgaagagggaaaactagatcctgtcgtcggtaggcaagatcagatagagcgtgttactcaaattctcggtagaagaacaaaaaacaatccatgtcttattggagagcctggagttggaaagacggcgattgctgaaggattagctcaacgcattgcaactggcgacgttcccgaaacaattgaaggaaaaaaggtgatcacattggacatgggtctacttgttgctggtacaaaataccgaggagaatttgaagagaggttaaaaaattaatggaggaaatcaagcaaagtgatgaaataatactcttcattgatgaagttcacacgctcattggagctggagcagcggagggtgcaattgatgcagcaaacatccttaagccagctcttgctaggggtgaattacaatgtattggagctacaactattgacgagtacagaaaacacatagagaaagatcctgcattagagaggcgatttcaacctgtgaaagtgccagaaccaagtgttgacgaaactatagaaatcttgaaaggacttcgtgaaagatacgaaattcaccacaaacttcgttacaccgatgaagctttggttgctgctgctcgtttatcctaccaatacatcagtgatcgatttctaccagataaagccattgatctcgttgacgaagccggttcacgtgttcggctccagcatgcgcagcttcctgaagaggccagggagcttgacaaagaattaagacagataactaaagagaaaaatgaagctgttcgcggccaagactttgaaaaggcgggcgagatccgagatagggaaatggagttgaaagcacagataacggcactcattgataaaggcaaagagatgaacaaagctgaaagtgaagcgggagatgcaggtcctattgttgatgagagtgacatccaacacatcgtttcatcgtggactggtattccagttgagaaggtatcaactgatgaatctgaccgtcttttaaaaatggaagaaactctccaccagcgtattatcgggcaagatgaagctgtcaaggcgataagtcgtgcaatccggcgtgcccgtgttgggctgaaaaacccaaatcgacccattgccagcttcatattttctggcccaactggtgttggaaaatctgagcttgctaaagcactagcaacttactacttcggatctaatgaagccatgattcggcttgacatgagtgagttcatggaaaggcacacagtctcaaagcttattgggtctccacctggatatgttgggtacactgaaggtggccaattaactgaagccgttcgccgccgaccatacacagttgtactatttgatgagatcgagaaagctcaccctgatgtcttcaacatgatgcttcaaatccttgaagatggaaggctcactgacagcaagggtcgaacagttgacttcaagaacacacttttgataatgacatcaaatgtcggtagcagtgtgatcgagaaaggtggtcgccggattgggtttgatcttgactacgatgagaaagacagcagctacaaccgaataaaaagtttagtcaccgaggagctgaagcagtatttccgaccagaattcttgaatcgactcgatgagatgattgtgttccgacagctaaccaaaatcgaagttaaggacattgctgcgataatgctcaatgaagtttttgatagactcaaaacaaaagacatcgctctacaagtgacagagcggttcagagatagagttgtcgatgaaggttacaacccaagctatggtgcaaggccattaaggagagccatcatgaggctactcgaagatagcttagccgagaagatgctcgcaggagaaatcaaagatggtgactctgccattgttgatgtagattctgatgggaatgtcattgttcttcatggtgagaccaccatggcagaaccagagccagaaccagaaaccgtccttcctgtatagtaagtgtagtctcaccttcctatttatattcattataaacttatatctacaagctttataaactcttaaaacactggaaccatatctagtccacactacctactatgaatcaaacccaatgttcttgtttctttcacaggtttagaaggccttggcttccttctaaggaattttctaggattcaggccagttttacctgcggccacctagtatgatgaagaatgtaaattaatcatggtttggaaaattaaacattaacatttcctcctgtccttattcgcttctttgtcatggtttatggttttggaatggaaaattgtctaaaataactcctgaaccaattcttattcttactttacattttag

SEQ ID NO: 3071 - DNA, 2987 bp, Flaveria ramosissima
ctctctccggttgttatctcgttgcctccggccaccggaatattcgatttccgatcagaattcgcatctattttatcctcctccggcgagttaggattctttgtttgcaatcatggcgggggctttggtgcaatctaccagctttccttctgcagtttcaagtgaaagcaaggtctgttcaaagcgatctggtaatacaaaaagaggagtcaagatgatggcgggggctttagctcctccagtgagggtgaggaccttttctggtttgcggggagtcaatgctttagacaacatggtaaatagagcccaggatttccactcaaaagttgcagcagccacctcggtccggaaagcaaagccttcaagaattgtacctaaggccatgtttgaacgattcactgagaaggctattaaagtaattatgcttgcacaagaggaagcaagacgacttggccacaattttgtgggtacagagcagattttgttaggtcttattggtgagggcactggcattgcagcaaaagtgctgaagtcaatgggaattaacttgaaggatgcacgtgttgaagtagaaaaaattattggtaggggtagtggatttgttgctgtagagattccgtttactcctcgtgctaaacgtgtgctggaattgtcactagaggaggccaggcaacttggtcataattatattggttcggagcacttgcttcttggtttgcttcgtgagggtgaaggtgtagcagctcgggttcttgagaatttgggtgcagacccaaataacattcgcacacaggtgatcagaatggtcggtgaaagtgcagaagctgtgggtgctggagttggtggtgggacttctggtaataagatgccaacactggaggagtatggtaccaacttgacaaagcttgcagaggagggtaagctggatcctgttgttggaagacagccacaaattgaacgagttacccaaattttgggacggcgtacaaaaaacaatccctgcctcattggagagcctggtgttggaaagactgctattgcagaaggtcttgcacaaaggattgcaaatggtgatgttccagaaacaattgaggggaagaaggtgattactctcgatatgggtctactagttgctggcacaaagtaccgtggggagtttgaagaaagactaaagaagctcatggaagaaatcaagcaaagtgacgaaattatcctcttcattgatgaggtccatacgttaattggtgcaggagcagcagagggagctattgatgctgctaacatcttgaagcctgctcttgctagaggtgaattacagtgtattggggcaacaacccttgatgagtaccggaagcatattgagaaggacccagcactagagagacggttccagcctgtaaaagtgcctgagcccacagtcgatgaaaccattcagattttgaaggggcttcgagaacgatatgaaattcaccacaaactccgttacaccgatgaggcactggtagctgctgcccagttatcatatcagtacataagtgaccgttttctgcctgataaagctattgacttgatcgatgaagccggttctcgtgttagacttcgtcatgcacaactcccagaggaagctaaggagctggagaaagaacttaggcagataacaaaagaaaagaatgaagcagttcgtggccaggacttcgaaaaggctggggagttacgggatcgggaaatggatctcaagactcaaatatcagctcttgtggacaagaacaaagagatgagcaaagccgagacagaggcaggagaggagggacctaccgtcaccgaagcagacattcagcacattgtctcatcatggactggcatacctgtggagaaagtctctacagacgaatctgaccgtctcctcaaaatggaagaaacccttcacacacgaattattggtcaagacgaagcagtcaaagccataagccgcgccatccgtcgtgcccgtgttggactaaaaaacccgaaccgccccattgccagtttcatcttctcaggaccaaccggtgttggtaaatccgaactcgcaaaagctttagctgcttactactttggctctgaagaagccatgattagactcgacatgagcgagttcatggagagacacaccgtctcaaagctcatcggttcacctcccgggtacgttggttacaccgaaggcggtcagttaaccgaggcagtccgccgccgcccatacactgttgttctattcgacgaaattgaaaaggctcaccctgatgtcttcaacatgatgcttcaaatccttgaagatggaaggctgactgacagcaaaggacgaaccgttgacttcaagaacacacttctaatcatgacttcaaacgttggcagcagtgtaatcgaaaaaggtggtcgtagaatcgggtttgacctggactacgacgagaaagacagcagctacaacagaatcaagagcctggtgaccgaagaactcaaacaatatttcaggcccgaattcctgaacaggttagatgaaatgatcgtgttcagacagttgaccaaacttgaagtcaaagagatcgctgatataatgctgaaggaggttttcgagaggctaaaaggaaaagaaatcgagcttcaagtgactgagaggtttagagaccgagttgtagaggagggatacaaccccagctatggtgcaaggccgcttagacgggcgatcatgaggctgttggaagacagcatggcggagaagatgcttgctcgtgagatcaaggagggcgattctgttattgtcgacgttgattcagatggtaacgtgactgttctgaatggtagcagcggtgctccacccgaggcattgccggagccaatctcggtgtagaagaagctagcccagagaccagtaaatcgtctctaaacttaaactatatatgttgttatgtcttaatgaatttgcatgcacagtctagccatagttgtttaag

SEQ ID NO: 3072 - DNA, 3030 bp, Flaveria ramosissima
gtaatattatactacctctctccggttgttagttctccgttgcctcggccaccggaatattcgattccgatcagaattcgcatctatttgatcctcctccggcgagttaggattctttgtttgcaatcatggcgggggctttggtgcaatctaccagctttccttctgcagtttcaagtgaaagcaaggtctgttcaaagcgatctggtaatacaaaaagaggagtcaagatgatggcgggggctttagctcctccagtgagggtgaggaccttttctggtttgcggggagtcaatgctttagacaacatggtaaatagagcccaggatttccactccaaagttgcagcagccacctcagtccggaaagcaaagccttctagaattgtacctaaggccatgtttgaacgattcactgagaaggctattaaagtaattatgcttgcacaagaggaagcaagacgacttggccacaattttgtgggtacagagcagattttgttaggtcttattggtgagggcactggcattgcagcaaaagtgctgaagtcaatgggaattaacttgaaggatgcacgtgttgaagtagaaaaaattattggtaggggtagtggatttgttgctgtagagattccgtttactcctcgtgctaaacgtgtgctggaattgtcactagaggaggccaggcaacttggtcataattatattggttcggagcacttgcttcttggtttgcttcgtgagggtgaaggtgtagcagctcgggttcttgagaatttgggtgcagacccaaataacattcgcacacaggtgatcagaatggtcggcgaaagtgcagaagctgtgggtgctggagttggtggtgggacttctggtaataagatgccaacactggaggagtatggtaccaacttgacaaagcttgcagaggagggtaagctggatcctgttgttggaagacagccacaaattgaacgagttacccaaattttgggacggcgtacaaaaaacaatccctgcctcattggagagcctggtgttggaaagactgctattgcagaaggtcttgcacaaaggattgcaaatggtgatgttccagaaacaattgaggggaagaaggtgattactctcgatatgggtctactagttgctggcacaaagtaccgtggggagtttgaagaaagactaaagaagctcatggaagaaatcaagcaaagtgacgaaattatcctcttcattgatgaggtccatacgttaattggtgcaggagcagcagagggagctattgatgctgctaacatcttgaagcctgctcttgctagaggtgaattacagtgtattggggcaacaacccttgatgagtaccggaagcatattgagaaggacccagcactagagagacggttccagcctgtaaaagtgcctgagcccacagtcgatgaaaccattcagattttgaaggggcttcgagaacgatatgaaattcaccacaaactccgttacaccgatgaggcactggtagctgctgcccagttatcatatcagtacataagtgaccgttttctgcctgataaagctattgacttgatcgatgaagccggttctcgtgttagacttcgtcatgcacaactcccagaggaagctaaggagcttgagaaagaacttaggcagataacaaaagaaaagaatgaagcagttcgcggccaggacttcgaaaaggctggggagttacgggatcgggaaatggatctcaagactcaaatatcagctcttgtggacaagaacaaagagatgagcaaagccgagacagaggcaggagaggagggtcccaccgtcaccgaagcagacattcagcacattgtctcatcatggactggcatacctgtggagaaagtctctacagacgaatctgaccgcctcctcaaaatggaagaaacccttcatacacgaattattggtcaagatgaagcagtcaaagccataagccgtgccatccgtcgtgcccgtgttggactcaaaaacccgaaccgccccattgccagtttcatcttctcaggaccaaccggtgttggtaaatccgaactcgcaaaagctctagctgcttactactttggctctgaagaagccatgattagactcgacatgagcgagttcatggagagacacaccgtctcaaagctcatcggttcacctcccgggtacgttggttacaccgaaggcggtcagttaaccgaggcagtccgccgccgcccatacactgttgttctattcgacgaaattgaaaaggctcaccctgatgtcttcaacatgatgcttcaaatccttgaagatggaaggctgactgacagcaaaggacggaccgttgacttcaagaacacacttctaatcatgacttcaaacgttggcagcagtgtaatcgaaaaaggtggtcgtagaatcgggtttgacctggactacgacgagaaagacagcagctacaacagaatcaagagcctggtgaccgaagaactcaaacaatatttcaggcccgaattcctgaacaggttagatgaaatgatcgtgttcagacagttgaccaaactcgaagtcaaagagatcgctgatataatgctgaaggaggttttcgagaggctaaaaggaaaagaaatcgagcttcaagtgaccgagaggtttagagaccgagttgtagaggagggatacaaccccagctatggtgcaaggccgcttagacgggcgatcatgaggctgttggaagacagcatggcggagaagatgcttgctcgtgagatcaaggagggcgattctgttattgtcgacgttgattcagatggtaacgtgaccgttctgaatggtagcagcggtgctccacccgaggcattgccggagccaatctcggtgtagaagaagctagcccagagaccagtaaatcgtctctaaacttaaactatatatgttgttatgtcttaatgaatttgcatgcacagtctagccatagttgtttaagctaaacagtattaattttaaatttcta

SEQ ID NO: 3073 - DNA, 3195 bp, Nicotiana benthamiana
tagcaattcacggccgacctttttcaaggtctctatttcttttccctttcttctctctatctcgtttcagttttgaagaatcttttgggtctttagtattattgaggtccaatatggctcgagctttagttcagtcaaccaacatcccatcttcagttgccggtgaaatgactaggcaatttagtggatctgggaaaaacaaaaaaactgttaaaatgctatgtaatgtacaaccaccctccataaggttgaccaattttacaggactgcgagggtgcaatgcaatagatacacttgtaaaatctggacaaactctccattcaaaagtggcagctgcaacttctgtcaggcggccaaaaggttgccggtttgtcccaaaagcaatgtttgagcgcttcactgagaaagcaataaaagtcattatgcttgcacaagaagaggccagacgactaggtcataacttcgttgggacagagcagattttgctgggtcttattggtgagggaactggtattgcagccaaagttcttaaatccatgggcatcaatttaaaagatgctcgtgtggaggtggagaagataattggaaggggtagtgggtttgttgctgttgagattccatttactcctcgtgcaaagcgtgttcttgaactctctctggaggaagcccgccaactagggcataactacattggctcggaacacttgctacttggattgctgcgtgaaggtgaaggtgtggctgcccgtgttcttgagaacttgggtgctgaccccagtaacattcgcactcaggtcattcgaatggttggcgagagtaatgaggctgttggggctagtgttggtggtggaacttctggacaaaagatgcctacattggaggagtacggcaccaatttgacaaagttagctgaagaggggaaactggatcccgttgttggaagacagccgcaaattgagcgcgttactcaaatcttgggtcggcgtacaaaaaacaatccttgccttattggagaaccaggtgttggcaaaactgctattgctgaaggtttagctcaaagaattgctaatggcgatgtccctgaaacaatagagggaaagaaggtcataacactagatatgggtttgcttgttgctgggacaaaataccgtggagagtttgaggaaagactgaagaaactaatggaagaaattaaacaaagtgatgaaataatactctttattgatgaagtgcacacattgattggagctggagctgcagagggggcaattgatgctgcaaatatcttgaaacctgccctagctagaggggaactacagtgtattggagccacaaccctggatgagtacagaaagcacattgagaaagatcctgcgttggagaggaggttccagccagttaaagtccctgaacctactgtggatgaaaccatacaaatcttgaaagggcttcgggagagatatgagattcatcacaagctccgttacaccgatgaggcattagaagctgctgcccagctttcttatcagtacatcagtgaccgttttctgcctgataaagcaattgatttgattgatgaagctggttctcgtgttagacttcgccatgcacagctccctgaggaagcaagagagctcgagaaagaacttcgtcagattacaaaggagaaaaatgaagctgtgcgcggtcaagattttgaaaaggctggggaactgcgtgatagagaaatggatcttaaggcacagatctcagccctgatagacaaaaacaaagagatgagtaaggctgaatccgaggctggagatacaggtccactcgttacagaggcagatattcagcacattgtatcttcatggactggcatccctgttgagaaggtttctacagatgagtctgatcgcctcttgaaaatggaagaaacacttcacaccagaatcattggccaggatgaagctgttaaagccattagtcgcgctatccgacgtgctcgtgttgggctcaagaatcccaaccgacctattgccagtttcatcttttctggtccaactggtgttgggaaatcagaactggctaaggctttagcagcatactactttggttctgaagaagcaatgatccggcttgatatgagtgagtttatggagagacacaccgtctctaaactcattggttcaccccctggttatgttggttacactgaaggtggtcaactgactgaagctgtgaggcgtcgaccttacactgttgtgctctttgatgagattgagaaggctcatcctgatgtcttcaacatgatgcttcaaattcttgaagatggaagattgacagacagcaagggcagaactgtggacttcaagaatacacttctcatcatgacatcgaatgtcggaagcagtgtgatagagaaaggaggccgtcgtataggttttgatctagattatgacgagaaggatagcagttacaaccgtatcaaaagcttggtgactgaggagttgaaacagtacttcaggccagagttcttgaacagattggatgagatgattgtattccgtcagctaactaagttagaggtgaaggagatagctgatatcatgcttaaggaggtctttgagaggttgaaaaataaggagatagaacttcaagtgacagagaggtttagagacagggtggttgacgaagggtacaacccaagctacggagcaagaccgttgaggagagctattatgagactgctggaagacagcatggccgagaagatgcttgcaggtgagatcaaagaaggtgattcagtaattgtggacgtggactctgatggcaatgtgaccgtcctcaatggcactagcggaactccctcagatccagctcctgagcctatccctgtgtagatccgcttcttgctttagctctgcaaatttgttgtttgtaatgttgctttcatttgtcgtggccactaagccctcctggggttatgaagcaacttgtgagtaatttatggggttatccggtgatgaaatctgccaagttgagaagggtagcatctccattatatgcagagctttcaggattacacgctacatactggatttcgttaagattctagtgatctcgcaagatagtgtaaaattgcgacgaagactatgtagaaccatatcttctaatttatggtaggtgatagtcgaatttgtcattgttttc

SEQ ID NO: 3074 - DNA, 3238 bp, Silene vulgaris
ctctctcttcttcagattgattggtgtgagtcatggctggggctttactacagtcaactaatatccctgctacatttgcctatcaaagaaatggacaatttcagagatcaggaaagggtagaaagtctgtaaagatgatggccacccttcaagcacctggatatcgaatgaaaagtttctcagggttgcatggtagtaattctttggattccttgggatctactaacgattgcttctacaccaaaatgagggcggtgatatctgtacggagagggagagccagtcgtggtgtagttagagcaatgtttgaacgtttcaccgagaaagctattaaagtaattatgcttgctcaagaggaggcaagacggttaggacacaattttgttggcacggagcaaattctgctgggtcttattggtgaaggcaccggtatagctgctaaggttttgaaatcaatgggaattaatctgaaagatgcccgtgttgaagttgagaagattattggaaggggaagtggatttgtagctgttgagattccattcactccccgtgctaagcgcgtgttggaactttcattggaggaagctcgtcaacttggtcacaactatattggatctgaacacttgcttctgggtcttcttcgagagggtgaaggagtggctgctcgtgtcctggagaacttgggcgctgatccaagtaacatccgaacacaggttattcgtatggtgggtgagaacacggaagctgttggtgctggtgttggtggaggcacttctggcaataagatgccaaccttggaggagtatggaacaaatctgacaaagttggccgaagagggaaaattggatccggttgttggaaggcagccacagattgagcgtgtcacccagattctcggtagaagaacaaagaacaatccttgtcttattggagagccaggggttggtaagacagcaatcgctgagggccttgcacaaagaattgcaaatggtgatgttcctgaaacaattgaagggaagaaggttataactctcgatatgggtcttttggtggctggaactaagtaccgtggagagtttgaagaaagattgaagaagttaatggaggaaattaagcagagcgacgaaattattctgtttattgatgaagtacacactttgattggtgctggagcagcagaaggagccattgatgccgctaatatcttaaaaccagctcttgcaagaggtgaattgcagtgcattggagccaccacccttgatgaatacagaaaacacattgagaaagatccagcactagagagaaggtttcagcctgttaaagtgcccgaacccactgtagatgaaaccatacaaattctgaaagggcttcgtgaacgctatgagatacatcataaactccgttacacggatgaatcgctggaggctgcagcacgactttcttaccagtatatcagtgaccgtttcctgcctgataaagctattgaccttattgatgaagctggttctcgtgttagactgcgccatgcgcagctacccgaagaagctagggagcttgaaaaagaactacgacagattacaaaggaaaagaacgaagctgtccgaggccaagattttgagaaggccggagaattgcgggaccgggaaatggatcttaaggcccaaattagtgctcttatagaaaagaacaaagaaatgagcaaggccgagacagaagcaggtgatgtcggtcctgtggtgacagaagtggacattcagcacattgtcgcctcttggactggtattccagttgataaagtgtctacagatgagtctgaccgtctgctcaaaatggaagaaacactccacagtagagtcatcggtcaagatgaggctgtcaaagccattagtcgagccattcgccgtgctcgtgttggtctcaagaacccaaaccgtcccatcgcaagcttcatattctctggccccactggggttggaaaatctgagcttgcaaaaaccttagccgcctattactttgggtccgaggaagccatgatccggcttgatatgagtgagttcatggagagacacaccgtctccaagctaattgggtcaccgcccggttacgtgggatacactgagggtggtcaactcactgaggccgtccgccgccggccttacacggtggtccttttcgatgaaattgaaaaagcccatccggatgtatttaacatgatgctccaaatacttgaagatggaaggctgacggacagcaaaggccggacggttgactttaagaacacccttctaatcatgacatcaaacgttggaagcagcgtgattgagaaaggtggccggaagataggattcgacctagactacgatgagaaggacagcagctacaacagaataaagagcctggtgactgaggagttgaagcaatacttccgtcctgagttcttgaataggttggatgaaatgattgtgttcagacagctcacaaagctggaggtgaaggaaattgcagacataatgttgaaggaagtgtttgagaggttgaagaacaaggagatagaacttcaagtaacggaaaggttcagagaccgagtggtggacgagggttacaacccaagttacggggccaggcctttaagaagagccattatgagacttctcgaggacagcatggctgaaaaaatgcttgcccgggaaatcaaggaaggcgactctgtgatcgtagatgtcgactcagatggaaacgtcattgttctaaatggaagtagcggtgcaccaccagagcccttgcccgaggttattactgtgtaaacacaccctcggctacttggatttctgtagttttgttgtactggaatgttgattataaatcgggtttgaacaaggtacttgttgcacccaggatgtgtaattttaagcacagcctttgaagcagacagcacacaatctaagatacaagttttttcagtgaagtagtaagttagagaagttggaggataatgaatttgtttggttaattatcttgtaaaaagtactgtagtttgtttttgtgggttcaatgtttgcacttggaagtcctttctgatgcaagttgggatgattccctgaatctggtcccacctttaacaatgatgtttcagaagacagtatggccacttatatttgatgggtcttgtcagctgcaatcatgctcaaaacaatttacatatgtgcactataattgtaccaacaattgataccaaaat

SEQ ID NO: 3075 - DNA, 2905 bp, Chenopodium quinoa
ctcactttctctctcctccatttttcttctgatttctggtggaaatcatggctggggcattaattcaatcaactaacatccctgcttcatttgcgttaaatggtcaatttcaaagatctggtaagggtaagaaggctgtgaagatgatggccagccttcaagcccccggatatagagtgcgaagtttctcagggttgcgtggaggaaatgctttggatactttgggtactactagtgaatgtttctattccaagatgagagctgtgctctctgtacgtaaagggacagccagccggggtgtagttagagctatgtttgaacgttttactgagaaagcaattaaagttataatgcttgctcaagaagaggcgagacggctaggtcacaactttgttggcactgagcagattttgctgggtcttattggtgaaggcactggaattgctgctaagttctgaagtccatgggaattaatctaaaggatgctcgtgtagaagttgagaagataattggaaggggcagcggatttgttgctgtagaaattccatttactcctcgtgccaaacgtgttttggagctttcattggaggaagcccgtcaacttggccacaactacattggatctgagcacttgcttctgggtcttcttcgtgagggtgagggtgtagctgctcgtgttttagagaacctgggtgctgatcctagtaacattcgtactcaggttattcgtatggtgggtgaaaacacagaagctgttggtgctggtgttggagggggcactacagggaacaagatgccaaccttggaggagtatggaacaaacttgacaaagttggccgaagagggaaaattggatcctgttgttggaagacagccacagattgaacgggttacccaaattctgggtaggcgaacaaaaaacaatccttgtcttattggtgagcccggtgttggtaaaacagcaatagcagagggccttgctcaaagaattgctaatggtgatgttccagaaacaatcgagggaaagaaggttataactcttgatatgggacttctggttgctggaactaaatatcgtggagagtttgaagaaagattgaagaagttgatggaggaaataaaacaaagtgatgaaataattctatttattgatgaagtacatactttgattggagccggggcagcagaaggagccattgatgctgcaaacatcttgaagcctgctcttgcaaggggtgaattacagtgtattggagctaccaccctcgacgaatacagaaaacacattgagaaagacccagcattggaaagaaggtttcagcctgttaaagtgcctgagccaactgtagatgaaactatacagatattgaaggggctgcgtgaacgctatgagattcatcacaaacttcggtacactgatgaagcactggtggctgcagcacaactgtcataccagtatatcagtgaccgtttccttccggataaagctatcgaccttattgatgaagcgggctcccgagttcggttgcgccatgcacagctccctgaagaagctagagagcttgagaaagaacttaggcagctcacgaaagagaagaatgaagctgttcgaggccaagactttgaaaaggctggtgagttgcgtgacagagaaatggacctcaaggcccaaattaatgctcttatagaaaaaacaaggaaatgagcaaggcagagacagaagctggggatgttggtcctactgtcacagaaactgatattcagcacatagtctcttcctggactggtattccagttgagaaagtgtctacagatgaatctgaccgtcttctcaagatggaggaaacacttcatactagagttattggtcaagatgaagctgttaaagccattagccgtgccatccgtcgtgctcgtgtaggccttaagaaccccaaccgtccaattgctagcttcatcttctcagggccaactggtgttggaaagtccgaacttgcaaaagctttggctgcttactacttcggttctgaagaagccatgatacggcttgatatgagtgagttcatggaaaggcacactgtatccaaacttattggttcacctcctggttatgtgggttacactgagggtggccagcttactgaggctgttagacgccgtccttacacagtcgtgctttttgatgaaattgagaaggctcatcctgacgtcttcaacatgatgttgcaaatccttgaagacggcaggctgacagacagcaagggaaggaccgtcgactttaaaaacacactcctgatcatgacatcgaatgttggaagcagtgtaattgaaaaaggtgggcgcaggataggttttgacctagactatgacgagaaggacagcagttacaaccgaatcaagagccttgtgactgaggagctgaaacagtacttcaggcctgagttcttgaacaggttagatgagatgattgtgtttaggcaacttacaaagctggaggttaaggagattgccgatattatgttgaaggaagtatttgagaggttgaagaacaaggaaattgagcttcaagtaacagagagattcagagatagggtggtggatgaaggttacaaccctagctacggtgctaggccactgagaagagccataatgagacttctggaggacagcatggctgagaagatgctttcaagagaaatcaaagagggtgattcagtgattgtagatgttgattctgacggaaacgttatggtcctcaacggtagcagtggtgcacctcctgagagcttaccagaggtcatcactgtgtagagatcaaacactcctactgatacttcctatgtttatttgtacttggatttgccttctgaattccgtatacatatggtctttgttatgaatgtag

SEQ ID NO: 3076 - DNA, 3430 bp, Chenopodium quinoa
gtattatttatttttgaagaaaatcttaacgtattattttaacaaacgtgtttcgacaaaatattacatgtattgagaaacgaagataatatcgtggtataattatgtacacaccgccccaattatcatagaccacaatatattatccacttctcactctacacatctcttccttgcgcacaacctcatctcagccgttccttcctctcagctggaaggaaaagtctcttcatcttcttctctttctctcacccaccatttcatcccctcttctctcactttctctctcctccatttttcttctgatttctggtggaaatcatggctggggcattaattcaatcaactaacatccctgcttcatttgcgttaaatggccaatttcaaagatctggtaagggtaagaaggctgtgaagatgatggccagccttcaagcccccggatatagagtgcgaagtttctcagggttgcgtggaggaaatgctttggatactttgggtactactagtgaatgtttctattccaagatgagagcagtgctctctgtacgtaaagggacagccagccggggtgtagttagagctatgtttgaacgttttactgagaaagcaattaaagttataatgcttgctcaagaagaggcgagacggctaggtcacaactttgttggcactgagcagattttgctgggtcttattggtgaaggcactggaattgctgctaaggttctgaagtccatgggaattaatctgaaggatgctcgtgtagaagttgagaagataattggaagaggcagtggatttgttgctgttgaaattccatttactcctcgtgccaagcgtgttttggagctttcattggaggaagcccgtcaacttggccacaactacattggatctgagcacttgcttctgggtcttcttcgtgagggtgagggtgtagctgctcgtgttttagagaacctgggtgctgatcctagtaacattcgtactcaggttattcgtatggtgggtgaaaacacagaagctgttggtgctggtgttggagggggcactacagggaacaagatgccaaccttggaggagtatggaacaaacttgacaaagttggctgaagagggaaaattggatcctgttgttggaagacagccacagattgaacgtgttacccaaattctgggtaggcgaacaaaaaacaatccttgtcttattggtgagcccggtgttggtaaaacagcaatagcagagggccttgctcaaagaattgctaatggtgatgttccagaaacaattgagggaaagaaggttataactcttgatatgggtcttctggttgctggaactaaatatcgtggagagtttgaagaaaggttgaagaagttgatggaggaaataaaacaaagtgatgaaataattctttttattgatgaagtacatactttgattggagccggggcagcagaaggagccattgatgctgcaaacatcttaaagcctgctcttgcaaggggggaattacagtgtattggagctaccacccttgacgaatacagaaagcacattgagaaagacccagcattggaaagaaggtttcagcctgttaaagtgcccgagccaactgtagatgaaactatacagatattgaagggcctgcgtgaacgctatgagattcatcacaaacttcgttacacggatgaagcactggtggctgcagcacaactgtcttaccagtatatcagtgaccgtttccttccggataaagctattgaccttattgatgaagctggttcccgagttcggttgcgccatgcacagctccctgaagaagctagagagcttgagaaagaacttaggcagctcacaaaagagaagaatgaagctgttcgaggccaagactttgaaaaggctggtgagttgcgtgacagagaaatggacctcaaggcccaaattaatgctcttatagaaaagaacaaggaaatgagcaaggcagagacagaagctggggatgttggtcctactgtcacagaaactgatattcagcacatagtctcttcctggactggtattccagttgagaaagtgtctacagatgaatctgaccgtcttctcaagatggaggaaacacttcatactagagttattggtcaagatgaagctgttaaagccattagccgtgccatccgtcgtgctcgtgtaggccttaagaaccccaaccgtccaattgcaagcttcatcttctcagggccaactggtgttggaaagtccgaacttgctaaagctttggctgcttactacttcggttctgaagaagccatgatacggcttgatatgagtgagttcatggaaaggcacactgtatccaaacttattggttcaccccctggttatgtgggttacactgagggtggccagctaactgaggctgttagacgccgcccttacacagtcgtgctttttgatgaaattgagaaggctcatcctgacgtcttcaacatgatgttgcaaatccttgaagacggcaggctgacagacagcaagggaaggaccgtcgattttaaaaacacactcctgatcatgacatcgaatgttggaagcagtgtaatcgaaaaaggtgggcgcaggataggttttgacctagactatgacgagaaggacagcagttacaaccgaatcaagagccttgtcactgaggagctgaaacagtacttcaggcctgagttcttgaacagattagatgagatgattgtgtttaggcaacttacaaagctggaggtcaaggagattgccgatattatgttgaaggaagtatttgagaggttgaagaacaaggaaattgagcttcaagtaacagagagattcagagatagggtggtggatgaaggctacaaccctagctacggtgctaggccactgagaagagccataatgagacttctggaggacagcatggctgagaagatgctttcaagagaaatcaaagagggcgattcagtgattgtagatgttgattctgacggaaatgttatggtcctcaatggtagcagtggtgcacctcctgagagtttaccagaggtcatcactgtgtagagatcaaaacactcctactgatacttcgtatgtttatttgtacttggatttgccttctgaactccgtatacatatggtctttgttatgaatgtagagattttaaagcaggaccaattggtttgcagtggccatttgtgacattaatcacatgtcataacacagattcagaaagttgtagtatcaatttttctctaagaagtatgatagtaggtaaacttttggcttatgtaggagttagaatgatgtagctcaaggtaaatgaaattcttattctagtatagtctgttatcctgttcaagtaattaatggttcatcctttgtgaaactcttgcatgccaaaag

SEQ ID NO: 3077 - DNA, 3007 bp, Ambrosia trifida
tcatcatcatcatccacatctctaaattgcttcctctatcgtgttagaattatctggctgcaattatggcaggggcattggtgcagtctacgagctttccgtctgcggtttcgagtgaaagcaaagtccgttcaaagcgatcttgtaatgcaaaaagagcggtcaagatgatgtgtggtttacaagctcctccaatgagggtgaggactttctctggtttgcggggagctaatgctttagataacttggtccaaagaggccaggatttccactcaaaggttgcggctgccacctcggttcgaaaagcaaagccttctagaattgtaccaaaggccatgtttgaacgctttactgagaaggcgattaaagtaattatgcttgcacaagaggaagcgagaaggcttggccacaactttgtgggtacggagcagattttattaggtcttattggtgagggcaccggcattgcagctaaggtcctgaagtcgatgggaattaatttgaaagatgcacgtgttgaggtggaaaaaattattggcaggggcagtggatttgttgctgtagagattccatttactccccgtgccaaacgtgtacttgaactctcgctagaggaggctcgacaacttgggcataattatattggatcagagcatttgcttcttggtttgcttagagaaggtgaaggtgtagcagctcgtgttcttgagaatttaggtgcagacccaaataacattcgcacacaggtaatcagaatggttggcgagagtgcagaagccgtaggtgctggagttggtggtgggacgtctggtaacaagatgccaacactcgaggaatatggtaccaacttaacaaagctggcagaggagggtaaactggatccagttgttggaaggcagccacaaattgaaagagttactcaaattcttggacgccgtaccaaaaacaatccttgtttgattggagaacccggtgttggaaagactgctattgcagaaggccttgcgcaaagaattgctaatggtgatgttccggaaacaatcgaggggaagaaagtgataactctggatatggggctgcttgtcgctggcacaaagtaccgtggggagtttgaagagagattaaagaagctgatggaggaaatcaagcaaagtgatgaaattattctctttattgatgaggtccatacgttaattggagcaggagcagcagagggagctattgatgccgctaacatcttgaaacctgcgcttgctcgaggtgaattacagtgtattggggccacaacccttgatgagtaccgaaagcatattgagaaggacccagcgctggagagacggttccagcccgtgaaggtacctgagcccacagttgatgaaactatacagatcttaagggggcttcgagagcgatatgaaattcaccacaaactccgttacaccgatgatgcactggtagctgctgcccagctgtcgtatcagtacataagtgaccgttttctgcctgataaagctattgatttaatcgatgaagccggttctcgtgttagacttcgtcatgcacaactcccagaagaagctagagagcttgagaaagaacttaggcagataacaaaagaaaagaatgaagctgttcgtggccaagactttgaaaaggctggagagctgcgtgatcgggaaatggatcttaaaactcagatttccgctcttgtggacaagaacaaagagatgagcaaagccgagaccgaggttggagaagagggccccactgttactgaagcagacattcagcacattgtctcatcatggactggcataccagtcgaaaaagtctctacagacgaatcagaccgccttctcaaaatggaagaaacacttcacacacggatcatcggtcaagacgaagcagttaaagccattagccgtgccattcgccgtgctcgtgtaggactcaaaacccaaaccgccccatcgccagtttcatcttttcgggacccactggtgttggtaaatctgaactcgcgaaagctttagccgcttactacttcggatcggaagaagccatgatccggctggacatgagtgagtttatggagcgccacactgtctcaaagctcattggttcacctcctggttacgtcggctacacagaaggtggtcagttgactgaggcggtccgccgccgcccttacaccgttgttctatttgacgaaattgaaaaagcccaccctgatgtcttcaacatgatgcttcaaatccttgaagatggaaggttgaccgacagcaaaggacgaaccgttgacttcaagaacacacttctaatcatgacttcaaacgtgggtagcagtgtaatcgaaaaaggtgggcggagaatcgggtttgacctcgactacgacgagaaagacagcagctacaacagaatcaagagcctggtgaccgaagaactaaaacaatatttccggcccgaattcttaaacaggttagacgagatgatcgtgttccgacagttgaccaaactggaagtcaaagaaatcgctgacataatgttgaaggaagttttcgagaggctaaaaggtaaagaaattgaacttcaagtgacggagaggtttagggaccgtgtggttgaggaaggctacaaccctagctacggtgcaaggcctttaagacgggcaatcatgaggctgttggaagacagcatggcggaaaagatgctcgcacgcgacatcaaggagggcgattctgtaattgtcgatgttgactcggatggcaatgtgaccgtcctcaatggtagcagtggcgccccacagaggcattgccggagccgatctccgtgtagacaaagggtagtcagtcattgatattatgtatgttgtttgtatactgtgctgctttgccttaaatattttcatataagaacatacaacactgccttgtggaagtgaatatgaattgcatgcacagggtcaatagatgttgcagatttttttcaataataaaagatacttgta

SEQ ID NO: 3078 - DNA, 3271 bp, Chelidonium majus
ctcctgttattgcaggagaagaggtttctctctctactttctctctcgtgtgtcggttatttgatcaaaggttgaatcacattaatacaaagcagactgtttctttttagtgagaatcatggctcgggctctggtgcagtcaacaaatctcccggctgcagttgttagtgaaaatcatggccagcgtcaaggatctggaaaaggcagaaggaccgtcaaaatgttgtgcaatgcccaagcatcaactctcagaatgcagggtttctcagggttgcggggatccaatgctttggatacaatggtaaagtctggcgttgatttccactccaaggtggcagctgcaatatctgcacctcgaggaaggggaagccggtctgtagctaaagctatgtttgagcgcttcacagagaaggccattaaagttattatgcttgcacaagaggaagcaagacgcttgggacacaattttgttggtacggaacagattttactgggtcttattggtgaaggcactggaattgctgccaaagttcttaaatccatgggaatcaatctgaaggatgctcgtgttgaagtggagaagataattggcagaggaagtggattcgttgctgtggagataccatttactcctcgtgcaaagcgtgttttggaactgtcacttgaggaagcacgtcaacttggtcataactacattggatctgagcacctacttctagggctacttcgtgagggtgaaggtgttgcagcccgtgtactcgagaacttaggtgctgatccaagtaacatccgtactcaggtaattcgtatggtcggtgagagcactgaagctgttggagctggagttggaggaggcagcagcggcactaagatgcctacacttgaggaatacggtaccaatctcacaaaattggcagaggagggtaagttggatccagttgtcgggaggcaaccacaaatagaacgtgtaactcaaattttgggtaggcgaaccaagaacaatccatgcctgattggagagcctggtgttgggaaaactgcaattgcagaaggacttgcccaacgaattgcaactggtgatgtaccagaaacaattgaaggaaagaaggtcataaccctggatatgggtcttctagttgccggtacaaaatatcgtggagaatttgaagaaaggttaaagaagctcatggaagaaattaaacagagtgatgaaataatactgttcatagatgaggtgcatacactgattggagcaggagcagcagagggtgcaattgatgctgcgaacatcttgaaaccagctcttgcacgaggagaactgcagtgcattggtgccacgactctagacgaataccgaaagcacatcgagaaagatccggctttggaaaggcgattccagccagtgaaagtgcctgaaccaactgttgatgagactatacagattctgaaaggtcttcgagagagatatgagatccaccacaaactccgttacacggatgaagctctagtcgctgctgcgcagctgtcataccagtatatcagtgaccgttttcttcccgacaaagcaatcgacttggttgatgaggctggttctcgggtccgtcttcgtaatgcacagctccctgaggaagccagagaacttgagaaagaactcaggcaaattacaaaggagaaaaacgaagctgttcgcggccaggactttgaaaaggctggggagttgagagatagagaaatggatctcaaagcccagatcacgaaccttgttgacaagggcaaagaactaaccaaggcagagagtgaagcagctgatacaggtcctattgtgacagaagtggacattcagcacattgtatcttcatggaccggtatccctgtcgataaagtctcaagtgacgaatctgatcgcctcctcaagatggaagaaacactccaccaaagggtcattggccaggatgaagctgtcaaagctattagtcgtgcgatacgtcgtgcccgtgttggccttaaaaaccccaaccgaccaattgccagctttatattttctggaccaactggtgtaggaaagtccgaactggcaaaaactttggcttcctactactttgggtctgaggaagccatgatcaggctggatatgagtgagttcatggagaggcacactgtctcaaagctcattggatcaccacctggttacgtcggctacactgagggtggtcagctgactgaagctgttcgccgccgaccttacactgtggtcctttttgatgaaattgagaaagctcatccagatgtcttcaacatgatgcttcagattctggaagatggaagattgacagacagcaagggccgaactgtggacttcaagaacacacttctcataatgacatcaaatgttggaagtagtgtgatcgaaaagggaggtcgccgcattggatttgacctcgactacgacgagaaggacagtagctacaaccggataaagagtttggtgacagaggagctgaaacagtatttccgaccagagttcctaaacaggttggatgagatgattgtgttccggcagctcacaaagttggaggtgaaggagattgcaggtataatgttgaaggaggtgtttgaaagactaaaggcaaaggacattgaacttcaagtgactgagaggtttacagaccgagtggttgatgagggttacagtcccagctatggagcaagaccattgaggagggcaattatgaggcttttggaggacagcatggccgagaagatgctgggtggagagatcaaggagggggattcagttatagtggacgttgatggcgacgggaacgtgactgtgctcaacggtagcagtggcgttcaggattcattgcctccagcaatacctgtgtaaatgacaaaacctgcctttgatcggactatcacacgagtatgttgtctgtacttcttactaatattcagataggttttagttgtagcacttccattatgagactacataaccagtttggtttgtgtggccaaatatcaaagttgtatttatcttttaccacagttgaacagaggagcatgttatataaaaactaaaccagttaagtgttcctgtccgttcttataaaacgaagaacacggagacttgaggaggtgaatggatcagtatgggtgggttgcatattgtatagttaggaacttcctaatgttcacttaatagaatgttttatatgacctgggtttgactgaattttaggttttcgacagtcacatccgacaaatgaaa

SEQ ID NO: 3079 - DNA, 3398 bp, Vitis vinifera
cgtgtacgtctactctgccgtgacattgaccgacggatattacctaaatatttaagttaatcaaacggttgaaatccccccggacgcatcatcaacggtccacaggcgtcgggagaggttataatataagtgagagtgcaggaggggttaggatggagaagcagatagagtagagaaaagcgagagacgagggagatatattgggattatcttcgaccacatctctataaatcgaatcctttcaacgcggccgaccttgtatcggctataagcagtcatggctagggctctggttcagtcaaccaatatctttgcttcagttgctgatgggaagcatggaaagtttcaagggtctgagagaaccaaaaagtctgtcaaaatgatgtgtaatgtccaagcacctggattgaggatcagaggcttctcaggattgcgaggagccaatgctttagataatttggtgagatcaggccatgatttccattccagagtggcagctgctatttctgttcggggaggaaaggctagtcgatgtgtagctagagctatgtttgagcgcttcactgagaaagcaattaaagttattatgcttgcacaagaggaagcaagaagacttggtcacaattttgttggcactgagcagattctgttgggtcttattggggaaggcactggtattgctgctaaggtccttaaatccatgggaatcaatctgaaagatgcccgtgtggaagtggaaaagataattggaaggggcagtggatttgttgctgtcgagattccatttacgcctcgagcaaagcgtgttttggaactttcgctggaggaagctcggcaacttggccataactatattggatcggagcacttgcttctgggactacttcgtgaaggcgaaggtgtagctgcccgtgttcttgagaatttaggtgctgaccctagtaatattcgcactcaggtcattcgtatggtgggtgagagtacagaagctgttggtgctggtgttggaggaggaaccactggcaataagatgccaacgttggaggagtatggtaccaatttaacaaagctggcagaggagggtaaattggaccctgttgttggaaggcagcaacaaatagagcgtgtaacccaaattttgggtcgacggactaaaaataacccatgcctcattggagaacctggcgttggaaaaacagcaattgcagaaggccttgcacaaagaattgcaaatggtgatgttccagaaacgattgaggggaagaaggttataacattggatatgggtctccttgttgctggaacaaaatatcgcggagagtttgaggaaagattgaagaagctaatggaagaaatcaaacaaagtgatgagataatactcttcattgatgaggtacacaccttaattggagcaggagcagcagagggggcgattgatgctgctaacatcttgaagccagctcttgcaaggggtgaactgcagtgtatcggagccacaacactggatgaatacaggaagcacattgagaaagaccctgccttggaaaggagattccagccagtcaaagtgcctgaaccatctgtggatgaaaccatacaaattttgaaagggcttcgggagcggtatgagatccatcacaagctccggtatacggatgaagctttggtatctgctgcccgactgtcataccagtacattagtgatcgatttcttcctgataaggcaattgacttgatcgacgaagctggttctcgggttcgacttcgtcatgcacagcttccagaggaagcaagagagcttgagaaagagctcagacagatcactaaagagaagaatgaagcagtacgaagccaagattttgagaaggccggtgaattacgtgatagagaaatggatctaaaggcacagatctcaaccctcatagacaaaggcaaggagatgaccaaggcagagactgaggcaggagatataggtcctatggtgacagaagtggacattcagcacattgtatctgcttggactggcatccctgttgagaaagtgtcaactgatgaatctgatcgtctcctcaagatggaggagaccctccacagacgagtcattggtcaggatgaagctgttaaagccatcagccgtgctattcgccgagctcgtgttggactcaagaatcccaaccgtccaattgccagcttcatcttttctggtccaactggtgtaggaaagtcagaattggcaaaagcactagctgcttactattttggttctgaagaagccatgatccgtcttgatatgagtgagttcatggagagacacacagtctccaaactgattggttcacctcctggttatgttggttatactgagggtggtcagttgactgaggctgttagacgccgaccttatacagtggttctctttgatgaaattgagaaggctcaccctgatgtcttcaacatgatgcttcagattcttgaggatggcaggttgacagacagcaagggccgaactgtggacttcaagaatactcttttgataatgacatccaatgttggaagcagtgtgatcgagaagggaggccgcaggataggatttgatctcgattacgatgaaaaggatagcagttacaaccgaattaagagcttggtgacagaggaactgaaacaatatttcaggccagagttcttgaatagattggatgagatgattgttttccgacagctcactaagctggaggtgaaggacattgctgatataatgctgaaggaggtgtttgaaaggctgaaggccaaggacatagaacttcaggtgaccgagaggtttagagatagagtggtggatgaagggtacaaccccagttatggtgcaaggccactgagaagagccataatgagacttttggaggacagcatggctgagaagatgcttgcaagggaaatcaaagaaggcgattcggtaattgtggatgttgattctgatggaaatgtcactgtgctcaatggcagcagtggtgctccacctgagtcattaccagaggcaatgcctgtgtaaacagtcttcccttcaaacttttacagatctattgttagtacttttacctttttatttaaagtgggctttagttgtagtctcttttcttttaaagactacttggaagttagaatattggaagccattttatgaattggttttatttcctggtacttgtggatatttcatagatgaatccatatatgactgaaatagttccatgccattttttttttcttgggttcaaacttcaaaccattctttcaggattgcattttctggagcacatctaccatgtgatacctacaatcgaaacctaaaatacaggctataagcagttgatcgactttgtttttttggcatcaccttc

SEQ ID NO: 3080 - DNA, 3083 bp, Cucumis melo
ggcccttcctctcagtctcatcttctccgcccttccatttccaccgaacgccttatcagtatcaaggctgtggatatcatggctagagttctggttcagtcgacaaatattcctggtttggtcggtgggagaaagaatggccttacatctagggggtcagcaagtgtaaaacgggctgttaaaatgatggccaccgcacattcacctggcttgagaataagaaatttctctggactcagaggatttaattctttggataacatgttgagaagtggccaagattttcattccaagatggccattacaatctcttcgaggcgacgaaaggctagcagatgtgttccaagggctatgtttgagcggtttacagaaaaggcaattaaagtcatcatgcttgcccaggaggaagcgaggcggcttggtcacaattttgttggcacggagcagatacttttaggtcttattggcgaaggcactggtatcgctgctaaggttcttaaatccatgggaattaatcttaaagatgcgcgcgtggaggtggagaagataattggtaggggcagtggcttcgttgctgtagaaattccattcactcctcgtgcaaagcgtgttttggaactttctctcgaggaagctcgccaactaggccacaattatattgggtcagagcacttgcttctgggactacttcgtgaaggtgagggtgttgcagctcgtgttctggagaacctaggtgctgatcctagtaacattcgcactcaggttattcgaatggttggtgagagcactgaggctgttggtgctggtgttggaggaggaagcagtgggaacaagatgccaaccctggaagagtatggcacaaatttaactaagctggctgaagagggtaaattagatcctgttgttggaaggcagcagcaaatagaacgtgtaacccagattttgggtcggcggacaaaaaataatccttgcctcattggcgagcctggtgttgggaaaactgctattgcagaaggtctagcgcaaaggattgctaatggggatgtccctgaaacaattgaaggaaagaaggttataaccctggatatgggccttcttgttgctggcacaaaatatcgtggagaatttgaggaaagattaaagaaactgatggaggaaattaaacaaagtgatgagattatcctttttattgatgaggtgcacacattaattggagcaggggccgcagaaggagccattgatgcagcaaatatattgaaacctgccctcgcaagaggtgaactgcagtgcattggagccacgacattggatgaatacaggaagcacattgagaaagacccagccttagaaaggagatttcagccagtcaaagtgccggagccatctgtggatgaaaccatacagattttgaaaggccttagggaacgctatgaaattcaccacaaacttcgttacacggacgaagcattagtagctgctgcgcagctgtcataccagtacatcagtgatcgattcttgcctgataaggcaattgacttggttgatgaagcaggttctcgagttcgccttcgtcatgctcaactacccgaggaagcacgggagcttgagaaagagctgaggcagatcacaaaggagaagaatgaagcagttcgcagtcaagactttgagaaggctggggaattgcgtgatagagaaatggaacttaagactaagatctctgctctagtagataagggcaaggagatgagcaaggctgaaagcgaggcaggagatgtaggccctgttgtgactgaagttgatattcagcatattgtttcctcctggactggcattcctgttgagaaagtatctaccgacgaatctgatcgcctcctcaaaatggaagagaccctccataagagggttattggtcaagatgaagcagttaaagccatcagtcgtgccatacgccgagctcgtgttggtttgaagaatcccaatcgtccaattgctagctttatattttctggtccaactggtgttggtaaatctgagttagcgaaagcattggctgcatactattttgggtctgaagaagcaatgattcgccttgatatgagtgaatttatggaaaggcatacagtttccaagctcattggttcccctcctggttatgttggttacacggaaggtggtcaattgacagaggctgttcgacgtcgtccatacacagtagtgctctttgatgagatcgagaaggctcatcctgatgtattcaacatgatgcttcaaattttagaggatggaagattgacagatagcaagggcaggactgtagacttcaaaaatacacttctgataatgacatcaaatgtgggaagcagtgttatagagaagggaggtcggagaatagggttcgaccttgattatgacgagaaggatagtagttataaccgaatcaagagcttggtgacagaggaactgaaacaatacttcaggccggagttcttgaataggttggatgagatgattgtcttccgtcagctcacaaaattggaagtgaaggagattgcggatataatgctaaaggaggtgtttgataggttaaaagcgaaagaaattgaccttcaagtgacagagagatttagagatagggtagtggaggaaggatataacccaagctacggtgcgagacctttgagaagggcaataatgagacttttggaggacagcatggcagaaaagatgctggcaagggagatcaaggagggtgactcggtcatcgtggatgttgattcggatggaaacgttacagtactcaacggcagcagtggtgctcccgaatccttgccagatgccatccccgtgtaaactactccattttattacgtagagataacattcttactagctcataaaatgtatttccaacttcatcttatttaaattagtaggctgtacactcgagaattaatgtattgtaatttgctttgtcggtggatccttgccaattgtcgatttggttgtatagctgatttatgtttattgctcctgttcactctagctggaatattcagaagaaaacaaaagaatctacaatgaaa

SEQ ID NO: 3081 - DNA, 3134 bp, Valeriana officinalis
cttagctctctttctctctccttctctatttcaatcccacactctactggactgattcagattactaggcggcagtcatggctagtgctctggttcagtcgactaacatcccttcttcagtatccggaaaaagaaatggtcagcttaagggacgtggaaaagcaaaaggtacgattacaatggtggcgagcttacaaacagctactcctatgaggttgacaagtttcaccggaatgcgaggatcgaatgcattagataacatttcaaagcccaggcaagatttccattccaaggtggcagctgcaatatctgcccctcgaggaaaaggtgcaatcaaaagcgtagttaaagcaatgttcgaacgcttcacagaaaaagcaattaaagttataatgcttgcacaagaagaggctagaaggctcggccataactttgttggcacagaacagattctgttaggtcttatcggcgagggcactggaattgctgctaaggttctcaagtcaatgggcatcaatttgaaagatgcacgtgtcgaagttgagaaaattatcggtagaggcagtggatttgttgctgtggagattccattcacacctcgcgcaaaacgtgtgttagaactttctttagaggaagctcgccaacttgggcataactatattggatctgagcacttgcttctggggttgcttcgtgagggtgaaggtgtagctgcccgtgttcttgagaatttaggtgcagatcctaataacatccggacgcaggttatcagaatggttggtgaaagtgcagaagctgtcggtgccggtgttggtggtggaagctctggaaataagatgcctacactggaggagtatggtaccaacttaacaaagttagcagaggagggtaaacttgatcctgtagttggaaggcaggctcaaattgaacgtgtgactcaaattctcggtcgacgtaccaaaaataatccctgcctcattggagagcctggtgttggaaaaactgctattgctgaaggtttggctcagagaattgcaaccggtgatgtcccagaaactatcgaaggaaagaaggtcataacgcttgatatgggtctccttgttgctggcacaaaatatcgtggagagtttgaggaaaggctaaagaagctgatggaggaaatcaaacaaagtgacgaaattattctatttatcgatgaagtccatacgttgatcggagcaggagctgcagagggggcaattgatgcagctaacatcttgaaaccagctcttgctagaggtgaacttcagtgtataggggcaaccacgcttgatgaatacagaaagcatattgagaaagaccctgccctagaaagacgtttccagccagtgaaggtgccggagcccactgtggatgaaactattcagattctcaaaggtcttcgagaacgatatgagattcaccacaagcttcgttacaccgatgaagctcttgttgctgctgcgcagttatcataccagtacatcagtgaccgtttcctacccgataaagccatcgatttgattgatgaagctggttctcgtgttaggcttcgtcatgcacagcttcccgaggaagccagagagcttgagaaggagctcaggcagattacaaaagagaagaatgaagctgttcgtggccaagattttgaaaaggcgggtgagttgcgtgacagagaaatggatctgaagacacagatatcagcacttgtggacaaaaacaaagagatgaacaaagcagaaagtgaagcaggggatactggtcctcttgtaacagaggtagatattcaacacatcgtatcttcatggaccggcatcccagtcgataaagtctccgctgatgaatctgaccgtctgctcaagatggaagagaccctccacaagcgggtcattggtcaagacgaagctgtcatggccatcagccgagccattcgtcgtgctcgtgttggtctcaagaaccctaacagacccattgctagcttcatcttttccggtccaaccggtgtcggaaaatccgaacttgcaaaagcactggctgcctactatttcggctcagaagaagccatgatccgactcgacatgagtgagttcatggaaagacacacggtctccaaacttatcggttcacctcctggctatgttggctacactgagggtggtcagttaacggaggcggtccgtcgacgtccttacaccgtcgtactattcgacgagattgagaaggctcaccccgacgtattcaacatgatgcttcagattcttgaggacggtagattaacagacagcaagggtagaactgttgatttcaagaacacgcttttgatcatgacgtctaacgtcggaagtagcgtgatcgagaagggtggcagacgtatgggttttgtcctcgattacgacgagaaggatagcagctacaacagaatcaagagcttggtgaccgaagaactgaagcagtatttcaggccagagttcttgaacaggctggatgagatgattgtgttcaggcaactcactaagctggaggtgaaggaaatagcggacataatgttgaacgaggtgtttgggaggttgaagaagaaggacattgaactgcaggtaacagaaaggtttagagacagagtggtggatgaaggttataaccctagctatggtgcacgccctttaagaagagcaatcatgaggctcttggaggacagcatggcagagaagatgctttcacgcgagatcaaagaaggtgattcagttatagttgatgttgattcagatggcaacgtgaccgttctcaatggtagcagcggtgcaccgccggagtctttgccggagccgattgctgtgtaggccactggtggtttagggtgggctgttgtttgtactgctgctggtttttagtcggtattggtcattattagtgttatttttagactggttggcagtgggatcgagttaagggctgtaatctatctttaaaaactcaaatttgaaacatggtgcatagtatatcagccaagaaagtaggatgatgatcatgttgttgctagggttagatcttgccagggatgtcgtaataaatcatgtatgttataaactgaaagtgaatattttgtttgtgtttcaaaa

SEQ ID NO: 3082 - DNA, 3130 bp, Flaveria ramosissima
tatggagttgcgtgtacaaataataatcaagacgtgtttgtttaaagaagataatattatacacactctccggttgttatctcgtcgctccggccaccggaatattcgattccgatcagaattcgcatctattttatcctcctccggcgagttagaattctttgtttgcaatcatggcgggggctttggtgcaatctaccagctttccttctgcagcttcaagtgaaagcaaggtctgttcgaagcgatctggtaataccaaaagaggagtcaagatgatgtctagcttacaagctcctcctgtgagggtgaggactttttctggtttgcggggagtcaatgctttagacaacatggtaaatagagcccaggatttccactcaaaagttgcagcagccacctcggtccggaaagcaaagccttctagaattgtacctaaagccatgtttgaacgattcactgagaaggctattaaagtaattatgcttgcacaagaggaagcaagacgacttggccacaattttgtgggtacagagcagattttgttaggtcttattggtgagggcactggcattgcagcaaaagtgctgaagtcaatgggaattaacttgaaggatgcacgtgttgaagtagaaaaaattattggtaggggtagtggatttgttgctgtagagattccgtttactcctcgtgccaaacgtgtgctggaattgtcactagaggaggccaggcaacttggtcataattatattggatcggagcacttgcttcttggtttgcttcgtgagggtgaaggtgtagcggctcgggttcttgagaatttgggtgcagacccaaataacattcgcacacaggtgatcagaatggtcggtgaaagtgcagaagctgtgggtgctggagttggtggtgggacttctggtaataagatgccaacactggaggagtatggtaccaacttgacaaagctagcagaggagggtaagctggatcctgttgttggaaggcagccacaaattgaacgtgttacccaaattctgggacggcgtacaaagaacaacccctgcctcattggagagcctggtgttggaaagactgctattgcagaaggccttgcacaaaggattgcaaatggtgatgttccagaaacaattgaggggaagaaggtgattactctcgatatgggtctactagttgctggcacaaagtaccgtggggagtttgaagagagactaaagaagctcatggaggaaatcaagcaaagtgatgagattatcctcttcattgatgaggtccatacgttaattggtgcaggagcagcagagggagctattgatgctgctaacatcttgaagcctgctcttgctagaggtgaattacagtgtattggagcaacaacccttgatgagtaccggaagcatattgagaaggacccagcactagagagacggttccagcctgtaaaggtgcctgagcccacagtcgatgaaactattcagattttgaaggggcttcgagaacgatatgaaattcaccacaaactacgttacaccgatgaggctctggtagctgctgcccagttatcatatcagtacataagtgaccgttttctgcctgataaagctattgacttgatcgatgaagctggttctcgtgttagacttcgtcatgcacaactcccagaggaagctaaggagcttgagaaagaacttaggcagataacaaaagaaaagaatgaagcagttcgtggccaggacttcgaaaaggctggggagttacgggatcgggaaatggatctcaagactcaaatatcagctcttgtggacaagaataaagagatgagcaaagccgagacagaggcaggagaggagggtcccaccgtcaccgaagccgacattcagcacattgtctcatcatggactggcatacctgtggagaaagtctctacagacgaatctgaccgtctcctcaaaatggaagaaacccttcacacacgaattattggtcaagacgaagcagtcaaagccataagccgcgccatccgtcgtgcccgtgttggactcaaaaacccgaaccgccccattgccagtttcatcttctcaggaccaaccggtgttggtaaatccgaactcgcaaaagctttagctgcttactactttggctctgaagaagccatgattagactcgacatgagtgagttcatggagagacacacagtctcaaagctcatcggttcacctcctgggtacgttggttacaccgaaggcggtcagttaaccgaggcagtccgccgccgcccatacactgtggttctatttgacgaaattgaaaagggctcaccctgatgtcttcaacatgatgcttcaaatccttgaagacggaaggctgactgacagcaaaggacgaaccgttgacttcaagaacacgcttctaatcatgacttcaaacgttggcagcagtgtaatcgaaaaaggtggtcgtagaatcgggtttgaccttgactacgatgagaaggacagcagctacaacagaatcaagagcctggtgactgaagaactcaaacaatatttcaggcccgaattcttgaacaggttagatgaaatgatcgtgttcagacagttgaccaaactcgaggtcaaagagattgctgatataatgctaaaggaagtttttgagaggctaaaaggaaaagaaatcgagcttcaagtgaccgagaggtttagagaccgagttgtagaggagggatacaaccccagctatggtgcaaggccgcttagacgggcgatcatgaggctgttggaagacagtatggcggagaagatgcttgctcgtgagatcaaggagggcgattctgtcattgtcgacgttgattcagatggtaacgtgaccgttctgaatggtagcagcggtgctccacccgaggcattgccggagccgatctcagtgtagaagaaactagcccagagacaagtaaatcgtctctaaacttaaactatatatgttatgtcttattgaatttgcatgcacagtctagccatagttgtttaagctaaacagtatatttaaatttctagtatgttattttttttaatttataggtaactgaattagaaaataaaaaaaaaaaaaaaag

SEQ ID NO: 3083 - DNA, 3187 bp, Panax ginseng
acaacgcttttatcctcaacaccacatctgcactacccatctatccttccaatccggccgaccagtattaagttggtctctctctcgctcgctctttccttgaagaggaagaccttagcccttacccctctaacctgtattcataactcaccatctgattaagattacctggtggcaatcatggcaagggctttggttcagtcaactaacttcccttcttcagttgctggtgagaggaacggtcaatttaagggatctgggaaaacaaaaagaactgttaagatgatgtgtactttaagaactgttccaacaaggatgagaggtttttcaggattacgaggagccaatgctttggatgccatggtaaaatctgggcatgatttccattccaaggtggcagctgcaatctctgttagacgaggaagagccagtcgaagtgtaccgaaagctatgtttgagcggttcacagaaaaagcaataaaagttattatgcttgcacaagaggaggcaaggcggcttggtcacaattttgttggaacagagcagatattgttgggtctcattggcgagggcactggtattgctgctaaagtgctcaagtcaatgggtatcaatttgaaagatgcgcgtgtggaggtagagaagatcattggtaggggtagtggatttgttgctgtagagattccctttactccccgtgcaaagcgtgttctagagctctcactagaggaagcccgccaacttggtcataattatattggatctgagcacttgctgctggggttgcttcgtgagggtgaaggtgtagcagcacgagttcttgagaatctaggtgctgaccctaataacattcgtacacaggttattcgaatggtcggggagagtcaagaagctggtgctgttgttggaggtggaagctctggcaacaagatgcctacactggaggagtatggtactaatttgacaaagctagcagaggagggtaaactggatcctgttgtaggaaggcagcagcaaattgaacgtgtaacccaaattttgggaaggcgaacaaaaaacaatccctgcctcattggagagcccggtgttggcaaaacagctattgcagaaggccttgctcaaaggatcgcaactggtgatgttccagaaacaatagaggggaagaaggttataaccttggatatgggtcttcttgttgctggcacaaaatatcgtggagagtttgaggagaggctgaagaagcttatggaggaaattaaacaaagtgatgaaattatattatttattgatgaggtgcacacactaattggagcaggagcagcagaaggagccatcgatgctgcgaacatcttgaaaccagcccttgctagaggagaactgcagtgtattggggccacaactcttgatgaatacagaaagcacattgaaaaagacccggcactggagaggcgatttcagccagttaaggtacctgaacccactgtggatgaaaccatacagatcttgaaaggactcagagagcgatatgagatccaccacaagcttcgatatactgatgaagccttggtttctgcagcacagctgtcataccagtacatcagtgaccgatttcttccggataaagctattgacttaattgatgaagccggttctagagtccgacttcgtcatgcacagctcccagaggaagccagagagcttgagaaagagcttaggcagataacaaaagagaagaacgaagccgttcgcggccaggactttgaaaaggctggggagttacgtgatagagaaatggatctgaagacacagataactgctctagtagagaaaaacaaagagatgagcaaggcggagaccgaggcaggggatgatggtcccatagtgacagaagtggacattcagcacattgtctcttcgtggacgggcatacctgttgagaaagtgtcaactgatgaatctgaccgcctcctcaagatggaagagacgctccacacacgagtcattggtcaggatgaagccgtcaaagccatcagccgtgctatccggcgtgcccgagttggactcaagaatcctaaccgacccattgccagctttatcttttctggtccaactggtgttggaaagtcagaactagcgaaggcgttggctgcctactacttcggctctgaagaagctatgatccgacttgatatgagtgaattcatggagagacacacagtctcaaagctcattggttcacctcctggatatgttggttatactgaaggtggtcaactaactgaggctgttaggcgccgtccttacacagttgtgctctttgatgagatcgagaaggctcaccctgacgtattcaatatgatgcttcagattctggaggatggtaggttaacagacagcaaaggtagaactgtcgacttcaagaacacattattgattatgacgtcaaatgttggaagtagtgtgattgagaagggaggccgccggataggttttgatcttgattacgacgagaaggatagcagttacaaccgtatcaagagcctggtaacagaggaactgaaacaatacttcaggccagaattcttgaatagattggatgagatgattgtattcaggcagctaaccaagctagaggtgaaggagattgcagatattatgctcaaggaagtcttccagaggttgaaggccaaagacattgaacttcaggttacagagaggtttagggatagggtggttgaggaaggatacaacccaagctatggggccaggcccctaagaagagccataatgagactcttggaggacagcatggcggagaagatgcttgctagagagattaaagagggtgattcagtaattattgatattgattctgatggtaatgtgactgttctcaatggcagcagtggtgctccgcccgaggcattacaagagcctgtcgcagtgtagactagtacttttttaattggacttttttaccaccgtcttgtttgtattctgatttttgttcaattcgccataaagtctcatttttatttttattttttgcttgaagaggctggtggtcggtagactaaagctggtctcagtcagtagctttgttttaaggctgtttccccggaagacttgcatacttttatcggatagtaaatgtttagtgttagatttgaagatatttggttataaa

SEQ ID NO: 3084 - DNA, 2985 bp, Arnica chamissonis
atccacatctcttcgatccggccaccggaatcttcgcttccagacaaaaaacgcatttcttctatcctgctccggttagttagaattcctcatttgcaatcatggcgggggctttggtgcaatctaccagctttccttctgcagtttcaggtcaaagcaaggtccgttcaaagcgatctggtaatacaaaaagagcagtaaagatgacgtgtagcttacaagctcctcgagtgagtgtgagggcattttccggtttgcggggagtcaatgctttggacaacatggtaaacagaggccaagacttccactcaaaagttgcagcagccacctcagttcgtagagcaaaggcttgtagaattgtacctaaagccatgttcgaacgcttcaccgagaaggcgattaaagtaattatgcttgcacaagaggaagcaagacgacttggccacaattttgtaggtacagagcagattttattaggtcttattggtgagggcactggcatagctgcaaaagtgcttaagtcaatgggaattaacttgaaagatgcacgtgttgaagtagaaaaaattattggtaggggtagtggatttgttgctgtagagattccatttactcctcgtgccaaacgtgtactggaattgtcactagaggaggcccggcaacttggtcataattatattggatcagagcacttgcttcttggtttgcttcgtgagggtgaaggtgtagcagctcgtgttcttgagaatttaggtgcagacccaaataacattcgcacacaggtgatcagaatggttggcgagagtgcagaagctgtgggtgccggagttggtggtgggacttctggtaataagatgccaacactggaggaatatggtaccaacttgacaaagctagcagaggagggtaagctggatcctgttgtcggaaggcagccacaaattgaacgagtcacccaaattctaggacgacgtacaaaaaacaatccgtgcctcattggagagcctggtgtcggaaagactgctattgctgaaggccttgcacaaaggattgcaaacggtgatgttccagaaacaattgaggggaagaaggtgattactctggatatgggtctacttgttgccggcacaaagtaccgtggggagtttgaggagagactaaagaagctcatggaggaaatcaagcaaagtgatgaaattattctctttattgatgaggtccatacattaattggtgcaggagcagcagagggagctattgatgctgctaatatcttgaagcctgctcttgctagaggcgaattacagtgtattggggcaaccacccttgatgagtacagaaagcatattgagaaggacccagcactggagagacggttccagcctgtaaaggtccctgagcccacagttgatgaaaccatacagattttaaaggggcttcgagaacggtatgaaattcaccacaaactccgttacactgatgagtcactggtagctgctgcccagttgtcatatcagtacataagtgaccgttttctgcctgataaagctattgacttgatcgatgaagccggttctcgtgttagacttcgtcatgcacaactcccagaagaagctaaagagcttgagaaagaacttaggcagataacaaaagaaaagaacgaagctgttcgtggccaggacttcgaaaaggctggggagttacgggaccgggaaatggatctcaagactcaaatatcagctcttgtggacaagaacaaagagatgaacaaagcggagacagaggcaggagaggagggtcccactgtaactgaagccgacattcagcacattgtctcatcatggaccggcataccagtggaaaaagtctccacagacgaatcagaccgtctcctcaaaatggaagaaacactccacacacgaatcatcggtcaagatgaagcggtcaaagccataagccgtgccatccgccgtgcccgtgttggactcaaaaacccaaaccgccccatcgctagtttcatcttctcaggaccaaccggtgtcggaaaatccgaactcgcgaaagctttagccgcttactactttggctcgcaagaagccatgattcggctcgacatgagtgagttcatggagagacacaccgtctcaaagctcatcggttcccctcctgggtatgttggttacacggaaggcggtcagttaactgaggcagttcgccgccgcccttacaccgtcgttctattcgacgaaatcgaaaaggctcaccctgatgtcttcaacatgatgcttcaaattcttgaagacggaagactgaccgacagcaaaggacggactgttgacttcaagaacacacttctaatcatgacttcaaatgtcggtagcagtgtaatcgaaaaaggtggccgaaggatcgggtttgaccttgactatgacgagaaggacagcagctacaacagaattaagagcctggtgaccgaagaacttaaacaatatttcaggccggagttcttgaacaggttagatgaaatgatcgtgttcagacagttgaccaaactcgaagtcaaggagatcgctgatattatgttgaaggaagttttcgagaggctaaaagtaaaagaaatcgagcttcaggtgacggagaggtttagagaccgggtcgtggaggaaggatacaaccctagctatggtgcaaggccgcttagacgggcaatcatgaggctattggaagacagcatggcggagaagatgcttgcacgtgagataaaggagggtgattccgtcattgtcgatgttgattctgatggtaacgtgacggttctgaacggtagtggtgccccacccgaggcattaccggagccgatctcggtgtagaaaaggagatcacaaaggccagtctgtctctcatctctaaactcaaatatcatatatgttgtttgttatgtgttattgaatttgcatgcacagcctagcgacaacacagggtcat

SEQ ID NO: 3085 - DNA, 3059 bp, Flaveria ramosissima
cgtgtacaaataataacaataataataatctggtagtatatagaagatatatagacatcattcacctcctgttcatctatcatccacatctccaaaatccgccggaggaaagcctccgattaaccggaatattcgattccgaacggcaccaacggttcttctatcgtgttagaattctctggttgcaatcatggcaggggctttggtgcaatctaccagctttccttctgcagtttcaagtgaaagcaaagtacgttccaagcgatctggtaatacaaaaagagcagtcaagatgatgtgtggcttacaagctcctccaatgagggtaaggactttttctggtttgcggggagccaatgctgtagacaacctggtcaaaagaggccaggatttccactcaaaagttgcagctgccacgtcggttcggaaagcgaagcctagtagaattgtaccaaaggctatgtttgaacgcttcactgagaaggctattaaagtcattatgcttgcacaagaggaagcgagaaggcttggccacaattttgtgggtacagagcagattttattaggtcttattggtgagggtactggcattgcagcaaaggttctgaagtcaatgggaattaatttaaaagatgcacgtgttgaggtggaaaaaattattggtaggggtagcggatttgttgctgtagaaattccatttactcctcgtgccaaacgtgtgctggaactctcactagaggaggcccgacaacttggtcataattatattggatcagagcatttgcttcttggtttgcttcgagaaggtgaaggtgtagccgctcgtgtccttgagaatttaggtgcagacccaaacaacattcgcacacaggtgatcagaatggttggtgagagtgcagaagcagtgggtgctggagtcggtggtgggacctctggtaacaagatgccaacgctggaggagtatggtaccaacttaactaagctagcagaggagggtaagctggaccctgttgttggaaggcagccacaaattgaaagagttactcaaattcttggccggcgtaccaaaaacaatccttgtttaattggagagcctggtgtcggaaagactgctatcgcagaaggccttgcacaaagaattgctaatggtgatgttccagaaacaattgaggggaagaaagtgataactttggatatgggtctacttgttgctggcacaaaataccgtggggagtttgaagagagactaaagaagctgatggaagaaatcaagcaaagtgatgaaatcattctctttattgacgaggtgcatactttaattggagcaggagcagcagagggagcaattgatgctgctaacatcttgaaacctgctcttgctcgtggagaattacagtgtattggggccacaactcttgatgagtaccgaaagcacattgagaaggacccagcactggagagacggttccagcctgtaaaggtgcccgaacccacagttgatgaaaccatacagattctaaaagggcttcgagaacgatatgaaattcaccacaaacttcgttacaccgatgaagctttggtagctgctgcccagttgtcatatcagtacataagtgaccgttttctccctgataaggctattgatttaatcgatgaagccggttctcgtgttagacttcgtcatgcacagctcccagaagaagctagagagcttgagaaagaacttaggcagataacaaaagaaaaaaatgaagcggttcggggtcaagacttcgaaaaggctggggagttgcgtgatcgggaaatggacctaaaaactcagatatcctctcttgtagacaagaacaaagagatgagcaaagctgaaaccgaggcaggagaggagggtcccactgtaactgaagcggacattcagcacatcgtctcatcatggactgggataccggttgaaaaagtgtctacagatgaatcagaccgcctcctcaaaatggaagaaacactccacacacgaatcattggtcaagatgaagcagtcaaagccattagccgtgccattcgccgtgctcgtgtaggactcaaaaaccctaaccgtcccattgccagtttcatcttttctggacccactggtgttggtaaatctgaacttgcgaaagctttagccgcttactacttcggctctgaagaagccatgatccggctggacatgagtgagtttatggagcgacacactgtctcaaagctcattggttcccctcctggttatgtcggctacacagaaggcggtcagttaacggaggcggtccgtcgccgcccttacaccgtcgtcctattcgacgaaattgaaaaagctcaccccgatgtcttcaacatgatgctccaaatccttgaagatggaaggttgactgacagcaaaggacgaactgttgacttcaagaacacacttctaatcatgacctcgaatgtgggtagcagtgtaatcgaaaaaggtggaaggagaatcgggtttgacctcgactatgacgagaaagacagcagctacaacagaattaagagcctggtgactgaagaactaaaacaatatttcaggcccgaattcttgaacagattagacgagatgatcgtgttcagacagttgaccaaactggaagtcaaagagattgctgatattatgttaaaggaagttttcgagaggttaaaaggtaaggaaattgaacttcaagtaaccgagaggtttagagaccgtgttgtggaggaaggttacaaccctagctatggtgcaaggccattaagacgggcaatcatgcggctgctggaagacagcatggcggaaaagatgctagcacgcgaaatcaaggagggcgattctgtaattgttgatgttgattccgatggtaacgtcaccgtcctgaatggtagcagtggtgctccgccagaggcgttgccagaacccatctccgtgtagacaaagtgtagacaaaggctagtctcttatatctgaactcaaatcatgtattatgttgttttatactgtggtgtcttttccttaatttaataacata

SEQ ID NO: 3086 - DNA, 3149 bp, Helianthus annuus
atcatcatccacatctcttcaatcctgccgattcaccggaatattcgcttccgtacggtcttaacggttcttctatcgtcttgttgattgtgttagaattatctggttgcaatcatggcaggggctttagtgcaatctaccagctttccttctgcagtttcaagtgaaagcaaagtccgttcaaagcgatctggcaatacaaaacgagcagtgaagatgatgtgtggcttacaagctcctccaatgagggtgaggactttctctggtttgcggggcgctaatgcgttagacaacttggtccaaagaggccaggatttccactcaaaagttgcagctgccacctcagttcgaaaagcaaagccttctagaattgtaccaaaggccatgtttgaacgcttcaccgagaaggctattaaagtaattatgcttgcacaagaggaagcgagacgacttggccacaattttgtgggcactgagcaaattttattaggtcttattggtgagggaaccggcattgctgcaaaggtcctgaagtcaatgggaattaatttgaaagatgcacgtgttgaggtggagaaaattattggtaggggtagtggatttgttgctgtcgagattccatttactccccgtgccaaacgtgtactggaactctcgctagaggaggcccgacaacttggtcataattatattggatccgagcatttgcttcttggtttgcttagagagggtgaaggtgtagcagcccgcgttctcgaaaatttaggtgcagacccaaataacattcgcacacaggtgatcagaatggttggcgagagtgcagaagccgtgggtgccggagttggtggtgggacctctggtaacaagatgccaacactcgaggaatacggtaccaacttaacaaagctagcagaagagggtaagctggatcccgtcgttggaaggcagccacaaatcgaaagagttactcaaattcttggacgccgcaccaaaaacaatccttgtttgatcggagaacccggtgttggaaaaactgctattgcagaaggtcttgcacaaagaattgctaatggcgatgttccggaaacaattgaggggaagaaagtgataactctggacatgggtctgcttgttgctggcacaaagtaccgtggggagtttgaagagagactaaagaagctgatggaggaaatcaagcaaagtgacgaaattattctgtttattgatgaggtccatacgttaattggagcaggtgctgcagagggagctattgatgctgctaacatcttgaaacccgctcttgctcgaggtgaattacagtgtattggggccacaacacttgatgagtaccggaagcatattgagaaggacccagcactggagagacgtttccagcccgtaaaggttcccgagcccacagttgatgaaaccatacagattttaaaggggcttcgagaacgatatgaaattcaccataaactccgttacaccgatgatgctctggtagctgctgctcagctgtcttatcagtacataagtgaccgttttctgcctgataaggctattgatttaatcgatgaagccggttctcgtgttagacttcgtcatgcacaactcccagaggaagctagagagctcgagaaagaactcaggcagataacaaaagaaaagaatgaagctgttcgtggccaagatttcgaaaaggctggggagttgcgtgatcgggaaatggatcttaaaactcaaatatccgctcttgtggacaagaacaaagagatgagcaaagccgagaccgaggcgggagaggagggccccaccgtaactgaagcggacattcagcacattgtctcatcatggactgggataccggtcgaaaaagtctcaacagacgaatcggaccgtcttctcaaaatggaagaaacactccacacacgtatcatcggtcaagacgaagcagttaaagccattagccgtgccatccgccgtgctcgtgtaggactcaaaaacccaaaccgccccatcgccagtttcatcttttcgggacccactggtgttggtaaatccgaactcgcgaaagctttagccgcttactacttcggctcggaagaagccatgatcaggctggacatgagtgaatttatggagcgacacaccgtttcgaagctcattggttcacctcctggttacgtcggctacacagaaggcggtcagctgaccgaggctgttcgccgccgcccttacactgttgtcctatttgacgaaattgaaaaagctcaccccgatgtgttcaacatgatgcttcaaatccttgaagatggaaggttgactgacagcaaaggacggactgttgacttcaaaaacacgcttctaatcatgacttcgaacgtgggtagcagtgtgatcgaaaaaggtggccggagaatcgggtttgacctcgactacgacgagaaagacagcagctacaacagaatcaagagcctggtgactgaagaactaaaacaatatttccggcccgaattcttgaacagattagacgagatgatcgtgttccgacagttgaccaaactggaagtcaaagagattgctgacataatgttgaaggaagttttcgagaggctaaaaggtaaagaaatcgaacttcaagtgaccgagaggttcagggaccgcgaggtggaggaaggttacaaccctagctacggtgcaaggcctttaagacgcgcaatcatgaggctgttggaagacagcatggcggaaaagatgctcgcacgcgacatcaaggagggcgattccgtaattgttgatgttgattccgatggcaatgtgaccgtcctcaatggtagcagcggtgcaccgccagaggcattgccggagccgatctccgtgtagacaaaggctagtgttttatctctcaacttaaattatgtatgttgtttttatactgtgctgctctgtcttcaatatttttcatataagaacatataggtgaatatgaattgcatgcacagggtcaatagatgttgcagaatttttttccataataaaagatccttctagaatgtatatgtgtactggcttgtttctatttagcatccttatggttaaataaatctgatgttctaatgtaatcacttcactttataaaactgtcg

SEQ ID NO: 3087 - DNA, 3048 bp, Helianthus annuus
atcatcatccacatctcttcaatcctgccgattcaccggaatattcgcttccgtacggtcttaacggttcttctatcgtctcgttgattgtcttagaattatctggttgcaatcatggcaggggctttagtgcaatctaccagctttccttctgcagtttcaagtgaaagcaaagtccgttcaaagcgatctggcaataccaaacgagcagtgaagatgatgtgtggcttacaagctcctccaatgagggtgaggactttctctggtttgcggggcgctaatgcgttagacaacttggtccaaagaggccaggatttccactcaaaagttgcagctgccacctcagttcgaaaagcaaagccttctagaattgtaccaaaggccatgtttgaacgcttcaccgagaaggctattaaagtaattatgcttgcacaagaggaagcgagaagacttggccacaattttgtgggcacagagcaaattttattaggtcttattggtgagggcaccggcattgcagcaaaggtcctgaagtcgatgggaattaatttgaaagatgcacgtgttgaggtggagaaaatcattggtaggggtagtggatttgttgctgtagagattccttttactccccgtgccaaacgcgtactggaactctcgctagaggaggcccgacaacttggtcataattatattggatccgagcatttgcttcttggtttgcttagagagggtgaaggtgtagcggcccgtgttcttgaaaatttgggtgcagacccaaataacattcgcacacaggtgattcgaatggttggcgagagtgcagaagctgtgggtgctggagttggtggtgggacctccggtaacaagatgccaacactggaggaatacggtaccaacttaacaaagctagcagaagagggtaagctggatcccgtcgttggaaggcagccacaaatcgaaagagttactcaaattcttggacgccgtaccaaaaacaatccttgtttgattggagaacccggtgtcggaaaaactgctattgcagaaggtcttgcacaaagaattgctaatggcgatgttccggaaacaattgaggggaagaaagtgataactttggacatgggtctgcttgttgctggcacaaagtaccgtggggagtttgaagagagactaaagaagctgatggaggaaatcaagcaaagtgatgaaattattctgtttatcgatgaggtccatacgttaattggagcaggtgctgcagagggagctattgatgctgctaacatcttgaaacccgctcttgctcggggtgaattacagtgtattggggctacaacacttgatgagtaccggaagcatattgagaaggacccagcactggagagacgtttccagcccgtaaaggtgcccgagcccacagttgatgaaaccatacagattttaaaggggcttcgagaacgatatgaaattcaccataaactccgttacaccgatgatgctctggtaactgctgcccagctgtcatatcagtacataagtgaccgttttctgcctgataaggctattgatttaatcgatgaagccggttctcgtgttagacttcgtcatgcacaactcccagaagaagctagagagctcgagaaagaactcaggcagataacaaaagaaaagaacgaagctgttcgtggccaagatttcgaaaaggctggggagttgcgtgatcgggaaatggatcttaaaactcaaatatccgctcttgtggacaagaacaaagagatgagcaaagccgagaccgaggcgggagaggagggccccaccgtaactgaagcggacattcagcacattgtctcatcatggactggcataccggtcgaaaaagtctcaacagacgaatcggaccgtcttctcaaaatggaagaaacactccacacacgtatcatcggtcaagacgaagcagttaaagccattagccgtgccatccgccgtgctcgtgtaggactcaaaaacccaaaccgccccatcgccagtttcatcttttcgggacccactggtgttggtaaatccgaactcgcgaaagctttagccgcttactacttcggctcggaagaagccatgatccggctggacatgagtgaatttatggagcgacacaccgtttcgaagctaattggttcacctcctggttacgtcggctacacagaaggcggtcagctgaccgaggctgttcgccgccgcccttacaccgtcgtcctatttgacgaaattgaaaaagctcatcccgatgtgttcaacatgatgcttcaaatccttgaagatggaaggttgaccgacagcaaaggacggaccgttgacttcaagaacacgcttctaatcatgacttcgaacgtgggtagcagtgtaatcgaaaaaggtgggcggagaatcgggtttgacctcgactacgacgagaaagacagcagctacaacagaatcaagagcctggtgaccgaagaactaaaacaatatttccggcctgaattcttgaacagattagacgagatgatcgtgttccgacagttgaccaaactggaagtcaaagagatcgctgacataatgttgaaggaagttttcgagaggctaaagggtaaagaaatcgaacttcaagtgaccgagaggttcagggaccgcgtggtggaggaaggttacaaccctagctacggtgcacggcctttaagacgcgcaatcatgaggctgttggaagacagcatggctgaaaagatgcttgcacgcgacatcaaggagggcgattccgtaattgttgatgttgattccgatggcaatgtgaccgtactcaatggtagcagtggtgccccgccagaggcattgccggagccgatctccgtgtagacaaaggctagtgttttatctctcaacttaaattatgtatgttgtttttatactgtgctgctgccttcaatatttttcatataagaacatataacactgccttgttgaggtgaatatgaattgcatgcacagggtcaatagatgttgcagattttttttcca

SEQ ID NO: 3088 - DNA, 2859 bp, Flaveria ramosissima
gtgttagaattctctggttgcaatcatggcaggggctttagtgcaatccaccagctttccttctgcagtttcaagtgaaagcaaagttcgttcaaagcgatctggtaatacaaaaagagcagtcaagatgatgtgtagcttacaagctcctccaatgagggtgaggactttttctggtttgcggggagccaacgctttagacaacctggtcaaaagaggccaagatttccactcaaaagttgcagctgccacctcggttcggaaagcgaagcctagtagaattgtaccaaaggctatgtttgaacgcttcactgagaaggctattaaagtaattatgcttgcacaagaagaagctagaaggcttggccacaattttgtgggtacagagcagattttattaggtcttattggtgagggcactggcattgcagcaaaggttctgaagtcaatgggaattaatctaaaagatgcacgtgttgaggttgaaaaaattattggtaggggtagtggatttgttgctgtagagattccatttactcctcgtgccaaacgtgtactggaactctcactagaggaggcccgacaacttggtcataattatattggatcagagcatttgcttcttggtttgcttcgagaaggtgaaggtgtagccgctcgtgtccttgagaatttaggtgcagacccaaacaacattcgcacacaggtgatcagaatggttggtgagagtgcagaagcagtgggtgctggagtcggtggtgggacctctggtaacaagatgccaacgctggaggagtatggtaccaacttaactaagctagcagaggagggtaagctggaccctgttgttggaaggcagccacaaattgaaagagttactcaaattcttggccggcgtaccaaaaacaatccttgtttaattggagagcctggtgtcggaaagactgctattgcagaaggccttgcacaaagaattgctaatggtgatgtccctgaaacaattgaggggaagaaagtgataactttggatatgggtctacttgttgctgggacaaagtatcgtggggagtttgaagaaagactaaagaagctgatggaggaaatcaaacaaagtgatgaaatcattctctttattgatgaggtccatacattaattggagcaggagcagcagagggagctattgatgctgctaacatcttaaaacctgctcttgctcgtggtgaattacagtgtattggggccacaacccttgatgagtaccgaaagcacattgagaaggacccagcactggagagacggttccagcctgtaaaggtgcctgagcccacagttgatgaaaccatacagattttaaagggacttagagaacgatatgaaattcaccacaaactccgctacacagatgatgcactggtagctgctgcccagctatcatatcagtacataagtgatcgttttctgcctgataaggctattgatctaattgatgaagctggttctcgtgttagacttcgtcatgcacaactcccagaagaagctagagagcttgagaaagaacttaggcagataacaaaagaaaagaacgaagcagttcgtggccaagacttcgaaaaggctggggagttgcgtgatcgggaaatggatcttaaaactcagatatctgctcttgtggacaagaacaaggagatgagcaaagccgagactgaggcgggagaggagggccccactgtaactgaagcggacattcagcacattgtctcatcatggactggcataccggtcgaaaaagtttctacagacgaatctgaccgtctcctcaaaatggaagaaacactccacacacgaattattggtcaagatgaagcggtcaaagccataagccgtgccattcgccgtgctcgtgtaggacttaaaaacccaccgtccaattgccagtttcatcttctcgggacccactggtgttggtaaatccgaactcgcgaaagctttagctgcttactacttcggctctgaagaagccatgattaggctggacatgagtgagtttatggagcgacacactgtctcaaagctcattggttcacctcctggttacgttggctacacagaaggcggtcagttaacagaggcggtccgccgccgcccttacaccgtcgttctattcgacgaaatcgaaaaagctcaccccgacgtcttcaacatgatgcttcaaatccttgaagatggaaggttgacggacagcaaaggacgtaccgttgacttcaagaacacacttctaatcatgacctcgaatgtgggtagcagtgtaatcgaaaagggtggaaggagaatcgggtttgaccttgattatgatgagaaagacagcagctacaacagaatcaagagcctggtgactgaagaactaaaacaatatttcaggcccgaattcttgaacagattagacgagatgatcgtgttcagacagttgaccaaactggaagtcaaagagattgctgatattatgttgaaggaagttttcgagaggctaaaaggtaaagaaattgaacttcaagtaactgagaggtttagagaccgtgttgtggaggaaggttacaaccccagctatggtgcaaggccattaagacgggcaatcatgcggctgttggaagacagcatggcggaaaagatgcttgcacgcgatatcaaggagggtgattctgtaattgttgatgtagactccgatggtaacgtcaccgtcctcaatggtagcagtggtgctccgccagaggcgttgccggaacctgtctccgtgtagacaaaggctagtctcttatctctgaactcaaatcatgtattatgttgttttatactgtggtgtt

SEQ ID NO: 3089 - DNA, 3249 bp, Panax ginseng
aaaaacacaacgcttttatcctcaacaccacatctgcactacccatctatccttccaatccggccgaccagtattaagttggtctctctctcgctcgctctttccttgaagaggaagaccttagcccttaccccttaccccttaccccttacccctctaacctgtattcataactcaccatctgattaagattacctggtggcaatcatggcaagggctttggttcagtcaactaacttcccttcttcagttgctggtgagaggaacggtcaatttaagggatctgggaaaacaaaaagaactgttaagatgatgtgtactttaagaactgttccaataaggatgagaggtttttcaggattacgaggagccaatgctttggatgccatggtaaaatctgggcatgatttccattccaaggtggcagctgcaatctctgttagacgaggaagagccagtcgaagtgtaccgaaagctatgtttgagcggttcacagaaaaagcaataaaagttattatgcttgcacaagaggaggcaaggcggcttggtcacaattttgttggaacagagcagatattgttgggtctcattggcgagggcactggtattgctgctaaagtgctcaagtcaatgggtatcaatttgaaagatgcgcgtgtggaggtagagaagatcattggtaggggtagtggatttgttgctgtagagattccctttactccccgcgcaaagcgtgttctagagctctcactagaggaagcccgccaacttggtcataattatattggatctgagcacttgctgctggggttgcttcgtgagggtgaaggtgtagcagcacgagttcttgagaatctaggtgctgaccctaataacattcgtacacaggttattcgaatggtcggggagagtcaagaagctggtgctgttgttggaggtggaagctctggcaacaagatgcctacactggaggagtatggtactaatttgacaaagctagcagaggagggtaaactggatcctgttgtaggaaggcagcagcaaattgaacgtgtaacccaaattttgggaaggcgaacaaaaaacaatccctgcctcattggagagcccggtgttggcaaaacagctattgcagaaggccttgctcaaaggatcgcaactggtgatgttccagaaacaatagaggggaagaaggttataaccttggatatgggtcttcttgttgctggcacaaaatatcgtggagagtttgaggagaggctgaagaagcttatggaggaaattaaacaaagtgatgaaattatattatttattgatgaggtgcacacactaattggagcaggagcagcagaaggagccatcgatgctgcgaacatcttgaaaccagccctagctagaggagaactgcagtgtattggggccacaactcttgatgaatacagaaagcacattgaaaaagacccggcactggagaggcgatttcagccagttaaggtacctgaacccactgtggatgaaaccatacagatcttgaaaggactcagagagcgatatgagatccaccacaagcttcgatatactgatgaagccttggtttctgcagcacagctgtcataccagtacatcagtgaccgatttcttccggataaagctattgacttaattgatgaagccggttctagagtccgacttcgtcatgcacagctcccagaggaagccagagagcttgagaaagagcttaggcagataacaaaagagaagaacgaagccgttcgcggccaggactttgaaaaggctggggagttacgtgatagagaaatggatctgaagacacagataactgctctagtagagaaaaacaaagagatgagcaaggcggagaccgaggcaggggatgatggtcccatagtgacagaagtggacattcagcacattgtctcttcgtggacgggcatacctgttgagaaagtgtcaactgatgaatctgaccgcctcctcaagatggaagagacgctccacacacgagtcattggtcaggatgaagccgtcaaagccatcagccgtgctatccggcgtgcccgagttggactcaagaatcctaaccgacccattgccagctttatcttttctggtccaactggtgttggaaagtcagaactagcgaaggcgttggctgcctactacttcggctctgaagaagctatgatccgacttgatatgagtgaattcatggagagacacacagtctcaaagctcattggttcacctcctggatatgttggttatactgaaggtggtcaactaactgaggctgttaggcgccgtccttacacagttgtgctctttgatgagatcgagaaggctcaccctgacgtattcaatatgatgcttcagattctggaggatggtaggttaacagacagcaaaggtagaactgtcgacttcaagaacacattattgattatgacgtcaaatgttggaagtagtgtgattgagaagggaggccgccggataggttttgatcttgattacgacgagaaggatagcagttacaaccgtatcaagagcctggtaacagaggaactgaaacaatacttcaggccagaattcttgaatagattggatgagatgattgtattcaggcagctaaccaagctagaggtgaaggagattgcagatattatgctcaaggaagtcttccagaggttgaaggccaaagacattgaacttcaggttacagagaggtttagggatagggtggttgaggaaggatacaacccaagctatggggccaggcccctaagaagagccataatgagactcttggaggacagcatggcggagaagatgcttgctagagagattaaagagggcgattcagtaattattgatattgattctgatggtaatgtgactgttctcaatggcagcagtggtgctcctcccgaggcattacaagagcctgtcgcagtgtagacgagtactcttttaattggacttttttaccaccgtcttgtttgtattctgatttttgttcaattcgccatgtagtctcatttttatttttattttttgcttgaagaggctggtggtcggtagactaaagctggtctcagtcagtagctttgtttcaaggctgtttccccggaagccttgatagtaaatgtttagtgttagatttgaagatatttggttataaataggcctttagttgaaggttggtaactcatctttgtgatttaatcaagg

SEQ ID NO: 3090 - DNA, 2924 bp, Ambrosia trifida
tcatcgtcatccacatctctaaactgtttcttctatcgtgttagaattatctggctgcaataatggcaggggcattggtgcagtctacgagctttccgtctgcggtttcgagtgaaagcaaagtccattcaaagcgatctggtaatgcaaaaagagcggtcaagatgatgtgtggtttacaagctcctccaatgagggtgaggactttctctggtttgcggggagctaatgctttagataacttggtccaaagaggccaggatttccactcaaaagttgcggctgcgacctcagttcgaaaagcaaagccttctagaattgtaccaaaggccatgtttgaacgctttactgagaaggcgattaaagtaattatgcttgcacaagaggaagcgagaaggcttggccacaactttgtgggtacagagcagattttattaggtcttattggtgagggcaccggcattgcagcaaaggtcctgaagtcgatgggaattaatttgaaagatgcacgtgttgaggtggaaaaaattattggtaggggcagtggatttgttgctgtagagattccatttactccccgtgccaaacgtgtacttgaactctcgctagaggaggcccgacaacttgggcataattatattggatcagagcatttgcttcttggtttgcttagagaaggtgaaggtgtagcagctcgtgttcttgagaatttaggtgcagacccaaataacattcgcacacaggtaatcagaatggttggcgagagtgcagaagccgtaggtgctggagttggtggtgggacgtccggtaacaagatgccaacactggaggaatatggtaccaacttaacaaagctggcagaggagggtaaactggatccagttgttggaaggcagccacaaattgaaagagttactcaaattcttggacgccgtaccaaaaacaatccttgtttgattggagaacccggtgttggaaagactgctattgcagaaggccttgcgcaaagaattgctaatggtgatgttccggaaacaatcgaggggaagaaagtgataactctggatatgggtctgcttgttgctggcacaaagtaccgtggggagtttgaagagagactaaagaagctgatggaggaaatcaagcaaagtgatgaaattattctctttattgatgaggtccatacgttaattggagcaggagcagcagagggagctattgatgctgctaacatcttgaaacctgcgcttgctcgaggtgaattacagtgtattggggccacaacccttgatgagtaccgaaagcatattgagaaggacccagcgctggagagacggttccagcccgtgaaggtacccgagcccacagttgatgaaactatacagatcttaaaggggcttcgagagcgatatgaaattcaccacaaactccgttacaccgatgatgcattggtagctgctgcccagctgtcatatcagtacataagtgaccgttttctgcctgataaagctattgatttaattgatgaagctggttctcgtgttagacttcgtcatgcacaactcccagaagaagctagagagcttgagaaagaacttaggcagataacaaaagaaaagaatgaagctgttcgtggccaagactttgaaaaggctggagagttgcgtgatcgggaaatggatcttaaaactcagatttccgctcttgtggacaagaacaaagagatgagcaaagccgagaccgaggcgggagaagagggccccactgttactgaagcagacattcagcacatcgtctcatcatggactggcataccagtcgaaaaagtctctacagacgaatcagaccgccttctcaaaatggaagaaacactccacacacggatcatcggtcaagacgaagcagttaaagccattagccgtgccatccgccgtgcccgtgtaggactcaaaaacccaaaccgccccatcgccagtttcatcttttcgggacccactggtgttggtaaatccgaactcgcgaaagctttagccgcttactactttggatcggaagaagccatgatccggctggacatgagtgagtttatggagcgacacactgtctcaaagctcattggttcacctcctggttacgtcggctacacagaaggtggtcagttgactgaggcggtccgccgccgcccttacaccgtcgttctatttgacgaaattgaaaaaggcccacccctgatgtcttcaacatgatgcttcaaatccttgaagatggaaggttgaccgacagcaaaggacgaaccgttgacttcaagaacacacttctaatcatgacttcaaacgtgggtagcagtgtaatcgaaaaaggtgggcggagaatcgggtttgacctcgactacgacgagaaagacagcagctacaacagaatcaagagcctggtgaccgaagaactaaaacaatatttccggcctgaattcttgaacaggttagacgagatgatcgtgttccgacagttgaccaaactggaagtcaaagaaattgctgacataatgttgaaggaagttttcgagaggctaaaaggtaaagaaattgaacttcaagtgacggataggtttagggaccgagttgtggaggaaggctacaaccctagctacggtgcaaggcctttaagacgggcaatcatgaggctgttggaagacagcatggcggaaaaaatgctcgcacgcgacatcaaggagggcgattctgtaattgttgatgttgattctgatggcaatgtgaccgtcctcaatggtagcagtggcgccccaccagaggcattgccagagccgatctcagtgtagccaaatctagtctttcatatcttaacttaaagtatgtatgttgttttaatactgtgctgctttgccttaaatatttttcatataagaa

SEQ ID NO: 3091 - DNA, 3103 bp, Fagus grandifolia
cctattggatagaaatattgagtaataaaaacttcgtattattcgaacctcatctcatctatctccttggccgaccaacaaagggtctgcctttctctctcttttttctctgccaaacaaacacggtacctctagagtagtagtttggcatcatggctcgggttttggttcagacgtctaatatccctggtgtagttgctagccagaggcaccaatctaaaggatctggaaaagcaagacgggccgtcaaaatgatgtctagtttacaggcacctggattgagaatgggaagcttctcaggattgcgaagtgttaatgctttagatactctggtgaaacctgggctagatttacattctaaggtgagaattacaatcaattctcggaaaggaaggggtagcagatgtgtggctagagccatgtttgagcgcttcacagaaaaggcaattaaagtaattatgcttgcacaagaggaagcaagacggcttggtcataattttgttggcacagagcagatcctgttgggtcttattggtgaaggcactggcattgctgctaaggttcttaaatcaatggaaatcaatcttaaagatgcacgcgtagaagtggaaaagattattggaaggggtagtggatttgttgctgttgagattccttttactcctcgtgcaaagcgtgttttggaactctcgctagaggaagcccgccaacttggccataactatattggatctgagcacttgcttctgggattgcttcgtgagggtgagggtgttgcagctcgtgttcttgaaaatctaggtgctgacccaagtaacattcgcacccaggttattcgaatggttggtgagagcaatgaagctattggcgctggtgttggaggaggaagcagtggcactaagatgcccaaccttggaggagtatgggaccaatctgactaagctagcagaggagggtaattggatcctgttgttggaaggcagcaacaaatagaacgtgtcacccaaagttttgggtcgcagaaccaaaaacaatccatgtcttattggagaacctggagttagggaaaacagcaattgcagaagggcttgctcaaaggattgcaactggtgatgtccctgaaacaatagaggggaagaaggttataaccttggatatgggtcttctagtcgctggtacaaaatatcgtggagagtttgaggaacgattaaagaagctaatggaagaaaacaaacaagtgatgagataatattgtttattgatgaggtgcacactttaattggagcaggagcagcagaaggagcaattgatgctgcaaacatattgaaacctgctcttgcaagaggtgaactgcagtgtattggagccacaacactcgatgaatacagaaagcacatcgagaaggatccagccttggaaagacgattccagccagtcaaagtgcctgaacctactgtggatgaaaccatacagattttgaaggggcttcgggagcgatatgagattcatcacaagctccgttacacagatgaagcactcgtatctgctgcacagctgtcataccagtacatcagtgaccgtttcctgcctgataaagcaattgacttgattgatgaggctggttctcgagttcgtttgcgtcatgcacagctaccagaggaagctagagaacttgagaaagagctcaggcagatcacaaaagaaaagaatgaatctgttcgcagccaagactttgagaaggctggagagttacgtgatagagaaatggaccttaaggcgcagataacagctcttgtagataaaggcaaagagatgtcaaaggcagagactgaggctggggatgtaggtcctctcgtgactgaggtggatattcaacatattgtctcctcttggactggcattcctgttgagaaagtgtcaaccgatgaatctgatcgcctcctcaagatggaagagaccctccataagcgggtcattggtcaggatgaagcagtcaaagccatcagtcgtgctattcgccgagcccgtgttggtctcaagaatcccaaccgtccaattgccagtttcatcttttcaggtccaactggtgtaggaaagtctgagctagcaaaagcgttggctgcttactactttggctctgaagaagccatgattaggcttgatatgagtgaatttatggaaagacacactgtctccaagctaattggatcccctcctggttatgttggttacactgagggaggtcagctgactgaggctgttcgacgccgtccttacactgtggtactctttgatgaaattgagaaggcccatcctgatgtcttcaacatgatgcttcaaattctcgaggatggaaggttgacagatagcaagggcagaaccgtggactttaagaatactcttctgataatgacatcaaatgttggaagcagtgtaattgagaaaggaggtcgccgaataggatttgatcttgattatgatgagaaggatagcagttataaccgaattaagagtttggtgactgaggaactaaaacaatatttcaggccagagtttttgaacagattggatgagatgattgtctttaggcagctgacaaagctggaggtaaaggatatagccgatattatgctgaaagaggtatttgataggctgaagacaaaagatatagagcttcaggtgacagagagattcagagatagagtggttgatgaagggtataacccaagctatggggcaaggcctctgagaagagcgataatgagacttctggaggacagcatggcagagaagatgctttcaagagagatcaaagagggtgattcagttattgtggatgttgattctgatggcaaagtgaacgtgctcaatggtagtagcggtgctcccgaatcattacccgaggctcttcctgtaaaataggcctctttatttaacctttgccaatatgttgtttgtagttgtactttcttttctatttgaactatagttgtagtctgttttattgaaaggactacttaaaagtggaattggaagctgatggattaattgaagggctgtagttgttactcttcaaataccatgcataggtcacattcacagg

SEQ ID NO: 3092 - DNA, 3051 bp, Citrullus lanatus
accctccattaacatctttttctttaaacgctgacagtcagtggatatcatggcgagagttctggttcagtcgacaaatattcctggtttggtcggtggaagaaagaatggcctatcatcaagggggtcagcaaatgtaaaacgggttgttaaaatgatggccaccgtacatgcacctggtttgacaataagaagtttctctggactcaggggatttaattctttggataacatgttgagaactggacaaaattttcattctaagatggccattacaatctctaggcgacgaaaggctagcaggtgtgttccaagagctatgtttgagcggttcacagaaaaggcaattaaagtcatcatgcttgcccaggaggaagcgaggcggcttggtcacaattttgttggcacagagcagatacttttaggtcttattggcgaaggcactggcatcgctgctaaggttcttaaatctatgggaattaatcttaaagatgcgcgcgtggaggtggagaagataattggtaggggcagcggctttgttgctgtagaaattccattcactcctcgggcaaagcgtgttttggaactttctcttgaagaagctcgccaacttggccacaattatattgggtcagagcacttgcttctgggactacttcgtgaaggtgagggcgttgcagctcgtgttctcgaaaacctaggtgctgatcctagtaacattcgcactcaggtaattagaatggttggtgagagtacggaggctgttggtgctggtgttggaggaggaagcagtgggaacaagatgccaaccctggaagagtatggcacaaatttaactaagctggctgaagagggtaaactagatcctgttgttggaaggcagcagcaaatagaacgtgtaacccagattttgggtcggcggacaaaaaataatccttgcctcattggcgagcctggtgttgggaaaactgctattgctgaaggtctggcacaaaggattgctaatggggatgtccctgaaacaatagaaggaaagaaggttataaccctggatatgggccttctcgtagctggcacaaaatatcgtggagagtttgaggaaagattaaagaaactgatggaggaaattaaacaaagtgatgagattatcctttttattgatgaggtgcacacattaattggagcaggggctgcagaaggagctattgatgcagcaaatatattgaaacctgccctcgcaagaggtgaactgcagtgcattggagccacgacattggatgaatacaggaagcacattgaaaaagacccagccttagaaaggagatttcagccagtcaaagtgccggaaccatctgtggatgaaaccatacagattttgaaaggccttagggagcggtatgaaatccaccacaaacttcgttacacagatgaagcactagtagctgctgcgcagctgtcataccagtacatcagtgatcggttcttgcctgataaggcaatcgacttggttgatgaagcaggttctcgggttcgcctgcgtcatgctcaactacctgaggaagccagggagcttgagaaagagctgaggcagatcacaaaggagaagaatgaggctgttcgaagtcaagactttgagaaggctggagaattacgtgacagagaaatggaacttaagactaagatctctgctctagtagacaagggcaaggagatgagcaaggctgaaagcgaggcaggagatgtaggccctgttgtgactgaggtcgatattcagcatattgtctcctcctgcattcctgtcgagaaagtatccactgatgaatctgaccgcctcctcaaaatggaagagaccctccataagagggtcattggtcaagatgaagcagttaaagccatcagccgtgccatacggcgagctcgggttggtctgaagaatcccaatcgtccaattgcaagctttatattttctggtccaactggtgttggtaaatctgagttagcaaaagcgttggctgcatactattttgggtctgaagaagcaatgattcgccttgacatgagtgaatttatggagaggcatactgtctccaagctcattggttcccctcctggctatgttggttacacggagggtggtcaattaactgaggctgttcgtcgtcgtccatacacagtggtgctctttgatgagattgagaaggctcatcctgatgtgttcaacatgatgcttcaaattttagaggatggaaggttgacagatagtaagggcaggactgtagacttcaaaaatacacttttgataatgacatcaaatgtgggaagcagtgttatagagaagggaggtcgcagaatagggtttgacctcgattatgacgagaaggatagtagttacaaccggatcaagagcttggtgacagaggaactgaaacaatacttcaggcctgagtttttgaataggttggatgagatgattgtcttccgtcagctcacaaaactggaggtgaaggagattgcggatataatgctgaaggaggtatttgataggttaaaagcaaaagaaatagaccttcaagtgacagaaagatttagagatagggtggtggaggaaggatataacccaagctacggtgcgagaccattgagaagggcaataatgagacttttggaggacagcatggcagagaagatgctggcaagggagatcaaggagggtgactcggtaatagttgatgtcgattcagacggaaacgtcacagtgctcaacggcagcagcggtgctcccgagtccctgccggatgccatccctgtgtaaactactccattttattacatagagacaggaactttaccagctcctataaaatgtatttccaactttatcatatttaatttagtgggttgtatactcggaaaagaaaattcgtctcccgttttttttttccggttgtagtttgcttctagatcgatgtttacccgattgtggatctggtagtataggtgatttattgcttctgttctctcaagttggaatattcaaaagaaaacagaaca

SEQ ID NO: 3093 - DNA, 3066 bp, Citrullus lanatus
caatctctttctttctctctaaaagcttacagtttgtagaaatcatggctagagttttggtccagccgacaaatattcctggtctggttggtggaagaaagagtcctacttcaagaggatctgtttatgtaaaacggggtgttaaaatgatgtctagtgtacatgcacctggtttgaggatgagaagcttttctgggcttagagggtttaattctttggataatatgttgagaactgggcaagattttcattcgaagatggctattgcaatctcttccaggcgagggaaggctagcagatgtgttccaagagctatgtttgagcgatttactgagaaggcaattaaagtaattatgcttgctcaggaggaagcgaggcggcttggtcacaattttgttggcacagagcagatccttttgggtcttattggggaaggcacaggaattgctgctaaggttcttaaatctatgggaattaatcttaaagatgcacgtgtggaagtggagaagataattggtcggggaagtggttttgttgctgtagaaattccattcactcctcgcgcgaagcgtgttttggaactctctctcgaggaagctcgccaacttggccacaattatattgggtccgagcacttgcttctgggactgcttcgtgaaggggagggtgttgcagctcgtgttcttgaaaatttaggtgctgatcccacgaacatacggactcaggttattcgaatggtgggtgagagcacagaggctgttggtgctggtgttggaggagggaccagtgggaacaagatgccaaccctggaagagtatgggacaaacttaactaagctggcagaagagggtaaactagatcctgttgttggtaggcagcagcaaatagaacgtgttacccaaattcttggtcgacgaacaaaaaataacccttgcctcattggtgaacctggtgttgggaaaactgccattgccgaaggtctggctcaaaggattgctaatggggatgttcctgaaacaatagaagggaagaaggttataaccttggatatggggcttcttgtagctggcacaaaatatcgtggggagtttgaggaaagattaaaaaaactgatggaggaaataaaacaaagcgatgagattatcctttttattgatgaggtccacacactaattggagcaggggctgccgaaggagcaattgatgcagcaaacatattaaaacccgcccttgcaaggggtgaattgcagtgcattggagctacaaccctggatgaatacagaaaacacattgagaaagacccagccttagaaagacgttttcagccagtcaaagtgccagaaccatctgtggatgaaaccatacaaattttgaaaggccttagggagcgctatgaaatccaccataaacttcgttacacagatgaagcattagaagctgctgcacagctgtcataccagtacattagtgatcgattcttgcctgataaggcaattgacttgattgatgaagcagggtcccgtgttcgccttcgtcatgctcagctacctgaggaagctagggaggttgagaaagagctcaggcagatcacaaaggagaagaatgaagctgttcgaagtcaagatttcgagaaggctggagaattgcgtgatagagaaatggaacttaagactaagatctctgctctaatagataagggcaaggagatgagcaaggcagaaagcgaggcaggagatgtaggccctgttgtgactgaagtcgatattcagcacattgtctcctcctggactggcattcctgtcgagaaagaatccactgatgaatctgaccgcctcctcaaaatggaagagaccctccataagagggtcattggtcaagatgaagcagttaaagccatcagccgtgccatacgccgagctcgtgttggactcaagaatcccaatcgtcccattgcaagctttatattttctggtccaactggtgtgggtaaatctgagttagcaaaagcattggccgcttactattttggctctgaagaagcaatgattcgtcttgatatgagtgaatttatggaaagacatacggtttccaagctcattggttcaccccctggttatgttggttacacagagggtggtcaattaactgaggccgttcgtcgtcgtccatacacagtggttctctttgatgagattgaaaaggctcatcctgatgtgttcaacatgatgcttcaaattctagaggatggaaggttgacagatagcaagggcagaacggtagacttcaagaatacacttctgataatgacatcgaacgtgggaagcagtgtaatagagaagggaggccgcagaatagggttcgaccttgattacgacgaaaaggacagcagttataaccgtatcaagagtttggtgacagaggaactgaaacaatacttcaggcccgagtttttgaacaggttggatgagatgattgtgttccgtcaactcacgaaactggaggtgaaggagattgcggatataatgttgaaggaggtatttgatagactaaaaggaaaagaaattgatcttcaagttacagagagattcagagatagggtagttgaggaaggatacaacccaagctatggtgcaagaccgttgagaagggcaatcatgagacttctggaggacagcatggctgagaagatgctggcaagggagatcaaggagggtgactctgtaattgtggatgttgattctgatggaaacgtgacagtgctcaacggcggagccactcctgagtctttggctgatgctattcctgtgtaacctgtaaaggtatgcgcccattttatttgatagagagaataataacgatcttattgtttacaagttacaaaatgaaatgtatttccatccttatttaatgggttgtacttgtatagtctatttttaactagatggatggggcagctggtttagtggaaatgtgtagttgatttattacttcttttctgttcaagttgtatttgataatttaatggttatttccactggctttgcagaactttgttgtaacaataaa

SEQ ID NO: 3094 - DNA, 3260 bp, Panax ginseng
ccctctccctgtcgtcgtcctcgcctccagctgctttatcctcaacaccacatctgcactaccactctatcttccaatccggccgaccggtcttaagttggtctctctctctctcgctcgctcgctcgttgaagaggaagaccttagccctcacccctctaaccctcaacttgtattcataactcaccatctgattaagattacctggtggcaatcatggcaagggctttggttcagtcaactaacttcccttcttcagttgctggtgagaggaacggtcaatttaagggatctgggaaaacaaaaagaactgttaagatgatgtgtactttaagaactgttccaataaggataagaggtttttcaggattacgaggagccaatgctttggatgccatggtaaaatctgggcatgatttccattccaaggtggcagctgcaatctctgttcgacgaggaagagccagtcgaagtgtaccgaaagctatgtttgagcggttcacagaaaaagcaataaaagttattatgcttgcacaagaggaggcaaggcggcttggtcacaattttgttggaacagagcagatattgttgggtctcattggcgagggcactggtattgctgctaaagtgcttaagtcaatgggtatcaatttgaaagatgcgcgtgtggaggtagagaagatcattggtaggggcagtggatttgttgctgtagagattccctttactccccgcgcaaagcgtgttctagagctctcactagaggaagcccgccaacttggtcataattatattggatctgagcacttgctgctggggttgcttcgtgagggtgaaggtgtagcagcacgagttcttgagaatctaggtgctgaccctaataacattcgtacacaggttattcgaatggtcggggagagtcaagaagctggtgctgttgttggaggtggaagctctggcaacaagatgcctacactggaggagtatggtactaatttgacaaagctagcagaggagggtaaactggatcctgttgtaggaaggcagcagcaaattgaacgtgtaacccaaattttgggaaggcgaacaaaaaacaatccctgcctcattggagagcccggtgttggcaaaacagctattgcagaaggccttgctcaaaggatcgcaactggtgatgttccagaaacaatagaggggaagaaggttataaccttggatatgggtcttcttgttgctggcacaaaatatcgtggagagtttgaggagaggctgaagaagcttatggaggaaattaaacaaagtgatgaaattatattatttattgatgaggtgcacacactaattggagcaggagcagcagaaggagccatcgatgctgcgaacatcttgaaaccagccctagctagaggagaactgcagtgtattggggccacaactcttgatgaatacagaaagcacattgaaaaagacccggcactggagaggcgatttcagccagttaaggtacctgaacccactgtggatgaaaccatacagatcttgaaaggactcagagagcgatatgagatccaccacaagcttcgatatactgatgaagccttggtttctgcagcacagctgtcataccagtacatcagtgaccgatttcttccggataaagctattgacttaattgatgaagctggttctagagtccgacttcgtcatgcacagctcccagaggaagccagagagcttgagaaagagcttaggcagataacaaaagagaagaacgaagccgttcgcggccaggactttgaaaaggctggggagttacgtgatagagaaatggatctgaagacacagataactgctctagtagagaaaaacaaagagatgagcaaggcggagaccgaggcaggggatgatggtcccatagtgacagaagtggacattcagcacattgtctcttcgtggacgggcatacctgttgagaaagtgtcaactgatgaatctgaccgcctcctcaagatggaagagacgctccacacgcgagtcgttggtcaggatgaagccgtcaaagccatcagccgtgctatccggcgtgcccgagttggactcaagaatcctaaccgacctattgccagctttatcttttctggtccaactggtgttggaaagtcggaactagcgaaggcgttggctgcctactacttcggctctgaagaagctatgatccgacttgatatgagtgaattcatggagagacacacagtctcaaagctcattggttcacctcctggatatgttggttatactgaaggtggtcaactaactgaggctgttaggcgccgtccttacacagttgtgctctttgatgagatcgagaaggctcaccctgacgtatttaatatgatgcttcagattctggaggatggtaggttaacagacagcaaaggtagaactgtcgacttcaagaacacattattgattatgacgtcaaatgttggaagtagtgtgattgagaagggaggccgccggataggttttgatcttgattacgacgagaaggatagcagttacaaccgtatcaagagcctggtaacagaggaactgaaacaatacttcaggccagaattcttgaatagattggatgagatgattgtattcaggcagctaaccaagctagaggtgaaggagattgcagatattatgctcaaggaagtcttccagaggttgaaggccaaagacattgaacttcaggttacagagaggtttagggatagggtggttgaggaaggatacaacccaagctatggggccaggcccctaagaagagccataatgagactcttggaggacagcatggcggagaagatgcttgctagagagattaaagagggtgattcagtaattattgatattgattctgatggtaatgtgactgttctcaatggcagcagtggtgctccgcccgaggcattacaagagcctgtcgcagtgtagactagtacttttttaattggtacttttttaccaccgtcttgtttgtattctgatttttgttcaattcgccattaagtctcatttttatttttaatttttgcttgaagaggctggtggtcggtagactaaagctggtctcagtcagtagctttgttttaaggctgtttccccggaagacttgcatacttttatcggatagtaaatgtttagtgttagatttgaagatatttggttataaattaaaggttggtaacttatctttgtgatttaatcaa

SEQ ID NO: 3095 - DNA, 3152 bp, Eucalyptus grandis
cccctctctcgttctcccacgcgaagcgattccgcgcacgaacttaaacgtagcgacaatctgagaaagaccgcactttgaatatcagttatttttccacgtcgcgaattacgctctggaatgctgctacggttgttttttctttgcaatttgcttgctcatgttgcggactgacccgtttgtccgcctatgcaggcatcttggtcggagttatggctggggtcttggcgcagtcgaggaatgcgccggccatagtgtctggccagaggtatggcggctccggcggttctgccaagtcgaggaggagtgtgaaaatgatgtccgctctcactgctcccagtataaggatgaggggcttctctggtctcagaggatccaacagtttggacactttgttgaattcaagccctgactttcactctagggtggcaaattccatctcctttcgcagggggaaggcaagccgtggtgtagtcagggccatgttcgagcgcttcaccgagaaagccatcaaagtcatcatgcttgctcaagaggaagcacggaggctgggtcacaatttcgtggggacagagcaaattctcctgggtcttatcggcgaaggcaccggtattgctgctaaagtcctcaagtcgatgggaatcaatttgaaagatgctcgtgtcgaggttgaaaaaataattgggaggggaagtggatttgttgccgtggagattcccttcactccacgtgcaaagcgcgtcttggaactgtccttggaagaagctcgacaactaggtcataactacattgggtctgagcacttgcttcttggattgcttcgtgagggtgagggtgtggctgctcgtgttcttgagaacatgggtgctgatcctagcaacattcgcacgcaggtcattagaatggtgggtgagagcaccgaagctgttggagctggtgttggtggtgggagtagtggcaacaaaatgccaacgcttgaggagtatggaaccaatttgactaagatggcagaggagggcaaattggatcctgttgttggaaggcagccgcaaatagaacgagttgtccaaattcttggtcgccgaaccaaaaataatccctgccttatcggagaacctggtgttgggaagactgcaattgctgaaggtcttgctcagcgtatttcaagcggtgatgtccctgaaacaattgaagggaagaaggtcattaccctggacatgggtcttttagttgctggaacaaagtatcgtggagagtttgaagagagattgaagaagctaatggaggaaattaaacagagtgatgaaattatactcttcattgatgaggtgcatactcttattggagcaggagcagcagagggggctattgatgctgcaaatattctcaagcctgctcttgcaagaggtgaactgcagtgtattggggctaccaccctggatgaatacaggaagcacattgagaaggacccagccttagaaagacgattccagcctgtcaaagttcccgagccaacagtggatgaaactattcagattctgaagggactccgagagagatatgagatccatcacaagctgcgttacactgatgaagccttagtatctgctgcgcatctctcttaccagtacataagcgaccgttttctgcctgacaaggccattgatttggttgatgaggcgggttctcgggttcggcttcgtcatgcacagctccctgaggaggccagagagcttgagaaagaactccggcagatcacaaaggagaagaatgaggctgttcgcagtcaggattttgagaaggctggagagttacgtgatagagaaatggatcttaaggcacagatatctgcgctggttgacaaaggcaaggagatgagcaaggctgagactgaggctggggatgttggtcctgttgttactgaagtggacattcagcacattgtctccgcttggactggcattcctgtagagaaagtgtcaagtgatgagtcagatcgcctcctcaaaatggaagagaccctgcacaagcgagtcattggacaggatgaagcagttaaagccattagccgcgccatcaggcgagctcgtgttgggctcaagaaccctaatcgaccgattgccagtttcatcttttctggcccaactggtgttgggaagtcagaactcgccaaagcactggcggcttattactttggatctgaagaagccatgatccgacttgacatgagtgagttcatggaaagacacacggtgtccaagctaattggttccccacctggttatgttggatatacagaaggtggtcagctcactgaagctgttcgtcggcgtccttacacagtggttctgtttgatgagatcgagaaggcccatccggatgtcttcaacatgatgcttcaaattcttgaggacggaagattgacagatagcaaggggagaactgttgatttcaagaatacacttctcataatgacgtccaatgttgggagcagtgtaatagagaagggaggccgcaggataggatttgatctcgattatgatgagaaggatagtagttacaaccgaatcaagagcctagtgacagaagagctgaagcaatacttccggccagagttcttgaatagattggatgaaatgatagtgttccgtcagcttactaagttggaggtgaaggaaatcgcccacatcatgcttagggaggtgtttgagcggctgaaagcaagggagattgaacttcaagtgacagagagatttacggacatggtggtggaggaaggctacaatccaagctatggtgcgaggcctctgaggagagcaataatgagactactggaggacagtatggctgagaaaatgctttccggggagatcaaagagggtgattctgtcattgtggatgttgattctgataaaaaggtaactgtgctcaacggaagcagcggcactccagaagctactttctctacacctacaccatgagaagtctactgatatcaaagccgggttgtctttaaaggggctgtccaggccggcagcaaaactttagtccgtggatattcggttggtacttgcaattctttggcacgatggcaagtagcaccaacagcttttagacgcacatcgctggacggtggataggcagatgtgtaa

SEQ ID NO: 3096 - DNA, 3075 bp, Zostera marina
ctacgtcttctctcagttcacatcactactgcactatttttcctccatctccgacggcatctcaccgcaaccgccaaaatccctaacggaggaggaaaagctcgccggaaaaaccgtcatcaagccatgtctggtgttttacttcccactgtctctccttctgggcttacaagaagaattcgaagccaggtgcggctttctggaaagggaaaaaggtctgttacgatgatggctccttctcttggaagctctcttagatttcaaaacttctctggattgaggaagtcgaacactctagatttcaatggaaaatcttccaatgattttcatagtgttgtgactgcttccatctccaagataattggaaagccgattcgaggtgctgctgtggcaatgtttgaacgtttcacagagaaggccatcaaagttattatgcttgcccaggaggaagcaagacgtttaggtcataattttgtggggactgagcaaattctattggggttgataggtgaaggaactggtattgctgctaaagttttgaagtcgatgggtatcaatttgaaagatgcacgtgtagaagtggaaaaaatcattggaaggggtagtggctttgttgccgttgagataccattcactccacgtgcaaagcgtgttttggaactatcactggaagaagcccggcaacttggtcacaattatatcggttctgagcatttgctccttggattgcttcgtgaaggtgaaggagttgctgctcgagttcttgaaagccttggatctgatccaaacaatatccgcacccaggttattcggatggttggggaaagcacagaggctgttggtgctggagttggtggtggaagcagtggcaacaaaatgcctacacttgaagagtatgggactaatcttacaaagttagccgaagaggggaaattagatcctgttgttggtaggcaagaccaaatagagcgtgttactcaaattcttggtaggcggacaaagaacaatccatgtcttattggagagccgggagttgggaaaacagcaattgcagaagggctagctcaacgcatttcaaatggagatgttcctgaaactattgaggggaaaaaagtaattactctggacatggggcttctggttgctggaacgaaatatcgtggagaattcgaagaaagattaaagaaactaatggaggaaattaaacaaagtgatgagataatattgtttattgacgaggttcataccttaataggagctggagctgcagaaggggctattgatgcagcaaatattttaaaacctgcccttgctagaggcgaactgcagtgcattggagctaccactcttgatgagtatagaaaacatatagagaaggatcctgctttagaaagacgttttcaaccagtgagggttccagagccaactgttgaggagactatacaaattttgggtggacttcgtgaaagatatgaaattcaccacaaacttcgatacacagatgaagctttagttgctgctgctaaattatcgtatcaatatatcagtgatcgattcctgcccgataaagccattgaccttattgatgaagctggatcacgcgtgagactccaacatgctcagcttcccgaggaggctaaagagcttgacaaggagttaagacagataacaaaggataaaaatgaatctgttcgtgggcaagactttgaaaaggctggagaacttcgggacagagaaatggagctgaaggcacaaatctctgcattgattgacaagggcaaagagatgaacaaagcagaaagcgaggcaggagatacaggtcctattgtatcagaaagtgatatacagcacattgtatcatcatggacagggatcccagttgagaaggtatcaagtgatgagtctgacaagctcctaaagatggaagaaactctacacacacgtgtcattggccaagatgaagcagtcaaggccataagtcgtgccatccgacgtgcccgtgttggtctcaaaaatccaaacagacccattgccagtttcatattttccggaccaaccggtgtgggaaatctgaacttgcaaagtcactggctacctattactttggatctgaggaggcaatgatccgactagatatgagtgaattcatggaacgacacacagtctcaaagctaataggttccccgcctggttatgttggctacacagagggtggtcagcttactgaagctgtccgccgtcggccttacacggttgtactttttgacgagatagagaaagctcaccctgatgtgttcaacatgatgcttcaaattctagaagatggtagacttacagacagcaagggtcgtactgtagatttcaagaacacactcctgatcatgacatcaaatgttggaagtagtgttattgagaagggtggccgtagaataggatttgatcttgattacgatgagaaggatagtagctacaacagaataaagagcttggttaccgaggagctaaaacagtatttcagacctgaattcttgaacagattggacgagatgattgtattcagacagctaacgaaattggaggtgaaggagattgcagatataatgttgaaggaggttttcaataggctgaaaacaaaggacattgatctccaggtgactgagagattcagggacagggttgtcgacgaaggatacaaccctagctatggagcaaggccattgaggagggccatcatgaggcttcttgaagatagtttggctgagaggatgcttgccaatgagatcaaagaaggagactctgccatcgttgatgtcgatgctgatggtaatgtgacagttctcaatggtgaaagtggcgttccagaggctgccttgcctttatagttttactacttattttagttttattttcttagacttagttttttagcacaccatcattcatcaatcttggtattcatataaattgctttgaaatttaaattcgaatctgatatgtcattataatttttatgtacacttttaagttttatgcagaaggttccgctgatgaggtttttgtttcacttttatcagc

SEQ ID NO: 3097 - DNA, 3138 bp, Arnica chamissonis
acaagatatagattcacctcctgtcctgttatcatccacatctcttcaatccggccgacggctgccgattaaccggaatcttcgcttccgaacaggggaaacacctcttctatcctgttcctctgtgttagaattctctggttgcaatcatggcaggggcattggtgcaatctaccagctttccttctgcagtttcaagtgaaagcaaagtccgttcaaagcgatctggtaattcaaaaagagcagtcaagatgatgtgtagcttacaagctcctccaatgagggtgaggactttttctggtttgcggggagccaatgctttagacaacttggtgaaaagaggccaggatttccactcaaaagttgcagctgccacctcagttcgaaaagcaaagccttgtagaattgtaccaaaggccatgtttgaacgcttcactgagaaggctattaaagtaattatgcttgcacaagaggaagcaagaaggcttggccacaattttgtgggtacagagcagattttattaggtcttattggtgagggcactggcattgctgcaaaggttctgaagtcgatgggaattaatttgaaagatgcacgtgttgaggtggaaaaattattggtaggggtagtggatttgttgccgtagagattccgtttactcctcgtgccaaacgtgtactggaactctcactagaggaggcccgacaacttggtcataattatattggatcagagcatttgcttcttggtttgcttcgagagggtgaaggtgtagcagctcgtgttcttgagaatttaggtgcagacccaaataacattcgcacacaggttatcagaatggttggcgaaagtgcagaagctgtgggtgcgggagttggtggtgggacctctggtaacaagatgccaacactggaggaatatgggaccaacttaacaaagctagcagaggagggtaagctggaccctgttgttggaaggcagccacaaattgaaagagttactcaaattcttggacgccgtacaaaaaacaatccctgtttaattggagaacctggtgttggaaagactgctattgcagaaggccttgcacaaagaattgctactggtgatgttccagaaacaattgaggggaagaaagtgataaccttggatatgggtctacttgttgctggcacaaagtaccgtggggagtttgaggagaggctaaagaagctgatggaggaaatcaagcaaagtgatgaaattattctctttattgatgaggtccatacactaattggagcaggagcagcagagggagctattgatgctgctaacatcttgaaacctgctcttgctcgaggcgaattacagtgtattggggcaacaacccttgatgagtacagaaagcatatcgagaaggacccagcactagagagacggtttcagcctgtaaaggtgcccgagcccacagttgatgaaaccatacagattttaaaggggcttcgagaacgatatgaaattcaccacaaacttcgttacaccgatgaagcactggtagctgctgctcagctgtcataccagtacataagtgaccgttttctgccagataaagctattgatttaatcgatgaagctggttctcgcgttagacttcgtcatgcacagctcccagaagaagctagagagctagagaaagaacttaggcagataacaaaagaaaagaatgaagcagttcgtggccaagactttgaaaaggctggggagttgcgtgatcgggaaatggatcttaaaactcagatatccgctcttgtggacaagaacaaggagatgagcaaagctgagactgaggcgggagaggagggccccatggtaactgaagccgacattcagcacattgtctcatcatggaccggcataccggttgaaaaagtgtccacagatgaatcagatcgcctccttaaaatggaagaaacactccacacccgaatcatcggtcaagatgaagcggtcaaagccatcagccgtgccatccgccgtgctcgtgtcggacttaaaaaccctaaccgccccattgccagtttcatcttttccggacccaccggtgttggtaaatccgaactcgcaaaagctttagccgcttactacttcggctcggaagaagccatgatccggctagatatgagcgagtttatggagcgacacactgtctcaaagctcatcggttcacctcctggttacgtcggctacactgaaggcgggcagttaaccgaggcggtccgccgccgcccttacaccgtcgtcctattcgacgaaatcgaaaaagctcaccctgatgtcttcaacatgatgctccaaatccttgaagacggaaggttgaccgacagcaaaggacgaacagttgacttcaagaacacacttctaatcatgacttcaaacgtgggcagcagtgtaatcgaaaaaggtgggcggagaatcgggtttgacctcgattatgacgagaaagacagcagctacaacagaatcaagagcctggtgacagaagaactaaaacaatatttccggcccgaattcttgaacagattagacgagatgatcgtgttccgacagttgaccaaactggaagtcaaagagattgctgacataatgttgaaggaagtgtttgagaggctaaaagtcaaagaaattgaacttcaggtgaccgagaggtttagggaccgggttgtggaggaaggttacaaccctagctatggtgcacggcctttaagacgggcgatcatgaggctgttggaagacagcatggcagaaaagatgcttgcacgcgaaatcaaggagggcgattctgtaattgtagatgtcgattccgatggtaatgtcaccgttcttaatggtagcagcggtgctccaccggaggcgttgcctgaaccgatctccgtctagtcagtctcttatctctcaacttaaaccatgtatgttatgttgtggtgcttttccttcaatataagaacatataacactgccttattgagtccagccacaccacagggtcaatagatgttgcaggtttttatttttatttttcataataaaggatcctttaaagtttctagaatgtatatttttctggtcttggctttgttttatgttaggatatctta

SEQ ID NO: 3098 - DNA, 3115 bp, Cucumis sativus
aagaatccgactaccctaaatcggaaaaaccctaagaattcaatctcgttctctctcacgatcacccatccggcagtggttcctggtgggcgacggcggcgctgtttccttatcttaatagcatccacctaaacggcagcggcgttaaaatcatggctagagttttggttcaacccacaaatattcctggtctggttgttgcaaggaagagtccttcttcaagaggatcaggtaatgcaaaacgggttgttaaaatgatgtctagtgtacattcacctggtatgaggatgagaagcttttctggacttagagggttgaattctttggataatatgtttagacctgggcaagattttcattcgaaggtggctattgctatctcttccaggcgaggggggaggcctagcaggggtgttccaagagcaatgtttgagcgatttactgaaaaggcaattaaagtaattatgcttgctcaggaggaagcgaggcgacttggtcacaattttgttggtacggagcagatccttttgggtcttattggggaaggcactggtattgctgctaaggttcttaaatctatgggaattaatcttaaagatgcgcgtgtggaggtggagaagataattggtcggggtggtggttttgttgctgtagaaattccattcactccccgtgctaagcgtgttttggaactctctctcgaagaagctcgccaacttggccacaattatattggatcggagcacttgcttctgggactacttcgtgaaggggagggtgttgcagctcgtgttcttgaaaatttaggtgccgaccctgccaacatacggactcaggcaagaattttaatggtgggtgagagcacagaggctgttggtgctggtgttggaggagggagcagtggaaacaagatgccgaccctggaagagtatgggacaaacttaactaagctggcagaagagggtaaactagatcccgttgttggtaggcagccgcaaatagaacgtgtaacccaaattcttggtcgtagaacaaaaaataacccttgccttattggtgaacctggtgttgggaaaactgccattgccgaaggtcttgctcaaaggattgctaatggtgatgttcctgaaacaatagaagggaagaaggttataaccttggatatgggccttcttgtagctggcacaaaataccgtggggagtttgaagaaagattaaagaaactgatggaggaaataaaacaaagtgatgaaattattctatttattgatgaagtgcacacattaattggagcaggggctgcagaaggagctattgatgcagcaaacatattaaaacctgcccttgcaaggggtgaactgcagtgcattggtgcgacaaccttggatgaatacagaaaacatattgagaaggatccagccctagaacggcgatttcagccagttaaggtgccagaaccatctgtggatgaaacgatacagattttgaaaggccttagggagcgctatgaaatccaccacaaacttcgttacactgatgaagcattagaagctgctgcgcagctgtcatatcagtacatcagtgatcgattcttgccagacaaggcaatcgacttgattgatgaagcagggtccagggttcgcctccgtcatgctcagctacctgaggaagctaaggaggttgagaaagagctcaggcagatcacgaaggagaagaatgatgctgttcggagtcaagatttcgagaaggctggagaattgcgtgatagagaaatggaacttaaggctaagatctcagccctaatcgacaagggcaaggagatgagcaaggcagaaagtgaggcaggagatgtaggccctgttgtgactgaagttgatattcagcatattgtctcctcctggactggcattcctgtcgagaaagtatccactgatgaatctgaccgcctactcaaaatggaagagactcttcacaggagggtcattggtcaagatgaagcagttaaagccatcagccgtgccatacgccgagctcgtgttgggctcaagaatcccaatcgccccattgccagctttatattttcaggtccaactggtgtgggtaaatctgagttagcaaaagcattggctgcttactattttggttctgaagaagcaatgattcgtctcgatatgagtgaatttatggaaagacatactgtttcgaagctcattggttcgccccctggttatgttggttacacagagggcggtcaattaactgaggctgttcgtcgtcgtccgtacacagtggttctatttgatgagattgaaaaggctcatcctgatgtgttcaacatgatgcttcaaattctagaggatggaaggttgacagatagtaagggcagaacagtagacttcaagaatacacttttgataatgacatcaaacgtgggaagcagtgtaatagagaagggaggtcgcagaatggggttcgaccttgattacgatgagaaggacagtagttatacccgcatcaagagcttggtgacagaagaactgaaacagtacttcaggcctgagttcttgaacaggttggacgagatgatcgtgttccgtcagctcacaaaactagaggtgaaggagattgcggatataatgctgaaggaggtatttgatagactaaaaggaaaagaaattgatcttcaagttacggagagattcagagatagggtagttgatgaaggatacaacccaagctatggtgctagaccattgagaagggcaatcatgagacttttggaggacagcatggctgagaagatgctggctagggagatcaaggagggggactccgttattgtggatgtcgattccgatggaaatgtcacggttctcaatggcagcagtggagctgcacccgagtctttggcagatcctattcctgtgtaacctgtaaaggtatgcgcacattttatttgatagagaaaataaacaatcttgttgtttacaagttacgaaaagaaatttagttccatccttgattcaatgggagtgtacattcatttataatctatttctaactagaaaatggatggggcagctggtgtagaggatcttgaaatgtgtagttgatt

SEQ ID NO: 3099 - DNA, 3195 bp, Eschscholzia californica
aaaagttgtcagctatccatccaggttaaatcttatagtataagacgcgtagggttctctcttagttagaatcatggctcgagctctggttcaatctacaaacctccctgccacagtagttggtgaaagtcatgcccaactccaaggatctcggagaaacaaaaaaactgttaaaatgttgtgcaatgcccaagcatcgtcccttagagtgcagagtttctcaggattgcggggatcgaatgctctggatggaatgatcaagtctggcgttgatttccactctaaggttgcagctgctatctccgctccacgtggaaaggggaatcgatctgttgctaaggcgatgtttgagcgcttcacagagaaggctatcaaagttattatgcttgctcaagaagaagcgagacgtttaggccataattttgttggtacggaacagattctactgggtcttattggtgaaggcacaggaattgctgcaaaagttcttaagtccatgggtataaatttgaaggatgctcgggttgaagtagaaaagataattgggagaggaagtggttttgttgctgttgaaataccattcactcctcgtgcaaagcgcgttttggaactgtcacttgaggaggcacgccaacttggtcataactacattgggtcagaacacctgcttctaggtcttcttcgtgagggagaaggtgtagctgcacgtgtgcttgaaaacttaggggctgatccaagtaacatccgaacacaggttatccgtatggtgggtgagagtacagaagctgttggagcaggtgtcggaggaggcagcagtggcaataagatgcccacacttgaggagtatggtaccaatctcacaaaattggcggaggagggtaagctagatccagttgttgggaggcagcctcaaatcgaacgagtaactcaaattttgggtaggcgaacaaagaacaatccgtgcctaattggagaacctggtgttggcaaaacggcaattgcagaaggacttgctcagcgaattgcaaccggtgatgtaccagaaacgattgagggaaagaaggtcatcactttggatatgggtcttctagttgctggtacaaaatatcgtggagagtttgaagaaaggttaaagaaactcatggaagaaatcaaacaaagtgatgaaatcatactcttcattgatgaggtgcatacactaattggagcgggagcagcagagggtgcaattgatgctgcaaatatcttgaaaccagctcttgcacgaggagaactccagtgtattggtgccacgactctagatgagtacaggaagcacattgagaaagaccctgccctggaaagacgattccagcctgtaaaagtgcctgagccaactgttgatgagaccatccagattctgaaaggtcttcgagagagatatgaaattcatcataaactccgttacactgatgaagccctagttgctgcagctcagttatcataccagtacatcagtgaccgcttcctccctgacaaagcaatcgacttggttgacgaggctggatctcgtgttcgtcttcgtaatgcgcagctaccggaggaagccagagaacttgagaaagagctcagacaaataaccaaagagaaaaatgaatctgttcgtggccaggactttgaaaaggctggagagttaagagatagagaaatggacctcaaggcacagataacaaatcttgttgacaagggcaaagagaaaagcaaggcggagagtgaatcgagcgatacaggccccgttgtgacagaagtcgacatacaacatatcgtctcttcttggactggtatccctgttgataaagtatcaagtgacgaatctgatcgcctccttaagatggaagacacattacacgcaagggtcattggacaggatgaagctgtcaaggcaattagtcgagccatccgtcgtgcccgtgttggtcttaaaaatcccaacaggccaatcgccagtttcatattttctggtcccactggtgttggaaaatctgaactggcgaagacattggcggcctattactttggttctgaggaagccatgatcagactggacatgagtgagtttatggagaggcacactgtttccaagctcattgggtcaccacctggttatgtcggttacaccgaaggtggtcaactgactgaagctgtccgtcgtcgaccatacactgtagtcctattcgacgagatcgagaaagctcaccctgatgtattcaacatgatgcttcagattctagaggatggaagattaacagacagcaaaggtcgaacagtagatttcaagaacacacttctgataatgacatcgaacgttggaagtagtgtaattgagaagggaggacgtcgaatcggatttgatctagactacgacgaaaaggacagtagctacaccaggataaagagcctggtgacagaagagcttaaacagtatttcaggccagagttcctaaacaggttagacgagatgattgttttcagacaactcaccaagttggaagtgaaggagatagcagatataatgttgaaggaagttttcggaagactgaaaaagaaggagatagagcttcaagtgacagagaggttcagagacagagtggtggatgaaggttacagtccaagctatggagcaaggccattgaggagagcaatcatgaggcttctggaagatagcatggctgagaagatgttgggaggagagataaaggaaggagattcagttatagtggacgtggatggtgatggaaacgtaacagtgctcaatggtagcagtggagttcctgattcgttgccgcccccagcaatagctgtctagtaatttaaccctcatcgtctgaaccttccgacttcgttgcctgtaatttattgtattcatcagttatagcatcttaggtaaaagactcggtaggtagcagttcggccgaagttactgaactatgtacgtataatgcatgctagatgttgtataaactaaaccagtacgcaaatgtgttgtcattacttgtattcttattctctgaattccaacatattcaacttgttagaagtaggttgtgtattataggggtcagggctggagaagtcattatccctccaagtttcttgcttcaattccgtccaggttgtactcggatttatcgcgaatgagtgagagtagtctgtaca

SEQ ID NO: 3100 - DNA, 3268 bp, Oryza sativa
acaaaattttcagaagaaaacaaacaaggagagagagagagagagagagagagagagagagagagagagagtaggccaaaataaaggcaggagaggagagcccaggcagtgaagccggaggcccgtcttctccctagtctctcttcttcccccttatctctagggaggaaagaaaaataacaagaacgcaccttttgtctctctcctctcctccgaggtaaggtttggggaagctacttctgaccatggcaggcaccctgctccagccggttgccctcggaacaacttttgcaggccgtgtaagtggtcagcgatggaagtctcatggcacaaggaggcctccctcaatgttggcgatgtccttgagccgcccagttaagatggccgcatttgtcggtctgagatcggtgcatagcttctcagtcacgcctgtcaccaacttcagatcgacggttgcatcttacagatcaagacggggaaggcgtgctcgctttgtaaccagatcgatgtttgagaggttcactgagaaagctattaaggttataatgcttgcgcaagaagaggcaaggcggttgggccacaactttgtcggtactgagcaaattctcttgggtctgattggagaagggactggtattgctgctaaggtgctcaagtcaatgggcataaatctcaaggatgcacgtgtggaagtggagaagatcattgggaggggcaatggtttcgttgctgtcgaaataccattcacaccacgtgcaaaacgtgttttggagctttcattggaagaagctcgtcagctaggacacaactatattggatctgagcacttgcttcttggactgctccgtgagggtgaaggtgtagcagcccgtgtgctcgaaagccttggagccgatcctagcaatattcgcacgcaggttatccgaatgattggcgagactacagaagctgttggtgcaggagttggaggagggagtagtggcaataaaatgccaacacttgaggagtacggaactaatttaacaaaattagcagaggagggaaagctagatcctgttgttggaaggcaaccccagattgagcgtgtcgtacaaattctgggcagacgaacaaagaacaacccatgcttaattggagagcctggtgttggaaagacagcaattgcagaaggccttgctcaacgcatttctactggtgatgtgcctgaaacaattgaaggaaagaaggtcattacccttgatatgggacttcttgttgctggtacaaaataccgtggagaatttgaagaaagattaaagaagctgatggaagaaatcaagcagagtgatgagataatactatttattgatgaagtccacactctcataggagcaggagcagctgagggtgctattgacgctgctaacattttaaagccagcattagcaagaggagaactacagtgtattggagccaccacacttgatgaatacaggaagcatattgagaaagacccagcattagaaagacgtttccagcctgtaagagtgccagagccaacagttgatgaaaccatagaaattctcagagggcttcgggaacgatatgagatccatcataaacttcgttacactgatgatgctctgatttcagctgccaagctatcttatcaatacatcagtgatcgtttcctcccagataaagcaattgatttgattgatgaagcaggttcacgtgtaaggcttcgacatgcccaggttcctgaagaagctagagagcttgacaaggagctcaagcaaatcacaaaagataagaatgaagctgtccgtagccaggacttcgaaaaggctggagagttacgtgatcgtgaaatggaattgaaggcccagataacagctctcattgacaagagcaaggagatgagcaaagcagagactgaatcaggggagacagggccactggtcaatgaagcagatatccagcacattgtatcctcgtggactggtattccagtagagaaggtatcaagtgacgagtccgataagcttcttaagatggaagagactttgcatcagcgtgtcattggtcaagatgaggctgtgaaagccataagtcgctccatccgccgtgctcgtgtgggcctcaagaacccgaacaggccgattgcaagcttcattttcgcaggtccaaccggtgttggtaaatccgagctcgcaaaagcacttgcagcatattactttggatctgaggaggccatgatcaggcttgatatgagtgaattcatggagaggcacactgtatccaagttgattggttcacccccagggtatgttgggtacacggagggtggacagctgactgaggcagttcgacgcaggccatacacagtcgtgcttttcgacgagatcgaaaaggcgcatccagatgtattcaacatgatgctccagatcttggaagatggaaggctgactgacagcaagggaagaacagtggacttcaagaacacacttctcataatgacttcgaacgtcggaagcagcgtcatcgagaagggtggtcggaagataggtttcgatctcgattacgatgagaaggacagcagctacagcaggatcaagagccttgtcgtcgaggagatgaagcagtacttccgccccgagttcctcaaccgtctcgacgagatgatcgtcttcaggcaactcaccaagctggaggtcaaggagatcgccgagatcatgctcaaggaggtctttgacaggctcaaggccaaggacattgacctccaggtcaccgagaagttcaaggagcgtatcgttgacgaaggcttcaacccgagctatggtgcgaggccgctaaggagggccatcatgaggctcctggaggacagcctcgcggagaagatgctagctggggaggtgaaggagggtgattctgccattgtcgatgtggattccgaggggaaggtgattgtactgaatggccaaagtgggttgcctgagctttcaactccggctgtcactgtgtagtagttcatatatactgcagagtgttaagagatgcagtgcttttcattcagatatatttctgcatagttagcaacttagcataactgtatatatagtatatacaaatcaaaggaggaggaaacaccagctgattcctggtttctcatgtttgggacacctttttttttattaacaataatttcatatggtagagggatcttaaattaaattagctaatggcaaaaatttggtagtaaaataaattttccatgcttatttatata

SEQ ID NO: 3101 - DNA, 3109 bp, Oryza sativa
agccggaggcccgtcttctcccttgtctctcttcttcccccttatctctagggaggaaagaaaaataacaagaacgcacattttgtctctctcctctcctccgaggtaaggtttggggaagctacttctgaccatggcaggcaccctgctccagccggttgccctcggaacaacttttgcaggccgtgtaagtggtcagcgatggaagtctcatggcacaaggaggcctccctcaatgttggcgatgtccttgagccgcccagttaagatggccgcatttgtcggtctgagatcggtgcatagcttctcagtcacgcctgtcaccaacttcagatcgacggttgcatcttacagatcaagacggggaaggcgtgctcgctttgtaaccagatcgatgtttgagaggttcactgagaaagctattaaggttataatgcttgcgcaagaagaggcaaggcggttgggccacaactttgtcggtactgagcaaattctcttgggtctgattggagaagggactggtattgctgctaaggtgctcaagtcaatgggcataaatctcaaggatgcacgtgtggaagtggagaagatcattgggaggggcaatggtttcgttgctgtcgaaataccattcacaccacgtgcaaaacgtgttttggagctttcattggaagaagctcgtcagctaggacacaactatattggatctgagcacttgcttcttggactgctccgtgagggtgaaggtgtagcagcccgtgtgctcgaaagccttggagccgatcctagcaatattcgcacgcaggttatccgaatgattggcgagactacagaagctgttggtgcaggagttggaggagggagtagtggcaataaaatgccaacacttgaggagtacggaactaatttaacaaaattagcagaggagggaaagctagatcctgttgttggaaggcaaccccagattgagcgtgtcgtacaaattctgggcagacgaacaaagaacaacccatgcttaattggagagcctggtgttggaaagacagcaattgcagaaggccttgctcaacgcatttctactggtgatgtgcctgaaacaattgaaggaaagaaggtcattacccttgatatgggacttcttgttgctggtacaaaataccgtggagaatttgaagaaagattaaagaagctgatggaagaaatcaagcagagtgatgagataatactatttattgatgaagtccacactctcataggagcaggagcagctgagggtgctattgacgctgctaacattttaaagccagcattagcaagaggagaactacagtgtattggagccaccacacttgatgaatacaggaagcatattgagaaagacccagcattagaaagacgtttccagcctgtaagagtgccagagccaacagttgatgaaaccatagaaattctcagagggcttcgggaacgatatgagatccatcataaacttcgttacactgatgatgctctgatttcagctgccaagctatcttatcaatacatcagtgatcgtttcctcccagataaagcaattgatttgattgatgaagcaggttcacgtgtaaggcttcgacatgcccaggttcctgaagaagctagagagcttgacaaggagctcaagcaaatcacaaaagataagaatgaagctgtccgtagccaggacttcgaaaaggctggagagttacgtgatcgtgaaatggaattgaaggcccagataacagctctcattgacaagagcaaggagatgagcaaagcagagactgaatcaggggagacagggccactggtcaatgaagcagatatccagcacattgtatcctcgtggactggtattccagtagagaaggtatcaagtgacgagtccgataagcttcttaagatggaagagactttgcatcagcgtgtcattggtcaagatgaggctgtgaaagccataagtcgctccatccgccgtgctcgtgtgggcctcaagaacccgaacaggccgattgcaagcttcattttcgcaggtccaaccggtgttggtaaatctgagctcgcaaaagcacttgcagcatattactttggatctgaggaggccatgatcaggcttgatatgagtgaattcatggagaggcacactgtatccaagttgattggttcacccccagggtatgttgggtacacggagggtggacagctgactgaggcagttcgacgcaggccatacacagtcgtgcttttcgacgagatcgaaaaggcgcatccagatgtattcaacatgatgctccagatcttggaagatggaaggctgactgacagcaagggaagaacagtggacttcaagaacacacttctcataatgacttcgaacgtcggaagcagcgtcatcgagaagggtggtcggaagataggtttcgatctcgattacgatgagaaggacagcagctacagcaggatcaagagccttgtcgtcgaggagatgaagcagtacttccgccccgagttcctcaaccgtctcgacgagatgatcgtcttcaggcaactcaccaagctggaggtcaaggagatcgccgagatcatgctcaaggaggtctttgacaggctcaaggccaaggacattgacctccaggtcaccgagaagttcaaggagcgtatcgtcgacgaaggcttcaacccgagctatggtgcgaggccgctaaggagggccatcatgaggctcctggaggacagcctcgcggagaagatgctagctggggaggtgaaggagggtgattctgccattgtcgatgtggattccgaggggaaggtgattgtactgaatggccaaagtgggttgcctgagctttcaactccggctgtcactgtgtagtagttcatatatactgcagagtgttaagagatgcagtgcttttcattcagatatatttctgcatagttagcaacttagcataactgtatatatagtatatacaaatcaaaggaggaggaaacaccagctgattcctggtttctcatgtttgggacacctttttttttattaacaataatttcatatggtagagggatcttaaattaaattagctaa

SEQ ID NO: 3102 - DNA, 3305 bp, Sorghum bicolor
cagacaaaaggcagaatcaggaggctatacgaaaggaggagaaagagagaacaatcacggagtcctctttcttgttgggcactcgggcagcgcggcccccttatctccagggaccaggggaggacgcacaccaacgcaccgcccttccttccctcctcctcctcctcctcctctctctctcctcggaaggttaagggacggtatttctgaccatggcagggaccttactccagtcagttgccctcggaacaacattcgggggtcgcataagcacccagcgttggaggtcccatggcgccaggaggcctgcctctatgttggcaatgtcacttagccgccccgtcaagatgtcagcatttgtgggtctaagatcagtgcatagcttctcggtcacacccacggtgtccaattccaggtcgacagttgcatcttacaggtcatctcgacggacaagacgttctcgttttgttactcgggcaatgtttgagaggttcacggagaaagctattaaggtcatcatgcttgcgcaagaggaagcaagacgcctggggcacaactttgttggaactgagcagattctcttgggtctgattggagagggcactggtattgcagcaaaggtgctcaagtccatgggaataaatctcaaggatgcacgtgtggaggtggaaaagattattggccgtggcaatggttttgttgctgttgaaataccattcacaccacgtgcgaaacgtgttttggagctctccttggaggaagctcgccaattaggacataattatattggatctgagcacctgcttcttggactgcttcgtgagggtgaaggtgtggcggctcgtgttcttgagagtcttggagctgatcccagcaatatccgtacacaggttattcgaatgattggtgagaccacagaagctgttggtgctggagttggagggggcagcagtggtaataagatgccaactcttgaggagtatggaactaatttaacaaaattagcagaggagggaaaattagatcctgttgttggaaggcagccacagattgagcgtgtggtacaaattttaggcagacgaactaagaacaatccctgcttgattggagagcctggtgttggaaagactgcaattgctgaaggacttgctcaacgcatttctacaggcgatgtacctgaaacaatagaagggaaaaaggtcattacccttgacatgggacttcttgttgctggcacaaaataccgtggagaattcgaagaaagattaaagaagctgatggaggaaataaagcaaagtgacgagataatactctttattgatgaagttcacactctgataggagcaggagcagccgaaggtgctatagatgctgctaatatcttgaagcctgcgttggccagaggtgaattacagtgcattggagcgactacacttgatgaatataggaagcacattgagaaagacccagcacttgaacggcggtttcaacctgtgaaagtgccagagccaacagtagatgaaaccattgaaattctcagaggactgagggaacgatatgagatccaccataaacttcgttacactgatgaagctctgattgcagctgcaaagctgtcatatcaatatatcagtgaccgtttcctcccagataaggcaattgacttgattgatgaagcaggttcccgtgttaggctacagcatgcacaggttcctgaggaagcaagagagcttgacaaggagcttaaacaaatcacgaaacagaagaatgaagctgttcgtagccaggatttcgagaaggctggcgaattgcgagaccgtgaaatggaattgaaggcccagataacagccttcattgacaagagcaaggaattgagcaaagcagaggaagagtctggagagacaggacctatggtcaatgaagcagatatccagcacatagtatcgtcatggactggcatccctgtggagaaggtttccagcgatgagtcagataagcttcttaagatggaagagactttgcacacgcgtgtcattggccaagatgaggctgtggtagccattagtcgctccatccgccgtgctcgtgtgggtctcaagaaccccaacaggccaattgcaagctttatttttgcaggtcccaccggcgttgggaagtcagagcttgcaaaggctcttgcagcctattactttggctctgaggaggctatgatccggcttgatatgagtgaattcatggagaggcacacagtatccaagctgattggttcacctccaggatatgtaggatacactgagggtggccagctgacagaggcagttcgacggcggccatacacagttgtgctctttgatgagattgagaaggcacacccggatgtcttcaacatgatgcttcagattttggaagatgggagattgactgacagcaagggaaggactgtggacttcaagaacacactactgatcatgacctcaaatgtagggagcagcgtcatcgagaagggtgggcggaagatcggatttgaccttgactctgatgagaaggacagcagctacagcaggatcaagagcctggtcatcgaggagatgaagcagtacttccgacctgagttcctcaaccgtctcgacgagatgatcgtgttcaggcagctgaccaagctcgaggtcaaggagatcgcggagatcatgctcaaggaggtctttgacaggttgaaggccaaggacataaatcttcaagtgaccgagaagttcaaggagcgggtggtggacgaaggctacaacccaagctatggtgcacgcccgctgaggcgagccatcatgaggctgctggaggacagccttgctgagaagatgctcgctggggaggtaaaggagggcgactctgccatagtggatgtggactcggaagggaaggttgttgtgctcaatggccagggcggcataccggagctctcaactccggcgatcaccgtttagctcgtacatgacagaagatgacaaaatagaagagtttttgtttcaaacacattatcatatatagttagcatataactgtgtatatgtagtggtatagtcaaaggggaaatcgttgctgcctttgaattccttttcaaattcaagtattcttttgtctcaagttaatctgcctggttattgaggtattgtgtacaaagtgatgtgaaaagctcttgtctgtgtacaggcatacataaagatacctaaagtagcacgtaggcagatacatagcacgtaggcatcattccaatagctagaaatatatattcgaaataacgattatcttaa

SEQ ID NO: 3103 - DNA, 3255 bp, Fragaria vesca
gaccacatcctctatcggccgaccatatcagaattctaagaatagggtctctcttcttcagaccctcttctctttctctctctagtcctcctttttgggtggtttaaagtttgcttcttttcgagggttggaggttaatccaggagcgagaagatttaggtgggtatcatggctagggttttggttcactctactaatattcctggtctggttgccgggcaaaggcttggtcaatctaaaggctctggaaatgctagaaggtcaacgaagatgatgtgctctttacgaactcctgctttgagaattagcagtttctcgggactccgtagtgttaatgcgttagatatcatggcgaggcctgggcaagacttatattctaaggtgggagtagctatctcatcccggcgtcgaaaggccagcagatgtgtgcctaaagctatgtttgagcgcttcacggaaaaggcaataaaggttattatgcttgcacaagaggaagcaaggcgacttggtcacaacttcgttggtactgagcagatactcttgggtcttattggtgaaggaactggaattgctgccaaggtccttaaatctatgggaatcaatcttaaagatgcacgcgttgaagtggaaaagatcattggaaggggcagtggctttgttgctgttgaaatcccattcactcctcgtgcaaagcgagttctggaactgtcgctggaggaagctcgccaactaggtcataactatattggatctgagcacttgcttctgggactgcttcgggaaggtgagggtgtggcagctcgtgttcttgagaatttaggtgctgaccccagcaatattcgcacacaggttattcgtatggtgggtgagagcacagaagctgttggtgttggagctggacagggaactagtggcaacaagatgccaactctagaggagtatggaaccaatttgactaagctagcagaggagggaaagctggatcctgttgttggaagacaacctcaaattgaacgcgttgtccaaattttgggcaggcgaacaaagaacaatccctgccttattggagagcctggcgttgggaagactgcaattgcagaaggtcttgctcaacgaattgcaagtggcgatgtgcctgaaacaatagagggaaagaaggttatcactctggatatgggtcttcttgttgctggtactaaataccgtggagagtttgaggaaagattaaagaagctaatggaggaaatcaaacaaagtgatgagataatcttgtttattgatgaggtgcacactctaattggagcaggagcagcagaaggtgcaattgatgctgcaaatatattaaaaccagccctggcaagaggtgaactgcagtgtattggagccaccactcttgatgaatacagaaaacacattgagaaagaccctgcattggaaagacgttttcaacctgttaaagttcctgaaccaactgtggacgaaactatacagattttgcgagggctccgggagcgatatgagattcaccacaaactccggtatactgatgaagctctgatttctgctgcccagctatcataccagtacatcagtgatcgatttctacctgataaagcaatcgacttgattgatgaagctggatctcgagttcgccttcgtcatgcacagctacctgaagaagctagagaacttgacaaggaactgagacagattaccaaggagaagaatgaagctgtacggagccaagactttgaaaaggctggggagttgcgtgacagagaaatggaccttaagacacagatcactgctataacagagaaaggcaaagagatgagcaaggctgagagtgaggcaggggatgtaggacctttggtaaccgaggtggatattcaacatatcgtggcctcttggacaggtattcctgtggacaaagtgtcagctgatgaatccgatcgcctcctcaagatggaagagaccctccatacgcgagttattggtcaggatgaagcagtcaaggctatcagtcgtgctattcgccgagcccgtgttggactcaagaatcctaatcgtccaattgccagtttcatcttttctggtccaactggtgttggaaaatccgaactcgcaaaagctttggctgcatactactttggttctcaagaagccatgatccgtcttgatatgagtgaattcatggaaaggcacactgtttcaaagcttattggttcacctcctggttatgttggttacactgagggaggtcagttgactgaagctgttagacgccgtccttacactgtggtgctttttgatgagattgagaaggctcatccggatgtcttcaacatgatgcttcaaattcttgaggatggaagattgacagacagtaagggcagaactgtagatttcaagaacacacttctgatcatgacttctaatgttggaagcagtgtaattgagaaaggaggccgccgtataggatttgaccttgattacgatgagaaggacagcagttacaatcgcatcaagagcttggtgacagaggagttgaaacagtactttagaccagagttcctaaataggttggatgaaatgatcgtcttccgccagctcacaaagttagaggtgaaggaaatagcagatataatgctgaaggaggtttttgaaaggctgaagactaaagagatagagcttcaagtgacagagaggttcagagatagggtggttgatgaaggatacaatccaagctatggggcaaggcctctaagaagagctataatgagacttctggaggatagcatggctgagaagatgctagcaagggagatcaaagagggtgactccgttattgtggatgtcgattctgatgggaatgtaactgtgctcaatggtaacagtggttctgctggatctttgccagagcctgttcccgtttgaaagctgacagcacgccacttgagctctcctttttcccaatatgtttgtaatttttcatttgaactttctcgttaaaagtagtctgttttcttggtaagttttagtcggtagtggtaattgaaagctgtttattgatgcttgacttgactgatcaaggctgtaccagttatacagaagaatagcatgcatagttcagtcgcagatggtagggttagtatttttttcttttttttccttcttccatagttgcgtttggttggtgggaatgctagtatttagtatttacaataaaagaacataatttgatcattgcatagc

SEQ ID NO: 3104 - DNA, 3397 bp, Panax ginseng
gtactacctatatcctctcaatccggccgaccattattgtaacttggtctctatagcggaagaccttatctccctattttatcttctcctctcttctattaattgtaaatccttctcctcgtctgattcagattacttggtggcactcatggcgagagctttggttcagtcaaccaatttctcttcttctgttactggtgagaggaatggtcaattcaagggatctgggaagacaagaagaacagttatgatgatgtgtactctacaaactgttccaacaaggattagagatttttcgggattacgaggagccaatgctttagacacaatggtaaaatctggccacgatttccattccaaggtggcagctgcgacctctgtccgccgaggaaaagccagccgaattgcaccaaaagctatgtttgagcggttcacagaaaaagctattaaagttattatgcttgcacaagaggaggcaaggcggcttggtcacaattttgttggcactgagcagatattgttgggtctaattggtgagggcactggcatagctgctaaagtgctcaagtcaatgggtatcaacttgaaagatgcgcgcgtggaggtagagaagatcattggtaggggtagtggatttgttgctgtagagattccctttactccacgtgcaaagcgtgttctagaactctcactagaggaagcccgccaacttggtcataattatattggatctgagcacttgttgttggggttgcttcgtgagggtgaaggtgtagcagcacgagttcttgagaatctaggtactgaacctaataatattcgcacacaggttatccgaatggttggtgagagtgtagaagcaggtgccactgttggaggtggaagctctggcaacaaaatgccgacactggaggagtatggtactaatttgacaaagctagcagaggagggtaaactggatcccgttgtaggaaggcagcagcaaattgaacgtgttactcaaattttgggacggcgaacaaaaaataatccctgcctgattggagagcctggtgttgggaaaacagctattgcagaaggccttgctcaaaggattgctactggtgatgttccagaaactatagaggggaagaaggttataactttggatatgggtcttcttgttgctggcacaaaatatcgtggggagtttgaggagcggcttaagaagcttatggaggaaattaaacaaagtgatgaaattatactatttattgacgaggtgcacacattaattggagcaggagcagcagagggtgccattgatgctgcgaacatcttgaaaccagcccttgctagaggcgaattgcagtgtattggggccacaacacttgatgaatacagaaagcacattgagaaagacccggcattggagaggcgatttcagccagttaaggtgcctgaacccacagtggatgaaaccatacagatcctgaaagggctcagagagcgatatgagattcaccacaagcttcgatatactgatgaagccttagtttctgcagcacagctgtcataccagtacatcagtgaccgctttcttcctgataaagcaattgacttaattgatgaagctggttctagggtccgacttcgtcatgcacagctcccagaggaagccagagagcttgaaaaagagcttaggcagataacgaaagagaagaacgaagcagttcgtagccaggattttgaaaaggctggggagttacgtgatagagaaacagatcttaagacacagatatctgctcttgtagacagaaacaaagagatgaccaaggcggagactgaggcaggggatgggggaccccttgtgacagaagtagacattcagcacattgtctcttcgtggacaggcatacctgtcgagaaagtgtcaactgatgaatctgaccgtcttctcaagatggaagagaccctccacacacgaatcattggtcaggatgaagctgtcaaagccatcagccgtgctattcgtcgtgcccgagttggactcaagaatcctaatcggccaattgctagctttatcttttctggtccaactggtgttgggaagtcagagctagcaaaggctttagctgcctactactttggctctgaagaagctatgattcgtctcgatatgagtgaattcatggagagacacacagtctcgaagctcatcggttcacctcctggctacgttggttacaccgagggtggtcagctaactgaggctgtaaggcgccgtccttacacagtggtactatttgatgagattgagaaggctcaccctgatgttttcaacatgatgcttcagattctggaggatggtaggttgacagacagcaaaggtaggactgttgacttcaagaacacgctattgattatgacatcaaatgttggaagtagtgtgattgagaagggaggtcgtcgaataggttttgatctcgattacgatgagaaggatagcagttacaaccgtatcaagagcctggtaactgaggaactaaaacaatatttcagaccagaattcttgaatagattggatgagatgattgtattcaggcagctcaccaagctggaggtgaaagagattgcagatatcatgctcaaagaagtcttcgagaggctgaagggtaaagatattgaacttcaggttacagagaggtttagggatagggtggttgaggaaggatacaacccaagctatggggccaggcctctaagaagagccataatgagactcttggaggacagtatggccgagaagatgcttgccagagaaatcaaagagggtgattcagtaattgttgatgttgattctgatggtaatgtgactgttctaaatggcagcagtggtgcccctcctgagtcattaccagagccaattgccgtatagattaatatttgcttgtccgactattcccccccccccccccccccccccctcccctccccctcccctcccaatatctttgtttgtatggctggttttcattgaattagctacaagtattttttctgtgaagaggctggttgacagtagattagatgccggtctcggtggctgtgttttaaggctgtatctgttacccaggaaggtatgcatacttggatcaatttgtagatgttattaatattagatgtcaagagatatggtaataaaataggacatataaattaaatgtcacttattgatttctgtgacttgatcaataattttagttgtgtatcgatactcggtaaaaaaaaaaaaaaaaaaaacaaaaacaaaacaaaacaaaaaaaaaaaaaaaaaaaaaaaaaaaaaaaaaaacaaacaaacaacaagagagagagagacagagagagacaccccccccccccccccccccccccc

SEQ ID NO: 3105 - DNA, 3286 bp, Malus domestica
agagttttagagagagaaagagcttctcttaagaccacaccttctgtctcttgctctttcggccgaccatatcatactaaaaatagggtctctttcttcctctccgaagaaagaccctctctctctccgtctctcgagaaattccattttttatatttcaattcgaaagtttatccggataacggggttttaggttggaatcatggctacaaatctggttcagtctacttatattcctagtgtggcaatggggagaaggcttggctactctaaaggatctgggaatgctagaaggacagtcatgttgtgtactttacgagcacctgcattgagaatgagcggttacacaggacttcggagtgttaatgctttagatattagtgtaaagccgaggcgagacttattttcttctgtgaaatttgcaaacactaaacggcgtgaacgagctagcagatgtgtgcctaaagccatgtttgagcgcttcacagaaaaagcaattaaagtaattatgcttgcacaagaggaagcaaggcgactaggtcacaattttgttggcacggagcagatacttttgggtcttattggtgaagggactgggattgctgccaaggttctcaagtccatgggaattaatcttaaagatgcacgagttgaagtggagaagataattggaaggggtagtggatttgttgctgttgaaattccattcactcctcgtgcaaagcgagttttggagctgtcactggaggaagctcgccaacttggtcataactatattggatccgaacatttgcttctgggtttgcttcgggagggtgagggtgtagcagctcgtgttcttgagaatttaggtgctgaccctagtaacattcgcacacaggttattcgtatggtcggtgagagcacagaagctgttggtgctggtgttggaggagggaccagtggtaataaaatgccgactctagaagaatatgggaccaatttgactaagctagcagaggagggtaagttggatcctgttgttggaagacaacagcaaattgaacgtgtcgtccaaattttgggtaggaggactaagaataatccctgccttattggagaacctggtgttgggaagactgcaattgcagaaggtcttgctcaacggatttcaactggtgatgttcctgaaacaatagagggaaagaaggttataactctggatatgggtcttcttgttgccggtacaaagtaccgtggagagtttgaggaaagattgaagaagctaatggaggaaatcaaacaaagtgatgagattattttgtttattgatgaggtgcacactttaattggagcaggagcagcagaaggggcaattgatgctgcaaatatattaaaaccggctcttgcaagaggtgaactgcagtgcattggagccacaactctcgatgagtacagaaagcacattgagaaagatccagctttggaaaggcgattccaaccagtcaaagttcctgaaccaaccgtggatgaaaccattcagattttgagagggcttagggagcggtatgagattcaccacaagctccgctacactgatgaagccttggtatctgctgcacagctatcataccagtacatcagtgatcgttttttgcctgataaggcaattgacttggttgatgaagctggttctcgagttcgccttcgtcatgcacagctacctgaagaagccagagggattgagaaagagctgagggcgatcactaaagagaagaacgaggctgttagaagccaagactttgaaaaggcgggggagttacgtgacaaagaaatggacctaaaggcacagatcacagctgttgttgataaaggcaaggagatgagcaaggcagagagtgaggcaggagatgtaggtcctctcgtgactgaagtggatattcaacatattgtgtcctcctggactggaattccagttgagaaagtgtcaaccgatgaatcagaccgcctcctcaagatggaagagaccctccataagcgagttattggtcaggatgaagcagtcaaggctattagtcgtgctattcgccgagcccgtgttggactaaagaatcctaatcgtcctattgccagtttcatcttttctggtcccactggtgttgggaaatctgagctcgctaaagctttggctgcttactactttggttctgaagaagccatgattcggcttgatatgagtgagttcatggaaaggcacactgtttccaagctcattggttctcccccgggttatgttggttacactgagggaggtcagctgactgaagctgttcgacgccgtccttacactgtagtgctttttgatgaaattgagaaggctcatcccgatgtcttcaacatgatgctccaaatactcgaggatggaagattaaccgacagcaagggcagaaccgtggatttcaagaatacacttctgataatgacatctaatgttggaagcagcgtgatcgagaaaggaggccgacgcattggatttgaccttgattatgatgagaaggatagcagttacaatagaattaagagcttggtgacggaggaactaaaacagtacttcagaccagagttcttgaataggttggacgaaatgattgttttccgacaactcaccaagctggaggtgaaggacatagcagatataatgctcaaggaggttttcgagaggttgaagaagaaagagatagagcttcaagtgacagagaggttcagagatagagtggttgacgaaggatacaacccgagctacggagccaggcctctaagaagagctatcatgagactcttggaggacagcatggctgagaagatgcttgcaagggagatcaaagaaggcgactcggtcattgtggatgtcgattctgatggaaacgtgaccgtgctcaacggcagcagcggttctcccgagtccttgccagagccgattcctgtttgaaaagttcacgtagcctcatttcgttggatcttttggcatatgtttgtattttttccatttgcactttgccattgaacgtagtctgatttacggtcgtcggaacggaccagtcggtagcggtaactgaaagctatttgtttagtggttcttcacttgaatgctcaagctgtagcagtatcacagaaaaatagcatctgcatagttcagtttcccaaatatattagggttagactcttctttttacactcgtgtgctgaatacagtgttggtatttataataaaagatttttaacacattcatgtggcttaaccgtgaaa

SEQ ID NO: 3106 - DNA, 3188 bp, Malus domestica
atttatcaatttatagagagagttttagagagagagcgagagagagagagagagagagcttctcttaagaccacacctatctcttcctctttcggccgaccatatcatactaagaatagggtctctctcttcgtctccgaagaaagaccctctctctctcttctctttctctctctataaattccatttttaatatttcaattcgaaagtttatccagataacggggttttaggttggaatcatggcgaggaatctggttcagtctacttatattccaagtgtggcaactgggagaaggcttggctactctaaagggtctgggaatgccagaaggacagtcatgttctgtactttacgagcacctgcattgagaatgagcagttacacaggactccggagtgttaatgctttagatgttagcgtaaaacccaggcatgacttattttctacggtgaaatttgcaaacactaaacgtcgtgaacgagctagcagatgtgtgcctaaagccatgtttgagcgcttcacagaaaaagcaattaaagtaattatgcttgcacaagaggaagcaaggcgactaggtcacaattttgttggtactgagcagatacttttgggtcttattggtgaagggaccggtattgctgccaaggttctcaaatccatgggaatcaatcttaaagatgcacgagttgaagtggaaaagataattggaaggggtagtggatttgttgctgttgaaattccattcactcctcgtgcaaagcgagttttggagctgtcactggaggaagctcgccaacttggtcataactatattggctccgagcatttgcttctgggattgcttcgggagggtgagggtgtagcagctcgtgttcttgagaatttaggtgctgatcctagtaacattcgcacacaggttattcgtatggttggtgagagcacagaagctgttggtgctggtgttggaggagggaccagtggtaataaaatgccgactctagaagaatacgggaccaatttgactaagctagcggaggagggtaagttggatcctgttgttggaagacaaccgcaaattgaacgtgtcgtccaaattttgggtaggaggaccaagaataatccctgccttattggagaacctggtgttgggaagactgcaattgcagaaggtcttgctcaacggattgcaactggtgatgttcctgaaacaatagagggaaagaaggttataactctggatatgggtcttcttgttgctggtacaaagtaccgtggagagtttgaggaaagattaaagaagctaatggaggaaatcaaacaaagtgatgagattattttgtttattgatgaggtgcacactttaattggagcaggagcagctgaaggggcaattgatgccgcaaatatattaaaaccagctcttgcgagaggtgaactgcagtgtattggagccacaactctcgatgaatacagaaagcacattgagaaagatccagccttggaaaggcgattccaaccagtcaaagttcctgaaccaaccgtggatgaaaccattcaaattttgagagggcttagagagcgttacgagattcaccacaagctccgttacactgatgaagccctggtatctgctgcacagctatcataccagtacatcagtgatcgctttctgcctgataaggcaattgacttgattgatgaagccggttctcgagttcgccttcgtcatgcacagctacctgaagaagctagagagcttgagaaagagctgagggcaatcactaaagagaagaacgaggctgttagaagccaagactttgaaaaggctggggagttacgtgacaaagaaatggacctaaaggcacagatcacagctgttgttgataaaggcaaggagatgagcaaggcagagagtgaggcaggagatgtaggtcctctcgtgactgaagtggatattcaacatattgtgtcctcctggactggaattccagttgagaaagtgtccactgatgaatcagaccgcctcctcaagatggaagagaccctccataagcgagtgattggtcaggatgaagcagtcaaggctattagtcgtgctattcgccgagcccgtgttggactgaagaatcctaatcgtcctattgccagtttcatcttttctggtccaactggggttgggaaatctgagctcgctaaagctttggctgcttactactttggttctgaagaagccatgattcggcttgatatgagtgagtttatggagaggcacactgtttccaagctcattggttctcccccgggttatgttggttacacagagggaggtcagctgactgaagccgttcgacgccgtccttacactgtggtgctttttgatgaaattgagaaggctcatcccgatgtcttcaacatgatgcttcaaatactcgaggatggaagattaaccgacagcaagggcagaaccgtggatttcaagaatacacttctgataatgacatctaacgtaggaagcagtgttattgagaagggaggccgacgcataggatttgaccttgattatgatgagaaggatagcagttacaatagaattaagagcttggtgacagaggaactaaaacaatacttcagacccgagttcttgaacaggttggacgaaatgattgttttccgtcaactcaccaagctggaggtaaaggaaatagctgatataatgctcaaggaggtattcgaaaggttgaagaagaaggagatagagcttcaagtgacggagaggttcagagacagagtggttgacgaaggatacaacccgagctacggagccaggcctctaagaagagcgatcatgagactgttggaggacagcatggctgagaagatgcttgcaagggagatcaaagaaggcgactcggtcattgtggacgtcgattctgatgggaacgtgaccgtgctaaacggcagcagcggtgctcccgagtctttgccggagccgattcccgtttgaaaagctaacgtaggcgcatttcgttgatctgttggcaatatatttgtatctttttttcatttgcactttgccattgaacgtagtctgttttaatgtcgaaaaggacttggtcggtagcggcaattgaaagctgtttgtttaatggttcttcacttgaatgttcaaggctgtaccagttca

SEQ ID NO: 3107 - DNA, 3131 bp, Artemisia annua
gagttattaagttggaatcatggcgggggctttggtgcaatccaccagctttccctcagcggtgtctggtgaaagcaaggtccgttcaaagcaatctggtaataacaaacgagcagtcaagatgatgtacagtttacaagctcctccaatgagggtgaatacgttctctggtttgcgtggagtcaatgctttagacaacttggtaaacagaggccaggatttccactcaaaggttgcagccgccacctcagttcggaaagcaaagccgtctcgtattgtgcctaaagccatgtttgaacgcttcacagagaaggctattaaagttattatgcttgcacaagaagaggcaagacggcttggtcacaatttcgtcggtacagagcagattttattgggtcttatcggtgagggtactggtattgcagcaaaggtgttgaaatcaatgggaattaatttgaaagatgcacgtgttgaggtagagaaaatcattggtaggggtagcggatttgttgcagttgagattccattcactcctcgtgcaaagcgcgtacttgaactgtcactagaggaggcccggcagctaggtcataattatattggatcagagcacttgcttcttggtttgcttcgtgagggtgaaggtgtagcagctcgtgttcttgagaatctcggtgctgacccaaataacattcgcacacaggtgatcagaatggttggcgagagtgcagaagctgtaggcgctggagttggtggtgggacctctggtaacaaaatgccaacattagaggaatatggtaccaacttgacaaagctagcagaggagggtaagttggatcctgttgttggaagacagccacaaattgaaagagttactcaaattcttggacgtcgtacaaaaaacaacccctgtctcattggagaacctggtgttggaaaaactgctattgcagaaggcctagctcaaagaattgcgactggtgatgttccagaaacaattgaggggaagaaggtgattactctcgatatgggtctacttgttgcgggcacaaagtaccgtggagagttcgaggagagactaaagaagctgatggaagaaatcaagcagagtgatgaaataatcctctttatcgacgaggtccatactttaatcggggcaggagctgcagagggggctattgatgctgctaacatcttgaagcctgctcttgctagaggcgaattacagtgtattggggcaacaacccttgatgagtacaggaagcatattgagaaggacccggccctcgagagacgtttccagcctgtaaaggtacctgagccaacagtcgatgagaccatacaaatcttgaaggggctccgagaaagatacgagattcaccacaagctccgttacaccgatgaagcactggtagctgctgcccagttgtcatatcaatacattagtgaccgttttctacctgataaagctattgatttaatcgatgaagctggttctcgtgttagacttcgtcatgctcaactcccagaagaagccagagagcttgagaaagagcttaggcagataactaaagagaagaatgaagcagttcggggccaggactttgaaaaggctggtgagttacgagaccgtgaaatggatctcaagacacagatatcagctcttgtagataagaacaaagagatgagcaaggccgaaacagaagcaggagaggaaggccccactgtaaccgaagctgacattcagcacatcgtctcgtcttggaccggcataccagttgagaaagtctcaacagatgaatctgaccgtctcctcaagatggaagagacacttcacacacgaattgtcggtcaagatgaagccgtcaaagccattagtcgcgccattcgtcgtgcccgtgtaggactgaaaaaccccaaccggcccatcgccagtttcatcttctctggaccaactggtgtcgggaaatctgaactcgctaaagctttagccgcttactacttcggctcagaagaagccatgattcggctcgatatgagtgagttcatggagagacacactgtctcaaagctcattggttcaccacccggttacgttggttacaccgaaggtggtcagttaactgaggctgttcgtcgtcgcccatacaccgtcgtcctatttgacgaaattgagaaggctcaccctgatgtattcaacatgatgcttcaaatcttagaagacggtaggttgactgacagtaaaggtagaactgttgacttcaagaacacgcttcttatcatgacttcaaatgtcggaagtagcgtaattgaaaaaggtggacgcagaatcgggtttgaccttgactacgacgaaaaggacagcagctacaacagaatcaagagtctagtcacagaggaactgaaacaatatttcaggcctgaattcttgaacagattagacgagatgatcgtgttcagacagttaacgaaactcgaagtcaaagaaatcgctgatataatgttgaaggaagttttcgagaggttaaaggttaaagacatcgagcttcaagtaactgagaggttcagggatcgtgttgtggaggaaggttacaatcctagctatggtgcaaggccattaaggcgtgcgatcatgaggttattggaagacagcatggcagagaagatgcttgcacgtgagatcaaggaaggcgattcagtcattgttgacgttgatgctgatggcaacgtcactgttctcaatggtagcagtggagctccacctgaggcattgccagaaccgatctctgtgtagatgagggcagtctctgatctctaaactcaaaaccatatagtatgttgtttgtactgtgatgcttttcatttagtaattgtcatgtataaaacatataacactgtctacttattgaggcattgagcgtaggatcctgcccaatgaattcgcatgcacagtccagccactagaaagggtcatagatgttgcagaattttttcacaaataatacttaaactgatccttccaggtgttttttctttttctattaattttaatgtatatttattatggaacaagtactgtcgtttcggtgtatattttttcaatgatggcgtatgaaaactaaagaatttttagc

SEQ ID NO: 3108 - DNA, 3473 bp, Prunus mume
gccataatctcacactttagacgacgtgtcgtaatatattgccgttgatcaatcgcggatgtaggcagcggtgtcgtgtagcttatcatgtacgggacggtgcatgaacggtgatggagcctcatatggaagagaaaagggtaagagatatatttatcgatttatcgatttatagagaaacagcgagaaagaaagagagagagagagagagcttctcttaagaccacacctatctcttcctcttcggccgaccatagaatactaagaatagggtctctctcttctctctgaagaaagaccctgtctctctttctgaaaatttcattttatttaattgaaagtttatccaaataaggggttttagactgctaagttatcatggctagagttctggttcagtcaactaatattcctggtgtggttgctgggagaaggcttagtcaatctaaaggatcgggaaatgccaaaaggacagtcaagatgtgttgtactttacgagcacctggattgagaataagcagtttctcaggactccgtagtgttaatgctttagatattatggcgaaacctgggcaagacttttattccaagatgggagttgcaatcacttcccggcgtcgaaaggctagcagatgtgtgcctaaagccatgtttgagcgcttcacagaaaaggcaattaaagtaattatgcttgcacaagaggaagcaaggcgacttggtcacaattttgttggcacagagcagatacttttgggtcttattggtgaaggaactggtattgctgccaaggttcttaagtccatgggaattaatcttaaagatgcacgtgttgaagtggagaagataattggaaggggtagtggatttgttgctgttgaaattccattcactcctcgtgcgaagcgagttttggagctgtcactggaggaagctcgccaacttggccataactatattggatccgagcacttgcttctgggcttacttcgggagggtgagggtgtagcagctcgtgttcttgagaatttaggtgctgaccctagtaacattcgcacacaggttatccgtatggtgggtgagagcacagaggctgttggtgccggtgttggaggaggaagcagtggtaataagatgccgactctagaagaatatgggaccaatttaactaagctagcagaggagggtaagttggatcccgttgttggaagacaaccacaaatcgaacgtgttgtgcaaattttgggtaggcggactaagaataatccctgccttattggagaacctggtgttgggaagactgcaattgcagaaggccttgctcaacggattgcaactggtgatgttcctgaaaccatagagggaaagaaggttataacactggatatgggtcttcttgttgctggtacaaagtaccgtggagagtttgaggaaagattaaagaagctcatggaggaaattaaacaaagtgacgagataattttgtttattgatgaggtgcacactttaattggagcgggagcagcagaaggggcaattgatgccgcaaatatattaaaaccggctcttgcaagaggtgaactgcagtgcattggtgccacaactctcgatgaatacagaaagcacatagagaaagatccagccttggaaaggcgtttccagccagtcaaagttcctgaaccaactgtggatgaaaccattcagattttgagaggacttcgagagcgatacgagattcaccacaagctccgctacactgatgaagccctggtatctgctgcacagctatcataccagtatatcagtgatcgctttctgcctgataaagcaattgacttgattgatgaagctggttctcgagttcgtcttcgtcatgcacagctacctgaagaagctagagagcttgagaaagaacggaggctgatcactaaggagaaggatgaggctgttagaagccaagactttgaaaaggctggggaattacgtgacagagaaaaggacctttcggcacagatctcagctgttgttgataaaggcaaggagatgagtaaggcagagagtgaggcaggagatgtaggtcctctcgtgactgaagtggatattcaacatattgtgtcctcctggactggcattccagtggagaaggtgtcaactgatgaatcggaccgcctcctcaagatggaagagaccctccatacgcgagtcattggtcaggatgaagcagtcaaggctattagtcgtgctattcgccgtgctcgtgttggactgaagaatcctaatcgtcctattgccagtttcatcttttctggtccaactggtgttgggaaatctgagctcgcaaaagctttggctgcttactactttggttctgaagaagccatgattcggcttgatatgagtgagttcatggaaaggcacactgtttccaagctcattggttctcccccaggttatgttggttacactgagggaggtcagctgactgaagccgttcgacgacgtccttacactgtggtgctttttgatgagattgagaaggctcatcccgatgtcttcaacatgatgcttcaaatacttgaggatggaagattgactgacagcaagggcagaactgtggatttcaagaatacacttctgataatgacgtctaatgttggaagcagtgtaattgagaaaggaggccgtcgtataggatttgaccttgattacgatgagaaggatagcagttacaatagaattaagagcttggtgacagaggaactaaaacagtactttagaccagagttcttgaataggttggatgaaatgattgtcttccgacaactcactaagctggaggtaaaggaaatagcagatataatgctgaaggaggtttttgagaggttgagggttaaagagatagagcttcaagtgacagagaggtttagagatagagtggttgacgaaggatacaacccaagttatggagcaaggcctctaagaagagccataatgagacttttggaggacagcatggctgagaagatgcttgcaagggagatcaaagaaggcgactcggttatcgtggatgtcgattctgatggcaatgtgactgtgctcaatggtagcagtggttctcctgagtctttgcccgaggcaatccctgtttgaaagttaacatagccgcttttgttaatcttttgccaatatgtttgtatttttttcatttgcgctttgcaattgaacagtctgtggactagttggtagcggtaattgaaagctgtttgtttaatggttgacttgactgttcaaggctgtaccagtttatacagaagaatagcatgcatagttcagtcacaaatggtagggttagtacttttttcttttagacccctcctgtggtggaattagtgttgggaatgctagtatttctaataaagaattttaacacattcatgttgtttaactctctaattttatccttgggttgttcttaa

SEQ ID NO: 3109 - DNA, 3037 bp, Silene vulgaris
acctcagattaacctgtgtgcttcatggccggggctttacttcaatccactaatatccctgctacatttgcctatcaaagaaatggacaatttccaagatcgggaaagagtagaaaagctgtaaaaatgatggccacccttcaagcacctgggtatcagataaatagtttctcgggtttgcgtggtagtaagtctttggataccttgggatctactaatgattgtttttataccaaaatgagggcagttttatctgtacgaagagggacagccagccgaggtgtggttagagcaatgtttgaacgtttcactgagaaagctattaaagtaatcatgcttgctcaagaggaggctagacggttaggacataattttgtcggcaccgagcaaattctattgggtcttattggtgaaggcacaggtatagctgctaaggttctgaaatcaatgggaattaatctcaaagatgcccgtgtagaagttgagaaaataattggaagaggtagtggttttgttgctgttgagattccgttcactcctcgtgcgaagcgtgtgttggaactttcattggaggaagctcgccaacttggtcacaactatattggatctgaacacttgcttctgggacttcttcgtgagggtgagggagtggctgctcgcgttctagagaacttgggcgctgatccaagtaacattcgaacacaggttattcgtatggtgggtgagaacacagaaactgttggcgctggcgttggtggaggcaccagcggaaataagactcccaccttggaggagtatggaacaaatctgacaaagcttgcagaagaggggaaattggatcctgttgttggaaggcagccgcagattgagcgtgtaacccagatccttggtagaagaacaaagaacaacccttgtcttattggtgagccaggagttggcaaaacagctattgccgagggacttgcacaaagaatagcaactggcgatgttcctgaaacaatcgagggaaagaaggttataaccctcgatatgggtcttctggttgctggaacgaaataccgtggagagtttgaggaaagactgaagaagttgatggaggaaatcaagcagagtgatgatatcatcctttttattgatgaggtacacactttgattggggcaggggcggcagaaggagcgattgatgctgccaacattttaaaacccgctctcgcaagaggtgaattacagtgcattggagccaccacccttgatgaatacaggaaacatattgagaaagatcctgcactagagagaaggtttcagcctgtgaaggtgccggaaccaacagtagatgaaaccatacaaattctgaaagggcttcgtgaacgctatgagatacatcataagcttcgctacactgacgattccctggaggcagcagcacggctttcttaccagtatatcagtgaccgtttcctgcctgataaagctatagatcttattgatgaagctggttctcgggttagattgcgccatgcacagctgcctgaagaagccagggagcttgaaaaagaactccgacaaattacaaaggaaaagaatgactctgtccggggccaagactttgagaaggccggagagttgcgtgaccgagaaatggacctcaaggcccaaataaccgctatgatcgagaaaaacaaggaaatgagcaaggccgaaacggaagctggtgatgtggggcctgtcgtgacagaagtggacattcagcatattgtcgcttcttggactggcattcctgttgacaaagtgtctgctgacgaatctgaccgtctccttaaaatggaggacacacttcacaccagaattatcggtcaagatgaggctgtaaaagccattagtcgtgccattcgtcgtgctcgtgtaggtctcaagaatccaaaccgtcctatcgctagctttatattctctggcccaactggtgttgggaaatccgagcttgcaaaagcgttagctgcctactactttggatctgaagaagccatgatccggcttgatatgagtgagtttatggagagacacaccgtctccaagttaatcgggtcacctccaggttacgtgggttacaccgagggtggtcaattaacagaggccgttaggcgtcggccttacacggtggtgctcttcgatgaaatcgagaaggcccatcccgatgttttcaacatgatgcttcaaatactcgaagatgggaggttgaccgatagcaaaggccgaacggttgactttaagaacaccctcctaattatgacatcaaatgtcggaagcagcgttattgagaaaggtgggcgtaagatagggttcgacctagactacgacgagaaggatagcagttacaacagaataaagagcctggtgacagaggagttgaagcagtacttccggcccgagttcttgaatagattggatgagatgattgtgttcaggcagcttacaaaattagaggtgaaggagattgcagatataatgttgaaagaagtttttgagaggttgaagtccaaagagattgatctccaagtaaccgagagattcagagaccgagtggtggacgagggttacaacccgagctatggggctcggcctttgagacgggccattatgagacttcttgaggacagcatggccgagaaaatgctctcgcgcgaaataaaagagggagactctgtgattgtggatgtcgactcagatgggaacactattgttctcaacggcagtaccggtgcgcctcccgaatccttgcctgaggttatcacagtctaatactccataaccttgggagtttaattagtagattaaaaattaaattaaatggtacttgtatcatgaatagttaaacttttcacatatattgtaataattgcatggagtagtaaataacacaaattcatctctatcccttgattttaattacattttcctttcttaaacaaaattgtcgattgaaattagacggggatataaaaggcgttatgtacatatcttactcaattgcttcatttgc

SEQ ID NO: 3110 - DNA, 3147 bp, Ambrosia trifida
ctttctccggattagagtcccctgaaccggattcaattgcgtgtacaaatattattcaatgccttgctagtttataatacaacataataataataataacatagattcacctcctgtttgttatcatcctcatcatcatccacatctcttcaattgttctttgtgttagaattatctggttgcaatcatggcaggggctttagtacaatctacgagctttccgtctgcggtttcgagtgaaagcaaagtccgttcaaagcgatctggtaatacaaaaagagcagtcaagatgatgtgtggtttacaagctcctccaatgagggtgaggactttttctggtttgcggggagccaatgctttagacaacctggtccaaagaggccaggatttccactcaaaagttgcagctgccacctcagttcgaaaagcaaagccatctagaattgtaccaaaggccatgtttgaacgcttcactgagaaggcgattaaagtaatcatgcttgcacaagaggaagcgagaaggcttggccacaactttgtgggtacagagcagattttgttaggtcttattggtgagggcaccggcattgcggcaaaggtcttgaagtcgatgggaattaatttgaaagatgcacgtgttgaggtggaaaaaattattggtagggggagtggatttgttgctgtagagattccatttactccccgtgccaaacgtgtactggaactctcgctagaggaggcccgacaacttggccataattatattggatcagagcatttgcttcttggtttgcttagagagggtgaaggtgtagcagcccgtgttcttgagaacttaggcgccgacccaaataacattcgtacacaggtgatcagaatggttggcgagagcgcagaagccgtaggtgctggagttggtggtgggacctctggtaacaagatgccaacactcgaggaatatggtaccaacttaacgaagctagcagaggagggtaagctggatccagttgttggacggcagccacaaattgaaagagttactcaaattcttggacgccgtaccaaaaacaatccttgtttgattggagaacctggtgttggaagactgctattgcagaaggccttgcgcaaagaatcgctaatggtgatgttccgggaaacaatcgaggggaagaaagtgataactctggatatgggtctgcttgttgctggcacaaagtaccgtggggagtttgaagagagactaaagaagctgatggaggaaatcaagcaaagtgatgaaattattctctttattgatgaggtccacacgttaattggagcgggagcagcagagggagctattgatgctgctaacatcttgaaacctgcgcttgctcgaggtgaattacagtgtattggggccacaacccttgatgagtaccgaaagcatattgagaaggacccagcgctggagagacggttccagcccgtgaaggtacctgagcccacagttgatgaaactatacagatcttaagggggcttcgagagcgatatgaaattcaccacaaactccgttacaccgatgatgcactggtagctgctgcccagctgtcgtatcagtacataagtgaccgttttctgcctgataaagctattgatttaatcgatgaagccggttctcgtgttagacttcgtcatgcacaactcccagaagaagctagagagcttgagaaagaacttaggcagataacaaaagaaaagaatgaagcagtcctggccaagacttcgaaaaggctggagagttgcgtgatcgggaaatggatcttaaaactcagatctccgctcttgtagacaagaacaaagagatgagcaaagctgagaccgaggcgggagaagagggtcccactgtaactgaagcggacattcagcacatcgtctcatcatggactggcataccggtcgaaaaagtgtctacagacgaatcagaccgccttctcaaaatggaggaaacactccacacacggatcattggccaagatgaagcagttaaagccattagccgtgccatccgccgtgctcgtgtaggactccaaaaacccaaaccgccccatcgccagtttcatctttcgggacccactggtgttggtaatctgaactcgcgaaagctttagctgcttactacttcggctcggaagaagccatgatccggctggacatgagtgagtttatggagcgacacacagtctcaaagctcattggttcccctcctggttatgtcggctacacagaaggtggccagttgaccgaggcggtccgccgccgcccttacaccgtggttctatttgacgaaattgaaaaagcccaccctgatgtcttcaacatgatgcttcaaatcctgaagatggaaggttgaccgacagcaaaggacgaaccgtagacttcaagaacacacttctaatcatgacttcaaatgtgggtagcagtgtaatcgaaaaaggtggacggagaattgggtttgacctcgactatgacgagaaagacagcagctacaacagaatcaagagcctggtgaccgaagaactaaaacaatatttccggcccgaattcttgaacaggttagacgagatgatcgtgttccgacagttgaccaaactggaagtcaaagaaatcgctgacataatgttgaaggaagttttcgagaggctaaaaggtaaagaaattgaacttcaagtgacggagaggtttagggaccgtgtggttgaggaaggctacaaccctagctacggtgcaaggcctttaagacgggcaatcatgaggctgttggaagacagcatggcggaaaagatgctcgcacgcgacatcaaggagggcgattctgtaattgtcgatgttgactcggatggcaatgtgaccgtcctcaatggtagcagtggcgccccaccagaggcattgccggagccgatctctgtgtagacaaagggtagtcagtcattgatattatgtatgttgtttgtatactgtgcttgctttgccttaaatcttttcatataaaagaacatataacactgccttgtggaagtgaatatgaattgcatgcacagtccaaccaagtcacagggtcaatagatgttgcagatttttttcaataataaaagatacttgta

SEQ ID NO: 3111 - DNA, 3064 bp, Mimulus guttatus
cagatttcttggaggcagatatggcgcgcgctttagtccaatcaacgaatttgccctcttcagtcagctgggcaaacaactgccctttcgagggatcaaacaaaacgaaagcgggccccacaatgctctgcaattctctggcaacttccgcgagaatgaggagcttctcaggtcttcgtggggccaactccattgacatgatgctgcagaaaaatatccaaactctccaatcgaaggtatcagtcagcagacgaggcaagaaaatacgaacgggcgcacgagccatgttcgagcggttcacggagaaggctataaaggtcattatgctcgcccaagaggaggcgagaaggctcggacataattttgtcgggaccgagcagatcttgctgggacttatcggtgaaggcactggaattgctgctaaggtgctaaagtcgatgggaatcaatctgaaagatgctcgtgttgaggtggagaaaataatcggtcgtggtagtggttttgttgctgttgagattccatttactcctcgtgcgaaacgggttttggagctctcgttggaggaagcccgccagcttggccacaattatattggatcggagcatttgcttctgggattgcttcgcgaaggtgaaggagtggcggctcgtgtgctcgagaatttaggtgctgagcccagtaatattcgaactcaggttataagaatggtgggtgagagtgccgaggcagttggtgctggtgttggagggggaagctccggcactaaaatgccaacactggaggagtatggtaccaatttgaccaagctagcagaggagggtaagctagaccctgtcgttggaaggcaagctcaaatcgaacgtgtgactcaaattcttggaaggcgtactaaaaataacccttgcctcattggagaacctggagtcggtaaaacagccattgcagagggtcttgctcagagaatagccaatggggatgtcccggaaactattgagggcaaaaaggttataactttggatatgggacttctcgttgctggtacaaagtatcgtggtgaatttgaagaaagattgaagaaattgatggaggaaattaaacagagcgatgaaattattctattcatcgatgaggtgcacactttgatcggagctggagctgctgaaggtgccattgatgctgctaatatcttgaagcccgccttagctcgtggtgaacttcagtgtattggagcctacactagacgagtacagaaagcatatagaaaaggatccagcgctcgagagaaggttccaacccgtaaaagtaccggagcccactgtggatgaaaccattcagattctgaaaggtcttagagagagatacgagattcatcacaagcttcgttacaccgatgaagctttagttgccgctgctcagttatcctatcagtatatcagtgaccgatttttgcctgataaagcaattgacttggtcgatgaagctggctctcgagtccgacttcgtcatgcacagctacccgaggaagctagagagctcgaaaaagagctgaggcagataaccaaggagaagaacgaagctgtccgaggacaagactttgagaaggctggggaactacgcgacagagaaatggacctcaaggcccaaatctccaccctgatcgacaaaaacaaagagatgtccaaagccgaaacggaagccggcgacgtaggcccggtcgtaactgaagtcgacatccagcacatcgtatcctcatggaccggcatcccggtggataaggtctccaccgacgaatccgaccgcctcctcaagatggaagacaccctccacacccgcatcatcggccaagacgaagccgtaaaagccatctcccgggccatccgccgggcccgtgtgggcctcaagaaccccaaccgcccaatcgccagcttcatcttctcgggccccacgggtgtcggcaaatccgagctggcgaaagccctcgccacctactacttcggctccgaggaggccatgatccgattggacatgagtgagttcatggagaggcacactgtatcaaaactcatcggatcgccgcccgggtacgtcggctacacagagggcgggcagctgaccgaggcggtccgtcgccgcccgtacacggtcgtcctctttgacgagatcgaaaaggcccacccggacgttttcaacatgatgctccaaatcttagaagacggaaggttgaccgacagtaaaggccgtacggttgacttcaagaacacgctgttgatcatgacctcaaacgtcgggagttcggtgattgaaaagggtggccgtaggatcgggttcgatctcgactacgacgagaaggacagcagctacaacaggatcaagagcctggtcaccgaagagttgaagcaatacttccgccccgagttcttgaacaggctcgacgaaatgattgtcttcaggcagttgaccaagctcgaagtcaaggagatagccgatattatgctcaaggaggttttcgagaggctcaaggtgaaggagatcgagcttcaagttaccgagaggtttagggatagggttgtggacgaagggtacaaccctagctacggagctcgacctctgaggagggctattatgaggctcttggaggatagcatggccgaaaaaatgcttgcgcgcgagattaaagaaggtgattcggttatcgtggacgttgattccgatgggaaggtgattgttctgaacggaagcagtggggcccctccggaaacttctactcccgaagaggtggtggtgtagggaatatttgggttttcggctttggagtcgagtgtgttgtttgtatcatctgtatctgccagctgtgtttttcggttcggggtggggtttcgaagattttaatggctgctttgctccgtctcgaaaggattatgtagcttttctagatatttattatctactgtactgaaactttatacaaacattgtagtattgtcttttttttttacactaagaatatttatggtaataatggggatgttaattatggtgagtggtgtctgagttgtttttattt

SEQ ID NO: 3112 - DNA, 3237 bp, Triphysaria pusilla
cgtttaagaaagcagacacgttgtagcgtgtaagatagataaatccaaaagcaaaggcaaattattatcatccacatctatctagatatatatctatattcgccatttccgtctaaagaaatccggccgagcatttgaggacctctctcaaaatctcgcagagacactattttccgtatacttgtatctcatttagaccccttgaaggcagacatgtcacacgctctgcttcaatcgaccactttgccctcttcagttggtttggcaaataatggaaaggtcaagggctctaataaaacaagaaacacagcaacaatgttgtccagcacgcaatcagctcccatgaggatgagaggcttctcaggattgcggggagctaatgcattagacttcttggtgtcccaaaatcgtcagacgctccaatcgaaggtagaagcggcaaccagtcccatgaaacgaggacgaaaaacacgcatggccccacgagccatgtttgagcggtttacagagaaagcaataaaagtcattatgcttgcacaagaggaggcgaggcgactgggccataattttgttgggactgagcagattttattgggtcttataggtgaaggcactggaattgccgctaaggtcctcaagtccatgggtataaatctgaaagatgcccgtgtagaggtggagaaaattattggacggggcagtggatttgttgctgtggagataccctttactcctcgtgctaaacgtgttctagaactctctctggaggaagcccgccagctaggtcacaattacattggatcggagcacttgctgctaggattgcttcgtgagggtgaaggggtggctgcacgtgttcttgagaatttaggtgccgaccccagtaatattcgaactcaggttattagaatggtcggtgagagtgctgaggctgttggtgctggtgttggaggtggaagctcaggcaacaaaatgcccactttggaagagtatggtaccaatttgaccaagctagcggaagagggtaaactagatcctgttgtgggaagacaggctcaaattgaacgcgtcactcaaattttgggacgtcgcacgaaaaataatccttgcctcataggagagcctggtgttggaaaaacagctattgccgagggtcttgctcaaagaatagccaacggagatgttccagaaactatcgaggggaaaaaggttataactctggatatgggtcttcttgttgctgggacaaagtatcgtggtgaattcgaagaaagattgaagaagttgatggaagagattaagcaaagtgatgaaattatactgttcattgatgaagtacacacgttgattggagcaggagctgctgaaggtgcaattgatgctgcaaacatcttgaagcctgcattagctcggggtgaactgcagtgtattggggctaccacactagatgaataccgaaagcacatcgagaaggatccagcactcgaaagaaggtttcaacctgtcaaggtccctgaacccacagtagatgaaacaattcagattcttaaagggctccgagaacgctatgagatacatcacaagcttcgctacactgatgagtctttagttgctgcagctcagttgtcttatcaatatatcagtgaccgttttttgcctgataaggcaatcgacttggtcgacgaagctggttcccgtgttcgacttcgtcatgcacagctccctgaagaggccagagagcttgaaaaagagctcaggcagataacaaaggagaagaacgaagctgtccgaggtcaagactttgagaaggctggggagctacgtgatagagaaatggatctcaaggcacaaatgtctgctctcatagacaaaaacaaagagatgagcaaagccgaaagtgaggctggggatataggtcccgtcgtcaccgaagtcgacattcagcacatcgtttcttcttggacaggcatccccgtcgataaggtctcggctgatgaatctgatcgtctcctcaagatggaggagacactacacacgagggtcgttggtcaagacgaagctgtcaaagccattagccgagccatccgccgtgcccgtgttggtctcaaaaaccccaaccgccccattgccagcttcatcttttctggccccacaggtgtcggaaaatcagagctagcgaaagctctggccgcctactatttcggatccgaagaggccatgatccgactcgacatgagtgagttcatggagagacacacagtatcgaagctcatcggatcgccacctggatacgtcggttacactgaaggtggacagctgaccgaggctgttagacgtcgtccttacaccgtcgtgcttttcgacgagatcgaaaaagctcacccggatgtcttcaacatgatgcttcagattctcgaagacggaaggttgaccgacagcaaaggtagaaccgtcgacttcaagaacacgcttctcataatgacttcgaacgttgggagcagcgtgatcgagaagggtggtcgccggatcggtttcgatcttgattacgatgagaaggacagcagctacaaccggatcaagagccttgtgagcgaggagcttaaacagtatttcaggcccgaattcttgaacagattggacgagatgatcgtgttcagacagctcacgaagctggaggtgaaggagatagccgacattatgttgaaggaagtgtttgagcgattgaaggtgaaggaaatcgaactccaggtgacagagaggtttagagacagagtggtcgacgaaggatataacccgagctatggagcaagacctctcagacgagcgattatgaggcttttggaggatagcatggccgagaagatgctagcacgtgaaattaaagaaggggattcggttattgttgatgtcgattccgatgggaatgtgatggttcttaatggtgccagtgggacccctccggaaccgtctcctgaaccattgacggtgtaaatttagccgtttggttggttcggacctggcctgcagttggacttggcaggcagtaggctcagaagctattctgccacttggtgatttataggctctattttctgaaaaagttcctagaatatatttatgtacttgagctatatatgctcgttgtaattttctttgctaggaagaaggtgatacagttggaacgtttagagagccttgtttattgtattgtaaaaatgctgataactcttgtttaat

SEQ ID NO: 3113 - DNA, 3460 bp, Lactuca sativa
gccaataaaaagctacctaccaaagggcataaccggtacatgaaaaagatatgatccgtaatccaacggcccgtcacgtagcaaattcaagacacctccgtgacgatagcaaactatatgacctttattttcgttttgcactagatgacgctctatcgaacccaatggagtagcgtgtccaaacaacatcgtgaagaagatattgtctttcttcctatataaactcaccgcctgctatcatccacatctcttcattcagccggacctttcgctgaggtccctttaaagaatcttgtaggttccaaaaccaatttgttcttctgttcatcttaactcgactcctgtgattcaggtgatttgattataatcatggcgggggctctggttcaatccaccagctttccttcaacggttgctggagatcgtaaggtccgttcgaagagatctggtaatacaaaaggagaaatcaagatgatgtatagcgtacaaactcctcacatgagtgtaaggtctttctctggtttgagaggaaccaatgctttagacaacttggtaaaaaggggtcaagatttccattcaaaggttgcagctgccacctctgttcggaaagcaaagccttctcgaattgtgccaaaagccatgtttgagcgcttcactgagaaagctatcaaagttattatgcttgcacaagaggaggctagacgacttggtcacaactttgtgggaactgagcagatcttattaggtcttattggtgagggcactggtattgctgcaaaggtgttgaaatcaatggggattaatttgaaagatgctcgtgttgaggtagagaagattatcggtagaggaagtggatttgttgctgtagaaatcccatttacgcctcgtgcaaagcgtgttttggagctttcattggaggaggcgcgtcaacttgggcataattatattggatctgagcacttgcttcttggtttgcttcgtgagggtgaaggagtagcagctcgtgttcttgagaatttaggtgcagacccgaataacattcgcacacaggttatcagaatggttggtgagagtgcagaagctgtgggtgctggagttggtggtgggagctccaacaacaagatgccgacacttgaggaatatggcaccaacttgacaaaactagcagaggagggtaagttggatcctgttgtgggaagacaaccacaaatcgaaagagttacacagattttgggcaggcgtactaaaaacaatccctgtcttattggagaacctggtgttgggaaaacagctattgcagaaggccttgcccaaagaattgcaaatggtgatgttccagaaacaatagaggggaagaaggtgataactctagacatgggtcttcttgtggctggaacaaagtatcgtggggagtttgaggagagattaaagaagttaatggaggaaattaaacaaagtgatgaaattattctatttatcgatgaggttcatacactaattggagctggagcagcagagggggctattgatgctgctaacattttgaagcctgctcttgctagaggtgaattgcagtgtattggtgcaacaacacttgatgaataccggaagcatattgagaaggaccctgcattggagagacgattccagccagtaaaggtaccagagccaacagttgatgaaacaattcagatcttaaagggtcttcgtgagcgatatgagatccaccataagcttcgctacaccgatgaagcattagttgctgctgcacagttatcatatcagtacataagtgatcgttttcttcccgataaagcaattgatttggtcgatgaagccgggtctcgtgttcgtctacgtcacgcacaactcccagaggaagcccgagagcttgagaaagagcttagacagataaccaaagaaaagaatgaagcagttcgtggccaagattttgagaaggccggggagttgcgggatagagaaatggatctcaagacccaaatatcagcactcgtggataaaaacaaagagatgagcaaagcagaaaccgaagcaggggaggaaggcccaattgtaacagaggtcgacattcagcacatcgtatcttcctggaccggcatcccagtggacaaagtctcaaccgacgaatccgaacgcctcctcaaaatggaagaaacccttcacaaaagaatcatcggtcaagacgaagcagtcgtagccataagccgagccatccgccgagcccgtgtcggtctaaaaaaccccaaccgccccatcgccagtttcatcttctcgggtcccacgggtgtcggtaaatccgaactcgctaaagccttagccgcatactacttcggctcagaagaagccatgattcgtctcgacatgagtgagttcatggaacgccacaccgtctcaaagctcatcggttcaccgcccggttacgttggctacaccgaaggcggtcagttaaccgaagcggttcgccgccgcccctacaccgtcgtcctcttcgacgaaatcgaaaaagcgcatcccgatgtcttcaacatgatgcttcagatcctcgaagacggacgtttgaccgatagcaaaggccggacagttgactttaaaaacacgcttttgatcatgacttcaaatgtcggaagtagtgtgattgaaaagggagggagaagaatcgggtttgaccttgactatgatgaaaaggatagcagttacaacagaatcaaaagtttggtcaccgaggagctaaaacagtatttccgacccgagtttttgaacaggttagacgaaatgattgttttcaggcaactaacgaagctcgaagtgaaggaaattgcggatataatgttgaaggaagttttcgagaggctaaaagtgaaggaaattgagcttcaggtgactgaaaggtttagagacagggtggttgaggaaggatataatccgagttatggtgcgagacccttaaggagagctatcatgaggctactggaagacagcatggccgagaagatgttggcacgggaaatcaaggaaggtgattcggtcattgtggatgttgattccgatggtaatgtgacggttcttaatggcggcaccggagcggctccaccaccggaggctttgccggaggcgattggagtgtagagtgtagactcgagactccccggagatatgttgtttgtttgtgtattgttatatggtgtgattaaatatctcacacgatgaatttgcatatccgttggttggatcagatgtgatacagttttagattatattcagaatttttatgttgttttagtaataaaaagacgtgttaaaggatttgtatcttgattttgttttggtcctacaaatgctttgtacgatgtatatatatggtgtagaccttgtacaatatatgtcatatatatgcacctcatgatatctttaaaattagatatcaatagtttttatgttt

SEQ ID NO: 3114 - DNA, 3258 bp, Triphysaria pusilla
ttaagaaagcagacacgttgtagcgtgtaagatagataaatccaaaagcaaaggcaaattattatcatccacatctatctagatatatatctatattcgccatttccgtctaaagaaatccggccgagcatttgaggacctctctcaaaatctcgcagacacactattttccgtatacttgtatctcatttagaccccttgaaggcagacatgtcacacgctctgcttcaatcgaccactttgccctcttcagttggtttggcaaataatggaaaggtcaagggctctaataaaacaagaaacacagcaacaatgttgtccagcacgcaatcagctcccatgaggatgagaggcttctcaggattgcggggagctaatgcattagacttcttggtgtcccaaaatcgtcagacgctccaatcgaaggtagaagcggcaaccagtcccatgaaacgaggacgaaaaacacgcatggccccacgagccatgtttgagcggtttacagagaaagcaataaaagtcattatgcttgcacaagaggaggcgaggcgactgggccataattttgttgggactgagcagattttattggggcttataggcgaaggcactggaattgccgctaaggtcctcaagtccatgggaataaatctgaaagatgcccgtgtagaggtggagaaaattattggacggggcagtggatttgttgctgtggagataccctttactcctcgtgctaaacgtgttctagaactctctctggaggaagcccgccagctaggtcacaattacattggatcggagcacttgctgctaggattgcttcgtgagggtgaaggggtggctgcacgtgttcttgagaatttaggtgccgaccccagtaatattcgaactcaggttattagaatggtcggtgagagtgctgaggctgttggtgctggtgttggaggtggaagctcaggcaacaaaatgcccactttggaagagtatggtaccaatttgaccaagctagcggaagagggtaaactagaccctgttgtgggaagacaggctcaaattgaacgcgtcactcaaattttgggacgtcgcacgaaaaataatccttgcctcataggagagcctggtgttggaaaaacagctattgccgagggtcttgctcaaagaatagccaacggagatgttccagaaactatcgaggggaaaaaggttataactctggatatgggtcttcttgttgctgggacaaagtatcgtggtgaattcgaagaaagattgaagaagttgatggaagagattaagcaaagtgatgaaattatactgttcattgatgaagtacacacgttgattggagcaggagctgctgaaggtgcaattgatgctgcaaacatcttgaagcctgcattagctcggggtgaactgcagtgtattggggctaccacactagatgaataccgaaagcacatcgagaaggatccagcactcgaaagaaggtttcaacctgtcaaggtccctgaacccacagtagatgaaacaattcagattcttaaagggctccgagaacgctatgagatacatcacaagcttcgctacactgatgagtctttagttgctgcagctcagttgtcttatcaatatatcagtgaccgttttttgcctgataaggcaatcgacttggtcgacgaagctggttcccgtgttcgacttcgtcatgcacagctccctgaagaggccagagagcttgaaaaagagctcaggcagataacaaaggagaagaacgaagctgtccgaggtcaagactttgagaaggctggggagctacgtgatagagaaatggatctcaaggcacaaatgtctgctctcatagacaaaaacaaagagatgagcaaagccgaaagtgaggccggggatataggtcccatcgtcaccgaagtcgacattcagcacatcgtttcttcttggacaggcatccccgtcgataaggtctcggctgacgaatctgatcgtctcctcaagatggaggagacactacacacgagggtcgtcggtcaagacgaagccgtcaaagccattagccgagccatccgccgtgcccgtgttggtctcaaaaaccccaaccgccccattgccagcttcatcttttctggccccacaggtgtcggaaaatcagagctagcgaaagctctggccgcctactatttcggatccgaagaggccatgatccgactcgacatgagtgagttcatggagagacacaccgtatcgaagctcatcggatcgccacctggatacgtcggttacactgaaggtggacagctgaccgaggctgttagacgtcgtccttacaccgtcgtgcttttcgacgagatcgaaaaagctcacccggatgtcttcaacatgatgcttcagattctcgaagacggaaggttgaccgacagcaaaggtagaaccgttgacttcaagaacacacttctcataatgacttcgaacgtcgggagcagcgtgatcgagaagggtggtcgccgtatcggtttcgatcttgattacgatgagaaggacagcagctacaaccggatcaagagccttgtgagcgaggagcttaaacagtatttcaggcccgaattcttgaacagattggacgagatgatcgtgttcagacagctcacgaagctggaggtgaaggagatagccgatattatgttgaaggaagtgtttgagagattgaaggtgaaggaaattgaactccaggtgacggagaggtttagagacagggtggttgacgaaggatataaccctagctatggagcaagacctctcagacgagcgattatgaggcttttggaggatagcatggccgagaagatgctagcacgtgaaattaaagaaggggattcggttattgttgatgtcgattccgatgggaatgtgatggttcttaatggtgccagtgggacccctccggaaccgtctcctgaaccattggcggtgtaaatttagccgtttggttggttcggacctggcctgcagttggacttggcaggcagtaggctcagaagctattctgccacttggtgatttataggctctattttctgaaaaagttcctagaatatatttatgtacttgagctatatatgctcgttgtaattttctttgctaggaagaaggtgatacagttggaacgtttagagagccttgtttattgtattgtaaaaatgctgataactcttgtttaatagtatgttgtaagagcacgtctct

SEQ ID NO: 3115 - DNA, 3479 bp, Beta vulgaris
ttcttcactttctctctcctccatttttcttcttcagattttctggtgtgagtcatggctgggggattaattcagtcaaccaccatccctgcatcatttgcctatcaaagaaatggccaattccaaaggtctggtaagggtaaacagggtgtaaagatgatggccagtcttcaagcacctggatacagaatgcgaaatttctcgggattgcgtggaggaaatgctttggatactttgggatctaccagtgaatgtttctattccaagatgagggctgtgctttctgtacgtaaagggacagctagccgaggtgttgttagagcaatgtttgagcgttttactgagaaagctattaaagttataatgcttgctcaagaagaggccagacgcctaggccataattttgtgggcacagagcagattttgctgggtcttattggggaaggaacaggaattgctgccaaggtattgaaatccatgggtattaatttgaaagatgctcgtgtagaagttgagaagataattgggaggggtagtggctttgttgctgttgaaattccatttactcctcgcgccaagcgtgttctggaactttcgttggaggaagcccgtcaacttggccacaactacatcggatctgagcacttgcttctgggtcttcttcgtgagggtgaaggtgtagctgctcgtgttttggagaacttgggggctgatcctagtaacattcgcacgcaggttatacgtatggtgggtgaaaacactgaagctgttggtgctggtgttggagggggtactacaggaaataagatgccaaccttggaggagtatgggacaaatttgacaaagttggcagaagagggaaaattggatcctgttgttggaaggcagcctcagattgagcgtgttacccaaattttgggtagaaggaccaaaaataatccctgtcttattggagagcccggtgttggtaaaacagcaattgcagagggccttgctcaaagaatagctactggtgatgtcccagaaactatcgagggaaagaaggtcataactcttgatatgggtcttctggttgctggaactaaataccgtggagagtttgaggaaagactgaagaagttgatggaggaaattaaacagagtgacgagataattttgtttattgatgaagtacatactttgattggagcaggtgcagcagaaggagctattgatgctgcaaacatcttaaaaccagctcttgcaaggggtgaattgcagtgtattggagccaccacccttgatgagtacagaaaacacattgagaaagatccagcacttgagagaaggtttcagcctgttaaagttcctgagccaactgtagatgagactatacagatcttgaaagggcttcgtgaacgttatgagattcatcacaaacttcgatacaccgatgaagcactagtggctgcagcacaactctcttaccagtatatcagtgaccgtttcttgcccgataaagctattgatctcattgatgaagcaggttccagggttcgattggaacatgctcagctccctgaagaagctagagagcttgaaaaagaacttaggcagctcacaaaagagaaaaatgaatctgttcgcagccaagactttgaaaaggctggtgagttgcgtgacagagaaatggacctcaaggcccaaattagtgctcttatagaaaagaacaaggaaatgagcaaggcagagacagaagctggggatgtcggtcctattgtcacagaaacagatattcagcacatagtgtcatcttggactggtattccagttgagaaagtgtctacagatgaatctgaccgtcttctcaaaatggaggaaacacttcatacgagagttgttggtcaagatgaagctgttaaagccattagccgtgccatccgtcgtgctcgtgttggcctcaagaaccccaaccgtccaattgcaagcttcatcttttcaggtccaactggtgttggaaagtctgaacttgcaaaagctttggctgcgtactactttggatctgaagaagccatgatccgtcttgatatgagtgagttcatggagagacacactgtatccaagcttattggttcacccccaggttatgtgggttacactgagggtggccagcttacagaggctgtaaggcgtcgcccttacacggttgttctttttgatgaaattgagaaggctcatcctgatgtcttcaacatgatgcttcaaattctcgaagatggaaggttgactgacagcaagggcaggactgttgatttcaagaatacgcttcttattatgacatcaaacgttggaagcagtgtaatcgagaaaggtgggcgtaggataggatttgacctagactatgacgagaaggacagcagttacaaccgaattaagagcctcgtgaccgaggagctgaagcagtacttcaggcctgagttcttgaacagattagatgagatgattgtgtttaggcagctaaccaagctggaggtcaaggaaattgccgatattatgttgaaggaagtgtttgagaggctgaagaacaaggatattgaacttcaagtaacagagaggttcagagatagggtggtggatgaaggctacaacccaagttatggtgctaggccattgagaagagctattatgagacttctggaagacagcatggctgagaagatgcttgcaagggaaatcaaagagggcgactcagtaattgtggatgttgattctgaaggaaatgtcatcgtcctcaatggtagcagtggtgcacctcccgagacgttaccagaggttatcactgtgtagacgaacacgcctgctactggtgaagtttgaattccatagtatgtttgtttgtacttggatttgtcatctgaattttatatagatatggtctgtgctaaaaatgtagaaattcaaagcaggaccaattggttcgtagtgtggccatttgtgacattaatcataacagattcagaaagttgtagtattaatttttccaaggagtccgataataggggaacttttggatttggtagggattaggatgttatagctcaaggataatgaaacactccttattgctgtagatttgttttctttttgtatcctgtaagtgtaataatggttcttccttggttaaagttttgcatgctgagtgctgctacgcttctccatggttcgaaagaggggtttccggtttacatgattcgactaagaggaggtctgtaggagggtgcttccttggtgcgtggcttttggagaagattgtagatgagatgaaggttgaatatgttccaatatgttcataaataagttttagtaagctatcaaaagttccatcaatttccatctaattttagataagttaaaagttcaacaaaatttgcagaggaaaatgtaccctaatatgggcttccagcccaggtaactacatggagaagaaaagggcataaaat

SEQ ID NO: 3116 - DNA, 3164 bp, Setaria italica
aacaatcttgtgttctcttttttgttgggcactcagccaaagccaagcaagcggcccccttatctccagggaccaggggaggacgcaacaccaacgcaccgcccttccaccacctcctcccctctctcctcggaggttaaggggcagcacttctgaccatggcagggactttactccagtcagttgcccttggaacaacgttcgggggtcgcataagcacccagcgatggaggtcccatggcaccaggaggcctgcctctatgttggcaatgtctcttagccgccctgtcaagatgtcagcattcgtcggcctaagatcagtacatagcttctcggtgacaccaacggtgtccaattccaggtcggcagttgcatcttacagatcctctcgacggacaagacgttctcgctttgttactcgggcgatgtttgagaggttcacggagaaagctattaaggtcatcatgcttgcgcaagaggaagcgaggcgcctgggccacaactttgttggtaccgagcagattctcttaggtctgatcggagaggggactggtattgcagcaaaggtgctcaagtccatgggtataaatctcaaggatgcacgtgtggaagtggaaaagatcattgggcggggcaatggctttgttgctgttgaaataccattcacaccacgcgctaaacgtgttttggagctctcactggaggaagctcgccaattaggacacaattatattggatctgagcacctgcttcttggactgcttcgtgagggtgaaggtgtggcggctcgtgtacttgagagtctcggagctgaccccagcaatatccgtacacaggttatccgaatgattggtgagaccacagaagctgttggtgctggagttggaggagggagtagtggtaataagatgcctacgctcgaggagtatggaactaatttaacaaaattagcagaagagggaaagctagatcctgttgttggtaggcagccacagattgagcgtgtggtacaaattttaggtagacgaacgaagaacaatccctgcttgattggagagcctggtgttggaaagactgcaattgctgaaggactggctcaacgcatttctacaggcgatgtgcctgaaacaatagaagggaaaaaggtcattacccttgacatgggacttcttgttgctggcacaaaataccgtggagaattcgaagaaagattaaagaagctgatggaagaaatcaagcaaagtgacgagataatactctttattgatgaagttcacactctgataggagcaggagcagcagaaggtgctatcgatgctgctaacattttgaagccagcattagcaagaggtgaactacagtgcattggagcgactacacttgatgaatataggaagcacattgagaaagacccagccctggaaaggcgtttccaacccgtgaaagtgccagagccaacagtagatgaaaccatagaaattctcagaggacttagggaacgatacgagatccatcataaacttcgttacactgatgaagctctgattgcagctgcaaagctttcatatcaatacatcagtgatcgtttcctcccggacaaggcaattgacttgattgatgaagcaggttcccgtgttaggctacagcatgcacaggttcctgaggaagcaagagagcttgacaaagagctcaaacaagtcacaaaacagaagaatgaagctgttcgtagccaggattttgaaaaggctggagagctgcgagaccgtgaaatggaattgaaagcccagataacagctttcattgacaagagcaaagagatgagcaaagcagaggaggaatctggagagacaggacctatggttaatgaagcagatatccagcacatagtatcgtcatggactggcattccagtggagaaggtttccagtgatgaatctgataagcttcttaagatggaagagactttgcacaaacgtgtcattggccaagatgaggctgtggtagctattagtcgttccattcgccgtgctcgtgtgggcctcaagaaccccaacaggccgattgcaagctttatcttcgcaggtcccaccggtgttgggaagtcagagctcgctaaggcccttgctgcctattactttggctctcaggaggctatgatccggcttgatatgagtgaattcatggagaggcacacagtttccaagctgatcggttcacctccaggatatgttggatacactgagggtggccaactgactgaggcagttagaaggcgcccatacacagttgtgctctttgatgagattgagaaggcacaccctgatgtcttcaacatgatgctccagattttggaagacgggaggttgaccgacagcaagggaagaacagtggacttcaagaacaccctcctaatcatgacctcgaacgtcgggagcagtgtcattgagaagggtgggcgtaagattggttttgacctcgactccgacgagaaggacagcagctatggcaggatcaagagcctcgtcattgaggagatgaagcagtacttccgccccgagttcctcaaccgtctcgatgagatgatcgtcttcaggcagctcaccaagctcgaggtcaaggagatcgcggatattatgctccaggaggtcttcgaccgactcaaggccaaggacatcaacctgcaggttactgagaagttcaaggagcgggtggtggatgaaggctacaaccccagctacggtgcacggccgttgaggcgggctatcatgaggctgctggaggacagccttgcggagaagatgctcgctggggaggtcaaggagggtgactctgccattgtggatgttgactcagaggggaaggtcatcgtgctcaacagccagggtggcataccggagctcccaactccggcagtcacggtttagatcgtacataacagatgacaaaatagttgagttttcgtttcaaacacataatcatatagctagcggataactgtgtatattagtggtatagtcgaaggaaaaatcgatgttgcctgtgaattcccatttcaaattcaagtatttttgtctctgaaattaatctcacatggaatgataacgtgtggagactggttgccctttttttgaagtgacgagcatatggaatggtattgaattgca

SEQ ID NO: 3117 - DNA, 3149 bp, Setaria italica
cttttttgttgggcactcagccaaagccaagcaagcggcccccttatctccagggaccaggggaggacgcaacaccaacgcaccgcccttccaccacctcctcccctctctcctcggaggttaaggggcagcacttctgaccatggcagggactttactccagtcagttgccctcggaacaacgttcgggggtcgcataagcacccagcgatggaggtcccatggcaccaggaggcctgcctctatgttggcaatgtctcttagccgccctgtcaagatgtcagcattcgtcggcctaagatcagtacatagcttctcggtgacaccaacggtgtccaattccaggtcggcagttgcatcttacagatcctctcgacggacaagacgttctcgctttgttactcgggcgatgtttgagaggttcacggagaaagctattaaggtcatcatgcttgcgcaagaggaagcgaggcgcctgggccacaactttgttggtaccgagcagattctcttaggtctgatcggagaggggactggtattgcagcaaaggtgctcaagtccatgggtataaatctcaaggatgcacgtgtggaagtggaaaagatcattgggcggggcaatggctttgttgctgttgaaataccattcacaccacgcgctaaacgtgttttggagctctcactggaggaagctcgccaattaggacacaattatattggatctgagcacctgcttcttggactgcttcgtgagggtgaaggtgtggcggctcgtgtacttgagagtctcggagctgaccccagcaatatccgtacacaggttatccgaatgattggtgagaccacagaagctgttggtgctggagttggaggagggagtagtggtaataagatgcctacactcgaggagtatggaactaatttaacaaaattagcagaagagggaaagctagatcctgttgttggtaggcagccacagattgagcgtgtggtacaaattttaggtagacgaacgaagaacaatccctgcttgattggagagcctggtgttggaaagactgcaattgctgaaggactggctcaacgcatttctacaggcgatgtgcctgaaacaatagaagggaaaaaggtcattacccttgacatgggacttcttgttgctggcacaaaataccgtggagaattcgaagaaagattaaagaagctgatggaagaaatcaagcaaagtgacgagataatactctttattgatgaagttcacactctgataggagcaggagcagcagaaggtgctatcgatgctgctaacattttgaagccagcattagcaagaggtgaactacagtgcattggagcgactacacttgatgaatataggaagcacattgagaaagacccagccctggaaaggcgtttccaacccgtgaaagtgccagagccaacagtagatgaaaccatagaaattctcagaggacttagggaacgatacgagatccatcataaacttcgttacactgatgaagctctgattgcagctgcaaagctttcatatcaatacatcagtgatcgtttcctcccggacaaggcaattgacttgattgatgaagcaggttcccgtgttaggctacagcatgcacaggttcctgaggaagcaagagagcttgacaaagagctcaaacaagtcacaaaacagaagaatgaagctgttcgtagccaggattttgaaaaggctggagagctgcgagaccgtgaaatggaattgaaagcccagataacagccctcattgacaagagcaaagagatgagcaaagcagaggaggaatctggagagacaggacctatggttaatgaagcagatatccagcacatagtatcgtcatggactggcattccagtggagaaggtttccagtgatgaatctgataagcttcttaagatggaagagactttgcacaaacgtgtcattggccaagatgaggctgtggtagctattagtcgttccattcgccgtgctcgtgtgggcctcaagaaccccaacaggccgattgcaagctttatcttcgcaggtcccaccggtgttgggaagtcagagctcgctaaggcccttgctgcctattactttggctctcaggaggctatgatccggcttgatatgagtgaattcatggagaggcacacagtttccaagctgatcggttcacctccaggatatgttggatacactgagggtggccaactgactgaggcagttagaaggcgcccatacacagttgtgctctttgatgagattgagaaggcacaccctgatgtcttcaacatgatgctccagattttggaagacgggaggttgaccgacagcaagggaagaacagtggacttcaagaacaccctcctaatcatgacctcgaacgtcgggagcagtgtcattgagaagggtgggcgtaagattggttttgacctcgactccgacgagaaggacagcagctatggcaggatcaagagcctcgtcattgaggagatgaagcagtacttccgccccgagttcctcaaccgtctcgatgagatgatcgtcttcaggcagctcaccaagctcgaggtcaaggagatcgcggatattatgctccaggaggtcttcgaccgactcaaggccaaggacatcaacctgcaggttactgagaagttcaaggagcgggtggtggatgaaggctacaaccccagctacggtgcacggccgttgaggcgggctatcatgaggctgctggaggacagccttgcggagaagatgctcgctggggaggtcaaggagggtgactctgccattgtggatgttgactcagaggggaaggtcatcgtgctcaacagccagggtggcataccggagctcccaactccggcagtcacggtttagatcgtacataacagatgacaaaatagttgagttttcgtttcaaacacataatcatatagctagcggataactgtgtatattagtggtatagtcgaaggaaaaatcgatgttgcctgtgaattcccatttcaaattcaagtatttttgtctctgaaattaatctcacatggaatgataacgtgtggagactggttgccctttttttgaagtgacgagcatatggaatggtattgaattgcac

SEQ ID NO: 3118 - DNA, 3345 bp, Triphysaria pusilla
agccactgaaggtagcgtttaagaaagcagacacgttgtagcgtgtaagatagataaatccaaaagcaaaggcaaattattatcatccacatctatctagatatatatctatattcgccatttccgtctaaagaaatccggccgagcatttgaggacctatctcaaaatctcgcagagacactattttccgtatacttgtatctcatttagaccccttgaaggcagacatgtcacacgctctgcttcaatcgaccactttgccctcctcagttggtttggcaataatggaaaggtcaagggctctaataaaacaagaaacacagcaacaatgttgtccagcacgcaaacagctcccatgaggatgagaggcttctcaggattgcgaggagctaatgcattagacttcttggtgtcccaaaatcgtcagacgctccaatcgaaggtagaagcggcaaccagtcccatgaaacgaggacgaaaatcacgcatggccccacgagccatgtttgagcggttcacagagaaagcaataaaagtcattatgcttgcacaagaggaggcgagacgacttggccataattttgttgggactgagcagattttattggggcttataggcgaaggcactggaattgccgctaaggtcctcaagtccatgggaataaatctgaaagatgcccgtgtagaggtggagaaaattattggacggggcagtggatttgttgctgtggagataccctttactcctcgtgctaaacgtgttctagaactctctctggaggaagcccgccagctaggtcacaattacattggatcggagcacttgctgctaggattgcttcgtgagggtgaaggggtggctgcacgtgttcttgagaatttaggtgccgaccccagtaatattcgaactcaggttattagaatggtcggtgagagtgctgaggctgttggtgctggtgttggaggtggaagctcaggcaacaaaatgcccactttggaagagtatggtaccaatttgaccaagctagcagaggagggtaaactagaccctgttgttggaagacaggcccaaattgaacgcgtcactcaaattttgggacgtcgcacgaaaaataatccttgcctcataggagagcctggtgttggaaaaacagctattgccgagggtcttgctcaaagaatagccaacggagatgttccagaaactatcgaggggaaaaaggttattactctggatatgggtcttcttgttgctgggacaaagtatcgtggtgaattcgaagaaagattgaagaagttgatggaagagattaagcaaagtgatgaaattatactgttcattgatgaagtgcacacgttgattggagcaggagctgctgaaggtgcaattgatgctgcaaacatcttgaagcctgcattagctcggggtgaactgcagtgtattggggctaccacgctagatgaataccggaagcacattgagaaggatccagcactcgaaagaaggtttcaacctgtcaaggttcctgaacccactgtagatgaaacgattcagattcttaaaggtctccgagaacgctatgagatacaccacaagcttcgctacactgatgagtcttagttgctgcagctcagttgtcttatcaatatatcagtgaccgttttttgcctgataaggcaatcgacttggtcgatgaagctggttcccgtgttcgacttcgtcatgcacagctccctgaagaggccagagagcttgagaaagagctcaggcagataacaaaggagaagaacgaagctgtccgaggtcaagacttcgagaaggctggggagctacgtgatagagaaatggatctcaaggcacaaatgtctgctctcatagacaaaaacaaagagatgagcaaagccgaaagtgaggctggggatataggtcccgtcgtcaccgaagtcgacattcagcacatcgtttcttcttgggcaggcatccctgtcgataaggtctcggctgacgaatctgatcgtctcctcaagatggaggagacactacacacaagggttgtcggtcaagacgaagctgtcaaagccattagtcgagccatccgccgtgcccgtgttggtctcaaaaaccccaaccgccccattgccagcttcatcttttctggccccacaggtgtcggaaaatcagagctagcgaaagctctggccgcctactatttcggatccgaagaggccatgatccgactcgacatgagtgagttcatggagagacacaccgtatcgaagctcatcggatcgccacctggatacgtcggttacactgaaggtggacagctgaccgaggctgttagacgtcgtccttacaccgttgtgcttttcgacgagatcgaaaaagctcacccggatgtcttcaacatgatgcttcagattctcgaagacggaaggttgaccgacagcaaaggtagaaccgttgacttcaagaacacgcttctcataatgacttcgaacgtcgggagcagcgtgatcgagaagggtggtcgccggatcggtttcgatcttgattacgatgagaaggacagcagctacaaccggatcaagagccttgtgagcgaggagcttaaacagtatttcaggcccgaattcttgaacagattggacgagatgatcgtgttcagacagctcacgaagctggaggtgaaggagatagctgatattatgttgaaggaagtgtttgagagattgaaggtgaaggaaattgaactccaggtgacggagaggtttagagacagggtagttgacgaaggatataaccctagctatggagcaagacctctcagacgagcgattatgaggcttttggaggatagcatggccgagaagatgctagcacgtgaaattaaagaaggggattcggttattgttgatgtcgactccgatgggaatgtgatggttcttaatggtgccagtgggacccctccggaaccgtctcctgaaccattgacggtgtaaatttagccgtttggttggttcggacctggcctgcagttggacttggcaggcagtaggctcagaagctattctgccacttggtgatttataggctctattttctgaaaaagttcctagaatatatttatgtacttgagctatatatgctcgttgtaattttctttgctaggaagaaggtgatacagttggaacgtttagagagccttgtttattgtattgtaaaaatgctgataactcttgtttaatagtatgttgtaagagcacgtctcttattcgaaaaaaaaaaaaaaacaaaaaaaaaaaaacaaaaaaaaaaaacaaaaaaaaaaacaaaaaacaga

SEQ ID NO: 3119 - DNA, 3837 bp, Phaseolus vulgaris
ccagctactttaggtctctctcttctctctctctctctcttctttctttctgttgatataatccatcttttatcttcgtttttccccctttctcctccaggttaaagattgttaggttatttctccactgcttccgccggctattgaggaatcatggctagggttttggctcagtcagttactgtccctggtctagtggctgagcatagacatggtcagcaaaagggatcaggaaaattaaaaagaccggccaaaatgatgagtgctgtacgtacaaatggattaagaatgtcaggtttcacaggacttcgtacttttaatcctttggatactatgttgagacctggaatagattttcgttctaaagtatccattgcaacttctgcacgccgaggaagagctaccagatgcgtacccaaagccatgtttgagcgtttcactgagaaagcaattaaagtaataatgctagcccaggaggaagcaagacgtcttggtcataattttgttggaacagagcagattctattgggtcttattggtgaaggcactggtattgctgccaaggttctaaagtctatggggatcaaccttaaagatgctcgtgtggaagtagagaagataattggaaggggcagtggatttgtggctgttgagattccatttactcctcgtgcaaagcgtgttttggaactttcactggaggaagctcgtcaacttggtcacaattatattggatcagagcacctgcttctgggtcttcttcgagagggtgagggtgtagcagcacgtgttctggaaaacctgggtgctgatcctactaacattcgcacacaggttattcgcatggtgggtgagagcgccgacagtgttactgctactgttggttcaggaagtagtggcaataagatgccaactttggaggagtatggtaccaatttgaccaagctagcggaagagggaaaattggatcctgttgttggaaggcagcagcaaattgaacgtgtgactcaaattttaggccgtcgaactaaaaataatccttgtctgattggagaacctggtgttgggaagactgcaattgctgaaggtcttgctcagcggattgcaaatggtgatgtaccggaaaccatagagggaaaaaaggttataacccttgacatgggtttgcttgttgctggaactaaatatcgtggtgagtttgaggagaggttgaagaaactgatggaagaaatcaagcaaagtgatgagataatccttttcatcgacgaggtacacactttgattggagcaggagcagcagaaggggcaattgatgctgctaatatactaaagccagctcttgcaaggggtgaactacagtgtattggagccacaacattagatgaatataggaagcacattgaaaaagatcctgctttagagagacggttccagccagttaaagtaccagagccaactgttgatgaaaccatacaaatactgaaaggacttagagaacgatatgaaattcaccacaagctccgctatactgatgaggctcttgtagctgctgcacagctgtcataccagtatatcagtgatcggtttttacctgacaaagctatagatttgattgatgaagctggttcacgagttaggcttcaacatgcacagttacctgaggaagcaagagaacttgacaaggaggtcaggcagattatcaaggagaaagaggaagctgttcgcaaccaagactttgaaaaggctggagagctacgagatagagaaatggatcttaaggcacagatctcaacacttgtagagaaaggaaaggagatgagcaaggcagagagtgaggcaggggatgaaggtcctactgttactgaagctgacatacagcacattgtatcatcctggactggtattcctgttgagaaggtctcaacagatgaatctgatcgccttctgaagatggaagagactttacataagcgagtcattggtcaggatgaagcggttaaagccattagtcgggctatccgtcgagctcgggttggattgaagaaccctaaccgtccaattgccagcttcatcttttctggtccaactggtgtggggaagtctgaattggccaaagcattggctgcatattactttggctctgaagaagctatgattcgacttgacatgagtgagtttatggaaagacacacagtttccaaacttattggttcacctcctggatatgtaggttacaccgaaggtggacagttgactgaggcagttcggcgtcgtccttacactgttgtactatttgatgagatcgagaaagcccatccggatgtgttcaacatgatgcttcagatcctggaagatggaagactaacagacagtaagggaagaactgtggatttcaagaacacacttcttataatgacatcaaatgttggaagcagtgtgattgagaaaggaggccgccgtattggatttgatctggattatgatgagaaggatagcagttataacagaatcaagagcttggtgactgaggagctaaagcaatactttaggccagaatttttgaatagactggatgagatgattgtcttcaggcaactaacaaaactggaggtgaaggagattgctgacattatgctcaatgaggtgtttaatagactgaaggtgaaagatattgaacttcaagtgactgaaagatttagggacagagtggtggaggaaggttataatcctagttacggagccaggcctttaagaagagctataatgcgacttttggaagacagcatggctgagaagatgcttgctagagagatcaaagagggcgactctgttatagtggatgttgattctgacggtaacgtgattgtgctcaatggtaacagtggagcccccgagaccttaccagaggcacttcctgtgtaatgcggttaatttgctattactatgtgttatttaatttgtctaaaccatagtcatagtatgttttttacccgtcaatgttcctaaagcttttgattgatactggtaggcctcatctaagaaaaaacaaattcagaaaaggggtagtgggggttaccaggggtttggggaaacttaaaaggatctgcggggaaggtgaaaatcaaatcagtgccacgatgtatggcctattcattgcttgagaatgcaatgcgtgtaatgataaaattcttgcatgataatgacagattcagggtaagtagatcaatttgaatacggaactgtcctcaaatcatctatgcaagcaagtttaaattttcatgtggatggtagtgaagcaacgtgattcaagtgttgtatcggcatgttttacggtgtccctgcggtcagatttatggtggttaaatgtctaacctctttcatccacgttttgaaaccgactacaatatcacaagcggactaaaggtgcagctcggaaatcaaattcatggctctccaatgagcaattttatgaaaattgtactggttcagacgttaggttaaatgactctgtaactagcaattttgttaagggtttttgcatcccatgattttaagcctgcactcccataagacggtgaaatcacaactctataaaaaaaatgcatttcaaattctacatttcgatttcagaatatgcaaaatgtattatctccataatgtatttattaaatttggaaatcttttattttatgcaatgtgaaatcaataatatattaatatattttagaatgtgtattttggaaggtattttagatctataatactttttgaattgtataacgtacaatgtattactatattattaattgtataatgcaaaatgttttatagatttac

SEQ ID NO: 3120 - DNA, 3150 bp, Castanea mollissima
  misc_feature (3118)..(3118): n is a, c, g, or t
gtttgagttctaaaaaacaaacctcatctctttccttggccgaccaaatacgagggtctgcctttttctcccaaacaaaacacttatagagtattaggttggcatcatggctcgggtgttgcttcagtcagctaatgtccctggtttagttgctaatcagagacgcaaccaatctaaaggatttggaaaagcaaaaaggtccgtcaaaatgatgtctagtttacaggcacctggattgagaatgggaagcttctcaggattgcgaagtgttaatgctttggatactctggtaaagcctgggatagatttacattctaaggtgagaatcgcaatcaattctcggcaaggaaggggtagcagatgtgtggctagagccatgtttgagcgcttcacagaaaaggcgattaaagtaattatgcttgcacaagaggaagctagacggcttggtcataattttgttggcacagaacagatcctgttgggtcttattggtgaaggcactggcattgctgctaaagttcttaaatctatgggaatcaatcttaaagatgcacgtgtagaagtggaaaaaattattggaaggggcagtggatttgttgctgttgagattccattcactcctcgtgcgaagcgtgttttggagctctcgctagaggaagcccgccaacttggccataactatattggatctgagcatttgcttctgggacttcttcgtgagggtgagggtgttgcagctcgtgttcttgaaaatctaggtgctgacccgagtaacattcgcacccaggttattcgaatggttggtgagagcccagaagctgttgctgctggtgttgcaggaggaagtagtggcaataagatgccaaccctggaggaatatgggactgacctgactaagcttgcagtggagggtaaattggatcctgttattggaaggcaggcacaaatagaacgtgtcacccaaattttggggcgtcgaaccaaaaacaatccatgtcttattggagaacctggagttgggaaaacagcaatcgcagaagggcttgctcaaagaattgcaactggtgatgttcctgaaactatagaggggaagaaggttataaccttggacatgggtcttctagttgctggtacaaaatatcgtggagagtttgaggaacgattaaagaagttaatggaggaaatcaaacaaagtgacgagataatattgtttattgatgaggtgcacactttaattggagctggagcagcagaaggagcaattgatgctgcaaacatattgaaaccagctcttgcaagaggtgaactgcagtgcattggagctacaacactagatgaatacagaaagcacatcgagaaggatccagctttggaaagacgtttccagccagtcaaagtgcctgaaccaactgtggatgaaaccatacagattttgaagggccttcgggagcgatatgagattcatcacaagctccgttacacagatgaagcacttgtatctgctgcacagctatcatatcagtacatcagtgatcgtttcctgcctgataaagcaattgacttgattgatgaagctggttctcgagttcgtctgcgtcatgcacagctaccagaggaagctagagaacttgagaaagagctcaggcagatcacaaaagaaaagaatgaagctgttcgcagccaagactttgagaaggctggagagttacgtgatagagaaatggaccttaaggcacaaatatcagctcttgtagataaaggcaaggaaatgtcaaaagcagagactgaggctggggatgtaggtccactggtgactgagctggatattcaacatattgtctcctcttggacaggcattcccgttgagaaagtctcaacagatgaatctgaccgcctcctcaagatggaagagaccctccataagcgggtcattggtcaggatgaagcagtcaaagccatcagccgtgctattcgccgtgcccgtgttggtctcaagaatcctaaccgtccaattgctagtttcatcttttcaggtccaactggtgtaggaaagtctgagctggcaaaagcgttggctgcttactactttggctctgaagaagccatgattaggcttgatatgagtgaatttatggaaagacatactgtctccaagctaattggatccccccctggttatgttggttacactgagggaggtcagttgactgaggctgttcgacgccgtccttacactgtggtattgtttgatgaaattgagaaggcccatcctgacgtcttcaacatgatgcttcaaattctcgaagatggaaggttgacagatagcaagggcagaactgtggacttcaagaatactcttttgataatgacgtcaaatgttggcagtagcgtaattgagaaaggaggccgccgaataggatttgatcttgattacgatgagaaggatagcagttataaccgaatcaagagcttggtgactgaggaattgaaacaatattttaggccagagtttttgaacaggttggatgaaatgattgtctttaggcagctcacaaagctggaggtaaaggatatagctgatattatgctgaaagaggtctttgaaaggctgaagaccaaagaaatagagcttcaggtgacagagagatttagagatagagtggttgacgaagggtataacccaagctatggggcaaggcctctgagaagagccataatgagactcttggaggacagcatggcagagaagatgcttgctagagagatcaaagagggtgattcagttattgtggatgttgatactgatggcaatgtgaccgtcctcaaaggtagcagcggctcccccgaatcattaccagagcccgagccaattccagtgtaaaataggcctcattatttagtaaacttttaccaatatgttgtttgtacttctcattttgaactatagttgtagtctctttttatgaaaagattacttgaaagtggaattggaaaatgttggattaattgctggcgcctggctttttataggttgtatttgttatgcctcaaacaccacgcataggtcattcacaggttgtaaggtgttggtacttggtagtgctagttttgcagaatnttgttaataataaaaatgtaacgatgtcagag

SEQ ID NO: 3121 - DNA, 3110 bp, Pennisetum glaucum
tcttgttgggcactcggccaaaaccaagcaagcggcccccttatctccagggaccaggggaggacgcagcaccaacgcaccgcccttccaccacctcctccccctctctcctcggaggttaagggacggcacttctgaccatggcagggaccttactccagtcagttgccctcggaacaacgtttgcgggccgcataagcacccagcgatggaggtcccatggaaccaggaggcctgtctctatgttggcaatgtcgcttagccgccctgtcaagatgtcagcatttgtcggcctaagatcagttcatagcttctcggtcacaccgacggtgtccaattccaggtcgacagttgcatcttacagatcctctcgacggacaaggcgttcccgctttgttactcgggcgatgtttgagaggttcactgagaaagctattaaagtcatcatgcttgcgcaagaggaagcgaggcgcctgggccacaactttgttggtactgagcagattctcttgggtctgatcggagaggggactggtattgcagcaaaggtgctcaagtccatgggtataaatctcaaggatgcacgcgtggaagtggaaaagatcattggacggggtaatggcttcgttgctgttgaaataccattcacaccacgcgctaaacgtgttttggagctctcactggaggaagctcgccagttaggacacaattatattggatctgagcacctgcttcttggactgcttcgtgagggtgaaggtgtggcggctcgtgtacttgagagtctcggagctgaccccagcaatatccgtacacaggttattcgaatgattggtgagaccacagaagctgttggtgctggagttggaggagggagtagtggtaacaagatgccaacgcttgaggagtatggaactaatttaacaaaattagcagaagagggaaagctagatcctgttgttggtaggcaaccacagattgagcgtgtcgtacaaattttaggtagacgaacgaagaacaatccctgcttgattggagagcctggtgttggaaagactgcaattgctgaaggactggctcaacgcatttctacaggcgatgtacctgaaacaatagaagggaaaaaggtcattacccttgacatgggacttcttgttgctggcacaaaataccgtggagaattcgaagaaagattaaagaagctgatggaagaaatcaagcaaagtgacgagataatactctttattgatgaagttcacactctgataggagcaggagcagcagaaggtgctatcgatgctgctaacattttgaagccagcattagcaagaggtgaactacagtgcattggagcgactacacttgatgaatataggaagcacattgagaaagacccagccctggaaaggcgtttccaacctgtgaaagtgccagagccaacagtagatgaaaccatagaaattctcagaggacttagggaacgatacgagatccatcataaacttcgttacactgatgaagctctgattgcagctgcaaagctttcatatcaatacatcagtgatcgtttcctcccggacaaggcaattgacttgattgatgaagcaggttcccgtgttaggctacagcatgcacaggttcctgaggaagcaagagagcttgacaaagagcttaaacaaatcacaaaacagaagaatgaagctgttcgtagccaggattttgaaaaggctggagagctgcgagaccgtgaaatggaattgaaaacccagataacagccctcattgacaagagcaaggagatgagcaaagcagaggaggaatctggggagacaggacctatggttaatgaagcagatatccagcacatagtatcatcatggactggcattccagtggagaaggtttccagcgatgaatctgataagcttcttaagatggaagagactttgcacaaacgtgtcattggccaagatgaggccgtggtagcaattagtcgttccattcgccgtgctcgtgtgggcctcaagaaccccaacaggccgattgcaagctttatctttgcaggtcccaccggtgttgggaagtcagagctcgctaaggctcttgctacctattactttggctccgaggaggcaatgatccggcttgatatgagtgaattcatggagaggcacacagtgtccaagctgatcggttcacctccaggatatgttggatacactgagggtggccaactgacagaggcagttcgacggcggccatacacagttgtgctctttgatgagattgagaaggcacaccctgatgtcttcaacatgatgctccagattttggaagacgggaggttgacagacagcaagggaagaacagtggacttcaaaaataccctcctaatcatgacctcgaacgtcgggagcagtgtcattgagaagggtgggcgcaagattggttttgaccttgactctgatgagaaggacagcagctatgggaggatcaagagcctcgtcattgaggagatgaagcagtacttccgcccggagttcctcaaccgtctcgatgagatgatcgtcttcaggcagctcaccaagctcgaggtcaaggagattgcggatatcatgctccaggaggtctttgaccgactcaaggccaaggatatcaacctgcaggttactgagaagttcaaggagcgtgtggtggatgaaggttacaaccccagctacggtgcacggccactgaggcgggctatcatgaggctgctagaggacagcctcgcggagaagatgctcgccggggaggtcaaggagggtgattctgccattgtggatgttgactcagaggggaaggtcatcgtgctcaacagccagggtggcataccggagctcccaactccagcagtcaccgtttagatagtacataacagatgacaaagtagttgagttttcgtttcaaacacataatcatatagctagcggataactgtgtatattagtggtatagtcgaaggaaaatcgatgttgcctttgaattcccatttccaacttaaagtattttttgtctctgaaattaatctcacctggaatgataacgtgcggagactgttttcccttttt

SEQ ID NO: 3122 - DNA, 3325 bp, Quercus alba
gcagagtacatggggtgttttgtagttccgaaaaacctcatctatttccttggccgaccaaatacgagggtctgcctttctctcccaaacaaaacacttatagagtagtaggtcagcatcatggctcgggtgttacttcagtcagctaatgtccctggtttagttgctaatcagagacgtaaccaatctaaaggatttggaaaagcaaaaaggtccgtcaaaatgatgtctagtttacaggcacctggattgagaatgggaagcttctcaggattgcggagtgttaatgctttggatactctggtaaagcctgggatagatttacattctaaggtgagaattgcaatcaattctcggcaaggaaggggtagcagatgtgtggctagagccatgtttgagcgcttcacagaaaaagcgattaaagtaattatgcttgcacaagaggaagctagacggcttggtcataattttgttggcacagaacagatcctgttgggtcttattggtgaaggcactggcattgctgctaaagttcttaaatctatgggaatcaatcttaaagatgcacgtgtagaagtggaaaaaattattggaaggggcagtggatttgttgctgttgagattccattcactcctcgtgcaaagcgtgttttggaactctcgctagaggaagcccgccaacttggccataactatattggatctgagcatttgcttctgggacttcttcgtgagggtgagggtgttgcagctcgtgttcttgaaaatctaggtgctgacccgagtaacattcgcacccaggttattcgaatggttggtgagagcccagaagctgttgccgctggtgttgcaggaggaagtagtggcaataagatgccaaccctggacgaatatgggactgacctgactaagcttgcagtggagggaaaattggatcctgttattggtaggcaggcacaaatagaacgtgtcacccaaattttggggcgtcgaaccaaaaacaatccatgtcttattggagaacctggagttgggaaaacagcaatcgcagaagggcttgctcaaagaattgcaactggtgatgttcccgaaactatagaggggaagaaggttataaccttggacatgggtcttctagttgctggtacaaaatatcgtggagagtttgaggaacgattaaagaagttaatggaggaaatcaaacaaagtgacgagataatattgtttattgatgaggtgcatactttaattggagctggagcagcagaaggagcaattgatgctgcaaacatattgaaaccagctcttgcaagaggtgaactgcagtgcattggagctacaacactagatgaatacagaaagcacatcgagaaggatccagctttggaaagacgtttccagccggtcaaagtgcctgaaccaactgtggatgaaaccatacagattttgaaggggcttcgggagcgatatgagattcatcacaagctccgttacacagatgaagcacttgtatctgctgcacagctatcatatcagtacatcagtgatcgtttcctccctgataaagcaattgacttgattgatgaagctggttctcgagttcgtctgcgtcatgcacagctaccagaggaagctagagaacttgagaaagagctcaggcagatcacaaaagaaaagaatgaagctgttcgcagccaagactttgagaaggctggagagttacgtgatagagaaatggaccttaaggcacaaatatcagctcttgtagataaaggcaaggaaatgtcaaaggcagagactgaggctggggatgtaggtccactggtgactgagctggatattcaacatattgtctcctcttggacaggcattcctgttgagaaagtctcaacagatgaatctgaccgcctcctcaagatggaagagaccctccataagcgggtcattggtcaggatgaagcagtcaaggccatcagccgtgctattcgccgtgcccgtgttggtctcaagaatcctaaccgtccaattgctagtttcatcttttcaggtccaactggtgtaggaaagtctgagctggcaaaagcgttggctgcttactactttggctctgaagaagccatgattaggcttgatatgagtgaatttatggaaagacataccgtctccaagctaattggatccccccctggttatgtcggttacactgagggaggtcagttgactgaggctgttcgacgccgtccttacactgtggtattgtttgatgaaattgagaaggcccatcctgatgtcttcaacatgatgcttcaaattctcgaagatggaaggttgacagatagcaagggcagaactgtggacttcaagaatactcttttgataatgacgtcaaatgttggcagtagtgtaattgagaaaggaggccgccgaataggatttgatcttgattacgatgagaaggatagcagttataaccgaatcaagagcttggtgactgaggaattgaaacaatattttaggccagagtttttgaacaggttggatgaaatgattgtctttaggcagctcacaaagctggaggtaaaggatatagccgatattatgctgaaagaggtctttgagaggctgaagaccaaagaaatagagcttcaggtgacggagagatttagagatagagtggttgacgaagggtataacccaagctatggggctaggcctctgaggagagccataatgagactcttggaggacagcatggcagagaagatgcttgctagagagatcaaagagggtgattcagttattgtggatgttgattctgatggcaacgtgactgtcctcaaaggtagcagtggctcccccgaatcattaccagagcccgagccaattccagtgtaaaataggccttcattatttagtaaactttaccaatatgttgtttgtacttctcattttgaactatagttgtagtctttttttatgaaaagaatacttgaaagtggaatcggaaaatgttgggttaattgctggcgcctggctttttctaggttgtatttgtcattgcttcaaacaccacgcatggcatgggtcattcacaggttgtaaggtgttggtacttggtagtgctagttttgcagaatattttttataataaaaatgtaacgatgttaaagattatttgtttttacagtactatgatatctttggatatgatgatcagaatctaatattgacctcttagaatggattaaccaaaaaaagaggaagggactaataagaaagggaaggaaaaggattacaagctcgatgaggttaaacatttcttgaa

SEQ ID NO: 3123 - DNA, 3509 bp, Glycine max
cggtagatatttaagattgagttatcgattagagatagagatatcttggaaaagaggggacggggaaggttagcgcctattcctcaccacaattttattccttcctcttctcatcttcgctcactatataattcattcatctccctctttcttcttttcagctactttaggtctctctctctctctctctctcttctctctctctctttcttcctttctttaatacttattaattcatcttttttatctttctttctttctttccccttttgtatttctgggttcgatattgttatcggttatttgtgcactgcttccgccggggctattcaggaatcatggctagggttttggctcagtctgttaatgtccctggtctagtggctgagcataggcatggtcagcaaaagggatcaggaaaattaaaaagatcgaccaaaatgatgagtgctttacggacaaatggattaagaatgtcaggtttctcagggcttcgtactttcaatcctttggatactatgttgagacctggcatagattttcattctaaggtatccattgcaacgtcttcgcggcaagcaagagctaccagatgcgtgcccaaagccatgtttgagcgtttcactgagaaagcaatcaaagtgattatgctagcccaggaggaagcaagacgtcttggtcacaattttgttggcacagagcaaattctattgggtcttatcggcgaaggaactggtattgctgctaaggtgctaaagtcaatggggatcaacctcaaagatgcacgagtggaagtagaaaaaataattggaaggggtagtggatttgtggctgttgagattccatttactccccgtgcaaagcgtgttttagaactttcactggaggaagctcgtcaacttggtcacaattatattggatctgagcacctgcttctgggtcttcttcgagagggtgagggtgtagcagcacgtgttctggaaaatctgggtgctgatcctactaatattcgcacacaggttattcgcatggtgggtgagagtgctgacagtgttactgcaactgttggctcaggaagtagtggtaataagatgccaactttggaggagtatggtaccaatttgaccaagctagcggaagagggaaaattggatcctgttgtgggaaggcagccgcaaattgaacgtgtgactcaaattttaggtcgtcggactaaaaataatccttgtcttattggagaacctggtgttgggaagacagcaattgctgaaggtctcgctcagcggattgcaaatggtgatgtacctgaaaccatagagggaaaaaaggtcataaccctcgacatgggtctgcttgttgctggaactaaataccgtggtgagtttgaggagaggttgaagaaactgatggaagagatcaaacaaagtgacgagataatacttttcatcgatgaagtgcacactttgattggagcaggagcagcagaaggggcaattgatgctgctaacatactaaagccagctcttgcaagaggtgaactacagtgtattggagccacaacattagacgagtacaggaagcacattgaaaaagatcctgctttggagagacgattccagccagttaaagtgccagagccaactgtagatgaaaccatacaaatactgaaaggacttagagagcggtatgaaattcaccacaagctccgctatactgatgaggctcttgtagctgctgcacagctgtcctaccagtatatcagtgatcgatttttgccagacaaagctatcgatttgattgatgaagctggttcacgagtccggcttcaacatgcacagttacctgaagaagcaagagaacttgacaaggaggtgaggcagattattaaggagaaagaagaagctgttcgcaaccaagactttgaaaaggctggagagctacgtgatagagagatggatcttaaggcacagatctcaacacttgtagagaaaggcaaggagatgagcaaggcagagactgaggcaggggatgaaggtcctattgtgactgaagctgacatacagcatattgtctcatcctggactggtattcctgttgagaaagtctcaacagatgaatctgatcgcctcctgaagatggaagagactttacataagcgagtcattggtcaggatgaagcagttaaagccattagtcgggctatccgtcgagctcgggttggactaaaaaatcctaatcgtcccattgccagcttcatcttttctggtccaactggtgtggggaagtctgaattggccaaagcattggctgcatactactttggctccgaagaagctatgattcggcttgacatgagtgaattcatggaaaggcacactgtctccaaacttattggttcacctcctggatatgttggttacactgaaggtggtcaattgaccgaggcagttcggcgtcgtccttacactgttgtactgtttgatgagattgagaaagcccatcctgatgtgttcaacatgatgcttcagatcctggaagatggaagactaacagacagtaagggcagaacagtggatttcaagaacacacttcttataatgacatcaaatgttggaagcagtgtgattgagaaaggaggccgcaaaattggatttgatctggattacgatgagaaggatagcagttataacagaatcaagagcctggtaactgaggagctaaaacaatacttcaggccagaatttttgaatagattggatgaaatgattgtcttcaggcagctcacaaaactggaggtgaaggagattgctgacataatgctcaaagaggtgtttgatagactgaaggtgaaagatattgaacttcaagtgacagaaagattcagggacagagtggtggaggaaggttataaccctagttatggagctagacctctaagaagagccataatgcgacttttggaggacagcatggctgagaagatgcttgccagagagatcaaggagggcgactctgttatagtggatgttgattctgatggtaatgtgattgtgctcaatggtagcagcggagcccccgaatccttgccagagacgcttcctgtataatgcggttaatttgctaatactatgtacttaatttgtttaaaccatagtcatagtatgttttacttgtcaatgtacctaaagtttttaatggaatacctggtaggcctcatcatgttttttgcctataaagcaaatcaaattcagaaaaagggtagcggggttaccagggggatatagggaaaaactgaaaaaggatttgtggggaaggtgaaaatcagcgccgtattcggtataactttggcaccaatgaactattccgtcggaagctgggggtgtttgtatgtttccactggtttgactatgatgtaatattaatatcccagcattactgtaaatgatcattatggcgtattcattgcttgagattgcaatgcatgtaatgacaggtttagggtattagat

SEQ ID NO: 3124 - DNA, 3538 bp, Glycine max
gttagcgcctattcctcaccacaattttattccttcctcttctcatcttcgctcactatataattcattcatctccctctttcttcttttcagctactttaggtctctctctctctctctctctcttctctctctctctttcttcctttctttaatacttattaattcatcttttttatctttctttctttctttccccttttgtatttctgggttcgatattgttatcggttatttgtgcactgcttccgccggggctattcaggaatcatggctagggttttggctcagtctgttaatgtccctggtctagtggctgagcataggcatggtcagcaaaagggatcaggaaaattaaaaagatcgaccaaaatgatgagtgctttacggacaaatggattaagaatgtcaggtttctcagggcttcgtactttcaatcctttggatactatgttgagacctggcatagattttcattctaaggtatccattgcaacgtcttcgcggcaagcaagagctaccagatgcgtgcccaaagccatgtttgagcgtttcactgagaaagcaatcaaagtgattatgctagcccaggaggaagcaagacgtcttggtcacaattttgttggcacagagcaaattctattgggtcttatcggcgaaggaactggtattgctgctaaggtgctaaagtcaatggggatcaacctcaaagatgcacgagtggaagtagaaaaaataattggaaggggtagtggatttgtggctgttgagattccatttactccccgtgcaaagcgtgttttagaactttcactggaggaagctcgtcaacttggtcacaattatattggatctgagcacctgcttctgggtcttcttcgagagggtgagggtgtagcagcacgtgttctggaaaatctgggtgctgatcctactaatattcgcacacaggttattcgcatggtgggtgagagtgctgacagtgttactgcaactgttggctcaggaagtagtggtaataagatgccaactttggaggagtatggtaccaatttgaccaagctagcggaagagggaaaattggatcctgttgtgggaaggcagccgcaaattgaacgtgtgactcaaattttaggtcgtcggactaaaaataatccttgtcttattggagaacctggtgttgggaagacagcaattgctgaaggtctcgctcagcggattgcaaatggtgatgtacctgaaaccatagagggaaaaaaggtcataaccctcgacatgggtctgcttgttgctggaactaaataccgtggtgagtttgaggagaggttgaagaaactgatggaagagatcaaacaaagtgacgagataatacttttcatcgatgaagtgcacactttgattggagcaggagcagcagaaggggcaattgatgctgctaacatactaaagccagctcttgcaagaggtgaactacagtgtattggagccacaacattagacgagtacaggaagcacattgaaaaagatcctgctttggagagacgattccagccagttaaagtgccagagccaactgtagatgaaaccatacaaatactgaaaggacttagagagcggtatgaaattcaccacaagctccgctatactgatgaggctcttgtagctgctgcacagctgtcctaccagtatatcagtgatcgatttttgccagacaaagctatcgatttgattgatgaagctggttcacgagtccggcttcaacatgcacagttacctgaagaagcaagagaacttgacaaggaggtgaggcagattattaaggagaaagaagaagctgttcgcaaccaagactttgaaaaggctggagagctacgtgatagagagatggatcttaaggcacagatctcaacacttgtagagaaaggcaaggagatgagcaaggcagagactgaggcaggggatgaaggtcctattgtgactgaagctgacatacagcatattgtctcatcctggactggtattcctgttgagaaagtctcaacagatgaatctgatcgcctcctgaagatggaagagactttacataagcgagtcattggtcaggatgaagcagttaaagccattagtcgggctatccgtcgagctcgggttggactaaaaaatcctaatcgtcccattgccagcttcatcttttctggtccaactggtgtggggaagtctgaattggccaaagcattggctgcatactactttggctccgaagaagctatgattcggcttgacatgagtgaattcatggaaaggcacactgtctccaaacttattggttcacctcctggatatgttggttacactgaaggtggtcaattgaccgaggcagttcggcgtcgtccttacactgttgtactgtttgatgagattgagaaagcccatcctgatgtgttcaacatgatgcttcagatcctggaagatggaagactaacagacagtaagggcagaacagtggatttcaagaacacacttcttataatgacatcaaatgttggaagcagtgtgattgagaaaggaggccgcaaaattggatttgatctggattacgatgagaaggatagcagttataacagaatcaagagcctggtaactgaggagctaaaacaatacttcaggccagaatttttgaatagattggatgaaatgattgtcttcaggcagctcacaaaactggaggtgaaggagattgctgacataatgctcaaagaggtgtttgatagactgaaggtgaaagatattgaacttcaagtgacagaaagattcagggacagagtggtggaggaaggttataaccctagttatggagctagacctctaagaagagccataatgcgacttttggaggacagcatggctgagaagatgcttgccagagagatcaaggagggcgactctgttatagtggatgttgattctgatggtaatgtgattgtgctcaatggtagcagcggagcccccgaatccttgccagagacgcttcctgtataatgcggttaatttgctaatactatgtacttaatttgtttaaaccatagtcatagtatgttttacttgtcaatgtacctaaagtttttaatggaatacctggtaggcctcatcatgttttttgcctataaagcaaatcaaattcagaaaaagggtagcggggttaccagggggatatagggaaaaactgaaaaaggatttgtggggaaggtgaaaatcagcgccgtattcggtataactttggcaccaatgaactattccgtcggaagctgggggtgtttgtatgtttccactggtttgactatgatgtaatattaatatcccagcattactgtaaatgatcattatggcgtattcattgcttgagattgcaatgcatgtaatgacaggtttagggtattagatcaatttgaatacgacagtgtccccaaatcatctatacacaagtttaaaatgtagggcggatgcggagtgaatcaacgtgattcatgtattatatcgg

SEQ ID NO: 3125 - DNA, 3246 bp, Panicum virgatum
cagaatcaggagtctggacgaaaggaggggagagagggtgttcttgttctctttcttattcggcactcggccaggccaagcaagcgcccccttatctccagggaccacgggaggacgcaacaccaacgcccttctcctcctcctcctctctctctctcctcggaggttaagggacggtgcttctgaccatggcaggaactttactccagtcagttgccctcggaacaacatttgcaggtcgcataagcacccagcaattgaggtcccatggcgccaggaggcctgtctctatgttggcaatgtcgcttagccgccctgtcaagatgtcagcatttgttggcctaagatcggtacatagcttctcgatcacaccgacagtgtccaattccaggtcagcagttgcatcttacagatcgtctcggcggacaaggcgttctcgttttgttactcgggcgatgtttgagaggtttacagagaaagctattaaggtcatcatgcttgcgcaagaggaagcaaggcgcctgggtcacaactttgttggaaccgagcaaattctcttgggtctgatcggagagggcactggtattgcagcaaaggtgctcaagtccatgggtataaatctcaaggatgcacgtgtggaagtggaaaagatcattgggcggggcaacggctttgttgctgttgaaataccattcacaccgcgcgctaaacgtgttttggagctctcattggaggaagctcgccaattaggacacaattatattggatctgagcacctgcttcttggactgcttcgcgagggtgaaggtgtggcggctcgtgtacttgagagtctcggagctgaccctagcaatatccgtacacaggttatccgaatgattggggagaccacagaagctgttggtgctggagttggaggagggagtagtggtaataagatgccaacacttgaggagtatggaactaatttaacaaaattagcagaagagggaaagctagatcctgttgttggtaggcagccacagattgagcgtgtggtacaaattttaggcagacgaacaaagaacaatccctgcttgattggagagcctggtgttggaaagactgcaattgctgaggggcttgctcaacgcatttctactggcgatgtgcctgagacgatagaagggaaaaaggtcattacccttgacatgggacttcttgttgctggcacaaaataccgtggagaattcgaagaaagattaaagaagctgatggaagaaatcaagcaaagtgatgagataatactctttattgatgaagttcacacactgataggagcaggagcagctgaaggtgctatcgatgctgctaatattttgaagccagcattagcaagaggtgaattacagtgtattggagcaactacacttgatgaatataggaagcacattgagaaagacccagccctggaaaggcgtttccaaccagtgaaagtgccagagccaacagtagatgaaaccatagaaattctcagaggacttagggaacgatatgagatccatcataaacttcgttacactgatgaagcactgatcgcagctgcaaagctttcatatcaatacatcagtgatcgtttcctcccggacaaggcaatcgacttgattgatgaagcaggttcccgtgttaggctacagcatgcacaggttcctgaggaagcaagagagcttgataaggagctcaaacaaataacaaaacagaagaacgaagctgttcgtagccaggattttgaaaaggctggagagctgcgagaccgtgaaatggaattgaaggcgcaaataacagccctcattgacaagagcaaggagatgagcaaagcagaggaggaatctggagagacaggaccaatggttaatgaagcagatatccagcacatagtgtcgtcatggactggcattccagtggagaaggtctctagcgatgaatctgataagcttcttaagatggaagagactttgcacagacgtgtcattggccaagatgaggctgttgtagcaattagtcgctccatccgccgtgctcgtgtgggcctcaagaaccccaacaggccaattgcaagctttattttcgcaggtcccaccggtgttgggaagtcagagctcgcaaagacccttgctgcctattactttggctctgaggaggctatgatccggcttgatatgagtgaatttatggagaggcacacagtgtccaagctgatcggttcacctccaggatatgttggatacactgagggtggccaactgacagaggcagttcgacggcggccatacacagttgtgctctttgatgagattgagaaggcacaccctgatgtcttcaacatgatgctccagattttggaagatgggaggttgaccgacagcaagggaagaacggtggacttcaagaacaccctcctgatcatgacctcaaatgttgggagcagtgtcatcgagaagggtgggcgcaagattggttttgacctcgactctgacgagaaggacagcagctacggcaggatcaagagcctcgtcattgaggagatgaagcagtacttccgccctgagttcctcaaccgtcttgatgagatgatcgtcttcaggcagctcaccaagctcgaagtcaaggagattgcggacatcatgctccaggaggtctttgaccgactcaaggccaaggacatcaacctgcaggtcactgagaagttcaaggagcgggtggtggacgaaggctacaaccccagctacggtgcgcggccgttgaggcgggctatcatgaggctgctggaggacagccttgcagagaagatgcttgctggggaggtcaaggagggtgactccgccattgtggatgttgactcagagggtaaggtcgtcgtgctcaatggtcagggtggcattcccgagctctcaactcctgcggtcgccgtttagatcgtaaataacagctgacaaaatagttgagttttcgtttcaaacacattatcatgtagctagcggataactatgtatatgtagtggtatagtcgaaggaaaaaatcaatgttgcctttgaatttttcttttcgaattcaagtatttttgtctctgaaatcaatctcaccaggaacgataacgtgtagagactagttacgcttgatttttaagtgatggggatctggaatgatattgaattaaactaaagttaccatctgatgcgcgagagaaataccaaagaaacattatg

SEQ ID NO: 3126 - DNA, 3229 bp, Cajanus cajan
ccggctattcaggaatcatggctagggttttggctcagtcaattaatgtccctggtgtagtagctgagcataggcatggtcagcataaggggtcaggaaaattaaaaagatcaaccaaaatgatgagtgctttacgaacaaatggattaagaatgtcaggtttctcaggacttcgtacttttaatcctttggatactatgttgagacctggaatagattttcactctaaggtatccattgcaacttcttcacggcgagcaaaagctacccgatgtgtacccaaagccatgtttgagcgtttcactgagaaagctatcaaagtaattatgctagcccaggaggaagcaagacgtcttggtcacaattttgttggaacagagcagattctattgggtcttattggtgaaggcactggtattgctgctaaggttttaaagtcaatggggatcaaccttaaagatgcacgtgtggaagtagaaaagataattggaaggggtagcggatttgtggcggttgagattccgtttactccacgtgcaaagcgtgttttggaactttcactggaggaagctcgtcaacttggtcacaattatattggatctgagcacctgcttctgggtcttcttcgagagggtgagggtgtagcagcacgtgttctggaaaacctgggtgctgatccaactaatattcgcacacaggtaattcgcatggtgggtgagagtgctgacagtgttactgctactgttggttcaggaagtagtggcaataagatgccaactttggaggagtatggtaccaatttgaccaagctagcggaagagggaaaattggatcctgttgtgggaaggcagcagcaaattgaacgtgtgactcaaattttaggtcgtcgaaccaaaaataatccttgtctgattggagaacctggtgttgggaagacagcaattgctgaaggtcttgcccaacggattgcaaatggtgatgtacctgaaaccatagagggaaaaaaggttataaccctcgatatgggtctgcttgttgctggaactaaatatcgtggtgagtttgaggagaggttgaagaaactgatggaagaaatcaaacaaagtgatgagataatactttttatcgatgaagtgcacactttgattggagctggagcagcagaaggggcaattgatgctgctaacatactcaagccagctcttgcaagaggtgaactacagtgtattggagccacaacattagatgaatacaggaagcacattgaaaaagatccagctttggagagacgattccagccagttaaagtgccagagccaactgtagatgaaactatacaaatactgaaaggacttagagaacgatatgaaattcaccacaagctccgctataccgatgaggctcttgtagctgctgcacagctgtcgtaccagtatatcagtgatcgatttttgcctgataaagctatagatttgattgatgaagctggttcacgagtccggcttcaacatgcccagctacctgaagaagcgagagaacttgacaaggaggtcaggcagattattaaggagaaagaagaagctgtgcgcaaccaagactttgaaaaggctggagagctacgagataaagaaatggatcttaaggcacagatctcaacacttgtagagaaaggcaaggagatgagcaaggcagagagcgaggccggggacgaaggtcctattgtgactgaagctgacatacagcatattgtatcatcctggactggtattcctgttgaaaaagtctcaacagatgaatctgatcgcctcctcaaaatggaagagaccttacataagcgagtcattggtcaggatgaagcagtaaaagccattagtcgagctatccgtcgagctagggttggattaaagaaccctaatcgtccgattgccagcttcatcttttctggtcccactggtgtgggaaagtctgaattggccaaagcattggctgcatactacttcggctctgaagaagctatgattcggcttgacatgagtgaatttatggaaaggcacactgtctccaaacttattggttcacctcctggatatgttggttacactgaaggtggccaattgactgaagcagttcggcgccgtccttacactgttgtactatttgatgagatcgagaaagcccatcctgatgtattcaacatgatgcttcagatcctggaagatggaagactaacagacagtaagggcagaactgtggatttcaagaacacgcttctcataatgacatcaaatgtgggaagcagtgtgattgagaaaggaggccgccgaattggatttgatctggattacgatgagaaggatagcagttataacagaatcaagagcttggtgactgaggagctaaaacaatacttcaggccagaattcttgaataggttggatgaaatgattgtcttcaggcaactcaccaaactggaggtgaaggagattgctgacataatgctcaaagaggtgtttgacagactgaaggtgaaagatattgaacttcaagtaacagaaagatttagggacagagtggttgaggaaggctacaatcctagttatggagccaggcctctaagaagagccataatgcgacttttggaggacagcatggctgagaagatgcttgctagagagatcaaagagggagactctgttatagtggatgttgattctgatggtaatgtgattgtgctcaatggtagcagtggaaccccggagtccttacctgaggcacttcctgtataatgcggttacctagctataactatgtacttaatttgtttaagccatagtcatagtatgttttactgtcaatgtacctaaaatccttttaattgatcactggttaggcctaatgttttcccatagctaagcaaaaacaaaaacaaattcaagaaaaaaggggtagcgggggataccggggaaaactgaaaattagcgtcgtatttgggacagtgtgcatcaatgaaggtttccgtagggagctgggtgcttttatgttttaactggttcgaccatgatgtaatatcccagcattactgtaaactaaactagatatatatccctgcgatgcatcatgcgtggccagtggcacttactattttttccttttttactattatctttaataacccaacttagtatataggttaaaaccccttcctattaataaatgatttagattcaga

SEQ ID NO: 3127 - DNA, 3176 bp, Triphysaria pusilla
atttccgtctaaagaaatccggccgagcatttgaggacctctttcaaaatctcgcagacacactattttccgtatacttgtatctcatttagaccccttgaaggcagacatgtcacacgctctgcttcaatcgaccactttgccctcttcagttggtttggcaaataatggaaaggtcaagggctctaataaaacaagaaacacagcaacaatgttgtccagcacgcaatcagctcccatgaggatgagaggcttctcaggattgcggggagctaatgcattagacttcttggtgtcccaaaatcggcagacgctccaatcgaaggtagaagcggcaaccagtcccatgaaacgaggacgaaaaacacgcatggccccacgagccatgtttgagcggtttacagagaaagcaataaaagtcattatgcttgcacaagaggaggcgaggcgactgggccataattttgttgggactgagcagattttattggggcttataggcgaaggcactggaattgccgctaaggtcctcaagtccatgggaataaatctgaaagatgcccgtgtagaggtggagaaaattattggacggggcagtggatttgttgctgtggagataccctttactcctcgtgctaaacgtgttctagaactctctctggaggaagcccgccaactaggtcacaattacattggatcggagcacttgctgctaggattgcttcgtgagggtgaaggggtggctgcacgtgttcttgagaatttaggtgccgaccccagtaatattcgaactcaggttattagaatggtcggtgagagtgctgaggctgttggtgctggtgttggaggtggaagctcaggcaacaaaatgcccactttggaagagtatggtaccaatttgaccaagctagcggaagagggtaaactagaccctgttgtgggaagacaggctcaaattgaacgcgtcactcaaattttgggacgtcgcacgaaaaataatccttgcctcataggagagcctggtgttggaaaaacagctattgccgagggtcttgctcaaagaatagccaacggagatgttccagaaactatcgaggggaaaaaggttataactctggatatgggtcttcttgttgctgggacaaagtatcgtggtgaattcgaagaaagattgaagaagttgatggaagagattaagcaaagtgatgaaattatactgttcattgatgaagtacacacattgattggagcaggcgctgctgaaggtgcaattgatgctgcaaacatcttgaagcctgcattagctcggggtgaactgcagtgtattggggctaccacactagatgaataccgaaagcacattgagaaggatccagcactcgaaagaaggtttcaacctgtcaaggttcctgaacccacggtagatgaaaccattcagattcttaaagggctccgagaacgctatgagatacaccacaagcttcgctacactgatgagtctttagttgctgcagctcagttgtcttatcaatatatcagtgaccgttttttgcctgataaggcaatcgacttggtcgacgaagctggttcccgtgttcgacttcgtcatgcacagctccctgaagaggccagagagcttgagaaagagcttaggcagataacaaaggagaagaacgaagctgtccgaggtcaagactttgagaaggctggggagctacgtgatagagaaatggatctcaaggcacaaatgtctgctctcatagacaaaaacaaagagatgagcaaagccgaaagtgaggccggggatataggtcccatcgtcactgaagtcgacattcagcacatcgtttcttcttggacaggcatccccgtcgataaggtctcggctgacgaatctgatcgtctcctcaagatggaggagacactacacacgagggtcgtcggtcaagacgaagccgtcaaagccattagccgagccatccgccgtgcccgtgttggtctcaaaaaccccaaccgccccattgccagcttcatcttttctggccccacaggtgtcggtaaatccgagctagcgaaagctctggccgcctactatttggatccgaagaggccatgatccgactcgacatgagtgagttcatggagagacacacagtatcgaagctcatcggatcgccacctggatacgtcggttacactgaaggtggacagctgaccgaggctgttagacgtcgtccttacaccgtcgtgcttttcgacgagatcgaaaaagctcacccggatgtcttcaacatgatgcttcagattctcgaagacggaaggttgaccgacagcaaagggagaaccgttgacttcaagaacacacttctcataatgacttcgaacgtcgggagcagcgtgatcgagaagggtggtcgccgtatcggtttcgatcttgattacgatgagaaggacagcagctacaatcggatcaagagccttgtgagcgaggagcttaaacagtatttcaggcccgaattcttgaacagattggatgagatgatcgtgttcagacagctcacgaagctggaggtgaaggagatagccgatattatgttgaaggaagtgtttgagagattgaaggttaaggaaatcgaactccaggtgacggagaggtttagagacagggtggttgacgaaggatataaccctagctatggagcaagacctctcagacgagcgattatgaggcttttggaggatagcatggccgagaagatgctagcacgtgaaattaaagaaggggattcggttattgttgatgtcgattccgatgggaatgtgatggttcttaatggtgccagtgggacccctccggaaccgtcccctgaaccattggcggtgtaaatttagctgtttggttggttcggacctggcctgcagttggacttggcaggcagtaggctcagaagctattctgccacttggtgatttataggctctattttctgaaaaagttcctagaatatatttatgtacttgagctatatatgctcgttgtaattttctttgttaggaagaaggtgatacagttggaacgtttagagagccttgtttattgtattgtaaaaatgctgataactcttgtttaatatatgttgtaagagcacgtctcttattcgaaaaaaaaaaaaaaa

SEQ ID NO: 3128 - DNA, 2797 bp, Musa acuminata
ccattactttttttaaagaagatggctaggcctttattcaaatcatctgtccttcctgatgctgtgtctggaagtgttcctttatttcaaggttctgggaaagctaggaagcctgcaaacatgatgtgcagtagaagatcatcacagcttagattcttaggcttcacaggcttgaaaggttcaaatgatttgcatttagtgtctggacctagcaaagatttcagattagctgtgtctgcttcagtctctgcaccaaagggaaaagcttctcgtggagttgctgtagctatgtttgaacggttcacagagaaggctattaaagttattatgcttgcacaagaagaagcaagacgacttggccacaattttgttggaacagaacagatattgttgggtcttattggtgaagggacaggtatagctgctaaagttttaaaatccatgggcataaatcttaaagatgctcgtatcgaggttgaaaaaatcattggaagaggcagtgggtttgttgctgtagaaataccattcacacctcgtgcaaagcgtgttttggagctctctcttgaggaagctcgtcaactaggtcataactatataggatctgagcacttgctacttggattgcttcgtgagggtgaaggtgtggcagctcgtgtacttgagaaccttggagctgacactagcaacatccggacacaggttattcgaatggttggtgaaagcacagaagctgttggtgctggagttggaggaggaagcagtggcaataagatgcctacacttgatgaatatggaactaatctaacaaagttggctgaggagggaaagctagatcctgttgttggtaggcagcagcaaatagaacgtgtggtccagattttaggaaggaggacaaagaacaatccttgcctgatcggtgagcctggtgttgggaagacagcaattgcagaaggtcttgctcaaagaatagttactggtgatgtgccagaaacaattgaaggaaagaaggtcattacacttgatatgggactccttgttgctggaaccaagtatcgtggagaatttgaagaaagaataaagaaactgatggaagaaattaaacaaagtgatgagataatactcttcattgatgaggtacacactttgattggagcaggggcagcagagggtgcaattgatgctgctaatatcctaaaaccagctcttgcaagaggtgaactgcagtgtattggagccacaactctggacgagtacaggaagcacatcgagaaagatccagctctggaaagacggtttcagccagttaaagtgccagaacccactgttgacgaaactatagagattctgagagggcttcgtgagcgatacgagattcaccacaaactccgttacactgatgaggcactcattgctgctgcacatttgtcttaccaatacataagtgaccgttttctccccgacaaagcaattgacttagttgatgaagctggttcccgtgttaggcttcgccatgcacagcttcctgaagatgccagagagcttgataaagagctcagacggataaccaaggaaaaaaatgaagctgtccgcggtcaagattttgaaaaggcaggagaactgagagatcgggaaatggagctcaaggctcagatctcggcacttgttgacaaaggcaaagagagaagccaggcagaaagtgaggctggagaggggggcccagttgttacggaagcagacattcagcatattgtctcttcatggacaggaatcccagttgaaaaagtctcgagtgatgaatctgatcgtctcctaaagatggaggagactcttcacaagcgtgtcattggccaggatgaggccgtcaaagctataagccgtgctattcgccgagcacgtgttggccttaagaaccccaaccgacccatagccagcttcatattttctggtcctacaggtgttggtaaatcagagcttgcaaaagctctggcagcctactattttggctctgaggaagccatgatccggcttgacatgagtgaattcatggagagacatacagtttccaaactcattgggtcacctcctggctatgttggctacactgaaggtggccagcttactgaagctgttcgacgcagaccctacacggttgtcctctatgatgaaatagagaaggctcacccagatgttttcaacatgatgcttcagatcttggaagatggaaggctgactgatagcaagggtcgaacagtcgatttcaagaacaccctccttatcatgacatctaatgtgggaagcagtgtgatcgaaaaaggaggtcggagaattggttttgatttggactatgatgagaaagacagcagctacaacagaatcaagagcctcgtcactgaggagctgaagcagtattttagacctgagttcctcaaccgactagatgagatgatagtcttccgtcaactgacaaagttagaggtgagagagattgcagatattatgctgaaggaggtgtttgagagggtcaaagcgaaggacatagaacttcaggtcactgagagattccgagacagggttgtggaggaaggttacagcccgagttatggagcaaggccattgcgaagggccatcatgaggctgttggaagacagcatggcagagaagatgctggcaggcgagataaaggagggagattcagcaatcgtagatgtcgatgctgatggcaacgttacagttctaaatggacggactggtttgccagagcaattgcccccagctattcctgtgtgaagaacaccat

SEQ ID NO: 3129 - DNA, 3306 bp, Ricinus communis
gaaaccacatctatatatctatcctctcttctcggccgaccataaaaggagtctctctctgttttttctttaaaaataaaaattatataaaaggaaagaccctctttaggtctcttctttcttttcatttttcatttttattattgtttcttcttttcggttctatctctgaaattttagagtgtctcttacatggcgaggcttctagttcattcaataaatgttcctgctttagctcctcatataaagcatggccaatctcaagaatctggaacatcaagaaggactgctaccaaaatgatgtgtagttcacggttgccagcgttgacattgagagggtatactggattgcgaagctcaaattgtttagatacaatgctgagatctggactagatttccattccagggttgcaatcacaatgtcacgcaggcaacagaaagctaagcggtttctacctagggctatgtttgagcgcttcacagaaaaagcaataaaagtgattatgcttgctcaagaggaagcaagacggcttggtcacaactttgttggcacagagcaaatcctgttaggtcttattggtgaaggaactggtattgctgcgaaggtgctcaagtctatgggtatcaatcttaaggatgcgcgtgtagaagttgagaagattatagggagaggcagtggatttgttgctgtggagattccatttactcctcgtgcaaaacgtgtcttggaactttcattggaggaagcccgccaacttggtcacaactacataggatctgagcacttgctgcttggattgctccgtgaaggtgaaggtgtagcagcccgtgttcttgagaatttaggtgctgaccctagcaacatccgcacacaggtcattcgcatggttggtgaaagcacagaaaatatccctgcccctgttggaccaggaggtggcagcaataagatgcccacgctcgaagagtatggaactaatttgactaagctggcagaggagggtaaattggatcctgttgttgggagacagccacaaatagaacgtgtcatccaaatcttgggtcgccgaactaaaaataatccctgccttattggtgagccaggtgttgggaaaacagcaattgcagaaggtcttgctcaacgtattgccagtggtgatgtccctgaaacaattgagcgaaagaaggtcattaccctggatatgggtcttctagttgctggaaccaaataccgaggagagtttgaggaaagactgaagaagctaatggaagaaatcaagcaaagtgatgaaataattctctttatcgatgaggtgcataccttaattggagctggagctgcagagggtgcaattgatgcagctaatatcttgaaaccagcacttgcaagaggtgaattgcagtgtattggagctaccacactggatgaatacagaaagcatatcgagaaggaccctgctttagaaagacgattccagccagtcaaagtgcctgagccgtctgtagatgaaaccattcagattctgaaagggctgcgtgagcgatatgagatccaccacaagctccgttacacagatgaagcactagtagctgctgcgcagttgtcatatcaatacatcagtgaccgttttctccctgataaggcaattgatttgattgatgaagctggttctcgggttcgcctacgtcatgcacaggttcccgaggaagctagggagcttgaaaaagaggtcaggcaaataacaaaggagaaagatgaagctgttcggagccaagactttgaaaaggctggggaattacgggaccgtgaaatggacctaagggcacaaattgcagctattgtggagaaaggcaaggagatgagcaaggctgagactgaggcaggagatgtaggtcctcttgtcaatgaatcagacattcagcacattgtttcttcctggactggtattcctgttgagaaagtatcaactgacgaatcagatcgccttctgaagatggaagagaccttgcacaaaagagtcattggccaggatgaagctgtcaaagccatcagccgtgctattcgacgggcacgtgttggactcaagaaccccaaccgtcctattgctagcttcatattttctggtccaactggtgtgggaaagtcagaactggcaaaagcactagctgcctattactttggatctgaagaagcaatgatccgacttgacatgagtgagttcatggaaagacatacagtatccaagttaattggttcacctccaggttatgttggttatactgagggtggtcagttgacagaagctgttagacgtcgcccttacactgttgtactatttgatgagattgagaaggcccatcctgatgtcttcaacatgatgcttcagattcttgaagatggaaggttaacagacagcaagggcagaactgtggatttcaagaatacccttctgataatgacttcaaatgtcggaagcagtgttattgagaaaggaggtcgccggataggatttgaccttgattatgatgagaaggatagcagctataatagaattaagagcctggtgacagaggaattgaagcagtatttcaggccggaattcttaaatagattggatgagatgattgttttccggcagctcactaagctagaggttaaggagatagctgatataatgttgaaggaagtgtttgacaggctgaaggtcaaagatatagagcttcaagttacagagagatttagagagagggtggttgaagaagggtataacccaagctatggggcacggccattacgaagagccataatgagactactagaggatagcatggccgagaaaatgcttgcaggagagatcaaagagggcgattcagttatagtggatgttgattctgatggtaatgttattgtgctaaacggcagcagtgggtctcctgaggcattgcctgatgtgttgtcagtcgtgtaagcaaaggctccctgtttaggaatctatgctcctgtgttgcttgtactgcatcgttttaacttaaattggcaatatagtttgtagtctgttttgttgcaatgactacttggcggcggatatggggcctgtgatttgatattgggtgggttgaaggctgtacttttatatcaccatgaataggatgaatattgaacagttaggcggcatatagtccatggtatgtgggttagtttttcataataaacggatagtcatggggaagttataactcagttttctttttttttttctttttggttgtcatgtaatgggaaattgtgatttcaacttgcaacacaa

SEQ ID NO: 3130 - DNA, 3208 bp, Tripterygium wilfordii
attctgccaggataagagcatttactcgcatctctaatacgtttggatttctaatagaaatttaacaggaggatcacactgaatagagatcctctctctcttctttggccgagcataaaagagtgtctctcttcatctgctaggggaaaaagagagacccttttggtctatctaaatattccattatttattttattcatcaatcaaactacgattccgcgatttaggactgcttcatgatggcaagagttttggttcattcaactaatgtccctgctttagttcctggacggaggctcggccaatctcaaggatctggcaaagcacgaagtgtcaaaatgatgtgtgcttttcgagtgcctagagtgacaatgagcggtttctctggattgagaggtgtcaactccttagattttatgttcaggtctgccgaggattttcattctaaggtgaacagatcaatcaattttcggcgtgcaaagcctagccgatgtgttacgaaagcaatgtttgagcgtttcactgagaaagcaattaaagtaattatgctcgcacaagaagaagctaggcggcttggtcacaattttgttggcacagaacaaatactgttgggtctaataggtgaaggcactggcattgctgcaaaggttctaaaatctatggggatcaatcttaaagatgcacgtgtagaagtggagaagataattggtaggggaagtggattcgttgctgtggagataccattcactcctcgtgcaaagcgtgtgttagagctctctctggaggaggcccgccaactcggtcataactacattggctccgagcacttgcttcttggcctacttcgtgaaggggagggtgtagcagcccgtgttcttgagaatctaggtgctgatcctagtaatatacgtacacaggtgatccgtatggtgggtgagagcaatgaaaatgctgttggtgttactcctggtggaggtggtagcaataagatgccgacacttgaggaatatggaactaatttgacgaaaatggcagaagagggtaaattagatcctgttgttggaaggcagccacaaatagaacgcgtcgtccaaattttgggtcggcgcactaagaataacccttgtctcattggagaacctggtgtggggaaaacagctatagcagagggtcttgctcagcgaattgctagtggtgatgttcccgagacaattgagggaaagaaggttataaccctggatatgggccttctagttgccggaactaagtaccgtggagagtttgaggagagactaaaaaagttgatggaggaaatcaagcagagtgatgaaataattcttttcattgatgaagtgcacaccctaattggagctggggcagcagaaggggcaattgatgcggcaaacattttaaaaccagctcttgctagaggtgaattgcagtgtattggagctacgacattagatgaatacagaaagcacattgagaaggacccagccttagaaagacgatttcagcctgtgaaagtaccggaaccttctgtagatgaaactatacagattttgagaggattgcgagaacgttatgagatccaccacaagctccgctacacagatgaagccctagattctgccgcaaagctttcatatcagtatatcagtgatcgctttctgcctgataaggcgatagacttgattgatgaagctggttcaagagttcggctacgtcatgcacagctccctgaggaagctagggagcttgaaaaggagctcaggcagataaccaaagagaaaaatgaagctgttcgcagtcaggactttgaaaaggccggggagttacgtgatcgagagatggacttaaaggcacagatctcagctcttgtagacaaaggcaaggagatgagcaaagctgagagtgaagctggggatgtaggtcctgttgtgactgaagtggacattcagcatattgtctcctcctggactggcattccagttgagaaagtatcttctgatgaatctgatcgccttctcaagatggaagagacgcttcacaagcgggttgttggtcaggatgaagctgtcaaagccatcagccgtgctattcgccgtgctcgtgttggcctaaagaaccctaaccggccaatcgctagtttcatcttttccggtccaactggtgtagggaagtcggagttggcgaaagcactagcagcatactactttggctctgaggaagcaatgattcgacttgatatgagtgagttcatggaaagacacactgtttccaagctcattggttcacctcccggctatgtaggttatactgagggtggccagctgactgaagctgtacggcgtcgtccttatacagtagttctctttgatgaaattgagaaggcccaccctgatgtcttcaacatgatgcttcaaattcttgaagatggaaggctaacagatagcaagggcagaactgttgacttcaagaatactcttctgataatgacatcaaatgttgggagcagtgtaattgagaagggtggacgccggatgggatttgatatggactatgatgataaagatagcagttacaaccgaatcaagagcctggtaacagaggagttgaagcaatatttcaggccagaatttctcaacagattggatgagatgatcgttttccggcaactcacgaaactggaggtgaaagagatagccgatataatgttgaaggaggtatttgagaggttgaaagtcaaagagatagaacttcaagtgacagagagatttagagatagagtggttgatgaagggtacaaccccagctatggtgcaaggcctttgaggagggccataatgagactcttggaggacagcatggctgagaagatgcttgcaagagaaatcaaagagggtgattcagttatcgtcgatgtagattctgatggaaatgttactgtgctcaacggtagcagtggtgctccggagtccttgccggatgcattgtctgttgtgtaaactgttacttaataccagttatgttgtttgtaccttttcttttggtttgaattagctttatatgattatatctgtagtctctttttttttccttgaaaggactacatggccgtagaattgggagctgttggttatattgatggcttttgttgtaaggctgtattttcagcaccatgatagttattgatagtcaactagca

SEQ ID NO: 3131 - DNA, 3373 bp, Solanum lycopersicum
gacaattatatctatccacctactttctctatatagctatcacacggccgactttcaagctctctctatttcttttttctttcttttttctcctctttccaccatctttagtgttattgaggttgcaggtccatgatggctagagctttagttcagtcaacaaacattctaccttcagttgctggtgaaagggctggacaattcaatggatcccggaaagatcaaagaactgttagaatgctatgtaatgtaaaatgttcttcctcaaggctgaacaattttgcaggactgcgagggtgcaatgcattagatacactactagtaaaatctggagaaactctccattcgaaagtggcagctgcaacttttgtcagacggccacgagggtgccgatttgtcccaaaagcaatgtttgagcggttcaccgagaaagcaataaaagtcattatgcttgcccaagaagaggccagacgactaggtcacaactttgttgggacagaacagatcctgctgggtcttattggtgagggaactggtattgctgctaaggttcttaaatccatgggaattaatttgaaagatgctcgtgtggaagtagagaagatcattggcaggggtagtggatttattgcagtggaaatcccttttactcctcgtgcaaagcgtgttctagaactatctctggaggaagcccgccaactagggcataattacattggctccgaacacttgttacttggattgttgcgcgaaggtgaaggtgtggctgcccgtgttcttgaaaacttgggtgctgaccccactaacattcgcacacaggtcatacggatggttggcgagagtagtgaggctgttggtgctagtgttggaggtggaacttctggcctaaagatgcctacattggaggagtacggcaccaatttgacaaagttagctgaagaggggaaactagatcctgtagttggaagacaggctcaaatcgagcgtgttactcaaatcttgggtcgccgtacaaaaaacaacccttgccttattggagaaccaggtgttggaaaaactgctattgccgaagggctagctcaaagaattgctaatggtgatgtccctgaaacaatagaaggaaagaaggtcataacacttgatatgggattgcttgttgctgggacaaaataccgtggagagtttgaggaaagactgaagaaactaatggaggaaattaaacaaagtgatgaaataatactgtttattgatgaagtacacacattgattggagctggagctgcagagggagcaattgatgctgcaaacatcttgaaacctgccctggctagaggcgagctacagtgtattggagccacaaccctggatgagtacagaaagcacattgagaaagaccctgcactagagagaaggttccagccagttaaagtccctgaaccttctgtggatgaaaccatacagatcttgaaagggcttcgggagaggtatgagattcatcacaagctccattacactgatgaggcaatagaggccgctgccaagctttctcaccagtacatcagtgaccgctttctgcctgataaagcaattgacttgattgatgaagctggttcccgtgttcgacttcgtcatgcacagctccctgaggaagcaagagagctggaaaaggagcttcgccagattacaaaggagaaaaatgaatctgtccgcggtcaagattttgagaaggctggggagttgcgtgatagagaaatggatcttaaggcacaaatctcagccttgatagacaaaaacaaagagaagagcaaggcagaatctgaggcaggagatgcagcaggtcccatagtgacagaggcagatattcagcatattgtctcttcctggaccggcattcctgtagagaaggtctcaactgatgaatctgatcgcctcctaaaaatggaagaaacacttcatacccgagtcattggccaggatgaagcagtaaaagccattagtcgtgctatcagacgtgcccgtgttggcctcaagaatcccaaccgacctattgccagtttcatcttttctggtccaactggtgttgggaagtcagaactggccaagtctttagcaacgtactactttggttctgaagaagcaatgattcggcttgatatgagtgagtttatggaaagacacactgtgtctaaactcatcggttcaccccctgggtatgttggttacactgaaggtggtcaattaactgaagctgtgaggcgtcgaccttacactgttgtgctctttgacgagattgagaaggctcatcctgatgtctttaacatgatgcttcaaattcttgaagatggaagattgacagacagcaaaggcagaactgtcgacttcaagaatacactcctcatcatgacatcgaatgttggcagcagtgtgatagagaaaggaggtcgtcgtataggttttgatctagattttgacgagaaggatagtagttacaaccgtatcaagagcttggtgactgaggagttgaaacagtacttcaggccagagtttttaaacagattagatgagatgattgtattccgtcagctcactaagttggaggtgaaggagattgctgatatcatgcttaaggaggtctttgtgaggttgaagaataaggagatagaacttcaagtgacagagaggtttagagatagggtagttgatgaaggatataacccaagctacggagctaggccactgagaagagctattatgagactgctagaggatagcatggccgagaagatgcttgcaggtgagatcaaagaaggtgattcagtaattgtggatgtggattcagatggcaacgtcaccgtcctcaatggcagtagtggtgctccctcagattcagctcctgagcctatccttgtgtagatcaattcttcatttagctctacaaatttgttcttcgtaatgttgcttttggatgtcttggctaagcaacatgtgagtaattttttgggtgacaggctgatatattcttccaagttgactaggcagtctccttcccaaggatagcattcaggaatacacactatatacttaattgggtttcattaaaattctgtcaagggatatgtaaaagcatttcttctaatttttggtaggtgatagttagactttttatcatcattttcagtacgtttttcttctaatttttggtaggtgatggtcagacattgtcatcattttcagcatgttttttctgctgtcttgttaatttggttcataccacaactaagtattttggttatgaacatttgagttcttgtccacaacaaacactagacaaatgtacttccaaatttcgaatttgaatgaattttgtcagcca

SEQ ID NO: 3132 - DNA, 3230 bp, Cedrus atlantica
aaggatttctttacctgatcaagcagattaggcaggcttattatctgggtaagatggctggtgcactagcacaatctgcaattcttcctggtagaataatcagtacaaagcatggtcaaatccagaactctaaaagagggaaacgagttccaaagatgattggtaaggtgcattcacgatccttcagcatgcaaagtttcactggattgcgccaagaaacatgcatagataaggttggaagtcgtgtaaaagactttcatacaacagtagcagcttcaattcgtcttccagtggggaaaggcaatagaggggtggttgtagctatgtttgagcgctttactgagaaggccatcaaggtaattatgcttgctcaagaggaagcacgacgccttggacacaattttgtaggtacagagcagattctcttaggtctcattggtgaagggactggtattgcagcaaaggtcctaaaatccatgggaatcaatctcaaggaggctcgtgtagaggttgagaaaatcattggcagaggcagtgggtttgttgctgtggagattccattcactcccagagcaaagcgtgtgttggaactttcactggaggaagctcgacaacttggacacaactacataggatctgaacacttgcttttagggttgttgagggagggtgaaggtgtcgcagctcgtgtgcttgagaatcttggagctgaccccagcaatattcgtacacaggtgattcggatggttggagaaagtacagaagctgttggtgctggagttggaggtggtagcagcagcaacaagatgccaactcttgaggaatatggaacgaatttgacaaaactggcagaggagggcaagcttgatccagtggttggaaggcagccacaaatagaacgtgttactcaaatactgggacgccgtacaaaaaataatccttgtctcattggtgagcctggtgtagggaaaacagctattgctgagggacttgcacagcgaatagcttctggagatgtcccagagacaatcgagggtaaaaaggtcattactttagatatggggttacttgtagctggtaccaagtatcgtggagaatttgaagagagattgaagaagttgatggaggaaatcaaacagagtgatgagattatactcttcatagatgaagttcatactttgattggagcaggtgcagcagaaggtgcaattgatgcagccaatattctgaaaccatctcttgcacgaggtgaactacagtgcattggagccaccaccttagatgaatacaggaaacacattgagaaggacccagcgctagagaggagattccaaccagtacaagtgccagagccaactgttgatgagacaatacagatactgaaaggtttacgtgagcgatatgagattcatcacaagcttcgttatactgatgaggctttggtggctgctgcaaagttgtcgtatcaatatatcagtgatcgtttcctccctgacaaagcaattgatctgattgatgaggctggttctcgagtacgccttcgccacgcacagcttcctgaagaagctagagaacttgacaaagaactcagacagattacaaaagaaaagaatgaagctgttcgaggccaggactttgaaaaggctggagagctacgtgatcgtgagatggaacttaaggcacaaatttcagctttaacagagaaagggaaagagaaatcgaaggctgagagtgaagcaggagatgcaggtccattagtaactgaggtggatattcagcaaattgtatgtgcatggacaggcattccagttgaaaaggtgtcaactgacgagtctgacaaacttttgaaaatggaggaaacactccaccaacgcatcattgggcaagatgaggcagttaaagctatcagtcgagctattcgccgtgcaagagttggtttgaagaatccaaacaggccaattgccagcttcattttctctggtccaacaggtgtgggcaagtcggagcttgccaaggcattggccgcatactattttggctcggaggaggcaatgataaggttagatatgagtgaattcatggaaaggcacactgtttccaagttgattggttcacccccgggatatgtaggctacactgaaggagggcaactaactgaagctgttaggagacgtccttacacggtggttcttttcgatgaaattgaaaaggctcatcctgacgtcttcaatatgatgcttcaaatcctagaagacggaagattgacagatagcaaaggccggacagtggactttaagaatacccttttgatcatgacctctaatgttgggagtagcgtgattgagaagggaggccgtggaattggtttccagcttgattatgatgagaaagacagtagctatacaaggatcaaaagtcttgtcaatgaagagctgaagcaatattttcgacctgagttcctgaatcgattagatgagatgattgtgtttagacagctcacaaagacagaggtaaaagagattgcagatataatgctgagagaggtctttgaacggcttaaaacaaaagaaattgatcttcaagtaacagagcggttcacagaccgagttgtagatgaaggttatagtcccagctatggtgcaaggccactccgtagggcaattatgaggttattagaggatagtcttgctgaaaaaatgcttgccggtgagatcaaagagggcgattcagctatagttgacgtggacggcgaaggaaatgttattgtcttgaatggtaaaactggcacagtagggccatcagccgctgctttagctgcatagaaaaagggcccattcatttgagtggttgggccaaagattggtcaagctggctccatactattaaatgtaagtagctattaaatgccaggatttcatttctggtttcaatttgatttctgagtacatgatgttcgctgtaattaccttagttctgagcatataaagttgtaggatatacgttttgattgttctgaactttattgaaacgatgataacttttaagtggtacaagtacaaaagagatgttgaggttgtctcttaaattcctccagccattaattttcacgaagttctcttgtggattggttgaaatagtttttgtgaatgttcaactactagaaaataattcaaaactgaaatggattcattctgaaattgttggcagtggattagctgcaaatatagaaa

SEQ ID NO: 3133 - DNA, 3463 bp, Glycine max
aaaggagggcaggggaaggttagcgcctattcctcaccacaattttattccttcctcttctcttcttcgctcactatataattcattcatctctctcttttctcttttcagctactttaggtctctctctctttcttcttttctttaatacttaattcgtcttttttatctttctttctttctttccccttttatatttctgggttcgatattgttatcggtttatttgtgcactacttccgccggctattcaggaatcatggctagggttttggctcagtctattaatgtccctggtctattggctgagcataggcatggtcagcaaaaggaatcaggaaaattaaaaagatcgaccaaaatgatgagtgctttacgaacaaatggattaagaatgtcaggtttctcagggcttcgtactttcaatcctttggatactatgttgagacctggaatagattttcattctaaggtatccattgcaacttcttcacggcgagcaagagctaccagatgcgtgcccaaagccatgtttgagcgtttcactgagaaagcaatcaaagtaattatgctagcccaggaggaagcaagacgtcttggtcacaattttgttggaacagagcaaattctattgggtcttatcggcgaaggaactggtattgctgctaaggtgctaaagtcaatggggatcaacctcaaagatgcacgagtggaagtagaaaaaataattggaaggggtagtggatttgtggctgttgaaattccgtttactccccgggcaaagcgtgttttagaactttcactggaggaagctcgccaacttggtcacaattatattggatctgagcacctgcttctgggtcttcttcgagagggcgagggtgtagcagcacgtgttctggaaaatctgggtgctgatcctactaatattcgcacacaggttattcgcatggtgggtgagagtgctgacagtgttactgctactgttggctcaggaagtagtggtaataagatgccaactttggaggagtatggtaccaatttgaccaagctagcagaagagggaaagttggatcctgttgtgggaaggcagccgcaaattgaacgcgtgactcaaattttaggtcgtcgaaccaaaaataatccttgtcttattggagaacctggtgttgggaagacagcaattgctgaaggtcttgctcagcggattgctaatggtgatgtacctgaaaccatagagggaaaaaaggtcataacccttgacatgggtctgcttgttgccggaactaaatatcgtggtgagtttgaggagaggttgaagaaactgatggaagaaatcaaacaaagtgatgagataatactttttatcgatgaagtgcacactttgattggagcaggagcagcggaaggggcaattgatgctgctaacatactaaagccagctcttgcaagaggtgaactacagtgtattggagccacaacattagacgagtataggaagcacattgaaaaagatcctgctttggagagacgattccagccagttaaagtgccagagccaactgtagatgaaaccatacaaatactgaagggacttagagagcgatatgaaattcaccacaagctccgctatactgatgaggctcttgtagctgctgcacagctgtcgtaccagtatatcagtgatcgatttttgcccgacaaagctatagatttgattgatgaagctggttcacgagtccggcttcaacatgcacagttacctgaagaagcaagagaacttgacaaggaggtcaggcagattattaaggagaaagaagaagccgttcgcaaccaagattttgaaaaggctggagagctacgagatagagagatggatcttaaggcacagatctcaactcttgtagagaaaggcaaggagatgagcaaggcagagagtgaggcaggggatgcaagtcctgttgtgactgaagctgacatacagcatattgtctcatcttggactggtattcctgttgagaaagtctcaacagatgaatcagatcgcctcctcaagatggaagagactttacataagcgggtcattggtcaggatgaagcagttaaagccattagtcgggccatccgtcgagctcgggttggattaaagaaccctaatcgtcctattgccagcttcatcttttctggtccaactggtgtggggaagtctgagttggccaaagcattggctgcatactacttcggctccgaagaagctatgatccggcttgacatgagtgaattcatggaaaggcacactgtctccaaacttattggttcacctcctggatatgttggttacactgaaggtggtcaattgaccgaggcagttcggcgtcgtccttacactgttgtattatttgatgagattgagaaagcccatcctgatgtgttcaacatgatgcttcagatcctggaagatggaagactaacagacagtaagggcagaacggtggatttcaagaacacacttcttataatgacatcaaatgttggaagcagtgtgattgagaaaggaggccgcaaaattggatttgatctggattatgatgagaaggatagcagttataacagaatcaagagcctggtaaccgaggagctaaaacaatacttcaggccagaatttttgaataggttggatgaaatgatagtcttcaggcagctcacaaaactggaggtgaaggagattgctgacataatgctcaaagaggtgtttgaaagactgaaggtgaaagatattgaacttcaagtgacagaaagatttagggacagagtggtggaggaaggttataaccctagttatggagctagacctctgagaagagccataatgcgacttttggaggacagcatggctgagaagatgcttgccagagagatcaaggagggcgactctgttatagtggatgttgattctgacggtaatgtgattgtgctcaatggtagcagcggagcccccgagtccttgccagaggcacttcctgtataaggtgcggttaattggccaatactatgtacttaatttgtttaaaccatagtcatagtatgcttaacttgtcaatgtacctaaaatacctaaaattttcaattggatactggtaggcctcatcatgtttgcctatggtcaagcaaatcaaattcaaaggggaaggggtggggggggggggggggtgatagggaaaaactgaaaaatgatctgtggggaaggtgaaaatagcgccgtatttggtataactttggcatcaatgaactattctgtcggaagctggggtgcttttatgtttccactagtttgactacgatgtaatatcctagcattactgtaaatgttccttatggcgcgttcattgcttgagattgaaacatgtaatgacaggattcttgcatgataatgacaggtttagggtattagatcaatttgaaa

SEQ ID NO: 3134 - DNA, 3476 bp, Glycine max
gggaaggttagcgcctattcctcaccacaattttattccttcctcttctcttcttcgctcactatataattcattcatctctctcttttctcttttcagctactttaggtctctctctctttcttcttttctttaatacttaattcgtcttttttatctttctttctttctttccccttttatatttctgggttcgatattgttatcggtttatttgtgcactacttccgccggctattcaggaatcatggctagggttttggctcagtctattaatgtccctggtctattggctgagcataggcatggtcagcaaaaggaatcaggaaaattaaaaagatcgaccaaaatgatgagtgctttacgaacaaatggattaagaatgtcaggtttctcagggcttcgtactttcaatcctttggatactatgttgagacctggaatagattttcattctaaggtatccattgcaacttcttcacggcgagcaagagctaccagatgcgtgcccaaagccatgtttgagcgtttcactgagaaagcaatcaaagtaattatgctagcccaggaggaagcaagacgtcttggtcacaattttgttggaacagagcaaattctattgggtcttatcggcgaaggaactggtattgctgctaaggtgctaaagtcaatggggatcaacctcaaagatgcacgagtggaagtagaaaaaataattggaaggggtagtggatttgtggctgttgaaattccgtttactccccgggcaaagcgtgttttagaactttcactggaggaagctcgccaacttggtcacaattatattggatctgagcacctgcttctgggtcttcttcgagagggcgagggtgtagcagcacgtgttctggaaaatctgggtgctgatcctactaatattcgcacacaggttattcgcatggtgggtgagagtgctgacagtgttactgctactgttggctcaggaagtagtggtaataagatgccaactttggaggagtatggtaccaatttgaccaagctagcagaagagggaaagttggatcctgttgtgggaaggcagccgcaaattgaacgcgtgactcaaattttaggtcgtcgaaccaaaaataatccttgtcttattggagaacctggtgttgggaagacagcaattgctgaaggtcttgctcagcggattgctaatggtgatgtacctgaaaccatagagggaaaaaaggtcataacccttgacatgggtctgcttgttgccggaactaaatatcgtggtgagtttgaggagaggttgaagaaactgatggaagaaatcaaacaaagtgatgagataatactttttatcgatgaagtgcacactttgattggagcaggagcagcggaaggggcaattgatgctgctaacatactaaagccagctcttgcaagaggtgaactacagtgtattggagccacaacattagacgagtataggaagcacattgaaaaagatcctgctttggagagacgattccagccagttaaagtgccagagccaactgtagatgaaaccatacaaatactgaagggacttagagagcgatatgaaattcaccacaagctccgctatactgatgaggctcttgtagctgctgcacagctgtcgtaccagtatatcagtgatcgatttttgcccgacaaagctatagatttgattgatgaagctggttcacgagtccggcttcaacatgcacagttacctgaagaagcaagagaacttgacaaggaggtcaggcagattattaaggagaaagaagaagccgttcgcaaccaagattttgaaaaggctggagagctacgagatagagagatggatcttaaggcacagatctcaactcttgtagagaaaggcaaggagatgagcaaggcagagagtgaggcaggggatgcaagtcctgttgtgactgaagctgacatacagcatattgtctcatcttggactggtattcctgttgagaaagtctcaacagatgaatcagatcgcctcctcaagatggaagagactttacataagcgggtcattggtcaggatgaagcagttaaagccattagtcgggccatccgtcgagctcgggttggattaaagaaccctaatcgtcctattgccagcttcatcttttctggtccaactggtgtggggaagtctgagttggccaaagcattggctgcatactacttcggctccgaagaagctatgatccggcttgacatgagtgaattcatggaaaggcacactgtctccaaacttattggttcacctcctggatatgttggttacactgaaggtggtcaattgaccgaggcagttcggcgtcgtccttacactgttgtattatttgatgagattgagaaagcccatcctgatgtgttcaacatgatgcttcagatcctggaagatggaagactaacagacagtaagggcagaacggtggatttcaagaacacacttcttataatgacatcaaatgttggaagcagtgtgattgagaaaggaggccgcaaaattggatttgatctggattatgatgagaaggatagcagttataacagaatcaagagcctggtaaccgaggagctaaaacaatacttcaggccagaatttttgaataggttggatgaaatgatagtcttcaggcagctcacaaaactggaggtgaaggagattgctgacataatgctcaaagaggtgtttgaaagactgaaggtgaaagatattgaacttcaagtgacagaaagatttagggacagagtggtggaggaaggttataaccctagttatggagctagacctctgagaagagccataatgcgacttttggaggacagcatggctgagaagatgcttgccagagagatcaaggagggcgactctgttatagtggatgttgattctgacggtaatgtgattgtgctcaatggtagcagcggagcccccgagtccttgccagaggcacttcctgtataaggtgcggttaattggccaatactatgtacttaatttgtttaaaccatagtcatagtatgcttaacttgtcaatgtacctaaaatacctaaaattttcaattggatactggtaggcctcatcatgtttgcctatggtcaagcaaatcaaattcaaaggggaaggggtggggggggggggggggtgatagggaaaaactgaaaaatgatctgtggggaaggtgaaaatagcgccgtatttggtataactttggcatcaatgaactattctgtcggaagctggggtgcttttatgtttccactagtttgactacgatgtaatatcctagcattactgtaaatgttccttatggcgcgttcattgcttgagattgaaacatgtaatgacaggattcttgcatgataatgacaggtttagggtattagatcaatttgaaacgacactcgcccaaatcatcctata

SEQ ID NO: 3135 - DNA, 3020 bp, Tripterygium wilfordii
gctatctaaatattccattatttgtcaatcaaattgcgatttagcggtttacgactgcttcatgatggaaagagttctggttcattcaacaaatgtccctgctttagttcctggacagaggcttggccaatctcaagggcctggcaaactacgaagcgtcaaaatgatgtgttgcgctgttcaagtgcctagagtgacaatgagaggcttctcaggattgcgaggtgtcaactccttagattttatgtccaggtctgctgaggattttcattctaaggtgaacaggtcaatcaattttcggtgcgcaaagcctagccgatgtgttacgaaagcaatgtttgagcgtttcacagagaaagcaattaaagtaattatgctcgctcaagaagaagctaggcggcttggtcacaattttgttggcacagaacaaatactgttgggtctaataggtgaaggcactggcattgctgcaaaggttcttaaatctatggggatcaatcttaaggatgcacgtgtagaagtggagaagataattgggagaggaagtggatttgttgctgtggagataccgttcactcctcgtgcaaaacgtgttttagaactctctctggaggaggcccgccaacttggtcataattacattggatctgagcacttgcttcttggcctacttcgtgaaggggagggtgtagcagcccgtgttcttgagaatctaggtgctgatcctagtaatatacgcacacaggtgatccgcatggtgggtgagagcaatgaaaatgctgttggtgttactcctggtggaggtggtagcaataagatgccaacacttgaggaatatggaactaatttgacgaaactggcagaagagggtaaattagatcctgttgttggaaggcagccacaaatagaacgtgtcgtccaaattttgggccggcgcactaagaataacccttgtctcattggagaacctggtgtggggaaaacagctatagctgagggtcttgctcagcgaatagctagtggtgatgttcccgaaacaattgagggaaagaaggttataaccctggatatgggccttctagttgccggaaccaagtaccgtggagagtttgaggagagactaaaaaagctgatggaggaaatcaagcaaagtgatgaaataattcttttcattgatgaagtgcacaccttaattggagctggggcagcagaaggagcaattgatgcggcaaacattttaaaaccagctcttgctagaggtgaattgcagtgtattggagctacgacgttagatgaatacagaaagcacattgagaaggacccagccttggaaagacgatttcagcctgtgaaagtaccggaaccatctgtagatgaaactatacagattctgaaaggattgcgggaacgctatgagatccaccacaagctccgctacacagatgaagcactagaatctgctgcaaagctttcgtaccagtatatcagtgatcgttttctgcctgataaggcaattgacttgattgatgaagctggttcacgagttcggctacgtcatgcacagctccctgaggaagctagagagcttgaaaaggagctcaggcagataaccaaagagaaaaatgaatctgttcgcagccaggattttgaaaaggccggggagttacgtgatcgtgagatggacctaaaggcacagatctcagctcttgtagacaaaggcaaggagatgagcaaggctgagagtgaagctggggatgtaggacctgtagtgactgaagtggacattcagcatattgtctcctcctggactggcattcccgttgagaaagtatcttctgatgaatctgaccgccttctcaagatggaagagacacttcacaagcggatcattggtcaggatgaagctgtcaaagccatcagccgtgctattcgccgtgcccgtgttggcctaaagaaccccaaccgcccaattgctagtttcatcttttctggtccaactggtgtagggaagtcagagttggcgaaagccctagcggcatactactttggctctgaggaagcaatgattcgacttgatatgagtgagttcatggaaagacacactgtttccaagctcattggttcacctccaggctatgtaggttatactgagggtggtcagcttactgaagctgtacgacgccgtccttatacggtagttctgtttgatgagattgagaaagcccatcctgatgtctttaacatgatgcttcaaattcttgaagatggaaggttaacagacagtaagggcagaactgttgacttcaagaatactcttcttataatgacatcaaatgttgggagcagtgtaattgagaagggtggacgccggatgggatttgatatggattatgatgacaaagatagcagttacaaccgaatcaagagcctggtgacagaggaattgaagcagtattttaggccagaatttctcaacagattggatgagatgatcgttttccggcaactcacaaaactggaggtgaaagagatagccgacataatgttgaaggaagtatttgagaggttgaaagtaaaagaaatagaacttcaagtgacagagagatttagagatagagtggttgaagaagggtacaaccccagctatggtgcaaggcctttgaggagagccataatgagacttttggaggacagcatggctgagaagatgcttgcaagagaaatcaaagagggtgattcagttattgtggatgtggattctgatggaaacgttaccgtgctgaatggaagcagtggtgctccagagtccttgccagatgcattatctgttgtgtaaactgttacgttatacccgttatgttgtttgtaccttttcttttggtttttattggctttatatctgtagtctgtttttcttggaaggactacatggctgtagaattagaagctgttggctaattgatggctttggttgtaaggctgtattttcttcaccatgaaatttatcgatagtcaactag

SEQ ID NO: 3136 - DNA, 3189 bp, Vinca minor
aaaaagaaagagcggccattatcaaatatcatccttcccctatccatctctacccaccatttttctcttatttttcttctttcttctttctccctgagggggtgatattattattattaatattattgctcaggttgctctcttatagtcatggccagagctttggcacatttcagtaatttaccttccgtagtcacgggaggtcatgggcaacatagagggtcgggtagatccacaagagctgttaggatgctctgcaatgcgtacgcagcacctctgagaatgagtagtttttctggcttacgggcgtcgaacgccttggataccatggctagatctgggcagactttacattcgctggtggcaaatgcaccctttggccggagggctggctggagaaaggctgccagaatggtaccaagagccatgttcgagcggttcacggagaaagctataaaggttattatgcttgcacaagaggaggcaagacggttaggtcacaattttgttggcactgagcaaattttacttgggcttattggtgagggtacaggaattgcagctaaggtcctcaaatcaatgggcattaatttgaaagatgcacgtgtggaagttgagaagataattggaaggggtagtggatttgtggctgtagaaatcccctttactccacgtgcaaagcgagttttggaactttcattggaggaagcgcgacagcttggtcacaattatattgggtcggagcacctattgcttggattgcttcgcgagggtgaaggtgttgctgctcgtgttcttgagaacttaggtgctgacccaagtaacattcgcacgcaggtcattagaatggttggtgaaagtgccgaagctgtgggtgctggtgttggaggtggaagttccagcaacaagatgcctacattagaggaatatggtacaaatttgacaaagttggctgaggagggaaaactagatcctgtcgttggaaggcaagatcagattgaacgtgttactcaaatattgggtcgccggacgaagaataatccctgccttattggagagcctggagtagggaaaacagctattgctgagggtctcgcacaacgaattgcaaatggtgatgttccagaaacaatagagggaaagaaggttataactttggatatgggtctacttgtggctggtacaaagtatcgtggagagttcgaagaaaggctcaagaaattgatggaggaagttaaacaaagtgatgaaattatacttttcattgatgaggtgcacacattaattggagctggagcagcagagggcgcaattgatgccgcaaacatcttaaaaccggctctagctcgaggtgaactacagtgtatcggggccaccacactagatgaatacagaaagcacattgagaaggatcctgctcttgaaaggcgttttcagcctgtgaaggtacccgaacccacggtcgatgaaacaattcagattttgaagggccttcgggagaggtatgagattcatcacaagcttcgctacaccgatgaggcgttggttgctgctgcccagctgtcgtaccaatatatcagtgaccgttttctgcccgataaggctatcgacttgattgatgaagctggttcacgtgttagacttcgtcatgcccagctccctgaggaagccagagaactagagaaagaacttaggcagattacaaaggagaaaaatgaagctgtccgtagccaagattttgagaaggctggtgagttacgtgacagagaaacggatcttaaagcacagatttctgctcttatagataagaacaaagagatgagcaaggcagagtctgaggctggggatgaaggtcctctcgtaacagaaagggatattcaacacattgtttcttcatggacaggtattcctgttgagaaggtatccactgatgaatcagatcgcctcctcaagatggaagagacgctccatacacgagtggttggtcaagacgaagctgtcaaggccatcagccgtgccatccgtcgtgcacgtgttggtctcaagaatcccaaccggccaattgctagcttcatcttctctggacctactggtgtggggaagtctgaacttgctaaagcactagctgcttattattttggttccgaagaatcaatgattagacttgacatgagtgagttcatggagagacacaccgtctcgaagcttatcggttcacctcctggatatgttgggtacactgaaggtggtcagcttacggaggccgtgagacgtcgcccttacactgttgttctttttgatgagattgagaaagctcatcccgatgtcttcaacatgatgcttcaaattctcgaggatggaaggttaacggacagtaagggtagaaccgtcgacttcaagaacacacttctgattatgacatcaaatgttggtagcagtgtaattgagaagggtgggcgacgtataggttttgatctcgactacgatgagaaagatagtagttacaatagaatcaagagcttggtgaccgaggaactaaaacaatacttcagaccagaattcttgaacagattggatgagatgatagtattccgacaacttaccaagctcgaggtgaaggagatagctgacataatgctcaaggaggtctttgagcggttgaagaaaaaggacataaagctcgacgtaacagagaggttcaaagaaagggtcgtggaggaaggttacaatccaagctatggtgcacggccattgagacgagctatcatgaggctgttggaggatagcatggctgagaagatgcttgcaagggaaatcaaggagggcgattcagttattgtggatgtagattcagatggcaatgttaccgtcctgaatggtgatttagaggcaaagccagctgcggtttaagttgaacaaaaacttatgatgtctttttgacattttacaaaatgtgttgtttgtacttgcttctttttgggttttaaattagctacaacactaacctggctttgcagagcaactgggaaatcctgattgtatttctatacagagggttgcatcttcttgtcttagcaatctttaaggttttaatattagtacaatattaggttttgtggaagtagctatttatcaaatcattaggtggtttgttcgatttgcacactttgattcgtataattatatgct

SEQ ID NO: 3137 - DNA, 3352 bp, Theobroma cacao
aaaaaaaaagaaaaaaaatagaaagagagtaaaaaagagctggttgttataagccacatctatcctctgcattttccttctctcttcggccgaccatttgcactagataaaaaagggtctcttctctctgcaacttctaaaagaaaagaccccttttcagttttactctctatttctattttatctttttcagcttttttttttcttttcttcctgcaccgcttctttcctttttgagattgcttaataggagtgatggctaaggttctggctcagtcaactattgttcctgctctagttactagtcgaagtcatggtccatccaaagaatcttcaaaatcaaaagggtctgccaaaatgatgtgcagtttacaaacacctggattgaggataagaagtttctctgggttgcgtggttcaaattctttagataatatggtcagatttggccaagatttccgttctaaggttgcaatttcaatctcttcccgacgaggaaggggtagcagatgtgtacctaaagccatgtttgagcgcttcacagaaaaagcaattaaagtaattatgcttgcccaagaggaagccagacggcttggccataattttgttggtacagagcaaattttattgggccttattggtgaaggtactggcattgctgcgaaagttcttaaatccatgggaatcaatcttaaggatgcacgtgtagaggtggagaagataattggaaggggcagtgggtttgttgctgtggagattccatttactcctcgtgcaaaacgtgttttggaactctcattggaagaagcgcgccaacttggccataattatattggatcagagcatcttcttcttgggctgcttcgtgaaggtgaaggtgtagcagcccgtgttctggagaatttaggtgctgacccaagcaatatccgcacacaggttattcgtatggttggtgagggcaatgaagttagcgttgttcctggaggatcaactggcaacacaaagatgccaacacttgaggaatatggaaccaatttgactaagctcgccgaggagggtaaattggatcctgttgttgggaggcaggttcaaatagaacgtgttgtccaaatattgggtagacggaccaaaaataacccatgtcttataggagaacctggtgttggaaaaacagcaattgctgaaggccttgctcagcgtattgctagtggtgatgttcctgatacaattgagggaaagaaggttataacgcttgatatgggtcttcttgttgctggaacaaaatatcgtggagagtttgaagagagattgaagaagctaatggaggaaatcaagcaaagtgatgagataatattgtttattgatgaggtgcacaccttaattggagcaggagctgcagaaggggctattgatgctgccaatatcttgaagccagctcttgcaagaggtgaattgcagtgtattggagctacaacactcgatgaatacagaaagcatattgagaaagacccagctttggaaagacgtttccagccggtcaaagtgcctgaaccatctgtagatgaaactatacagattttgaaaggtttgcgagaacgttacgagattcaccacaagcttcgctacacagatgatgccttaatttctgctgcacagctgtcataccagtacatcagtgaccgttttctgcctgataaagcaattgacttgattgatgaagctggttctcgtgttcgccttcgtcatgcacagctccctgaggaagctagagagcttgaaaaggagctcaggcagatcacaaagtcaaagaatgaagctgttcgcagccaggactttgagaaggctggggaattacgtgaccgagaaatcgagctcagggctcagatcactgccatccaagagaaagacaaggagatgaataaggcagaggcagaggcaggggaaggaggtccagttgtgaccgaagtggacattcagcatatagtctctgcctggactggtattcctgttgagaaagtatcaaccgatgagtctgatcgcctccttaagatggaagagactcttcataagcgagtcattggtcaggatgaagctgtcaaagccattagtcgtgcaattcgacgtgcccgtgtcggtctcaagaatcccaaccggccaattgctagcttcatcttttctggaccaactggtgtaggaaagtcagaactagcaaaggcactagctgcttactattttggttctgaagaagccatgatccggcttgatatgagtgagttcatggaacggcatacggtgtccaagctcattggttcacctcctggttatgttggttacactgagggtggtcagctgactgaggctgttagaagacgaccatacactgtagtactttttgatgagattgagaaggcacatcctgatgtcttcaacatgatgcttcagatacttgaggatggaaggttgacagacagtaaaggaagaactgtggatttcaagaatacccttctgataatgacatcaaatgttggaagcagtgtaattgagaagggtggacgacggataggatttgatcttgattatgatgagaaggacagcagttacaatagaataaagagcctggtgacagaagaactgaagcaatatttcaggccagagttcttgaatagattggatgagatgattgttttcaggcagctcaccaagttggaggtcaaggagattgcagatataatgcttaaggaggtgtttgacaggctcaaagccaaagagatagagcttcaagtgactgaaaggtttagagagagggtggtggaggaaggatacaacccaagttatggagcaaggcctttgagaagagccattatgagacttcttgaggacagcatggccgagaagatgcttgctagggaaatcaaggagggtgattcagtaattgtggatgttgactctgatggaaatgttaccgttctgaatggtagcagtggtgctcctgagtcattggctgatccaattccagttgtgtaaccaaataggtttttgggatatgttgtttgtaacttttctttttcattgaactggctatactagttgtagtctgttttcttgaaaggactacttggcagtagaattggaagtcattgattgcttgcctgtggacattgaagctgtatttctgacactgaatcacatgcatatttgtaagaggcgcatagaagatgctgctggtagtattaggttggcagtttacttaacaataaaatttaattagattggaatacgttcaaaatgttactgcttattattgaacctgaatcgagactgtgaggttgttcttcaatgatccacatttaga

SEQ ID NO: 3138 - DNA, 3387 bp, Solanum lycopersicum
atgacaattatatctatccacctactttctctatatagctatcacacggccgactttcaagctctctctatttcttttctctttcttttttctcctctttccaccatctttagtgttattgaggtcaggttgcaggtccatgatggctagagctttagttcagtcaacaaacattctaccttcagttgctggtgaaagggctggacaattcaatggatcccggaaagatcaaagaactgttagaatgctatgtaatgtaaaatgttgttcctcaaggctgaacaattttgcaggactgcgagggtgcaatgcattagatacactactagtaaaatctggagaaactctccattcgaaagtggcagctgcaacttttgtcagacggccacgagggtgccgatttgtcccaaaagcaatgtttgagcggttcaccgagaaagcaataaaagtcattatgcttgcccaagaagaggccagacgactaggtcacaactttgttgggacagaacagatcctgctgggtcttattggtgagggaactggtattgctgctaaggttcttaaatccatgggaattaatttgaaagatgctcgtgtggaagtagagaagatcattggcaggggtagtggatttattgcagtggaaatcccttttactcctcgtgcaaagcgtgttctagaactatctctggaggaagcccgccaactagggcataattacattggctccgaacacttgttacttggattgttgcgcgaaggtgaaggtgtggctgcccgtgttcttgaaaacttgggtgctgaccccactaacattcgcacacaggcaagtcatacggatggttggcgagagtagtgaggctgttggtgctagtgttggaggtggaacttctggcctaaagatgcctacattggaggagtacggcaccaatttgacaaagttagctgaagaggggaaactagatcctgtagttggaagacaggctcaaatcgagcgtgttactcaaatcttgggtcgccgtacaaaaaacaacccttgccttattggagaaccaggtgttggaaaaactgctattgccgaagggctagctcaaagaattgctaatggtgatgtccctgaaacaatagaaggaaagaaggtcataacacttgatatgggattgcttgttgctgggacaaaataccgtggagagtttgaggaaagactgaagaaactaatggaggaaattaaacaaagtgatgaaataatactgtttattgatgaagtacacacattgattggagctggagctgcagagggagcaattgatgctgcaaacatcttgaaacctgccctggctagaggcgagctacagtgtattggagccacaaccctggatgagtacagaaagcacattgagaaagaccctgcactagagagaaggttccagccagttaaagtccctgaaccttctgtggatgaaaccatacagatcttgaaagggcttcgggagaggtatgagattcatcacaagctccattacactgatgaggcaatagaggccgctgccaagctttctcaccagtacatcagtgaccgctttctgcctgataaagcaattgacttgattgatgaagctggttcccgtgttcgacttcgtcatgcacagctccctgaggaagcaagagagctggaaaaggagcttcgccagattacaaaggagaaaaatgaatctgtccgcggtcaagattttgagaaggctggggagttgcgtgatagagaaatggatcttaaggcacaaatctcagccttgatagacaaaaacaaagagaagagcaaggcagaatctgaggcaggagatgcagcaggtcccatagtgacagaggcagatattcagcacattgtctcttcctggaccggcattcctgtagagaaggtctcaactgatgaatctgatcgcctcctaaaaatggaagaaacacttcatacccgagtcattggccaggatgaagcagtaaaagccattagtcgtgctatcagacgtgcccgtgttggcctcaagaatcccaaccgacctattgccagtttcatcttttctggtccaactggtgttgggaagtcagaactggccaagtctttagcaacgtactactttggttctgaagaagcaatgattcggcttgatatgagtgagtttatggaaagacacactgtgtctaaactcatcggttcaccccctgggtatgttggttacactgaaggtggtcaattaactgaagctgtgaggcgtcgaccttacactgttgtgctctttgacgagattgagaaggctcatcctgatgtctttaacatgatgcttcaaattcttgaagatggaagattgacagacagcaaaggcagaactgtcgacttcaagaatacactcctcatcatgacatcgaatgttggaagcagtgtgatagagaaaggaggtcgtcgtataggttttgatctagattttgacgagaaggatagtagttacaaccgtatcaagagcttggtgactgaggagttgaaacagtacttcaggccagagtttttaaacagattagatgagatgattgtattccgtcagctcactaagttggaggtgaaggagattgccgatatcatgcttaaggaggtctttgtgaggttgaagaataaggagatagaactccaagtgacagagaggtttagagatagggtagttgatgaaggatataacccaagctatggagctaggccattgaggagagctattatgagactgctagaggatagtatggccgagaagatgcttgcaggtgagatcaaagaaggtgattcagtaattgtggatgtggattcagatggcaacgtcaccgtcctcaatggcactagtggtgctccctcagattcagctcctgagcctatccttgtgtagatcaattcttcatttagctctacaaatttgttcttcgtaatgttgcttttggatgtcttggctaagcaacatgtgagtaattttttgggtgacaggctgatatattcttccaagttgactaggcaatctccttctcaaggatagcattcaggaatacacactatatacttaattgggtttcattaaaattctgtcaaagggatatgtaaaagcatttcttctaatttttggtaggtgatagttagactttttatcatcattttcagtacgtttttcttctaatttttggtaggtgatggtcagacattgtcatcattttcagcatgttttttctgctgtcttgttaatttggttcataccataactgaagtattttggttatgaacattttgagttcttgtccacaacaaacactagacaaatgtacttccaaatttcgaatttgaatgaattttgtcagcca

SEQ ID NO: 3139 - DNA, 2850 bp, Primula obconica
agggatctggtaaatcgaaaaaagatgtaaaaacgatgtgtatgttacaagcaactccgctcaggttgagaagtttctcaggccttcgaggatcaaatgccttggacaccgtatctagacctagccaagattttttttcgacagtggaagctgctctctcagtccgaggtggtaagactaggcgtgttgctgctaaagctatgtttgaacgtttcaccgaaaaagcaattaaggttattatgcttgcgcaagaggaagcaagacggctcggtcacaatttcgttggaacagaacagattttgttggggctgattggggagggcacaggcattgctgcgaaggtgctcaagtccatgggaatcaatttgaaagaagcgcgtgtagaagtagagaagatcattgaaggggcagtggctttgttgctgtagagattccatttactcctcgtgctaagcgtgttttggaactctctctcgaggaagcccgtcagcttggtcataactatattggatccgaacacttgttattgggtttgcttcgagagggtgaaggtgtggctgcccgagttcttgaaaattaggtgctgatccgagtaatatccgcacacaagtgattcggatggttggagaaagtacagaagcagttggtgcaggtgtgggaggaggatcaagtggtaacaagatgccgacccttgaagaatatgggacaaatttgacgaaactagcagaagagggcaaactggatccagttgtcggaaggcagccgcaaatagaacgtgtgacccagattttgggtcggcggacgaaaaataacccttgtcttattggagagcctggtgttgggaagacggcaattgcggaagggctcgcacaacgaatagcaaacggtgatgttccagaaacgatagaggggaagaaggttatcaccttggatatgggccttcttgttgctggcaccaaatatagaggagaatttgaggaaagattgaagaagctgatggaggaaattaaacaaagtgatgaaattatactatttattgatgaggtacacacactgataggagcaggggcagcagaaggcgctattgatgctgcaaatattttaaaacccgctcttgcaagaggtgaattgcagtgtatcggggccactacacttgatgaatacagaaaacacattgagaaagaccctgccttggagagacgttttcagccagtgaaggtgcctgagcccactgtcgatgaaactatacagattttgaaaggactccgagagcgctatgagatacaccacaagcttcgttatacagatgaggcactagttgctgctgcacaactgtcataccaatacatcagtgatcgctttttgtcctgataaagcaatagatttggttgatgaagctgggtctcgggttaggcttcgtcatgcacagcttccagaggaagcaagagagcttgacaaagaactgaggcaaattaccaaagaaaaaacgaagctgttcgcggccaagacttcgaaaaggctggggaattgcgagatagagaaatggacctgagggctcagatcacatccctaatcgacaagggcaaagagatgagcaaagcagagaccgaagcaggtgaagttggtcccatagtgaccgaagtcgacattcagcacatcgtctcttcatggaccggcatccctgtcgagaaagtctcgacggacgaatccgaccgtctattaaagatggaagataccctccacaaacgaatcatcggccaagatgaagccgtcaaagccataagccgcgccatccgccgagcccgtgtcggtctcaaaaaccccaaccgccccatcgctagtttcatcttctccggccccactggcgtcgggaaatccgagctggcgaaggccctcgcgacttactacttcggctccgaagaggcgatgattcgcttagatatgagcgagtttatggaaagacacaccgtctcgaagctcatcggttcgccacccggttacgttggttacaccgaaggaggtcagctaaccgaagcggtccgacgccgaccttacaccgtcgtcctctttgatgagatcgaaaaggctcatcccgacgtcttcaacatgatgcttcaaatccttgaagacggtaggttgaccgatagcaagggacgaaccgtggatttcaaaaatacccttttgattatgacctcgaacgtgggtagtagtgtcatcgagaagggcggtcgtagaattgggttcgatttggattacgatgagaaagatagcagctacaataggatcaagagccttgtaactgaggagctgaagcaatatttccgacccgagtttttgaacagattggacgagatgatcgtttttagacagctcaccaagctcgaagtcagggacatcgccgacataatgcttaaagaagtgtttgagaggctaaagttgagggaaattgagcttcaagtgactgataggtttagagatagggtggttgatgaagggtataaccctagctatggagcaaggccacttagaagggcaattatgagacttttagaggatagtatggccgagaaaatgcttatgggtgagatcaaggagggcgattcggtaattgttgatgttgatgccgatggtaaggtgacggtgcttaatggaagcagtggggcgccacctgaggcgttgccggaaccaatctctgtgtagataaaaggccatttgggtgttgagcctgtttggcttttaacgatgatctttctcataagtttgtatgtaccgactttatgataatcatatctatagttgtgtttaaagaacgtaggtgtgtaatagtattagatttggtaataacatttg

SEQ ID NO: 3140 - DNA, 3314 bp, Brachypodium distachyon
gaggcagaaagagaagagaatcatccagggtgaggccaaaataaagaaaggaaacggcaaattctcttctcttctttgcttgcttgttgggcacccccaaccaagcgactcttcttctctcctcctcccctcctcttcttatctccttgggagcaaaaacgaaacaaggccgcgcttctctctcaccctctcctcgcaggtttggggaagctatttctgaccatggcagggaccttactcctgccagttgctctagggtcaacttttgcaggccgtgcaagcggtcagcgctggaagtctcatggcaccaggaggcctgcctcgatgttagccatgtcattgaaccgtccggttaggatggcagcatttgttggtctgagatcggcacacagctttacagccacacctgcatccaactacagatcgacagttgcatcttacagatcctccagacgcggacgacgtactcggtttgtaaccagagcgatgttcgagaggttcactgagaaagctataaaggtcataatgcttgcacaggaggaagcaaggcgcctgggtcacaactttgtcggaacagagcaaattttgttgggtctggttggagaaggcactggtattgctgcaaaggtgctcaagtccatgggtataaatctgaaggatgcccgtgtggaagtggaaaaaatcattggcaggggcaatggttttgttgctgttgaaataccattcacgccacgtgcaaaacgtgttttggagctttcattggaagaagctcgccaactaggacacaattatattgggtctgagcacttgcttcttggactgcttcgtgagggtgaaggtgtggcagcccgtgtccttgagtctcttggtgctgaccctagcaatattcgaacacaggttgtcagaatgattggcgagacaaccgaagctgttggtgctggagttgggggagggagcagtggtaataagatgccaacactcgaggagtatggaactaatttgacgaaattagccgaggagggaaagctagatcctgtcgttggaaggcaaccacagattgaacgtgttgtacaaattttaggcagacgtaccaagaacaatccatgcttaattggagagcctggtgttgggaagacagcaattgcagaagggcttgctcaacgtatttctagtggggatgtgcctgagacgatagaagggaagaaggttattacccttgatatgggacttcttgttgctggtacaaaataccgtggagaatttgaagaacggttaaagaaactgatggaagaaataaagcaaagtgatgagataattctcttcattgatgaagttcacaccctcataggagcaggagcagccgaaggtgctattgatgctgctaatatcttaaagccagcattagcaagaggagaactacagtgtattggagccaccacacttgatgaatacaggaagcatgttgagaaagacccagcattagaaaggcgtttccaacctgtaaaagtgccagagccatcagttgatgaaacgatagaaattctcagagggcttcaggaacgatatgagatccatcataaacttcgatacactgatgatgctttgattgcagctgctaagctatcttatcagtatatcagtgaccgtttcctcccagataaggcaattgacttgattgatgaagcaggttcacgtgtaaggcttcgacatgcgcaggttcctgaggaagctagagagcttgacaaggagcttaagcaaataacaaaagataaaaatgaagctgtccgtggccaggatttcgaaaaggctggagagttgcgagatcgcgaaatggaactgaaggctcagataacagctctcattgacaagagcaaggagatgatcaaagcagagaccgattcaggagagaccgggccaatggtcaccgaagcagatatccagcacattgtatcatcatggactggtatcccggtggagaaagtctcaactgatgaatctgataaacttcttaagatggaagagacattgcataagcgtgtcattggccaagacgaggctgtgaaagcaataagccgctctgttcgccgtgctcgtgtgggcctgaagaaccccaacaggccaattgcaagctttatttttgcaggtcccactggtgttgggaagtcggaacttgcaaaggctctcgcgtcgtattactttggctccgaagaagccatgatccggctggatatgagtgagttcatggagaggcacacagtatccaagttgatcggttcaccaccaggatatgttggatacaccgaaggtggccagttgacggaggcggttcgacgcaggccatacagcgttgtgctttttgatgagattgagaaggcgcatccggatgtcttcaacatgatgctccagatcctcgaagacggcaggttaactgacagcaagggaagaacagtggatttcaagaacacgcttctcataatgacatcgaatgttggcagcagcgtcatcgagaagggagggcggaagatcgggttcgaccttgactcagacgagaaggacagcagctacggcaggatcaagagcttggtcgtcgaggagatgaagcagtacttccgtcctgaatttctcaaccgtctcgatgagatgatcgtcttcaggcagctgaccaagctggaagtgaaagatatcgctgagatcatgctactggaggtcttcaacaggctgaaggccaaggagatcaacctgcaggtgaccgagaagttcaaggaacgggtcgtcgacgaaggctacaaccctagctacggagcacggccgctaaggagggcgatcatgaggctgctggaggacagcctcgcggagaagatcttggctggggaggtcaaggagggcgattccgccatcgttgatgttgactcagaggggaaggtgattgtgctgaatggcgagagcgggctgccggagcttccaaccccagccgtcaccgtgtagttcacacagattaactgtccaacatatacagcagcgttttcatttcattcgagcacatatctcttcatagttagtgtataactgtaaactgtacatacattatatatatacaatattttttttgcgagagaaagtataatatatacagtatgcatatatataatcaaaagggaaacattgctggcgactgattagttctgatgctttaagaggactgtctctgaattactgtctctgaattttcgcaatacgcttatatggatgtgacgtcatccattttttgtttttttgttttctttgaggaagaggaaatctatttttcggttaag

SEQ ID NO: 3141 - DNA, 3359 bp, Gossypium raimondii
tatctttcggccgaccactcccagaagataaaaggaaaaaagagaaagggtctcttctactctgctgcttctgaaagagaataccctttattattattatttttgttttctattttagtttctctgctttttaaattcttcaccgactctttctttttatttagattgcagaggagtgatggctaagattctggctcagtctgctattgttcctactctactttctagtcgtagccatggtgcgtctaaagaatctggaaaaccaaagaggtctgccaaaatgatgtgcagtttacaaactcctggattgaggataaggagtttttctgggttgcgaggctcaaattctttagataatattgtcagatatggccaagatttccattctaaggttggaatttcaatatcttctcaacggggaagaggtagcagatgcgtacctaaggccatgtttgagcgcttcactgagaaagcgattaaagtaattatgcttgcacaagaggaagccagacggcttggccataattttgttggtactgagcaaattttattgggccttattggtgaaggtactggcattgctgcaaaagttcttaaatccatgggaatcaatcttaaagatgcacgtgtagaagtggagaagataattggaaggggaagtggatttgttgctgtggagatcccttttactcctcgcgcaaaacgtgttctggaactctcgttggaagaagctcgccagcttggccataattatattggatcagagcatcttcttcttgggttgcttcgtgaaggtgaaggtgtagcagcccgtgttcttgagaatttaggtgctgacccaagtaatatccgcacccaggttattcgtatggttggtgagggcaatgaagttagtgttgttactggaggatcaggtggaaacacaaagatgccaacacttgaggaatatgggaccaatctgactaagctagctgaggagggtaaattggatcctgttgttgggaggcaggatcaaatagagcgtgttgtccaaatattgggtagacgaaccaaaaacaatccatgtcttattggagaacctggtgttggtaaaactgcaattgcagaaggtcttgctcaacgtattgccagtggtgatgttcctgatacaattgagggaaagaaggttattacacttgatatgggtctccttgttgctggaactaaatatcgtggagaatttgaggaaagattgaagaagctaatggaggaaatcaagcaaagtgatgaaattatattgtttattgatgaggtgcacaccttaattggagcaggagctgcagaaggtgctattgatgctgccaatatcttgaagccagctcttgcaagaggtgaattgcagtgtattggagcaacaacactggacgaatacagaaagcatattgagaaagacccagcattggaaagaagattccaaccggtcaaagtgcctgaaccatctgttgatgaaactatacagattttgaaaggtttgcgagaacgttatgagattcaccataagcttcggtacacagatgaggccttaatttctgctgcacagctgtcataccagtacatcagtgaccgttttctacctgacaaagcaattgacttgattgatgaagccggttctcgtgttcgccttcgtcatgcacagctccctgaggaagctaaagagcttgaaaaagagctgaggcagatcacaaagtcaaagaatgaagcagtccgcagccaggactttgagaaggccggggaattacgtgatcgagaaattgagcttagggctcagatcactgcaattcaggagaaagacaaggagatgaacaaggctgaggctgaggcaggagatggaggtcctgttgtgacagaagtggacatccagcatatagtctcttcgtggactggtattcctgttgagaaagtatcaactgatgaatctgatcgtctccttaagatggaagagacacttcataagcgagtcattggtcaggatgaagctgtaatagccattagccgtgctatccgacgtgcccgtgtaggtctcaagaaccccaaccggccaattgctagcttcatcttttctggaccaactggtgtaggaaagtcagaactagcaaaggctctagctgcttactatttcggctctgaagaagctatgatccgacttgatatgagtgagttcatggaaaggcacacagtgtccaagctcattggttcacctcctgggtatgttggttacactgagggtggtcagctaactgaggctgttagaagacgtccgtacactgtagtactttttgatgaaattgagaaggcccatcctgacgtcttcaacatgatgcttcagatactcgaggatggaaggttgacagacagtaaaggacgaactgtggatttcaagaatacccttctgataatgacatctaatgttggaagcagtgtaattgagaagggtggccgacggataggttttgatcttgattatgatgagaaagacagcagttacaatagaataaagagcttggtgacggaagagctgaaacaatatttccggcctgagttcttgaatagattggacgaaatgattgttttcaggcagctcaccaagttggaggtgaaggagatagcagatataatgcttaaggaggtgtttgacaggcttaaagacaaagagatagagcttcaagtgactgaaagatttagggaaagggtggtggaagaaggatacaacccgagctatggtgcaaggcctttgagaagagccattatgagacttctcgaggacagcatggccgagaaaatgcttgccagggaaatcaaggagggtgattcagtaatcgttgatgttgactccgatggaaatgttacggttctcaatggtagcagcggtacgcctgagtcattgggcgatccaatttcagtcgtttaaccaaatagccttttttggatatatgctcattttacctttccgttttcattgaaaggactacttggcagttgaattgaaagtcatcgctagcttgcccgttggcattgaaggtgtatttctgacacttcaaatcgcctgcttaattggaaggggcaaagaagatgctggtagtgttagtttagaatttaacttcacaataaactgtttggatatattgttttgaattatattgaaatacgttctaatgtgattatgttccacttctactatctggaaaacatttgttcatagttaaagctctttggttattcgtagttcgtgtatctatgttatttggattcttccttttcttgggtcaggtagatgcaagaataagcagagaaatcattagattttaacacacttttctcca

SEQ ID NO: 3142 - DNA, 3270 bp, Zea mays
tagttttctttcttgttggacattcgggcggccaaagcagcggcccccttatctccagggaccaggggaggtcgcacaccaacgcaccgtccttccctttcctcctcctcctccctctcctcggaaggtcaagtgacggtatttgtgaccatggcagggaccttactccagtcagttgccctgggaacaccatttgggggtcgcatgagaacccattgttggaggtcccatggcaccaggaggcctgcctctatgttggcagtgtcacttagccgccctgtcaagatgtcagcatttgtgggtctaagatcagtgcatagcttctcggtcacaccgacggtgtccaattccaggtcggcagttgcatcttacaggtcatcgcgacagacaagacgatctcgttttgtcactcaggcaatgtttgagaggttcacggagaaagctattaaggtcatcatgcttgcgcaagaggaagcaaggcgcctgggccacaactttgttggaactgagcagatcctcttgggtctgattggagagggcactggtattgcagctaaggtgctcaagtccatgggaataaatcttaaggatgcacgtgtggaggtggagaagattattggccgcggcaatggttttgttgctgttgaaataccattcacaccacgtgcgaaacgtgttttggagctctccttggaggaagctcgccaattaggacataattatattggatctgagcacctgctccttggactgcttcgtgagggtgaaggtgtggcggctcgtgtgcttgagagtctcggagctgaccccagcaatatccgtacacaagttattcgaatgattggtgagaccacagaagctgttggtgctggagttggcggcggcagcagtggtaataagatgccaactcttgaggagtatggaactaatttaacaaaattagcagaggagggaaaattagatcctgttgttggaaggcagccacaaattgagcgtgtggtacaaattttaggcagacgaaccaagaacaatccctgcttgattggagagcctggtgttggaaaaactgcaattgctgaaggacttgctcagcgcatttctacaggcgatgtacctgaaacaatagaagggaaaaaggtcataacccttgacatgggacttcttgttgctggcacaaagtaccgtggagaattcgaagaaagattaaagaagctgatggaggaaataaagcaaagtgatgagataatactctttattgatgaagttcacactctgataggagcaggagcagcggaaggtgctatagatgctgctaatatcttgaagcctgcgttggccagaggtgaattacagtgcattggagccactacactagatgaatataggaagcacattgagaaagacccagcacttgaacggaggtttcaacctgtgaaagtgccagaaccaacagtagatgaaaccattgaaatcctcagaggactgagggaacgatatgagatccaccataaacttcgttacactgatgaagctctgattgcagctgcaaagctgtcatatcaatatatcagtgatcggtttctcccagataaggcaattgacttgattgatgaagcaggttcccgtgttaggctacagcatgcacaggtccccgaggaagcaagagagcttgacaaggagctcaaacaagtcacgaaacagaagaatgaagctgttcgaagccaggattttgagaaggctggggaattgagagaccgtgaaatggaattgaaggcccagataacagccctcattgacaagagcaaggaattgagcaaagcagaggaagagtctggagagacaggacctatggtcaatgaagaagatatccagcacatagtatcttcatggactggcatccctgtggagaaggtttccagcgatgaatctgataagcttcttaagatggaagagactttgcacaagcgtgtcattggccaagatgaggctgtggtagcaattagtcgctccatccgccgtgctcgtgtgggtctcaagaaccccaacaggccaattgcaagctttatttttgctggtcccaccggcgttgggaagtctgagcttgcaaaggctcttgcagcctattactttggctctgaggaggctatgatccggcttgatatgagtgaattcatggagagacacacggtatccaagctgattggttcacctccaggatatgtaggatacactgagggtggccagctgacagaggcagttcgacggcggccatacacagttgtgctctttgatgagattgagaaggcacaccctgatgtcttcaacatgatgcttcagattttggaagatgggagattgactgacagcaagggaaggacggtggacttcaagaacacactcctgatcatgacctcaaatgtagggagcagtgtcatcgagaagggtggaaggaagatcggatttgaccttgactctgatgagaaggacagtagctacagcaggatcaagagcctggtcatcgaggagatgaagcagtatttccgacctgagttcctcaaccgtctcgatgagatgatcgtgttcaggcagcttaccaagctcgaggtcaaggagatagcggacatcatgctccaggaggtctttgacaggctgaaggccaaggacatcaatcttcaagtgaccgagaagttcaaggagcgggtggtggacgaaggctacaaccctagctatggtgcacgcccgctgaggcgagccatcatgaggctgctggaggacagccttgctgagaagatgctcgcaggggaggtaaaggagggcgactctgccatagtagatgtggactcggaggggaaggttgttgtgctcaatggtcagggcggcataccggagctctcaactccggcgatcaccgtttagctcgtacataacaaatgacaaaattaatagcatagtttttgttcaaacacattatcatttatggttagaatatctgtgtatatgtagtggtatagtcaatggggaaatcgttcctgcctctaaattcctttttttcaagttaaggtgtttcttttgtcgcaagttaatctgcctggttattaagatattgtttacagagtgatgtgaaaagctcttgtctgtgttcaaggatacatatacagacgggtcaagtagcatgtaggcaatagttccaatataggcctcagcgttgtctttaaccgagcatccgaaaacacttgcacctaaataccgtcgcctgaaaatacaaaaaaa

SEQ ID NO: 3143 - DNA, 3272 bp, Gossypium raimondii
tcggccgaccattcctactatcagtttaaaagaacaaaaaaagggtaaaaagagggtctcttctctctgcaattcccaaaagaaaagacccctttttagtatattttactgtccatttcactctctattcaatttcaccctctttcttttcgatagtttaggagtgatggctaaagttctggcgcagtcgactattgttccttctctagttacgagtcgaagtcatggtcgatccactgggaaatcgaaaaggtccgtcaaaatgatgtctagtttacgaacacctggattgaggataaatagtttctccgggttgcggggctcaacttctttggataatatggttagagtcgaccaagatttccattccaaggttgcgatttcaatctcgtctcgacgtggaaggggaagtaggtgtgtgcctaaagccatgtttgaacgctttactgaaaaagcaattaaagtaatcatgcttgctcaagaggaagctaggcgacttggccataactttgtcggtacagagcaaattttgttgggtcttattggtgaaggtactggcattgctgcaaaagttcttaaatccatgggaatcaatcttaaagatgcgcgagttgaagtggagaagataattggaaggggaagtggttttgttgctgtggaaattccatttactcctcgtgctaaacgtgttttggaactctcgttagaagaagctcgccaacttggccataattacattggatcagagcatctgcttctggggttgcttcgtgaaggtgaaggtgtagcagcacgtgttcttgaaaatttgggtgctgacccaagcaatatccgcacacaggttattcgtatggttggtgagggcaacgaagttagtgtggttaccggaggatcaactggtaacacaaagatgccaacacttgaggaatatggaaccaatttgactaagttagctgaagagggtaaattggatcctgttgttggaaggcaagatcaaatcgaacgagtcgtccaaatattgggtagacgaaccaaaaacaacccgtgtcttattggagaacctggtgttggaaaaactgctattgcagaaggtcttgcccaacgaattgctactggtgatgttcctgatactattgagggcaagaaggttataactcttgatatgggtcttcttgttgctggaacaaaatatcgtggtgagtttgaggagaggttgaagaagctaatggaggaaatcaagcaaagtgatgagataatattgtttattgatgaggtgcacactttgattggagctggagcagctgaaggtgcgattgatgctgccaatatcttgaagcctgctcttgcaagaggtgaattgcagtgtattggagctaccacacttgatgaataccgaaagcatattgagaaagacccagctttggaaagacgtttccagccagttaaagtgcccgaaccatctgttgatgaaactatacagattttgaaaggtttgcgagagcgttacgagattcaccacaagcttcgttacacagatgaggccttaatctctgccgcacagctttcataccagtacatcagtgaccgttttctgcctgataaagcaattgacttgattgatgaagctggatctcgtgttcgccttcgtcatgcacagctccctgaggaagctagagagcttgagaaagagctccggcagatcacaaagtcgaagaacgaagcagttcgcagccaggactttgagaaggctggggaattacgtgatcgggaaattgagctcagggctcagatcactgcaatccaagagaaagacaaggagatgaataaggcagaggcggaggcaggggatggagggcctctagtgactgaagtcgacattcagcatatagtctcttcatggactggtattcctgtcgagaaagtatcaaccgatgaatccgatcgcctacttaaaatggaagagactcttcataagcgagtcattggtcaggatgaagctgtcaaagccattagccgtgctattcgacgtgctcgtgttggtctcaagaaccctaaccggccaattgccagttttatcttctctggaccaactggtgtaggaaaatcggaactagcaaaggcactagctgcttactactttggctctgaagaagccatgatccgacttgatatgagtgagttcatggaaaggcacacggtgtccaagctgattggttcaccccctgggtatgttgggtacaccgagggtggtcagctaactgaggctgttaggaggcgaccatacaccgtagtacttttcgatgagattgagaaagcccatcccgatgttttcaacatgatgcttcagatcctcgaggacggaaggctcacagatagtaaaggaagaactgtcgatttcaagaatacactcctgataatgacatcaaacgttggaagcagtgttatcgaaaagggtggacggcgaattgggtttgatctcgattatgatgagaaagacagtagttacaatagaataaagagcctggtgacagaagaactgaagcaatatttcaggccggaatttttgaacagattggacgagatgattgttttcaggcaactcaccaagttagaagtgaaggaaattgccgatataatgctcaaagaagtgtttgacaggcttaaaagcaaagaaatcgagctccaagtgaccgaaaggtttagagaaagggtggtggaagaagggtacaacccaagttacggagcaaggcctttaagaagagccataatgagacttctggaggacagcatggctgagaagatgcttgcaagggaaatcaaggaaggtgattcagtaatagtagatgttgactctgatggaaatgtcacggttctcaatggcagcagtggcacttccgagtcattgaccgatccgattccagttgtgtaaaccacatataagccactctagatatgttgttttgtaccctcttttttcttttgcttctccttttgattgaactggctatactattatgaagtctgttttgttggaaggactagttgggcagttgaaattggaagccattagttgctttttgcatttggaagtgttgaaactgtaaatcttttaacactgaatttgtgcatgcatagttggagtaggctttcaacgaggatggtggttggtagtgttgttttgcttagtttatttcacaataaaaaagtttaaatttgttcaaaatgtgattcctttactttagaacatgaatgatgaatcaaaatatttttta

SEQ ID NO: 3144 - DNA, 3364 bp, Catharanthus roseus
agatcgctctcttatagtcatggctggagctttagtacaatcgactaatttaccttcagcggttgcgggaggttatggacaaattaaagggttccgtaaatccggtaaatcaagagcagttaaaatgctttgccctcagaatgtggcacctctaaggatcagaagtttctctggattacgggggtccactgccttggataacatggttaaatctggacagagtttacatttgaaagtggcaaatgcaacctctggccggagaaaggctagccgaatggcaccaagagccatgtttgagcgtttcacagagaaagctatcaaggttattatgcttgcacaagaggaggcaagacggttaggccacaattttgttggcactgagcaaattttactggggcttattggtgagggtacgggaattgctgctaaggtccttaaatcgatgggcattaatttgaaagatgctcgtgtagaagttgagaaaataattggaaggggcagtggatttgtggctgttgaaatcccctttactccacgtgctaagcgagtattggaactttcattagaggaggcccgccaacttggccacaattatattggatcagagcacctgttgcttggattgcttcgtgagggtgaaggtgttgctgctcgtgtccttgagaacttaggtgctgaccccagtaacattcgcacgcaggtcattaggatggtaggtgaaagtgcagaagctgttgctgctggtcttggaggtggtagttccagcaacaagatgcctacattagaggaatatggtacgaacttgacaaagctggctgaggaggggaaactagatcctgttgtcggaaggcaagatcaaattgaacgtgttactcaaatattgggccgccggacgaagaataatccctgccttattggagagccaggagtagggaaaacagctattgctgagggtcttgcccaacgaattgcaaatggtgatgttccagaaacaatagagggaaagaaggttattactttggatatgggtctgctggtggctggtacaaaatatcgtggagagtttgaagaaaggctcaaaaaattgatggaggaaataaaacaaagtgatgaaattatactcttcattgatgaagtgcacacattaattggagctggagcagcagagggtgcaattgatgctgcaaacattctaaaacctgctctagctcgtggtgaacttcagtgtataggggctaccacactagatgaatacagaaagcacattgagaaggatcctgcacttgaaagacgttttcagccggtcaaggtacctgaaccttcagttgatgaaactattcaaattttgaagggccttagagagaggtatgagattcatcacaaactccgctacactgatgaggccttggttgctgccgcacagctgtcataccagtacatcagtgaccgcttcttgcctgataaagctattgacttgattgatgaagctggttctcgtgttcgacttcgtcatgcccagctccctgaggaagctagggagctagagaaggaactcaggcagataacaaaggagaaaaatgaagctgtccgcagccaagactttgagaaggcaggtgaattgcgtgacagagaaatggatcttaaggcacagatatctgctcttatagataagaacaaagaaatgagcaaggcagagtcagaggctggggagggtggtcctactgtgacagaaatggacattcaacatatcgtttcttcatggacaggtattcctgttgagaaggtatctactgatgaatcagatcgtctcctcaagatggaagagacactccacacacgggtgatcggtcaagatgaagctgttaaggccatcagccgtgccattcgtcgtgctcgtgttggactcaagaaccccaaccggcccattgctagcttcatcttttctggtcctactggtgtggggaagtcggaacttgcaaaagcactagctgcttactattttggttctgaggaagcaatgatacgacttgatatgagtgagttcatggagagacacacagtttcaaagcttattggttcacccccgggatatgttggttacactgaaggtggtcagctgactgaggcagtgagacgtcgcccttacactgttgtgctatttgatgagattgagaaagctcatcctgatgtcttcaacatgatgcttcaaattcttgaggatggaaggttaacagacagtaaaggtagaaccgttgacttcaagaacacacttctgattatgacatctaatgttggtagcagtgttattgagaaaggtggcaggcgtataggttttgatcttgactacgatgagaaagatagtagctacaacagaattaagagtttagtgaccgaggaattaaaacaatatttcagaccagaattcttgaatcgattggatgagatgattgtattccgtcaactcaccaagcttgaagtgaaggagatagccgacataatgctcaaggaagtctttgaccggctgaagaaaaaggacataaagcttgatgtaacagagaggtttagagaaagagttgtggaagaaggttacaacccaagctatggagcacgaccattgagacgagctataatgaggctgttggaggatagcatggctgagaagatgcttgcacgtgaaatcaaagaaggcgattcagttattgtggatgtagactctgatggcaatgttaccgttctgaatggtgatttagaagcacaaccagctggggtttagatcctgtgccgtctttaacatttcacaaaatgtgttgtttgtactgctactttcgggttttgaattggctccaacaatatcctggttttgcagagggattggattttcacggtagacgacttcatatatagcttgcttaaacagctcatggttgtatttctcatgagagtgcttgaggttgcatcttcttttgccagcaagcaagctttttaaggtcttattcttctacgtatattaggtttctggtggagctatagacagtcatattaggatgttggatttgcacatgtttattcttataattatactagattatgatgtttaccaagaataacaactttcaacaagattatgtcatattttctgcccctcatgataatgtctcacagggttaattttctggaacaaccttgtacagcatttgctgatcgccaagttcctggcaaaacatgccaaggctaaagggcctgatgcaacatgctaaggctgagctcagttcctagcttgggttaggcgctgggctcggcatttcagcaggttgctggattatgtccccttgtattcttttctactatagagtcccaatttttg

SEQ ID NO: 3145 - DNA, 3218 bp, Gossypium hirsutum
ggtaaaaagaagggtctcttctctctgcaattcccaaaagaaaagacccctttttagtatattttactgtccatttcactctctattcaatttcaccctctttcttttctatagtttaggagtgatggctaaagttctggcgcagtcgactattgttccttctctagttacgagtcgaagtcatggtcgatccactgggaaatcgaaaaggtctgtcaaaatgatgtctagtttacgaacacctggattgaggataaatagtttctctgggttgcggggctcagcttctttggataatatggttagagttgaccaagatttccattccaaggttgcgatttcaatctcgtctcaacgtggaaggggaagtaggtgtgtgcctaaagccatgtttgaacgctttactgaaaaagcaattaaagtaatcatgcttgctcaagaggaagctaggcgacttggccataactttgtcggtacagagcaaattttgttgggtcttattggtgaaggtactggcattgctgcaaaagttcttaaatccatgggaatcaatcttaaagatgcacgagttgaagtggagaagataattggaaggggaagtggttttgttgctgtggaaattccatttactcctcgtgcaaaacgtgttttggaactctcgttagaagaagctcgccaactcggccataattacattggatcagagcatctgcttctggggttgcttcgtgaaggtgaaggtgtagcagcacgtgttcttgaaaatttgggtgctgacccaagcaatatccgcacacaggttattcgtatggttggtgagggcaacgaagttagtgtggttaccggaggatcaactggtaacacaaagatgccaacacttgaggaatacggaaccaatttgactaagttagctgaagagggtaaattggatcctgttgttggaaggcaagatcaaatcgaacgagtcgtccaaatattgggtagacgaaccaaaaacaacccgtgtcttattggagaacctggtgttggaaaaactgctattgcagaaggtcttgcccaacgaattgctactggtgatgttcctgatactattgagggcaagaaggttataactcttgatatgggtcttcttgttgctggaacaaaatatcgtggtgagtttgaggagaggttgaagaagctaatggaggaaatcaagcaaagtgatgagataatattgtttattgatgaggtgcacactttgattggagctggagcagctgaaggtgcgattgatgctgccaatatcttgaagcctgctcttgcaagaggtgaattgcagtgtattggagctaccacactcgatgaataccgaaagcatattgagaaagacccagctttggaaagacgtttccagccagttaaagtgcccgaaccatctgttgatgaaactatacagattttgaaaggtttgcgagagcgttacgagattcaccacaagcttcgttacacagatgaggccttaatctctgccgcacagctttcataccagtacatcagtgaccgttttctgcctgataaagcaattgacttgattgatgaagctggatctcgtgttcgccttcgtcatgcacagctccctgaggaagctagagagcttgagaaagagctccggcagatcacaaagtcgaagaacgaagcagttcgcagccaggactttgagaaggctggggaattacgcgatcgggaaattgagctcagggctcagatcactgcaatccaagagaaagacaaggagatgaataaggcagaggcggaggcaggggatggagggcctctagtgactgaagtcgacattcagcatatagtctcttcatggactggtattcctgttgagaaagtatcaaccgatgaatccgatcgcctacttaaaatggaagagactcttcataagcgagtcattggtcaggatgaagctgtcaaagccattagccgtgctattcgacgtgctcgtgttggtctcaagaaccctaaccggccaattgccagttttatcttctctggaccaactggtgtaggaaaatcggaactagcaaaggcactagctgcttactactttggctctgaagaagccatgatccgacttgatatgagtgagttcatggaaaggcacacggtgtccaagctgattggttcaccccctgggtatgttgggtacaccgagggtggtcagctaactgaggctgttaggaggcgaccatacaccgtagtacttttcgatgagattgagaaagcccatcccgatgttttcaacatgatgcttcagatcctcgaggacggaaggctcacagatagtaaaggaagaactgtcgatttcaagaatacactcctgataatgacatcaaacgttggaagcagtgttatcgaaaagggtggacggcgaattgggtttgatctcgattatgatgagaaagacagtagttacaatagaataaagagcctggtgacagaagaactgaagcaatatttcaggccggaatttttgaacagattggacgagatgattgttttcaggcaactcaccaagttagaagtgaaggaaattgccgatataatgctcaaagaagtgtttgacaggcttaaaagcaaagaaatcgagctccaagtgaccgaaaggtttagagaaagggtggtggaagaagggtacaacccaagttacggagcaaggcctttaagaagagccataatgagacttctggaggacagcatggctgagaagatgcttgcaagggaaatcaaggaaggtgattcagtaatagtagatgttgactctgatggaaatgtcacggttctcaatggcagcagtggcacttccgagtcattgaccaatccgattccagttgtgtaaaccacatataagccactctagatatgttgttttgtaccctcttttttcttttgcttctccttttgattgaactggctatactattatgaagtctgttttgttggaaggactagttgggcagttgaaattggaagccattagttgctttttgcatttggaagtgttgaaactgtaaatcttttaacactgaatttgtgcatgcatagttggagtaggctttcaacgaggatggtggttggtagtgttgttttgcttagtttatttcacaataaaaaagttttaaatttgttcaaaatgtgattcctttactttagaacatgaatgatgaatc

SEQ ID NO: 3146 - DNA, 3688 bp, Pinus taeda
tatagttgcgtgcctgttatggagacgtagtagcggaaaatataacgacacgcatatgtttaggttattgggacatacgtgagccaggaataaacgttagtttgattggaaaataaatacgacaaatattatatagatatgaaccataagacatttgagcatccacgtcgtccacatattccagatgctatctatcccgtgcctcttaaatgttaactactaatcatgtacaatctgccatatcttcacccccattaatttcctcccggggaaaaaactgcagtacaccaggaggaggatattcatctcaaggccctgcagtggcaggattccaggtgacgaattatactccgagattgccattttctgcaaaggatttctttacctgatcaagcatattaagcaatctttcttatctaggtaagatggctggagcactagcacaatctgcaattcttcctggtggaataatcagtagaaagcatggtcaaattcagagctctaaaagaggaaaaggagttccaaagatgattggtaaggtgcattcacgatcctttagcatgcgaagtttcactggattgcgccaagaaacatgcatagataaggttggaagtcctttaaaagactttcatgcagcagtagcagcttcagttcgtctcccagtggggagaggcaatagaggggtggttgtagctatgtttgagcgttttactgagaaggccatcaaggtaattatgcttgctcaagaggaagcacgacgccttggacacaattttgtaggtacagagcagattctcttaggtcttattggtgaagggactggtattgcagcaaaggtcctaaaatccatgggaatcaatctcaaggaggctcgtgtagaggttgagaaaatcattggcagaggcagtgggtttgttgctgtggagattccgttcactccaagagcaaagcgtgtgttggaactttcacttgaggaagctcgacaacttggacacaactacataggatctgagcacttgcttttagggttgttgagggaaggtgaaggtgttgcagctcgtgtgcttgagaatcttggagctgaccccagcaatattcgtacgcaggtaattcggatggttggagaaagtacagaagctgttggtgctggagttggaggcggtagcagcagcaacaagatgcctactcttgaggaatatggaacgaatttgacaaaactggcagaggagggcaagcttgatccagtggttggaaggcagccacaaatagaacgtgttactcaaatactgggacgccgtacaaaaaataatccttgtcttattggtgagcccggtgtaggaaaaacagctattgctgagggacttgcacagcgaatagcttcaggagatgttccagagacaatcgagggtaaaaaggtcatcactttagatatggggttacttgttgctggtaccaagtatcgtggagagtttgaagaaagattgaagaaattgatggaggaaatcaaacagagtgatgagattatactcttcatagacgaagttcatactttgattggagcaggtgcagcagaaggtgcaattgatgcagccaatattctgaaaccatctcttgcacgaggtgaacttcagtgtattggagccaccaccttggatgaatacaggaaacacattgagaaggacccagcgctagagaggagattccaaccagtacaagtgccagagccaactgttgatgagacgatacagatactgaaaggtttacgtgagcgatatgagattcatcacaagcttcgttatactgacgagtctttggtggctgctgcaaagttgtcgtatcaatatatcagtgatcgtttccttcctgacaaagcaattgatctgattgatgaggctggttctcgagtacgccttcgccatgcacagctccctgaagaggctagagaacttgacaaagaactcagacagattacaaaagaaaagaatgaagctgttcgaggccaggactttgaaaaggctggagagctacgtgatcgtgagatggaacttaaggcacaaatttcggctttaacagagaaaggaaaagagaaatcaaaggctgagagtgaagcaggagatgctagcccattagtaactgaggtagatattcagcaaattgtatgtgcatggacaggcattccagttgaaaaagtgtcaactgatgagtctgacaaacttctgaaaatggaagaaacactccaccaacgcattgttgggcaagatgaggcagttaaagctatcagtcgagctattcgccgtgcaagagttggccttaagaatccaaacaggccaattgcgagcttcattttctcaggacctacaggtgttggcaaatcggagcttgccaaggcattggctgcatactattttggttcagaggaggcaatgataaggctagatatgagtgaattcatggaaaggcacactgtttccaagttgattggttcacccccaggatacgtaggctacactgaaggagggcaactaactgaagctgttaggagacgcccatatacggtggtcctttttgatgaaattgaaaaggctcatccagacgtcttcaatatgatgcttcaaattcttgaagatggaagactgacagatagtaaaggacggactgtggactttaagaatacccttttgatcatgacttctaatgtcggtagtagtgtgattgagaagggaggccgtggaattggtttccagcttgattacgatgagaaagacagcagctacacaaggatcaaaagtcttgtcaatgaagagctgaagcaatattttcgacctgagttcctgaatcgactagatgagatgattgtgtttagacagctcacaaagacagaggtgaaggagattgcagatataatgctgaaagaggtctttgaacgtcttaaaacaaaagaaattgatcttcaagtaacagagcggttcacagaccgagttgtagatgaaggttatagtcccagctatggtgcaaggccactccgcagggcaattatgaggttattagaggatagcctggctgaaaaaatgcttgctggtgagatcaaagagggggattcagctatagttgacgtggatagcgaaggaaatgttattgtgttgaatgggaagactggcacagtagggccatcagccactgcattagctgcatagaaaaaaggtccattcatttgagtggctgggccaaagattggtcaacttggctccatctgattaaatgtaggtagttattaaatgacaggatttcttgcggtttcaatttgatgtctgagtacttgttagatgatgttcgctgtaattaccctagttctgagcatctaaagttgtaggatatacgttggattgttctgaactttattgagataatgaaaactttgaaatgttgcaagtataaaagagatgttaaggttgtcacttaaattcttccaaccattattttacacgaagttcctgttgtggcttggttgaaatggttttgtgaatgttaaaaactagaaaacaaatcaaaagtgaatgagattcattctgaaactgttggcagtttattagctgcaaattccaaaattttattgtagatatttgggtatagattggttatccatttaaaattgaaagcttttattactatgtaaaaaaaaaaaaaaaaa

SEQ ID NO: 3147 - DNA, 3259 bp, Pseudotsuga menziesii
gatttcctcactgcgaaaaaatttgctgtccaggaggaggaggatcttcatctcaaggccctgcagtcgcaaagttccatgtgacggattataatccgaaatcgccgtattttgcaaggatttctttacctgatcaagcagattaggcaggcttataatctgggtaagatggcaggagcactagcacaatctgcaattcttcctggtagaataatcagtacaaagcatggtcaaattcagagctctaaaagaggaaaaggagttccaaagatgatccgtaaggtgcattcacgatcctttagcatgcaaagttttactggattgcgccaagaaatgtgcatagataaggctggaagtcatgtaaaagattttcatgcagcagtagcagcttcaatttgtcttccagtggggaaaggcaatagaggtgtggttgtagctatgtttgagcgatttactgagaaggccatcaaggtaattatgcttgctcaagaggaagcacgacgccttggacacaattttgtaggtacagaacagattctcttaggccttattggtgaagggactggtattgcggcaaaggtcctaaaatccatgggaatcaatctcaaggaggctcgtgtagaggtcgagaaaatcattggcagaggcagtgggtttgttgctgtggagattccattcactcctagagcaaagcgtgtgttggaactttcccttgaggaagctcgacaacttggacacaactacataggatctgagcacttgcttttagggttattgcgggagggtgaaggtgttgcagctcgtgtgcttgagaatcttggagctgaccccagcaatattcgtacacaggtaattcggatggttggagaaagcacagaagctgttggtgctggagttggaggtggtagcagcagcaacaagatgccgactcttgaggaatatggaacaaatttgacaaaattggcagaggagggcaagctagatccagtggttggaaggcagccacaaatagaacgtgtgactcaaatactgggacgccgtacgaaaaataacccttgtctcattggtgagcccggtgtagggaaaacagctattgccgagggactggcacagcgaatagcttctggagatgttcctgagacaatcgagggtaaaaaggtcattactttagatatgggattacttgtggctggtactaagtatcgtggagaatttgaagagagattgaagaagttgatggaggaaatcaaacagagtgatgagattatactcttcatagacgaagttcatactttgattggagcaggtgcagcagaaggtgcaattgatgcagccaatattttgaagccatctcttgcacgaggtgaactgcagtgtattggagccaccaccttggatgaatacaggaaacacattgagaaggacccagcgctagagaggagattccaaccagtgcaagtgccagagccaactgttgatgagacaatacagatactgaaaggtttacgtgagcggtatgagattcatcacaagcttcgttatactgatgagtctttggtggctgctgcaaagttgtcgtatcaatatatcagtgatcgtttccttcctgacaaagcaattgatctgattgatgaggctggttctcgagtacgccttcgccatgcacagctccctgaagaagctagagaacttgacaaagaactcagacagattacaaaagaaaagaatgaatctgttcgaagccaggattttgaaaaggctggagaactacgtgatcgtgagatggaacttaaggcacaaattgcagctttaacagagaaaggaaaagagaaatcaaaggctgagagtgaagcaggaaatgcgagtccattagtaaccgaggtagatattcagcaaattgtatgtgcatggactggcattccagttgaaaaggtgtcaacagatgagtccgacaaacttttgaaaatggaggaaacactccaccaacgcatcattgggcaagatgaggcagttaaagctatcagtcgagctattcgccgtgcaagagttggtttgaagaatccaaacaggccaatcgcgagcttcattttctcgggtcctactggtgttggcaagtcggagcttgccaaggcattggctgcatactattttggttcagaggaggcaatgataaggctagatatgagtgaattcatggaaaggcacactgtttccaagttgattggttcacccccgggatatgtaggctacactgaaggagggcaactaactgaagctgtcaggagacgcccttacacggtggtcctttttgatgaaattgaaaaggctcatcctgacgtctttaatatgatgcttcaaatcctagaagatggaagactgacagatagcaaaggcagaactgtggactttaagaatacgcttttgatcatgacttctaatgttgggagtagcgtgattgagaagggaggccgtggaattggtttccagcttgattatgatgagaaagacagtagctacacaaggatcaaaagtcttgtcaatgaagagctgaagcaatatttccgacctgagttcctgaatcgactagatgagatgattgtgttcagacagcttacaaagacagaggtgaaagagattgcagatataatgttgagagaggtctttgaacggctcaaaactaaagaaattgatcttcaagtaacagagcggttcacagaccgagttgtagatgagggttatagtcccagctatggtgcaaggccactccgtcgggcaattatgaggttattagaggatagtctggctgaaaaaatgcttgctggtgagatcaaagagggcgattcagctatagttgatgtcgatagcgaaggaaatgttattgtcttgaatggaaagactggtacagcagggccatcagccactgcattagctgcataggaaaatggtccattcatttgagtggttgggccaatgattggtcaagctcgcttcattctatttaaatgtataagtagttattaaatgccaggatttcatttctggtttcagtttgatttcttagtaattgttagacggtgttcactgtaattaccctagttctgagcatctaaagttgtaggatatacgttgggttgttctgaactttattgagatgatgaatactttgagatgttacaagtacaaaagaggtgttaaggttatctcttaatatctttccagcattatttttcactaagtccttttgtcgcttggttgaaat

SEQ ID NO: 3148 - DNA, 3481 bp, Picea glauca
aatttcctccctgggaaggaaaaaactgcagtccacgaggaggaggatcttcatctcaaggccctgcagtggaagaattccaggtgacggattatactccgaaatccctgttttctgcaaaggatttccttacctgataaagcagattaagcaggcttattatctgggtaaaatggctggagcactagcacaatctgcaattcttcctggtagaataatcagtacaaagcatggtcaaattcagagctctaaaagaggaaaaggaattccaaagatgattggtaaggtgcattcacgatcctttagtatgcaaagtttcactggattgcgccgagaaacatgcatagataaggttggaactcctgtaaaagactttcatgcaacagtagcagcttcgatttgtcttccagtggggaaaggccatagaggggtggttgtagctatgtttgagcgctttactgagaaggccatcaaggtaattatgcttgctcaagaggaagcacggcgccttggacacaattttgtaggtacagagcagattctcttaggtcttattggtgaagggactggtattgcagcaaaggtcctaaaatcaatgggaatcaatctcaaggaggctcgtgtagaggttgagaaaatcattggcagaggtagtgggtttgttgctgtggagattccgttcactcccagagcaaagcgtgtgttggaactttcacttgaggaagctcgacaacttggacacaactacataggatctgagcacttgcttttagggttgttgcgggagggtgaaggtgttgcagctcgtgttcttgagaatcttggagctgaccccagcaatattcgtacacaggtaattcggatggttggagaaagtacagaagctgttggtgctggagttggaggtggaagcagcagcaacaagatgccaactcttgaggaatatggaacgaatttgacaaaactggcagaggagggcaagcttgatccagtggttggaaggcagccacaaatagaacgtgttactcagatactgggacgtcgtacaaaaaataatccttgtctcattggtgagcccggtgtagggaaaacagctattgctgagggacttgcacagcgaatagcttctggagatgttccagagacaatcgagggtaaaaaggtcattactttagatatggggttacttgttgctggtaccaagtatcgtggagagtttgaagagcgattgaagaagttgatggaggaaatcaaacagagtgatgagattatacttttcatagatgaagttcatactttgattggagcaggtgcagcagaaggtgcaattgatgcagccaatattctgaaaccatctcttgcacgaggtgaactgcagtgtattggagccactaccttggatgaatacaggaaacacattgagaaggacccagcgctagagaggagattccaaccagtacaagtgccagagccaactgttgatgagacgatacagatactgaaaggtttacgtgagcgatatgagattcatcacaagcttcgttatactgaagaggctttggtggctgctgcaaagttgtcgtatcaatatatcagtgatcgtttccttcctgacaaagctattgatctcattgatgaggctggttctcgagtacgccttcgccatgcacagcttcctgaagaagccagagaacttgacaaagaactcagacagattacaaaagaaaagaatgaatctgttcgaagccaggactttgaaaaggctggagagctacgtgatcgtgagatggaacttaaggcacaaatttcagctttaacagagaaaggaaaagagaaatcaaaggctgagagtgaagcaggagatgcaggtccattagtaactgaggtagatattcagcaaattgtatgtgcatggacaggcattccagttgaaaaggtgtcaactgacgagtctgacaaacttctgaaaatggaggaaacactccaccaacgcatcattgggcaagacgaggcagttaaagccataagtcgagctattcgccgtgcaagagttggtttaaagaatccaaacaggccaattgccagtttcattttctcgggtcctacaggtgttggcaagtcggagcttgccaaggcattggctgcatactattttggttcagaggaggcaatgataaggctagatatgagtgaatttatggaaaggcatactgtttccaagttgattggttcacccccaggatatgtaggctacactgaaggagggcaactaactgaagctgttaggagacgcccttatacggttgtccttttcgatgaaattgaaaaggctcacccagacgtcttcaatatgatgcttcaaatcctagaagatggaagactgacagatagcaaaggcaggactgtggactttaagaatacccttttgatcatgacttctaatgttgggagtagtgtgattgagaagggaggccgtggaattggtttccagcttgattatgatgagaaagacagtagctacacaaggatcaaaagtcttgtcaatgaagagctgaagcaatattttcgacctgagttcctgaatcggctagatgagatgattgtgtttagacagctcacaaagacagaggtgaaagagattgcagatataatgctgaaagaggtctttgaacggcttaaaacaaaagaaattggtcttcaagtaacagagcggttcacagaccgagttgtagatgaaggttatagtcccagctatggtgcaaggccactccgtagggcaattatgaggttattagaggatagtctggctgaaaaaatgcttgctggtgagatcaaagagggtgattcagctatagttgatgtggacggtgaaggaaacgttattgtcttgaatggaaagactggcacagcagggccatcagccactgcattagctgcatagaaaaagggtccattcatttgagtggttgggccaaagattggtcaagttggctccatcctattaaatgtaagtagttttaaatctcaggatttgttttctggtttcaatttgatttgagtttttgttagatggtgttcgctgtaattaccctagttctgagcatctaaagttgtaggatatacgttggattgttctgaactttattgagataatgaaaactttgaaatgttacaagtacaaaagagatgttaaggttgtctcttaaattcttccaaccattatttttcacgaagttcttttgtggcttggttgaaatggctttgtgaatgttagaaactagaaagtaaatcaaaagtgaatgggattcattctgaaattgttggcagttcattagctgcaaattcagaaactttgttgtagatattcgagtataaattggttatccatgtaaattgaaagtttttatagacattatgttgagaatatgaatgaaatttgacccaactacagtaactctgaaagggtgatattttccggcaa

SEQ ID NO: 3149 - DNA, 3107 bp, Tabernaemontana elegans
ccattgtcaattgtcatccaccccctttccatccctaccaccatttttaatctctttctattctctttctctctcttctttgagggggtgataatactattgctcagtcatggctggagctttagtacagtcaactaatttaccttcagtagttgctgcgggagggtatggacaaattaaaggttctggtaaatcaaaaagagcagcagttaaaatgctctgcactgtgtatgcgacacccttaaggttgacaagtttttctggattgcgagggtcaaatgccttggatacaatggttaactccggtcagagtttacatttgaaagtggcgaatgctacttctggccggagaagggccaggagaatggcacccaaagccatgtttgagcgtttcacggaaaaggctataaaagttattatgcttgcgcaagaggaggcaagacggttaggccacaattttgttggcactgagcaaattttgctgggccttattggtgagggtacaggaattgctgctaaggtcctcaaatcaatgggcattaatttgaaggatgctcgtgtggaagttgagaagataattggaaggggtagcggatttgtggcagtggaaatcccttttactccacgtgcaaagcgagtattggaactgtcattggaggaggcccgacaacttggccacaattatattgggtcagagcacttgttgctgggattgcttcgtgagggtgaaggtgttgctgcccgtgttcttgagaacttaggtgctgacccaagtaacattcgtacacaggtcattagaatggtaggtgaaagcgcagaagctgttgctgctggtcttggaggtggaagttctagcaataagatgcctacactagaggaatacggtacaaatttgaccaagatggctgaggagggaaaactagatcctgttgttggaaggcaagagcaaattgaacgtgttactcaaatattgggtcgccggacaaagaataatccctgccttattggagagccaggagtaggaaaaacagctattgctgagggccttgcacaacgaattgcaaatggtgatgttccagaaacaatagaggggaagaaggttattactttggatatgggtctcctggtggctggtacaaaatatcgtggagagttcgaagaaaggctaaagaaattgatggaggaaataaaacaaagtgatgaaattatactttttattgatgaagtgcacacattaataggagctggagcagctgagggtgcaattgatgctgcaaacattttgaaacctgctctagctcggggtgaactacagtgtatcggtgctacgacactagatgaatatagaaagcacattgagaaggatcctgcgctagaaagacgttttcagccagttagggtacctgaacctactgttgacgaaactattcagattttgaaggggcttcgagagaggtatgagatccatcacaaactccgctacacggatgaggctttggttgctgctgcccaattgtcataccagtacatcagtgatcgctttttgcctgataaagctattgacttgattgatgaagctggttctcgtgttcgacttcgtcatgcccagctccctgaggaagcgagagaacttgagaaagaactcagacagatcacaaaggagaaaaatgaagccgtccgtagtcaagattttgagaaggctggtgagctacgtgacagagaaatggatcttaagacacagatagctgctcttatagataagaataaagagatgagcaaggcagagtctgaggctggggatggtggtcctattgtgacagaagtggacattcaacatattgtttctgcctggacaggtattcctgttgagaaggtgtctactgatgaatccgatcgcctcctcaagatggaagagacactccacaggcgagtcattggtcaagacgaagctgttaaagccatcagccgtgccatccgtcgtgctcgtgttggacttaagaaccccaaccggcccattgctagctttatcttttctggtcctactggtgtggggaagtcggagcttgcaaaggcactagctgcttactattttggttctgaagaagctatgattagacttgatatgagtgagttcatggagagacacactgtttcaaagcttattggttcgccccctggatatgttggttatactgagggtggtcagctgactgaggcagtgcgacgtcgcccttacactgttgtgctctttgacgagattgagaaagctcatcctgatgtcttcaacatgatgcttcaaattctcgaggatggaaggttaacagacagtaagggtagaactgtcgacttcaagaacacacttctgattatgacatcaaatgttggtagcagtgtaattgagaaaggtggccgacgtataggttttgatcttgattatgatgagaaagacagcagttacaacagaatcaagagcttggtgactgaggaattaaaacaatatttccggccagaattcttgaatagattggatgagatgatagtattccgtcaactaactaagctggaagtgaaggagatagctgacataatgctcaaggaggtctttgatcggctaaagaaaagggagataaagcttgaagtgacagagagatttagagaaagggttgttgaggaaggttacaacccgagctatggtgcacggccattgagaagagctattatgaggcttttggaggatagcatggctgagaagatgcttgcacgtgagatcaaagaaggcgattcagttatcgtggatgtagattctgatggaaatgttactgttttgaatggtgacgcagagccagttgcagtttagaccaaagctttttatgctttgacattttacaagtttgttgtttgtactgctactttggatttgaattggctacgatagtatcgcagaacaactcttttgatggtaagactccttagctggttgagtgactcatggttatgtctctacactctacagagggtgcccgaagttgcatcttctctgccggcaagcattaaggttgtattctctagtattagtcgctaggagttgaatttgcacatttttattc

SEQ ID NO: 3150 - DNA, 3048 bp, Vinca minor
gaattggtgaatacttatagagagagtcattctctaccaccatttttctcttatttttcttctttctctcttctttgagagggggtgatattattattgatcaggtcgctctcttatagtcatggccagagttttggcacagttcacaccttcaatagtcacgggaggtcatgggcaaattagaggcaatggtagatctacaagagcagttagaatgctctgcaatgcgtacgcagcacctctaaggatgaacagtttttctggattacgagcgtcaaatgccttggatacaatggctagaactgggccgagtttacattcactggtggcaaatgcaccctttggccggagggccggccggagaaaggccaaccgaatggtcccgagagccatgttcgagcgtttcacagagaaagctataaaggttattatgcttgcacaagaagaggcaagacggttaggccacaattttgttggcactgagcaaattttactggggcttattggtgagggtacaggaattgcagctaaggtcctcaaatcaatgggcattaatttgaaagatgcacgtgtcgaagttgagaagattattggaaggggtagtggatttgtggcagtagaaatcccttttactccacgtgcaaagcgagtgttggaactttcattagaggaggcccggcaacttggtcacaattatattgggtcagagcacctgttgcttggtctgcttcgcgagggtgaaggtgttgctgctcgtgttcttgagaacttaggtgctgacccaagtaacattcgcacacaggtcattagaatggtaggtgaaagtgccgaagctgttggtgctggtgttggaggtggaagttccggcaacaagatgcctacattagaggaatatggtacaaatttgacaaagctggctgaggaggggaaactagatcctgttgttggaaggcaaccgcagattgaacgtgttactcaaatattgggtcgtaggacgaagaataatccctgccttattggagagcctggagtagggaaaacagctattgctgagggtctcgcccaacgaattgcaaatggtgatgttccggagacaatagagggaaagaaggttataactttggatatgggtctgctggtggctggtacgaagtatcgtggagagttcgaagaaaggctcaagaaattgatggaggaaattaaacaaagtgatgaaattatacttttcattgatgaggtgcacacattaattggagctggagcagcagagggtgcaattgatgctgcaaacatcttaaaaccagctcttgctcgaggtgaactacagtgtattggggctaccacacttgatgaatacagaaagcacattgagaaggatcctgcacttgaaagacgttttcagccagttaaggtacctgaacccacagtcgatgaaaccattcaaattttgaagggcctacgggagagatatgagattcatcacaaacttcgctacactgacgagtctttggttgctgctgcacagctgtcataccaatatatcagtgaccgctttctgcccgataaagctattgacttaattgatgaagctggttctcgtgttagacttcgtcatgcccagctccctgaggaagctagagaactagagaaagaactcaggcagatcacgaaggagaaaaatgaagctgtccgtggccaagattttgagaaggctggcgagttacgtgatagagaaatggatcttaaggcacagatatctgctcttatagataagaacaaagagatgagcaaggcagagtccgaggctggggatagcggtcctctcgtgacagaagtggacattcaacacattgtttcttcatggacaggtattcctgttgagaaggtatccactgatgaatcagatcgcctcctcaagatggaagagactctccacacacgagtggttggtcaagacgaagctgttaaggccatcagccgtgccatccgccgtgctcgtgttggtctcaagaaccccaaccggccaattgcaagcttcatcttctctggacctactggtgtggggaagtctgaacttgctaaagcactagcggcttattattttggttccgaggaatcaatgataagacttgacatgagtgaattcatggagagacacactgtttcgaagcttattggttcacctcctggatatgttgggtacactgaaggtggtcagctgaccgaggccgtgagacgtcgcccttacactgttgttctttttgacgagattgagaaagctcatcccgatgtcttcaatatgatgcttcagattctcgaggatggaaggttaacggacagcaagggtagaaccgtcgacttcaagaacacacttctgattatgacatcaaatgttggtagcagtgtaattgagaaaggtgggcgacgcatcggttttgatctcgactatgatgagaaagatagtagttacaacagaatcaagagcttggtgaccgaggaattgaaacaatacttcagacctgaattcttgaacagattggacgagatgatagtattccgacaactcaccaagctcgaggtgaaggagatagccgacataatgctcaaggaggtctttgagcggttgaagaaaaaggacataaagctcgacgtaacagagagattcaaagaaagggtcgtggaggaaggctacaaccctagctatggagctcgaccattgagacgagctatcatgaggctgttggaagacagcatggccgagaaaatgcttgcacgggaaatcaaggaaggcgattcagtcatcgtggatgtggattcagacgggaatgttaccgtcttgaacggtgatttagactcaaagccagttggggacgcaacaccagttggagtttaagattaaaaacgaaacttatgatgtctctttgattgtatttttctgaagaggtagcatcttctttgcttagcaatctttaaggttataatcttagcagaacattagcttctgtagaagtagtagtatctatgatcaatcattttgattcatataat

SEQ ID NO: 3151 - DNA, 3411 bp, Solanum phureja
tataacacggccgactttcaagctctctctatttcgtttccctttctttctttttttttcttctcctcttttcacaatctttagtgttattgaggttgcaggtccatcatggctagagctttagttcagtcaacagacattctatcttcagttgccagtgaaagggctggacaattcaatggatcccggaaaaatcaaagaactgttagaatgctatgtaatgtaaaatgttcttcctcaaggctgaacagttttgcaggactgcgagggtgcaatgcgttagatacactactagtaaaatctggagaaactctccattcgaaagtggcagctgcaacttttgttagacggtcacatttgtcccaaaagcaatgtttgagcgcttcaccgagaaagcaataaaagtcattatgcttgcgcaagaagaggccagacgactaggtcacaactttgttgggacagaacagatcctgctgggtcttattggtgagggaactggtattgctgctaaggttcttaaatccatgggaattaatttgaaagatgctcgtgtggaagtagagaagattattggcaggggtagtggatttattgcagtggaaatcccttttactcctcgtgcaaagcgtgttctagaattatctctggaggaagcccgccaactagggcataattacattggctcggaacacttgctacttggattgttgcgcgaaggtgaaggtgtggctgcccgtgttcttgaaaacttgggtgctgaccccagtaacattcgcacacaggcaagtcatacggatggttggcgagagtagtgaggctgttggtgctagtgttggcggtggaacttctggcctaaaaatgcctacattggaggagtacggcaccaatttgacaaagttagctgaagaggggaaactagatcctgtagttggaagacaggctcaaatcgagcgtgttactcaaatcttgggtcgccgtacaaaaaacaacccttgtcttattggagaaccaggtgttggaaaaactgctattgccgaagggctagctcaaagaattgctaatggtgatgtccctgaaacaatagagggcaagaaggtcataacacttgatatgggattgcttgttgctgggacaaaataccgtggagagtttgaggaaagactgaagaaactaatggaggaaattaaacaaagtgatgacataatactgtttattgatgaagtacacacattgattggagctggagctgcagagggagcaattgatgctgcgaacatcttgaaacctgccctggctagaggcgagctacagtgtattggagccacaaccctggatgagtacagaaagcacattgagaaagaccctgcactggagaggaggttccagccagttaaagtccctgaaccttctgtggatgaaaccatacagatcctgaaagggcttcgggagaggtatgagattcatcacaagctccgttacactgatgaggcaatagacgctgctgccaagctttctcaccagtacatcagtgaccgctttctgcctgataaagcaattgacttgattgatgaagctggttcccgtgttcgacttcgtcatgcacagctccctgaggaagcaagagagctggagaaggagcttcgccagattacaaaggagaaaaatgaatctgtccgtggtcaagattttgagaaggctggggagttgcgtgatagagaaatggaccttaaggcacaaatctcagccttgatagacaaaaacaaagagaagagcaaggcggaatctgaggcaggagatgcagcaggtcccatagtgacagaggcagatattcatcacattgtctcttcctggactggcattcctgtagagaaggtctcaactgatgaatctgatcgcctcctaaaaatggaagaaacacttcatacccgagtcattggccaggatgaagctgtaaaagccattagtcgtgctatcagacgtgcccgtgttggactcaagaatcccaaccgacctattgccagtttcatcttttctggtccaactggtgttgggaagtcagaactggccaagtctttagcaacgtactactttggttctgaagaagcaatgattcggcttgatatgagtgagtttatggagagacacactgtgtctaaactcatcggttctccccctgggtatgttggttacactgaaggtggtcaattaactgaagctgtgaggcgtcgaccttacactgttgtgctctttgatgagattgagaaggctcatcctgatgtctttaacatgatgcttcaaattcttgaagatggaagattgacagacagcaagggcagaactgtcgacttcaagaatacactcctcatcatgacatcgaatgttggaagcagtgtgatagaaaaaggaggtcgtcgtataggttttgatctagattttgatgagaaggatagtagttacaaccgtatcaagagcttggtgactgaggagttgaaacagtacttcaggccagagttcttaaacagattagatgagatgattgtattccgtcagctcactaagttggaggtgaaggagattgctgatatcatgcttaaggaagtctttgtgaggttgaagaataaggagatagaacttcaagtgacagagaggtttagagacagggtggttgatgaaggatacaacccaagctatggagctaggccattgaggagagctattatgagactgctggaggatagcatggccgagaagatgcttgcaggtgagatcaaagaaggtgattcagtaattgtggatgtggattcagatggcaatgtcaccgtcctcaatggcagtagcggtgctccctcagatccagctcccgagcctatccttgtgtagatcaagtcttcatttagctctgcaaatttgttgattgtaatgttgctttcggttgtattggctactaagctctcctacacttacgaagcaacttgtgagtaattttttggggtgacagttgacagggtgatgatattctgccaagttgacaaggcagtatccttcccaagcagagcatccaggattacacactatatacttaactggatttcattaaaattgtagtgtagaagcatttcttctaatttgtggtaggtgatagttagactttgtcatcattttcagcacgtttttcctgactgtttggctcaaatcacaactaaggatttaggttatgaacttgaatttctctactggttttttagctattgtccacaacaaacactagacaaatctaattccaaattttatattggataaccccctaatccttgtaactagacaaccccttgggataatattgtgcactaaaataccttcagcaggaattaacattattgttgaccttgaatgaattcttttgtcaactct

SEQ ID NO: 3152 - DNA, 3273 bp, Gossypium raimondii
atctttcggccgaccactcccagaagataaaaggaaaaaacagaaagggtctcttctactctgctgcttctgaaagagaataccctttattattattattatttgttttctattttagtttctctgctttttaaattcttcaccgactctttctttttatttagattgcataggagtgatggccaagattctagctcagtctgctattgttcctactctactttctagtcgtagccatggtgcgtctaaagaatctggaaaaccaaagaggtctgccaaaatgatgtgcagtttacaaactcctggattgaggataaggagtttttctgggttgcgaggctcaaattctttagataatattgtcagatatggccaagatttccattctaaggttggaatttcaatatcttctcgacgaggaaggggtagcagatgtgtacctaaggccatgtttgagcgtttcactgagaaagcgattaaagtaattatgcttgcacaagaggaagccagacggcttggccataattttgttggtactgagcaaattttattgggccttattggtgaaggtactggcattgctgcaaaagttcttaaatccatgggaatcaatcttaaagatgcacgtgtagaagtggagaagataattggaaggggaagtggatttgttgctgtggagatcccttttactcctcgcgcaaaacgtgttctggaactctcgttggaagaagctcgccagcttggccataattatattggatcagagcatcttcttcttgggttgcttcgtgaaggtgaaggtgtagcagcccgtgttcttgagaatttaggtgctgacccaagtaatatccgcacccaggttattcgtatggttggtgagggcaatgaagttagtgttgttactggaggatcaggtggaaacacaaagatgccaacacttgaggaatatgggaccaatctgactaagctagctgaggagggtaaattggatcctgttgttgggaggcaggatcaaatagagcgtgttgtccaaatattgggtagacgaaccaaaaacaatccatgtcttattggagaacctggtgttggtaaaactgcaattgcagaaggtcttgctcaacgtattgccagtggtgatgttcctgatacaattgagggaaagaaggttattacacttgatatgggtctccttgttgctggaactaaatatcgtggagaatttgaggaaagattgaagaagctaatggaggaaatcaagcaaagtgatgaaattatattgtttattgatgaggtgcacaccttaattggagcaggagctgcagaaggtgccattgatgctgccaatatcttgaagccagctcttgcaagaggtgaattgcagtgtattggagctacaacactggacgaatacagaaagcatattgagaaagacccagcattggaaagaagattccaaccagtcaaagtgcctgaaccatctgttgatgaaactatacagattttgaaaggtttgcgagaacgttatgagattcaccataagcttcggtacacagatgaggccttagtttctgctgcacagctgtcataccagtacatcagtgaccgttttctacctgacaaagcaattgacttgattgatgaagccggttctcgtgttcgccttcgtcatgcacagctccctgaggaagctaaagagcttgaaaaagagctgaggcagatcacaaagtcaaagaatgaagcagtccgcagccaggactttgagaaggccggggaattacgtgatcgagaaattgagcttagggctcagatcactgcaattcaggagaaagacaaggagatgaacaaggctgaggctgaggcaggagatggaggtcctgttgtgacagaagtggacatccagcatatagtctcttcgtggactggtattcctgttgagaaagtatcaactgatgaatctgatcgtctccttaagatggaagagacacttcataagcgagtcattggtcaggatgaagctgtaatagccattagccgtgctatccgacgtgcccgtgtaggtctcaagaaccccaaccggccaattgctagcttcatcttttctggaccaactggtgtaggaaagtcagaactagcaaaggctctagctgcttactatttcggctctgaagaagctatgatccgacttgatatgagtgagttcatggaaaggcacacagtgtccaagctcattggttcacctcctgggtatgttggttacactgagggtggtcagctaactgaggctgttagaagacgtccgtacactgtagtactttttgatgaaattgagaaggcccatcctgatgtcttcaacatgatgcttcagatactcgaggatggaaggttgacagacagtaaaggacgaactgtggatttcaagaatacccttctgataatgacatctaatgttggaagcagtgtaattgagaagggtggccgacggataggctttgatcttgattatgatgagaaagacagcagttacaatagaataaagagcttggtgacggaagagctgaaacaatatttccggcctgagttcttgaatagattggacgaaatgattgttttcaggcagctcaccaagttggaggtgaaggagatcgcagatataatgcttaaggaggtgtttgacaggcttaaagacaaagagatagagcttcaagtgactgaaaggtttagggaaagggtggtggaagaaggatacaatccaagctatggtgcaaggcctttgagaagagccattatgagacttctcgaggacagcatggctgagaaaatgcttgccagggacatcaaggagggtgattcagtaatcgttgatgttgactccgatggaaatgttacggttctcaatggtagcagcggtactcctgagtcattgggcgatccaatttcagtcgtgtaaccaaatagtcttttttggatatatgctctttttacctttccgttttcattgaaaggactacttggcagttgatttgaaagtcatcgctagcttgcccgttggcattgaaggtgtatttctgacacttaaaatcgcctgcttaattggaaggggcaaagaagatgctggtagtgttagtttagaatttaacttaacaataaactgtttggatatattgttttgaattatattgaaatacgttctaatgtgattatgttccacttctaccattatctggaaaacatttgttcatagttaaagctctttggttattcgtagttcgtgta

SEQ ID NO: 3153 - DNA, 3246 bp, Amsonia hubrichtii
gtcaatggagcagcagcagctgatagtataccagatatgatacattgatagtagtagaatgttagcatatttatagagagagcggccattatcaattatcatccacccccttttctatccctaccaacggtttaatctcttcttcttctctctctctctctctctcattccttcgagggggtgtttatattattgttaagattcctttctcatagtcatggctggagctttaatacagtctactaatttaccttcggtagttgctgctggaggatatggacaaattaaagggtctggtaaatcaaaaagagcagttaagatgctctgcagtgtgtatgcagcacctttaaggatgagaagtttttctggattgcgagggtctaatgccttggataccatggttaaatctggccagagtttacatttgaaagtggcaaatgcaacctctacccggagaaaggctagccgaatggcaccaagagccatgtttgagcgtttcacggaaaaagctataaaagttattatgcttgcacaagaggaggcaagacggttaggccacaattttgttggcactgagcaaattttactggggcttattggtgagggtacaggaattgctgctaaggtcctcaaatcaatgggcattaatttgaaggatgcacgtgtggaagtagagaagataattggaaggggtagtgggtttgtggctgtagaaatcccttttactccacgtgcaaagcgagttttggaactttcactagaggaggcccgccaacttggccacaattatattggctcagagcacctgttgctgggattgcttcgtgagggtgaaggtgttgctgctcgtgttcttgataacttgggtgccgacccaagtaacattcgcacacaggtcattagaatggttggtgaaagtgcagaagctgttgctgctggtcttggaggtggtagttctagcaacaagatgcctacactagaggaatatggtacaaacttgaccaagctggctgaggagggaaaactggatcctgttgttggaaggcaagagcaaattgaacgtgttactcaaatattgggtcgccgtacgaagaataatccttgccttattggagagcccggagtagggaaaacagctattgccgagggtcttgcccaacgaattgcaactggtgatgttccagaaacaatagaagggaagaaggttattactttggatatgggtctcctggtggctggtactaaatatcgaggagagtttgaagaaaggcttaagaaattgatggaggaaataagacaaagtgatgaaattatacttttcattgatgaagtgcatacattaattggagctggagcagcagagggtgctattgatgctgcaaacattttaaaacctgctctagctcgaggtgaattacagtgtattggggctaccacactagatgaatacagaaagcacattgagaaggatcctgcacttgagagacgttttcaaccagtaaaggtacctgaacccacagttgatgaaaccattctaattttgaaggggcttcgggagaggtacgagatccatcacaaactccgttacactgacgaggccttggtttctgctgcccagttgtcgtaccagtacataagtgaccgctttttgcctgataaagctattgacttgattgatgaagcgggttctcgtgttcgacttcgtcatgcccagctccctgaggaagctagagagctagagaaagaactgagacagattacaaaggagaaaaatgaagctgtccgtggtcaagattttgagaaggctggtgagttacgtgacagagaaatggatcttaaggcacagatatctgctcttattgataagaataaagagatgagcaaggcagagacagaggctggggatggcggtcctcttgtgacagaagtggacattcaacatattgtttcttcatggacgggtattcctgttgagaaggtatctactgatgaatctgatcgcctcctcaagatggaagagacactgcacaagcgagtgattggtcaagatgaagctgttaaagccatcagccgagccatccgtcgtgctcgtgttggactcaagaaccctaaccggcccattgctagcttcatcttttctggtcctactggtgtggggaagtcagaacttgcaaaagcactagctgcttattattttggttctgaagaagcaatgattagacttgatatgagtgagttcatggagagacacacagtttcaaagcttattggttcgccccctggatatgttggttacactgaaggtggtcagctgactgaggcagttcgacgtcgcccttacactgttgtgctctttgacgagattgagaaagctcatcctgatgttttcaacatgatgcttcaaattctcgaggacggaaggttaactgacagtaaaggtagaactgttgacttcaagaacacacttctgattatgacatcaaatgttggtagtagcgtgattgagaaaggaggccgacgtataggttttgatcttgattatgatgagaaagatagtagttataacagaatcaagagtttggtgactgaggaattaaaacaatatttcaggccagagttcttgaatagattggatgagatgatagttttccgacaactcactaagctggaagtgaaggagatagctgatataatgctcaaggaagtttttgagcggctaaagaagaaggatataaagcttgacgtgactgagaggtttagagaaagggttgttgaggaaggttacaacccaagctatggagcacggccattgagaagagctatcatgaggcttttggaggatagcatggctgagaagatgcttgcccgtgagattaaagagggtgattcagttattgtggatgtagattctgatgggaatgttactgttttaaatggtgatgcggagccagttgcagtttagatcaaagcttattctgttttgacattttacaaatttgttgtttgtaccttgttggattggctacagtggtatcctggttttgcagagcaactgtgttgatggtacactccatagctggttgaatgactcgtggttgtatttctctagagagggtgcacgaggttgcatcttctttgcaagcagctttaaggttgtattctagtatattaggttctgtgggaactttagtcattaggaagttggatttgcacactttcattcatataattataccaagatgatgc

SEQ ID NO: 3154 - DNA, 3277 bp, Prunus persica
agagagagaaagagagagagcttctcttaagaccacacctatctcttcctcttcggccgaccatagaatactaagaatagggtctctctcttctctctgaagaaagaccctgtctctctttctgaaaatttcattttatttaattgaaagtttatccaaataaggggttttagactgctaagttgatatcatggctagagttctggttcagtcaactaatattcctggtgtggttgctgggagaaggcttggtcaatctaaagggtcgggaaatgccaaaaggacagtcaagatgtgttgtactttacgagcacctggattgagaataagcagtttctcaggactccgtagtgttaatgctttagatattatggcgaaacctgggcaagacttttattccaagatgggagttgcaatcacttcccgtcgaaaggctagcagatgtgtgcctaaagccatgtttgaacgcttcacagaaaaagcaattaaagtaattatgcttgcacaagaggaagcaaggcgacttggtcacaattttgttggcacagagcagatacttttgggtcttatcggtgaaggaactggtattgctgccaaggttcttaaatccatgggaattaatcttaaagatgcacgtgttgaagtggagaagataattggaaggggtagtggttttgttgctgttgaaattccattcactcctcgtgcgaagcgagttttggagctgtcactggaggaagctcgccaacttggccataactatattggatccgagcacttgcttctgggcttacttcgggagggggagggtgtagcagctcgtgttcttgaaaatttaggtgctgaccctaaaagtaaccatgaaaaactttgttggtgtgggcaggttatccgtatggtgggtgagagcacagaggctgttggtgccggtgttggaggaggaagcagtggtaataagatgccgactctagaagaatatgggaccaatttaactaagctagcagaggagggtaagttggatcctgttgttggaagacaaccacaaatcgaacgtgttgtgcaaattttgggtaggcggactaagaataatccctgccttattggagaacctggtgttgggaagactgcaattgcagaaggccttgctcaacggattgcaactggtgatgttcctgaaaccatagagggaaagaaggttataacgctggatatgggtcttcttgttgctggtacaaagtaccgtggagagtttgaggaaagattaaagaagctcatggaggaaattaaacaaagtgatgagataattttgtttattgatgaggtgcacactttaattggagcgggagcagcagaaggggcaattgatgccgcaaatatattaaaaccagctcttgcaagaggtgaactgcagtgcattggtgccacaactctcgatgaatacagaaagcacatagagaaagatccagccttggaaaggcgtttccaaccagtcaaagttcctgaaccaactgtggatgaaaccattcagattttgagaggacttcgagagcgatacgagattcaccacaagctccgctacactgatgaagccctggtatctgctgcacagctatcataccagtatatcagtgatcgctttctgcctgataaagcaattgacttgattgatgaagctggttctcgagttcgtcttcgtcatgcacagctacctgaagaagctagagagcttgagaaagaacggaggcagatcactaaggagaaggatgaggctgttagaagccaagactttgaaaaggctggggaattacgtgacagagaaaaggacctttcggcacagatctcagctgttgttgataaaggcaaggagatgagtaaggcagagagtgaggcaggagatgtaggtcctctcgtgactgaagtggatattcaacatattgtgtcctcctggactggcattccagttgagaaggtgtcaactgatgaatcggaccgcctcctcaagatggaagagaccctccatacgcgagtcgttggtcaggatgaagcagtcaaggctattagtcgtgctattcgccgcgctcgtgttggactgaagaatcctaatcgtcctattgccagtttcatcttttctggtccaactggtgttgggaaatctgagcttgcaaaagctttggctgcttactactttggttctgaagaagccatgattcggcttgatatgagtgagttcatggaaagacacactgtttccaagctcattggttctcccccaggttatgttggttacactgagggaggtcagctgactgaagctgttcgacgacgtccttacacagtggtgctttttgatgagattgagaaggctcatcccgatgtcttcaacatgatgcttcaaatacttgaggatggaagattgactgacagcaagggcagaactgtggatttcaagaatacacttctgataatgacgtctaatgttggaagcagtgtaattgagaaaggaggccgtcgtataggatttgaccttgattacgatgagaaggatagcagttacaatagaattaagagcttggtgacagaggaactaaaacagtactttagaccagagttcttgaataggttggatgaaatgattgtcttccgacaactcactaagctggaggtaaaggaaatagcagatataatgctcaaggaggtttttgagaggttgagggttaaagagatagagcttcaagtgacagagaggtttagggatagagtggttgacgaaggatacaacccaagttatggagcaaggcctctaagaagggccataatgagacttttggaggacagcatggctgagaagatgcttgcaagggagatcaaagaaggcgactcggttatcgtggatgtcgattctgatggcaatgtgactgtgctcaatggtagcagtggttctcccgagtctttgcccgaggcaatcccagtttgaaagttaacatagccgcttttgttaatcttttgccaatatgtttgtatttttttcatttgcgctttgcaattgaacagtctactccaaaaaggactagttggtagcggtaattgaaagctgtttgtttaatggttgacttgactgttcaaggctgtaccagtttatacagaagaatagcatgcatagttcagtcacaaatggtagggttagtacttttttcttttagacccctcctgtggtggaattagtgttgggaatgctagtatttctaataaagaattttaacacattcatgttgtttta

SEQ ID NO: 3155 - DNA, 3172 bp, Panax ginseng
accacatctgcactacccatctatcttccaatccggccgaccggtcttaagttggtctctctctctctctcgctcgctcgttcgttgaagaggaagaccttagccctcacccctctaaccctcaacttgtattcataactcaccatctgattaagattacctggtggcaatcatggcaagggctttggttcagtcaactaacttcccttcttcagttgctggtgagaggaacggtcaatttaagggatctgggaaaacaaaaagaactgttaagatgatgtgtactttaagaactgttccaataaggataagaggtttttcaggattacgaggagccaatgctttggatgccatggtaaaatctgggcatgatttccattccaaggtggcagctgcaatctctgttcgacgaggaagagccagtcgaagtgtaccgaaagctatgtttgagcggttcacagaaaaagcaataaaagttattatgcttgcacaagaggaggcaaggcggcttggtcacaattttgttggaacagagcagatattgttgggtctcattggcgagggcactggtattgctgctaaagtgcttaagtcaatgggtatcaatttgaaagatgcgcgtgtggaggtagagaagatcattggtaggggcagtggatttgttgctgtagagattccctttactccccgtgcaaagcgtgttctagagctctcactagaggaagcccgccaacttggtcataattatattggatctgagcacttgctgctggggttgcttcgtgagggtgaaggtgtagcagcacgagttcttgagaatctaggtgctgaccctaataacattcgtacacaggttattcgaatggtcggggagagtcaagaagctggtgctgttgttggaggtggaagctctggcaacaagatgcctacactggaggagtatggtactaatttgacaaagctagcagaggagggtaaactggatcctgttgtaggaaggcagcagcaaattgaacgtgtaacccaaattttgggaaggcgaacaaaaaacaatccctgcctcattggcgagcccggtgttggcaaaacagctattgcagaaggccttgctcaaaggatcgcaactggtgatgttccagaaacaattgaggggaagaaggttataaccttggatatgggtcttcttgttgctggcacaaaatatcgtggagagtttgaggagaggctgaagaagcttatggaggaattaaacaaagtgatgaaattatattatttattgatgaggtgcacacactaattggagcaggagcagcagaaggagccatcgatgctgcgaacatcttgaaaccagcccttgctagaggagaactgcagtgtattggggccacaactcttgatgaatacagaaagcacattgaaaaagacccggcactggagaggcgatttcagccagttaaggtacctgaacccactgtggatgaaaccatacagatcttgaaaggactcagagagcgatatgagatccaccacaagcttcgatatactgatgaagccttggtttctgcagcacagctgtcataccagtacatcagtgaccgatttcttccggataaagctattgacttaattgatgaagccggttctagagtccgacttcgtcatgcacagctcccagaggaagccagagagcttgagaaagagcttaggcagataacaaaagagaagaacgaagccgttcgcggccaggactttgaaaaggctggggagttacgtgatagagaaatggatctgaagacacagataactgctctagtagagaaaaacaaagagatgagcaaggcggagaccgaggcaggggatgatagtcccatagtgacagaagtggacattcagcacattgtctcttcgtggacgggcatacctgttgagaaagtgtcaactgatgaatctgaccgcctcctcaagatggaagagacgctccacacgcgagtcattggtcaggatgaagccgtcaaagccatcagccgtgctatccggcgtgcccgagttggactcaagaatcctaaccgacccattgccagctttatctttctggtccaactggtgttggaaagtcagaacttagcgaaggcgttggctgcctactacttcggctctgaagagctatgatccgattgatatgagtgaattcatggagagacacacagtctcaaagctcattggttcacctctggatatgttggttatactgaaggtggtcaactactgaggctgttaggcgccgtcttacacagttgtgctctttgatgagatcgagaaggctcaccctgacgtatttaatatgatgcttcagattctggaggatggtaggttaacagacagcaaaggtagaactgtcgacttcaagaacacattattgattatgacgtcaaatgttggaagtagtgtgattaagaagggaggccgccggataggttttgatcttgattacgacgagaaggatagcagttacaaccgtatcaagagcctggtaacagaggaactgaaacaatacttcaggccagaattcttgaatagattggatgagatgattgtattcaggcagctaaccaagctagaggtgaaggagattgcagatattatgctcaaggagtcttccagaggttgaaggccaaagacattgaacttcaggttacagagaggtttagggatagggttgtgaggaaggatacaacccaagctatggggccaggcccctaagaagagccataatgagactcttggaggacagcatggcggagaagatgcttgctagagagattaaagagggtgattcagtaattattgatattgattctgatggtaatgtgactgttctcaatggcagcagtggtgctccgcccgaggcattacaagagcctgttgcagtgtagactagtactcttttaattggacttttttaccaccgtcttgtttgtattctgatttttgttcaattcgccataaagtctcatttttatttttaatttttgcttgaagaggctggtggtcggtagactaaagctggtctcagtcagtagctttgttttaaggctgtttccccggaagacttgcatacttttatcggatagtaaatgtttagtgttagatttgaagatatttggttataaat

SEQ ID NO: 3156 - DNA, 2823 bp, Vinca minor
aatatcatcccctatctcctctctacccaccattttctctcttctttgagagggggtgatcttataattgctcaggtcgctttcttacagtcatggccagagcattggcacagttcactaatttaccttcagtagtcgcgggaggtcatggacaaattagaggctccagtagatctacaagagcagtaacaatgctctgcaatgcgtacgcagcgcctctaaggatgaataatttttctggattacgagcggcaaatgccttggataccatggctagatatgggcagagtttacattcgctggtggcaaatgcaccctttggccggagggccggccggagaaaagccagcagaatggtacccagagccatgttcgagcgtttcacggagaaagctataaaggttattatgcttgcacaagaggaggcaagacggttgggccacaattttgttggcactgagcaaattttacttgggcttattggtgagggtacaggcattgcagctaaggtactcaaatcaatgggcattaatttgaaagatgcacgagtagaagttgagaagataattggaaggggtagtggatttgtggctgtagaaatcccttttactccacgtgcgaagcgagtattggaactttcattagaggaggcccggcaacttggccacaattatattgggtcggagcacctgttgcttggattgcttcgcgagggtgaaggtgtcgctgctcgcgttcttgagaacttaggcgctgagccaagtaacattcgcacacaggtcattagaatggtaggggaaagtgcggaagctgtagctgctgttggaggtggaagttccggcaacaagatgcctacactagaggaatatggtacaaatttgacaaagcttgctgaggaggggaaactagatccagttgttggaaggcaagcccaaattgaacgtgttactcaaatattgggtcgccggacgaaaaataatccctgccttattggagagcctggagtagggaaaacagctattgctgagggtctcgcccaacgaattgcaaatggtgatgttccggaaacaatagaaggcaagaaggttataactttggatatgggtctactggtggctggaacgaagtatcgcggagagtttgaggaaaggctcaagaaattgatggaggaaattaaacaaagtgatgaaattatacttttcattgatgaggtgcacacattaattggagctggagcagcagagggtgcaattgatgctgcaaacatcttaaaacctgctctagctcgaggtgaactacagtgtattggggccaccacactagatgaatacagaaagcacattgagaaggatcctgctcttgaaaggcgtttccagccagtgaaggtacctgaacccacagtagatgaaacgattcagattttgaagggccttcgggagaggtacgagattcatcacaaacttcgctacacagatgaggcattggttgctgctgcccagctgtcgtaccaatatatcagtgaccgctttcttcccgataaagctattgacttgattgatgaagctggttcgcgtgttagacttcgtcatgcccagctccctgaggaagctagagaaatagagaaagaactcaggcagattacaaaggagaaaaatgaagctgtccgtggccaagattttgagaaggctggcgagttacgtgacagagaaatggatcttaaacaacagatatctgctcttatagataagaacaaagagatgagcaaggcagagtccgaggctggggatagtggtcccctcgtgacggaagtggacattcaacacattgtttcttcatggacaggtattcctgttgataaggtatctgctgatgaatcagaccgcctcctcaagatggaagagacacttcacacacgagtggttggtcaagatgaagctgttaaggccatcagccgagccatccgccgtgctcgtgttggactcaagaaccccaacggccaattgctagcttcatcttctctggacctactggtgtggggaagtctgaacttgctaaagcactagctgcttattactttggttccgaagaatcaatgataagacttgacatgagcgagttcatggagagacacaccgtctcgaagcttattggttcacctcctggatatgttgggtacactgaaggtggtcagctgaccgaggccgtgagacggcgcccttacactgttgttctttttgatgagattgagaaagctcatcccgatgtcttcaacatgatgcttcaaattcttgaggatggaaggttaacagacagcaagggtagaacggtcgacttcaagaacacgcttctgattatgacatcaaatgttggtagcagtgtaattgagaaaggtgggagacgcataggttttgatctcgactatgatgagaaagatagtagttacaacagaatcaaaagcttggtgaccgaggaactaaaacagtacttcagaccagaattcttgaacagattggatgagatgatagtattccgacaactcaccaagcttgaagtgaaggagatagccgacataatgctcaaggaggtatttgagcggttgaagaaaaaggacataaagctggatgtaacagagaggttcagagaaagggttgtggaggaaggttacaacccaagctatggagctcggccattgagacgagctatcatgaggctgttggaggatagcatggctgagaagatgcttgcacgggaaatcaaagagggtgattcagtcattgtggatgcagactcggacggaaatgttacggtcttgaatggtgattt

SEQ ID NO: 3157 - DNA, 3288 bp, Citrus sinensis
cgtccgaccataaaagcggtctctctctttcctgctctttcattatttttttgccctttttctcttttctcttttaatttttatttatcaaagcaaacgcctttgcttttttctctctaatatctagattaaatcatggctaggcttctggctcagttaactaatgcccctgctttggttcctggcggaagacatttccagtcccaaaatgctggaaaatcaagaaggaatgtcaaaatgatgtcttatatgcagccgtctgcttcaagaattagtagtttctcaggattgcgacgctccaatgctttagatacattcacctgtgatttccattccacggtggctgtttcactctcttctagacgaggaaagtctggaagagctggtggatttgttgttaaagccatgtttgagcgcttcacagagaaagcaattaaagtgattatgcttgcccaagaggaagcaagacggcttggccacaattttgttggcacggagcaaattctattgggtcttattggtgaaggcactggcattgctgctaaggttcttaaatcaatgggaatcaatcttaaagatgcacgtgtagaagtggagaagatattggaaggggaagtggttttgttgctgtggaaattccgttcactcctcgtgcaaagcgtgtcttggagctttctctggaggaagcccgccagctgggccataattatattgggtccgagcatcttctccttgggcttcttcgtgaaggggaaggtgtagcagctcgtgttcttgagaatttaggtgctgaccctagtaacatccgcacacaggttattcgtatggttggtgagagcacagaagctgttggcgctggtgttggaggaggaagcagtggcaacaagatgccaacactggaggagtatggaacaaatttgactaagctagcagaggagggaaaattggatcctgttgttgggagacagccacaaatagagcgtgttgtccaaattttgggccgtcgaactaagaataatccatgtcttattggagaacctggtgtgggtaaaacagcaattgcagaaggccttgctcaacggattgcaagtggtgatgttcctgataccattgaaggaaagaaggttattaccctggatatgggtcttcttgttgcgggaacaaaatatcgtggagagtttgaagaaagattgaagaaactaatggaggaaatcaaacagagtgatgaaataattctattcattgatgaggtgcacactttaatcggcgcaggagcagcagaaggggctattgatgctgctaacatcctgaagccatctcttgcccgaggagagttacagtgtattggtgccacaacactagatgaatatagaaagcacattgagaaagatccagcattagaaagacgattccagccagttaaagtgccagaaccgtcagtggatgaaaccatacaaattttgaaagggcttcgagagcgatatgaaattcaccacaagcttcgttacactgatgaagcactagtttctgctgctcagttgtcataccagtacatcagtgaccgttttctccctgataaagctattgatttgattgatgaagctggttctcgggttcgtcttcgtcatgcacagctccccgaggaagctagagagcttgaaaaagagctcaggcagataactaaggagaagaatgaggctgttcgtggccaagactttgaaaaggctggagagttacgtgatagagaaatggaccttaaggctcagatatctgctcttgtcgataaaggcaaagagatgagcaaggcagagactgaagcaggggatgttggtcctgttgtgactgaagtggacattcaacacattgtctcagcttggacgggcattccggttgaaaaagtctcgactgatgaatctgatcgcctcctcaagatggaagagacccttcacaagagagttattggtcaggatgaagctgtcaaagctattagtcgtgctatccggcgtgcacgtgttggactcaagaaccccaatcgaccaattgctagtttcatcttttctggtccaactggtgtcgggaagtctgaactggccaaagcactggctgcctattactttggctcagaggaggccatgatcaggcttgatatgagtgagttcatggaaagacacactgtttccaagctcattggttcaccacctggttatgttggttacactgaggggggtcagctgactgaggctgttcgccgtcgtccttatactgttgtactctttgatgagattgaaaaggctcatcctgatgtcttcaacatgatgcttcaaattctcgaggatggaagattgacagacagcaagggaagaactgtagacttcaagaatactcttctaataatgacatcaaatgttggaagcagtgtaattgagaagggaggacgccgcattggttttgatcttgattatgatgagaaagacagcagttacaacaggattaagagtctggtaactgaggaattgaagcagtacttcaggccagagttcttgaatagattggatgagatgattgttttccgacaactcaccaagctggaggttaaagagatcgctgatataatgctgaaggaggtgtttgatagactcaagacaaaagatattgagcttcaagtgacagagagatttagggagagggtggttgaggaaggttataacccaagctatggagcaaggccattgagaagagccattatgagacttttggaagacagcatggctgagaagatgcttgcaagagagatcaaagagggtgattcggtcatcgttgatgtcgattctgatgggaacgtgactgtgctcaacggcagcagtggtgctccagaatcattggcagatccactacctgttgtgtaaactgatcatctattttgagatgttgtttgtacttccattttgatttcaactggctagatactcagtctgttttcttggaaggactacttggcagtagatttggaagctgttgattaaatcggtggtggttgggttttaaggctgtattcgtgacaccatatgaaaatagagtacacggttcagttcagtagcagcagatagtgggaaagttgcagtcagttgctagtgttaggtttcatattgttattattattattattcagttctcatcattatttgctttcttcttaatcagagaaggatttgaatgataagtcggatcataatcgactgctcttagttgctgtgaattatataagatattatatttatatttcaaaac

SEQ ID NO: 3158 - DNA, 3136 bp, Abies balsamea
gcagtccacgaggggagaggggaggatcttcatctcaaggtcctgacgtagcagatttccatgtgacagattacactccgaaatccccgttttctgcaaggatttctttccctgatcaagcagatcaagcaggcttattatctgggtgagatggctggagcactagcacaatctgcaattcttcctggtagaataatcagtacaaagcatggtcaaattcagagctctaaaagagggaaacgagttccaaagatgattggtaaggtgcattcacgaccctttagcatgcaaagtttcactggattgcggcaagaaacatgcatagataaggtcggaagtcgtgtaaaagactttcacgcagcagtagcagcttcagtttgtcttccagtggggaaaggcaatagaggggtagttgtagctatgtttgagcgctttactgagaaggccatcaaggtaattatgcttgctcaagaggaagcacgacgccttggacacaattttgtaggtacagagcagattctcttaggtcttattggtgaagggactggtattgcagcaaaggtcctaaaatccatgggaatcaatctcaaggaggctcgtgtagaggttgagaaaatcattggcagaggcagtgggtttgttgccgtggagattccattcactcccagagcaaaacgtgtgttggaactttcacttgaggaagctcgacaacttggacacaactacataggatctgagcacttgcttttagggttgttgcgggagggtgaaggtgttgcagctcgtgtgcttgagaatcttggagctgaccccagcaatattcgtacacaggtaattcggatggttggagaaagtacagaagctgttggtgctggagttggaggtggtagcagcagcaacaagatgccaactcttgaggaatatggaacgaatttgacaaaactggcagaggaaggcaagcttgatccagtggttggaaggcagccacaaatagaacgtgttactcaaatactgggacgccgcacaaaaaataatccttgtctcattggtgagcctggtgtagggaaaacagctattgccgagggacttgcacagcgaatagcttctggagatgttccagagacaatcgagggtaaaaaggtcattactttggatatggggttacttgttgctggtaccaagtatcgtggagagtttgaagagagattaaagaagttgatggaggaaattaaacagagtgatgagattatactcttcatagacgaagttcatactttgattggagcaggtgcagcagaaggtgcaattgatgcagccaatattctgaaaccatctcttgcacgaggtgaactacagtgtattggagccaccaccttggatgaatacaggaaacacattgagaaggacccagcgctagagaggagattccaaccagtacaagtgccagagccaactgttgatgagacaatacaaatactgaaaggtttacgtgagcgatatgagattcatcacaagcttcgttatactgatgaggctttggtggctgctgccaagttgtcatatcaatatataagtgatcgtttccttcctgacaaagcgattgatctgattgatgaagctggttctcgagtacgccttcgccatgcgcagctccctgaagaagctagagaacttgacaaagaactcagacagattacaaaagaaaagaatgaatctgttcgaagccaggactttgaaaaggctggagagttacgtgatcgtgagatggaacttaaggcacaaatttcatctttaacagagaaagggaaagagaaatcaaaggctgagagtgaagcaggagatgcaagtccactagtaactgaggtagatattcagcaaattgtatgtgcatggacaggcattccggttgaaaaggtgtcaacagacgagtctgacaaacttttgaaaatggaggaaacactccaccaacgcatcattgggcaagatgaggcagtaaaagccatcagtcgagcaattcgccgtgcaagagttggtttgaagaatccaaacaggccaattgccagcttcattttctccggtccgacaggtgttggcaagtcggagcttgccaaggccttggctgcatattattttggctcagaggaggcaatgataaggctagatatgagtgaattcatggaaaggcacactgtttccaagttgattggttcacccccgggatacgtaggctacactgaaggagggcaactaactgaagctgttaggagacggccttatacagtggtccttttcgatgaaattgaaaaagctcatcctgacgtcttcaatatgatgcttcaaatcctagaagatggaagactgactgatagcaaaggcaggactgtggactttaagaatactcttttgatcatgacttctaatgttgggagtagcgtgattgagaagggaggccgtggaattggtttccagcttgattatgatgagaaagacagtagctatacaaggatcaaaagtcttgtcaatgaagagctgaagcaatattttcgacctgagttcctgaatcgactagatgagatgattgtgtttagacagctcacaaagtcagaggtgaaagagattgcagatataatgctgaaagaggtctttgaacgacttaaaacaaaagaaattgatcttcaagtaacagagcggttcacagaccgagttgtagatgaaggttatagtcccagctatggtgcaaggccactccgtagggcaattatgaggttattagaggatagtctggctgaaaaaatgcttgctggtgagatcaaagagggtgattcagctatagttgatgtcgatggcgaaggaaatgttattgtcttgaatggaaaaactggcacagcagggtcatcagccactgcattagctgcatagaaaaagggtacattcatttgagtggttgggccaaagattgtcaatctggccccatcctattaaatgtaagtagttattagatgccaggatttcttttctggttcaatttgctttctgagtacttgttagatggtgttcgctgtaattaccttagttccgagcatctaaagttgtaggatatacgtttgattgttctgaactttattgagacgatgaa

SEQ ID NO: 3159 - DNA, 3057 bp, Cucumis sativus
gctgtggatatcatggctagagttctggttcagtcgacaaatattcctggtttggtcggtgggagaaagaatggccttacaacaagggggtcggcaaatgtaaaacgggctgttaaaatgatgtccaccgcgcattcacctggtttgagaataagaaatttctctggactcagaggatttaattctttggataacatgttgagaagtagacaaaattttcattccaaggtggccactgcaatctcttcgaggcgacgaaaggctagcagatgtgttccaagggctatgtttgagcggtttacagaaaaggcaattaaagtcatcatgcttgcccaggaggaagcgaggcggcttggtcacaattttgttggcacggagcagatacttttaggtcttattggcgaaggcactggcatcgctgctaaggttcttaaatccatgggaattaatcttaaagatgcgcgcgtggaggtggagaagataattggtaggggcagtggcttcgttgctgtagaaattccattcactcctcgtgcaaagcgtgttttggaactttctctcgaggaagctcgccaactaggccacaattatattgggtcagagcacttgcttctgggactactccgtgaaggtgagggtgttgcggctcgtgttctggaaaacctaggtgccgatcctagtaaactctttatttttaacttaatgttctataaattgagcaaacaggttattcgaatggttggtgagagcactgaggctgttggtgctggtgttggaggaggaagcagtgggaacaagatgccaaccttggaagagtatggcacaaatttaactaagctggctgaagagggtaaattagatcccgttgttggaaggcagcagcaaatagaacgtgtaacccagattttgggtcggcggacaaaaaataatccttgcctcattggtgagcctggtgttgggaaaactgctattgcagaaggtctggcgcaaaggattgctaatggggatgtccctgaaacaatcgaaggaaagaaggttataaccctggatatggggcttctcgttgctggcacaaaatatcgtggagaatttgaggaaagattaaagaaactgatggaggaaattaaacaaagtgatgagattatcctttttattgatgaggtgcacacattaattggagcaggggctgcagaaggagccattgatgcggcaaacatattgaaacctgctctcgcaagaggtgaactgcagtgcattggagccacaacattggatgaatacaggaagcacattgagaaagacccagccttagaaaggagatttcagccggtcaaagtgccggagccgtctgtggatgaaaccatacagattttgaaaggccttagggaacgctatgaaattcaccacaaacttcgttacacagatgaagcattagtagctgctgcgcagctgtcataccagtacatcagtgatcgtttcttgcctgataaggcaatcgatttagttgatgaagcaggttctcgagttcgccttcgtcatgctcaactacctgaggaagcaagggagcttgagaaagagctgaggcagatcacaaaggagaagaatgaggcggttcgcagtcaagactttgagaaggctggggaattgcgtgatagagaaatggaacttaagactaagatctctgctctagtagataagggcaaggagatgagcaaggctgaaagcgaggcaggagatgtaggccctgttgtgactgaagttgatattcagcatattgtttcctcctggactggcattcctgttgagaaagtatctactgatgaatctgatcgcctcctcaaaatggaagagaccctccataagagggttattggtcaagatgaagcagttcaagccatcagtcgtgccatacgccgagctcgtgttggtttgaagaatcccaatcgtccaattgcaagctttatattttctggtccaactggtgttggtaaatctgagttagcgaaagcattggctgcatactattttgggtctgaagaagcaatgattcgccttgatatgagtgaatttatggaaaggcatacagtctccaagctcattggttcccctcctggttatgttggttacacggaaggtggtcaattgacagaggctgttcgacgtcgtccatacacagttgtgctctttgatgagatcgagaaggctcatcctgatgtattcaacatgatgcttcaaattttagaggatggaaggttgacagatagcaagggcaggactgtagacttcaaaaatacacttttgataatgacatcaaatgtgggaagcagtgttatagagaagggaggtcggagaatggggttcgaccttgattacgacgagaaggatagtagttataaccgaatcaagagcttggtgacagaggaactgaaacaatacttcaggcctgagttcttgaataggttggatgaaatgattgtcttccgtcagctcacaaaactggaagtgaaggagattgcggatataatgctgaaggaggtgtttgataggttaaaagcgaaagaaattgaccttcaagtgacagagagatttagagatagggtagtggaggaaggatataacccaagctacggtgcgagacctttgagaagggcaataatgagacttttggaggacagcatggcagagaagatgctggcaagggagatcaaggagggtgactcggtaatcgtggatgttgattcggatggaaatgttacagtactcaacggcagcagtggtgctcctgaatccttgccggatgccatccctgtgtaaactacattttattacatagagataacattcttactagctcataaaatgtatttcgaacttcatcttatttaaattagtaggttgtacactcgagacggagaaaaaaagaaaagaaattaatgtatcgtaatttgcttctcaatggatgctagctaattgtcgatttggtagtatagctgatttatgtttattgctcctgttctctctagctgtaatattcagaagaaaacaaatgattctaca

SEQ ID NO: 3160 - DNA, 3319 bp, Pinus pinaster
cgtccacatattccaaatgctatctatcccgtgcctcttaaatgttaactactaattgtatacaatctgccatatcttcacccccattaatttcctcgcgggaaaaaaactgcagtacaccaggaggaggatattcatctcaaggccctgcagtggcaggattccaggtgacgaataatactccgagattgccattttctgcaaaggatttctttacctgatcaagcatattaagcaatctttcttatctaggtaagatggctggagcactagcacaatctgcaattcttcctggtggaataatcagtacaaagcatggccaaattcagagctctaaaagaggaaaaggagttccaaagatgattggtaaggtgcattcacgatcctttagcatgcgaagtttcactggattgcgccaagaaacatgcatagataaggttggaagtcctttaaaagactttcatgcagcagtagcagcttcagttcgtctcccagtggggagaggcaatagaggggtggttgtagctatgtttgagcgttttactgagaaggccatcaaggtaattatgcttgctcaagaggaagcacgacgccttggacacaattttgtaggtacagagcagattctcttaggtcttattggtgaagggactggtattgcagcaaaggtcctaaaatccatgggaatcaatctcaaggaggctcgtgtagaggttgagaaaatcattggtagaggcagtgggtttgttgctgtggagattccgttcactccaagagcaaagcgtgtgttggaactttcacttgaggaagctcgacaacttggacacaactacataggatctgagcacttgcttttagggttgttgagggaaggtgaaggtgttgcagctcgtgtgcttgagaatcttggagctgaccctagcaatattcgtacacaggtaattcggatggttggagaaagtacagaagctgttggtgctggagttggaggcggtagcagcagcaacaagatgccaactcttgaggaatatggaacgaatttgacaaaactggcagaggagggcaagcttgatccagtggttggaaggcagccacaaatagaacgtgttactcaaatactgggacgccgtacaaaaaataatccttgtcttattggtgagcctggtgtaggaaaaacagctattgctgagggacttgcacagcgaatagcttctggagatgttccagagacaatcgagggtaaaaaggtcatcactttagatatggggttacttgttgctggtaccaagtatcgtggagagtttgaagaaagattgaagaaattgatggaggaaatcaaacagagtgatgagattatactcttcatagacgaagttcatactttgattggagcaggtgcagcagaaggtgcaattgatgcagccaatattctgaaaccatctcttgcacgaggtgaacttcagtgtattggagccaccaccttggatgaatacaggaaacacattgagaaggacccagcgctagagaggagattccaaccagtacaagtgccagagccaactgttgatgagacgatacagatactgaaaggtttacgtgagcgatatgagattcatcacaagcttcgttatactgatgagtctttggtggctgctgcaaagttgtcgtatcaatatatcagtgatcgtttccttcctgacaaagcaattgatctgattgatgaggctggttctcgagtacgccttcgccatgcacagcttcctgaagaggctagagaacttgacaaagaactcagacagattacaaaagaaaagaatgaagctgttcgaggccaggactttgaaaaggctggagagctacgtgatcgtgagatggaacttaaggcacaaatttcagctttaacagagaaaggaaagaggaaatcaaaggctgagagtgaagcaggagatgctagcccattagtaactgaggtagatattcagcaaattgtatgtgcatggacaggcattccagttgaaaaagtgtcaactgacgagtctgacaaacttctgaaaatggaagaaacacttcaccaacgcatcattgggcaagatgaggcagttaaagctatcagtcgagctattcgccgtgcaagagttggccttaagaatccaaacaggccaattgctagcttcattttctcaggacctacaggtgttggcaaatcggagcttgccaaggcattggctgcatactattttggttcagaggaggcaatgataaggctagatatgagtgaattcatggaaaggcacactgtttccaagttgattggttcacccccaggatatgtaggctacactgaaggagggcaactaactgaagctgttaggagacgcccttatacggtggtcctttttgatgaaattgaaaaggctcatccagatgtcttcaatatgatgcttcaaattcttgaagatggaagactgacagatagtaaaggacggactgtggactttaagaatacccttttgatcatgacttctaatgtcgggagtagtgtgattgagaagggaggccgtggaattggtttccagcttgattacgatgagaaagacagcagctacacaaggatcaaaagtcttgtcaatgaagagctgaagcaatattttcgacctgagttcctgaatcgactagatgagatgattgtgtttagacagctcacaaagacagaggtgaaggagattgcacatataatgctgaaagaggtctttgaacgtcttaaaacaaaagaaattgatcttcaagtaacagagcggttcacagaccgagttgtagatgaaggttatagtcccagctatggcgcaaggccactccgtagggcaattatgaggttattagaggatagcctggctgaaaaaatgcttgctggtgagatcaaagagggggattcggctatagttgacgtggatagcgaaggaaatgttactgtgttgaatgggaagactggcacagtagggccgtcagccactgcattagctgcatagaaaaaaggtctattcatttgagtggctgggccaaatattggtcaacttggctccatcctattaaatgtaggtagttattaaatgacaggatttcttttgggtttcaatttgatttctgagtacttgttagatgatgttctctgtaagtaccctagttctgagcatctaaagttgtaggatatacattggattgttctgaactttattgagataatgaaaactttgaaatgttgcaagtataaaagagatgttaaggttgtctcttaaattcttccaaccatttttttactacg

SEQ ID NO: 3161 - DNA, 3082 bp, Papaver somniferum
aggcgagagacctttaggatctcgttctatatctcaaaataataaccctagttttcgttaaagattcattcaaggggttacttctctctggattcttaagtctgtttataactggtgagaaccatggccggggctcttgttcaatctacgaatatccgcacttctacatttggcaaaagtcatgacaagaaacaaagaggcagttctgggtcagccaacagaaggactgttaaaatgttatgtaatagtgttcaaatgcgggggttgagaatctcagcaccatctttgacagtaggaggttttaatggacttcgaggaactaacgctatagataaattggtattttctggccatgattttcattctaaggtagcactatctatagctgcaccccgcggaaggggtagtcggtgtgttgctagagctatgtttgagagattcacagagaaggctattaaagttatcatgctagcacaagaggaagcgagacggttgggtcataattttgttggtactgagcagatattgttagggcttataggtgaaggtactggtattgctgcaaaggttcttaaatctatgggaattaatcttaaggatgctcgtgtggaagtagaaaagatcattgggagaggtagtgggtttgttgctgtcgagataccatttactcctcgtgcaaagcgagttttggaactttcactagaagaagcacgccaacttggacataactatattggctctgagcatttgcttcttggtttacttcgtgagggtgaaggtgtggctgcccgtgtacttgaaaaccttggggccgaccctaacaacatccgcacgcaggttatccggatggttggtgaaagtactgaagctgtaggtgctggcgttggaggaggtagcaccaacagtaagatgcctacactcgaggagtatgggaccaatctaacaaaactggccgaggagggaaaattagatcctgttgttggaagggcagcacaaattgagcgtgtaacccaaattttgggcagacgtacgaagaacaacccttgcttgatcggagaacctggtgtgggtaaaactgcaatcgctgaagggcttgcccagagaattgccagtggtgatgtgccagaaacgattgagggaaagaaggttattaccttggatatgggtctccttgtagctggtacaaagtatcgtggagagttcgaagaacgattaaagaagttaatggaagagattaagcaaagtgacgagattatcttgtttatagatgaagtacatactttaattggagctggtgcagctgaaggtgcaatcgatgcagcaaacattttgaaaccagctcttgcaagaggtgaactacagtgtattggtgctacaacactggatgaatatagaaagcatatcgagaaggacccagctttagaaagacgatttcagccagtaaaagtgccggaacccactgttgacgagtctatccagattctaaaaggtcttcgtgaaagatatgaaattcatcacaagcttcgttatacagatgaagccttggaagctgcagcacgattgtcataccagtacatcagtgaccgtttcctccctgacaaagcgattgacttgattgatgaagctggttctcgagttcgacttcgtaatgctcagctgcccgaggaagccagagaactcgagaaagagctcaggcaaataacaaaagagaagaatgaggcagttcgtggccaagactttgaaaaggctggagagctgagagacagagagatggacttgagggcccagatcacaaatgttgttgacaagggtaaagagctaagcaaggcagagagtgagtcaggtgatacaggacccgttgttaccgaagtcgatattcagcacattgttgcttcttggactggaatcccagtcaacaaagtctcaagtgacgaatccgataagctccttaagatggaagacacactccacacaagggtcatcgggcaagatgaagctgttaaagctatcagtcgtgcaattcgtcgtgcacgtgttggacttaaaaaccctaatcgtcctattgccagcttcatattctctggacctacaggtgttggaaagtcagaattggcaaagacactggcttcttactattttggatctgaggaggctatgattcgtcttgatatgagtgagttcatggagaggcataccgtctccaagcttattggatcgccaccaggttatgttgggtacactgagggtggtcagctgacagaagctgttcgccgtagaccttacacagtggttctttttgatgagatagagaaagctcacccagatgtcttcaacatgatgcttcaaattcttgaagatgggcgtttaactgatagcaagggtagaaccgtagatttcaagaacacacttctcataatgacttctaatgtcggaagcaatgtgattgagaagggaggtaggagaattggttttgatctagactatgacgagaaagacagcagctacaacaggatcaagagtctcgtgcaagaggagctgaaacaatatttcagaccagaatttttgaatagattagatgagatgattgttttcagacagctaacgaagttggaagtcaaggagattgcggacataatgctcaaggaggtattcgaaagactccgtaagaaagaaatagagcttcaggtcactgaaaggtttagagacagagtggttgatgaaggatacaacccaagctatggtgcgaggccattgaggagagcgattatgagacttttggaggatagcatggcagagaagatgctggggggagagattaaagagggagattcagtcatcgtagatgtagatggtgatggaaatgtgacagtgctcaatggtacatcaccacaactggtgtaaacatgactaccagaagaataatattttgtactttagcttggtagttctaggtcgtctcctcttcatattttttctttttttgtttatccaaaagataaactgtgtgttttggtgagactttcaattttaagattgtagctgattgtaaactatcaatgaagagcatctagcagaacaaaaa

SEQ ID NO: 3162 - DNA, 3259 bp, Lolium multiflorum
gaaaagaatcagccagaatgaggccaaaataaagaaaggaaagagcgattctcttctgtgcttgcttgttgggcacccccaaccaagccactctcctcttcccctcttatctcctcggaggagaaacaaacaaggccgcgctcttccttctccccctctcctcgcaggtttggggcagtaacttctgaccatggcagggaccttagtcctgcccgttgctcttgggacaactttcgcaggccgtacaaagaagtctcatggaaccaggaggcctacctcaatgcttgcaatgtccttgaaccgtcctgtaaggatggcaggatttggtggtctgagatcagcacatagcttcacaaccatgccctcctccaacttcagatcaacagctgcatcttacagatcctctagacggggaagacgttctcgttttgtaaccagagccatgtttgagaggtttaccgagaaagctataaaggtcatcatgcttgcgcaagaggaagcaaggcgcctaggccacaactttgtcggaaccgagcaagttctattgggtttggttggagaaggaactggtattgccgcaaaggtgctcaagtccatgggtatcaatcttaaggatgcccgcgtggaagtggaaaagatcattgggaggggaaatggttttgtcgctgtcgaaataccgttcacaccacgcgcaaaacgtgttttagagctttcattggaggaagctcgccaactaggacacaattatattgggtctgagcacttgcttcttggacttcttcgtgagggtgaaggtgtggcagcccgtgtacttgagtctcttggtgctgacccaagcaatattcgtacacaggttgtccgaatgattggtgaaacaacagaagctgttggtgctggagttggcggaggaagcagtggtaataagatgccaacacttgaggagtatggaactaatttaacaaaattagcagaggagggaaagctagatcctgttgttggaagggaaccacagattgaacgcgtcatacaaattttgggaagacgaacaaagaacaatccctgcttaattggagagcccggtgttgggaagacagcaattgcagaagggcttgctcaacgcatttctactggcgatgtgcctgagacaatagaggggaagaaggtcattacccttgatatgggacttcttgttgctggtacgaaataccgtggagaatttgaagaacggttgaagaaactgatggaagaaatcaagcagagcgatgagataattctcttcattgatgaggttcacaccctcataggagcaggagctgccgaaggtgctatagatgctgctaatatcttaaagcctgcattagcaagaggagaattacagtgtattggagctactacacttgatgaatacaggaagcatgttgagaaagatccagcattagaaaggcgtttccagccagtaaaggtgccagagccttcagttgatgagaccatagaaattctcagaggacttcgggaacgatatgagatccatcataaactccattacactgatgattctttgattgcagctgctaagctatcttatcaatatatcagtgatcgtttccttccagataaagcaattgacttgatcgatgaagcaggttcacgtgtaaggcttcgacatgcccaggttcctgaggaagccagagagctcgacaaggagcttaagcaaataacaaaggataaaaatgaagccgtccgtggccaggattttgaaaaggctggagaactgagagatcgtgaaatggaattgaaggcccagataacagccctgattgacaagagcaaggagatgatcaaagcagagactgcgtcaggagagactgggccgatggtccatgaatcagatatccagcacattgtatcatcatggactggtatcccagtggagaaagtctcaactgacgaatccgataaacttcttaagatggaagagacattgcataagcgtgtcattggccaagatgaggctgtgaaagcaataagtcgctctgtccgccgtgctcgtgtcggcctcaagaaccccaacagaccaattgcgagcttcatttttgcaggtccaactggtgttgggaaatcagagcttgcaaagactcttgcatcgtattactttggctctgaagaggccatgatccgactcgatatgagtgagttcatggagagacacacagtgtccaagttgatcggttcaccaccaggctatgtgggatacacggagggtggccagttgacggaggcagttcgacgccggccttacagtgttgtgctttttgatgagattgagaaggcacatccggatgtgttcaacatgatgctccagatcctagaagacggaaggttaactgacagcaaggggaggacagtggacttcaagaacacgcttcttataatgacatcaaacgtgggaagcagcgtcattgagaagggagggcgtaagattgggtttgacctcgagactgacgagaaggacagcagctacggcaggatcaagagcttggtcgttgaggagatgaagcagtacttccgccctgaatttctcaatcgtcttgacgagatgatcgttttcaggcagctgaccaagctggaagtcaaagagatcgcggacatcatgctacaggaggtcttcaccaggctgaagctgaaggagattaatctgcaggtcactgagaagttcaaggagcgggtcgttgacgaagggtacaaccctagctatggagcacggccactaaggagggcgatcatgaggctgctggaggacagcctcgcggagaagatcttggccggggaggtcaaggaaggcgattctgccattgttgacgtggactctgaggggaaggtggttgtgctgaacggccagagcggactgcctgagcttccgaccccggctgtcactgtatagtttggtacagattgttaaaaatacatcattttcatttcattcgagcatatatctctttgtaggtagtgtatagctgtaactgtatatatatagtatgcattaatcaaaggggaaatattgctggctttgacttctgatttagagtgtggattactctctctctgaaacttcatagagagttagactagtcacagtcgaaagtattatcatgcatatgatactagtttatgataccgctcatataatgcatagtataataaggtagtactcataattttatcatatttaatagttctgtagaatctcaatgtaaatttg

SEQ ID NO: 3163 - DNA, 3466 bp, Musa acuminata
gcgctcctctcggcgtcctcgccgccgcctcctctcccttcgtcccctcgtcacgaaaggacgggtgacgggtggtccgcttctcctcaccttcccttacatctgctcttagggttcgtttactcggtcagcgccagatttcatcgcgtctatgatttcatctgcttgtttagctcaaagattgccaatgtcggtgatgagtcgtcgttgtgtcgattgatcctcgcggaggcattccggcgattctgttcttgggtactgcgaccacctaagtttatttgtctcctattaattattagaagaagagatggctggttctttggttcagtcggcagttcttcctgctgtcatcatgaacaggagccacagtcagcttcaaggttctggaaaggctaaaaggggtgccagaatgatatgccagctgcaaatgcatcccttaagactgcaagggtttgcaggcttgcgagttgcagataacttgttctcttcaagacatcgacaggattttcattcagtggtttcaggatatataactaacccacggggaagacccagtcgattagtcaccaaagctatgtttgagcgattcacggagaaggcaattaaagttatcatgcttgctcaagaagaggcaagacgtctaggccacaactttgttggaacagagcaaatattgttaggccttattggtgaagggactggtattgccgcaaaagttttgaaatcaatgggaattagtcttaaggatgcccgtgtggaagtggaaaagattattggaaggggaagtggatttgttgctgtcgagataccttttacaccacgtgcaaagcgcgttttagaactatctttagaggaagctcgtcaacttggtcataattatataggatctgagcatttgcttcttgggcttcttcatgagggtgaaggtgtagctgctcgtgtgcttgagagtcttggagctgatccaagcaacatacgaacccaggcaaatttttgtttagtaattcgaatggttggtgaaagcactgaagctgtaggtgccggggttgtggggggaagcagtggcaataaaatgcctactcttgaggagtatggaactaatttgacaaagttggctgaggagggcaaacttgatccagttgttggcaggcaggagcagatagaacgtgttacacaaattcttggaaggcgtacgaagaacaatccttgccttattggggagcccggtgttggaaagactgccattgcagaaggacttgcccagcgtatagctaatggagatgttccagaaacaatcgaaggaaaaaaggtgattacccttgatatggggcttcttgtcgctggtactaaatatcgtggagagtttgaagaaagattaaagaagttgatggatgaaattaaacaaagtgatgacataatactcttcattgatgaagtacatacattaattggagcaggagcagcagaaggtgctatagatgctgccaatatcttgaaaccagctcttgcaagaggtgaactgcagtgtgttggagcgacaacactcgatgaatacaggaaacatattgagaaagatcctgctctggaaagacgttttcaacctgtaaaagtaccagaaccaacagtagatgaagcaattcaaattcttagagggcttcgtgaaagatatgagattcaccacaaactctgttacactgatgaagctatagttgctgctgctcagttgtcctttcaatatattagtgaccgcttcttgcctgataaagcaattgacttgattgatgaagctggttctcgtgttcggcttcgtcatgcaaagcttcctgaggacgccagagaacttgacagagagctaaggcagattacaaaagaaaaaaatgaggcggtccgcagccaatattttgaaaaggcaggggagctgcgtgatcgggagatggagcttaaggctcagatctcagccctaattgacaaggggaaagagagaagcaaagcggagagcgaggctggtgtttcaggtcctgtggtgacagaagcagacatccagcacattgtgtcttcctggactggaattcctgtggagaaagtctccaccgacgagtctgaccgcctcctcaagatggaagaaaccctccacaagcgtgtcattggccaggacgaggctgtcaaagctataagccgtgccatccggcgagctcgtgtcggtctcaagaatcccaaccgtccaattgccagcttcatattttctggtccaactggtgttggtaaatcagagttggcaaagtcactagcctcctattattttggctctgaggaagccatgatccgactggacatgagtgaattcatggagaggcacaccgtatccaaactcatcggatccccacctggttatgttggttacaccgagggtggtcaacttactgaatctgttcgtcgtcgcccttatacagttgttctctttgacgagatagagaaagcccatcctgatgttttcaatatgatgcttcagattttagaggatgggaggttgaccgatagcaaagggcgaacagtatcttttaagagtaccctcctgatcatgacctccaatgtcgggagtagtgtgatcgagaagggagggcgtagaattggttttgatctcgactatgatgagaaggacagcagctacaaccgaatcaagagccttgtcacggaagagttgaagcagtacttccggccagaattcctgaacaggctagacgaaatgatcgtcttccgacagcttacaaaactggaggtcaaggagattgctgatataatgctcgaggaggtatttgacaggctgaaagggaaggatataaaacttcaagtgacggagagatttaaggatagggtggtggaggaaggttacaacccaagttatggggctaggccccttagaagagccataatgagactactggaggatagcttggctgagaaaatgctagccagggagattaaggagggagactcggcaattgtggatgtcgacttcgatgggaacgttacagttctcagtggtgggactggtacgccggaatcaacacctgaagccattcccatatagaatcaacaacatcatctgcatctctgtggtgaaatgccaagctgcaggttactaatccttgtagaagcagcaggtaaagtgttgctgctcaatttcttacaccgtttgatcttcatgtttacgacatccagtcccgttcctatggcagggcattaataggaaaaaaaatttcgacaaaaaccagatggcaggttgtcttcaaaagatttaaaatagtttggaccaaatttaattgttttagccaaaactggctgtgacacttttgtgtgattcatgttctcatacatctgtatctgctggcctttccttcctattaatgtgttttcattacatgaagtaattacttggaatccaccaactgtgcaacaatgctttcca

SEQ ID NO: 3164 - DNA, 3727 bp, Cicer arietinum
ggaatatatgattcagtgggagaaggtacaggaaggcacagtatagcaccagattagaaacataaagataaaaaaagaaagagatatttaattatcttgtgtatgtgtgtgttatttaacttgtccactgagccaatttgtcaccacaattttattttattccttcctcctctttgcttccccttatcattattattaaataattaattattatatataaacagcttcttctcccttaccagctcagctccttaagtatctctctcttttattttttgttttttactatcaaactttttggttgaaatccttctatcttatccgtttatttgggggaagtgcttacgctactcaggaatcatggctagggttttggctcagccaattaatgttcctggcttagtggctgggcacaggcaaaaccaacacaaggcatcgggaaaatcaaaaagatcagtcaaaatgatgtgtgctttccgaacaaacagattaagaatgccaggtttctcaggacttcgtactttcaatcatttagatactatgctgagacctggactagattttcactcaaaggtatcaattgcaatttcttcttcacggcgagcaagggctaccagatgcatacccaaagccatgtttgagcgtttcacagagaaagcaatcaaagtgataatgctagctcaggaggaagcaagacgtcttggtcacaattttgttggaacagagcagattctcttgggtcttattggtgaaggcactggtatcgccgccaaggttttaaagtctatgggaatcaaccttaaagatgcacgtgtggaagtggagaagataattggaaggggtagtgggtttgttgctgttgagattccgtttactccccgtgcaaagcgtgttttggaactttcactggaggaagctcgccaacttggtcacaattatattggatcagagcacttgcttctaggtcttcttcgagagggtgagggtgtagcagcacgtgttcttgaaaacctaggcgctgatcctactaatattcgcacacaggttattcgcatggtgggtgagagtgctgacagtgtaactgctactgttggctctggaagtagtaacaataagatgccaactttggaggagtatggtaccaatttgacaaagttagcagaagagggaaagttggatcctgttgtgggaaggcagccacaaattgaacgtgtcacccaaattttaggccggcgcaccaaaaataatccttgtcttattggcgaacctggtgttggcaagaccgcaattgccgaaggtcttgctcagcggattgcaaatggtgatgtacctgaaactattgagggaaaaaaggttataacccttgacatgggtctgcttgtagctggaaccaaataccgtggtgagtttgaggaaaggttgaagaaactgatggaagaaatcaaacaaagtgatgaaataatactttttatcgatgaagtgcacactctaattggagcaggagcagctgaaggtgcaattgatgctgctaacatcctaaaaccagctctagcaagaggtgaactacagtgtattggagccacaacattggacgaatacaggaagcacattgaaaaagatccagctttggagagacgattccagccagttaaagtaccagaaccaactgtggatgaaaccatacaaatactgaaaggacttagagaacgttatgagattcaccacaagctccgctataccgatgaggctcttgtagctgctgcgcaactttcttaccagtatatcagtgatcgatttctgccagacaaagctatagatttgattgatgaagctggctcacgagtccgtcttcaacatgctcagttgccagaagaggcaaaagaacttgacaaggaagtcaggcagattgtcaaggagaaagaggaagctgttcgcaaccaagactttgaaaaggctggagaactgcgtgataaagaaatggatctaaaggcacagatctcatcagttgtagagaaaggcaaggagatgaacaaagcagagagtgaggctggagatgaaggtcctcttgtaactgaagttgacatacaacatattgtgtcctcctggacgggcataccggttgacaaagtctcagcagatgaatctgatcgcctcctcaagatggaagatactttacacaagagaatcattggccaggatgaagctgtgaaagccattagtcgggctatccgtagagcccgggttggattgaagaaccctaatcgtccaattgccagcttcatattttctggtccaactggtgtggggaagtctgagttggccaaagcattggctgcatactacttcggctctgaagaggccatgattcgtcttgacatgagtgaatttatggaaaggcacactgtctccaaacttattggttcacctcctggatatgttggttacaccgaaggtggtcaattgactgaagcagttcggcgtcgtccttacactgttgtactgtttgatgagattgagaaagcccatcctgatgttttcaacatgatgctacagatccttgaagacggaagactaacagacagtaagggaagaactgtggatttcaaaaacacacttcttataatgacatcaaatgttggaagcagtgtgattgagaaaggtggccgcaaaattggattcgatctggattatgatgagaaagacagcagttataatagaatcaagagcttggtgactgaggagctaaaacaatactttaggccagagtttctaaataggttggatgaaatgattgttttcaggcaactcacaaaattggaggtgaaggatatagcagacataatgctcaaggaggtgtttaagagactggagaccaaagatattgaacttcaagtaacagaaagatttagggacagggtggttgaggaaggttataatcctagttacggagctaggcctctaagaagagctataatgcggcttttggaggatagcatggctgaaaagatgcttgctagagagatcaaagagggtgactctgttatagtagatgttgattctgacgggaatgtgattgttctcaatggtagcagcggaaacccggagtcattaccagaggctcttcctgtataaagtagttaccttttctatgaagtatgtacttgaattatttaaagcatagtcatagtatgttttacttgtcaataaacctaaatctcttaatttattactgataggcgcagttatgttttcccttagaagcctagcaaaatcaatttgaggggttaacattgcaggaacagggggtataggggaaaactaaaaagggtgtgggaatgatgaaaaagagccgtgtatggcatgccttggccatgtgcatccaccagctatttcattggaagccagagtcttttcatgttttcactgaactgttataatgtaacatcccagctttgctgtatagtactgtactactattgcatatttattgctcgacatgtaatcacatacttgtacaacaacgacaaattctggacagttagatatgtatgaaatatgtgtactccaatgtacagagaggtttacatgtttttcaggtatgggttgtattcctagtttatagaatgatacagttgctgtttgcttcccatgtaaacaacccagcaacagcgttccagattccgtaatgaaacttctatttattcttaaatcaagcttcattgcccca

SEQ ID NO: 3165 - DNA, 3248 bp, Glycine max
aaaacagtcatcaacatgatataaataacaaattcgcgtgtcttttatctcattgccttcttcttcctccctctccctcctcccccaaccacgcccttctctcttccaatttctcttctctgtccaactcaatcgattagtttagcttccgcggacagttcagggatcatggctagggttttagttcagtctactggtatgcctggcctactgagtgggcaaaggcacgggaagcataagggatcaggaaaatcgaaaagatctgtcaaaatgatgagcaccttacgaatgcctgctttaagaatgtcgagtttctccggattacgtactcttaatcctatggattctctgtcgagaccacgccacacttttccgttgaatacaacttctaggcgcgagagggctaaaagatgtgtacctaaagctatgtttgagcgtttcacagagaaggcaatcaaagtcattatgctagcccaggaggaagcaagacgactggggcacaattttgttggaacggaacagattctattgggtcttattggcgaaggaaccggcattgctgctaaggttctgaagtcaatgggaattaatcttaaagatgctcgggttgaagtggagaaaattattggaaggggtagtggatttgttgccgttgagattccgtttactccccgggcaaagcgtgttttggaattctcactggaggaagctcgccaacttggtcataattatattggatctgagcacttgcttcttggtctccttcgagagggtgagggtgtagcagcacgtgttcttgaaaatttgggtgctgatccaaacaatattcgtgctcaggttatccgcatggttggtgagggtgctgacagtgttggtgctactgttggccctggaagtagtaataacaataagatgccaactttggaggagtatggcacgaatttgaccaagctagcggaagagggaaaattggatcctgttgtgggtaggcagcaacaaattgaacgtgtcactcaaattttgggtcgtcgtaccaaaaataatccttgtcttattggggaacctggggttggcaagacagctattgctgaaggtcttgcccaaaggattgcaaatggtgatgttcctgaaaccatagagggaaagaaggttataacccttgatatgggtctactggtggctggaactaaatatcgtggagaatttgaggagagattgaagaaactaatggaggaaatcaaacaaagtgatgagataatactttttattgatgaagtgcacactctaattggagctggagcagctgagggggcaattgatgctgcaaacatattaaaaccagctcttgccagaggtgaactgcagtgtataggagccacgacactagatgaatataggaagcacattgaaaaggatccagctctggagaggcgattccagccagttaaagtgccagagccaactgtcgatgaaaccatacaaatactgaaaggacttagagaacgctatgaaattcaccacaagctccgttatacagatgatgctctcgtagccgctgctcagctgtcacaccaatatattagtgatcgatttttgcccgacaaagctatagatttaattgatgaagcaggttctcgagtccggcttcaacatgcccagttacctgaagaagcaagagagcttgacaaggaggtcaggcagattgtgaaggagaaagaagaatttgttcgcaatcaagactttgaaaaggctggagagctaagagacagagaaatggatcttaaggcccagatatctgcacttatagaaaaaggcaaggagatgagtaaggcagaaagcgaggcaggagatgaaggtcccatggtgactgaagttgacatacaacatattgtctcctcctggactggtattcctgtggagaaagtctcaactgatgaatctgatcgtctcctcaagatggaagagactttacacaagcgagtcataggtcaggatgaagcagtgaaagccataagcagggccatccgtcgagccagggttggactgaagaaccctaaccgtccaattgccagcttcatcttttctgggccaactggtgtggggaagtctgagttggccaaagcattggctgcatactactttggttctgaagaagccatgattcggcttgacatgagtgaattcatggaaaggcacacagtctccaaactcattggttcacctcctggatacgttggttacactgagggtggtcaactgaccgaggcagttcggcgtcgtccctacactgttgtactctttgatgagattgagaaagcccatcctgatgtattcaacatgatgcttcagatcctggaagatggaagattaacagacagcaaaggaagaactgtggacttcaagaacacgcttcttataatgacatcaaatgttggaagcagtgtgattgagaaaggaggccgtaaaataggatttgaccttgattatgatgagaaggatagcagttacaaccgaatcaagagcttggtgactgaggaactgaagcaatacttcaggccagagttcttgaataggttggatgaaatgattgtcttccggcaactcacaaaattggaggtaaaggagatagcagacataatgttgaaggaggtgtttgatagactgaaagccaaggaaattgatctctcagtaacagaaagatttagggagagggtggttgacgaaggatataatccgagttatggggctaggcctctaagaagagctataatgcgacttttggaggacagcatggctgagaagatgcttgctagagagattaaagagggtgactcagttatagttgatgctgactccgatggtaatgtgattgtgctcaacggtagtagtggtgccccagattcattagaagaagctcttcctgtgtaacgtggttgtcttagttagttgagttgtatttttttctctcttttatttgttaaaagaaaacatagcaatagtttgtttaagttgccaatagacatcaagcttttaattgaatgctgatggcctcagccacgtttgcccataacataatgaacacagcaaggtttgggtggaatgaaaaaatgacattatttctgttggtcctacccttgatatgttgcattgtgaacaattttaatttattgaaagcaagttgttttgtagttttcaccgttctgtaaacttattgttatagcttcattttaaataagttgcatgacatc

SEQ ID NO: 3166 - DNA, 3184 bp, Glycine max
ttcttcttccaccctctccctcctcgcccaaccacgcccttctctcttccaatttctcttctctgtccaactcaatcgattagtttagcttccgcggacagttcagggatcatggctagggttttagttcagtctactggtatgcctggcctactgagtgggcaaaggcacgggaagcataagggatcaggaaaatcgaaaagatctgtcaaaatgatgagcaccttacgaatgcctgctttaagaatgtcgagtttctccggattacgtactcttaatcctatggattctctgtcgagaccacgccacacttttccgttgaatacaacttctaggcgcgagagggctaaaagatgtgtacctaaagctatgtttgagcgtttcacagagaaggcaatcaaagtcattatgctagcccaggaggaagcaagacgactggggcacaattttgttggaacggaacagattctattgggtcttattggcgaaggaaccggcattgctgctaaggttctgaagtcaatgggaattaatcttaaagatgctcgggttgaagtggagaaaattattggaaggggtagtggatttgttgccgttgagattccgtttactccccgggcaaagcgtgttttggaattctcactggaggaagctcgccaacttggtcataattatattggatctgagcacttgcttcttggtctccttcgagagggtgagggtgtagcagcacgtgttcttgaaaatttgggtgctgatccaaacaatattcgtgctcaggttatccgcatggttggtgagggtgctgacagtgttggtgctactgttggccctggaagtagtaataacaataagatgccaactttggaggagtatggcacgaatttgaccaagctagcggaagagggaaaattggatcctgttgtgggtaggcagcaacaaattgaacgtgtcactcaaattttgggtcgtcgtaccaaaaataatccttgtcttattggggaacctggggttggcaagacagctattgctgaaggtcttgcccaaaggattgcaaatggtgatgttcctgaaaccatagagggaaagaaggttataacccttgatatgggtctactggtggctggaactaaatatcgtggagaatttgaggagagattgaagaaactaatggaggaaatcaaacaaagtgatgagataatactttttattgatgaagtgcacactctaattggagctggagcagctgagggggcaattgatgctgcaaacatattaaaaccagctcttgccagaggtgaactgcagtgtataggagccacgacactagatgaatataggaagcacattgaaaaggatccagctctggagaggcgattccagccagttaaagtgccagagccaactgtcgatgaaaccatacaaatactgaaaggacttagagaacgctatgaaattcaccacaagctccgttatacagatgatgctctcgtagccgctgctcagctgtcacaccaatatattagtgatcgatttttgcccgacaaagctatagatttaattgatgaagcaggttctcgagtccggcttcaacatgcccagttacctgaagaagcaagagagcttgacaaggaggtcaggcagattgtgaaggagaaagaagaatttgttcgcaatcaagactttgaaaaggctggagagctaagagacagagaaatggatcttaaggcccagatatctgcacttatagaaaaaggcaaggagatgagtaaggcagaaagcgaggcaggagatgaaggtcccatggtgactgaagttgacatacaacatattgtctcctcctggactggtattcctgtggagaaagtctcaactgatgaatctgatcgtctcctcaagatggaagagactttacacaagcgagtcataggtcaggatgaagcagtgaaagccataagcagggccatccgtcgagccagggttggactgaagaaccctaaccgtccaattgccagcttcatcttttctgggccaactggtgtggggaagtctgagttggccaaagcattggctgcatactactttggttctgaagaagccatgattcggcttgacatgagtgaattcatggaaaggcacacagtctccaaactcattggttcacctcctggatacgttggttacactgagggtggtcaactgaccgaggcagttcggcgtcgtccctacactgttgtactctttgatgagattgagaaagcccatcctgatgtattcaacatgatgcttcagatcctggaagatggaagattaacagacagcaaaggaagaactgtggacttcaagaacacgcttcttataatgacatcaaatgttggaagcagtgtgattgagaaaggaggccgtaaaataggatttgaccttgattatgatgagaaggatagcagttacaaccgaatcaagagcttggtgactgaggaactgaagcaatacttcaggccagagttcttgaataggttggatgaaatgattgtcttccggcaactcacaaaattggaggtaaaggagatagcagacataatgttgaaggaggtgtttgatagactgaaagccaaggaaattgatctctcagtaacagaaagatttagggagagggtggttgacgaaggatataatccgagttatggggctaggcctctaagaagagctataatgcgacttttggaggacagcatggctgagaagatgcttgctagagagattaaagagggtgactcagttatagttgatgctgactccgatggtaatgtgattgtgctcaacggtagtagtggtgccccagattcattagaagaagctcttcctgtgtaacgtggttgtcttagttagttgagttgtatttttttctctcttttatttgttaaaagaaaacatagcaatagtttgtttaagttgccaatagacatcaagcttttaattgaatgctgatggcctcagccacgtttgcccataacataatgaacacagcaaggtttgggtggaatgaaaaaatgacattatttctgttggtcctacccttgatatgttgcattgtgaacaattttaatttattgaaagcaagttgttttgtagttttcaccgttctgtaaacttattgttatagcttcattttaaataagttgca

SEQ ID NO: 3167 - DNA, 3359 bp, Manihot esculenta
aacgaaaacaccgtctaatattataagccacatctagatagctaaccttccttctcggccgaccataaaagagggtctctttcttctccaaaggaaaaggaaaaataaagaccctttaggtctctctggatttttatttttacttctcttctcattgattgttcttctgtgcttcgttttccatcttcgaattttagattgttttttggagtatcacatggcgaggttgctggttcattcaactaatattcctgcaatagcttctggtataaagcatggacaatctcaagaatcagacacatcaagaaggacaaccaccaaaatgatgtgtagttcccgatcaccaacgttgatcttgagaggattctcaggtctgcgaagttcaaactgtttggacacgttgctaagttccagacatgacttccattccaaggttgcaatcacaatgtcccgcaggcaacagaaggccaagcgattttcacctagggctatgtttgagcgcttcacagaaaaagcaattaaagtaattatgcttgcccaggaggaagcaagacggcttggtcacaactttgttggcaccgagcaaatcctgcttggtcttattggtgaaggaactggtattgctgcgaaggttctaaaatctatgggaatcaatctgaaggatgcacgcgtagaagtggagaagattataggaagaggcagtggatttgttgctgtggaaattccttttactcctcgtgcaaagcgtgtgttggaactctcactagaggaagcccgtcagcttggtcacaactacattggatctgagcacttgcttcttgggctgcttcgtgaaggtgaaggtgtagccgcccgtgttcttgagaacttaggtgctgaccctagcaacatccgcacacaggtcattcgcatggttggtgagagcacagaaaatattcctgctactgttggaccaggaggtggtagcaataagatgcctacacttgaagagtatggaactaatttgactaagctagcagaggagggaaaattggatcctgttgttggaagacagccacaaatagagcgtgtcatccaaatcttgggtcgacgaactaaaaacaatccctgtcttattggagaaccaggggttgggaaaacagcaattgcagaaggtctagctcaacgtatagcaagtggtgatgtccctgaaacaattgagagaaagaaggttattacccttgatatgggtcttctagttgctggaaccaagtaccgaggagagtttgaggaaagattgaagaagctaatggaagaaatcaaacaaagtgatgaaataattctctttattgatgaggtgcatacattaattggagctggagcagcagaaggtgcaattgatgcagctaatattttgaagccagctcttgcgagaggtgaattgcagtgcattggagctacaacattggatgaatacagaaagcacattgagaaggaccctgctttagaaagacgattccagccagtcaaagtgcctgagccatctgttgatgaaacaattcagattctgaaagggctgcgagagcgatatgagatccaccacaagcttcgttacacagatgaagctctagtagctgctgcacaattgtcatatcagtacattagtgatcgttttttgcctgacaaggcaattgacttgattgatgaggctggttctcgagttcgcctccgtcatgcacaggcatgaacttgtccctgaggaagccagggagcttgagaaagaggtcaggcaaataacaaaggagaaggatgaagctgttcgtagccaagactttgaaaaggctggtgaattacgggatcgtgaaatggacctaagggcacaaattgcagctattgtggagaaaggcaaggagatgagcaaggctgagactgaggcaggggatgtaggtcctgttgtcaccgaatcagacattcagcacattgtctcttcttggaccggcattcctgttgagaaggtatctactgatgaatctgaccgcctcttgaagatggaagagaccttgcacaagagagtcattggtcaagatgaagctgtcaaagccattagccgtgctattcgccgagctcgtgttggacttaagaaccccaatcgtccaattgctagcttcatattttcaggtccaactggtgtagggaagtcagagctggcaaaagccctagctgcatactacttcggctctgaagaagccatgattcgccttgatatgagtgagttcatggagagacacacagtctccaagctcattggttcacctcctggttatgttggttacacagagggtgggcagttgacagaggctgttaggcgtcggccttacactgtggtactctttgatgagattgagaaggcccatcctgatgtcttcaacatgatgcttcagattcttgaagatggaaggttgactgacagcaagggtagaactgtggacttcaagaatacccttcttataatgacttcaaatgttggaagcagtgttattgagaagggaggacgaaggataggttttgaccttgattatgatgagaaggatagcagttacaatcggatcaagagtctggtgacggaggaattgaagcagtatttcaggccagaattcttgaataggttagatgagatgatcgtcttccgtcagctcactaagcttgaggtcaaggagatagctgatataatgttgaaggaggtatttgataggctgaagggcaaagaaatagagcttcaagtgacggagagatttagagagagggtggttgaagaagggtataacccaagctatggggcgaggccattgagaagagccatcatgagactattggaggacagcatggccgagaaaatgcttgcaggagagatcaaagaaggggactcggttatcgtggatgttgattctgatgggaatgttattgtactcaatggtagcagtgggtcccccgagtcattgcaggatgccttgtctatcgtgtaagccagaatctctattcagcaatgttggccaatgaattgctttgcttggttttaacttaaagttggcaacgtagttgtagtctgttttgttgaaatgactactggcagtagaattggggccgttgatttattcctggccggatttgaagctgtgttcgtatcaccaagattagttaggtgcccgatagtggaatgctggtttttgagttagcttttgataataaactgatatagagttataaatttccccccttcacttttttcggttgcagtcatgtaatggagatttgtgattgaccctgctttctgtcatgaagctttccaatatcctattcgtttttttagagacgttacttta

SEQ ID NO: 3168 - DNA, 3266 bp, Cicer arietinum
tttatttttgtttttactatcaaactttttggttgaaatccttctatcttatccgtttatttgggggaagtgcttacgctactcaggaatcatggctagggttttggctcagccaattaatgttcctggcttagtggctgggcacaggcaaaaccaacacaaggcatcgggaaaatcaaaaagatcagtcaaaatgatgtgtgctttccgaacaaacagattaagaatgccaggtttctcaggacttcgtactttcaatcatttagatactatgctgagacctggactagattttcactcaaaggtatcaattgcaatttcttcttcacggcgagcaagggctaccagatgcatacccaaagccatgtttgagcgtttcacagagaaagcaatcaaagtgataatgctagctcaggaggaagcaagacgtcttggtcacaattttgttggaacagagcagattctcttgggtcttattggtgaaggcactggtatcgccgccaaggttttaaagtctatgggaatcaaccttaaagatgcacgtgtggaagtggagaagataattggaaggggtagtgggtttgttgctgttgagattccgtttactccccgtgcaaagcgtgttttggaactttcactggaggaagctcgccaacttggtcacaattatattggatcagagcacttgcttctaggtcttcttcgagagggtgagggtgtagcagcacgtgttcttgaaaacctaggcgctgatcctactaatattcgcacacaggttattcgcatggtgggtgagagtgctgacagtgtaactgctactgttggctctggaagtagtaacaataagatgccaactttggaggagtatggtaccaatttgacaaagttagcagaagagggaaagttggatcctgttgtgggaaggcagccacaaattgaacgtgtcacccaaattttaggccggcgcaccaaaaataatccttgtcttattggcgaacctggtgttggcaagaccgcaattgccgaaggtcttgctcagcggattgcaaatggtgatgtacctgaaactattgagggaaaaaggttataacccttgacatgggtctgcttgtagctggaaccaaataccgtggtgagtttgaggaaaggttgaagaaactgatggaagaaatcaaacaaagtgatgaaataatactttttatcgatgaagtgcacactctaattggagcaggagcagctgaaggtgcaattgatgctgctaacatcctaaaaccagctctagcaagaggtgaactacagtgtattggagccacaacattggacgaatacaggaagcacattgaaaaagatccagctttggagagacgattccagccagttaaagtaccagaaccaactgtggatgaaaccatacaaatactgaaaggacttagagaacgttatgagattcaccacaagctccgctataccgatgaggctcttgtagctgctgcgcaactttcttaccagtatatcagtgatcgatttctgccagacaaagctatagatttgattgatgaagctggctcacgagtccgtcttcaacatgctcagttgccagaagaggcaaaagaacttgacaaggaagtcaggcagattgtcaaggagaaagaggaagctgttcgcaaccaagactttgaaaaggctggagaactgcgtgataaagaaatggatctaaaggcacagatctcatcagttgtagagaaaggcaaggagatgaacaaagcagagagtgaggctggagatgaaggtcctcttgtaactgaagttgacatacaacatattgtgtcctcctggacgggcataccggttgacaaagtctcagcagatgaatctgatcgcctcctcaagatggaagatactttacacaagagaatcattggccaggatgaagctgtgaaagccattagtcgggctatccgtagagcccgggttggattgaagaaccctaatcgtccaattgccagcttcatattttctggtccaactggtgtggggaagtctgagttggccaaagcattggctgcatactacttcggctctgaagaggccatgattcgtcttgacatgagtgaatttatggaaaggcacactgtctccaaacttattggttcacctcctggatatgttggttacaccgaaggtggtcaattgactgaagcagttcggcgtcgtccttacactgttgtactgtttgatgagattgagaaagcccatcctgatgttttcaacatgatgctacagatccttgaagacggaagactaacagacagtaagggaagaactgtggatttcaaaaacacacttcttataatgacatcaaatgttggaagcagtgtgattgagaaaggtggccgcaaaattggattcgatctggattatgatgagaaagacagcagttataatagaatcaagagcttggtgactgaggagctaaaacaatactttaggccagagtttctaaataggttggatgaaatgattgttttcaggcaactcacaaaattggaggtgaaggatatagcagacataatgctcaaggaggtgtttaagagactggagaccaaagatattgaacttcaagtaacagaaagatttagggacagggtggttgaggaaggttataatcctagttacggagctaggcctctaagaagagctataatgcggcttttggaggatagcatggctgaaaagatgcttgctagagagatcaaagagggtgactctgttatagtagatgttgattctgacgggaatgtgattgttctcaatggtagcagcggaaacccggagtcattaccagaggctcttcctgtataaagtagttaccttttctatgaagtatgtgcttgaattatttaaagcatagtcatagtatgttttacttgtcaataaacctaaatctcttaatttattactgataggcgcagttatgttttcccttagaagcctagcaaaatcaatttgaggggttaacattgcaggaacagggggtataggggaaaactaaaaagggtgtgggaatgatgaaaaagagccgtgtatggcatgccttggccatgtcttggccatgtgcatccaccagctatttcattggaagccagagtcttttcatgttttcactgaactgttataatgtaacatcccagctttgctgtatagtactgtactactattgcatatttattgctcgacatgtaatcacatacttgtacaacaacgac

SEQ ID NO: 3169 - DNA, 3225 bp, Festuca arundinacea
actcctcggaggagaaacaaacaaggccgcgctcttccttcgccccctctcctcgcaggtttggggcagcaacttctgaccatggcagggaccttagtcctgcccgttgctcttgggacaactttcgcaggccgtacaaagaagtctcatggaaccaggaggcctacctcaatgcttgcaatgtccttgaaccgtcctgtaaggatggcaggatttggtggtctgagatcagcacatagcttcacaaccatgccctcctccaacttcagatcgacagctgcatcttacagatcctcgagacggggaagacgttctcgttttgtaaccagagccatgtttgagaggtttaccgagaaagctataaaggtcatcatgcttgcgcaagaggaagcaaggcgcctaggccacaactttgtcggaaccgagcaagttctattgggtttggttggagaaggaactggtattgccgcaaaggtgctcaagtccatgggtatcaatcttaaggatgcccgcgtggaagtggaaaagatcattgggaggggaaatggttttgtcgctgtcgaaataccgttcacaccacgcgcaaaacgtgttttagagctttcattggaggaagctcgccaactaggacacaattatattgggtctgagcacttgcttcttggacttcttcgtgagggtgaaggtgtggcagcccgtgtacttgagtctcttggtgctgacccaagcaatattcgtacacaggttgtccgaatgattggtgaaacaacagaagctgttggtgctggagttggcggaggaagcagtggtaataagatgccaacacttgaggagtatggaactaatttaacaaaattagcagaggagggaaagctagatcctgttgttggaagggaaccacagattgaacgcgtcgtacaaattttgggaagacgaacaaagaacaatccctgcttaattggagaacctggtgttgggaagacagcaattgcagaagggcttgctcaacgcatttatagtggcgatgtgcctgagacaatagaggggaagaaggtcattacacttgatatggggcttcttgttgctggtacgaaataccggggagaatttgaagaacggttaaagaaactgatggaagaaatcaagcagagcgatgagataattctcttcattgatgaagttcacacgctcataggagcaggagctgctgaaggtgctatagatgctgctaatatcttgaagccggcattagcaagaggagaactacagtgtattggagctaccacgcttgatgagtacaggaagcatgttgagaaagacccagcattagaaaggcgtttccagccagtaaaggtaccagagccatcagttgatgaaaccatagaaattctcagagggcttcgggaacgatatgagatccatcataaactcagttacactgatgattctttgattgcagctgctaagctatcgtatcaatatatcagtgatcgtttcctccccgataaagcaattgacttgatcgatgaagcaggttcacgtgtaaggcttcgacatgcccaggttcctgaggaagccagagagctcgacaaggagcttaagcaaataacaaaggacaaaaatgaggctgtccgtggccaggattttgaaaaggctggagaattgcgagatcgtgaaatggaattgaaggcccagataacagccctgattgacaagagcaaggagatgatcaaagcagagactgcgtcaggagagactgggccgatggtccatgaatcagatatccagcacattgtatcatcatggactggtatcccagtggagaaagtctcaactgacgaatccgataaacttcttaagatggaagagacattgcataagcgtgtcattggccaagatgaggctgtgaaagcaataagtcgctctgtccgccgtgctcgtgtcggcctcaagaaccccaacagaccaattgcgagcttcatttttgcaggtccaactggtgttgggaaatcagagcttgcaaagactcttgcatcgtattactttggctctgaagaggccatgatccgactcgatatgagtgagttcatggagagacacacagtgtccaagttgatcggttcaccaccaggctatgtgggatacacggagggtggccagttgacggaggcagttcgacgccggccttacagtgttgtgctttttgatgagattgagaaggcacatccggatgtgttcaacatgatgctccagatcctagaagacggaaggttaactgacagcaaggggaggacagtggacttcaagaacacgcttcttataatgacatcaaacgtgggaagcagcgtcattgagaagggagggcgtaagattgggtttgacctcgagactgacgagaaggacagcagctacggcaggatcaagagcttggtcgttgaggagatgaagcagtacttccgccctgaatttctcaaccgtcttgacgagatgatcgttttcaggcagctgaccaagctggaagtcaaagagatcgcggacatcatgctacaggaggtcttcaccaggctgaagctgaaggagatcaatctgcaggtcaccgagaagttcaaggagcgggttgttgacgaagggtacaaccctagctatggagcacggccactaaggagggcgatcatgaggctgctggaggacagcctcgcggagaagatcttggccggggaggtcaaggaaggcgattctgccattgttgacgtggactctgaggggaaggtggttgtgctgaacggccagagcggactgcctgagcttccaaccccggctgtcactgtatagtttggtacagattgttaaaaatacatcattttcatttcattcgagcatatatctcttcgtaggtagtgtatagctgtaactgtatatatatagtatgcactaatcaaaggggaaatattgctggctttgacttctgatttagagtgtggattactctctctctctctgaaacttcatagagacttagactagtcacatgcatatgatactagtttatgataccgctcatataatgcatagtataataaggtagtattcataattttatcatatttaatattttgtagaatctcaatgtaaatttgtgaacatgtatttagcatcaaattttctagttttacgtgttatgataccgtatctacctatgatactcccaaaaaaaaaaaaaaaaaa

SEQ ID NO: 3170 - DNA, 2807 bp, Medicago truncatula
ccggatattcaggaatcatggctcgggttttggctcagtcgattaatgttcctggcctagtggttgggcacaagcaaagtcaacataagggatcgggaaaatctaaaagatcagttaaaatgatgtgtgcttcgcgaacaattggattaagaatgcctggtttctcaggacttcgtaccatcaatcatttggatactatgctgagacctggactagattttcatgccaaggtatcaatggcaatttcttcacggcgggcaagggctaagagaatcatacctagagccatgtttgagcgtttcacagagaaagcaatcaaagtgataatgttagctcaagaggaagcaaggcgtcttggtcacaattttgttggaacagagcagattctactgggtcttattggtgaaggcactggtatcgccgccaaggttttaaagtctatgggaatcaaccttaaagatgcacgggtggaagtagagaagataattggaaggggtagtggatttgttgctgttgagattccgtttactcctcgtgcaaagcgtgtattggaactttcactcgaggaagctcgccaacttggtcacaattatattggatcggagcacttgcttctaggtcttcttcgagagggtgagggagtagcagcacgtgttcttgaaaacctaggcgctgatcctactaatattcgcacacaggttattcgcatggtgggtgagagtgctgacaatgttactgctactgttggctcaggaagtagtaacaataaaacgccaactttggaggagtatggaaccaatttgaccaagctagcagaagagggaaagttggatcctgttgtgggaaggcaaccacaaattgaacgtgtcacccaaattttaggccgtcgaaccaaaaataatccttgtcttattggagaacctggtgttgggaagacagcaattgctgaaggtcttgctcagcggattgcaaatggtgatgtacctgaaacaatcgagggaaaaaaggttataaccctagacatgggtttgcttgtagccggaaccaaataccgtggtgagtttgaggagaggttgaagaaactgatggaagaaatcaaacaaagtgatgatataatactttttatcgatgaagtgcacacactaattggagcaggagcagccgaaggtgcaattgatgctgctaacatactaaaaccagctcttgcaagaggtgaactacagtgtattggagccaccacattggatgaatacaggaagcacatcgaaaaagacccagctttggagagacgattccagccagttaaagtaccagaaccaactgttgatgaaaccatacaaatactgaaaggacttagagaacgttatgaaattcaccacaagctccgatatactgatgacgctcttatagctgctgcgcaactttcataccagtatatcagtgatcgatttttgcccgacaaagccattgatttgattgatgaagctggttcacgagtccgtcttcaacatgcacagttgccagaagaggcaaaagaacttgacaaggaggtcaggaagattgttaaagagaaagaggaatttgttcgcaaccaagactttgaaaaggctggagaactacgtgataaagaaatggatctaagggcgcagatctcggcacttgtagagaaaggcaaggagatgagcaaagcagagagtgaggcagcagatgaaggtcctattgtgactgaagttgacattcaacatattgtgtcctcctggacaggcattcctgttgataaagtctcagcagatgaatctgatcgcctcctcaagatggaagatactttacacaagcgagtcattggtcaggatgaagcagtagaagccattagccgggctatccgtcgagcacgggttggattgaagaaccctaaccgtccaattgctagcttcatcttttctggtccaactggtgtggggaagtctgaattggccaaagcattggctgcctactactttggctctgaagaagccatgattcgtcttgacatgagtgagtttatggaaaggcacactgtctccaaacttattggttcacctcctggatatgttggttacaccgaaggtggtcagttgactgaagcagttcgtcgtcgtccttacactgttgtactctttgatgagatcgagaaagctcatcctgatgtattcaacatgatgcttcagatccttgaagatggaagactaacggacagtaaaggccgaactgtggatttcaagaacacacttcttataatgacgtcaaatgttggaagcagtgtgattgagaaaggaggccgccgaattggattcgatcttgattatgatgagaaagatagcagttataatagaatcaagagtttggtgactgaagaactaaaacaatacttcaggccagagtttttaaataggttggatgaaatgattgttttcaggcaactcacaaaattggaggtgaaggaaatagcagacataatgctcagggaagtgtttcagagactgaagaacaaagaaattgaacttcaagtaacagaaagatttagggacagggtggttgacgaaggttataatcctagctatggagccaggcctctaagaagagccatcatgcgacttttggaggatagcatggctgagaagatgctcgccagagagatcaaagagggtgactccgtaatagtggatgttgattccgagggtaatgtgattgttctcaatggtaccagcggtactcaagagtcgttaccagaggctcttgctatataatgtggttaccttttccattat

SEQ ID NO: 3171 - DNA, 3445 bp, Populus trichocarpa
aattaaaaaaaaaaagaaaattttgttcgatatcatatcataaatcacatccatctctatctccacctccacctccacctcttggccgaccattaaagagggtctatatatctctttctccttctctttctcggaaagtagtaagatagacccccttaggtccctatctccccgtttcatttaatcaccgctcgttaatttagttaggatctttcctgggaattacatggctaggcttctagttcattctgctaatattcctgctgtagctccttgtccaaggcattgtcaatatgaagaatctaaaaaatcaagggcctcctctgccaaaatgatgtgtagcttaccattgcggggtttggtgataagtggatactcaggattgcgcagcgcaaactgtttagatacactgttgagacatggacattctttccattctaaggttgcaattacaatctctcctaggcagcaaaaggctaagcgatttgtacctagagctatgtttgaacgttttacagaaaaagcaatcaaagtaattatgcttgctcaagaggaagcaagacggcttggtcataattttgtcggaacagaacagatcctgttggggcttattggtgaaggaactggaattgctgcgaaggttctcaaatctatgggaatcaatcttaaagatgcacgtgtagaggtggagaagattattggcaggggtagtggatttgttgctgtggaaattccgttcactcctcgtgccaagcgtgttttggaactatcattggaagaggcccgccaacttggtcataattatattggatccgagcacttgcttctcgggctacttcgtgaaggtgaaggtgtagcagcccgtgttctcgagaatttaggtgctgatcctagtaacatacgtacacaggtcattcgtatggtgggtgagagcacagaaaacctggctggttccactgttggacctggaagcagtaacaacaagatgcctacacttgaggaatatggaactaatttgactaaattagcagaggagggtaaattggatcctgtagtcggaaggcagccacaaatagaacgtgttgttcaaatcctgggccgaagaactaagaataacccttgtctcattggagaacctggggttgggaaaactgcaattgctgaaggtcttgctcagaggatagcaagcggtgatgttcctgagacaattgagggaaagaaggttatcacccttgacatgggccttcttgttgctggaactaaataccgtggagagtttgaggaaagattgaagaagctaatggaggaaatcaaacagagtgatgaaataattctctttattgatgaggtgcataccctgataggggcaggagcagcagagggggctattgatgctgctaatattttgaaaccagctcttgctagaggtgaattgcagtgtattggagctacaaccctagatgagtacagaaagcacattgagaaggaccctgctttggaaagacgtttccagccagtcaaagtacctgagccatctgtggatgaaacaatacagattttgaaaggacttcgtgagcgatatgagatccaccacaaactccgttacacagatgaggccttaatagctgctgctcagttgtcataccagtacatcagtgaccgttttctgcctgataaagcaattgatctgatcgatgaagctggttctcgggttcgccttcggcatgcacaggtccctgaggaagcaagagagcttgagaaagaggtcagacaaatcacaaaggaaaaggatgaagctgtccgcggccaagacttcgaaaaggctggggaattgcgagacagagaaatggaccttagagcacagatcgcagctattgtggagaaaggcaaggaaatgagcaaagctgagacagaggcaggggatgtaggtcccactgtcactgaatcagatattcagcacattgtctcttcttggactggcatacctgtagagaaagtatccacggatgaatctaatcgtctcctaaagatggaagatacccttcacaagagagtcattggtcaggatgaagctgtcaaggcaatcagccgtgccatccgccgagctcgtgttgggcttaagaacccaaatcgaccaattgctagcttcatcttttctggtccaactggtgtcgggaagtcagaactggcaaaagcactagctgcctactactttggctcagaagaagccatgatccgacttgatatgagcgagtacatggagagacacactgttgccaagctaattggttcacctcctggttatgttggttacactgaaggtggtcagttgacagaggctgttcggcgtcgtccttacactgtggtactctttgatgagattgagaaggcccatcctgatgtctttaatattatgcttcaaattcttgaagatggaaggttgacagacagcaagggcaggacagtggacttcaaaaataccctcctgataatgacttcaaatgttggtagcagtgttattgagaagggaggacgcaagatgggatttgatcttgattatgatgagaaggatagcagttacaaccgaattaagagcctggtgacagaggagttaaagcagtattttaggccagaattcttgaacagattggatgagatgattgttttccgtcaactttccaagctggaggtcaaggatattgctgatataatgttgaaggaggtctttgagaggttgaaggtcaaggaaatagaacttcaagtgactgagagatttagagatagggtggtcgatgaagggtataacccatcctatggtgcaaggcctttgagaagagctataatgaggcttcttgaggacagcatggctgagaaaatgctttcagcagagatcaaagaaggtgattctgtcattatagatgttgattctgatggaaatgttgttgtgctcaacggtcaaagtggtggtgctcccgatgccttgccagacatgttgaacgttgtgtagagcgaatcctcttattcagtaacctttgctagaatgttgtttgttactgtggttttcattcgaattggcaaattatttgtagtctgttttattggaaggactacttgtcagtggaatttggagctgtgcttcattgctggctgggtttaaaggctgtatcattgcaccatgatagcatgaatagtttagaggcaaattgtagtatggtgcatgggttagctcccttaatgaaaggactaacaatggaaggttatgatccagtcagttttacagaactgtcatgtaatacgaaattatgatttgaacttgaaattgcggtcatgcttttctctgatgcagaatgtctataccttcaaaataatataatggctgccctcaaaattctctagcattttgattcgtgccatttaacatactctcagatgttattctttaaca

SEQ ID NO: 3172 - DNA, 3329 bp, Lupinus angustifolius
ttttttatttttgtacttttttttatttcaatactttattataatttcataataactattctttcctccttctctaataaacactttctttgcttcctctttcttttcaactgaatccataaaaactacatccctttaggtttcattctatctcttatattttaatcttcaactttgtttttcattttcattttatcttatatttgtgtagtgcttctgaggaccaccgattcaggaatcatggctaaggttttggctcagtcagttaatgtacctggcctagtggctgggcaaaggcatggtcaacataagggacaaggagagttaaaaagagcggtgaagacgatgtgtgcttcgcgaacaaacagattaagaatgaatggttactcaggactacgtacttctaatcctttggatatcatgttgagaccgggactggattttcattcgaaggtggcaattgcaacttcatcacggagagcaagagctaccagatccatacctaaagccatgtttgagcgtttcacagagaaagctatcaaagttattatgctggcccaggaggaagcaagacgtcttggtcacaattttgtgggaacagagcaaattctgttgggtcttattggtgaaggcactggtattgccgctaaggttctaaagtctatgggaatcaaccttaaagatgcacgtgtggaagtggagaagataattgggagaggtagtggatttgtcgctgttgagattccatttactccccgtgcaaagcgcgttttggaactctcactagaggaagctcgccaacttggtcacaattatattggctctgagcacttgcttctgggtcttcttcgagagggtgagggtgtagcagcacgtgttcttgagaaccttggtgctgatccaactaatatccgcacacaggttattcgtatggttggtgagagtgctgacagtgttgctgctactgttggcccaggaagtagtggcaataagatgccaactttggaggagtatggcaccaatttgaccaagctagcacaggagggaaaattggatcctgttgtgggaaggcagccgcaaattgaacgtgttactcaaattttaggccgtcgcacaaaaaataatccttgtcttattggtgaacctggtgttgggaagacagcaattgctgaaggtcttgctcagcggattgcaaatggtgatgtacctgaaaccatagagggaaaaaaggtcataactctcgatatggggttgcttgtagctggaactaaatatcgtggtgagtttgaggagaggttgaagaaactgatggaagaaatcaagcaaagtgatgagataatactttttatcgatgaagtgcacactctaattggagcaggagcagctgaaggagcaattgatgctgctaacatactaaaaccagctctggcaagaggtgaactgcagtgtattggagccacaacacttgatgaatacaggaagcacattgagaaagatccagctttggagagacgattccagccggttaaagtgccagagccaactgttgacgaaaccatacaaatactgaaaggacttagagagcgctatgagattcaccacaagctccgctatactgatgaagctcttgtagctgctgcacagctatcttaccagtatatcagtgatcgattcttacccgacaaagctatagatttggttgatgaagctggttcacgagtccggcttcaacatgcgcagttacctgaagaggcgagagaactcgacaaggaggccaggcagattattaaggagaaagaagaagctgttcgcaaccaagactttgaaaaggctggagagctacgagacaaagaaatggatctgaaggcacaaatctcgacacttgtagagaaaggcaaggagatgagcaaggcagagactgaggccggagatacaggtcctattgtgactgaagttgacatacaacatattgtgtcctcctggactggtattcctgttgacaaagtctcaacagatgaatctgatcgcctcctcaagatggaagatactttacacaagcgaatcgttggtcaggacgaagcagtgaaagcgataagtcgggctatccgtagagcccgggttggactaaagaaccctaatcgtccaattgccagcttcatattttctggtccaactggtgttgggaagtctgagttggccaaagcattggctgcatactactttggctctgaagaagccatgattcgtcttgacatgagtgaatttatggaaaggcacactgtctccaaactcataggttcacctcctggatatgttggttacactgaaggtggtcaattgactgaggcagtccggcggcgtccatacactgttgtactatttgatgagatcgagaaagcccatcccgatgtcttcaacatgatgcttcagatcctggaagatggaagactaacagacagtaaaggcagaactgtggatttcaagaatacacttctcataatgacatcaaatgttggaagcagtgtgattgagaaaggaggccgccgaattggattcgatctggattacgatgagaaggacagcagttacaatagaatcaagagcttagtgacagaggagctaaaacaatacttcaggccagagtttctgaataggttggatgaaatgattgttttcaggcaactcacaaaacttgaggtgaaggagatagccgacataatgctcaacgaggtgttcaatagactgaagactaaagacattgaacttcaagtgacagaaaggtttaaggacagagtggttgatgaaggttataatcctagttatggagcgaggcctctacgaagagcgataatgcgacttttggaggacagcatggctgagaagatgcttgctagagagatcaaagagggtgattctgttattgtggatgttgattctgatggcaatgtgattgtgcttaatggtagcagtggtaccccagagtcattaccagagccccttcctgtataatgtggttacctatgctaaataatatgtgtatttaatttcatttaaaactagtcctagtctgattttacttgtcaatggacctatagctttctattcagtcatgtttgcccattgccaagcaaaactagtagggaaagggtgtttttagttttcacctgcatgtctatgacaatgtaatatccttgtattattgtaaaatacagtgatggtgtatttatttattgcttgaaatcttaatatatgtaatgacaaatacttgacaatggcaattcaatttagagtgtaatgctcgtccagaaatatatttatcttttaacact

SEQ ID NO: 3173 - DNA, 3435 bp, Arnica chamissonis
cggtttaacgcgccgaaacgcgtaggtgcatctaacttgtttttttaaatattcttttaagttatttgtattctattgaaaaataaatggcaaacaaaaactatttatttcccaataatcttgcaaccataatcatacatgacacatgacacacttaggtattattgaccatactcactccttgttacaaatatcgaaacctaaaggctagaacacccttagttatgaatcggaccaggagtggtggtgccggttccaggattcgggacctcaaaacccgggtttggaacaaacgtatcatcaccaccaggcacatagcttcgaccaccaacaccaccaaacctcggcacacgatggcggcctataatcccgccgtcgtttctgccagtgacaggattgtaggtaaacggattaaacccgtccttgcacttgggtttaatacctcgtcccacacccgggactaggtaaccgcgatcatggttgattaatgactcgggctgcttaacggcatcatgttttttcaggtttgtgtttgggatatcgcgtccggccatcgcgatggtgatgaggatgtggaagatgagaattgctgttttctctgccatggctgggtcactaattcaggccgcttacttcccttcggttgaccatgaaaagaaacttcatacaaataaatctgggaaggctaaaagaacagttaaaatgatggcatattcctatgcacctcccatgagaatgaggaccttttcagggttacgtgggtccaatgctttagatagcattatgaaaacgggccaagatttccattctaaagttgctttagcaacatctgttagatcaagacgggctacacggattgtaccaaaagctatgtttgagcgctttacagagaaggctataaaagtaattatgctcgcacaagaggaagcacgtcgtttaggtcacaattttgttggcacagagcaaatattattagggcttattggtgagggaactggaattgcggctaaggtcttaaagtcaatgggaattagtttaaaggaagcacgtgtggaagttgagaaaattattggtaggggtagtggatttgttgctgttgagatcccatttacccctcgagctaaacgtgttttggaattatcattggaggaagcccgccaacttggtcataactatattggatcagagcatttgctacttggtttgcttcgtgagggtgatggtgttgcagcccgtgtcctggagaatttaggtgttgacactagtaacattcgcacccaggtaattcgaatggttggtgagagtgcagaagccgtgggtgcaggtgttggaggtgggacctctagcagcaagatgccaacactggaggaatacggaacaaacttaacaaagctagctgaagagggtaagttggacccagttgttggaaggcaggcacaagttgaacgggtcacccagattttggggcgtcgaactaagaataacccatgccttattggggagcctggtgtagggaagacagccattgcagaaggtcttgctcaaagaattgcaagtggtgatgtccctgaaaccattgaggggaagaaggtgataaccctagatatgggtcttcttgttgccggcacaaaataccgtggggagtttgaagaaagattaaagaagttaatggaagaaataaaagaaagtgatgatattattctgtttattgatgaggttcacactctaattggagctggagcagcagaaggtgctattgatgctgctaatatattgaaaccagcccttgccagaggtgaattgcagtgtattggggctacaacacttgatgaataccgaaaacatattgaaaaagatccagcattagagagacggttccagccagttaaggttcctgagcctactgttgatgaaacaattcaaattttgaggggacttagagaacgatatgaaattcatcataagcttcagtacactgatgacgctttagttgctgctgctgagttgtcacaccaatatataagtgaccgttttcttcctgataaagcaattgatttgattgatgaagccggatctcgtgttagacttcgccatgcacaactacctgaggaagctagagagcttgagaaagagcttagacagattacaaaagagaaaaatgaagctgttcgcggtcaggactttgaaaaggcaggggagctaagagatagagaaatggatctcaagactcaaatatcggctctaattgataaaaacaaggagatgagtaaagccgagagtgaagcgggtgacgagggtcccacagtgacagaagccgatattcaacatatcgtcgccacatggactggaatacccgtagagaaggtcagcagtgatgagtcagaccgccttctcaaaatggaagacaccctccacacacgaatcatcggtcaagacgaagcggtcaaagccattagccgagccatccgccgagcccgtgtcggtctcaagaaccctaaccgccccatagccagcttcatattttcaggacccacgggtgtcgggaaatccgagcttgcaaaatcattagccgcctactactttggttcagaagatgccatgatccggctcgacatgagtgagttcatggaacgacacaccgtctcgaagctcattggttcacctcccgggtacgttggctacaccgaaggcggtcaattgaccgaggcggtgcgccgacgcccttacaccctggttctttttgatgaaatcgagaaggctcacccggatgtgttcaacatgatgcttcagattcttgaagacggacggttgaccgacagcaaaggacgaacagttgactttaagaacacacttctaatcatgacatcaaatgtaggaagtaacgtgattgaaaaaggtggaagaagaatagggtttgatcttgattatgatgagaaagacaatagctacaacagaatcaaaagtttagttaccgaagaacttaaacagtattttcggccagaatttttaaacagactggatgaaatgatcgtgtttagacagttgactaaactggaagtcaaagaaatagctgacataatgttgaaggaagtatttgagaggctaaaaggtaaagaaatagaactgcaggtgacagaaagatttagggatagggtggtggaagaaggttataaccctagttatggtgcaaggccgctacggagagctataatgaggcttttggaggatagcatggccgaaaagatgcttgcacacgagattaaggagggcgattctgtaattgtggatgttgattcagacggtaatgtgacagttctcaacggtagtagcggaggtccgccagaggaggtgttacctgaaccgattgcagtgtagtagacaaggttaattctagatgttttactttgcatatcttgttagtgtgacggttctcaa

SEQ ID NO: 3174 - DNA, 3320 bp, Manihot esculenta
gaccataaaagaggggcctctctcttcaacgaaggaaaaaaaagaaaaaagaaagacctcttcaggtctctctctctccctctggatttttatttttacttctgttcttcttgatcgttcttctgatcgatttaattcttggaatttttgactgttcttgtgggatatcacatggcaaggcttctggttcattctactaatattcctgccatagcttctggtgtaaagcatggccaatctcaagaatctgaaacatcaagaagggcaaccactaaaatgatgtgtagttcacgatcaccaacattggtattgagaggattctcaggtctgcgaagttcaaactctttagatatgttgctaagatccggacaagatttccattccaaggttggaatcacaatgtcccgcaggcaacagaaggcaaagcggttttcacctagggcaatgtttgaacgcttcacggaaaaagcaattaaagtaatcatgcttgcccaggaggaagcaagacggcttggtcacaactttgttggcacggagcaaattttgctgggtcttattggtgaaggaactggtattgcggcaaaggtgctcaaatctatgggaatcaatctcaaggatgcacgtgtagaagtggagaagataatagggaggggcagtggatttgttgctgtggaaattccatttactcctcgtgcaaagcgtgtgctggaactctcacttgaggaagcccgccagcttggtcacaactatattggatctgagcacttgcttctcgggctgctacgtgaaggtgaaggtgtagcagctcgtgttcttgagaatttaggtgctgacactagcaacatccgcacacaggtcattcgcatggtgggtgaaagcacagaaaatattcctgctcctgttggaccaggaggtggcagcaataagatgcctacacttgaagagtatgggactaatttgaccaagctagcagaggagggtaaactggatccagttgttggaagacagccacaaatagaacgtgtcgtccaaatcttgggtcggcgaactaaaaacaacccctgtcttattggagaaccgggtgttggaaaaacagcaattgcagaaggtctcgctcaacgtatagcaagtggtgatgttcctgaaacaatcgagagaaagaaggtcattaccctggatatgggtcttcttgttgctggaactaagtaccgaggagagtttgaggaaagattgaagaagctaatggaagaaatcaaacaaagtgatgaaataattctttttattgatgaagtgcatacattaattggagctggagcagcagaaggtgcaattgatgcagctaatatcttgaaaccagcgcttgcgagaggtgaattgcagtgtattggagctaccacattggatgaatacagaaagcacattgagaaggaccctgctttggaaagacgattccagccggtcaaagtgcctgagccatctgttgatgaaacaattgagattctgaaagggctgcgagagcgatatgagatccaccacaagctccgttacacagatgaagcactagtatccgctgcacagttgtcatatcaatacatcagtgatcgttttctgcctgataaggcaattgacttgattgatgaagctggttctcgggttcgccttcgtcatgcacaggttcctgaggaagctagggagcttgagaaagaggtcaggcaaataacaaaggagaaggatgaagctgtccgtagccaagactttgaaaaggctggtgaattacgggatcgtgaaatggacctaagggcacaaattgcagctatcgtggagaaaggcaaggagatgagtaaggctgagactgaggcaggggatgtaggtcctattgtcactgaatcagacattcagcacattgtttcttcttggaccggcattcctgttgagaaagtttcaaccgatgaatctgatcgcctcttgaagatggaagagaccttgcacaagagagtcatcggtcaggatgaagctgtcaaagccattagccgtgctattcgccgagcccgtgttggactcaagaaccccaatcgtccaattgctagcttcatattttctggtccaactggcgtagggaagtcagaactggcaaaagcactagctgcttactactttggctctgaggaagccatgatccgccttgatatgagtgagttcatggaaaggcacaccgtctccaagctcataggttcaccccctggttatgttggttacaccgagggagggcagttgacagaggctgttcggcgtcggccttacactgtaatactctttgatgagattgagaaggcccatcctgatgtcttcaacatgatgcttcagattcttgaagatggaaggttgacagacagcaagggtagaacagtggacttcaagaatacccttttgataatgacatcaaatgttggaagcagtgttatcgagaagggaggaagaaggataggatttgaccttgattatgatgagaaggatagcagttacaatcgaataaagagtctggtgacagaggaattgaagcagtatttcaggccagaattcttaaataggttggatgagatgatcgtgtttcggcaactcactaagcttgaggtcaaggagatagctgatataatgttgaaggaggtatttgacaggctgaagggcaaagacatagaacttcaagtgacagagagatttagggagagggtggttgaagaaggatataacccaagctatggggcaaggccattaagaagagccataatgagactgctggaggacagcatggctgagaaaatgcttgcaggagatatcaaagagggtgactcggttatcgtagatgttgattctgatgggaatgttattgtgctcaatggcagcagcggatctcccgagtcattgccagatgtgttgtctatcgtgtaagcccaaagctctggctcccttctcggaaacctttgcccgtgttttgcctgtactgcatggtttaaacttaaatttggcaatgtagttgtagtctgtttagggaaatggccacttggcagtggaattgagccgttgattaatcgcgggctggggtttgaaggctgtaatcatatcaaccatgaatagcataaatagttaggtttgcagataaagtggaatcctggcatttgggttggctcttataataaacggatatagtcatgggtgagtcgtaattttctttttcgtttttaaatttatttttttaattgtgtcgtgtaacggaaaattgtgatatcaacatgcaatgcaatacagtgtttattccttttcct

SEQ ID NO: 3175 - DNA, 3068 bp, Cleome gynandra
agaaaagtaggggctgaaattagaagcttacctcatccatctattctctctctctcttcttcttctgcttcttttgatccagtgttgcgttgccgtcgatcgagagcgtcatggctatggctacaagggcgctggctcaatttactcccccatctctagcttgctaccagagaaatatatcatctcgtgaatctggaagatcaagaaggtcgccaaggatgatgtctagtcagctgcaggcacctgggctgagaatacaagggttcttgggcttacgtgggcagaatgtgttggatactcttggaagatcctctcaagattttcattccaaggtgcggctgacaatgacttcccgaagaagaaagcccagacgttgtatgccaaaagccatgtttgaaaggtttactgaaaaagctatcaaagttataatgctagcccaggaggaagctagaagattgggccacaattttgtaggcactgaacaaattctgctcggtctaattggtgagggtactggaattgctgctaaagttctgaaatccatgggaattaacctcaaagatgcaagggtggaggtagagaagattattggaaggggtagtggatttgttgctgttgagatcccctttactcctcgtgcaaagcgtgttcttgaattatcactggaagaagcccgtcaacttggtcataattacattggatctgagcatcttcttcttgggttgctacgtgagggtgaaggtgttgcagctcgtgtccttgagaacttaggtgctgatcctagtaatatccgcactcaggttatacgcatggttggtgagaacaatgaggtcactgctaatgtcgggggaggaagcagcagcaataagatgccgactcttgaagagtatgggacgaacttgacgaaactagcagaggagggtaaattggacccagtcgtgggaagacagccccagatagaacgcgtggtacaaatccttggcaggagaaccaagaacaatccatgtcttattggagaacctggtgttgggaaaacagctattgcggaaggacttgcacaacgcattgcgagtggggatgttcctgaaaccatcgaagggaagaaggttattacactcgacatgggccttcttgttgcgggaacaaaatatcgtggagagtttgaagagagattgaaaaagcttatggaggagataaaacagagtgacgagataattttgtttattgatgaagtgcacaccctgattggagctggggcagcagaaggtgctattgatgctgctaacattctaaagccagctcttgctagaggtgaattacagtgtattggggcaacaacattagacgaatacagaaagcacatcgagaaagaccctgccttggaaagaagattccagccagtgaaagtacctgaaccttctgtcgatgaaactattcaaattctgaaaggtctgcgtgagcgatatgaaatccatcacaagcttcggtacacagatgaggctctagtcgcagccgcacagttgtcctaccagtacataagtgatcgtttcctgcccgataaggcaattgacttgatcgatgaagctggttctcgggttcgccttcgtcatgcacaggttccagaggaagctaaagagcttgagaaggagctcaggcagatcacaaaggagaagaacgaagccgttcgtggccaggactttgagaaggctgggacacttcgtgatcgagaaattgaacttagagctgagatatctgctatccaagccaaaggaaaagagatgagcaaagccgagagtgagacaggagatggaggtccccttgtgacggaatccgacattcaacacatagtctcttcctggacgggtattcccgtggagaaagtttccactgatgagtctgaccgcctgctcaagatggaagagaccctccacaaacgtgtcattggccaagacgaagctgtcaaagccatcagccgagccatccgccgtgcacgtgtaggacttaagaatcctaaccgtccaatcgccagcttcattttctcaggtccaacaggtgtcgggaaatcagaactagcgaaagctttggcagcttactactttggatccgaagaagccatgatccgtctcgacatgagtgagttcatggagaggcacacagtctcgaaactcattggttcaccaccaggatacgttggttacacagagggtggtcagttaacggaagcagtgagacgccgtccctacactgttgttctcttcgacgagatcgagaaagctcaccccgacgtcttcaacatgatgcttcaaatcctcgaagatgggagactgacagacagcaaaggaagaaccgttgacttcaagaacacacttctaattatgacatcaaacgtcggaagcagcgtaatcgagaaaggaggaaggcgtatcgggtttgacctggacagtgacgagaaagacagcagctacaacaggatcaagagcctcgtgaccgaagaactaaagcaatacttcagaccagagttcctcaacaggctagacgagatgatcgtgttcagacaactaacgaagcttgaagtgaaagaaatagccgacattatgctcaaggaagtgttcgaaagactaaagaagaaagagatcgagctccaagtcacggagaggttcagagagagagttgtggatgaaggatacaacccaagctatggagcgagaccgttgcgaagagcgataatgaggcttctagaggatagcatggcggagaagatgctttcgggagagatcaaggaaaatgactccgttatcgttgacgtagattccgatggaaacgttacggtgctcaacggaagcagtggagctcccaaggctttggaggaagaagactcacttaccgttctctaatgcctttggcaatatattatacaatgtgaatgtgtatatctgatttagtgaaatcgtgttttgggtgcgttgccttaccgttttggattctttcatcaaatgcaacaaatctcaactcattagtcccttgattattgcttgaagcaatcaacatattatccacatataacaaat

SEQ ID NO: 3176 - DNA, 3412 bp, Populus trichocarpa
tatatttctatcccctcctcctcctcccacttgttgagggccttgtatccctctcttcttccatttctctaaagacagaccccttcagactctttcccaaacataacatggctaggcttctagttcattctgctaatattcctgccgtagctccttgtctaaggcattgtcaatttgaagaatctaaaaaacgaagagattcctctgccaaaatgatgtccagctcaccatctcagggtttggtaatgagtggatactcgggattgcgaagtgctaactgtttagatacactgttgagacatggacaatctttccattccaaggttgcaattacaatctctcccaggcagcaaaaggctaagcgatttgtacctagagctatgtttgaacgtttcacagaaaaagcaatcaaagtaatcatgcttgcccaagaggaagcgagacggcttggtcataattttgttggaacagaacaaatcctgttgggtcttattggtgaagggactggaattgctgcaaaggttctcaaatccatgggaattaatcttaaagatgcacgtgtagaagtagagaagattattgggaggggcagtggatttgttgctgtggaaattccattcactcctcgtgccaagcgtgtcctggaactatcattggaggaagctcgccaacttggtcataactacattggatctgagcacttacttctcgggctacttcgtgaaggtgagggtgtagcagcccgtgttcttgagaatttaggcgctgatcctagtaacatccgaactcaggtcattcgcatggtgggcgagagcacggagaacctggctggatccactgttggacctggaagcagtaacaacaagatgcctacacttgaggaatatggaactaatctgactaagctagcagaggagggtaaattggatcctgttgtcggtaggcagccacaaatagaacgtgtcatccaaatcttgggccgaagaactaagaacaacccttgtcttattggagaaccaggggttggaaaaactgcaattgctgaaggtcttgctcagaggatagcaagtggtgatgttcctgagacaattgagggaaagaaggttatcacccttgatatgggccttcttgttgctggaactaaataccgtggagagtttgaggaaagattaaagaagctaatggaggaaatcaagcagagtgatgaaataatgctctttatcgatgaggtgcataccctgataggggcaggagctgcagaaggagctattgatgctgctaatatcttgaaaccagctcttgcaagaggtgaattgcagtgtattggagctacaaccctagatgaatacagaaagcacattgagaaggaccctgctttagaaagacgtttccagccagtcaaagtacctgagccatctgtagatgaaacgatacagattttgaaaggacttcgtgagcgatatgagatccaccacaagctccgttacacagatgagtccttagtagctgctgctcagttgtcataccagtacatcagtgaccgttttctgcctgataaggcaattgatttgattgatgaagctggttctcgggttcggcttcgtcatgcacaggtccctgaggaagcaagagagcttgagaaagaggtcagacaaatcacaaaggaaaaggatgaagctgtccgtggccaagactttgaaaaggctggggaattgcgagacagagaaatggaccttagagcacagattgcagctattgtggagaaaggcaaagagatgagcaaagctgagacagaggcaggggatgtaggtcccactgtcactgaatcagacattcagcacattgtttcttcttggactggaattccagtagagaaagtatccacagacgaatctgaccgtctcctaaagatggaagatacccttcacaagcgagtcgttggccaggatgaagctgtcaaggcaatcagccgtgccatccgccgagctcgtgttggactcaagaatcccaatcgaccaattgctagcttcatattttctggtccaactggtgtcgggaagtcagaattggcaaaagcactagctgcctattactttggctctgaagaagccatgatccgtcttgatatgagtgagtacatggaaagacacactgttgctaagctgattggttcgcctcctggttatgttggttacactgagggtggtcagttgacggaggctgttaggcgtcgtccttacactgtggtactctttgatgagattgagaaggcccatcctgatgtctttaacattatgcttcaaattcttgaagatggaaggttgacagacagcaagggcaggactgtagacttcaaaaacaccctcctgataatgacttcaaatgttggtagcagtgttattgagaagggaggacgcaagattggatttgatcttgattatgatgagaaggatagcagttacaatcggattaagagcctggtgacagaggagttaaagcagtattttaggccggaattcttaaatagattggatgagatgattgttttccgtcaacttaccaagctggaggtcaaggatattgctgatataatgttgaaggaggtctttgagaggttgaaggccaaggaaatagagcttcaagtgacagagagatttagagatagggtggtagatgaagggtataacccagcctatggtgcaaggcctttgagaagagctataatgaggcttctcgaggacagcatggctgagaaaatgctttcagcagagatcaaagaaggtgattctgttattatagatgttgattctgatgggaatgttattgttctcaatggtcaaagtggtggtgctcccgacgccttgccggatgtgttgaatgttgcgtagagctcaactcctttctcagcgaacctttgctagtatgttgtttgtaactccggtattcattcgaattggcaaatagttgtgtagtctgttttattcgaaggactactaggcagtggaactgggagctgtttcttcattgctggctgggtttcaaggctgtatgtattacaccatgatagcttgaatagtttaggggatatggtgtttgggttagctctcttaatgaaattaccactcgtgaaatattgttttatgtaaccgtctcgtaatacaaattgtgattttacttagaaaatggtgttcatgctctctataatggagattgtccttgccattaaaatttcatgatggctaccctcaaaattgtgatcacaaggaatcttcaagattattttttatttgtgccgctcagcatgctttatcatgtactatcattttaccaggcatacaagagatggcaagtgaaggttcttcacgaagtgttcaatatggagcctggatacagaaaaaccatttattgcaaa

SEQ ID NO: 3177 - DNA, 3241 bp, Papaver somniferum
cattttcttcttcttccctctatatctttacggcaacaaaggcgagagacctttaggatctcgttctatatctcaaataaaaaccctagttttcattaaagattcattcaaggggtttacttctctctggattcttaagtctgtttataactggtgagaaccatggccggggctcttgttcaatcgacgaatatccgagcttctatatcttctacatttggcaaaagtcatgacaagaaacaaagaggcagttctggactagccaacagaaggactgttaaaatgttatgtaatagtgttcaaatgcgagggttgagaatctcagcaccatctttgacagtaggaggttttaatgggcttcgaggaactaatgctatagataagttggtattttctggtcatgattttcattacaaggtggcgatttctataggtgcacctcgcggaaggggtagtcggtgtgttgctagagctatgtttgagagattcacagagaaggctattaaagttatcatgcttgcacaagaggaagcaagacggttgggtcataattttgttgggactgagcagatattgttagggcttatcggtgaaggtactggtattgctgcaaaggttcttaaatctatgggaattaatcttaaggatgctcgtgtggaagtagaaaagatcattgggagaggtagtgggtttgttgctgtcgagataccatttactcctcgtgcaaagcgtgttttggaactttcactagaagaagcacgccaacttggacataactatattggctctgagcatttgcttcttggtttacttcgtgagggtgaaggtgtggctgcccgtgtacttgaaaaccttggggccgacccaaacaacatccgcacgcaggttatccggatggttggtgaaagtactgaagctgtaggtgctggcgttggaggaggtagcaccaacagtaagatgcctacactcgaggagtatgggaccaatctaacaaaactggccgaggagggcaaattagatcctgttgttggaagggcagcacaaatagagcgtgtaacccaaattttgggcagacgtacgaagaataacccttgcttgatcggagaacctggtgtgggtaaaactgcaatcgctgaagggcttgctcagagaattgccagtggtgatgtgccagaaacgattgagggaaagaaggttattaccttggatatgggtctccttgtagctggtacaaagtatcgtggagagttcgaagaacgattaaagaagttaatggaagagattaagcaaagtgacgagattatattgtttatagatgaagtacatactttaattggagctggtgcagctgaaggtgcaatcgatgcagcaaacattttgaaaccagctcttgcaagaggtgaactacagtgtattggtgctacaacactggatgaatatagaaagcatatcgagaaggacccagctttagaaagacgatttcagccagtaaaagtgccggaacccactgttgacgagtctatccagattctaaaaggtcttcgtgaaagatatgaaattcatcacaagcttcgttatacagatgaagccttggaagctgcagcacgattgtcataccagtacatcagtgaccgtttcctccctgacaaagcgattgacttgattgatgaagctggttctcgagttcgacttcgtaatgctcagctgcccgaggaagccagagaactcgagaaagagctcaggcaaataacaaaagagaagaatgaggcagttcgtggccaagactttgaaaaggctggagagctgagagacagagagatggacttgagggcccagatcacaaatgttgttgacaagggtaaagagctaagcaaggcagagagtgagtcaggtgatacaggacccgttgttaccgaagtcgatattcagcacattgttgcttcttggactggaatcccagtcgacaaagtctcaagtgacgaatccgataagctccttaagatggaagacacactccacacaagggtcatcgggcaagatgaagctgttaaagctatcagtcgtgcaattcgtcgtgcacgtgttggacttaaaaaccctaatcgtcctattgccagcttcatattctctggacctactggtgttggaaagtcagaattggcaaagacactggcttcttactattttgggtctgaggaggctatgattcgtcttgatatgagtgagttcatggagaggcatactgtctcgaagcttattggatcaccaccaggttatgttgggtacactgaaggtggtcagctgacagaagctgttcgccgcagaccttacacagtggttctttttgatgagatagagaaggctcacccagatgtcttcaacatgatgcttcagattctggaagatgggcgattaactgatagcaagggtagaaccgtggattttaagaacacacttctcataatgacttctaatgtcggaagcaatgtgattgagaagggaggtaggagaataggttttgatctagactacgatgagaaagacagcagctacaacaggatcaagagtctcgtgcaagaggagctgaaacagtatttcagaccagaattcttgaatagattagatgagatgattgttttcagacagctgacaaagttggaagtcaaggagattgcagacataatgctcaaggaggtgtttgaaagactgcgtaagaaggaaatagagcttcaggttactgaaaggtttagagacagagtggttgatgaaggatacaacccaagctatggtgcgaggccgctgaggagagcgattatgagacttttggaggatagcatggcagagaagatgctgggaggagagattaaagagggagattcagtcattgtagacgtagatggtgatggaaatgtcacagtgctcaacggtacatcaccacaactggtctaaaaacatgactaccagaagaatgatatattgtacttggtagtttgttagttccaggtctcttatattttttcttcttttttatccaaaagataaacttggtgttttgatagactttcagttttaagattgtagttcattcaccaatgtcaatgtatgtctattgccaatttcttagctttacgggatagctgattgatattttaatcagttttcatgaacaatgagagatggtctactgaaatttaaccggaaaagggctaattgtaaactgtcaatgaagagctgtactaag

SEQ ID NO: 3178 - DNA, 3050 bp, Eutrema parvulum
acttaggaagtcatggctatggccacaagggtgctggctcaatctactccaccgtctttggcctgttaccagaggaatcttccctctcgtggatctggtagatcgaaaagatcggtgaaaatgatgtgtagtcagctacaagtgtctggtttaagaatgcaagggtttttgggattacgtgggaacaatgtcttagacactctaggaagatcccgtcaagatttcaattcaaaggtgcggcatgcaatgaatgtgcccagagggaaagctagccggtgtgtggcgaaagcaatgtttgagaggtttactgagaaagctatcaaagttattatgcttgctcaggaggaagccagaagactaggccacaattttgtgggaactgaacaaatccttctaggtctcattggcgagggtactggaattgctgctaaagttttgaaatccatggggattaacctaaaagatgcacgagtggaggtagagaagattattggaaggggcagtgggtttgttgctgttgagatcccgtttacccctcgtgcgaagcgtgttcttgaactctcactggaagaagcccgccaactcggtcacaattacattggatccgagcaccttcttcttgggttgctacgagaaggtgaaggtgttgcagcccgagtccttgagaatttaggagcagatcctagtaatattcgcactcaggtgatacgcatggtgggtgagaataatgaggtgacggcaaatgttgggggaggaagcagcagcaataagatgccaactcttgaggagtacgggacaaacttgacgaaactggctgaggagggtaaattggacccagttgttggaaggcagccgcaaatagaacgtgtggtgcaaattcttggcaggagaaccaagaacaacccatgtcttattggagaacctggtgttggtaaaacagctattgcggaaggacttgcacaacgtatcgccagtggagatgttcctgaaaccattgaagggaagaaggttataacacttgacatgggtctcctggttgctggaacgaaatatcgtggagagtttgaagaaagattgaaaaagcttatggaggaaataagacagagtgacgaaatcatcttgttcatcgatgaagtgcatactctgattggggcaggagcagcggaaggtgcaattgatgcagctaacattttaaaaccagctctcgctagaggtgaattgcagtgcattggggctacaacattagatgaataccgaaagcacattgagaaagaccctgcattggaaagaagattccaaccagtgaaagtacctgaacctaccgtggatgaaactattcagatattgaagggtctccgagagcgatatgaaattcaccacaagcttcgctacactgatgattctttagtagcagctgcacaattgtcataccagtatataagtgatcgtttccttcctgacaaggcaattgacttgatagatgaagctggttctcgggttcgacttcgtcatgcacaggtcccggaggaagctagggagcttgagaaagagcttaggcagataacaaaggagaagaatgaagctgtccgtggccaggactttgagaaggctgggacacttcgtgatagagaaatcgagctcagagctgaggtatctgctatccaagctaaaggcaaggagatgagcaaagcagagagtgagactggtgaggaaggtcctatggtgacggagtcagacattcaacacattgtctcttcatggactggtatccccgtagagaaggtatcaaccgatgagtctgatcgcctcctcaagatggaagaaaccctccacaaacgtgtcataggccaagacgaagctgtcaaagccatcagccgagcgattcgccgtgcacgtgttgggcttaagaacccgaaccgtccaatagccagtttcatattctctggtcctaccggtgttgggaaatcagagcttgccaaagctttggcagcctattactttggatctgaagaagccatgattcgtctagatatgagtgagttcatggagaggcacactgtctcaaaacttatcggttcacctcctggatacgtcggttacaccgaaggaggtcagctaacagaagcagttagacgtcgcccttacacagtcgtcctattcgacgagatcgaaaaagcacacccagatgtcttcaacatgatgcttcagatccttgaagatggtagattaacagatagcaaaggaagaacagttgacttcaaaaacacgcttctcatcatgacatcaaacgttggaagcagcgtgatcgagaaaggaggaagacgtatcggtttcgacttagactacgacgagaaagacagcagttacaacagaattaagagccttgtaaccgaggagctgaaacagtacttcagaccggagttcctcaacaggctagacgagatgattgtgttcagacagctaacgaagctggaagtgaaagaaattgcagacatactgttgaaggaagtgtttgagaggctgaagaagaaggagattgagcttcaagtgactgagagattcagagagagagtagtggacgaaggttataacccgagctatggagcgagaccattgagaagagccatcatgagacttttagaggatagtatggcagagaagatgcttgcgagagagatcaaagaaggagactcagtgattgtggacgttgactctgaaggtaaagtcactgtgctaaatggtggaagtggcactcccactacttccttggaggagcaggaagattctctccctgttgcttgaaataaaaggggaagtgtgtttatctcttcttttgcttttgccccttaaacgaattatggcaagagaagggtctcaatgagatttggggtttcgtaatatacattttctaaatatataaaaaatgtaatgtatagatgacattgtgtagcttctttttcaatgctttttaaggacttgcgttggtgtcaatgggtgctttaacacgggtttataattaccaagttggattggtttgtgtgtgattatag

SEQ ID NO: 3179 - DNA, 3051 bp, Eutrema parvulum
gaagtcatggctatggccacaagggtgctggctcaatctactccaccgtctttggcctgttaccagaggaatcttccctctcgtggatctggtagatcgaaaagatcggtgaaaatgatgtgtagtcagctacaagtgtctggtttaagaatgcaagggtttttgggattacgtgggaacaatgtcttagacactctaggaagatcccgtcaagatttcaattcaaaggtgcggcatgcaatgaatgtgcccagagggaaagctagccggtgtgtggcgaaagcaatgtttgagaggtttactgagaaagctatcaaagttattatgcttgctcaggaggaagccagaagactaggccacaattttgtgggaactgaacaaatccttctaggtctcattggcgagggtactggaattgctgctaaagttttgaaatccatggggattaacctaaaagatgcacgcgtggaggtagagaagatcattggaaggggcagtggatttgttgctgttgagatcccattcactcctcgtgccaagcgtgttcttgaactctcgctcgaagaagctcgccaactcggtcacaattacattggatccgagcaccttcttcttgggttgctacgtgaaggtgaaggtgttgcagctagagtccttgagaatttaggtgcagatcctagtaatattcgcactcaggtgatacgcatggtgggtgagaataatgaggtgacggcaaatgttgggggaggaagcagcagcaataagatgccaactcttgaggagtacgggacaaacttgacgaaactggctgaggagggtaaattggacccagttgttggaaggcagccgcaaatagaacgtgtggtgcaaattcttggcaggagaaccaagaacaacccatgtcttattggagaacctggtgttggtaaaacagctattgcggaaggacttgcacaacgtatcgccagtggagatgttcctgaaaccattgaagggaagaaggttataacacttgacatgggtctcctggttgctggaacgaaatatcgtggagagtttgaagaaagattgaaaaagcttatggaggaaataagacagagtgacgaaatcatcttgttcatcgatgaagtgcatactctgattggggcaggagcagcggaaggtgcaattgatgcagctaacattttaaaaccagctctcgctagaggtgaattgcagtgcattggggctacaacattagatgaataccgaaagcacattgagaaagaccctgcattggaaagaagattccaaccagtgaaagtacctgaacctaccgtggatgaaactattcagatattgaagggtctccgagagcgatatgaaattcaccacaagcttcgctacactgatgattctttagtagcagctgcacaattgtcataccagtatataagtgatcgtttccttcctgacaaggcaattgacttgatagatgaagctggttctcgggttcgacttcgtcatgcacaggtcccggaggaagctagggagcttgagaaagagcttaggcagataacaaaggagaagaatgaagctgtccgtggccaggactttgagaaggctgggacacttcgtgatagagaaatcgagctcagagctgaggtatctgctatccaagctaaaggcaaggagatgagcaaagcagagagtgagactggtgaggaaggtcctatggtgacggagtcagacattcaacacattgtctcttcatggactggtatccccgtagagaaggtatcaaccgatgagtctgatcgcctcctcaagatggaagaaaccctccacaaacgtgtcataggccaagacgaagctgtcaaagccatcagccgagcgattcgccgtgcacgtgttgggcttaagaacccgaaccgtccaatagccagtttcatattctctggtcctaccggtgttgggaaatcagagcttgccaaagctttggcagcctattactttggatctgaagaagccatgattcgtctagatatgagtgagttcatggagaggcacactgtctcaaaacttatcggttcacctcctggatacgtcggttacaccgaaggaggtcagctaacagaagcagttagacgtcgcccttacacagtcgtcctattcgacgagatcgaaaaagcacacccagatgtcttcaacatgatgcttcagatccttgaagatggtagattaacagatagcaaaggaagaacagttgacttcaaaaacacgcttctcatcatgacatcaaacgttggaagcagcgtgatcgagaaaggaggaagacgtatcggtttcgacttagactacgacgagaaagacagcagctacaacagaattaagagccttgtaaccgaggagctgaaacagtacttcagaccggagttcctcaacaggctagacgagatgattgtgttcagacagctaacgaagctggaagtgaaagaaattgcagacatactgttgaaggaagtgtttgagaggctgaagaagaaggagattgagcttcaagtgactgagagattcagagagagagtagtggacgaaggttataacccgagctatggagcgagaccattgagaagagccatcatgagacttttagaggatagtatggcagagaagatgcttgcgagagagatcaaagaaggagactcagtgattgtggacgttgactctgaaggtaaagtcactgtgctaaatggtggaagtggcactcccactacttccttggaggagcaggaagattctctccctgttgcttgaaaataaaaggggaagtgtgtttatctcttcttttgcttttgcccccttaaacgaattatctggcaagagaagggtctctcgatgagacatttgggggttttcgtaatatacattttctaaatatatgaagaaaaaatgtaatgtatagatgacattctgtagcttctttttcaatgctttttaaggacttgcgttggtgtcaatgggtgctttaacacgggtttataattaccaagttggattggtttgtgtgtg

SEQ ID NO: 3180 - DNA, 2874 bp, Cleome spinosa
ccgtcgattcagagcatcatggccatggctacaagggtgctggctcaatctactccgccatctctagcttgctaccagaggaatataccatctcgcgaatctggaaggtcaagaaggtcgtcaccaaggatgatgtctagccaggtgctgtcacctgggttgagaatacaagggttcctgggcttacgtggacagaacgtgctggatactctcggaagatcacaccaagatttccattctaagattcggcttgcaatgacttcccgaagaggaaagcccacccgttccacgccaacagccatgtttgaaaggtttactgaaaaagctatcaaagttattatgctcgcccaagaggaagctagaaggctgggccacaattttgtgggaactgaacaaatccttctgggtctcattggtgagggtactggaattgctgctaaagttctgaaatccagtggggatcaacctgaaagacgcaagggtggaggtagagaagattatcggtaggggcagtggattcgttgctgttgaaatcccctttactcctcgtgcaaaacgtgttcttgaactatccctagaagaagcccgtcaacttggccataattacatcggatctgagcaccttcttcttgggttgctacgtgagggtgaaggtgtggcagctcgtgtacttgagaacttaggtgcggatcctagtaatattcgcacgcaggttatacgcatggttggtgagaacaatgaggtcacagctaatgttgggggaggaagcagtggcaataagatgccgacacttgaagagtatggaacgaacttgacgaaactagcggaggagggtaaattggacccagttgtcggaaggcagcaacagatagaacgcgtcgtacaaatccttggcaggagaaccaagaacaacccatgtcttatcggagaacctggtgtcggaaaaacagccattgccgaaggacttgctcagcgcatttcgagtggggatgttcccgaaaccattgaggggaagaaggttatcaccctcgacatgggtcttcttgttgctggaaccaaataccgtggagaatttgaagagaggttgaaaaaattgatggaggagatcaaacagagcgacgagataatcttattcatcgatgaagttcacaccttgatcggagctggagcagcagaaggtgcaatcgatgctgctaacattctaaagccagctcttgctagaggtgaattacagtgtatcggggcaacaacattagacgaatacaggaagcatattgagaaagaccctgccttggaaagaagattccagccagtgaaagtgcctgaaccgtccgtcgacgaaactattcagatcctaaaagggctacgagagcgatacgagatccatcacaagcttcgttacactgacgaggctttagtggcagctgcacaattgtcctaccaatacatcagcgatcgtttccttcccgacaaggccatcgacttgatcgatgaagctggttctcgggttcgactccgtcatgcacaggttcccgaggaagcaaaagagctcgagaaggagctcaggcagatcactaaggagaaaaacgaagccgttcgcggtcaggactttgagaaggctgggacgcttcgtgatcgggaaatcgaattaagagccgaggtatctgctatccaagccaaaggcaaggagatgagcaaagctgagagcgaaacgggagatggaggtcccctcgtgacggaatcggacattcaacatatcgtgtcttcgtggacaggtattcccgtggagaaagtttcgaccgacgagtctgatcggttgctcaagatggaagagacactccataaacgtgtcgtcgggcaagacgaagctgtaaaagccatcagccgagccataaggcgtgcccgtgttggactcaagaaccctaatcgcccgatagccagcttcatcttctcgggtcccactggtgtcgggaaatcggaacttgcgaaagctttggccgcatactactttggatccgaagaagccatgatccgtcttgacatgagcgagttcatggagagacacaccgtctcgaaactcattgggtcaccgcccggatatgtcggatacacggagggcgggcagttgaccgaagctgtcagacgccgtccctacacagtcgtgctgttcgatgagatcgagaaagctcatccggacgtcttcaacatgatgcttcaaatcctcgaagacgggagactaacagacagcaagggaagaacggtggatttcaagaacacgctcctgatcatgacatcgaacgtcgggagcagcgtgatcgagaaaggaggaagaaggatcgggttcgacctcgagagcgatgagaaagacagcagctacaaccgaataaagagcctagtgacggaggaactgaaacagtacttcagaccggagttcctgaacaggctggacgagatgatcgtgttcagacaactgacgaagatggaggtgaaggagatcggggacataatgctgagggaagtgttcgagagattgaagaagaaggagatcgagctgcaagtgacggagcggttcagggagagggtggtggaagaagggtataaccctagctatggagccaggccgttgcggagagcgatcatgcggcttctcgaagacagcatggccgagaagatgctctccggtgagatcaaggagggtgactccgttatagttgacgttgactccgacggcaatgtgacggtgcttaacggaagcagtggagctcctcccaaggctttggaggaagaagacccactccccgttgtgtaatgcttcttatattatgtattatgtgtacgagataaacttttaaaaaaacaaaccaacttatttta

SEQ ID NO: 3181 - DNA, 3042 bp, Cleome gynandra
tctacaaaaagaaagaacaatgaaagggtagatagggcctgaaattacaagctcaccacatccatactctctctctccttgttcttcatcatccttgtctctcgattcagtgtcttgttccctcgattaagaatatcatggctatggctacaagagtgctggctcaatctacgcctccatctttagcttgctaccagaggaatataccatcccgtgaatctggaagatcaagaagatcagcaaggatgatgtctagccaggcgcaagcacctgggttgagaatacaagggttcttgggtttacgtggacaaaatgtcttagatactctgggaagatcctgtcaagatttccattctaaggtgcgccttgctatgacttcaccaagaggaaagcccagacgttgtatgccaaaagcaatgtttgaacggtttactgaaaaagctatcaaagttattatgcttgcccaagaagaagctagaagactgggccacaattttgttggcactgagcaaatccttctgggtctcattggtgagggtactggaattgctgccaaagttctgaaatccatgggaatcaacctaaaagatgcaagggtggaggtggaaaagattattggtaggggcagtggatttgttgctgttgagattccatttactcctcgtgcaaagcgtgttcttgaactatcactagaagaagcccgtcagcttggtcataattacattggatctgagcaccttcttctggggttgctacgtgagggtgaaggtgttgcagctcgagtccttgagaatttaggtgctgatcctagtaatatccgcactcaggttatacgcatggtgggtgagaacaatgaggtcactgctaatgttgggggaggaagcagcagcaataagatgccgactcttgaggagtacggaacaaacttgacaaaactagcagaggagggtaaattggacccagttgttggaaggcagcaacagatagaacgtgtagtacaaatccttggcaggagaactaagaacaacccatgtcttattggagaacccggggttggaaaaacagctattgctgaaggacttgctcagcgcattgcgagtggggatgttcctgaaacaattgaggggaagaaggttattaccctggacatgggtcttcttgttgctggaaccaaatatcgcggagagtttgaagagagattgaaaaagcttatggaggagataaaacagagtgacgagatcatcttatttatcgatgaagtgcacaccttgattggagctggagcggcagaaggtgcaattgatgctgctaacattctaaagccagctcttgctagaggagaattgcagtgtattggtgcgacaactttagatgaatacagaaagcacatcgaaaaagaccctgccttggaaagaaggtttcagccggtgaaagtacctgagccttctgtagatgaaactattcagattttgaaaggtctaagagagcgatatgaaatccaccacaagcttcgttacactgatgaggctttagtcgcagctgcacagttgtcctatcagtacataagcgatcgtttccttcctgataaggcaattgacttgattgatgaagctggttctcgggttcgccttcgtcatgcacaggttcctgaggaggctaaagagctcgagaaggagcttaggcagatcacgaaggagaaaaatgaagctgttcgtggccaggactttgagaaggctgggacacttcgtgatcgggagattgaactaagggctgagatatctgctatccaagccaaaggcaaggagatgagcaaagccgagagtgagacaggagatggaggtccccttgttacagaatccgacatccaacacattgtctcttcgtggacgggtattccagtggagaaagtttcaaccgatgagtctgatcgccttctcaagatggaagagaccctccacaaacgtgtcatcggccaagacgaagccgtcaaagccatcagccgagccattcgtcgtgcacgtgttggactcaagaaccctaaccgtccaatagccagtttcatcttctcaggtcccactggtgtcggaaaatcagagcttgcaaaagctttggcagcttactactttggatccgaagaagccatgatccgtcttgacatgagtgagttcatggagaggcacactgtctcaaaactcatcggttcaccacctggatacgttggttacaccgagggcggtcagttaacagaagcagtcaggcgacgtccctacactgtcgttctgttcgacgaaatagagaaagcccatcctgacgtcttcaacatgatgcttcaaatccttgaagacgggagactgacggacagcaaaggaagaacagtcgacttcaagaacacgcttctgatcatgacatcaaatgttggaagcagcgtgattgagaaaggaggaaggcgcatcgggtttgacctggacagcgacgagaaagacagcagctacaacagaatcaagagccttgtgactgaggaactgaagcagtacttcagaccagaattcctaaacaggctcgatgagatgatcgtgttcagacaactgacgaagctcgaagtgaaggaaatagctgacataatgctcaaggaagtattcgacagattgaagaagaaagagattgaactccaagtcacagaacgattccgagagagagttgtcgaagaagggtacaacccgagctacggagcaaggccattgagaagggccataatgcggctcctggaagatagcatggcagagaagatgctgtcgggagagatcaaggagggagactcggtcatcgttgatgttgactctgaaggtgaagtaacagtgcttaacggaagcagtggagctcccaaggctttggaggaagaagatcctcttcccattgtctaatgctcctgatattattatatgtgtaatgcgtttgtatagaagacagtacaaaaatagtttgccatcctagtctcaactctttcttttgttattatttattattaaatcataattttcatgg

SEQ ID NO: 3182 - DNA, 3735 bp, Cajanus cajan
atttcatggttaaatgcagccatcaattcaggaatcatggctagggttctggctcagtctattagtatgcctggcctgctgagtgggcaaaggcatgatcagcataagggatcaggaaaactaaaaagatctgtcaaaatgatgagtagcttacgagtgcctgcattaagaatgtctggtttctctggattacgtagtcttaatactttggattatctgtcgaggccacgacaaaatttccactccaagatgttgactacaacttcttctcgccgcgaaagggcgaaacgatgtgtacctaaagcaatgtttgagcgtttcacggaaaaagcaataaaagtaattatgttagctcaggaggaagcaagacggctgggtcacaattttgttggaacggaacagattctattgggtcttattggtgaaggcactggtattgctgctaaggttctgaagtcaatgggaattaaccttaaggatgctcgagtagaagtggaaaagataattggaaggggtagtggatttgttgcagttgagattccatttactccccgcgcgaagcgtgttttggagctctcactggaggaggctcgccaacttggtcacaattatattggatctgagcacttgcttcttggtcttcttcgagagggtgagggtgtagcagcacgtgttcttgaaaatttgggtgctgatccaaataatattcgtgctcaggttatacgcatggttggtgagggtgctgacagtgttggagctactgttggccctggaagtagtaataacaataagatgccaactttggaggagtatggcaccaatttgactaagctagcagaagagggaaaattggatcctgttgtgggtaggcagccacaaattgaacgtgtcactcaaattttgggtcgccgaaccaaaaataatccatgtcttattggagaacctggtgttgggaagacagctattgctgaaggccttgcccaaaggattgcaaatggtgatgttcctgaaacaatagagggaaagaaggttataacccttgatatgggtctactggtagctggaactaaatatcgaggagaattcgaggagagattgaagaaactaatggaggaaattaaacaaagtgacgagataatactttttattgatgaagtgcatactttaattggagctggagcagctgagggggcaattgatgctgcaaacatattaaaaccagctcttgccagaggtgaactacagtgtataggagccacaacactggatgaatataggaagcacattgaaaaggatccagctctggagaggcgattccagccagttaaggtgccagagccaactgtggatgaaaccatacaaatactgaaaggacttagagaacgctatgagattcaccacaagctccgttatacagatgatgctcttatagctgctgcacagctgtcacaccaatatattagtgatcgatttttgcccgacaaagctatagatttaattgatgaagctggttcccgagtccggcttcaacatgcacagttacctgaagaagcaagagagcttgacaaggaggtcaggcagattgtgaaggagaaagaagaagctgttcgcaatcaagactttgagaaggctggagagttacgagatagagaaatggatcttaagacacagatatcagcacttatagaaaagggcaaggagatgagcaaggcagagagcgaggcaggagatggaggtccatcggtgactgaagttgacatacaacatattgtctcctcctggactggtattcctgtggagaaagtctcaactgacgaatctgatcgcctcctcaagatggaagagactttacacaagcgagtcattggtcaggatgaagcagtaaaagccattagccgggctatccgtcgagccagggttggactgaagaaccctaatcgtccaattgccagcttcatcttttctgggccaacgggtgtgggtaagtctgagttggccaaagcattggctacatactactttggttcggaagaagccatgattcggcttgacatgagtgaatttatggaaaggcacacggtctccaaactcataggttcacctcctggatatgttggttacactgagggtggccaacttaccgaggcagttcggcgtcgtacacggttgtactgtttgatgagattgagaaagcccatcctgatgtattcaacatgatgcttcagatccttgaagatggaagactaacagacagcaagggaagaacggtggacttcaagaacactcttcttataatgacatcaaatgttggaagcagtgtgattgagaaaggaggccgtaaaataggattcgaccttgattatgatgagaaggatagcagttacaatcgaatcaagagcttggtgactgaggagctgaagcaatactttaggccagaattcttgaatagattggatgaaatgattgttttcaggcaactcacaaagctggaggtgaaggagatagctgacataatgctgaaggaggtgtttgatagactgaaagacaaagagattgatctttcagtgacagaaagatttagggagagggtggttgatgaaggatacaatcctagttatggggctaggcctctgagaagagccataatgcgacttttggaggacagcatggctgagaagatgcttgccagagagattaaagagggtgactcagttatagtggatgctgattctgacggtaatgtgattgtgctcaacgggagtagtggtgccccagagtccctagcagaaactcttcctgtgtaacgtgtttgcctttgctgagttgtacttttttttttttttttttttcatttaaaaacgtagttatagtttgtttttgttgtcaaaggacctaaagcttttttttattgaatgctggtagtctcgggcacgttttgaccagaaccaacacagcaaggtttgggagaaagaaaaatgacgctatgtctgtcggtcgttccttggatatgttacattaatcaataattttaatttgtttaaagcaagaaatttaaagttttcaccgttcttcaggccagcatgcgatgatgttacatcttaattttagtaagttggattgagaacaaatgttttgatatcactttgcccccatgggtgacttgatcaattttgaaatgcgtcttttgattacaaaaagagtacaaattatcccagtgagataatgcctgattttgatcatacgaacttgggtcagagaatcgcaaatatatcctaaaggacccgtttgttggccaatggagaaactctgttacgagaattctcatgctccaatgaacatatttaaatgggacagctgttagacccccccactcccgaacctatatttcacttacacttcgtagaataaaaaaaactaaataaaaaacaccctttgggtgatattggctgttatattttgtgatccactcaaatttctaacctaatgatacttggtagcgtaaaatctatggatttgctgtttctattgatctattattggatgagacgacccttgtgtggggcttatcattggatgagatgggcttatcattggatgagatgggcttattattggatgtgatgacctttgtgtgggactgacacttccaccacggctaatcttcaatgctgttaatgctttctggatttccatagtcatggcactatctacactcccagatgatagctttctgtg

SEQ ID NO: 3183 - DNA, 3155 bp, Arabidopsis lyrata
agagagagagataagggagggtgaaacaaaataagcacacaccaccatatccatctgtttttttttttcttttcatttgtctctctcttcttcttcttcgattcgttttttcctccatttgatcctctgttacgcttcaatcgaactcggaagtcatggctatggccacaagggtgctggctcaatctactccaccatctttggcttgttaccagaggaatgttccctcccgtggatctggaagatcgagaagatcggtgaaaatgatgtgtagtcagttacaagtttctggattaaggatgcaaggatttttgggattacgtgggaacaatgctttagacactctagggaaaaaccgtcaagatttccattcgaaggtgcggcaggcgatgaatgtgcccaaggggaaagctagccggtttacggtgaaagcaatgtttgaaagatttactgagaaagctatcaaagttattatgcttgctcaggaggaagctagaagactaggccacaattttgtgggaaccgaacaaattcttctaggtctcattggtgagggtactggaattgctgctaaagttttgaaatccatggggattaacctaaaagatgcacgtgtggaggtggagaagattattggaaggggcagtggctttgttgctgttgagatcccattcactcctcgtgcaaagcgtgttcttgaactctcactggaagaagctcgccaacttggtcacaattacattggatccgagcaccttcttcttggattgctacgtgaaggtgaaggtgttgcagctcgtgtcctggaaaatttaggtgcagatcctagtaatattcgcactcaggtgatacgcatggtgggtgagaacaatgaggtaactgctaatgttgggggaggaagcagcagcaataagatgccaactcttgaagagtacgggacaaacttgacgaaactggctgaggagggtaaattggacccagttgttggaaggcagccacagatagaacgtgtggtacaaattcttggcaggagaaccaagaacaacccttgtcttattggagaacctggtgttggtaagacagctattgctgaaggacttgcacagcgtatagccagtggagatgttcctgaaaccattgaagggaagaaggttataacacttgacatgggtcttctagttgctggaacaaaatatcgtggagagtttgaagagagattaaagaagcttatggaggaaataagacagagcgacgagataatcttatttatcgatgaagtgcatactttgattggggctggagcagcggaaggtgcaattgatgcagctaacattttaaaacctgctctcgctagaggtgaattacagtgcattggagcgacaacattagatgaataccgaaagcacattgagaaagatcctgcgttggaaagaagattccagccggtgaaagtacctgaacctaccgtggatgaaactattcagattcttaagggtctgcgagagagatatgaaattcaccataagcttcgttacactgacgattctttagtagcagctgcacagttgtcataccagtatattagtgatcgtttccttcctgacaaggcaattgacttgatcgatgaagctggttctcgggttcgacttcgtcatgcacaggtccctgaggaagctagggagcttgagaaggagcttaggcagataacaaaggagaagaatgaagctgtccgtggccaagactttgagaaggctgggacacttcgggatagagaaattgaactcagagctgaggtatctgctatccaagcgaaaggcaaggagatgagcaaagcagagagtgagactggtgaggaaggtcctatggtcacggagtcagacatccaacacattgtatcttcatggactggtattcccgtagagaaagtatcaactgatgagtctgatcgcctcctcaagatggaagaaaccctccacaaacgtatcataggccaagacgaagctgtgaaagccataagccgagccattcgccgtgcacgtgttggactcaagaaccctaaccgtccaatagctagtttcatattctcgggtccaaccggtgttgggaaatccgagcttgccaaagctttggcagcttactacttcggatctgaagaagccatgattcgtctagatatgagtgagttcatggaaaggcacaccgtctccaaactcatcggttcacctcctggatacgtcgggtacaccgaaggaggtcagctaacagaagcagttaggcgtcgcccttacaccgtcgttctattcgatgagatcgaaaaagcccatccagatgttttcaacatgatgcttcagatccttgaagacggtagattaacagacagcaaaggaagaacagttgacttcaaaaacacacttcttatcatgacatcaaacgtcggaagcagcgtgatcgaaaaaggaggaagacgtatcgggttcgacttagactacgacgagaaagacagcagttacaacagaatcaagagccttgtgaccgaggagctgaaacagtacttcagaccagagttcttgaacaggctagacgaaatgattgtattcagacagctaacaaaactggaagtgaaagaaattgctgacatactgttgaaggaagtgttcgagaggttaaagaagaaggagatcgagctccaggtgactgagaggttcaaagagagagtagtagacgaaggttataacccgagctacggagcaagaccgttgagaagagccatcatgaggcttttagaggatagtatggcagagaaaatgcttgcgagagagattaaagaaggagactcggtgattgtggacgttgacgctgaaggcaacgtcacagtgctaaatggtggaagtggcactccaactacttccttggaagagcaggaagattctctccccgttgcttgaataaaaaaaaggcaaagtgcgtttctcttcttttgctttggcccctaaatgaagtatggcaagagaaggttatgaattgagatatttgggggctttcttaatatacattttctaaatatatgaaaaaaatgtaatgtatagatgacattgtgtagcttcttctcttcttccatgctttttaaggactttgctttggtgccatgcgaagag

SEQ ID NO: 3184 - DNA, 3183 bp, Arabidopsis lyrata
gagagagagagagataagggagggtgaaacaaaataagcacacaccaccatatccatctgtttttttttttcttttcatttgtctctctcttcttcttcttcgattcgttttttcctccatttgatcctctgttacgcttcaatcgaactcggaagtcatggctatggccacaagggtgctggctcaatctactccaccatctttggcttgttaccagaggaatgttccctcccgtggatctggaagatcgagaagatcggtgaaaatgatgtgtagtcagttacaagtttctggattaaggatgcaaggatttttgggattacgtgggaacaatgctttagacactctagggaaaaaccgtcaagatttccattcgaaggtgcggcaggcgatgaatgtgcccaaggggaaagctagccggtttacggtgaaagcaatgtttgaaagatttactgagaaagctatcaaagttattatgcttgctcaggaggaagctagaagactaggccacaattttgtgggaaccgaacaaattcttctaggtctcattggtgagggtactggaattgctgctaaagttttgaaatccatggggattaacctaaaagatgcacgtgtggaggtggagaagattattggaaggggcagtggctttgttgctgttgagatcccattcactcctcgtgcaaagcgtgttcttgaactctcactggaagaagctcgccaacttggtcacaattacattggatccgagcaccttcttcttggattgctacgtgaaggtgaaggtgttgcagctcgtgtcctggaaaatttaggtgcagatcctagtaatattcgcactcaggtgatacgcatggtgggtgagaacaatgaggtaactgctaatgttgggggaggaagcagcagcaataagatgccaactcttgaagagtacgggacaaacttgacgaaactggctgaggagggtaaattggacccagttgttggaaggcagccacagatagaacgtgtggtacaaattcttggcaggagaaccaagaacaacccttgtcttattggagaacctggtgttggtaagacagctattgctgaaggacttgcacagcgtatagccagtggagatgttcctgaaaccattgaagggaagaaggttataacacttgacatgggtcttctagttgctggaacaaaatatcgtggagagtttgaagagagattaaagaagcttatggaggaaataagacagagcgacgagataatcttatttatcgatgaagtgcatactttgattggggctggagcagcggaaggtgcaattgatgcagctaacattttaaaacctgctctcgctagaggtgaattacagtgcattggagcgacaacattagatgaataccgaaagcacattgagaaagatcctgcgttggaaagaagattccagccggtgaaagtacctgaacctaccgtggatgaaactattcagattcttaagggtctgcgagagagatatgaaattcaccataagcttcgttacactgacgattctttagtagcagctgcacagttgtcataccagtatattagtgatcgtttccttcctgacaaggcaattgacttgatcgatgaagctggttctcgggttcgacttcgtcatgcacaggtccctgaggaagctagggagcttgagaaggagcttaggcagataacaaaggagaagaatgaagctgtccgtggccaagactttgagaaggctgggacacttcgggatagagaaattgaactcagagctgaggtatctgctatccaagcgaaaggcaaggagatgagcaaagcagagagtgagactggtgaggaaggtcctatggtcacggagtcagacatccaacacattgtatcttcatggactggtattcccgtagagaaagtatcaactgatgagtctgatcgcctcctcaagatggaagaaaccctccacaaacgtatcataggccaagacgaagctgtgaaagccataagccgagccattcgccgtgcacgtgttggactcaagaaccctaaccgtccaatagctagtttcatattctcgggtccaaccggtgttgggaaatccgagcttgccaaagctttggcagcttactacttcggatctgaagaagccatgattcgtctagatatgagtgagttcatggaaaggcacaccgtctccaaactcatcggttcacctcctggatacgtcgggtacaccgaaggaggtcagctaacagaagcagttaggcgtcgcccttacaccgtcgttctattcgatgagatcgaaaaagcccatccagatgttttcaacatgatgcttcagatccttgaagacggtagattaacagacagcaaaggaagaacagttgacttcaaaaacacacttcttatcatgacatcaaacgtcggaagcagcgtgatcgaaaaaggaggaagacgtatcgggttcgacttagactacgacgagaaagacagcagttacaacagaatcaagagccttgtgaccgaggagctgaaacagtacttcagaccagagttcttgaacaggctagacgaaatgattgtattcagacagctaacaaaactggaagtgaaagaaattgctgacatactgttgaaggaagtgttcgagaggttaaagaagaaggagatcgagctccaggtgactgagaggttcaaagagagagtagtagacgaaggttataacccgagctacggagcaagaccgttgagaagagccatcatgaggcttttagaggatagtatggcagagaaaatgcttgcgagagagattaaagaaggagactcggtgattgtggacgttgacgctgaaggcaacgtcacagtgctaaatggtggaagtggcactccaactacttccttggaagagcaggaagattctctccccgttgcttgaataaaaaaaaggcaaagtgcgtttctcttcttttgctttggcccctaaatgaagtatggcaagagaaggttatgaattgagatatttgggggctttcttaatatacattttctaaatatatgaaaaaaatgtaatgtatagatgacattgtgtagcttcttctcttcttccatgctttttaaggactttgctttggtgccatgcgaagagttttttatttttaatattgggtttc

SEQ ID NO: 3185 - DNA, 3168 bp, Phaseolus vulgaris
gtaatgtactttaacaggtgagataaacaagcttcgtgcgtgcaatcgagaaaccactgttatcttcgccgcccaccacgccttctctctatatcccttctttttcactgcaacaatataggaataatggctagggttttggctcagtctatcggtatgcctggcctactgagtgggcaaaggcatgggcagcataagggatcaggaaaatcaagaaggtctctcaaaatgatgagtagcttacaaatgcctgcattaagaatgtcaagtttctctggactgcgtactgtgaacaatttggatcttctttcgagatctcgacgaagtttaccttctaagatgttgacttcaacttcttctcgtcgtgaaagggctaaaagattcgtacccagagcgatgtttgagcgtttcactgagaaagcaatcaaagtaattatgctagcccaggaggaagctaggcggctgggacataattttgttggaacagaacagattttattaggtcttatcggtgaaggcactggcattgctgccaaggtgctgaagtcaatgggaattaacctgaaggatgctcgtgtggaagtggaaaagataattggaaggggcagtggatttgttgcagttgagattccatttactccccgtgcaaaacgtgttttggaactctcactagaggaagctcgccaacttggtcacaattatattggatctgagcacttgcttcttggtcttctacgagagggtgagggtgtagcagcacgtgttcttgaaaatttgggtgctgatccaaacaatattcggtctcaggttattcgcatggttggtgagggtgctgacagtgttggtgctactgttggtcctggaagtagtaataacaataagatgccaactttggaggagtatggcaccaatttgactaagctagctgaagagggaaaattggatcctgttgttggtagacaaccacaaattgaacgtgtcactcaaatcttgggtcgtcgtaccaaaaataatccttgtcttattggagaacctggggttgggaagacagctattgctgaagggcttgcccaaaggattgcaaatggtgatgttcctgaaaccatagaggggaagaaggttataacccttgatatgggtctactggtagctggaactaaatatcgtggagaatttgaggagagattgaagaaactgatggaggaaatcaaacaaagtgatgagataatactttttattgatgaagtacacactctaattggagctggagcagctgagggggcaattgatgctgcaaacatactaaagcctgctcttgccagaggtgaactgcagtgtattggagccacgaccctggatgaatataggaagcacattgaaaaggatccagcactggagaggcgattccagccagttaaagtgccagagccaactgtagatgaaaccatacaaatattgaaagggcttagggaacgctacgagattcatcacaaactccaatacacagatgatgcacttgtagctgctgcccagctgtcacaccagtatattagtgatcgatttttgcccgacaaagctatagatttaattgatgaagcaggttcccgtgttcggcttcaacatgcgcagttaccagaagaagcaagagagcttgataaggaggtcagacagattgtaaaggataaagaagaagctgttcgcaatcaagactttgaaaaggctggagggctacgagataaagaaatggatcttaaggcccaaatatccacacttatagaaaaaggcaaggagatgagcaaggcagaaatggaggcaggagatggatgtcccatggtgactgaagttgacatacagcatattgtctcctcctggacaggtattccggtagagaaagtctcaactgacgaatctgatcgcctactcaagatggaagagactttacacacacgagtcataggtcaggatgaagcagtaaaagcaattagccgggccatccgtcgagctagggtgggattgaagaatcctaatcgaccaattgccagcttcatcttttctgggccaactggtgtggggaagtctgaattggctaaagctttggctgcatactattttggttctgaagaagccatgattaggcttgacatgagtgaatttatggaaagacacacagtctccaaactcattggttcaccccctggatatgttggttacaccgagggtggtcaactgactgaggcagttcggcgtcgtccctatactgttgtgctatttgacgagattgagaaagcccatcctgatgtatttaacatgatgcttcagatcctggaagatggaagactaacagatagcaagggaagaactgtggacttcaagaacactcttctaataatgacatcaaatgttggaagcagtgtgattgagaaaggaggacgtaaaatgggatttgaccttagttatgatgagaaggatagcagttacaatcgaatcaagagcttggtgactgaggagctgaaacaatactttaggccagagttccttaatcggttagatgaaatgattgttttcaggcaactcaccaagctggaggtaaaggagatagcagacataatgttgaaggaggtgtttgaaagactaaaggtcaaagagattgatctctcagtgacagaaaaatttagggaaagggtggttgaggaaggatataatcctagttatggggctaggcctctaagaagggccatcatgcgacttttggaggacagtatggccgagaagatgcttgctagagagattaaagagggtgactcagttatagtagatgccgattctgatggtaatgtgattgtgctcaacggtactagtggtgtccaggagtcactatcagaatctcttcctgtgtaacgtggttgcctttactagagtacttttttttttctttaaaagaaaaacatatttagttttagttgtcattggacacatacttttaattgaatgctggtagttttagtagtctcaggcaagtttgctcataatccatcaacacagcaagatttgagtgtgaatgaaaagaaaggtctgttggtctactttagtgaccaatctttatttatcgaaatggaattttaaagttacatttatggtcttacagcttaacctaaaatagttgtatca

SEQ ID NO: 3186 - DNA, 3158 bp, Phaseolus vulgaris
atggatgtgaacaaaagtaatgtactttaacaggtgagataaacaagcttcgtgcgtgcaatcgagaaaccactgttatcttcgccgcccaccacgccttctctctatatcccttctttttcactgcaacaatataggaataatggctagggttttggctcagtctatcggtatgcctggcctactgagtgggcaaaggcatgggcagcataagggatcaggaaaatcaagaaggtctctcaaaatgatgagtagcttacaaatgcctgcattaagaatgtcaagtttctctggactgcgtactgtgaacaatttggatcttctttcgagatctcgacgaagtttaccttctaagatgttgacttcaacttcttctcgtcgtgaaagggctaaaagattcgtacccagagcgatgtttgagcgtttcactgagaaagcaatcaaagtaattatgctagcccaggaggaagctaggcggctgggacataattttgttggaacagaacagattttattaggtcttatcggtgaaggcactggcattgctgccaaggtgctgaagtcaatgggaattaacctgaaggatgctcgtgtggaagtggaaaagataattggaaggggcagtggatttgttgcagttgagattccatttactccccgtgcaaaacgtgttttggaactctcactagaggaagctcgccaacttggtcacaattatattggatctgagcacttgcttcttggtcttctacgagagggtgagggtgtagcagcacgtgttcttgaaaatttgggtgctgatccaaacaatattcggtctcaggttattcgcatggttggtgagggtgctgacagtgttggtgctactgttggtcctggaagtagtaataacaataagatgccaactttggaggagtatggcaccaatttgactaagctagctgaagagggaaaattggatcctgttgttggtagacaaccacaaattgaacgtgtcactcaaatcttgggtcgtcgtaccaaaaataatccttgtcttattggagaacctggggttgggaagacagctattgctgaagggcttgcccaaaggattgcaaatggtgatgttcctgaaaccatagaggggaagaaggttataacccttgatatgggtctactggtagctggaactaaatatcgtggagaatttgaggagagattgaagaaactgatggaggaaatcaaacaaagtgatgagataatactttttattgatgaagtacacactctaattggagctggagcagctgagggggcaattgatgctgcaaacatactaaagcctgctcttgccagaggtgaactgcagtgtattggagccacgaccctggatgaatataggaagcacattgaaaaggatccagcactggagaggcgattccagccagttaaagtgccagagccaactgtagatgaaaccatacaaatattgaaagggcttagggaacgctacgagattcatcacaaactccaatacacagatgatgcacttgtagctgctgcccagctgtcacaccagtatattagtgatcgatttttgcccgacaaagctatagatttaattgatgaagcaggttcccgtgttcggcttcaacatgcgcagttaccagaagaagcaagagagcttgataaggaggtcagacagattgtaaaggataaagaagaagctgttcgcaatcaagactttgaaaaggctggagggctacgagataaagaaatggatcttaaggcccaaatatccacacttatagaaaaaggcaaggagatgagcaaggcagaaatggaggcaggagatggatgtcccatggtgactgaagttgacatacagcatattgtctcctcctggacaggtattccggtagagaaagtctcaactgacgaatctgatcgcctactcaagatggaagagactttacacacacgagtcataggtcaggatgaagcagtaaaagcaattagccgggccatccgtcgagctagggtgggattgaagaatcctaatcgaccaattgccagcttcatcttttctgggccaactggtgtggggaagtctgaattggctaaagctttggctgcatactattttggttctgaagaagccatgattaggcttgacatgagtgaatttatggaaagacacacagtctccaaactcattggttcaccccctggatatgttggttacaccgagggtggtcaactgactgaggcagttcggcgtcgtccctatactgttgtgctatttgacgagattgagaaagcccatcctgatgtatttaacatgatgcttcagatcctggaagatggaagactaacagatagcaagggaagaactgtggacttcaagaacactcttctaataatgacatcaaatgttggaagcagtgtgattgagaaaggaggacgtaaaatgggatttgaccttagttatgatgagaaggatagcagttacaatcgaatcaagagcttggtgactgaggagctgaaacaatactttaggccagagttccttaatcggttagatgaaatgattgttttcaggcaactcaccaagctggaggtaaaggagatagcagacataatgttgaaggaggtgtttgaaagactaaaggtcaaagagattgatctctcagtgacagaaaaatttagggaaagggtggttgaggaaggatataatcctagttatggggctaggcctctaagaagggccatcatgcgacttttggaggacagtatggccgagaagatgcttgctagagagattaaagagggtgactcagttatagtagatgccgattctgatggtaatgtgattgtgctcaacggtactagtggtgtccaggagtcactatcagaatctcttcctgtgtaacgtggttgcctttactagagtactttttttttttctttaaaagaaaaacatatttagttttagttgtcattggacacatacttttaattgaatgctggtagttttagtagtctcaggcaagtttgctcataatccatcaacacagcaagatttgagtgtgaatgaaaagaaaggtctgttggtctactttagtgaccaatctttatttatcgaaatggaattttaaagttacatttatggtctt

SEQ ID NO: 3187 - DNA, 3189 bp, Arabidopsis thaliana
ccggagatagatagagagagagataagggagggtgaaaaaataagcacacaccattatccatctgtttttttttttcatctctctctctctcttttcttcttcgattcgtgttttctccatttcattctctgttacgcttcaatcgaactcggaagtcatggctatggccacaagggtgttggctcaatcgactccaccgtctttagcttgttaccagaggaatgttccttcacgtggatctggaagatcgagaagatcggtgaaaatgatgtgtagtcagttacaagtgtctggtttaagaatgcaagggtttatgggattacgtggtaacaatgctttagacactcttggaaaaagtcgtcaagattttcattcgaaggtgcgacaggcaatgaatgtgcccaaggggaaagctagccggtttacggtgaaagcaatgtttgaaagatttacggagaaagctatcaaagttattatgcttgctcaggaggaagctagaagactaggccacaattttgtgggaaccgaacaaattcttcttggtcttattggtgagggtactggaatcgctgctaaagttttgaaatccatggggattaacttaaaagatgcacgtgtggaggttgagaagattattggaaggggaagtggctttgttgctgttgagatcccattcactcctcgtgccaagcgtgttcttgaactctctcttgaggaagctcgccaacttggtcacaattacattggatccgagcaccttttgcttgggttgctacgtgaaggtgaaggagttgcagctcgagtccttgagaatttaggtgcagatcctagtaatattcgcactcaggtgatacgcatggtgggtgagaacaatgaagtaactgctaatgttgggggaggaagcagcagcaataagatgccaactcttgaagagtacggaacaaacttgacgaaactggctgaggagggtaaattggacccagttgttggaaggcagccgcagatagaacgtgtggtgcaaattcttggcaggagaaccaagaacaacccttgtcttattggagaacctggtgttggtaagacagctattgctgaaggacttgcacagcgtattgccagtggcgatgtccctgaaactattgaagggaagaaggttataacactcgacatgggtcttctagttgctggaacaaaatatcgtggagagtttgaagagagattgaaaaagcttatggaggaaattagacagagcgatgagataatcttatttatcgacgaagtgcatactttgattggggctggagcagcagaaggtgcaattgacgcagctaacattttaaaaccagctctcgctagaggtgaattgcagtgcattggagcgacaacattagatgaataccgaaagcacattgagaaagaccctgccttggaaagaagattccagccagtgaaagtacctgaacctaccgtggatgaaactattcagatccttaagggtctgcgagagcgatatgaaattcaccacaagcttcgttacacagacgaatctttagtagcagctgcacagttgtcataccagtatataagtgatcgtttccttcctgacaaggcaattgacttgattgatgaagctggttctcgggttcgacttcgtcatgcacaggtccctgaggaagctagggagcttgagaaggagcttaggcagataacaaaggagaagaatgaagctgtccgtggccaggactttgagaaggctgggacacttcgggatagagaaattgaactcagagctgaggtatctgcaatccaagcgaaaggcaaggagatgagcaaagcagagagtgagaccggtgaggaaggccctatggtcacggagtcagacatccaacacattgtgtcttcatggactggtattcctgttgagaaagtatcaaccgatgagtctgaccgtctcctcaagatggaagaaaccctccacaaacgtatcataggccaagacgaagctgtgaaagccataagccgagccattcgccgtgcacgtgttggactcaagaatcctaaccgtccaatcgctagtttcatattctcgggtccaaccggtgttgggaaatctgagcttgccaaagctttagcagcttactacttcggttccgaagaagccatgattcgtctagatatgagtgagttcatggagaggcacactgtctccaaactcatcggttcacctcctggatatgtcggatacaccgaaggaggtcagttaacagaagcggttagacgtcgcccttacaccgtcgttctattcgatgagattgaaaaagcccatccagatgttttcaacatgatgcttcaaatccttgaagatggtagattaacagacagcaaaggaagaacagttgacttcaaaaacacacttctcatcatgacatcaaacgtcggaagcagcgtgattgagaaaggaggaagacgtatcggattcgacttagactacgacgagaaagacagcagttacaacagaatcaagagccttgtaacagaggagctgaaacaatacttcagacccgagttcctaaacaggctagacgagatgattgtgttcagacagctaacaaagctggaagtgaaagaaattgctgacatactgttgaaggaagtgttcgagaggttgaagaagaaagagattgagcttcaggtgaccgaaagattcaaagagagagtagtagacgaaggttataacccgagctatggagcaagaccgttgagaagagccatcatgaggcttttagaggatagtatggcagagaagatgcttgcgagagagatcaaagaaggagactcggtgattgtggacgttgacgctgaaggtaacgtcacggtgctaaatggtggaagtggcactccaactacttccttggaggagcaggaagattctctccctgttgcttaaataaaaaaagcaaagtgcgtgcgtttctctcttcttttgctttggcccttaaatgaattatggcaagagaaggttatgaattgagatacatgggggctttcttaatatacattttctaaatatatgaaaaatgtaatgtatagatgacattgtgtagcttctttttcttccatgctttttaaggacttgtctttggtgcccatgcaaagaggagtttttatgttggggttcgacgtcaaaa

SEQ ID NO: 3188 - DNA, 3519 bp, Theobroma cacao
ttccatatcttacaacaaagagaaagcaagggcaatttcgtcttcacaataatataccacattgtatttgaaatatcttttacattgaccaccaacccatttttattttgaaataaagactggacatctatgattttctattttgatatactttcctgtaatctacccccacccaaaaaaaaagaaaaaaaatagaaagagagtaaaaaagagctggttgttataagccacatctatcctctgcattttccttctctcttcggccgaccatttgcactagataaaaaagggtctcttctctctgcaacttctaaaagaaaagaccccttttcagttttactctctatttctattttatctttttcagcttttttttttcttttcttcctgcaccgcttctttcctttttgagattgcttaataggagtgatggctaaggttctggctcagtcaactattgttcctgctctagttactagtcgaagtcatggtccatccaaagaatcttcaaaatcaaaagggtctgccaaaatgatgtgcagtttacaaacacctggattgaggataagaagtttctctgggttgcgtggctcaaattctttagataatatggtcagatttggccaagatttccgttctaaggttgcaatttcaatctcttcccgacgaggaaggggtagcagatgtgtacctaaagccatgtttgagcgcttcacagaaaaagcaattaaagtaattatgcttgcccaagaggaagccagacggcttggccataattttgttggtacagagcaaattttattgggccttattggtgaaggtactggcattgctgcgaaagttcttaaatccatgggaatcaatcttaaggatgcacgtgtagaggtggagaagataattggaaggggcagtgggtttgttgctgtggagattccatttactcctcgtgcaaaacgtgttttggaactctcattggaagaagcgcgccaacttggccataattatattggatcagagcatcttcttcttgggctgcttcgtgaaggtgaaggtgtagcagcccgtgttctggagaatttaggtgctgacccaagcaatatccgcacacaggcaagaaatgcattaaccaacttgatcttgtttcaaatttctgttagcgttgttcctggaggatcaactggcaacacaaagatgccaacacttgaggaatatggaaccaatttgactaagctcgccgaggagggtaaattggatcctgttgttgggaggcaggttcaaatagaacgtgttgtccaaatattgggtagacggaccaaaaataacccatgtcttataggagaacctggtgttggaaaaacagcaattgctgaaggccttgctcagcgtattgctagtggtgatgttcctgatacaattgagggaaagaaggttataacgcttgatatgggtcttcttgttgctggaacaaaatatcgtggagagtttgaagagagattgaagaagctaatggaggaaatcaagcaaagtgatgagataatattgtttattgatgaggtgcacaccttaattggagcaggagctgcagaaggggctattgatgctgccaatatcttgaagccagctcttgcaagaggtgaattgcagtgtattggagctacaacactcgatgaatacagaaagcatattgagaaagacccagctttggaaagacgtttccagccggtcaaagtgcctgaaccatctgtagatgaaactatacagattttgaaaggtttgcgagaacgttacgagattcaccacaagcttcgctacacagatgatgccttaatttctgctgcacagctgtcataccagtacatcagtgaccgttttctgcctgataaagcaattgacttgattgatgaagctggttctcgtgttcgccttcgtcatgcacagctccctgaggaagctagagagcttgaaaaggagctcaggcagatcacaaagtcaaagaatgaagctgttcgcagccaggactttgagaaggctggggaattacgtgaccgagaaatcgagctcagggctcagatcactgccatccaagagaaagacaaggagatgaataaggcagaggcagaggcaggggaaggaggtccagttgtgaccgaagtggacattcagcatatagtctctgcctggactggtattcctgttgagaaagtatcaaccgatgagtctgatcgcctccttaagatggaagagactcttcataagcgagtcattggtcaggatgaagctgtcaaagccattagtcgtgcaattcgacgtgcccgtgtcggtctcaagaatcccaaccggccaattgctagcttcatcttttctggaccaactggtgtaggaaagtcagaactagcaaaggcactagctgcttactattttggttctgaagaagccatgatccggcttgatatgagtgagttcatggaacggcatacggtgtccaagctcattggttcacctcctggttatgttggttacactgagggtggtcagctgactgaggctgttagaagacgaccatacactgtagtactttttgatgagattgagaaggcacatcctgatgtcttcaacatgatgcttcagatacttgaggatggaaggttgacagacagtaaaggaagaactgtggatttcaagaatacccttctgataatgacatcaaatgttggaagcagtgtaattgagaagggtggacgacggataggatttgatcttgattatgatgagaaggacagcagttacaatagaataaagagcctggtgacagaagaactgaagcaatatttcaggccagagttcttgaatagattggatgagatgattgttttcaggcagctcaccaagttggaggtcaaggagattgcagatataatgcttaaggaggtgtttgacaggctcaaagccaaagagatagagcttcaagtgactgaaaggtttagagagagggtggtggaggaaggatacaacccaagttatggagcaaggcctttgagaagagccattatgagacttcttgaggacagcatggccgagaagatgcttgctagggaaatcaaggagggtgattcagtaattgtggatgttgactctgatggaaatgttaccgttctgaatggtagcagtggtgctcctgagtcattggctgatccaattccagttgtgtaaccaaataggtttttgggatatgttgtttgtaacttttctttttcattgaactggctatactagttgtagtctgttttcttgaaaggactacttggcagtagaattggaagtcattgattgcttgcctgtggacattgaagctgtatttctgacactgaatcacatgcatatttgtaagaggcgcatagaagatgctgctggtagtattaggttggcagtttacttaacaataaaatttaattagattggaatacgttcaaaatgttactgcttattattgaacctgaatcgagactgtgaggttgttct

SEQ ID NO: 3189 - DNA, 2993 bp, Avena sativa
ccccaaccaaacgactcccccctcctttcttatctcctcgggaggagaaacaaagaaggacgcgctcttccttctttctccccctctcctcgcaggtttgggcagctacttctgaccatggcagggaccttagtcttgccggttgctcttggtgcaactttcgaaggccgtgcaaggaagtctcatggaaccaggaggcctacctcaatgctggcaatgtcgttgaaccgtcctgtaaggatggcagcatttagtggtccgagatcagtacatagcttcacaacaatgccctcgtccagcttcagattgacagcggcatcttacagatcctcgagacgcggaagacgttgtcgttttgtaaccagagcaatgttcgagagatttactgagaaagctataaaggtcatcatgcttgcacaagaggaagcaaggcgcctaggccacaactttgtcggaaccgagcaagttctattgggtttggtcggagaaggcactggtattgccgcaaaggtgctcaagtccatgggtatcaatcttaaggatgctcgcgtggaagtggaaaagatcattgggaggggaaatggttttgttgcggtcgaaataccattcacaccacgcgcaaaacgtgttttagagctttcattggaggaagctcgccaactaggacacaattatattgggtctgagcacttgcttcttggactgcttcgtgagggtgaaggcgtggcagcccgtgtacttgagtctcttggtgctgacccaagcaatattcgtacacaggttgtccgaatgattggcgagacaacagaagctgttggtgctggagttggtggagggagcagtggtaataagatgccaacacttgaggagtatggaactaatttaacaaaattagcagaggagggaaagctagatcctgttgttggaagagaaccacagattgaacgtgtcatacaaattttgggcagacgaacaaagaacaatccctgcttaattggagaacctggtgttgggaagacagcaattgcagaagggcttgctcaacgcattaatagtggcgatgtgcctgagacaatagaggggaagaaggtcattacacttgatatggggcttcttgttgctggtacaaaataccgtggagagtttgaagaaaggttgaagaaactgatggaagaaatcaagcagagcgatgagataattctcttcatcgatgaagttcacaccctcataggagcaggagctgctgaaggcgctatagatgctgctaatatcttaaagccagcattagcaagaggagaactacagtgtattggagctaccacacttgatgaataccggaagcatgttgagaaagacccagcattagaaaggcgttttcagccagtaaaagtaccagagccatcagttgatgaaaccatagaaattctcagagggcttcgggaaagatatgagatccatcataaactcagttacactgatgattcattgattgcagctgctaagctttcttatcaatatatcagtgatcgtttccttcccgataaagcaattgatttgatcgatgaagcaggttcacgtgtaaggcttcgacatgcccaggttcctgaggaagccagagagctcgacaaggagcttaagcaaataacaaaggataaaaatgaggccgtccgtggccaggattttgaaaaggctggggaattgcgagatcgtgaaatggaattgaagacccagattacagccttgattgacaagagcaaggagatgatcaaagcagagactgcgtccggagagactgggccgatggtccatgaatcagatatccagcacattgtatcatcatggactggtatcccagtggagaaagtctcaactgacgaatctgataaacttcttaagatggaagagacattgcataagcgtgtcattggccaagatgaggctgtgaaagcaataagtcgttccgtccgccgtgctcgtgtcggcctcaagaaccccaacagaccaattgcgagcttcatttttgcaggtccaactggtgttgggaaatcagagcttgcaaagactcttgcatcgtattactttggctccgaagaagccatgatccgactggatatgagtgagttcatggagaggcacacagtgtctaagttgattggttcaccaccaggctatgtgggatacactgagggtggccaattgacggaggcggttcgtcgccggccttacagcgttgtgctttttgatgagattgagaaagcacatccggatgtgttcaacatgatgctccagatcctggaagatggaaggttaactgacagcaaggggagaacagtggacttcaagaacacgcttctcataatgacatcaaacgttggaagcagcgtcatcgagaagggagggcgtaagatcggtttcgaccttgagtctgacgagaaggacagcagctacggcaggatcaagagtttggtcatcgaggagatgaagcagtacttccgccctgaatttctcaaccgtcttgacgagatgatcgtcttcaggcagctgaccaagctggaagtcaaagagatcgcggacatcatgctacaggaggtcttcaccaggctgaagttgaaggagatcaatctgcaggtcaccgagaagttcaaggagagggttgttgacgaagggtacaatcctagctatggagcacgtccactaaggagggcgatcatgaggctgctggaggacagcctcgcggagaagatcctggccggggaggtcaaggagggtgattctgccattgttgacgtggactctgaggggaaggtcgttgtgcttaacggccagagcggactgcctgatcttccaactccggccgtcagtgtatagttagttccatacatcttgtaaaaagtacagtttttcatttcattcgagcacatatctctttgtagtatgaaagaagtttatataacccccataactttcagaaaaggtacaaagaaccccctcaa

SEQ ID NO: 3190 - DNA, 3162 bp, Eutrema halophilum
agaccggagagagataagggagggtgaaaaattaaagcacaccatatccatctattttgttcatttctctctccttcttcatcatcttcttcgtctttcttcatttgatcctgtgttacgctacaatcgatttcggaagtcatggctatggccacaagggtgctggctcaatcgactccaccgtctttggcctgttaccagaggaatgtcccctctcgtggatctgggagaacgagaagaccggtgaagatgatgtgtagtcagctacaagtgtccggcttaagaatgcaagggtttttgggattacgtgggaacaatgtcttagacactctaggaagaagccgtcaagatttccattcgagggttcggcaggcaatgaatgtgccaaaggggaaagctagccggtgtgtgacgaaagcaatgtttgagaggtttactgagaaagctatcaaagttattatgcttgcacaggaggaagcaagaaggctagggcacaatttcgtgggaaccgagcagatccttctaggtctcattggtgaaggtactggtattgctgctaaagttttgaaatccatggggattaacctaaaggatgcacgcgtggaggtagagaagatcattggaaggggcagtggatttgttgctgttgagatcccattcactcctcgtgccaagcgtgttcttgaactctcgctcgaagaagctcgccaactcggtcacaattacattggatccgagcaccttcttcttgggttgctacgtgaaggtgaaggtgttgcagctagagtccttgagaatttaggtgctgatcctagtaatatccgcactcaggtgatacgcatggtgggcgagaacaatgaggtcactgctaatgttggtggaggaagcagtagcaacaagatgccaactcttgaagagtacgggacaaacttgacgaaactagctgaggagggtaaattggaccccgttgttggaaggcagccgcaaatagaacgtgtggtgcaaattcttggtaggagaaccaagaacaacccatgtcttattggagaacctggtgttggtaagacagctattgctgaaggacttgcccagcgtattgccagtggagatgttcctgaaaccattgaagggaagaaggttattacccttgacatgggtcttcttgttgctggaacaaaatatcgtggagagtttgaagagagattgaaaaagcttatggaggaaataagacagagcgatgagatcatcttgtttatcgatgaagtgcatactttgattggggctggagcagcggaaggtgcaattgatgcagctaacattttaaaaccagctctcgctagaggtgaattgcagtgcattggagctacaactttagacgagtaccgaaagcacattgagaaagacccggcattggaaagaagattccagccagtgaaagtacctgaacctaccgtggatgaaactattcagatattgaagggtctgcgtgagcgatacgaaattcatcacaagcttcgttacactgacgattctttagtagcagctgcacagttgtcataccagtacattagtgatcgtttccttcctgacaaggcaattgacttgatcgatgaagctggttctcgggttcgccttcgtcatgcacaggtcccagaggaagctagggagcttgagaaggagcttaggcagataacaaaggagaagaacgaagctgtccgtggccaggactttgagaaggctgggacacttcgggatagagaaattgaactcagagctgaggtatctgctatccaagcgaaaggcaaggaaatgagcaaagcagagagtgagactggtgaggaaggtcctatggtcactgagtcagacatccaacacattgtgtcttcatggactggtatccctgtagagaaagtatcaaccgatgagtctgatcgcctcctcaagatggaagaaaccctccacaaacgtatcataggccaagacgaagctgtcgtagccataagccgagctatccgccgtgcacgtgttggactcaagaaccctaaccgtccaatcgctagtttcattttctctggtccgaccggtgttgggaaatccgagcttgccaaagctttggcagcttattacttcggatctgaagaagccatgatccgtcttgatatgagtgagttcatggagaggcacaccgtctcgaaactcatcggttcacctcctggttacgttggatacaccgaaggaggtcagctaaccgaagcagttagacgtcgtccttacacagtcgttctattcgacgagatcgaaaaagcccacccagacgttttcaacatgatgcttcagatcctcgaagatggtagattaacagacagcaaaggaagaactgttgatttcaagaacacgcttctcatcatgacatcgaacgtaggaagcagcgtgatcgagaaaggaggaagacgtatcggtttcgacttggactacgacgagaaagacagcagctacaacagaatcaagagcctcgtaaccgaggagctgaaacagtacttcagaccggagttcctgaacaggctagacgagatgattgtgttcagacaactaacgaagccggaagtgaaagagatcgcggacatactgttgaaagaagtgtttgagaggctgaagaagaaagagattgagcttcaagtgactgagaggttcaaagagagagtggtcgacgaaggttacaacccgagctacggagccagaccgttgagaagagccatcatgaggcttttggaagatagtatggcagagaagatgctcgcgagagagatcaaagaaggagactcggtgattgtggacgttgactctgaaggtaaagtcactgtgttgaatggtggaagtggcactcccactacttcgttggaggagcaggaagattctctccctattgtttgaagaaaataaaaaggggaaagtctcactgtgttctctcttcttttgcttttgcccccttaaacgaattatctggcaagagaagggtctctcgatgagacatttgggggttttcgtaatatacattttctaaatatatgaagaaaaaatgtaatgtatagatgacattctgtagcttctttttcaatgctttttaaggacttactttggtgccaaaaagggtttttcttttgg

SEQ ID NO: 3191 - DNA, 3025 bp, Eutrema halophilum
cttcatattgtaggaagtcatggctatggccacaagggtgctggctcaatcgactccaccgtctttggcctgttaccagaggaatgtcccctctcgtggatctgggagaacgagaagaccggtgaagatgatgtgtagtcagctacaagtgtccggcttaagaatgcaagggtttttgggattacgtgggaacaatgtcttagacactctaggaagaagccgtcaagatttccattcgagggttcggcaggcaatgaatgtgccaaaggggaaagctagccggtgtgtgacgaaagcaatgtttgagaggtttactgagaaagctatcaaagttattatgcttgcacaggaggaagcaagaaggctagggcacaatttcgtgggaaccgagcagatccttctaggtctcattggtgaaggtactggtattgctgctaaagttttgaaatccatggggattaacctaaaggatgcacgcgtggaggtagagaagatcattggaaggggcagtggatttgttgctgttgagatcccattcactcctcgtgccaagcgtgttcttgaactctcgctcgaagaagctcgccaactcggtcacaattacattggatccgagcaccttcttcttgggttgctacgtgaaggtgaaggtgttgcagctagagtccttgagaatttaggtgctgatcctagtaatatccgcactcaggtgatacgcatggtgggcgagaacaatgaggtcactgctaatgttggtggaggaagcagtagcaacaagatgccaactcttgaagagtacgggacaaacttgacgaaactagctgaggagggtaaattggaccccgttgttggaaggcagccgcaaatagaacgtgtggtgcaaattcttggtaggagaaccaagaacaacccatgtcttattggagaacctggtgttggtaagacagctattgctgaaggacttgcccagcgtattgccagtggagatgttcctgaaaccattgaagggaagaaggttattacccttgacatgggtcttcttgttgctggaacaaaatatcgtggagagtttgaagagagattgaaaaagcttatggaggaaataagacagagcgatgagatcatcttgtttatcgatgaagtgcatactttgattggggctggagcagcggaaggtgcaattgatgcagctaacattttaaaaccagctctcgctagaggtgaattgcagtgcattggagctacaactttagacgagtaccgaaagcacattgagaaagacccggcattggaaagaagattccagccagtgaaagtacctgaacctaccgtggatgaaactattcagatattgaagggtctgcgtgagcgatacgaaattcatcacaagcttcgttacactgacgattctttagtagcagctgcacagttgtcataccagtacattagtgatcgtttccttcctgacaaggcaattgacttgatcgatgaagctggttctcgggttcgccttcgtcatgcacaggtcccagaggaagctagggagcttgagaaggagcttaggcagataacaaaggagaagaacgaagctgtccgtggccaggactttgagaaggctgggacacttcgggatagagaaattgaactcagagctgaggtatctgctatccaagcgaaaggcaaggaaatgagcaaagcagagagtgagactggtgaggaaggtcctatggtcactgagtcagacatccaacacattgtgtcttcatggactggtatccctgtagagaaagtatcaaccgatgagtctgatcgcctcctcaagatggaagaaaccctccacaaacgtatcataggccaagacgaagctgtcgtagccataagccgagctatccgccgtgcacgtgttggactcaagaaccctaaccgtccaatcgctagtttcattttctctggtccgaccggtgttgggaaatccgagcttgccaaagctttggcagcttattacttcggatctgaagaagccatgatccgtcttgatatgagtgagttcatggagaggcacaccgtctcgaaactcatcggttcacctcctggttacgttggatacaccgaaggaggtcagctaaccgaagcagttagacgtcgtccttacacagtcgttctattcgacgagatcgaaaaagcccacccagacgttttcaacatgatgcttcagatcctcgaagatggtagattaacagacagcaaaggaagaactgttgatttcaagaacacgcttctcatcatgacatcgaacgtaggaagcagcgtgatcgagaaaggaggaagacgtatcggtttcgacttggactacgacgagaaagacagcagctacaacagaatcaagagcctcgtaaccgaggagctgaaacagtacttcagaccggagttcctgaacaggctagacgagatgattgtgttcagacaactaacgaagccggaagtgaaagagatcgcggacatactgttgaaagaagtgtttgagaggctgaagaagaaagagattgagcttcaagtgactgagaggttcaaagagagagtggtcgacgaaggttacaacccgagctacggagccagaccgttgagaagagccatcatgaggcttttggaagatagtatggcagagaagatgctcgcgagagagatcaaagaaggagactcggtgattgtggacgttgactctgaaggtaaagtcactgtgttgaatggtggaagtggcactcccactacttcgttggaggagcaggaagattctctccctattgtttgaagaaaataaaaaggggaaagtctcactgtgttctctcttcttttgcttttgcccccttaaacgaattatctggcaagagaagggtctctcgatgagacatttgggggttttcgtaatatacattttctaaatatatgaagaaaaaatgtaatgtatagatgacattctgtagcttctttttcaatgctttttaaggacttactttggtgccaaaaa

SEQ ID NO: 3192 - DNA, 3228 bp, Triticum aestivum
agcatgaggccaaaacaaagaaaggaaagagcaattctcttctctggttgcttgttgggcacccccaaccaagcgactcttctcttctcccttcttatctccttctccttggaggagaaacaaacagggccgcgctcctttctctccctctctcggtctctcatcgcaggtttgggacaacttacttttgaccatggcagggaccttagtcctgccggttgctcttgagacaacttttgcaggccgtacaggcggtcggcactgcaagtctcatggaaccaggaggactccctcaatgttggcaatgtcattgaaccgtcctgtaaggatggcagcatttgtcggtctgagatcggtacatagcttctcagccatgcgctcgtccaacttcaggtcaacagttgcatcttacagattctctagacggggaaggcgtgcttcttttgtaaccagagcaatgttcgagaggtttactgagaaagctataaaggtcataatgcttgcgcaagaggaagcgaggcgcctgggccacaactttgtcggaaccgagcaagttctattgggtctggttggagaaggcactggtattgcggcaaaggtgcttaagtccatgggtataaatctgaaggatgcccgtgtggaagtggagaagatcattgggaggggcaatggttttgttgctgtcgaaataccattcacaccacgtgcaaaacgtgttttagagctttcattggaggaagctcgccagctaggacacaactatattgggtccgagcacttgcttcttggattgcttcgtgagggggaaggggtggcagctcgcgtacttgagtctcttggtgctgaccccagcaatattcgtacccaggttgtccggatgattggtgagacaacagaagctgttggtgctggagttgggggagggagcagtggtaacaagatgccgacacttgaggagtatgggactaatttaacaaaattagccgaggagggaaagctagatcctgttgttgggagggaaccacagattgaacgtgtcgtacaaattttgggcagaagaaccaagaacaatccctgcttaattggagaacctggtgttgggaaaacagctattgcagaagggcttgctcaacgcatttctagtggcgatgtgcctgagacgatagaggggaagaaggtcattacccttgatatgggacttcttgttgctggtacgaaataccgtggagaatttgaagaacggttgaagaaactgatggaagaaatcaaacagagcgatgagataattctcttcatcgatgaagttcacaccctcataggagcaggagccgccgaaggtgctattgatgctgctaatattttaaagccagcattagcaagaggagaactacagtgtattggagccaccacgcttgatgaatacaggaagcatgttgagaaagatccagcattagaaagacgtttccagccagtaaaggtaccggaaccatcagttgatgagaccatagaaattctcagagggctccgggagcgatatgagatccatcataaacttcgttacactgatgattctttgattgcagctgctaagctatcttatcaatatatcagtgatcgtttcctcccagataaagcaattgatttgattgatgaagcaggttcacgtgttaggcttcgacatgcccaggttcctgaggaagccagagagcttgacaaggagcttaagcaaataacgaaagataaaaatgaagctgtccgtggccaggattttgagaaggctggagagttgcgagatcgtgaaatggaattgaaggcccagataacagccctgattgacaagagcaaggagatgaacaaagcagagactgagtcgggagagacggggccgatggtgcatgaatcagatatccagcacattgtgtcatcatggactggtattccagtggagaaagtctcgactgacgaatctgataaacttcttaagatggaagagacattgcataagcgtgtcatcggccaagatgaggctgtgaaagcaataagccggtccgttcgccgtgctcgtgtgggcctcaagagccccaacagaccaattgcgagcttcatttttgcaggtcccactggtgttgggaaatcagagcttgcaaagactctggcatcatattacttcggctctgaagaagccatgatccggctggatatgagtgagttcatggagaggcacactgtgtccaagttgatcggttcaccaccaggctatgtgggatacactgaaggtgggcagctgacggaggcggttcgacggcggccatacagcgttgtgctttttgatgagattgagaaggcgcatccggatgtgttcaacatgatgctccagatcctggaagacggaaggttaaccgacagcaaggggagaacggtggacttcaagaacacgctcctgataatgacatcaaatgttgggagcagcgtgattgagaagggggggaggaagatcgggttcgacctcgactccgacgagaaggacagcagctatggcaggatcaagagcttggtgatcgaggagatgaagcagtacttccgaccggagtttctcaaccgtctggacgagatgatcgtcttcagacagctgaccaagctggaagtcaaagagatcgcggacataatgctgcaggaggttttcaccaggctcaagaccaaggacatcaacctgcaggtgacggagaagttcaaggagcgggtcgtggacgaagggtacaaccctagctacggagcgcggccgctgaggagggccatcatgaggctcctggaggacagcctcgcggagaagattttgggcggggaggtcaaagagggcgactctgtcatcgttgatgtggacccggaggggaaagtcattgtgctgaatggcgagagcggactgccggagcttccaaccccggcggtcgctgtatagttgttggtactgtatagaatacgtagaagattgttaagcatatatacaatacagcgttttcatttccttccagcacatatctcttcataggtgcagcagtcaggtcaggtgtatataattctataactgtatgtataaaatacacagtaatatgcatatataatttaaggggaaaggaaacattgctggctttggctcttgattgatccactcaagtgcattgctcctgagcagttcagacaacctgctcgagtttttttttttcatttttg

SEQ ID NO: 3193 - DNA, 2800 bp, Chelidonium majus
caacaaacttccgagcttctgttttagacaaaactaatgggcaacctcaaagatctggacagtcaaacagaaggacgatcataatgctatctaatgtacagtttcggggactgagaacccgagcgccatgcttggcaatacggagttttagtggacttagaggatctaatgctttggataaatcggtattttctggccttgattttcatgcaaaggtggcaacctctctcgctatgcctcgtggaaggggtagccgatgtgttgctaaagctatgttcgagcgtttcacagagaaggccattaaagttatcatgcttgcacaagaggaagcaagacggttggggcataattttgtcggtaccgaacaaatattgttgggtttcattggcgaaggcactggtattgctgcaaaggttctcaaatctatgggaatcaatttaaaggatgctcgtgtggaagtggaaaagataattggtagaggaagtgggtttgttgctgtggagataccatttactcctcgtgcaaagcgtgttttggagctttcactggaagaagcccgccaacttggtcataattatattggatctgagcatttgttgcttggattacttcgtgagggtgaaggtgtagcagcccgtgtgcttgaaaacttaggtgccgatccaaataatattcgtacccaggttatccggatggttggtgagagtactgaggcgggtgccgttgttggaggcagcagcactaacaataagatgcctacgcttgaggagtacggaaccaatctcacaaagctagctgaggagggtaaactagatcctgtagttggaaggcagtcacaaatagaacgtgtaacccaaattttgggtaggcgtacaaagaacaacccttgcttgattggagaacctggcgttgggaaaacagcaattgcagaagggcttgctcaacgaattgcaactggtgatgtaccagaaacaattgaaggaaagaaggtaattacgctggatatgggtcttcttgtagctggtacaaaatatcgtggggagttcgaagaaaggttaaagaagctaatggaagaaattaagcaaagtgatgatataattctcttcatagatgaggtgcacactttaataggagctggtgcagctgagggtgcaattgatgcagctaacatattgaaacctgctcttgcaagaggcgaactccagtgtatcggtgctacaacactagatgaatacaggaagcatattgagaaggatccagctttggaaagacgtttccagccagtaaaagtccctgaacccactgttgatgagtccatacagatcttgaaagggcttcgagagcgatatgaaattcaccacaagctccgttacacagatgaggccttagttgctgctgcgcagttatcctaccagtatataagtgatcggttcctccctgataaagcaattgacttgattgatgaggcgggctccagggttcgccttcgtaatgcacagctccctgaggaagccagagagcttgagaaagagctcaggcaaataacaaaggagaaaaatgaagcagttcgcggccaagactttgaaaaggctggggagttgagagacagagaaatggacctgagggcccagatcacaaatcttgttgacaagggtaaagaattaagcaaggcggagagtgaagcaggtgattctggtcccgttgtaaccgaagttgatatccagcatatagttgcgtcatggactggaatcccagttgacaaagtttcaagtgacgaatctgatcgcctcctcaaaatggaagacactctccacacaagggttattggtcaagatgaagctgttagagctataagtcgtgcaatccgccgtgcacgtgttggacttaaaaccctaaccgtccaattgccagcttcatattctccggtcctactggtgtaggaaagtcagaattggcaaagacactggcttcttactattttggatctgaggaagctatgatccgtcttgatatgagtgagttcatggagaggcatactgtctccaaacttattggatcaccaccaggttatgttgggtacaccgagggtggtcaattgactgaagctgttcgccgtcgaccctacacagtagtcctctttgatgagatagagaaggctcatccagatgtcttcaacatgatgcttcagattctggaagatgggcggttgacggatagcaagggccggacagtggattttaagaacacactcctcataatgacatccaacgtgggaagtaatgtgatcgagaagggaggtaggagaattgggtttgacctagactatgatgagaaggatagtagctacaaccggatcaagagtctcgtgcaagaagaactgaaacagtatttcagacccgaattcttgaataggttagatgagatgattgtgttcaggcagctgacaaagctggaggtgaaggagattgctgatataatgctcaaggaagtgtttgtgaggctacaggacaaggaaattgatcttcaggtgacggagaggtttaaagatagggtggttgacgaaggatacaacccaagctatggagcaaggccactgagaagggcaattatgagacttttagaagatagcatggcagagaagatgcttgctggggagatcaaagagggagattcagtcatcgtggatgtcgatggtgatgggaatgtaacagttctgaatggtagtagcagcggtgaccccactattgatgtgccacaactggtgtaaacaccactcactgccaccagtacgatgtattat

SEQ ID NO: 3194 - DNA, 3173 bp, Brassica rapa
cgaagagagagagagataagatagggtgaagagtaaagcacatccatctgttttttttttcatttctctctctctctatctctctctcttcttcatcttatcgtcttcgtcgacctttgatcctgcgttcggtttaggaagtcatggctatggccacaagggtgatgtctcaatatactccactgtctttagcctgttcacagaggaatgctccctctcgtggatctggcacctcaaaaagatcggtgaaaatgatgtgcactcagctacaagtgtctggctcaagaatgcaaggctttctgggattgcgtgggaacaatgtcttagacactctagggagatcccgtcagagtttcggtggtaaggtgcggcaggcaatgaatgtgcccaaggggaaaggtagccggggtgtggtcaaagccatgtttgagaggtttactgagaaagctatcaaggttattatgcttgctcaggaggaagctaggaggctaggccacaattttgtgggaaccgaacagattcttctgggtcttattggtgagggtactggaattgctgctaaggttttgaagtccatggggattaacctaaaggatgcacgtgtggaggttgagaagattattggaaggggcagtgggtttgttgctgttgagatcccgtttactcctcgtgctaagcgtgttcttgaactctcactggaagaagctcgccaactcggtcacaattacatcggttccgagcaccttcttcttgggttgcttcgtgaaggtgaaggtgttgctgcccgagtccttgagaatttaggagcagatcctagtaatattcgcactcaggtgatacgcatggtgggtgagaacaatgaggtcactgctaatgttggtggaggaagcggcagcaataagatgccaactcttgaagagtacgggacaaacttgacaaaactggctgaggagggtaaattggacccagttgttggtaggcagccgcaaatagaacgtgtcgtgcagattcttggcaggaggaccaagaacaacccatgtcttattggagaacctggtgttggtaagacagctattgccgaaggactagcgcagcgtattgccagtggagatgttcctgaaactattgaagggaagaaggttataacacttgacatgggtcttctggttgctggaacgaaatatcgtggagagtttgaagagagattgaaaaagcttatggaggaaattaaacagagcgacgagatcatcttgtttatcgatgaagtgcacactttgattggagcaggagcagcagaaggtgcaattgacgcagctaacattttaaaacccgctctcgctagaggtgaattgcagtgcattggagcgacaacattagacgaatacaggaagcacattgagaaagaccctgcattggaaagaagattccagccagtgaaagtacctgagcctactgtggatgaaacgattcagatcctaaagggtctgcgagagcgatatgaaattcatcataagcttcgttacactgacgagtctttagtagcagctgcacagttgtcataccagtatatcagtgatcgtttcctacctgacaaggcaattgacttgatcgatgaagctggttctcgggttcgacttcgtcatgcacaggtccctgaggaggctagggaacttgagaaggagcttaggcagataacaaaggagaagaatgaagctgtccgtggccaggactttgagaaggctgggactctacgggatagagaaattgaactcagagctgaggtatctgctatccaagcgaaaggcaaggaaatgagcaaagcagagagtgagactggtgaggaaggtcctatggtgacagagtcagacatccagcacattgtgtcttcatggactggtatccctgtagagaaggtatcaaccgatgagtctgatcgcctcctcaagatggaagaaacccttcacaaacgtgtcataggccaagatgaagctgtcaaagccataagccgagccattcgccgtgcacgtgttggactcaagaaccctaaccgtccaatagccagtttcatattctctggtcctaccggtgtcgggaaatcagagcttgccaaagctttggcagcttactactttggatctgaagaagccatgattcgtctagatatgagtgagttcatggaaaggcacacagtctcgaaactcataggttcgcctcctggatacgtcggttacactgaaggaggtcagctaacggaagcagtcagacgccgcccttacacagtcgttctattcgacgagatagagaaagcccacccagatgttttcaacatgatgcttcagatcctcgaagatggtagactaacagacagcaaaggaagaacagtggacttcaaaaacacgcttctcatcatgacatcaaacgtcggaagcagtgtgattgagaaaggaggaagacgtattggtttcgacttggactacgacgaaaaagacagcagctacaacagaatcaagagccttgtgaccgaggagctgaaacagtacttcagaccggagttcctcaacaggcttgacgagatgattgtgttcagacagctaacgaagctggaagtgaaagaaatcgcagacattctgttgcaggaagtgttcgagaggctgaagaagaaggagattgagcttcaggtgaccgagaggttcagagagagagtagtggacgaaggttataacccgagctatggagcgagaccgttgaggagagccatcatgagacttttggaggatagcatggcggagaagatgctagcgagagagatcaaggaaggagactcagtgattgtggacgttgactctgaaggcaaagtgacagtgctaaatggtggaagtggcactccaacaacatccttggaggagcaggaagattctctccccgttgcttgaaataaaaggggaagtgtgtttgtttcttctctcttcttttgctttcccccttgaacgaattaatggcaagagagatacttgtgggggtttcgtaatatacattctctatatatgtaaccaatgtaatgtatagatgacattgtgtagcttctatttctcaatgctttaaggacttgctttggtaccaatgtttgtgtcaatgggtttagaattaaggtgtattggtttctgtgtgccaag
